United States Patent 11,464,842 (COMPOSITIONS AND METHOD FOR OPTIMIZED PEPTIDE VACCINES USING RESIDUE OPTIMIZATION) - sequence listing, part 9

SEQ ID NO: 139860 - protein, 9 aa, Artificial Sequence
  Description of Artificial Sequence: Synthetic peptide
  Seed: SFVYVWKTW (PMEL_HUMAN)
SYVYVWKTM

SEQ ID NO: 139861 - protein, 10 aa, Artificial Sequence
  Description of Artificial Sequence: Synthetic peptide
  Seed: EVISTAPVQM (PMEL_HUMAN)
EAISTAPVQK

SEQ ID NO: 139862 - protein, 9 aa, Artificial Sequence
  Description of Artificial Sequence: Synthetic peptide
  Seed: TEWVETTAR (PMEL_HUMAN)
TEWVETTAI

SEQ ID NO: 139863 - protein, 9 aa, Artificial Sequence
  Description of Artificial Sequence: Synthetic peptide
  Seed: YVWKTWGQY (PMEL_HUMAN)
YAWKTWGQK

SEQ ID NO: 139864 - protein, 9 aa, Artificial Sequence
  Description of Artificial Sequence: Synthetic peptide
  Seed: RLMKQDFSV (PMEL_HUMAN)
RVMKQDFSW

SEQ ID NO: 139865 - protein, 10 aa, Artificial Sequence
  Description of Artificial Sequence: Synthetic peptide
  Seed: VLMAVVLASL (PMEL_HUMAN)
VGMAVVLASV

SEQ ID NO: 139866 - protein, 10 aa, Artificial Sequence
  Description of Artificial Sequence: Synthetic peptide
  Seed: RALDGGNKHF (PMEL_HUMAN)
RVLDGGNKHW

SEQ ID NO: 139867 - protein, 9 aa, Artificial Sequence
  Description of Artificial Sequence: Synthetic peptide
  Seed: YVWKTWGQY (PMEL_HUMAN)
YVWKTWGQR

SEQ ID NO: 139868 - protein, 9 aa, Artificial Sequence
  Description of Artificial Sequence: Synthetic peptide
  Seed: AQRLCQPVL (PMEL_HUMAN)
AMRLCQPVM

SEQ ID NO: 139869 - protein, 10 aa, Artificial Sequence
  Description of Artificial Sequence: Synthetic peptide
  Seed: SQKRSFVYVW (PMEL_HUMAN)
SYKRSFVYVY

SEQ ID NO: 139870 - protein, 10 aa, Artificial Sequence
  Description of Artificial Sequence: Synthetic peptide
  Seed: VVLASLIYRR (PMEL_HUMAN)
VMLASLIYRE

SEQ ID NO: 139871 - protein, 9 aa, Artificial Sequence
  Description of Artificial Sequence: Synthetic peptide
  Seed: QLVLHQILK (PMEL_HUMAN)
QMVLHQILK

SEQ ID NO: 139872 - protein, 10 aa, Artificial Sequence
  Description of Artificial Sequence: Synthetic peptide
  Seed: SGTYCLNVSL (PMEL_HUMAN)
SPTYCLNVSW

SEQ ID NO: 139873 - protein, 9 aa, Artificial Sequence
  Description of Artificial Sequence: Synthetic peptide
  Seed: CVLYRYGSF (PMEL_HUMAN)
CKLYRYGSY

SEQ ID NO: 139874 - protein, 9 aa, Artificial Sequence
  Description of Artificial Sequence: Synthetic peptide
  Seed: FSIALNFPG (PMEL_HUMAN)
FIIALNFPW

SEQ ID NO: 139875 - protein, 9 aa, Artificial Sequence
  Description of Artificial Sequence: Synthetic peptide
  Seed: ALVVTHTYL (PMEL_HUMAN)
ASVVTHTYY

SEQ ID NO: 139876 - protein, 9 aa, Artificial Sequence
  Description of Artificial Sequence: Synthetic peptide
  Seed: GSWSQKRSF (PMEL_HUMAN)
GIWSQKRSY

SEQ ID NO: 139877 - protein, 9 aa, Artificial Sequence
  Description of Artificial Sequence: Synthetic peptide
  Seed: VQVPTTEVI (PMEL_HUMAN)
VVVPTTEVY

SEQ ID NO: 139878 - protein, 11 aa, Artificial Sequence
  Description of Artificial Sequence: Synthetic peptide
  Seed: SEVMGTTLAEM (PMEL_HUMAN)
SEVMGTTLAEF

SEQ ID NO: 139879 - protein, 10 aa, Artificial Sequence
  Description of Artificial Sequence: Synthetic peptide
  Seed: MTPAEVSIVV (PMEL_HUMAN)
MDPAEVSIVI

SEQ ID NO: 139880 - protein, 9 aa, Artificial Sequence
  Description of Artificial Sequence: Synthetic peptide
  Seed: VLPSPACQL (PMEL_HUMAN)
VLPSPACQI

SEQ ID NO: 139881 - protein, 9 aa, Artificial Sequence
  Description of Artificial Sequence: Synthetic peptide
  Seed: KVLPDGQVI (PMEL_HUMAN)
KLLPDGQVF

SEQ ID NO: 139882 - protein, 9 aa, Artificial Sequence
  Description of Artificial Sequence: Synthetic peptide
  Seed: TTPGQAPTA (PMEL_HUMAN)
TAPGQAPTL

SEQ ID NO: 139883 - protein, 10 aa, Artificial Sequence
  Description of Artificial Sequence: Synthetic peptide
  Seed: RGSRSYVPLA (PMEL_HUMAN)
RRSRSYVPLY

SEQ ID NO: 139884 - protein, 9 aa, Artificial Sequence
  Description of Artificial Sequence: Synthetic peptide
  Seed: RNQPLTFAL (PMEL_HUMAN)
RMQPLTFAV

SEQ ID NO: 139885 - protein, 9 aa, Artificial Sequence
  Description of Artificial Sequence: Synthetic peptide
  Seed: FTITDQVPF (PMEL_HUMAN)
FWITDQVPY

SEQ ID NO: 139886 - protein, 9 aa, Artificial Sequence
  Description of Artificial Sequence: Synthetic peptide
  Seed: LPSPACQLV (PMEL_HUMAN)
LPSPACQLL

SEQ ID NO: 139887 - protein, 10 aa, Artificial Sequence
  Description of Artificial Sequence: Synthetic peptide
  Seed: LAVIGALLAV (PMEL_HUMAN)
LQVIGALLAA

SEQ ID NO: 139888 - protein, 10 aa, Artificial Sequence
  Description of Artificial Sequence: Synthetic peptide
  Seed: AVVLASLIYR (PMEL_HUMAN)
AMVLASLIYK

SEQ ID NO: 139889 - protein, 10 aa, Artificial Sequence
  Description of Artificial Sequence: Synthetic peptide
  Seed: HFLRNQPLTF (PMEL_HUMAN)
HYLRNQPLTF

SEQ ID NO: 139890 - protein, 9 aa, Artificial Sequence
  Description of Artificial Sequence: Synthetic peptide
  Seed: SSIMSTESI (PMEL_HUMAN)
SEIMSTESY

SEQ ID NO: 139891 - protein, 11 aa, Artificial Sequence
  Description of Artificial Sequence: Synthetic peptide
  Seed: RALDGGNKHFL (PMEL_HUMAN)
RMLDGGNKHFM

SEQ ID NO: 139892 - protein, 10 aa, Artificial Sequence
  Description of Artificial Sequence: Synthetic peptide
  Seed: MPTAESTGMT (PMEL_HUMAN)
MATAESTGMV

SEQ ID NO: 139893 - protein, 11 aa, Artificial Sequence
  Description of Artificial Sequence: Synthetic peptide
  Seed: SYVPLAHSSSA (PMEL_HUMAN)
SPVPLAHSSSM

SEQ ID NO: 139894 - protein, 10 aa, Artificial Sequence
  Description of Artificial Sequence: Synthetic peptide
  Seed: RTKAWNRQLY (PMEL_HUMAN)
RVKAWNRQLS

SEQ ID NO: 139895 - protein, 9 aa, Artificial Sequence
  Description of Artificial Sequence: Synthetic peptide
  Seed: ALDGGNKHF (PMEL_HUMAN)
AYDGGNKHY

SEQ ID NO: 139896 - protein, 9 aa, Artificial Sequence
  Description of Artificial Sequence: Synthetic peptide
  Seed: GTYCLNVSL (PMEL_HUMAN)
GMYCLNVSI

SEQ ID NO: 139897 - protein, 10 aa, Artificial Sequence
  Description of Artificial Sequence: Synthetic peptide
  Seed: HFLRNQPLTF (PMEL_HUMAN)
HMLRNQPLTF

SEQ ID NO: 139898 - protein, 10 aa, Artificial Sequence
  Description of Artificial Sequence: Synthetic peptide
  Seed: KTWGQYWQVL (PMEL_HUMAN)
KGWGQYWQVW

SEQ ID NO: 139899 - protein, 11 aa, Artificial Sequence
  Description of Artificial Sequence: Synthetic peptide
  Seed: YLAEADLSYTW (PMEL_HUMAN)
YLAEADLSYTI

SEQ ID NO: 139900 - protein, 8 aa, Artificial Sequence
  Description of Artificial Sequence: Synthetic peptide
  Seed: RELPIPEP (PMEL_HUMAN)
RELPIPEL

SEQ ID NO: 139901 - protein, 9 aa, Artificial Sequence
  Description of Artificial Sequence: Synthetic peptide
  Seed: RLVKRQVPL (PMEL_HUMAN)
RSVKRQVPW

SEQ ID NO: 139902 - protein, 10 aa, Artificial Sequence
  Description of Artificial Sequence: Synthetic peptide
  Seed: EVVGTTPGQA (PMEL_HUMAN)
ETVGTTPGQV

SEQ ID NO: 139903 - protein, 9 aa, Artificial Sequence
  Description of Artificial Sequence: Synthetic peptide
  Seed: MTPAEVSIV (PMEL_HUMAN)
MVPAEVSIV

SEQ ID NO: 139904 - protein, 9 aa, Artificial Sequence
  Description of Artificial Sequence: Synthetic peptide
  Seed: SSPGCQPPA (PMEL_HUMAN)
STPGCQPPL

SEQ ID NO: 139905 - protein, 11 aa, Artificial Sequence
  Description of Artificial Sequence: Synthetic peptide
  Seed: GYLAEADLSYT (PMEL_HUMAN)
GMLAEADLSYA

SEQ ID NO: 139906 - protein, 8 aa, Artificial Sequence
  Description of Artificial Sequence: Synthetic peptide
  Seed: IGENSPLL (PMEL_HUMAN)
IAENSPLL

SEQ ID NO: 139907 - protein, 10 aa, Artificial Sequence
  Description of Artificial Sequence: Synthetic peptide
  Seed: NASFSIALNF (PMEL_HUMAN)
NMSFSIALNF

SEQ ID NO: 139908 - protein, 9 aa, Artificial Sequence
  Description of Artificial Sequence: Synthetic peptide
  Seed: VQVPTTEVI (PMEL_HUMAN)
VFVPTTEVL

SEQ ID NO: 139909 - protein, 9 aa, Artificial Sequence
  Description of Artificial Sequence: Synthetic peptide
  Seed: SGTLISRAL (PMEL_HUMAN)
SATLISRAL

SEQ ID NO: 139910 - protein, 10 aa, Artificial Sequence
  Description of Artificial Sequence: Synthetic peptide
  Seed: STAPVQMPTA (PMEL_HUMAN)
STAPVQMPTL

SEQ ID NO: 139911 - protein, 9 aa, Artificial Sequence
  Description of Artificial Sequence: Synthetic peptide
  Seed: VTLDIVQGI (PMEL_HUMAN)
VLLDIVQGL

SEQ ID NO: 139912 - protein, 11 aa, Artificial Sequence
  Description of Artificial Sequence: Synthetic peptide
  Seed: SYVPLAHSSSA (PMEL_HUMAN)
SNVPLAHSSSL

SEQ ID NO: 139913 - protein, 9 aa, Artificial Sequence
  Description of Artificial Sequence: Synthetic peptide
  Seed: VVLSGTTAA (PMEL_HUMAN)
VSLSGTTAF

SEQ ID NO: 139914 - protein, 11 aa, Artificial Sequence
  Description of Artificial Sequence: Synthetic peptide
  Seed: YLAEADLSYTW (PMEL_HUMAN)
YVAEADLSYTV

SEQ ID NO: 139915 - protein, 9 aa, Artificial Sequence
  Description of Artificial Sequence: Synthetic peptide
  Seed: TTAGQVPTT (PMEL_HUMAN)
TVAGQVPTL

SEQ ID NO: 139916 - protein, 9 aa, Artificial Sequence
  Description of Artificial Sequence: Synthetic peptide
  Seed: SSPGCQPPA (PMEL_HUMAN)
SSPGCQPPY

SEQ ID NO: 139917 - protein, 10 aa, Artificial Sequence
  Description of Artificial Sequence: Synthetic peptide
  Seed: ALDGGNKHFL (PMEL_HUMAN)
AQDGGNKHFL

SEQ ID NO: 139918 - protein, 8 aa, Artificial Sequence
  Description of Artificial Sequence: Synthetic peptide
  Seed: VLPDGQVI (PMEL_HUMAN)
VLPDGQVL

SEQ ID NO: 139919 - protein, 8 aa, Artificial Sequence
  Description of Artificial Sequence: Synthetic peptide
  Seed: HSSSHWLR (PMEL_HUMAN)
HFSSHWLR

SEQ ID NO: 139920 - protein, 9 aa, Artificial Sequence
  Description of Artificial Sequence: Synthetic peptide
  Seed: HTMEVTVYH (PMEL_HUMAN)
HVMEVTVYW

SEQ ID NO: 139921 - protein, 8 aa, Artificial Sequence
  Description of Artificial Sequence: Synthetic peptide
  Seed: ALVVTHTY (PMEL_HUMAN)
AMVVTHTY

SEQ ID NO: 139922 - protein, 10 aa, Artificial Sequence
  Description of Artificial Sequence: Synthetic peptide
  Seed: EVMGTTLAEM (PMEL_HUMAN)
ETMGTTLAEK

SEQ ID NO: 139923 - protein, 9 aa, Artificial Sequence
  Description of Artificial Sequence: Synthetic peptide
  Seed: SSIMSTESI (PMEL_HUMAN)
SMIMSTESI

SEQ ID NO: 139924 - protein, 9 aa, Artificial Sequence
  Description of Artificial Sequence: Synthetic peptide
  Seed: IYRRRLMKQ (PMEL_HUMAN)
ITRRRLMKI

SEQ ID NO: 139925 - protein, 9 aa, Artificial Sequence
  Description of Artificial Sequence: Synthetic peptide
  Seed: MEVTVYHRR (PMEL_HUMAN)
MTVTVYHRK

SEQ ID NO: 139926 - protein, 9 aa, Artificial Sequence
  Description of Artificial Sequence: Synthetic peptide
  Seed: ILKGGSGTY (PMEL_HUMAN)
ILKGGSGTF

SEQ ID NO: 139927 - protein, 9 aa, Artificial Sequence
  Description of Artificial Sequence: Synthetic peptide
  Seed: AVIGALLAV (PMEL_HUMAN)
ALIGALLAY

SEQ ID NO: 139928 - protein, 11 aa, Artificial Sequence
  Description of Artificial Sequence: Synthetic peptide
  Seed: KVLPDGQVIWV (PMEL_HUMAN)
KMLPDGQVIWI

SEQ ID NO: 139929 - protein, 11 aa, Artificial Sequence
  Description of Artificial Sequence: Synthetic peptide
  Seed: RRGSRSYVPLA (PMEL_HUMAN)
RVGSRSYVPLL

SEQ ID NO: 139930 - protein, 10 aa, Artificial Sequence
  Description of Artificial Sequence: Synthetic peptide
  Seed: AVIGALLAVG (PMEL_HUMAN)
AVIGALLAVR

SEQ ID NO: 139931 - protein, 11 aa, Artificial Sequence
  Description of Artificial Sequence: Synthetic peptide
  Seed: VWKTWGQYWQV (PMEL_HUMAN)
VMKTWGQYWQV

SEQ ID NO: 139932 - protein, 10 aa, Artificial Sequence
  Description of Artificial Sequence: Synthetic peptide
  Seed: EVVGTTPGQA (PMEL_HUMAN)
ETVGTTPGQY

SEQ ID NO: 139933 - protein, 10 aa, Artificial Sequence
  Description of Artificial Sequence: Synthetic peptide
  Seed: YVWKTWGQYW (PMEL_HUMAN)
YYWKTWGQYL

SEQ ID NO: 139934 - protein, 9 aa, Artificial Sequence
  Description of Artificial Sequence: Synthetic peptide
  Seed: AGLGQVPLI (PMEL_HUMAN)
ALLGQVPLV

SEQ ID NO: 139935 - protein, 11 aa, Artificial Sequence
  Description of Artificial Sequence: Synthetic peptide
  Seed: VLMAVVLASLI (PMEL_HUMAN)
VMMAVVLASLV

SEQ ID NO: 139936 - protein, 9 aa, Artificial Sequence
  Description of Artificial Sequence: Synthetic peptide
  Seed: KHFLRNQPL (PMEL_HUMAN)
KEFLRNQPY

SEQ ID NO: 139937 - protein, 9 aa, Artificial Sequence
  Description of Artificial Sequence: Synthetic peptide
  Seed: TTDGHRPTA (PMEL_HUMAN)
TTDGHRPTF

SEQ ID NO: 139938 - protein, 10 aa, Artificial Sequence
  Description of Artificial Sequence: Synthetic peptide
  Seed: MTPAEVSIVV (PMEL_HUMAN)
MGPAEVSIVY

SEQ ID NO: 139939 - protein, 9 aa, Artificial Sequence
  Description of Artificial Sequence: Synthetic peptide
  Seed: QAAIPLTSC (PMEL_HUMAN)
QTAIPLTSY

SEQ ID NO: 139940 - protein, 9 aa, Artificial Sequence
  Description of Artificial Sequence: Synthetic peptide
  Seed: RALDGGNKH (PMEL_HUMAN)
RQLDGGNKY

SEQ ID NO: 139941 - protein, 9 aa, Artificial Sequence
  Description of Artificial Sequence: Synthetic peptide
  Seed: SEVMGTTLA (PMEL_HUMAN)
SHVMGTTLV

SEQ ID NO: 139942 - protein, 9 aa, Artificial Sequence
  Description of Artificial Sequence: Synthetic peptide
  Seed: LSIGTGRAM (PMEL_HUMAN)
LVIGTGRAM

SEQ ID NO: 139943 - protein, 10 aa, Artificial Sequence
  Description of Artificial Sequence: Synthetic peptide
  Seed: LAVGATKVPR (PMEL_HUMAN)
LVVGATKVPK

SEQ ID NO: 139944 - protein, 10 aa, Artificial Sequence
  Description of Artificial Sequence: Synthetic peptide
  Seed: RSFVYVWKTW (PMEL_HUMAN)
RWFVYVWKTM

SEQ ID NO: 139945 - protein, 9 aa, Artificial Sequence
  Description of Artificial Sequence: Synthetic peptide
  Seed: MTPEKVPVS (PMEL_HUMAN)
MMPEKVPVV

SEQ ID NO: 139946 - protein, 9 aa, Artificial Sequence
  Description of Artificial Sequence: Synthetic peptide
  Seed: AVVSTQLIM (PMEL_HUMAN)
AAVSTQLIY

SEQ ID NO: 139947 - protein, 9 aa, Artificial Sequence
  Description of Artificial Sequence: Synthetic peptide
  Seed: GTYCLNVSL (PMEL_HUMAN)
GVYCLNVSR

SEQ ID NO: 139948 - protein, 10 aa, Artificial Sequence
  Description of Artificial Sequence: Synthetic peptide
  Seed: MPTAESTGMT (PMEL_HUMAN)
MPTAESTGMI

SEQ ID NO: 139949 - protein, 9 aa, Artificial Sequence
  Description of Artificial Sequence: Synthetic peptide
  Seed: VSLADTNSL (PMEL_HUMAN)
VSLADTNSW

SEQ ID NO: 139950 - protein, 9 aa, Artificial Sequence
  Description of Artificial Sequence: Synthetic peptide
  Seed: VLPDGQVIW (PMEL_HUMAN)
VTPDGQVIL

SEQ ID NO: 139951 - protein, 9 aa, Artificial Sequence
  Description of Artificial Sequence: Synthetic peptide
  Seed: QAAIPLTSC (PMEL_HUMAN)
QSAIPLTSY

SEQ ID NO: 139952 - protein, 8 aa, Artificial Sequence
  Description of Artificial Sequence: Synthetic peptide
  Seed: LLDGTATL (PMEL_HUMAN)
LSDGTATM

SEQ ID NO: 139953 - protein, 10 aa, Artificial Sequence
  Description of Artificial Sequence: Synthetic peptide
  Seed: SGTYCLNVSL (PMEL_HUMAN)
SLTYCLNVSY

SEQ ID NO: 139954 - protein, 9 aa, Artificial Sequence
  Description of Artificial Sequence: Synthetic peptide
  Seed: YVWKTWGQY (PMEL_HUMAN)
YMWKTWGQR

SEQ ID NO: 139955 - protein, 10 aa, Artificial Sequence
  Description of Artificial Sequence: Synthetic peptide
  Seed: KRQVPLDCVL (PMEL_HUMAN)
KKQVPLDCVM

SEQ ID NO: 139956 - protein, 10 aa, Artificial Sequence
  Description of Artificial Sequence: Synthetic peptide
  Seed: TAEPSGTTSV (PMEL_HUMAN)
TMEPSGTTSL

SEQ ID NO: 139957 - protein, 10 aa, Artificial Sequence
  Description of Artificial Sequence: Synthetic peptide
  Seed: RGSRSYVPLA (PMEL_HUMAN)
RQSRSYVPLG

SEQ ID NO: 139958 - protein, 9 aa, Artificial Sequence
  Description of Artificial Sequence: Synthetic peptide
  Seed: PLLDGTATL (PMEL_HUMAN)
PMLDGTATY

SEQ ID NO: 139959 - protein, 10 aa, Artificial Sequence
  Description of Artificial Sequence: Synthetic peptide
  Seed: GTHTMEVTVY (PMEL_HUMAN)
GQHTMEVTVM

SEQ ID NO: 139960 - protein, 9 aa, Artificial Sequence
  Description of Artificial Sequence: Synthetic peptide
  Seed: ISRALVVTH (PMEL_HUMAN)
IQRALVVTM

SEQ ID NO: 139961 - protein, 9 aa, Artificial Sequence
  Description of Artificial Sequence: Synthetic peptide
  Seed: AEADLSYTW (PMEL_HUMAN)
ADADLSYTW

SEQ ID NO: 139962 - protein, 9 aa, Artificial Sequence
  Description of Artificial Sequence: Synthetic peptide
  Seed: LAVGATKVP (PMEL_HUMAN)
LAVGATKVY

SEQ ID NO: 139963 - protein, 9 aa, Artificial Sequence
  Description of Artificial Sequence: Synthetic peptide
  Seed: ESAEILQAV (PMEL_HUMAN)
EVAEILQAW

SEQ ID NO: 139964 - protein, 10 aa, Artificial Sequence
  Description of Artificial Sequence: Synthetic peptide
  Seed: VLMAVVLASL (PMEL_HUMAN)
VHMAVVLASY

SEQ ID NO: 139965 - protein, 9 aa, Artificial Sequence
  Description of Artificial Sequence: Synthetic peptide
  Seed: HSSSHWLRL (PMEL_HUMAN)
HMSSHWLRK

SEQ ID NO: 139966 - protein, 9 aa, Artificial Sequence
  Description of Artificial Sequence: Synthetic peptide
  Seed: RLMKQDFSV (PMEL_HUMAN)
RNMKQDFSY

SEQ ID NO: 139967 - protein, 10 aa, Artificial Sequence
  Description of Artificial Sequence: Synthetic peptide
  Seed: MKQDFSVPQL (PMEL_HUMAN)
MMQDFSVPQV

SEQ ID NO: 139968 - protein, 9 aa, Artificial Sequence
  Description of Artificial Sequence: Synthetic peptide
  Seed: AVVLASLIY (PMEL_HUMAN)
ARVLASLIF

SEQ ID NO: 139969 - protein, 10 aa, Artificial Sequence
  Description of Artificial Sequence: Synthetic peptide
  Seed: RQLYPEWTEA (PMEL_HUMAN)
RALYPEWTEI

SEQ ID NO: 139970 - protein, 8 aa, Artificial Sequence
  Description of Artificial Sequence: Synthetic peptide
  Seed: VWGGQPVY (PMEL_HUMAN)
VYGGQPVL

SEQ ID NO: 139971 - protein, 9 aa, Artificial Sequence
  Description of Artificial Sequence: Synthetic peptide
  Seed: SVPQLPHSS (PMEL_HUMAN)
SSPQLPHSL

SEQ ID NO: 139972 - protein, 10 aa, Artificial Sequence
  Description of Artificial Sequence: Synthetic peptide
  Seed: KVLPDGQVIW (PMEL_HUMAN)
KSLPDGQVIW

SEQ ID NO: 139973 - protein, 9 aa, Artificial Sequence
  Description of Artificial Sequence: Synthetic peptide
  Seed: RAMLGTHTM (PMEL_HUMAN)
RLMLGTHTY

SEQ ID NO: 139974 - protein, 9 aa, Artificial Sequence
  Description of Artificial Sequence: Synthetic peptide
  Seed: SQKRSFVYV (PMEL_HUMAN)
SMKRSFVYG

SEQ ID NO: 139975 - protein, 10 aa, Artificial Sequence
  Description of Artificial Sequence: Synthetic peptide
  Seed: MTPAEVSIVV (PMEL_HUMAN)
MNPAEVSIVI

SEQ ID NO: 139976 - protein, 9 aa, Artificial Sequence
  Description of Artificial Sequence: Synthetic peptide
  Seed: RELPIPEPE (PMEL_HUMAN)
RELPIPEPP

SEQ ID NO: 139977 - protein, 10 aa, Artificial Sequence
  Description of Artificial Sequence: Synthetic peptide
  Seed: ASFSIALNFP (PMEL_HUMAN)
ASFSIALNFF

SEQ ID NO: 139978 - protein, 10 aa, Artificial Sequence
  Description of Artificial Sequence: Synthetic peptide
  Seed: SSHWLRLPRI (PMEL_HUMAN)
SYHWLRLPRR

SEQ ID NO: 139979 - protein, 10 aa, Artificial Sequence
  Description of Artificial Sequence: Synthetic peptide
  Seed: VQGIESAEIL (PMEL_HUMAN)
VQGIESAEIY

SEQ ID NO: 139980 - protein, 9 aa, Artificial Sequence
  Description of Artificial Sequence: Synthetic peptide
  Seed: WSQKRSFVY (PMEL_HUMAN)
WQQKRSFVI

SEQ ID NO: 139981 - protein, 9 aa, Artificial Sequence
  Description of Artificial Sequence: Synthetic peptide
  Seed: SVQVPTTEV (PMEL_HUMAN)
SPQVPTTEI

SEQ ID NO: 139982 - protein, 9 aa, Artificial Sequence
  Description of Artificial Sequence: Synthetic peptide
  Seed: LQAAIPLTS (PMEL_HUMAN)
LLAAIPLTY

SEQ ID NO: 139983 - protein, 9 aa, Artificial Sequence
  Description of Artificial Sequence: Synthetic peptide
  Seed: KAWNRQLYP (PMEL_HUMAN)
KSWNRQLYA

SEQ ID NO: 139984 - protein, 9 aa, Artificial Sequence
  Description of Artificial Sequence: Synthetic peptide
  Seed: SLAVVSTQL (PMEL_HUMAN)
STAVVSTQA

SEQ ID NO: 139985 - protein, 9 aa, Artificial Sequence
  Description of Artificial Sequence: Synthetic peptide
  Seed: KAWNRQLYP (PMEL_HUMAN)
KSWNRQLYL

SEQ ID NO: 139986 - protein, 9 aa, Artificial Sequence
  Description of Artificial Sequence: Synthetic peptide
  Seed: WSQKRSFVY (PMEL_HUMAN)
WAQKRSFVV

SEQ ID NO: 139987 - protein, 9 aa, Artificial Sequence
  Description of Artificial Sequence: Synthetic peptide
  Seed: TLIGANASF (PMEL_HUMAN)
TFIGANASL

SEQ ID NO: 139988 - protein, 9 aa, Artificial Sequence
  Description of Artificial Sequence: Synthetic peptide
  Seed: SQVWGGQPV (PMEL_HUMAN)
STVWGGQPF

SEQ ID NO: 139989 - protein, 9 aa, Artificial Sequence
  Description of Artificial Sequence: Synthetic peptide
  Seed: RSFVYVWKT (PMEL_HUMAN)
RAFVYVWKK

SEQ ID NO: 139990 - protein, 9 aa, Artificial Sequence
  Description of Artificial Sequence: Synthetic peptide
  Seed: LYPEWTEAQ (PMEL_HUMAN)
LYPEWTEAV

SEQ ID NO: 139991 - protein, 9 aa, Artificial Sequence
  Description of Artificial Sequence: Synthetic peptide
  Seed: DAFELTVSC (PMEL_HUMAN)
DVFELTVSI

SEQ ID NO: 139992 - protein, 10 aa, Artificial Sequence
  Description of Artificial Sequence: Synthetic peptide
  Seed: VLMAVVLASL (PMEL_HUMAN)
VWMAVVLASV

SEQ ID NO: 139993 - protein, 9 aa, Artificial Sequence
  Description of Artificial Sequence: Synthetic peptide
  Seed: QVIWVNNTI (PMEL_HUMAN)
QMIWVNNTR

SEQ ID NO: 139994 - protein, 9 aa, Artificial Sequence
  Description of Artificial Sequence: Synthetic peptide
  Seed: RLPRIFCSC (PMEL_HUMAN)
RQPRIFCSL

SEQ ID NO: 139995 - protein, 11 aa, Artificial Sequence
  Description of Artificial Sequence: Synthetic peptide
  Seed: WQVLGGPVSGL (PMEL_HUMAN)
WQVLGGPVSGY

SEQ ID NO: 139996 - protein, 10 aa, Artificial Sequence
  Description of Artificial Sequence: Synthetic peptide
  Seed: AEMSTPEATG (PMEL_HUMAN)
AEMSTPEATY

SEQ ID NO: 139997 - protein, 9 aa, Artificial Sequence
  Description of Artificial Sequence: Synthetic peptide
  Seed: RSYVPLAHS (PMEL_HUMAN)
RYYVPLAHK

SEQ ID NO: 139998 - protein, 9 aa, Artificial Sequence
  Description of Artificial Sequence: Synthetic peptide
  Seed: MSTPEATGM (PMEL_HUMAN)
MATPEATGF

SEQ ID NO: 139999 - protein, 9 aa, Artificial Sequence
  Description of Artificial Sequence: Synthetic peptide
  Seed: LNFPGSQKV (PMEL_HUMAN)
LGFPGSQKF

SEQ ID NO: 140000 - protein, 9 aa, Artificial Sequence
  Description of Artificial Sequence: Synthetic peptide
  Seed: MTPEKVPVS (PMEL_HUMAN)
MLPEKVPVI

SEQ ID NO: 140001 - protein, 10 aa, Artificial Sequence
  Description of Artificial Sequence: Synthetic peptide
  Seed: YLAEADLSYT (PMEL_HUMAN)
YLAEADLSYV

SEQ ID NO: 140002 - protein, 9 aa, Artificial Sequence
  Description of Artificial Sequence: Synthetic peptide
  Seed: ALNFPGSQK (PMEL_HUMAN)
AANFPGSQY

SEQ ID NO: 140003 - protein, 9 aa, Artificial Sequence
  Description of Artificial Sequence: Synthetic peptide
  Seed: KTWGQYWQV (PMEL_HUMAN)
KSWGQYWQR

SEQ ID NO: 140004 - protein, 9 aa, Artificial Sequence
  Description of Artificial Sequence: Synthetic peptide
  Seed: SYVPLAHSS (PMEL_HUMAN)
SFVPLAHSF

SEQ ID NO: 140005 - protein, 10 aa, Artificial Sequence
  Description of Artificial Sequence: Synthetic peptide
  Seed: NASFSIALNF (PMEL_HUMAN)
NQSFSIALNW

SEQ ID NO: 140006 - protein, 9 aa, Artificial Sequence
  Description of Artificial Sequence: Synthetic peptide
  Seed: QVWGGQPVY (PMEL_HUMAN)
QRWGGQPVY

SEQ ID NO: 140007 - protein, 9 aa, Artificial Sequence
  Description of Artificial Sequence: Synthetic peptide
  Seed: RALVVTHTY (PMEL_HUMAN)
RALVVTHTR

SEQ ID NO: 140008 - protein, 9 aa, Artificial Sequence
  Description of Artificial Sequence: Synthetic peptide
  Seed: FSVSVSQLR (PMEL_HUMAN)
FTVSVSQLK

SEQ ID NO: 140009 - protein, 9 aa, Artificial Sequence
  Description of Artificial Sequence: Synthetic peptide
  Seed: AVIGALLAV (PMEL_HUMAN)
AVIGALLAL

SEQ ID NO: 140010 - protein, 10 aa, Artificial Sequence
  Description of Artificial Sequence: Synthetic peptide
  Seed: IALNFPGSQK (PMEL_HUMAN)
ITLNFPGSQK

SEQ ID NO: 140011 - protein, 10 aa, Artificial Sequence
  Description of Artificial Sequence: Synthetic peptide
  Seed: RGSRSYVPLA (PMEL_HUMAN)
RISRSYVPLL

SEQ ID NO: 140012 - protein, 9 aa, Artificial Sequence
  Description of Artificial Sequence: Synthetic peptide
  Seed: TPAEVSIVV (PMEL_HUMAN)
TVAEVSIVI

SEQ ID NO: 140013 - protein, 10 aa, Artificial Sequence
  Description of Artificial Sequence: Synthetic peptide
  Seed: MTPAEVSIVV (PMEL_HUMAN)
MNPAEVSIVF

SEQ ID NO: 140014 - protein, 9 aa, Artificial Sequence
  Description of Artificial Sequence: Synthetic peptide
  Seed: VISTAPVQM (PMEL_HUMAN)
VTSTAPVQI

SEQ ID NO: 140015 - protein, 11 aa, Artificial Sequence
  Description of Artificial Sequence: Synthetic peptide
  Seed: APTAEPSGTTS (PMEL_HUMAN)
APTAEPSGTTF

SEQ ID NO: 140016 - protein, 9 aa, Artificial Sequence
  Description of Artificial Sequence: Synthetic peptide
  Seed: VLPSPACQL (PMEL_HUMAN)
VVPSPACQL

SEQ ID NO: 140017 - protein, 9 aa, Artificial Sequence
  Description of Artificial Sequence: Synthetic peptide
  Seed: PLLDGTATL (PMEL_HUMAN)
PLLDGTATV

SEQ ID NO: 140018 - protein, 10 aa, Artificial Sequence
  Description of Artificial Sequence: Synthetic peptide
  Seed: GPLLDGTATL (PMEL_HUMAN)
GWLLDGTATI

SEQ ID NO: 140019 - protein, 10 aa, Artificial Sequence
  Description of Artificial Sequence: Synthetic peptide
  Seed: RALVVTHTYL (PMEL_HUMAN)
RILVVTHTYW

SEQ ID NO: 140020 - protein, 9 aa, Artificial Sequence
  Description of Artificial Sequence: Synthetic peptide
  Seed: QLHDPSGYL (PMEL_HUMAN)
QAHDPSGYL

SEQ ID NO: 140021 - protein, 9 aa, Artificial Sequence
  Description of Artificial Sequence: Synthetic peptide
  Seed: AVIGALLAV (PMEL_HUMAN)
AIIGALLAL

SEQ ID NO: 140022 - protein, 10 aa, Artificial Sequence
  Description of Artificial Sequence: Synthetic peptide
  Seed: RALVVTHTYL (PMEL_HUMAN)
RQLVVTHTYV

SEQ ID NO: 140023 - protein, 11 aa, Artificial Sequence
  Description of Artificial Sequence: Synthetic peptide
  Seed: VQMPTAESTGM (PMEL_HUMAN)
VHMPTAESTGM

SEQ ID NO: 140024 - protein, 10 aa, Artificial Sequence
  Description of Artificial Sequence: Synthetic peptide
  Seed: YVWKTWGQYW (PMEL_HUMAN)
YMWKTWGQYW

SEQ ID NO: 140025 - protein, 9 aa, Artificial Sequence
  Description of Artificial Sequence: Synthetic peptide
  Seed: FLRNQPLTF (PMEL_HUMAN)
FQRNQPLTY

SEQ ID NO: 140026 - protein, 9 aa, Artificial Sequence
  Description of Artificial Sequence: Synthetic peptide
  Seed: GQVPTTEVV (PMEL_HUMAN)
GSVPTTEVY

SEQ ID NO: 140027 - protein, 9 aa, Artificial Sequence
  Description of Artificial Sequence: Synthetic peptide
  Seed: SSIMSTESI (PMEL_HUMAN)
SAIMSTESM

SEQ ID NO: 140028 - protein, 11 aa, Artificial Sequence
  Description of Artificial Sequence: Synthetic peptide
  Seed: FGDSSGTLISR (PMEL_HUMAN)
FGDSSGTLISM

SEQ ID NO: 140029 - protein, 9 aa, Artificial Sequence
  Description of Artificial Sequence: Synthetic peptide
  Seed: MLGTHTMEV (PMEL_HUMAN)
MQGTHTMEM

SEQ ID NO: 140030 - protein, 10 aa, Artificial Sequence
  Description of Artificial Sequence: Synthetic peptide
  Seed: VPQLPHSSSH (PMEL_HUMAN)
VYQLPHSSSF

SEQ ID NO: 140031 - protein, 10 aa, Artificial Sequence
  Description of Artificial Sequence: Synthetic peptide
  Seed: KRQVPLDCVL (PMEL_HUMAN)
KVQVPLDCVM

SEQ ID NO: 140032 - protein, 9 aa, Artificial Sequence
  Description of Artificial Sequence: Synthetic peptide
  Seed: AVIGALLAV (PMEL_HUMAN)
AIIGALLAT

SEQ ID NO: 140033 - protein, 9 aa, Artificial Sequence
  Description of Artificial Sequence: Synthetic peptide
  Seed: TLIGANASF (PMEL_HUMAN)
TFIGANASM

SEQ ID NO: 140034 - protein, 10 aa, Artificial Sequence
  Description of Artificial Sequence: Synthetic peptide
  Seed: LAVIGALLAV (PMEL_HUMAN)
LMVIGALLAL

SEQ ID NO: 140035 - protein, 9 aa, Artificial Sequence
  Description of Artificial Sequence: Synthetic peptide
  Seed: VPLAHSSSA (PMEL_HUMAN)
VALAHSSSY

SEQ ID NO: 140036 - protein, 10 aa, Artificial Sequence
  Description of Artificial Sequence: Synthetic peptide
  Seed: VLMAVVLASL (PMEL_HUMAN)
VEMAVVLASF

SEQ ID NO: 140037 - protein, 10 aa, Artificial Sequence
  Description of Artificial Sequence: Synthetic peptide
  Seed: LNFPGSQKVL (PMEL_HUMAN)
LGFPGSQKVY

SEQ ID NO: 140038 - protein, 9 aa, Artificial Sequence
  Description of Artificial Sequence: Synthetic peptide
  Seed: KAWNRQLYP (PMEL_HUMAN)
KVWNRQLYK

SEQ ID NO: 140039 - protein, 11 aa, Artificial Sequence
  Description of Artificial Sequence: Synthetic peptide
  Seed: KVLPDGQVIWV (PMEL_HUMAN)
KLLPDGQVIWY

SEQ ID NO: 140040 - protein, 9 aa, Artificial Sequence
  Description of Artificial Sequence: Synthetic peptide
  Seed: VTAQVVLQA (PMEL_HUMAN)
VMAQVVLQT

SEQ ID NO: 140041 - protein, 10 aa, Artificial Sequence
  Description of Artificial Sequence: Synthetic peptide
  Seed: RGSRSYVPLA (PMEL_HUMAN)
RASRSYVPLG

SEQ ID NO: 140042 - protein, 9 aa, Artificial Sequence
  Description of Artificial Sequence: Synthetic peptide
  Seed: LTSCGSSPV (PMEL_HUMAN)
LMSCGSSPI

SEQ ID NO: 140043 - protein, 10 aa, Artificial Sequence
  Description of Artificial Sequence: Synthetic peptide
  Seed: RGSRSYVPLA (PMEL_HUMAN)
RYSRSYVPLG

SEQ ID NO: 140044 - protein, 10 aa, Artificial Sequence
  Description of Artificial Sequence: Synthetic peptide
  Seed: DGTATLRLVK (PMEL_HUMAN)
DITATLRLVR

SEQ ID NO: 140045 - protein, 10 aa, Artificial Sequence
  Description of Artificial Sequence: Synthetic peptide
  Seed: VPQLPHSSSH (PMEL_HUMAN)
VNQLPHSSSL

SEQ ID NO: 140046 - protein, 10 aa, Artificial Sequence
  Description of Artificial Sequence: Synthetic peptide
  Seed: SQKRSFVYVW (PMEL_HUMAN)
SIKRSFVYVY

SEQ ID NO: 140047 - protein, 10 aa, Artificial Sequence
  Description of Artificial Sequence: Synthetic peptide
  Seed: RGSRSYVPLA (PMEL_HUMAN)
RNSRSYVPLR

SEQ ID NO: 140048 - protein, 9 aa, Artificial Sequence
  Description of Artificial Sequence: Synthetic peptide
  Seed: RTKAWNRQL (PMEL_HUMAN)
RSKAWNRQA

SEQ ID NO: 140049 - protein, 9 aa, Artificial Sequence
  Description of Artificial Sequence: Synthetic peptide
  Seed: RTKAWNRQL (PMEL_HUMAN)
RIKAWNRQG

SEQ ID NO: 140050 - protein, 10 aa, Artificial Sequence
  Description of Artificial Sequence: Synthetic peptide
  Seed: SVTLDIVQGI (PMEL_HUMAN)
STTLDIVQGV

SEQ ID NO: 140051 - protein, 10 aa, Artificial Sequence
  Description of Artificial Sequence: Synthetic peptide
  Seed: VPLDCVLYRY (PMEL_HUMAN)
VLLDCVLYRY

SEQ ID NO: 140052 - protein, 9 aa, Artificial Sequence
  Description of Artificial Sequence: Synthetic peptide
  Seed: FELTVSCQG (PMEL_HUMAN)
FELTVSCQL

SEQ ID NO: 140053 - protein, 9 aa, Artificial Sequence
  Description of Artificial Sequence: Synthetic peptide
  Seed: LMAVVLASL (PMEL_HUMAN)
LPAVVLASF

SEQ ID NO: 140054 - protein, 9 aa, Artificial Sequence
  Description of Artificial Sequence: Synthetic peptide
  Seed: ITDQVPFSV (PMEL_HUMAN)
IADQVPFSM

SEQ ID NO: 140055 - protein, 9 aa, Artificial Sequence
  Description of Artificial Sequence: Synthetic peptide
  Seed: ESTGMTPEK (PMEL_HUMAN)
ETTGMTPER

SEQ ID NO: 140056 - protein, 9 aa, Artificial Sequence
  Description of Artificial Sequence: Synthetic peptide
  Seed: LYRYGSFSV (PMEL_HUMAN)
LTRYGSFSM

SEQ ID NO: 140057 - protein, 9 aa, Artificial Sequence
  Description of Artificial Sequence: Synthetic peptide
  Seed: AEADLSYTW (PMEL_HUMAN)
ADADLSYTF

SEQ ID NO: 140058 - protein, 10 aa, Artificial Sequence
  Description of Artificial Sequence: Synthetic peptide
  Seed: EVMGTTLAEM (PMEL_HUMAN)
ETMGTTLAEF

SEQ ID NO: 140059 - protein, 10 aa, Artificial Sequence
  Description of Artificial Sequence: Synthetic peptide
  Seed: AMLGTHTMEV (PMEL_HUMAN)
AMLGTHTMEA

SEQ ID NO: 140060 - protein, 9 aa, Artificial Sequence
  Description of Artificial Sequence: Synthetic peptide
  Seed: QVWGGQPVY (PMEL_HUMAN)
QFWGGQPVY

SEQ ID NO: 140061 - protein, 9 aa, Artificial Sequence
  Description of Artificial Sequence: Synthetic peptide
  Seed: KQDFSVPQL (PMEL_HUMAN)
KADFSVPQW

SEQ ID NO: 140062 - protein, 10 aa, Artificial Sequence
  Description of Artificial Sequence: Synthetic peptide
  Seed: SIVVLSGTTA (PMEL_HUMAN)
SIVVLSGTTV

SEQ ID NO: 140063 - protein, 9 aa, Artificial Sequence
  Description of Artificial Sequence: Synthetic peptide
  Seed: TTPGQAPTA (PMEL_HUMAN)
TGPGQAPTV

SEQ ID NO: 140064 - protein, 10 aa, Artificial Sequence
  Description of Artificial Sequence: Synthetic peptide
  Seed: DGTATLRLVK (PMEL_HUMAN)
DQTATLRLVR

SEQ ID NO: 140065 - protein, 9 aa, Artificial Sequence
  Description of Artificial Sequence: Synthetic peptide
  Seed: VQVPTTEVI (PMEL_HUMAN)
VEVPTTEVV

SEQ ID NO: 140066 - protein, 10 aa, Artificial Sequence
  Description of Artificial Sequence: Synthetic peptide
  Seed: SGTYCLNVSL (PMEL_HUMAN)
SGTYCLNVSF

SEQ ID NO: 140067 - protein, 9 aa, Artificial Sequence
  Description of Artificial Sequence: Synthetic peptide
  Seed: VSEVMGTTL (PMEL_HUMAN)
VVEVMGTTM

SEQ ID NO: 140068 - protein, 9 aa, Artificial Sequence
  Description of Artificial Sequence: Synthetic peptide
  Seed: TTDGHRPTA (PMEL_HUMAN)
TADGHRPTL

SEQ ID NO: 140069 - protein, 9 aa, Artificial Sequence
  Description of Artificial Sequence: Synthetic peptide
  Seed: VSLADTNSL (PMEL_HUMAN)
VMLADTNSV

SEQ ID NO: 140070 - protein, 8 aa, Artificial Sequence
  Description of Artificial Sequence: Synthetic peptide
  Seed: LLDGTATL (PMEL_HUMAN)
LSDGTATL

SEQ ID NO: 140071 - protein, 9 aa, Artificial Sequence
  Description of Artificial Sequence: Synthetic peptide
  Seed: LAVGATKVP (PMEL_HUMAN)
LAVGATKVL

SEQ ID NO: 140072 - protein, 9 aa, Artificial Sequence
  Description of Artificial Sequence: Synthetic peptide
  Seed: VTAQVVLQA (PMEL_HUMAN)
VTAQVVLQL

SEQ ID NO: 140073 - protein, 10 aa, Artificial Sequence
  Description of Artificial Sequence: Synthetic peptide
  Seed: LQLHDPSGYL (PMEL_HUMAN)
LMLHDPSGYF

SEQ ID NO: 140074 - protein, 9 aa, Artificial Sequence
  Description of Artificial Sequence: Synthetic peptide
  Seed: AEADLSYTW (PMEL_HUMAN)
ALADLSYTL

SEQ ID NO: 140075 - protein, 10 aa, Artificial Sequence
  Description of Artificial Sequence: Synthetic peptide
  Seed: EVVGTTPGQA (PMEL_HUMAN)
ELVGTTPGQR

SEQ ID NO: 140076 - protein, 9 aa, Artificial Sequence
  Description of Artificial Sequence: Synthetic peptide
  Seed: YLAEADLSY (PMEL_HUMAN)
YQAEADLSI

SEQ ID NO: 140077 - protein, 9 aa, Artificial Sequence
  Description of Artificial Sequence: Synthetic peptide
  Seed: SVQVPTTEV (PMEL_HUMAN)
SMQVPTTEY

SEQ ID NO: 140078 - protein, 10 aa, Artificial Sequence
  Description of Artificial Sequence: Synthetic peptide
  Seed: LVLMAVVLAS (PMEL_HUMAN)
LDLMAVVLAV

SEQ ID NO: 140079 - protein, 10 aa, Artificial Sequence
  Description of Artificial Sequence: Synthetic peptide
  Seed: MTPAEVSIVV (PMEL_HUMAN)
MAPAEVSIVF

SEQ ID NO: 140080 - protein, 9 aa, Artificial Sequence
  Description of Artificial Sequence: Synthetic peptide
  Seed: ANASFSIAL (PMEL_HUMAN)
AAASFSIAH

SEQ ID NO: 140081 - protein, 10 aa, Artificial Sequence
  Description of Artificial Sequence: Synthetic peptide
  Seed: GYLAEADLSY (PMEL_HUMAN)
GMLAEADLSY

SEQ ID NO: 140082 - protein, 10 aa, Artificial Sequence
  Description of Artificial Sequence: Synthetic peptide
  Seed: RTKAWNRQLY (PMEL_HUMAN)
RAKAWNRQLW

SEQ ID NO: 140083 - protein, 9 aa, Artificial Sequence
  Description of Artificial Sequence: Synthetic peptide
  Seed: ITDQVPFSV (PMEL_HUMAN)
INDQVPFSI

SEQ ID NO: 140084 - protein, 9 aa, Artificial Sequence
  Description of Artificial Sequence: Synthetic peptide
  Seed: MTPAEVSIV (PMEL_HUMAN)
MSPAEVSIY

SEQ ID NO: 140085 - protein, 9 aa, Artificial Sequence
  Description of Artificial Sequence: Synthetic peptide
  Seed: WQVLGGPVS (PMEL_HUMAN)
WNVLGGPVF

SEQ ID NO: 140086 - protein, 9 aa, Artificial Sequence
  Description of Artificial Sequence: Synthetic peptide
  Seed: ANASFSIAL (PMEL_HUMAN)
AQASFSIAI

SEQ ID NO: 140087 - protein, 9 aa, Artificial Sequence
  Description of Artificial Sequence: Synthetic peptide
  Seed: YVWKTWGQY (PMEL_HUMAN)
YLWKTWGQR

SEQ ID NO: 140088 - protein, 9 aa, Artificial Sequence
  Description of Artificial Sequence: Synthetic peptide
  Seed: GQVPTTEVV (PMEL_HUMAN)
GIVPTTEVF

SEQ ID NO: 140089 - protein, 10 aa, Artificial Sequence
  Description of Artificial Sequence: Synthetic peptide
  Seed: MTPAEVSIVV (PMEL_HUMAN)
MMPAEVSIVL

SEQ ID NO: 140090 - protein, 10 aa, Artificial Sequence
  Description of Artificial Sequence: Synthetic peptide
  Seed: GPLLDGTATL (PMEL_HUMAN)
GELLDGTATI

SEQ ID NO: 140091 - protein, 10 aa, Artificial Sequence
  Description of Artificial Sequence: Synthetic peptide
  Seed: SVTLDIVQGI (PMEL_HUMAN)
SRTLDIVQGV

SEQ ID NO: 140092 - protein, 9 aa, Artificial Sequence
  Description of Artificial Sequence: Synthetic peptide
  Seed: VTLDIVQGI (PMEL_HUMAN)
VLLDIVQGT

SEQ ID NO: 140093 - protein, 9 aa, Artificial Sequence
  Description of Artificial Sequence: Synthetic peptide
  Seed: MTPAEVSIV (PMEL_HUMAN)
MQPAEVSIV

SEQ ID NO: 140094 - protein, 11 aa, Artificial Sequence
  Description of Artificial Sequence: Synthetic peptide
  Seed: MAVVLASLIYR (PMEL_HUMAN)
MCVVLASLIYR

SEQ ID NO: 140095 - protein, 8 aa, Artificial Sequence
  Description of Artificial Sequence: Synthetic peptide
  Seed: MAVVLASL (PMEL_HUMAN)
MQVVLASV

SEQ ID NO: 140096 - protein, 9 aa, Artificial Sequence
  Description of Artificial Sequence: Synthetic peptide
  Seed: VVLSGTTAA (PMEL_HUMAN)
VILSGTTAV

SEQ ID NO: 140097 - protein, 10 aa, Artificial Sequence
  Description of Artificial Sequence: Synthetic peptide
  Seed: GPLLDGTATL (PMEL_HUMAN)
GALLDGTATL

SEQ ID NO: 140098 - protein, 9 aa, Artificial Sequence
  Description of Artificial Sequence: Synthetic peptide
  Seed: VLPDGQVIW (PMEL_HUMAN)
VMPDGQVIY

SEQ ID NO: 140099 - protein, 9 aa, Artificial Sequence
  Description of Artificial Sequence: Synthetic peptide
  Seed: TPEATGMTP (PMEL_HUMAN)
TPEATGMTA

SEQ ID NO: 140100 - protein, 9 aa, Artificial Sequence
  Description of Artificial Sequence: Synthetic peptide
  Seed: QVIWVNNTI (PMEL_HUMAN)
QTIWVNNTY

SEQ ID NO: 140101 - protein, 9 aa, Artificial Sequence
  Description of Artificial Sequence: Synthetic peptide
  Seed: RALDGGNKH (PMEL_HUMAN)
RALDGGNKV

SEQ ID NO: 140102 - protein, 9 aa, Artificial Sequence
  Description of Artificial Sequence: Synthetic peptide
  Seed: RNQPLTFAL (PMEL_HUMAN)
RSQPLTFAI

SEQ ID NO: 140103 - protein, 9 aa, Artificial Sequence
  Description of Artificial Sequence: Synthetic peptide
  Seed: TTAAQVTTT (PMEL_HUMAN)
TIAAQVTTV

SEQ ID NO: 140104 - protein, 9 aa, Artificial Sequence
  Description of Artificial Sequence: Synthetic peptide
  Seed: RNQPLTFAL (PMEL_HUMAN)
RLQPLTFAL

SEQ ID NO: 140105 - protein, 11 aa, Artificial Sequence
  Description of Artificial Sequence: Synthetic peptide
  Seed: FTITDQVPFSV (PMEL_HUMAN)
FLITDQVPFSL

SEQ ID NO: 140106 - protein, 9 aa, Artificial Sequence
  Description of Artificial Sequence: Synthetic peptide
  Seed: GQVPLIVGI (PMEL_HUMAN)
GLVPLIVGM

SEQ ID NO: 140107 - protein, 9 aa, Artificial Sequence
  Description of Artificial Sequence: Synthetic peptide
  Seed: VLKRCLLHL (PMEL_HUMAN)
VSKRCLLHY

SEQ ID NO: 140108 - protein, 10 aa, Artificial Sequence
  Description of Artificial Sequence: Synthetic peptide
  Seed: ALLAVGATKV (PMEL_HUMAN)
ALLAVGATKL

SEQ ID NO: 140109 - protein, 10 aa, Artificial Sequence
  Description of Artificial Sequence: Synthetic peptide
  Seed: IFPDGGPCPS (PMEL_HUMAN)
IMPDGGPCPL

SEQ ID NO: 140110 - protein, 11 aa, Artificial Sequence
  Description of Artificial Sequence: Synthetic peptide
  Seed: RYGSFSVTLDI (PMEL_HUMAN)
RVGSFSVTLDW

SEQ ID NO: 140111 - protein, 9 aa, Artificial Sequence
  Description of Artificial Sequence: Synthetic peptide
  Seed: ILKGGSGTY (PMEL_HUMAN)
IVKGGSGTY

SEQ ID NO: 140112 - protein, 9 aa, Artificial Sequence
  Description of Artificial Sequence: Synthetic peptide
  Seed: LMAVVLASL (PMEL_HUMAN)
LIAVVLASL

SEQ ID NO: 140113 - protein, 9 aa, Artificial Sequence
  Description of Artificial Sequence: Synthetic peptide
  Seed: LSIGTGRAM (PMEL_HUMAN)
LSIGTGRAY

SEQ ID NO: 140114 - protein, 11 aa, Artificial Sequence
  Description of Artificial Sequence: Synthetic peptide
  Seed: RYGSFSVTLDI (PMEL_HUMAN)
RQGSFSVTLDY

SEQ ID NO: 140115 - protein, 10 aa, Artificial Sequence
  Description of Artificial Sequence: Synthetic peptide
  Seed: SQKRSFVYVW (PMEL_HUMAN)
SNKRSFVYVY

SEQ ID NO: 140116 - protein, 9 aa, Artificial Sequence
  Description of Artificial Sequence: Synthetic peptide
  Seed: ALLAVGATK (PMEL_HUMAN)
AVLAVGATL

SEQ ID NO: 140117 - protein, 9 aa, Artificial Sequence
  Description of Artificial Sequence: Synthetic peptide
  Seed: MLGTHTMEV (PMEL_HUMAN)
MGGTHTMEM

SEQ ID NO: 140118 - protein, 9 aa, Artificial Sequence
  Description of Artificial Sequence: Synthetic peptide
  Seed: TTPGQAPTA (PMEL_HUMAN)
TCPGQAPTL

SEQ ID NO: 140119 - protein, 9 aa, Artificial Sequence
  Description of Artificial Sequence: Synthetic peptide
  Seed: LIVGILLVL (PMEL_HUMAN)
LMVGILLVT

SEQ ID NO: 140120 - protein, 9 aa, Artificial Sequence
  Description of Artificial Sequence: Synthetic peptide
  Seed: VQVPTTEVI (PMEL_HUMAN)
VFVPTTEVM

SEQ ID NO: 140121 - protein, 9 aa, Artificial Sequence
  Description of Artificial Sequence: Synthetic peptide
  Seed: VQMPTAEST (PMEL_HUMAN)
VHMPTAEST

SEQ ID NO: 140122 - protein, 9 aa, Artificial Sequence
  Description of Artificial Sequence: Synthetic peptide
  Seed: ANASFSIAL (PMEL_HUMAN)
AQASFSIAH

SEQ ID NO: 140123 - protein, 9 aa, Artificial Sequence
  Description of Artificial Sequence: Synthetic peptide
  Seed: AEMSTPEAT (PMEL_HUMAN)
AEMSTPEAA

SEQ ID NO: 140124 - protein, 10 aa, Artificial Sequence
  Description of Artificial Sequence: Synthetic peptide
  Seed: MPTAESTGMT (PMEL_HUMAN)
MITAESTGML

SEQ ID NO: 140125 - protein, 9 aa, Artificial Sequence
  Description of Artificial Sequence: Synthetic peptide
  Seed: RSYVPLAHS (PMEL_HUMAN)
RVYVPLAHK

SEQ ID NO: 140126 - protein, 9 aa, Artificial Sequence
  Description of Artificial Sequence: Synthetic peptide
  Seed: AGQVPTTEV (PMEL_HUMAN)
AGQVPTTEF

SEQ ID NO: 140127 - protein, 10 aa, Artificial Sequence
  Description of Artificial Sequence: Synthetic peptide
  Seed: KVLPDGQVIW (PMEL_HUMAN)
KLLPDGQVIW

SEQ ID NO: 140128 - protein, 9 aa, Artificial Sequence
  Description of Artificial Sequence: Synthetic peptide
  Seed: SSHWLRLPR (PMEL_HUMAN)
STHWLRLPA

SEQ ID NO: 140129 - protein, 9 aa, Artificial Sequence
  Description of Artificial Sequence: Synthetic peptide
  Seed: ILKGGSGTY (PMEL_HUMAN)
IWKGGSGTF

SEQ ID NO: 140130 - protein, 11 aa, Artificial Sequence
  Description of Artificial Sequence: Synthetic peptide
  Seed: YLAEADLSYTW (PMEL_HUMAN)
YLAEADLSYTV

SEQ ID NO: 140131 - protein, 10 aa, Artificial Sequence
  Description of Artificial Sequence: Synthetic peptide
  Seed: RYGSFSVTLD (PMEL_HUMAN)
RYGSFSVTLM

SEQ ID NO: 140132 - protein, 11 aa, Artificial Sequence
  Description of Artificial Sequence: Synthetic peptide
  Seed: ITDQVPFSVSV (PMEL_HUMAN)
IVDQVPFSVSM

SEQ ID NO: 140133 - protein, 9 aa, Artificial Sequence
  Description of Artificial Sequence: Synthetic peptide
  Seed: TTPGQAPTA (PMEL_HUMAN)
TSPGQAPTV

SEQ ID NO: 140134 - protein, 9 aa, Artificial Sequence
  Description of Artificial Sequence: Synthetic peptide
  Seed: RQVPLDCVL (PMEL_HUMAN)
RQVPLDCVI

SEQ ID NO: 140135 - protein, 9 aa, Artificial Sequence
  Description of Artificial Sequence: Synthetic peptide
  Seed: RTKAWNRQL (PMEL_HUMAN)
RSKAWNRQR

SEQ ID NO: 140136 - protein, 10 aa, Artificial Sequence
  Description of Artificial Sequence: Synthetic peptide
  Seed: KVSNDGPTLI (PMEL_HUMAN)
KASNDGPTLW

SEQ ID NO: 140137 - protein, 9 aa, Artificial Sequence
  Description of Artificial Sequence: Synthetic peptide
  Seed: LTSCGSSPV (PMEL_HUMAN)
LLSCGSSPA

SEQ ID NO: 140138 - protein, 10 aa, Artificial Sequence
  Description of Artificial Sequence: Synthetic peptide
  Seed: GSRSYVPLAH (PMEL_HUMAN)
GQRSYVPLAK

SEQ ID NO: 140139 - protein, 10 aa, Artificial Sequence
  Description of Artificial Sequence: Synthetic peptide
  Seed: RQLYPEWTEA (PMEL_HUMAN)
RCLYPEWTEY

SEQ ID NO: 140140 - protein, 9 aa, Artificial Sequence
  Description of Artificial Sequence: Synthetic peptide
  Seed: VVLQAAIPL (PMEL_HUMAN)
VLLQAAIPY

SEQ ID NO: 140141 - protein, 10 aa, Artificial Sequence
  Description of Artificial Sequence: Synthetic peptide
  Seed: YRYGSFSVTL (PMEL_HUMAN)
YPYGSFSVTL

SEQ ID NO: 140142 - protein, 11 aa, Artificial Sequence
  Description of Artificial Sequence: Synthetic peptide
  Seed: RRGSRSYVPLA (PMEL_HUMAN)
RAGSRSYVPLA

SEQ ID NO: 140143 - protein, 10 aa, Artificial Sequence
  Description of Artificial Sequence: Synthetic peptide
  Seed: MTPAEVSIVV (PMEL_HUMAN)
MCPAEVSIVM

SEQ ID NO: 140144 - protein, 9 aa, Artificial Sequence
  Description of Artificial Sequence: Synthetic peptide
  Seed: DSSGTLISR (PMEL_HUMAN)
DASGTLISK

SEQ ID NO: 140145 - protein, 10 aa, Artificial Sequence
  Description of Artificial Sequence: Synthetic peptide
  Seed: VLMAVVLASL (PMEL_HUMAN)
VTMAVVLASI

SEQ ID NO: 140146 - protein, 9 aa, Artificial Sequence
  Description of Artificial Sequence: Synthetic peptide
  Seed: YWQVLGGPV (PMEL_HUMAN)
YFQVLGGPY

SEQ ID NO: 140147 - protein, 9 aa, Artificial Sequence
  Description of Artificial Sequence: Synthetic peptide
  Seed: AAQVTTTEW (PMEL_HUMAN)
ATQVTTTEF

SEQ ID NO: 140148 - protein, 10 aa, Artificial Sequence
  Description of Artificial Sequence: Synthetic peptide
  Seed: LAVIGALLAV (PMEL_HUMAN)
LLVIGALLAA

SEQ ID NO: 140149 - protein, 9 aa, Artificial Sequence
  Description of Artificial Sequence: Synthetic peptide
  Seed: GQVPTTEVV (PMEL_HUMAN)
GEVPTTEVA

SEQ ID NO: 140150 - protein, 9 aa, Artificial Sequence
  Description of Artificial Sequence: Synthetic peptide
  Seed: VPLDCVLYR (PMEL_HUMAN)
VVLDCVLYR

SEQ ID NO: 140151 - protein, 10 aa, Artificial Sequence
  Description of Artificial Sequence: Synthetic peptide
  Seed: VSLADTNSLA (PMEL_HUMAN)
VWLADTNSLI

SEQ ID NO: 140152 - protein, 10 aa, Artificial Sequence
  Description of Artificial Sequence: Synthetic peptide
  Seed: YRYGSFSVTL (PMEL_HUMAN)
YVYGSFSVTM

SEQ ID NO: 140153 - protein, 9 aa, Artificial Sequence
  Description of Artificial Sequence: Synthetic peptide
  Seed: GSFSVTLDI (PMEL_HUMAN)
GQFSVTLDL

SEQ ID NO: 140154 - protein, 9 aa, Artificial Sequence
  Description of Artificial Sequence: Synthetic peptide
  Seed: AVIGALLAV (PMEL_HUMAN)
APIGALLAS

SEQ ID NO: 140155 - protein, 10 aa, Artificial Sequence
  Description of Artificial Sequence: Synthetic peptide
  Seed: HFLRNQPLTF (PMEL_HUMAN)
HYLRNQPLTM

SEQ ID NO: 140156 - protein, 8 aa, Artificial Sequence
  Description of Artificial Sequence: Synthetic peptide
  Seed: TLDIVQGI (PMEL_HUMAN)
TIDIVQGM

SEQ ID NO: 140157 - protein, 10 aa, Artificial Sequence
  Description of Artificial Sequence: Synthetic peptide
  Seed: SSSHWLRLPR (PMEL_HUMAN)
SLSHWLRLPK

SEQ ID NO: 140158 - protein, 9 aa, Artificial Sequence
  Description of Artificial Sequence: Synthetic peptide
  Seed: FTITDQVPF (PMEL_HUMAN)
FCITDQVPM

SEQ ID NO: 140159 - protein, 11 aa, Artificial Sequence
  Description of Artificial Sequence: Synthetic peptide
  Seed: RRRLMKQDFSV (PMEL_HUMAN)
RARLMKQDFSV

SEQ ID NO: 140160 - protein, 10 aa, Artificial Sequence
  Description of Artificial Sequence: Synthetic peptide
  Seed: LLDGTATLRL (PMEL_HUMAN)
LLDGTATLRV

SEQ ID NO: 140161 - protein, 9 aa, Artificial Sequence
  Description of Artificial Sequence: Synthetic peptide
  Seed: IVVLSGTTA (PMEL_HUMAN)
ITVLSGTTF

SEQ ID NO: 140162 - protein, 10 aa, Artificial Sequence
  Description of Artificial Sequence: Synthetic peptide
  Seed: MKQDFSVPQL (PMEL_HUMAN)
MMQDFSVPQL

SEQ ID NO: 140163 - protein, 9 aa, Artificial Sequence
  Description of Artificial Sequence: Synthetic peptide
  Seed: TTDGHRPTA (PMEL_HUMAN)
TIDGHRPTF

SEQ ID NO: 140164 - protein, 9 aa, Artificial Sequence
  Description of Artificial Sequence: Synthetic peptide
  Seed: VLGGPVSGL (PMEL_HUMAN)
VQGGPVSGV

SEQ ID NO: 140165 - protein, 9 aa, Artificial Sequence
  Description of Artificial Sequence: Synthetic peptide
  Seed: SVQVPTTEV (PMEL_HUMAN)
SIQVPTTEL

SEQ ID NO: 140166 - protein, 8 aa, Artificial Sequence
  Description of Artificial Sequence: Synthetic peptide
  Seed: SNDGPTLI (PMEL_HUMAN)
SWDGPTLF

SEQ ID NO: 140167 - protein, 9 aa, Artificial Sequence
  Description of Artificial Sequence: Synthetic peptide
  Seed: VVLASLIYR (PMEL_HUMAN)
VQLASLIYR

SEQ ID NO: 140168 - protein, 10 aa, Artificial Sequence
  Description of Artificial Sequence: Synthetic peptide
  Seed: SQVWGGQPVY (PMEL_HUMAN)
SQVWGGQPVF

SEQ ID NO: 140169 - protein, 9 aa, Artificial Sequence
  Description of Artificial Sequence: Synthetic peptide
  Seed: TPAEVSIVV (PMEL_HUMAN)
TVAEVSIVM

SEQ ID NO: 140170 - protein, 10 aa, Artificial Sequence
  Description of Artificial Sequence: Synthetic peptide
  Seed: VSLADTNSLA (PMEL_HUMAN)
VDLADTNSLI

SEQ ID NO: 140171 - protein, 8 aa, Artificial Sequence
  Description of Artificial Sequence: Synthetic peptide
  Seed: SHWLRLPR (PMEL_HUMAN)
SWWLRLPR

SEQ ID NO: 140172 - protein, 11 aa, Artificial Sequence
  Description of Artificial Sequence: Synthetic peptide
  Seed: RYGSFSVTLDI (PMEL_HUMAN)
RSGSFSVTLDW

SEQ ID NO: 140173 - protein, 10 aa, Artificial Sequence
  Description of Artificial Sequence: Synthetic peptide
  Seed: YRYGSFSVTL (PMEL_HUMAN)
YQYGSFSVTG

SEQ ID NO: 140174 - protein, 10 aa, Artificial Sequence
  Description of Artificial Sequence: Synthetic peptide
  Seed: QVPLDCVLYR (PMEL_HUMAN)
QQPLDCVLYR

SEQ ID NO: 140175 - protein, 11 aa, Artificial Sequence
  Description of Artificial Sequence: Synthetic peptide
  Seed: AEMSTPEATGM (PMEL_HUMAN)
ALMSTPEATGY

SEQ ID NO: 140176 - protein, 9 aa, Artificial Sequence
  Description of Artificial Sequence: Synthetic peptide
  Seed: KQDFSVPQL (PMEL_HUMAN)
KWDFSVPQM

SEQ ID NO: 140177 - protein, 9 aa, Artificial Sequence
  Description of Artificial Sequence: Synthetic peptide
  Seed: MEVTVYHRR (PMEL_HUMAN)
MYVTVYHRR

SEQ ID NO: 140178 - protein, 10 aa, Artificial Sequence
  Description of Artificial Sequence: Synthetic peptide
  Seed: YVPLAHSSSA (PMEL_HUMAN)
YWPLAHSSSV

SEQ ID NO: 140179 - protein, 11 aa, Artificial Sequence
  Description of Artificial Sequence: Synthetic peptide
  Seed: QAVPSGEGDAF (PMEL_HUMAN)
QLVPSGEGDAF

SEQ ID NO: 140180 - protein, 10 aa, Artificial Sequence
  Description of Artificial Sequence: Synthetic peptide
  Seed: RALDGGNKHF (PMEL_HUMAN)
RILDGGNKHR

SEQ ID NO: 140181 - protein, 10 aa, Artificial Sequence
  Description of Artificial Sequence: Synthetic peptide
  Seed: TAAQVTTTEW (PMEL_HUMAN)
TVAQVTTTEF

SEQ ID NO: 140182 - protein, 10 aa, Artificial Sequence
  Description of Artificial Sequence: Synthetic peptide
  Seed: SSSHWLRLPR (PMEL_HUMAN)
SESHWLRLPK

SEQ ID NO: 140183 - protein, 10 aa, Artificial Sequence
  Description of Artificial Sequence: Synthetic peptide
  Seed: RQLYPEWTEA (PMEL_HUMAN)
RSLYPEWTEY

SEQ ID NO: 140184 - protein, 10 aa, Artificial Sequence
  Description of Artificial Sequence: Synthetic peptide
  Seed: RQVPLDCVLY (PMEL_HUMAN)
RVVPLDCVLW

SEQ ID NO: 140185 - protein, 9 aa, Artificial Sequence
  Description of Artificial Sequence: Synthetic peptide
  Seed: LIYRRRLMK (PMEL_HUMAN)
LLYRRRLMR

SEQ ID NO: 140186 - protein, 9 aa, Artificial Sequence
  Description of Artificial Sequence: Synthetic peptide
  Seed: TDQVPFSVS (PMEL_HUMAN)
TEQVPFSVI

SEQ ID NO: 140187 - protein, 9 aa, Artificial Sequence
  Description of Artificial Sequence: Synthetic peptide
  Seed: RSYVPLAHS (PMEL_HUMAN)
RIYVPLAHK

SEQ ID NO: 140188 - protein, 9 aa, Artificial Sequence
  Description of Artificial Sequence: Synthetic peptide
  Seed: ANASFSIAL (PMEL_HUMAN)
AQASFSIAW

SEQ ID NO: 140189 - protein, 9 aa, Artificial Sequence
  Description of Artificial Sequence: Synthetic peptide
  Seed: GQVPLIVGI (PMEL_HUMAN)
GRVPLIVGL

SEQ ID NO: 140190 - protein, 10 aa, Artificial Sequence
  Description of Artificial Sequence: Synthetic peptide
  Seed: LAVIGALLAV (PMEL_HUMAN)
LDVIGALLAI

SEQ ID NO: 140191 - protein, 9 aa, Artificial Sequence
  Description of Artificial Sequence: Synthetic peptide
  Seed: VSEVMGTTL (PMEL_HUMAN)
VAEVMGTTW

SEQ ID NO: 140192 - protein, 9 aa, Artificial Sequence
  Description of Artificial Sequence: Synthetic peptide
  Seed: EGPDASSIM (PMEL_HUMAN)
EAPDASSIL

SEQ ID NO: 140193 - protein, 10 aa, Artificial Sequence
  Description of Artificial Sequence: Synthetic peptide
  Seed: YVPLAHSSSA (PMEL_HUMAN)
YSPLAHSSSV

SEQ ID NO: 140194 - protein, 9 aa, Artificial Sequence
  Description of Artificial Sequence: Synthetic peptide
  Seed: RLVKRQVPL (PMEL_HUMAN)
RMVKRQVPA

SEQ ID NO: 140195 - protein, 9 aa, Artificial Sequence
  Description of Artificial Sequence: Synthetic peptide
  Seed: SLIYRRRLM (PMEL_HUMAN)
SLIYRRRLL

SEQ ID NO: 140196 - protein, 9 aa, Artificial Sequence
  Description of Artificial Sequence: Synthetic peptide
  Seed: SLGPLLDGT (PMEL_HUMAN)
SQGPLLDGV

SEQ ID NO: 140197 - protein, 10 aa, Artificial Sequence
  Description of Artificial Sequence: Synthetic peptide
  Seed: LLVLMAVVLA (PMEL_HUMAN)
LMVLMAVVLV

SEQ ID NO: 140198 - protein, 9 aa, Artificial Sequence
  Description of Artificial Sequence: Synthetic peptide
  Seed: VVLSGTTAA (PMEL_HUMAN)
VPLSGTTAF

SEQ ID NO: 140199 - protein, 9 aa, Artificial Sequence
  Description of Artificial Sequence: Synthetic peptide
  Seed: ESAEILQAV (PMEL_HUMAN)
EGAEILQAK

SEQ ID NO: 140200 - protein, 11 aa, Artificial Sequence
  Description of Artificial Sequence: Synthetic peptide
  Seed: FGDSSGTLISR (PMEL_HUMAN)
FQDSSGTLISL

SEQ ID NO: 140201 - protein, 9 aa, Artificial Sequence
  Description of Artificial Sequence: Synthetic peptide
  Seed: GTYCLNVSL (PMEL_HUMAN)
GVYCLNVSL

SEQ ID NO: 140202 - protein, 10 aa, Artificial Sequence
  Description of Artificial Sequence: Synthetic peptide
  Seed: MAVVLASLIY (PMEL_HUMAN)
MIVVLASLIY

SEQ ID NO: 140203 - protein, 9 aa, Artificial Sequence
  Description of Artificial Sequence: Synthetic peptide
  Seed: VSLADTNSL (PMEL_HUMAN)
VQLADTNSY

SEQ ID NO: 140204 - protein, 9 aa, Artificial Sequence
  Description of Artificial Sequence: Synthetic peptide
  Seed: ANASFSIAL (PMEL_HUMAN)
AMASFSIAH

SEQ ID NO: 140205 - protein, 9 aa, Artificial Sequence
  Description of Artificial Sequence: Synthetic peptide
  Seed: RTKAWNRQL (PMEL_HUMAN)
RMKAWNRQK

SEQ ID NO: 140206 - protein, 9 aa, Artificial Sequence
  Description of Artificial Sequence: Synthetic peptide
  Seed: GILLVLMAV (PMEL_HUMAN)
GMLLVLMAL

SEQ ID NO: 140207 - protein, 9 aa, Artificial Sequence
  Description of Artificial Sequence: Synthetic peptide
  Seed: YLAEADLSY (PMEL_HUMAN)
YQAEADLSH

SEQ ID NO: 140208 - protein, 9 aa, Artificial Sequence
  Description of Artificial Sequence: Synthetic peptide
  Seed: TVYHRRGSR (PMEL_HUMAN)
TSYHRRGSK

SEQ ID NO: 140209 - protein, 9 aa, Artificial Sequence
  Description of Artificial Sequence: Synthetic peptide
  Seed: LNFPGSQKV (PMEL_HUMAN)
LLFPGSQKA

SEQ ID NO: 140210 - protein, 11 aa, Artificial Sequence
  Description of Artificial Sequence: Synthetic peptide
  Seed: KAWNRQLYPEW (PMEL_HUMAN)
KSWNRQLYPEF

SEQ ID NO: 140211 - protein, 11 aa, Artificial Sequence
  Description of Artificial Sequence: Synthetic peptide
  Seed: FSVTLDIVQGI (PMEL_HUMAN)
FTVTLDIVQGV

SEQ ID NO: 140212 - protein, 9 aa, Artificial Sequence
  Description of Artificial Sequence: Synthetic peptide
  Seed: LIVGILLVL (PMEL_HUMAN)
LLVGILLVA

SEQ ID NO: 140213 - protein, 9 aa, Artificial Sequence
  Description of Artificial Sequence: Synthetic peptide
  Seed: LIVGILLVL (PMEL_HUMAN)
LLVGILLVI

SEQ ID NO: 140214 - protein, 10 aa, Artificial Sequence
  Description of Artificial Sequence: Synthetic peptide
  Seed: MTPAEVSIVV (PMEL_HUMAN)
MLPAEVSIVH

SEQ ID NO: 140215 - protein, 10 aa, Artificial Sequence
  Description of Artificial Sequence: Synthetic peptide
  Seed: RGSRSYVPLA (PMEL_HUMAN)
RFSRSYVPLK

SEQ ID NO: 140216 - protein, 9 aa, Artificial Sequence
  Description of Artificial Sequence: Synthetic peptide
  Seed: LMAVVLASL (PMEL_HUMAN)
LHAVVLASM

SEQ ID NO: 140217 - protein, 10 aa, Artificial Sequence
  Description of Artificial Sequence: Synthetic peptide
  Seed: YVPLAHSSSA (PMEL_HUMAN)
YCPLAHSSSL

SEQ ID NO: 140218 - protein, 9 aa, Artificial Sequence
  Description of Artificial Sequence: Synthetic peptide
  Seed: RLMKQDFSV (PMEL_HUMAN)
RIMKQDFSI

SEQ ID NO: 140219 - protein, 9 aa, Artificial Sequence
  Description of Artificial Sequence: Synthetic peptide
  Seed: ILKGGSGTY (PMEL_HUMAN)
IMKGGSGTF

SEQ ID NO: 140220 - protein, 10 aa, Artificial Sequence
  Description of Artificial Sequence: Synthetic peptide
  Seed: NASFSIALNF (PMEL_HUMAN)
NHSFSIALNW

SEQ ID NO: 140221 - protein, 9 aa, Artificial Sequence
  Description of Artificial Sequence: Synthetic peptide
  Seed: MAVVLASLI (PMEL_HUMAN)
MMVVLASLI

SEQ ID NO: 140222 - protein, 10 aa, Artificial Sequence
  Description of Artificial Sequence: Synthetic peptide
  Seed: GSRSYVPLAH (PMEL_HUMAN)
GMRSYVPLAK

SEQ ID NO: 140223 - protein, 8 aa, Artificial Sequence
  Description of Artificial Sequence: Synthetic peptide
  Seed: FGDSSGTL (PMEL_HUMAN)
FWDSSGTM

SEQ ID NO: 140224 - protein, 9 aa, Artificial Sequence
  Description of Artificial Sequence: Synthetic peptide
  Seed: TAPVQMPTA (PMEL_HUMAN)
TAPVQMPTL

SEQ ID NO: 140225 - protein, 10 aa, Artificial Sequence
  Description of Artificial Sequence: Synthetic peptide
  Seed: FLRNQPLTFA (PMEL_HUMAN)
FLRNQPLTFL

SEQ ID NO: 140226 - protein, 11 aa, Artificial Sequence
  Description of Artificial Sequence: Synthetic peptide
  Seed: LGPLLDGTATL (PMEL_HUMAN)
LFPLLDGTATV

SEQ ID NO: 140227 - protein, 9 aa, Artificial Sequence
  Description of Artificial Sequence: Synthetic peptide
  Seed: STAPVQMPT (PMEL_HUMAN)
SNAPVQMPV

SEQ ID NO: 140228 - protein, 11 aa, Artificial Sequence
  Description of Artificial Sequence: Synthetic peptide
  Seed: RQVPLDCVLYR (PMEL_HUMAN)
RMVPLDCVLYR

SEQ ID NO: 140229 - protein, 10 aa, Artificial Sequence
  Description of Artificial Sequence: Synthetic peptide
  Seed: MTPAEVSIVV (PMEL_HUMAN)
MYPAEVSIVW

SEQ ID NO: 140230 - protein, 10 aa, Artificial Sequence
  Description of Artificial Sequence: Synthetic peptide
  Seed: TMEVTVYHRR (PMEL_HUMAN)
TAEVTVYHRR

SEQ ID NO: 140231 - protein, 10 aa, Artificial Sequence
  Description of Artificial Sequence: Synthetic peptide
  Seed: AVIGALLAVG (PMEL_HUMAN)
AMIGALLAVA

SEQ ID NO: 140232 - protein, 9 aa, Artificial Sequence
  Description of Artificial Sequence: Synthetic peptide
  Seed: RQVPLDCVL (PMEL_HUMAN)
RQVPLDCVV

SEQ ID NO: 140233 - protein, 9 aa, Artificial Sequence
  Description of Artificial Sequence: Synthetic peptide
  Seed: SAFTITDQV (PMEL_HUMAN)
SQFTITDQI

SEQ ID NO: 140234 - protein, 10 aa, Artificial Sequence
  Description of Artificial Sequence: Synthetic peptide
  Seed: LMAVVLASLI (PMEL_HUMAN)
LMAVVLASLN

SEQ ID NO: 140235 - protein, 9 aa, Artificial Sequence
  Description of Artificial Sequence: Synthetic peptide
  Seed: YLAEADLSY (PMEL_HUMAN)
YAAEADLSH

SEQ ID NO: 140236 - protein, 10 aa, Artificial Sequence
  Description of Artificial Sequence: Synthetic peptide
  Seed: EVISTAPVQM (PMEL_HUMAN)
ETISTAPVQV

SEQ ID NO: 140237 - protein, 10 aa, Artificial Sequence
  Description of Artificial Sequence: Synthetic peptide
  Seed: VVLASLIYRR (PMEL_HUMAN)
VQLASLIYRK

SEQ ID NO: 140238 - protein, 9 aa, Artificial Sequence
  Description of Artificial Sequence: Synthetic peptide
  Seed: SAFTITDQV (PMEL_HUMAN)
SVFTITDQI

SEQ ID NO: 140239 - protein, 9 aa, Artificial Sequence
  Description of Artificial Sequence: Synthetic peptide
  Seed: LADTNSLAV (PMEL_HUMAN)
LNDTNSLAV

SEQ ID NO: 140240 - protein, 11 aa, Artificial Sequence
  Description of Artificial Sequence: Synthetic peptide
  Seed: FGDSSGTLISR (PMEL_HUMAN)
FSDSSGTLISY

SEQ ID NO: 140241 - protein, 10 aa, Artificial Sequence
  Description of Artificial Sequence: Synthetic peptide
  Seed: MTPAEVSIVV (PMEL_HUMAN)
MKPAEVSIVH

SEQ ID NO: 140242 - protein, 9 aa, Artificial Sequence
  Description of Artificial Sequence: Synthetic peptide
  Seed: HLAVIGALL (PMEL_HUMAN)
HTAVIGALL

SEQ ID NO: 140243 - protein, 10 aa, Artificial Sequence
  Description of Artificial Sequence: Synthetic peptide
  Seed: LAEADLSYTW (PMEL_HUMAN)
LKEADLSYTW

SEQ ID NO: 140244 - protein, 9 aa, Artificial Sequence
  Description of Artificial Sequence: Synthetic peptide
  Seed: TTDGHRPTA (PMEL_HUMAN)
TQDGHRPTI

SEQ ID NO: 140245 - protein, 10 aa, Artificial Sequence
  Description of Artificial Sequence: Synthetic peptide
  Seed: SVPQLPHSSS (PMEL_HUMAN)
SFPQLPHSSM

SEQ ID NO: 140246 - protein, 9 aa, Artificial Sequence
  Description of Artificial Sequence: Synthetic peptide
  Seed: IYRRRLMKQ (PMEL_HUMAN)
ITRRRLMKA

SEQ ID NO: 140247 - protein, 11 aa, Artificial Sequence
  Description of Artificial Sequence: Synthetic peptide
  Seed: YLEPGPVTAQV (PMEL_HUMAN)
YMEPGPVTAQL

SEQ ID NO: 140248 - protein, 9 aa, Artificial Sequence
  Description of Artificial Sequence: Synthetic peptide
  Seed: KHFLRNQPL (PMEL_HUMAN)
KQFLRNQPA

SEQ ID NO: 140249 - protein, 10 aa, Artificial Sequence
  Description of Artificial Sequence: Synthetic peptide
  Seed: KTWGQYWQVL (PMEL_HUMAN)
KMWGQYWQVV

SEQ ID NO: 140250 - protein, 9 aa, Artificial Sequence
  Description of Artificial Sequence: Synthetic peptide
  Seed: FELTVSCQG (PMEL_HUMAN)
FELTVSCQA

SEQ ID NO: 140251 - protein, 9 aa, Artificial Sequence
  Description of Artificial Sequence: Synthetic peptide
  Seed: VSVSQLRAL (PMEL_HUMAN)
VRVSQLRAL

SEQ ID NO: 140252 - protein, 9 aa, Artificial Sequence
  Description of Artificial Sequence: Synthetic peptide
  Seed: ALVVTHTYL (PMEL_HUMAN)
AQVVTHTYM

SEQ ID NO: 140253 - protein, 9 aa, Artificial Sequence
  Description of Artificial Sequence: Synthetic peptide
  Seed: WQVLGGPVS (PMEL_HUMAN)
WMVLGGPVM

SEQ ID NO: 140254 - protein, 9 aa, Artificial Sequence
  Description of Artificial Sequence: Synthetic peptide
  Seed: VLMAVVLAS (PMEL_HUMAN)
VQMAVVLAT

SEQ ID NO: 140255 - protein, 9 aa, Artificial Sequence
  Description of Artificial Sequence: Synthetic peptide
  Seed: QPVLPSPAC (PMEL_HUMAN)
QAVLPSPAF

SEQ ID NO: 140256 - protein, 9 aa, Artificial Sequence
  Description of Artificial Sequence: Synthetic peptide
  Seed: GSRSYVPLA (PMEL_HUMAN)
GNRSYVPLK

SEQ ID NO: 140257 - protein, 10 aa, Artificial Sequence
  Description of Artificial Sequence: Synthetic peptide
  Seed: VPQLPHSSSH (PMEL_HUMAN)
VMQLPHSSSM

SEQ ID NO: 140258 - protein, 9 aa, Artificial Sequence
  Description of Artificial Sequence: Synthetic peptide
  Seed: MTPEKVPVS (PMEL_HUMAN)
MVPEKVPVM

SEQ ID NO: 140259 - protein, 9 aa, Artificial Sequence
  Description of Artificial Sequence: Synthetic peptide
  Seed: AQVVLQAAI (PMEL_HUMAN)
AHVVLQAAV

SEQ ID NO: 140260 - protein, 10 aa, Artificial Sequence
  Description of Artificial Sequence: Synthetic peptide
  Seed: GPLLDGTATL (PMEL_HUMAN)
GRLLDGTATM

SEQ ID NO: 140261 - protein, 9 aa, Artificial Sequence
  Description of Artificial Sequence: Synthetic peptide
  Seed: YLAEADLSY (PMEL_HUMAN)
YHAEADLSM

SEQ ID NO: 140262 - protein, 10 aa, Artificial Sequence
  Description of Artificial Sequence: Synthetic peptide
  Seed: KRQVPLDCVL (PMEL_HUMAN)
KHQVPLDCVF

SEQ ID NO: 140263 - protein, 11 aa, Artificial Sequence
  Description of Artificial Sequence: Synthetic peptide
  Seed: KVLPDGQVIWV (PMEL_HUMAN)
KVLPDGQVIWF

SEQ ID NO: 140264 - protein, 10 aa, Artificial Sequence
  Description of Artificial Sequence: Synthetic peptide
  Seed: VLMAVVLASL (PMEL_HUMAN)
VLMAVVLASF

SEQ ID NO: 140265 - protein, 9 aa, Artificial Sequence
  Description of Artificial Sequence: Synthetic peptide
  Seed: AVIGALLAV (PMEL_HUMAN)
AEIGALLAY

SEQ ID NO: 140266 - protein, 10 aa, Artificial Sequence
  Description of Artificial Sequence: Synthetic peptide
  Seed: TLISRALVVT (PMEL_HUMAN)
TLISRALVVV

SEQ ID NO: 140267 - protein, 9 aa, Artificial Sequence
  Description of Artificial Sequence: Synthetic peptide
  Seed: AGLGQVPLI (PMEL_HUMAN)
AMLGQVPLV

SEQ ID NO: 140268 - protein, 11 aa, Artificial Sequence
  Description of Artificial Sequence: Synthetic peptide
  Seed: FGDSSGTLISR (PMEL_HUMAN)
FGDSSGTLISF

SEQ ID NO: 140269 - protein, 9 aa, Artificial Sequence
  Description of Artificial Sequence: Synthetic peptide
  Seed: HLAVIGALL (PMEL_HUMAN)
HAAVIGALF

SEQ ID NO: 140270 - protein, 10 aa, Artificial Sequence
  Description of Artificial Sequence: Synthetic peptide
  Seed: AVVLASLIYR (PMEL_HUMAN)
AYVLASLIYK

SEQ ID NO: 140271 - protein, 9 aa, Artificial Sequence
  Description of Artificial Sequence: Synthetic peptide
  Seed: KHFLRNQPL (PMEL_HUMAN)
KQFLRNQPH

SEQ ID NO: 140272 - protein, 10 aa, Artificial Sequence
  Description of Artificial Sequence: Synthetic peptide
  Seed: MTPAEVSIVV (PMEL_HUMAN)
MMPAEVSIVM

SEQ ID NO: 140273 - protein, 9 aa, Artificial Sequence
  Description of Artificial Sequence: Synthetic peptide
  Seed: TPAEVSIVV (PMEL_HUMAN)
TIAEVSIVF

SEQ ID NO: 140274 - protein, 11 aa, Artificial Sequence
  Description of Artificial Sequence: Synthetic peptide
  Seed: GYLAEADLSYT (PMEL_HUMAN)
GYLAEADLSYI

SEQ ID NO: 140275 - protein, 9 aa, Artificial Sequence
  Description of Artificial Sequence: Synthetic peptide
  Seed: KTWGQYWQV (PMEL_HUMAN)
KMWGQYWQK

SEQ ID NO: 140276 - protein, 9 aa, Artificial Sequence
  Description of Artificial Sequence: Synthetic peptide
  Seed: VLPDGQVIW (PMEL_HUMAN)
VSPDGQVIL

SEQ ID NO: 140277 - protein, 9 aa, Artificial Sequence
  Description of Artificial Sequence: Synthetic peptide
  Seed: RLMKQDFSV (PMEL_HUMAN)
RKMKQDFSF

SEQ ID NO: 140278 - protein, 9 aa, Artificial Sequence
  Description of Artificial Sequence: Synthetic peptide
  Seed: LPDGQVIWV (PMEL_HUMAN)
LGDGQVIWI

SEQ ID NO: 140279 - protein, 9 aa, Artificial Sequence
  Description of Artificial Sequence: Synthetic peptide
  Seed: SQVWGGQPV (PMEL_HUMAN)
SMVWGGQPV

SEQ ID NO: 140280 - protein, 10 aa, Artificial Sequence
  Description of Artificial Sequence: Synthetic peptide
  Seed: MTPAEVSIVV (PMEL_HUMAN)
MGPAEVSIVL

SEQ ID NO: 140281 - protein, 10 aa, Artificial Sequence
  Description of Artificial Sequence: Synthetic peptide
  Seed: ALDGGNKHFL (PMEL_HUMAN)
ASDGGNKHFF

SEQ ID NO: 140282 - protein, 9 aa, Artificial Sequence
  Description of Artificial Sequence: Synthetic peptide
  Seed: FLRNQPLTF (PMEL_HUMAN)
FMRNQPLTI

SEQ ID NO: 140283 - protein, 9 aa, Artificial Sequence
  Description of Artificial Sequence: Synthetic peptide
  Seed: ITDQVPFSV (PMEL_HUMAN)
ILDQVPFSF

SEQ ID NO: 140284 - protein, 10 aa, Artificial Sequence
  Description of Artificial Sequence: Synthetic peptide
  Seed: LHLAVIGALL (PMEL_HUMAN)
LQLAVIGALL

SEQ ID NO: 140285 - protein, 9 aa, Artificial Sequence
  Description of Artificial Sequence: Synthetic peptide
  Seed: ILKGGSGTY (PMEL_HUMAN)
IYKGGSGTM

SEQ ID NO: 140286 - protein, 9 aa, Artificial Sequence
  Description of Artificial Sequence: Synthetic peptide
  Seed: AHSSSAFTI (PMEL_HUMAN)
ARSSSAFTL

SEQ ID NO: 140287 - protein, 11 aa, Artificial Sequence
  Description of Artificial Sequence: Synthetic peptide
  Seed: FVYVWKTWGQY (PMEL_HUMAN)
FQYVWKTWGQY

SEQ ID NO: 140288 - protein, 9 aa, Artificial Sequence
  Description of Artificial Sequence: Synthetic peptide
  Seed: WSQKRSFVY (PMEL_HUMAN)
WKQKRSFVL

SEQ ID NO: 140289 - protein, 10 aa, Artificial Sequence
  Description of Artificial Sequence: Synthetic peptide
  Seed: YRYGSFSVTL (PMEL_HUMAN)
YSYGSFSVTW

SEQ ID NO: 140290 - protein, 9 aa, Artificial Sequence
  Description of Artificial Sequence: Synthetic peptide
  Seed: LLDGTATLR (PMEL_HUMAN)
LIDGTATLY

SEQ ID NO: 140291 - protein, 10 aa, Artificial Sequence
  Description of Artificial Sequence: Synthetic peptide
  Seed: RTKAWNRQLY (PMEL_HUMAN)
RIKAWNRQLR

SEQ ID NO: 140292 - protein, 9 aa, Artificial Sequence
  Description of Artificial Sequence: Synthetic peptide
  Seed: RALVVTHTY (PMEL_HUMAN)
RYLVVTHTL

SEQ ID NO: 140293 - protein, 9 aa, Artificial Sequence
  Description of Artificial Sequence: Synthetic peptide
  Seed: RAMLGTHTM (PMEL_HUMAN)
RKMLGTHTW

SEQ ID NO: 140294 - protein, 9 aa, Artificial Sequence
  Description of Artificial Sequence: Synthetic peptide
  Seed: AEPSGTTSV (PMEL_HUMAN)
AAPSGTTSA

SEQ ID NO: 140295 - protein, 11 aa, Artificial Sequence
  Description of Artificial Sequence: Synthetic peptide
  Seed: RQLRTKAWNRQ (PMEL_HUMAN)
RMLRTKAWNRK

SEQ ID NO: 140296 - protein, 10 aa, Artificial Sequence
  Description of Artificial Sequence: Synthetic peptide
  Seed: SRALVVTHTY (PMEL_HUMAN)
SQALVVTHTM

SEQ ID NO: 140297 - protein, 9 aa, Artificial Sequence
  Description of Artificial Sequence: Synthetic peptide
  Seed: GQVPTTEVV (PMEL_HUMAN)
GEVPTTEVF

SEQ ID NO: 140298 - protein, 10 aa, Artificial Sequence
  Description of Artificial Sequence: Synthetic peptide
  Seed: TDQVPFSVSV (PMEL_HUMAN)
TTQVPFSVSV

SEQ ID NO: 140299 - protein, 10 aa, Artificial Sequence
  Description of Artificial Sequence: Synthetic peptide
  Seed: ESITGSLGPL (PMEL_HUMAN)
EMITGSLGPV

SEQ ID NO: 140300 - protein, 10 aa, Artificial Sequence
  Description of Artificial Sequence: Synthetic peptide
  Seed: GPLLDGTATL (PMEL_HUMAN)
GSLLDGTATI

SEQ ID NO: 140301 - protein, 9 aa, Artificial Sequence
  Description of Artificial Sequence: Synthetic peptide
  Seed: LADTNSLAV (PMEL_HUMAN)
LIDTNSLAL

SEQ ID NO: 140302 - protein, 9 aa, Artificial Sequence
  Description of Artificial Sequence: Synthetic peptide
  Seed: VSNDGPTLI (PMEL_HUMAN)
VANDGPTLH

SEQ ID NO: 140303 - protein, 10 aa, Artificial Sequence
  Description of Artificial Sequence: Synthetic peptide
  Seed: HTMEVTVYHR (PMEL_HUMAN)
HFMEVTVYHR

SEQ ID NO: 140304 - protein, 10 aa, Artificial Sequence
  Description of Artificial Sequence: Synthetic peptide
  Seed: RGSRSYVPLA (PMEL_HUMAN)
RFSRSYVPLS

SEQ ID NO: 140305 - protein, 9 aa, Artificial Sequence
  Description of Artificial Sequence: Synthetic peptide
  Seed: ITGSLGPLL (PMEL_HUMAN)
IAGSLGPLF

SEQ ID NO: 140306 - protein, 11 aa, Artificial Sequence
  Description of Artificial Sequence: Synthetic peptide
  Seed: AEMSTPEATGM (PMEL_HUMAN)
AEMSTPEATGL

SEQ ID NO: 140307 - protein, 9 aa, Artificial Sequence
  Description of Artificial Sequence: Synthetic peptide
  Seed: AVIGALLAV (PMEL_HUMAN)
APIGALLAP

SEQ ID NO: 140308 - protein, 10 aa, Artificial Sequence
  Description of Artificial Sequence: Synthetic peptide
  Seed: MTPAEVSIVV (PMEL_HUMAN)
MCPAEVSIVV

SEQ ID NO: 140309 - protein, 9 aa, Artificial Sequence
  Description of Artificial Sequence: Synthetic peptide
  Seed: VSNDGPTLI (PMEL_HUMAN)
VTNDGPTLY

SEQ ID NO: 140310 - protein, 10 aa, Artificial Sequence
  Description of Artificial Sequence: Synthetic peptide
  Seed: MSTESITGSL (PMEL_HUMAN)
MVTESITGSL

SEQ ID NO: 140311 - protein, 11 aa, Artificial Sequence
  Description of Artificial Sequence: Synthetic peptide
  Seed: RYGSFSVTLDI (PMEL_HUMAN)
RTGSFSVTLDM

SEQ ID NO: 140312 - protein, 9 aa, Artificial Sequence
  Description of Artificial Sequence: Synthetic peptide
  Seed: WQVLGGPVS (PMEL_HUMAN)
WQVLGGPVV

SEQ ID NO: 140313 - protein, 10 aa, Artificial Sequence
  Description of Artificial Sequence: Synthetic peptide
  Seed: YLAEADLSYT (PMEL_HUMAN)
YMAEADLSYW

SEQ ID NO: 140314 - protein, 9 aa, Artificial Sequence
  Description of Artificial Sequence: Synthetic peptide
  Seed: KHFLRNQPL (PMEL_HUMAN)
KRFLRNQPM

SEQ ID NO: 140315 - protein, 9 aa, Artificial Sequence
  Description of Artificial Sequence: Synthetic peptide
  Seed: FSVSVSQLR (PMEL_HUMAN)
FWVSVSQLR

SEQ ID NO: 140316 - protein, 9 aa, Artificial Sequence
  Description of Artificial Sequence: Synthetic peptide
  Seed: FPDGGPCPS (PMEL_HUMAN)
FIDGGPCPF

SEQ ID NO: 140317 - protein, 10 aa, Artificial Sequence
  Description of Artificial Sequence: Synthetic peptide
  Seed: MPTAESTGMT (PMEL_HUMAN)
MGTAESTGML

SEQ ID NO: 140318 - protein, 10 aa, Artificial Sequence
  Description of Artificial Sequence: Synthetic peptide
  Seed: GALLAVGATK (PMEL_HUMAN)
GTLLAVGATR

SEQ ID NO: 140319 - protein, 11 aa, Artificial Sequence
  Description of Artificial Sequence: Synthetic peptide
  Seed: SQKRSFVYVWK (PMEL_HUMAN)
SQKRSFVYVWR

SEQ ID NO: 140320 - protein, 10 aa, Artificial Sequence
  Description of Artificial Sequence: Synthetic peptide
  Seed: KVSNDGPTLI (PMEL_HUMAN)
KISNDGPTLF

SEQ ID NO: 140321 - protein, 11 aa, Artificial Sequence
  Description of Artificial Sequence: Synthetic peptide
  Seed: QAVPSGEGDAF (PMEL_HUMAN)
QRVPSGEGDAL

SEQ ID NO: 140322 - protein, 10 aa, Artificial Sequence
  Description of Artificial Sequence: Synthetic peptide
  Seed: RGSRSYVPLA (PMEL_HUMAN)
RWSRSYVPLK

SEQ ID NO: 140323 - protein, 9 aa, Artificial Sequence
  Description of Artificial Sequence: Synthetic peptide
  Seed: KAWNRQLYP (PMEL_HUMAN)
KTWNRQLYM

SEQ ID NO: 140324 - protein, 9 aa, Artificial Sequence
  Description of Artificial Sequence: Synthetic peptide
  Seed: ANASFSIAL (PMEL_HUMAN)
AVASFSIAY

SEQ ID NO: 140325 - protein, 9 aa, Artificial Sequence
  Description of Artificial Sequence: Synthetic peptide
  Seed: LVLKRCLLH (PMEL_HUMAN)
LILKRCLLK

SEQ ID NO: 140326 - protein, 9 aa, Artificial Sequence
  Description of Artificial Sequence: Synthetic peptide
  Seed: VWKTWGQYW (PMEL_HUMAN)
VYKTWGQYL

SEQ ID NO: 140327 - protein, 9 aa, Artificial Sequence
  Description of Artificial Sequence: Synthetic peptide
  Seed: FGDSSGTLI (PMEL_HUMAN)
FFDSSGTLC

SEQ ID NO: 140328 - protein, 10 aa, Artificial Sequence
  Description of Artificial Sequence: Synthetic peptide
  Seed: LQLHDPSGYL (PMEL_HUMAN)
LYLHDPSGYV

SEQ ID NO: 140329 - protein, 9 aa, Artificial Sequence
  Description of Artificial Sequence: Synthetic peptide
  Seed: VMGTTLAEM (PMEL_HUMAN)
VFGTTLAEL

SEQ ID NO: 140330 - protein, 9 aa, Artificial Sequence
  Description of Artificial Sequence: Synthetic peptide
  Seed: VPTTEVVGT (PMEL_HUMAN)
VPTTEVVGA

SEQ ID NO: 140331 - protein, 11 aa, Artificial Sequence
  Description of Artificial Sequence: Synthetic peptide
  Seed: ESITGSLGPLL (PMEL_HUMAN)
ETITGSLGPLW

SEQ ID NO: 140332 - protein, 9 aa, Artificial Sequence
  Description of Artificial Sequence: Synthetic peptide
  Seed: ITGSLGPLL (PMEL_HUMAN)
IAGSLGPLM

SEQ ID NO: 140333 - protein, 9 aa, Artificial Sequence
  Description of Artificial Sequence: Synthetic peptide
  Seed: LNFPGSQKV (PMEL_HUMAN)
LQFPGSQKW

SEQ ID NO: 140334 - protein, 9 aa, Artificial Sequence
  Description of Artificial Sequence: Synthetic peptide
  Seed: KEACMEISS (PMEL_HUMAN)
KEACMEISC

SEQ ID NO: 140335 - protein, 9 aa, Artificial Sequence
  Description of Artificial Sequence: Synthetic peptide
  Seed: AEMSTPEAT (PMEL_HUMAN)
ADMSTPEAV

SEQ ID NO: 140336 - protein, 11 aa, Artificial Sequence
  Description of Artificial Sequence: Synthetic peptide
  Seed: GMTPAEVSIVV (PMEL_HUMAN)
GMTPAEVSIVL

SEQ ID NO: 140337 - protein, 9 aa, Artificial Sequence
  Description of Artificial Sequence: Synthetic peptide
  Seed: SQKRSFVYV (PMEL_HUMAN)
SYKRSFVYA

SEQ ID NO: 140338 - protein, 10 aa, Artificial Sequence
  Description of Artificial Sequence: Synthetic peptide
  Seed: GPLLDGTATL (PMEL_HUMAN)
GLLLDGTATI

SEQ ID NO: 140339 - protein, 9 aa, Artificial Sequence
  Description of Artificial Sequence: Synthetic peptide
  Seed: RLMKQDFSV (PMEL_HUMAN)
RMMKQDFSY

SEQ ID NO: 140340 - protein, 10 aa, Artificial Sequence
  Description of Artificial Sequence: Synthetic peptide
  Seed: MPTAESTGMT (PMEL_HUMAN)
MATAESTGMI

SEQ ID NO: 140341 - protein, 9 aa, Artificial Sequence
  Description of Artificial Sequence: Synthetic peptide
  Seed: VVLQAAIPL (PMEL_HUMAN)
VALQAAIPM

SEQ ID NO: 140342 - protein, 9 aa, Artificial Sequence
  Description of Artificial Sequence: Synthetic peptide
  Seed: MEVTVYHRR (PMEL_HUMAN)
MAVTVYHRK

SEQ ID NO: 140343 - protein, 10 aa, Artificial Sequence
  Description of Artificial Sequence: Synthetic peptide
  Seed: VVLASLIYRR (PMEL_HUMAN)
VMLASLIYRN

SEQ ID NO: 140344 - protein, 9 aa, Artificial Sequence
  Description of Artificial Sequence: Synthetic peptide
  Seed: KTWGQYWQV (PMEL_HUMAN)
KWWGQYWQF

SEQ ID NO: 140345 - protein, 9 aa, Artificial Sequence
  Description of Artificial Sequence: Synthetic peptide
  Seed: EPGPVTAQV (PMEL_HUMAN)
EAGPVTAQF

SEQ ID NO: 140346 - protein, 10 aa, Artificial Sequence
  Description of Artificial Sequence: Synthetic peptide
  Seed: YLAEADLSYT (PMEL_HUMAN)
YAAEADLSYY

SEQ ID NO: 140347 - protein, 9 aa, Artificial Sequence
  Description of Artificial Sequence: Synthetic peptide
  Seed: AQRLCQPVL (PMEL_HUMAN)
AQRLCQPVY

SEQ ID NO: 140348 - protein, 9 aa, Artificial Sequence
  Description of Artificial Sequence: Synthetic peptide
  Seed: SQVWGGQPV (PMEL_HUMAN)
SKVWGGQPF

SEQ ID NO: 140349 - protein, 9 aa, Artificial Sequence
  Description of Artificial Sequence: Synthetic peptide
  Seed: VQVPTTEVI (PMEL_HUMAN)
VGVPTTEVM

SEQ ID NO: 140350 - protein, 9 aa, Artificial Sequence
  Description of Artificial Sequence: Synthetic peptide
  Seed: LMAVVLASL (PMEL_HUMAN)
LRAVVLASF

SEQ ID NO: 140351 - protein, 9 aa, Artificial Sequence
  Description of Artificial Sequence: Synthetic peptide
  Seed: LNFPGSQKV (PMEL_HUMAN)
LLFPGSQKV

SEQ ID NO: 140352 - protein, 10 aa, Artificial Sequence
  Description of Artificial Sequence: Synthetic peptide
  Seed: ESAEILQAVP (PMEL_HUMAN)
EMAEILQAVV

SEQ ID NO: 140353 - protein, 9 aa, Artificial Sequence
  Description of Artificial Sequence: Synthetic peptide
  Seed: LAVVSTQLI (PMEL_HUMAN)
LVVVSTQLF

SEQ ID NO: 140354 - protein, 9 aa, Artificial Sequence
  Description of Artificial Sequence: Synthetic peptide
  Seed: SPACQLVLH (PMEL_HUMAN)
SPACQLVLY

SEQ ID NO: 140355 - protein, 9 aa, Artificial Sequence
  Description of Artificial Sequence: Synthetic peptide
  Seed: ESAEILQAV (PMEL_HUMAN)
EMAEILQAV

SEQ ID NO: 140356 - protein, 10 aa, Artificial Sequence
  Description of Artificial Sequence: Synthetic peptide
  Seed: RQLYPEWTEA (PMEL_HUMAN)
RTLYPEWTEF

SEQ ID NO: 140357 - protein, 9 aa, Artificial Sequence
  Description of Artificial Sequence: Synthetic peptide
  Seed: AEVSIVVLS (PMEL_HUMAN)
AEVSIVVLP

SEQ ID NO: 140358 - protein, 10 aa, Artificial Sequence
  Description of Artificial Sequence: Synthetic peptide
  Seed: LAVGATKVPR (PMEL_HUMAN)
LYVGATKVPR

SEQ ID NO: 140359 - protein, 9 aa, Artificial Sequence
  Description of Artificial Sequence: Synthetic peptide
  Seed: TLISRALVV (PMEL_HUMAN)
TSISRALVI

SEQ ID NO: 140360 - protein, 9 aa, Artificial Sequence
  Description of Artificial Sequence: Synthetic peptide
  Seed: KQDFSVPQL (PMEL_HUMAN)
KEDFSVPQA

SEQ ID NO: 140361 - protein, 10 aa, Artificial Sequence
  Description of Artificial Sequence: Synthetic peptide
  Seed: ESAEILQAVP (PMEL_HUMAN)
ETAEILQAVH

SEQ ID NO: 140362 - protein, 9 aa, Artificial Sequence
  Description of Artificial Sequence: Synthetic peptide
  Seed: TEWVETTAR (PMEL_HUMAN)
TDWVETTAM

SEQ ID NO: 140363 - protein, 9 aa, Artificial Sequence
  Description of Artificial Sequence: Synthetic peptide
  Seed: TLIGANASF (PMEL_HUMAN)
TQIGANASI

SEQ ID NO: 140364 - protein, 11 aa, Artificial Sequence
  Description of Artificial Sequence: Synthetic peptide
  Seed: LYRYGSFSVTL (PMEL_HUMAN)
LMRYGSFSVTF

SEQ ID NO: 140365 - protein, 9 aa, Artificial Sequence
  Description of Artificial Sequence: Synthetic peptide
  Seed: YLAEADLSY (PMEL_HUMAN)
YYAEADLSH

SEQ ID NO: 140366 - protein, 9 aa, Artificial Sequence
  Description of Artificial Sequence: Synthetic peptide
  Seed: VPFSVSVSQ (PMEL_HUMAN)
VPFSVSVSV

SEQ ID NO: 140367 - protein, 9 aa, Artificial Sequence
  Description of Artificial Sequence: Synthetic peptide
  Seed: CQLVLHQIL (PMEL_HUMAN)
CQLVLHQIM

SEQ ID NO: 140368 - protein, 8 aa, Artificial Sequence
  Description of Artificial Sequence: Synthetic peptide
  Seed: LLDGTATL (PMEL_HUMAN)
LFDGTATL

SEQ ID NO: 140369 - protein, 10 aa, Artificial Sequence
  Description of Artificial Sequence: Synthetic peptide
  Seed: KTWGQYWQVL (PMEL_HUMAN)
KDWGQYWQVF

SEQ ID NO: 140370 - protein, 11 aa, Artificial Sequence
  Description of Artificial Sequence: Synthetic peptide
  Seed: GYLAEADLSYT (PMEL_HUMAN)
GSLAEADLSYI

SEQ ID NO: 140371 - protein, 9 aa, Artificial Sequence
  Description of Artificial Sequence: Synthetic peptide
  Seed: ANASFSIAL (PMEL_HUMAN)
AKASFSIAW

SEQ ID NO: 140372 - protein, 10 aa, Artificial Sequence
  Description of Artificial Sequence: Synthetic peptide
  Seed: GPLLDGTATL (PMEL_HUMAN)
GPLLDGTATM

SEQ ID NO: 140373 - protein, 9 aa, Artificial Sequence
  Description of Artificial Sequence: Synthetic peptide
  Seed: GQVPLIVGI (PMEL_HUMAN)
GEVPLIVGI

SEQ ID NO: 140374 - protein, 8 aa, Artificial Sequence
  Description of Artificial Sequence: Synthetic peptide
  Seed: LNFPGSQK (PMEL_HUMAN)
LSFPGSQL

SEQ ID NO: 140375 - protein, 9 aa, Artificial Sequence
  Description of Artificial Sequence: Synthetic peptide
  Seed: AEPSGTTSV (PMEL_HUMAN)
ALPSGTTSF

SEQ ID NO: 140376 - protein, 9 aa, Artificial Sequence
  Description of Artificial Sequence: Synthetic peptide
  Seed: SVQVPTTEV (PMEL_HUMAN)
SIQVPTTEM

SEQ ID NO: 140377 - protein, 10 aa, Artificial Sequence
  Description of Artificial Sequence: Synthetic peptide
  Seed: MAVVLASLIY (PMEL_HUMAN)
MTVVLASLIM

SEQ ID NO: 140378 - protein, 9 aa, Artificial Sequence
  Description of Artificial Sequence: Synthetic peptide
  Seed: KVSNDGPTL (PMEL_HUMAN)
KASNDGPTM

SEQ ID NO: 140379 - protein, 9 aa, Artificial Sequence
  Description of Artificial Sequence: Synthetic peptide
  Seed: AGLGQVPLI (PMEL_HUMAN)
ASLGQVPLL

SEQ ID NO: 140380 - protein, 9 aa, Artificial Sequence
  Description of Artificial Sequence: Synthetic peptide
  Seed: GSRSYVPLA (PMEL_HUMAN)
GSRSYVPLI

SEQ ID NO: 140381 - protein, 9 aa, Artificial Sequence
  Description of Artificial Sequence: Synthetic peptide
  Seed: GGPVSGLSI (PMEL_HUMAN)
GMPVSGLSL

SEQ ID NO: 140382 - protein, 10 aa, Artificial Sequence
  Description of Artificial Sequence: Synthetic peptide
  Seed: VLYRYGSFSV (PMEL_HUMAN)
VIYRYGSFSK

SEQ ID NO: 140383 - protein, 11 aa, Artificial Sequence
  Description of Artificial Sequence: Synthetic peptide
  Seed: APNTTAGQVPT (PMEL_HUMAN)
APNTTAGQVPL

SEQ ID NO: 140384 - protein, 9 aa, Artificial Sequence
  Description of Artificial Sequence: Synthetic peptide
  Seed: AQVVLQAAI (PMEL_HUMAN)
AMVVLQAAV

SEQ ID NO: 140385 - protein, 9 aa, Artificial Sequence
  Description of Artificial Sequence: Synthetic peptide
  Seed: RLPRIFCSC (PMEL_HUMAN)
RLPRIFCSI

SEQ ID NO: 140386 - protein, 9 aa, Artificial Sequence
  Description of Artificial Sequence: Synthetic peptide
  Seed: VVLASLIYR (PMEL_HUMAN)
VSLASLIYK

SEQ ID NO: 140387 - protein, 9 aa, Artificial Sequence
  Description of Artificial Sequence: Synthetic peptide
  Seed: VQMPTAEST (PMEL_HUMAN)
VQMPTAESW

SEQ ID NO: 140388 - protein, 10 aa, Artificial Sequence
  Description of Artificial Sequence: Synthetic peptide
  Seed: MTPAEVSIVV (PMEL_HUMAN)
MLPAEVSIVT

SEQ ID NO: 140389 - protein, 10 aa, Artificial Sequence
  Description of Artificial Sequence: Synthetic peptide
  Seed: SGTYCLNVSL (PMEL_HUMAN)
SRTYCLNVSV

SEQ ID NO: 140390 - protein, 9 aa, Artificial Sequence
  Description of Artificial Sequence: Synthetic peptide
  Seed: ESAEILQAV (PMEL_HUMAN)
EAAEILQAR

SEQ ID NO: 140391 - protein, 9 aa, Artificial Sequence
  Description of Artificial Sequence: Synthetic peptide
  Seed: GCQPPAQRL (PMEL_HUMAN)
GAQPPAQRM

SEQ ID NO: 140392 - protein, 9 aa, Artificial Sequence
  Description of Artificial Sequence: Synthetic peptide
  Seed: KVLPDGQVI (PMEL_HUMAN)
KVLPDGQVY

SEQ ID NO: 140393 - protein, 9 aa, Artificial Sequence
  Description of Artificial Sequence: Synthetic peptide
  Seed: RQVPLDCVL (PMEL_HUMAN)
RLVPLDCVV

SEQ ID NO: 140394 - protein, 9 aa, Artificial Sequence
  Description of Artificial Sequence: Synthetic peptide
  Seed: FGDSSGTLI (PMEL_HUMAN)
FQDSSGTLV

SEQ ID NO: 140395 - protein, 9 aa, Artificial Sequence
  Description of Artificial Sequence: Synthetic peptide
  Seed: VQVPTTEVI (PMEL_HUMAN)
VEVPTTEVY

SEQ ID NO: 140396 - protein, 11 aa, Artificial Sequence
  Description of Artificial Sequence: Synthetic peptide
  Seed: FSVTLDIVQGI (PMEL_HUMAN)
FNVTLDIVQGV

SEQ ID NO: 140397 - protein, 10 aa, Artificial Sequence
  Description of Artificial Sequence: Synthetic peptide
  Seed: EVMGTTLAEM (PMEL_HUMAN)
EQMGTTLAER

SEQ ID NO: 140398 - protein, 9 aa, Artificial Sequence
  Description of Artificial Sequence: Synthetic peptide
  Seed: SQKRSFVYV (PMEL_HUMAN)
SAKRSFVYV

SEQ ID NO: 140399 - protein, 9 aa, Artificial Sequence
  Description of Artificial Sequence: Synthetic peptide
  Seed: RALVVTHTY (PMEL_HUMAN)
RYLVVTHTM

SEQ ID NO: 140400 - protein, 10 aa, Artificial Sequence
  Description of Artificial Sequence: Synthetic peptide
  Seed: MAVVLASLIY (PMEL_HUMAN)
MPVVLASLIM

SEQ ID NO: 140401 - protein, 9 aa, Artificial Sequence
  Description of Artificial Sequence: Synthetic peptide
  Seed: KQDFSVPQL (PMEL_HUMAN)
KRDFSVPQM

SEQ ID NO: 140402 - protein, 10 aa, Artificial Sequence
  Description of Artificial Sequence: Synthetic peptide
  Seed: QVLGGPVSGL (PMEL_HUMAN)
QVLGGPVSGR

SEQ ID NO: 140403 - protein, 10 aa, Artificial Sequence
  Description of Artificial Sequence: Synthetic peptide
  Seed: KTWGQYWQVL (PMEL_HUMAN)
KSWGQYWQVM

SEQ ID NO: 140404 - protein, 9 aa, Artificial Sequence
  Description of Artificial Sequence: Synthetic peptide
  Seed: RLMKQDFSV (PMEL_HUMAN)
RLMKQDFSL

SEQ ID NO: 140405 - protein, 9 aa, Artificial Sequence
  Description of Artificial Sequence: Synthetic peptide
  Seed: AQRLCQPVL (PMEL_HUMAN)
ATRLCQPVK

SEQ ID NO: 140406 - protein, 9 aa, Artificial Sequence
  Description of Artificial Sequence: Synthetic peptide
  Seed: SQKRSFVYV (PMEL_HUMAN)
STKRSFVYF

SEQ ID NO: 140407 - protein, 9 aa, Artificial Sequence
  Description of Artificial Sequence: Synthetic peptide
  Seed: ALDGGNKHF (PMEL_HUMAN)
ASDGGNKHV

SEQ ID NO: 140408 - protein, 9 aa, Artificial Sequence
  Description of Artificial Sequence: Synthetic peptide
  Seed: LTVSCQGGL (PMEL_HUMAN)
LTVSCQGGF

SEQ ID NO: 140409 - protein, 9 aa, Artificial Sequence
  Description of Artificial Sequence: Synthetic peptide
  Seed: HTMEVTVYH (PMEL_HUMAN)
HQMEVTVYM

SEQ ID NO: 140410 - protein, 9 aa, Artificial Sequence
  Description of Artificial Sequence: Synthetic peptide
  Seed: SLAVVSTQL (PMEL_HUMAN)
SVAVVSTQY

SEQ ID NO: 140411 - protein, 9 aa, Artificial Sequence
  Description of Artificial Sequence: Synthetic peptide
  Seed: TLIGANASF (PMEL_HUMAN)
TWIGANASF

SEQ ID NO: 140412 - protein, 9 aa, Artificial Sequence
  Description of Artificial Sequence: Synthetic peptide
  Seed: TTAGQVPTT (PMEL_HUMAN)
TTAGQVPTA

SEQ ID NO: 140413 - protein, 9 aa, Artificial Sequence
  Description of Artificial Sequence: Synthetic peptide
  Seed: HSSSHWLRL (PMEL_HUMAN)
HTSSHWLRM

SEQ ID NO: 140414 - protein, 9 aa, Artificial Sequence
  Description of Artificial Sequence: Synthetic peptide
  Seed: SSIMSTESI (PMEL_HUMAN)
STIMSTESY

SEQ ID NO: 140415 - protein, 10 aa, Artificial Sequence
  Description of Artificial Sequence: Synthetic peptide
  Seed: NASFSIALNF (PMEL_HUMAN)
NRSFSIALNY

SEQ ID NO: 140416 - protein, 9 aa, Artificial Sequence
  Description of Artificial Sequence: Synthetic peptide
  Seed: RLMKQDFSV (PMEL_HUMAN)
RKMKQDFSM

SEQ ID NO: 140417 - protein, 9 aa, Artificial Sequence
  Description of Artificial Sequence: Synthetic peptide
  Seed: YVWKTWGQY (PMEL_HUMAN)
YAWKTWGQW

SEQ ID NO: 140418 - protein, 10 aa, Artificial Sequence
  Description of Artificial Sequence: Synthetic peptide
  Seed: IFPDGGPCPS (PMEL_HUMAN)
IWPDGGPCPF

SEQ ID NO: 140419 - protein, 9 aa, Artificial Sequence
  Description of Artificial Sequence: Synthetic peptide
  Seed: MTPEKVPVS (PMEL_HUMAN)
MSPEKVPVM

SEQ ID NO: 140420 - protein, 10 aa, Artificial Sequence
  Description of Artificial Sequence: Synthetic peptide
  Seed: KTWGQYWQVL (PMEL_HUMAN)
KLWGQYWQVP

SEQ ID NO: 140421 - protein, 9 aa, Artificial Sequence
  Description of Artificial Sequence: Synthetic peptide
  Seed: MAVVLASLI (PMEL_HUMAN)
MVVVLASLI

SEQ ID NO: 140422 - protein, 10 aa, Artificial Sequence
  Description of Artificial Sequence: Synthetic peptide
  Seed: RGSRSYVPLA (PMEL_HUMAN)
RFSRSYVPLI

SEQ ID NO: 140423 - protein, 10 aa, Artificial Sequence
  Description of Artificial Sequence: Synthetic peptide
  Seed: VPLDCVLYRY (PMEL_HUMAN)
VWLDCVLYRY

SEQ ID NO: 140424 - protein, 9 aa, Artificial Sequence
  Description of Artificial Sequence: Synthetic peptide
  Seed: SGEGDAFEL (PMEL_HUMAN)
SIEGDAFEL

SEQ ID NO: 140425 - protein, 9 aa, Artificial Sequence
  Description of Artificial Sequence: Synthetic peptide
  Seed: RALDGGNKH (PMEL_HUMAN)
RLLDGGNKY

SEQ ID NO: 140426 - protein, 10 aa, Artificial Sequence
  Description of Artificial Sequence: Synthetic peptide
  Seed: SLAVVSTQLI (PMEL_HUMAN)
SMAVVSTQLV

SEQ ID NO: 140427 - protein, 9 aa, Artificial Sequence
  Description of Artificial Sequence: Synthetic peptide
  Seed: YPQETDDAC (PMEL_HUMAN)
YVQETDDAM

SEQ ID NO: 140428 - protein, 10 aa, Artificial Sequence
  Description of Artificial Sequence: Synthetic peptide
  Seed: VPQLPHSSSH (PMEL_HUMAN)
VDQLPHSSSM

SEQ ID NO: 140429 - protein, 9 aa, Artificial Sequence
  Description of Artificial Sequence: Synthetic peptide
  Seed: VVLSGTTAA (PMEL_HUMAN)
VMLSGTTAI

SEQ ID NO: 140430 - protein, 9 aa, Artificial Sequence
  Description of Artificial Sequence: Synthetic peptide
  Seed: LPDGQVIWV (PMEL_HUMAN)
LYDGQVIWM

SEQ ID NO: 140431 - protein, 10 aa, Artificial Sequence
  Description of Artificial Sequence: Synthetic peptide
  Seed: KTWGQYWQVL (PMEL_HUMAN)
KGWGQYWQVF

SEQ ID NO: 140432 - protein, 9 aa, Artificial Sequence
  Description of Artificial Sequence: Synthetic peptide
  Seed: AVIGALLAV (PMEL_HUMAN)
AMIGALLAS

SEQ ID NO: 140433 - protein, 9 aa, Artificial Sequence
  Description of Artificial Sequence: Synthetic peptide
  Seed: EKVPVSEVM (PMEL_HUMAN)
EHVPVSEVI

SEQ ID NO: 140434 - protein, 11 aa, Artificial Sequence
  Description of Artificial Sequence: Synthetic peptide
  Seed: RALDGGNKHFL (PMEL_HUMAN)
RSLDGGNKHFL

SEQ ID NO: 140435 - protein, 10 aa, Artificial Sequence
  Description of Artificial Sequence: Synthetic peptide
  Seed: RGSRSYVPLA (PMEL_HUMAN)
RASRSYVPLA

SEQ ID NO: 140436 - protein, 10 aa, Artificial Sequence
  Description of Artificial Sequence: Synthetic peptide
  Seed: VLMAVVLASL (PMEL_HUMAN)
VMMAVVLASI

SEQ ID NO: 140437 - protein, 9 aa, Artificial Sequence
  Description of Artificial Sequence: Synthetic peptide
  Seed: SAFTITDQV (PMEL_HUMAN)
SPFTITDQI

SEQ ID NO: 140438 - protein, 9 aa, Artificial Sequence
  Description of Artificial Sequence: Synthetic peptide
  Seed: VTLDIVQGI (PMEL_HUMAN)
VVLDIVQGV

SEQ ID NO: 140439 - protein, 9 aa, Artificial Sequence
  Description of Artificial Sequence: Synthetic peptide
  Seed: TTTEWVETT (PMEL_HUMAN)
TTTEWVETL

SEQ ID NO: 140440 - protein, 8 aa, Artificial Sequence
  Description of Artificial Sequence: Synthetic peptide
  Seed: FGDSSGTL (PMEL_HUMAN)
FSDSSGTF

SEQ ID NO: 140441 - protein, 9 aa, Artificial Sequence
  Description of Artificial Sequence: Synthetic peptide
  Seed: KTWGQYWQV (PMEL_HUMAN)
KLWGQYWQG

SEQ ID NO: 140442 - protein, 9 aa, Artificial Sequence
  Description of Artificial Sequence: Synthetic peptide
  Seed: YPQETDDAC (PMEL_HUMAN)
YCQETDDAY

SEQ ID NO: 140443 - protein, 9 aa, Artificial Sequence
  Description of Artificial Sequence: Synthetic peptide
  Seed: KQDFSVPQL (PMEL_HUMAN)
KVDFSVPQV

SEQ ID NO: 140444 - protein, 10 aa, Artificial Sequence
  Description of Artificial Sequence: Synthetic peptide
  Seed: LVLKRCLLHL (PMEL_HUMAN)
LPLKRCLLHV

SEQ ID NO: 140445 - protein, 9 aa, Artificial Sequence
  Description of Artificial Sequence: Synthetic peptide
  Seed: VSVSQLRAL (PMEL_HUMAN)
VRVSQLRAY

SEQ ID NO: 140446 - protein, 11 aa, Artificial Sequence
  Description of Artificial Sequence: Synthetic peptide
  Seed: RQLRTKAWNRQ (PMEL_HUMAN)
RFLRTKAWNRR

SEQ ID NO: 140447 - protein, 9 aa, Artificial Sequence
  Description of Artificial Sequence: Synthetic peptide
  Seed: RLMKQDFSV (PMEL_HUMAN)
RSMKQDFSL

SEQ ID NO: 140448 - protein, 9 aa, Artificial Sequence
  Description of Artificial Sequence: Synthetic peptide
  Seed: SVQVPTTEV (PMEL_HUMAN)
STQVPTTEI

SEQ ID NO: 140449 - protein, 10 aa, Artificial Sequence
  Description of Artificial Sequence: Synthetic peptide
  Seed: LAHSSSAFTI (PMEL_HUMAN)
LSHSSSAFTM

SEQ ID NO: 140450 - protein, 10 aa, Artificial Sequence
  Description of Artificial Sequence: Synthetic peptide
  Seed: RTKAWNRQLY (PMEL_HUMAN)
RMKAWNRQLV

SEQ ID NO: 140451 - protein, 9 aa, Artificial Sequence
  Description of Artificial Sequence: Synthetic peptide
  Seed: ISRALVVTH (PMEL_HUMAN)
IARALVVTV

SEQ ID NO: 140452 - protein, 10 aa, Artificial Sequence
  Description of Artificial Sequence: Synthetic peptide
  Seed: SLADTNSLAV (PMEL_HUMAN)
SQADTNSLAI

SEQ ID NO: 140453 - protein, 9 aa, Artificial Sequence
  Description of Artificial Sequence: Synthetic peptide
  Seed: RGSRSYVPL (PMEL_HUMAN)
RSSRSYVPM

SEQ ID NO: 140454 - protein, 9 aa, Artificial Sequence
  Description of Artificial Sequence: Synthetic peptide
  Seed: AEPSGTTSV (PMEL_HUMAN)
AMPSGTTSF

SEQ ID NO: 140455 - protein, 9 aa, Artificial Sequence
  Description of Artificial Sequence: Synthetic peptide
  Seed: VVLQAAIPL (PMEL_HUMAN)
VMLQAAIPL

SEQ ID NO: 140456 - protein, 9 aa, Artificial Sequence
  Description of Artificial Sequence: Synthetic peptide
  Seed: SQVWGGQPV (PMEL_HUMAN)
SMVWGGQPH

SEQ ID NO: 140457 - protein, 9 aa, Artificial Sequence
  Description of Artificial Sequence: Synthetic peptide
  Seed: ASFSIALNF (PMEL_HUMAN)
AAFSIALNV

SEQ ID NO: 140458 - protein, 9 aa, Artificial Sequence
  Description of Artificial Sequence: Synthetic peptide
  Seed: ITDQVPFSV (PMEL_HUMAN)
INDQVPFSY

SEQ ID NO: 140459 - protein, 9 aa, Artificial Sequence
  Description of Artificial Sequence: Synthetic peptide
  Seed: LNFPGSQKV (PMEL_HUMAN)
LQFPGSQKI

SEQ ID NO: 140460 - protein, 9 aa, Artificial Sequence
  Description of Artificial Sequence: Synthetic peptide
  Seed: GQVPLIVGI (PMEL_HUMAN)
GQVPLIVGV

SEQ ID NO: 140461 - protein, 10 aa, Artificial Sequence
  Description of Artificial Sequence: Synthetic peptide
  Seed: AVPSGEGDAF (PMEL_HUMAN)
ATPSGEGDAW

SEQ ID NO: 140462 - protein, 10 aa, Artificial Sequence
  Description of Artificial Sequence: Synthetic peptide
  Seed: RQLRTKAWNR (PMEL_HUMAN)
RFLRTKAWNR

SEQ ID NO: 140463 - protein, 9 aa, Artificial Sequence
  Description of Artificial Sequence: Synthetic peptide
  Seed: LNFPGSQKV (PMEL_HUMAN)
LMFPGSQKM

SEQ ID NO: 140464 - protein, 10 aa, Artificial Sequence
  Description of Artificial Sequence: Synthetic peptide
  Seed: MTPAEVSIVV (PMEL_HUMAN)
MPPAEVSIVF

SEQ ID NO: 140465 - protein, 9 aa, Artificial Sequence
  Description of Artificial Sequence: Synthetic peptide
  Seed: YVWKTWGQY (PMEL_HUMAN)
YQWKTWGQM

SEQ ID NO: 140466 - protein, 10 aa, Artificial Sequence
  Description of Artificial Sequence: Synthetic peptide
  Seed: GTYCLNVSLA (PMEL_HUMAN)
GVYCLNVSLV

SEQ ID NO: 140467 - protein, 10 aa, Artificial Sequence
  Description of Artificial Sequence: Synthetic peptide
  Seed: AVIGALLAVG (PMEL_HUMAN)
AMIGALLAVL

SEQ ID NO: 140468 - protein, 9 aa, Artificial Sequence
  Description of Artificial Sequence: Synthetic peptide
  Seed: GTYCLNVSL (PMEL_HUMAN)
GLYCLNVSW

SEQ ID NO: 140469 - protein, 10 aa, Artificial Sequence
  Description of Artificial Sequence: Synthetic peptide
  Seed: RGSRSYVPLA (PMEL_HUMAN)
RISRSYVPLF

SEQ ID NO: 140470 - protein, 9 aa, Artificial Sequence
  Description of Artificial Sequence: Synthetic peptide
  Seed: RLVKRQVPL (PMEL_HUMAN)
RLVKRQVPR

SEQ ID NO: 140471 - protein, 9 aa, Artificial Sequence
  Description of Artificial Sequence: Synthetic peptide
  Seed: HLAVIGALL (PMEL_HUMAN)
HMAVIGALY

SEQ ID NO: 140472 - protein, 10 aa, Artificial Sequence
  Description of Artificial Sequence: Synthetic peptide
  Seed: MPTAESTGMT (PMEL_HUMAN)
MHTAESTGML

SEQ ID NO: 140473 - protein, 9 aa, Artificial Sequence
  Description of Artificial Sequence: Synthetic peptide
  Seed: VTLDIVQGI (PMEL_HUMAN)
VILDIVQGL

SEQ ID NO: 140474 - protein, 9 aa, Artificial Sequence
  Description of Artificial Sequence: Synthetic peptide
  Seed: AVVSTQLIM (PMEL_HUMAN)
AHVSTQLIM

SEQ ID NO: 140475 - protein, 10 aa, Artificial Sequence
  Description of Artificial Sequence: Synthetic peptide
  Seed: MTPAEVSIVV (PMEL_HUMAN)
MEPAEVSIVS

SEQ ID NO: 140476 - protein, 9 aa, Artificial Sequence
  Description of Artificial Sequence: Synthetic peptide
  Seed: AEMSTPEAT (PMEL_HUMAN)
AEMSTPEAM

SEQ ID NO: 140477 - protein, 10 aa, Artificial Sequence
  Description of Artificial Sequence: Synthetic peptide
  Seed: WKTWGQYWQV (PMEL_HUMAN)
WMTWGQYWQM

SEQ ID NO: 140478 - protein, 8 aa, Artificial Sequence
  Description of Artificial Sequence: Synthetic peptide
  Seed: HTMEVTVY (PMEL_HUMAN)
HKMEVTVF

SEQ ID NO: 140479 - protein, 9 aa, Artificial Sequence
  Description of Artificial Sequence: Synthetic peptide
  Seed: FLRNQPLTF (PMEL_HUMAN)
FKRNQPLTF

SEQ ID NO: 140480 - protein, 9 aa, Artificial Sequence
  Description of Artificial Sequence: Synthetic peptide
  Seed: TEVISTAPV (PMEL_HUMAN)
TEVISTAPF

SEQ ID NO: 140481 - protein, 9 aa, Artificial Sequence
  Description of Artificial Sequence: Synthetic peptide
  Seed: FGDSSGTLI (PMEL_HUMAN)
FPDSSGTLL

SEQ ID NO: 140482 - protein, 9 aa, Artificial Sequence
  Description of Artificial Sequence: Synthetic peptide
  Seed: KQDFSVPQL (PMEL_HUMAN)
KTDFSVPQL

SEQ ID NO: 140483 - protein, 9 aa, Artificial Sequence
  Description of Artificial Sequence: Synthetic peptide
  Seed: LAVIGALLA (PMEL_HUMAN)
LPVIGALLA

SEQ ID NO: 140484 - protein, 9 aa, Artificial Sequence
  Description of Artificial Sequence: Synthetic peptide
  Seed: FTITDQVPF (PMEL_HUMAN)
FMITDQVPI

SEQ ID NO: 140485 - protein, 10 aa, Artificial Sequence
  Description of Artificial Sequence: Synthetic peptide
  Seed: LVLMAVVLAS (PMEL_HUMAN)
LELMAVVLAA

SEQ ID NO: 140486 - protein, 11 aa, Artificial Sequence
  Description of Artificial Sequence: Synthetic peptide
  Seed: ISRALVVTHTY (PMEL_HUMAN)
IHRALVVTHTW

SEQ ID NO: 140487 - protein, 10 aa, Artificial Sequence
  Description of Artificial Sequence: Synthetic peptide
  Seed: FLRNQPLTFA (PMEL_HUMAN)
FMRNQPLTFA

SEQ ID NO: 140488 - protein, 9 aa, Artificial Sequence
  Description of Artificial Sequence: Synthetic peptide
  Seed: KVLPDGQVI (PMEL_HUMAN)
KLLPDGQVY

SEQ ID NO: 140489 - protein, 9 aa, Artificial Sequence
  Description of Artificial Sequence: Synthetic peptide
  Seed: RLMKQDFSV (PMEL_HUMAN)
RSMKQDFSY

SEQ ID NO: 140490 - protein, 10 aa, Artificial Sequence
  Description of Artificial Sequence: Synthetic peptide
  Seed: VLKRCLLHLA (PMEL_HUMAN)
VLKRCLLHLV

SEQ ID NO: 140491 - protein, 9 aa, Artificial Sequence
  Description of Artificial Sequence: Synthetic peptide
  Seed: RAMLGTHTM (PMEL_HUMAN)
REMLGTHTV

SEQ ID NO: 140492 - protein, 11 aa, Artificial Sequence
  Description of Artificial Sequence: Synthetic peptide
  Seed: MTPEKVPVSEV (PMEL_HUMAN)
MVPEKVPVSEL

SEQ ID NO: 140493 - protein, 10 aa, Artificial Sequence
  Description of Artificial Sequence: Synthetic peptide
  Seed: QILKGGSGTY (PMEL_HUMAN)
QVLKGGSGTK

SEQ ID NO: 140494 - protein, 9 aa, Artificial Sequence
  Description of Artificial Sequence: Synthetic peptide
  Seed: TLISRALVV (PMEL_HUMAN)
TMISRALVI

SEQ ID NO: 140495 - protein, 9 aa, Artificial Sequence
  Description of Artificial Sequence: Synthetic peptide
  Seed: FLRNQPLTF (PMEL_HUMAN)
FWRNQPLTM

SEQ ID NO: 140496 - protein, 9 aa, Artificial Sequence
  Description of Artificial Sequence: Synthetic peptide
  Seed: YVWKTWGQY (PMEL_HUMAN)
YHWKTWGQY

SEQ ID NO: 140497 - protein, 9 aa, Artificial Sequence
  Description of Artificial Sequence: Synthetic peptide
  Seed: QLHDPSGYL (PMEL_HUMAN)
QQHDPSGYY

SEQ ID NO: 140498 - protein, 9 aa, Artificial Sequence
  Description of Artificial Sequence: Synthetic peptide
  Seed: GMTPAEVSI (PMEL_HUMAN)
GMTPAEVSM

SEQ ID NO: 140499 - protein, 11 aa, Artificial Sequence
  Description of Artificial Sequence: Synthetic peptide
  Seed: LMAVVLASLIY (PMEL_HUMAN)
LQAVVLASLIY

SEQ ID NO: 140500 - protein, 11 aa, Artificial Sequence
  Description of Artificial Sequence: Synthetic peptide
  Seed: LGPLLDGTATL (PMEL_HUMAN)
LDPLLDGTATV

SEQ ID NO: 140501 - protein, 10 aa, Artificial Sequence
  Description of Artificial Sequence: Synthetic peptide
  Seed: GPLLDGTATL (PMEL_HUMAN)
GMLLDGTATL

SEQ ID NO: 140502 - protein, 9 aa, Artificial Sequence
  Description of Artificial Sequence: Synthetic peptide
  Seed: GQVPTTEVV (PMEL_HUMAN)
GMVPTTEVY

SEQ ID NO: 140503 - protein, 10 aa, Artificial Sequence
  Description of Artificial Sequence: Synthetic peptide
  Seed: LPHSSSHWLR (PMEL_HUMAN)
LGHSSSHWLR

SEQ ID NO: 140504 - protein, 10 aa, Artificial Sequence
  Description of Artificial Sequence: Synthetic peptide
  Seed: SCPIGENSPL (PMEL_HUMAN)
SGPIGENSPM

SEQ ID NO: 140505 - protein, 10 aa, Artificial Sequence
  Description of Artificial Sequence: Synthetic peptide
  Seed: ESAEILQAVP (PMEL_HUMAN)
ETAEILQAVW

SEQ ID NO: 140506 - protein, 10 aa, Artificial Sequence
  Description of Artificial Sequence: Synthetic peptide
  Seed: SLIYRRRLMK (PMEL_HUMAN)
STIYRRRLMR

SEQ ID NO: 140507 - protein, 9 aa, Artificial Sequence
  Description of Artificial Sequence: Synthetic peptide
  Seed: VLPDGQVIW (PMEL_HUMAN)
VYPDGQVIL

SEQ ID NO: 140508 - protein, 10 aa, Artificial Sequence
  Description of Artificial Sequence: Synthetic peptide
  Seed: LPRIFCSCPI (PMEL_HUMAN)
LPRIFCSCPA

SEQ ID NO: 140509 - protein, 10 aa, Artificial Sequence
  Description of Artificial Sequence: Synthetic peptide
  Seed: APTAEPSGTT (PMEL_HUMAN)
APTAEPSGTM

SEQ ID NO: 140510 - protein, 9 aa, Artificial Sequence
  Description of Artificial Sequence: Synthetic peptide
  Seed: SAFTITDQV (PMEL_HUMAN)
SGFTITDQW

SEQ ID NO: 140511 - protein, 9 aa, Artificial Sequence
  Description of Artificial Sequence: Synthetic peptide
  Seed: VQVPTTEVI (PMEL_HUMAN)
VTVPTTEVI

SEQ ID NO: 140512 - protein, 10 aa, Artificial Sequence
  Description of Artificial Sequence: Synthetic peptide
  Seed: RALVVTHTYL (PMEL_HUMAN)
RYLVVTHTYY

SEQ ID NO: 140513 - protein, 11 aa, Artificial Sequence
  Description of Artificial Sequence: Synthetic peptide
  Seed: LYRYGSFSVTL (PMEL_HUMAN)
LIRYGSFSVTF

SEQ ID NO: 140514 - protein, 10 aa, Artificial Sequence
  Description of Artificial Sequence: Synthetic peptide
  Seed: EVVGTTPGQA (PMEL_HUMAN)
ETVGTTPGQK

SEQ ID NO: 140515 - protein, 9 aa, Artificial Sequence
  Description of Artificial Sequence: Synthetic peptide
  Seed: WSQKRSFVY (PMEL_HUMAN)
WMQKRSFVL

SEQ ID NO: 140516 - protein, 10 aa, Artificial Sequence
  Description of Artificial Sequence: Synthetic peptide
  Seed: YRYGSFSVTL (PMEL_HUMAN)
YPYGSFSVTI

SEQ ID NO: 140517 - protein, 9 aa, Artificial Sequence
  Description of Artificial Sequence: Synthetic peptide
  Seed: THTMEVTVY (PMEL_HUMAN)
TMTMEVTVY

SEQ ID NO: 140518 - protein, 9 aa, Artificial Sequence
  Description of Artificial Sequence: Synthetic peptide
  Seed: FSVSVSQLR (PMEL_HUMAN)
FAVSVSQLI

SEQ ID NO: 140519 - protein, 9 aa, Artificial Sequence
  Description of Artificial Sequence: Synthetic peptide
  Seed: VQVPTTEVI (PMEL_HUMAN)
VDVPTTEVL

SEQ ID NO: 140520 - protein, 10 aa, Artificial Sequence
  Description of Artificial Sequence: Synthetic peptide
  Seed: LVLKRCLLHL (PMEL_HUMAN)
LGLKRCLLHV

SEQ ID NO: 140521 - protein, 10 aa, Artificial Sequence
  Description of Artificial Sequence: Synthetic peptide
  Seed: MSTESITGSL (PMEL_HUMAN)
MNTESITGSV

SEQ ID NO: 140522 - protein, 10 aa, Artificial Sequence
  Description of Artificial Sequence: Synthetic peptide
  Seed: GDSSGTLISR (PMEL_HUMAN)
GTSSGTLISR

SEQ ID NO: 140523 - protein, 9 aa, Artificial Sequence
  Description of Artificial Sequence: Synthetic peptide
  Seed: IMPGQEAGL (PMEL_HUMAN)
ISPGQEAGM

SEQ ID NO: 140524 - protein, 10 aa, Artificial Sequence
  Description of Artificial Sequence: Synthetic peptide
  Seed: LHLAVIGALL (PMEL_HUMAN)
LMLAVIGALV

SEQ ID NO: 140525 - protein, 9 aa, Artificial Sequence
  Description of Artificial Sequence: Synthetic peptide
  Seed: VSCQGGLPK (PMEL_HUMAN)
VSCQGGLPL

SEQ ID NO: 140526 - protein, 10 aa, Artificial Sequence
  Description of Artificial Sequence: Synthetic peptide
  Seed: TITDQVPFSV (PMEL_HUMAN)
TVTDQVPFSV

SEQ ID NO: 140527 - protein, 9 aa, Artificial Sequence
  Description of Artificial Sequence: Synthetic peptide
  Seed: SGLSIGTGR (PMEL_HUMAN)
SALSIGTGK

SEQ ID NO: 140528 - protein, 8 aa, Artificial Sequence
  Description of Artificial Sequence: Synthetic peptide
  Seed: KAWNRQLY (PMEL_HUMAN)
KSWNRQLF

SEQ ID NO: 140529 - protein, 9 aa, Artificial Sequence
  Description of Artificial Sequence: Synthetic peptide
  Seed: MTPEKVPVS (PMEL_HUMAN)
MWPEKVPVL

SEQ ID NO: 140530 - protein, 9 aa, Artificial Sequence
  Description of Artificial Sequence: Synthetic peptide
  Seed: CVLYRYGSF (PMEL_HUMAN)
CILYRYGSL

SEQ ID NO: 140531 - protein, 9 aa, Artificial Sequence
  Description of Artificial Sequence: Synthetic peptide
  Seed: ALDGGNKHF (PMEL_HUMAN)
AFDGGNKHF

SEQ ID NO: 140532 - protein, 11 aa, Artificial Sequence
  Description of Artificial Sequence: Synthetic peptide
  Seed: LYPEWTEAQRL (PMEL_HUMAN)
LYPEWTEAQRF

SEQ ID NO: 140533 - protein, 10 aa, Artificial Sequence
  Description of Artificial Sequence: Synthetic peptide
  Seed: SVPQLPHSSS (PMEL_HUMAN)
SPPQLPHSSI

SEQ ID NO: 140534 - protein, 10 aa, Artificial Sequence
  Description of Artificial Sequence: Synthetic peptide
  Seed: LKVSNDGPTL (PMEL_HUMAN)
LRVSNDGPTY

SEQ ID NO: 140535 - protein, 9 aa, Artificial Sequence
  Description of Artificial Sequence: Synthetic peptide
  Seed: SITGSLGPL (PMEL_HUMAN)
STTGSLGPY

SEQ ID NO: 140536 - protein, 9 aa, Artificial Sequence
  Description of Artificial Sequence: Synthetic peptide
  Seed: SGLSIGTGR (PMEL_HUMAN)
SLLSIGTGK

SEQ ID NO: 140537 - protein, 9 aa, Artificial Sequence
  Description of Artificial Sequence: Synthetic peptide
  Seed: AVIGALLAV (PMEL_HUMAN)
AIIGALLAA

SEQ ID NO: 140538 - protein, 9 aa, Artificial Sequence
  Description of Artificial Sequence: Synthetic peptide
  Seed: QVIWVNNTI (PMEL_HUMAN)
QMIWVNNTL

SEQ ID NO: 140539 - protein, 9 aa, Artificial Sequence
  Description of Artificial Sequence: Synthetic peptide
  Seed: RYGSFSVTL (PMEL_HUMAN)
RSGSFSVTI

SEQ ID NO: 140540 - protein, 9 aa, Artificial Sequence
  Description of Artificial Sequence: Synthetic peptide
  Seed: MSTPEATGM (PMEL_HUMAN)
MITPEATGL

SEQ ID NO: 140541 - protein, 9 aa, Artificial Sequence
  Description of Artificial Sequence: Synthetic peptide
  Seed: RTKAWNRQL (PMEL_HUMAN)
RIKAWNRQS

SEQ ID NO: 140542 - protein, 9 aa, Artificial Sequence
  Description of Artificial Sequence: Synthetic peptide
  Seed: STAPVQMPT (PMEL_HUMAN)
SQAPVQMPA

SEQ ID NO: 140543 - protein, 9 aa, Artificial Sequence
  Description of Artificial Sequence: Synthetic peptide
  Seed: AHSSSAFTI (PMEL_HUMAN)
AKSSSAFTL

SEQ ID NO: 140544 - protein, 9 aa, Artificial Sequence
  Description of Artificial Sequence: Synthetic peptide
  Seed: SVPQLPHSS (PMEL_HUMAN)
SAPQLPHSV

SEQ ID NO: 140545 - protein, 9 aa, Artificial Sequence
  Description of Artificial Sequence: Synthetic peptide
  Seed: YRYGSFSVT (PMEL_HUMAN)
YHYGSFSVY

SEQ ID NO: 140546 - protein, 10 aa, Artificial Sequence
  Description of Artificial Sequence: Synthetic peptide
  Seed: RQVPLDCVLY (PMEL_HUMAN)
RQVPLDCVLM

SEQ ID NO: 140547 - protein, 10 aa, Artificial Sequence
  Description of Artificial Sequence: Synthetic peptide
  Seed: SSSHWLRLPR (PMEL_HUMAN)
SHSHWLRLPR

SEQ ID NO: 140548 - protein, 9 aa, Artificial Sequence
  Description of Artificial Sequence: Synthetic peptide
  Seed: ASFSIALNF (PMEL_HUMAN)
ATFSIALNR

SEQ ID NO: 140549 - protein, 9 aa, Artificial Sequence
  Description of Artificial Sequence: Synthetic peptide
  Seed: SVQVPTTEV (PMEL_HUMAN)
SSQVPTTEL

SEQ ID NO: 140550 - protein, 11 aa, Artificial Sequence
  Description of Artificial Sequence: Synthetic peptide
  Seed: SQKRSFVYVWK (PMEL_HUMAN)
SIKRSFVYVWR

SEQ ID NO: 140551 - protein, 9 aa, Artificial Sequence
  Description of Artificial Sequence: Synthetic peptide
  Seed: AGQVPTTEV (PMEL_HUMAN)
AAQVPTTEH

SEQ ID NO: 140552 - protein, 9 aa, Artificial Sequence
  Description of Artificial Sequence: Synthetic peptide
  Seed: KQDFSVPQL (PMEL_HUMAN)
KQDFSVPQM

SEQ ID NO: 140553 - protein, 10 aa, Artificial Sequence
  Description of Artificial Sequence: Synthetic peptide
  Seed: SITGSLGPLL (PMEL_HUMAN)
SMTGSLGPLV

SEQ ID NO: 140554 - protein, 9 aa, Artificial Sequence
  Description of Artificial Sequence: Synthetic peptide
  Seed: IVVLSGTTA (PMEL_HUMAN)
IVVLSGTTY

SEQ ID NO: 140555 - protein, 9 aa, Artificial Sequence
  Description of Artificial Sequence: Synthetic peptide
  Seed: RSFVYVWKT (PMEL_HUMAN)
RTFVYVWKK

SEQ ID NO: 140556 - protein, 9 aa, Artificial Sequence
  Description of Artificial Sequence: Synthetic peptide
  Seed: MLGTHTMEV (PMEL_HUMAN)
MAGTHTMEM

SEQ ID NO: 140557 - protein, 9 aa, Artificial Sequence
  Description of Artificial Sequence: Synthetic peptide
  Seed: SSPGCQPPA (PMEL_HUMAN)
SVPGCQPPL

SEQ ID NO: 140558 - protein, 9 aa, Artificial Sequence
  Description of Artificial Sequence: Synthetic peptide
  Seed: LSIGTGRAM (PMEL_HUMAN)
LPIGTGRAV

SEQ ID NO: 140559 - protein, 9 aa, Artificial Sequence
  Description of Artificial Sequence: Synthetic peptide
  Seed: VVLSGTTAA (PMEL_HUMAN)
VVLSGTTAV

SEQ ID NO: 140560 - protein, 9 aa, Artificial Sequence
  Description of Artificial Sequence: Synthetic peptide
  Seed: WSQKRSFVY (PMEL_HUMAN)
WTQKRSFVY

SEQ ID NO: 140561 - protein, 9 aa, Artificial Sequence
  Description of Artificial Sequence: Synthetic peptide
  Seed: WQVLGGPVS (PMEL_HUMAN)
WVVLGGPVY

SEQ ID NO: 140562 - protein, 9 aa, Artificial Sequence
  Description of Artificial Sequence: Synthetic peptide
  Seed: GSRSYVPLA (PMEL_HUMAN)
GIRSYVPLA

SEQ ID NO: 140563 - protein, 9 aa, Artificial Sequence
  Description of Artificial Sequence: Synthetic peptide
  Seed: SSPGCQPPA (PMEL_HUMAN)
STPGCQPPV

SEQ ID NO: 140564 - protein, 10 aa, Artificial Sequence
  Description of Artificial Sequence: Synthetic peptide
  Seed: LIMPGQEAGL (PMEL_HUMAN)
LTMPGQEAGL

SEQ ID NO: 140565 - protein, 10 aa, Artificial Sequence
  Description of Artificial Sequence: Synthetic peptide
  Seed: LPRIFCSCPI (PMEL_HUMAN)
LPRIFCSCPL

SEQ ID NO: 140566 - protein, 9 aa, Artificial Sequence
  Description of Artificial Sequence: Synthetic peptide
  Seed: VIWVNNTII (PMEL_HUMAN)
VMWVNNTIV

SEQ ID NO: 140567 - protein, 9 aa, Artificial Sequence
  Description of Artificial Sequence: Synthetic peptide
  Seed: VSEVMGTTL (PMEL_HUMAN)
VFEVMGTTM

SEQ ID NO: 140568 - protein, 11 aa, Artificial Sequence
  Description of Artificial Sequence: Synthetic peptide
  Seed: RQVPLDCVLYR (PMEL_HUMAN)
RSVPLDCVLYR

SEQ ID NO: 140569 - protein, 10 aa, Artificial Sequence
  Description of Artificial Sequence: Synthetic peptide
  Seed: RQLRTKAWNR (PMEL_HUMAN)
RVLRTKAWNR

SEQ ID NO: 140570 - protein, 11 aa, Artificial Sequence
  Description of Artificial Sequence: Synthetic peptide
  Seed: VPFSVSVSQLR (PMEL_HUMAN)
VVFSVSVSQLR

SEQ ID NO: 140571 - protein, 10 aa, Artificial Sequence
  Description of Artificial Sequence: Synthetic peptide
  Seed: KVSNDGPTLI (PMEL_HUMAN)
KMSNDGPTLL

SEQ ID NO: 140572 - protein, 9 aa, Artificial Sequence
  Description of Artificial Sequence: Synthetic peptide
  Seed: HTMEVTVYH (PMEL_HUMAN)
HPMEVTVYY

SEQ ID NO: 140573 - protein, 9 aa, Artificial Sequence
  Description of Artificial Sequence: Synthetic peptide
  Seed: GTYCLNVSL (PMEL_HUMAN)
GTYCLNVSF

SEQ ID NO: 140574 - protein, 10 aa, Artificial Sequence
  Description of Artificial Sequence: Synthetic peptide
  Seed: QVPLDCVLYR (PMEL_HUMAN)
QLPLDCVLYK

SEQ ID NO: 140575 - protein, 9 aa, Artificial Sequence
  Description of Artificial Sequence: Synthetic peptide
  Seed: THTMEVTVY (PMEL_HUMAN)
TMTMEVTVF

SEQ ID NO: 140576 - protein, 9 aa, Artificial Sequence
  Description of Artificial Sequence: Synthetic peptide
  Seed: QLYPEWTEA (PMEL_HUMAN)
QAYPEWTEV

SEQ ID NO: 140577 - protein, 10 aa, Artificial Sequence
  Description of Artificial Sequence: Synthetic peptide
  Seed: SVPQLPHSSS (PMEL_HUMAN)
SIPQLPHSSM

SEQ ID NO: 140578 - protein, 10 aa, Artificial Sequence
  Description of Artificial Sequence: Synthetic peptide
  Seed: LIMPGQEAGL (PMEL_HUMAN)
LVMPGQEAGL

SEQ ID NO: 140579 - protein, 9 aa, Artificial Sequence
  Description of Artificial Sequence: Synthetic peptide
  Seed: RTKAWNRQL (PMEL_HUMAN)
RTKAWNRQF

SEQ ID NO: 140580 - protein, 10 aa, Artificial Sequence
  Description of Artificial Sequence: Synthetic peptide
  Seed: QVLGGPVSGL (PMEL_HUMAN)
QVLGGPVSGY

SEQ ID NO: 140581 - protein, 9 aa, Artificial Sequence
  Description of Artificial Sequence: Synthetic peptide
  Seed: VTLDIVQGI (PMEL_HUMAN)
VTLDIVQGL

SEQ ID NO: 140582 - protein, 10 aa, Artificial Sequence
  Description of Artificial Sequence: Synthetic peptide
  Seed: MTPAEVSIVV (PMEL_HUMAN)
MQPAEVSIVI

SEQ ID NO: 140583 - protein, 9 aa, Artificial Sequence
  Description of Artificial Sequence: Synthetic peptide
  Seed: DAFELTVSC (PMEL_HUMAN)
DHFELTVSI

SEQ ID NO: 140584 - protein, 9 aa, Artificial Sequence
  Description of Artificial Sequence: Synthetic peptide
  Seed: RAMLGTHTM (PMEL_HUMAN)
RVMLGTHTM

SEQ ID NO: 140585 - protein, 9 aa, Artificial Sequence
  Description of Artificial Sequence: Synthetic peptide
  Seed: RLMKQDFSV (PMEL_HUMAN)
RQMKQDFSV

SEQ ID NO: 140586 - protein, 9 aa, Artificial Sequence
  Description of Artificial Sequence: Synthetic peptide
  Seed: RAMLGTHTM (PMEL_HUMAN)
RMMLGTHTK

SEQ ID NO: 140587 - protein, 9 aa, Artificial Sequence
  Description of Artificial Sequence: Synthetic peptide
  Seed: DSSGTLISR (PMEL_HUMAN)
DISGTLISY

SEQ ID NO: 140588 - protein, 10 aa, Artificial Sequence
  Description of Artificial Sequence: Synthetic peptide
  Seed: QILKGGSGTY (PMEL_HUMAN)
QLLKGGSGTY

SEQ ID NO: 140589 - protein, 11 aa, Artificial Sequence
  Description of Artificial Sequence: Synthetic peptide
  Seed: RALDGGNKHFL (PMEL_HUMAN)
RLLDGGNKHFI

SEQ ID NO: 140590 - protein, 10 aa, Artificial Sequence
  Description of Artificial Sequence: Synthetic peptide
  Seed: VPQLPHSSSH (PMEL_HUMAN)
VWQLPHSSSY

SEQ ID NO: 140591 - protein, 11 aa, Artificial Sequence
  Description of Artificial Sequence: Synthetic peptide
  Seed: VPTTEVVGTTP (PMEL_HUMAN)
VPTTEVVGTTL

SEQ ID NO: 140592 - protein, 11 aa, Artificial Sequence
  Description of Artificial Sequence: Synthetic peptide
  Seed: GIESAEILQAV (PMEL_HUMAN)
GMESAEILQAA

SEQ ID NO: 140593 - protein, 11 aa, Artificial Sequence
  Description of Artificial Sequence: Synthetic peptide
  Seed: YLEPGPVTAQV (PMEL_HUMAN)
YTEPGPVTAQL

SEQ ID NO: 140594 - protein, 11 aa, Artificial Sequence
  Description of Artificial Sequence: Synthetic peptide
  Seed: LGPLLDGTATL (PMEL_HUMAN)
LSPLLDGTATV

SEQ ID NO: 140595 - protein, 9 aa, Artificial Sequence
  Description of Artificial Sequence: Synthetic peptide
  Seed: LMAVVLASL (PMEL_HUMAN)
LMAVVLASM

SEQ ID NO: 140596 - protein, 9 aa, Artificial Sequence
  Description of Artificial Sequence: Synthetic peptide
  Seed: ITGSLGPLL (PMEL_HUMAN)
IVGSLGPLW

SEQ ID NO: 140597 - protein, 9 aa, Artificial Sequence
  Description of Artificial Sequence: Synthetic peptide
  Seed: AQVVLQAAI (PMEL_HUMAN)
AEVVLQAAY

SEQ ID NO: 140598 - protein, 10 aa, Artificial Sequence
  Description of Artificial Sequence: Synthetic peptide
  Seed: MTPAEVSIVV (PMEL_HUMAN)
MIPAEVSIVM

SEQ ID NO: 140599 - protein, 9 aa, Artificial Sequence
  Description of Artificial Sequence: Synthetic peptide
  Seed: YLEPGPVTA (PMEL_HUMAN)
YGEPGPVTL

SEQ ID NO: 140600 - protein, 9 aa, Artificial Sequence
  Description of Artificial Sequence: Synthetic peptide
  Seed: YVWKTWGQY (PMEL_HUMAN)
YLWKTWGQK

SEQ ID NO: 140601 - protein, 9 aa, Artificial Sequence
  Description of Artificial Sequence: Synthetic peptide
  Seed: QLHDPSGYL (PMEL_HUMAN)
QVHDPSGYV

SEQ ID NO: 140602 - protein, 9 aa, Artificial Sequence
  Description of Artificial Sequence: Synthetic peptide
  Seed: SAFTITDQV (PMEL_HUMAN)
SLFTITDQI

SEQ ID NO: 140603 - protein, 10 aa, Artificial Sequence
  Description of Artificial Sequence: Synthetic peptide
  Seed: SQKRSFVYVW (PMEL_HUMAN)
SAKRSFVYVF

SEQ ID NO: 140604 - protein, 9 aa, Artificial Sequence
  Description of Artificial Sequence: Synthetic peptide
  Seed: RLVKRQVPL (PMEL_HUMAN)
RTVKRQVPF

SEQ ID NO: 140605 - protein, 10 aa, Artificial Sequence
  Description of Artificial Sequence: Synthetic peptide
  Seed: IALNFPGSQK (PMEL_HUMAN)
ICLNFPGSQK

SEQ ID NO: 140606 - protein, 10 aa, Artificial Sequence
  Description of Artificial Sequence: Synthetic peptide
  Seed: VPLAHSSSAF (PMEL_HUMAN)
VGLAHSSSAY

SEQ ID NO: 140607 - protein, 8 aa, Artificial Sequence
  Description of Artificial Sequence: Synthetic peptide
  Seed: TLDIVQGI (PMEL_HUMAN)
TADIVQGI

SEQ ID NO: 140608 - protein, 9 aa, Artificial Sequence
  Description of Artificial Sequence: Synthetic peptide
  Seed: QVWGGQPVY (PMEL_HUMAN)
QTWGGQPVY

SEQ ID NO: 140609 - protein, 10 aa, Artificial Sequence
  Description of Artificial Sequence: Synthetic peptide
  Seed: KTWGQYWQVL (PMEL_HUMAN)
KVWGQYWQVF

SEQ ID NO: 140610 - protein, 11 aa, Artificial Sequence
  Description of Artificial Sequence: Synthetic peptide
  Seed: RTKAWNRQLYP (PMEL_HUMAN)
RVKAWNRQLYV

SEQ ID NO: 140611 - protein, 9 aa, Artificial Sequence
  Description of Artificial Sequence: Synthetic peptide
  Seed: RALDGGNKH (PMEL_HUMAN)
RALDGGNKM

SEQ ID NO: 140612 - protein, 10 aa, Artificial Sequence
  Description of Artificial Sequence: Synthetic peptide
  Seed: MTPAEVSIVV (PMEL_HUMAN)
MEPAEVSIVH

SEQ ID NO: 140613 - protein, 10 aa, Artificial Sequence
  Description of Artificial Sequence: Synthetic peptide
  Seed: LVLMAVVLAS (PMEL_HUMAN)
LPLMAVVLAA

SEQ ID NO: 140614 - protein, 9 aa, Artificial Sequence
  Description of Artificial Sequence: Synthetic peptide
  Seed: VSCQGGLPK (PMEL_HUMAN)
VTCQGGLPL

SEQ ID NO: 140615 - protein, 10 aa, Artificial Sequence
  Description of Artificial Sequence: Synthetic peptide
  Seed: RGSRSYVPLA (PMEL_HUMAN)
RYSRSYVPLF

SEQ ID NO: 140616 - protein, 9 aa, Artificial Sequence
  Description of Artificial Sequence: Synthetic peptide
  Seed: GQVPTTEVV (PMEL_HUMAN)
GRVPTTEVL

SEQ ID NO: 140617 - protein, 10 aa, Artificial Sequence
  Description of Artificial Sequence: Synthetic peptide
  Seed: RNQDWLGVSR (PMEL_HUMAN)
RIQDWLGVSK

SEQ ID NO: 140618 - protein, 9 aa, Artificial Sequence
  Description of Artificial Sequence: Synthetic peptide
  Seed: AGLGQVPLI (PMEL_HUMAN)
AMLGQVPLA

SEQ ID NO: 140619 - protein, 10 aa, Artificial Sequence
  Description of Artificial Sequence: Synthetic peptide
  Seed: MTPAEVSIVV (PMEL_HUMAN)
MHPAEVSIVF

SEQ ID NO: 140620 - protein, 11 aa, Artificial Sequence
  Description of Artificial Sequence: Synthetic peptide
  Seed: ISRALVVTHTY (PMEL_HUMAN)
IFRALVVTHTW

SEQ ID NO: 140621 - protein, 11 aa, Artificial Sequence
  Description of Artificial Sequence: Synthetic peptide
  Seed: QAVPSGEGDAF (PMEL_HUMAN)
QVVPSGEGDAW

SEQ ID NO: 140622 - protein, 10 aa, Artificial Sequence
  Description of Artificial Sequence: Synthetic peptide
  Seed: NASFSIALNF (PMEL_HUMAN)
NYSFSIALNW

SEQ ID NO: 140623 - protein, 9 aa, Artificial Sequence
  Description of Artificial Sequence: Synthetic peptide
  Seed: RGSRSYVPL (PMEL_HUMAN)
RISRSYVPV

SEQ ID NO: 140624 - protein, 10 aa, Artificial Sequence
  Description of Artificial Sequence: Synthetic peptide
  Seed: EVMGTTLAEM (PMEL_HUMAN)
EVMGTTLAEL

SEQ ID NO: 140625 - protein, 10 aa, Artificial Sequence
  Description of Artificial Sequence: Synthetic peptide
  Seed: AVVLASLIYR (PMEL_HUMAN)
AAVLASLIYK

SEQ ID NO: 140626 - protein, 9 aa, Artificial Sequence
  Description of Artificial Sequence: Synthetic peptide
  Seed: VPFSVSVSQ (PMEL_HUMAN)
VGFSVSVSY

SEQ ID NO: 140627 - protein, 9 aa, Artificial Sequence
  Description of Artificial Sequence: Synthetic peptide
  Seed: YWQVLGGPV (PMEL_HUMAN)
YYQVLGGPW

SEQ ID NO: 140628 - protein, 11 aa, Artificial Sequence
  Description of Artificial Sequence: Synthetic peptide
  Seed: AEAPNTTAGQV (PMEL_HUMAN)
AEAPNTTAGQC

SEQ ID NO: 140629 - protein, 9 aa, Artificial Sequence
  Description of Artificial Sequence: Synthetic peptide
  Seed: WSQKRSFVY (PMEL_HUMAN)
WTQKRSFVW

SEQ ID NO: 140630 - protein, 9 aa, Artificial Sequence
  Description of Artificial Sequence: Synthetic peptide
  Seed: RLVKRQVPL (PMEL_HUMAN)
RAVKRQVPK

SEQ ID NO: 140631 - protein, 9 aa, Artificial Sequence
  Description of Artificial Sequence: Synthetic peptide
  Seed: FPDGGPCPS (PMEL_HUMAN)
FLDGGPCPY

SEQ ID NO: 140632 - protein, 10 aa, Artificial Sequence
  Description of Artificial Sequence: Synthetic peptide
  Seed: QVLGGPVSGL (PMEL_HUMAN)
QSLGGPVSGR

SEQ ID NO: 140633 - protein, 9 aa, Artificial Sequence
  Description of Artificial Sequence: Synthetic peptide
  Seed: GSRSYVPLA (PMEL_HUMAN)
GMRSYVPLA

SEQ ID NO: 140634 - protein, 11 aa, Artificial Sequence
  Description of Artificial Sequence: Synthetic peptide
  Seed: THTMEVTVYHR (PMEL_HUMAN)
TMTMEVTVYHR

SEQ ID NO: 140635 - protein, 9 aa, Artificial Sequence
  Description of Artificial Sequence: Synthetic peptide
  Seed: VMGTTLAEM (PMEL_HUMAN)
VAGTTLAEF

SEQ ID NO: 140636 - protein, 10 aa, Artificial Sequence
  Description of Artificial Sequence: Synthetic peptide
  Seed: NASFSIALNF (PMEL_HUMAN)
NKSFSIALNW

SEQ ID NO: 140637 - protein, 9 aa, Artificial Sequence
  Description of Artificial Sequence: Synthetic peptide
  Seed: DQVPFSVSV (PMEL_HUMAN)
DEVPFSVSA

SEQ ID NO: 140638 - protein, 11 aa, Artificial Sequence
  Description of Artificial Sequence: Synthetic peptide
  Seed: ILKGGSGTYCL (PMEL_HUMAN)
IQKGGSGTYCY

SEQ ID NO: 140639 - protein, 10 aa, Artificial Sequence
  Description of Artificial Sequence: Synthetic peptide
  Seed: RSFVYVWKTW (PMEL_HUMAN)
RSFVYVWKTY

SEQ ID NO: 140640 - protein, 10 aa, Artificial Sequence
  Description of Artificial Sequence: Synthetic peptide
  Seed: VPLAHSSSAF (PMEL_HUMAN)
VKLAHSSSAY

SEQ ID NO: 140641 - protein, 9 aa, Artificial Sequence
  Description of Artificial Sequence: Synthetic peptide
  Seed: GQVPLIVGI (PMEL_HUMAN)
GVVPLIVGF

SEQ ID NO: 140642 - protein, 9 aa, Artificial Sequence
  Description of Artificial Sequence: Synthetic peptide
  Seed: FTITDQVPF (PMEL_HUMAN)
FMITDQVPA

SEQ ID NO: 140643 - protein, 9 aa, Artificial Sequence
  Description of Artificial Sequence: Synthetic peptide
  Seed: AVVSTQLIM (PMEL_HUMAN)
AEVSTQLIY

SEQ ID NO: 140644 - protein, 9 aa, Artificial Sequence
  Description of Artificial Sequence: Synthetic peptide
  Seed: LQAAIPLTS (PMEL_HUMAN)
LKAAIPLTY

SEQ ID NO: 140645 - protein, 10 aa, Artificial Sequence
  Description of Artificial Sequence: Synthetic peptide
  Seed: YRYGSFSVTL (PMEL_HUMAN)
YLYGSFSVTL

SEQ ID NO: 140646 - protein, 9 aa, Artificial Sequence
  Description of Artificial Sequence: Synthetic peptide
  Seed: KTWGQYWQV (PMEL_HUMAN)
KVWGQYWQW

SEQ ID NO: 140647 - protein, 9 aa, Artificial Sequence
  Description of Artificial Sequence: Synthetic peptide
  Seed: FLRNQPLTF (PMEL_HUMAN)
FTRNQPLTY

SEQ ID NO: 140648 - protein, 10 aa, Artificial Sequence
  Description of Artificial Sequence: Synthetic peptide
  Seed: LIVGILLVLM (PMEL_HUMAN)
LTVGILLVLV

SEQ ID NO: 140649 - protein, 10 aa, Artificial Sequence
  Description of Artificial Sequence: Synthetic peptide
  Seed: LVLMAVVLAS (PMEL_HUMAN)
LYLMAVVLAV

SEQ ID NO: 140650 - protein, 10 aa, Artificial Sequence
  Description of Artificial Sequence: Synthetic peptide
  Seed: RGSRSYVPLA (PMEL_HUMAN)
RASRSYVPLM

SEQ ID NO: 140651 - protein, 9 aa, Artificial Sequence
  Description of Artificial Sequence: Synthetic peptide
  Seed: LIVGILLVL (PMEL_HUMAN)
LAVGILLVY

SEQ ID NO: 140652 - protein, 9 aa, Artificial Sequence
  Description of Artificial Sequence: Synthetic peptide
  Seed: RLMKQDFSV (PMEL_HUMAN)
RLMKQDFSF

SEQ ID NO: 140653 - protein, 11 aa, Artificial Sequence
  Description of Artificial Sequence: Synthetic peptide
  Seed: FGDSSGTLISR (PMEL_HUMAN)
FFDSSGTLISM

SEQ ID NO: 140654 - protein, 9 aa, Artificial Sequence
  Description of Artificial Sequence: Synthetic peptide
  Seed: RTKAWNRQL (PMEL_HUMAN)
RVKAWNRQM

SEQ ID NO: 140655 - protein, 9 aa, Artificial Sequence
  Description of Artificial Sequence: Synthetic peptide
  Seed: HLAVIGALL (PMEL_HUMAN)
HSAVIGALL

SEQ ID NO: 140656 - protein, 8 aa, Artificial Sequence
  Description of Artificial Sequence: Synthetic peptide
  Seed: FGDSSGTL (PMEL_HUMAN)
FSDSSGTM

SEQ ID NO: 140657 - protein, 10 aa, Artificial Sequence
  Description of Artificial Sequence: Synthetic peptide
  Seed: RGSRSYVPLA (PMEL_HUMAN)
RVSRSYVPLG

SEQ ID NO: 140658 - protein, 11 aa, Artificial Sequence
  Description of Artificial Sequence: Synthetic peptide
  Seed: TLIGANASFSI (PMEL_HUMAN)
TMIGANASFSI

SEQ ID NO: 140659 - protein, 10 aa, Artificial Sequence
  Description of Artificial Sequence: Synthetic peptide
  Seed: GDSSGTLISR (PMEL_HUMAN)
GMSSGTLISK

SEQ ID NO: 140660 - protein, 9 aa, Artificial Sequence
  Description of Artificial Sequence: Synthetic peptide
  Seed: KVSNDGPTL (PMEL_HUMAN)
KTSNDGPTY

SEQ ID NO: 140661 - protein, 10 aa, Artificial Sequence
  Description of Artificial Sequence: Synthetic peptide
  Seed: LIVGILLVLM (PMEL_HUMAN)
LVVGILLVLV

SEQ ID NO: 140662 - protein, 10 aa, Artificial Sequence
  Description of Artificial Sequence: Synthetic peptide
  Seed: GDSSGTLISR (PMEL_HUMAN)
GQSSGTLISK

SEQ ID NO: 140663 - protein, 10 aa, Artificial Sequence
  Description of Artificial Sequence: Synthetic peptide
  Seed: RALVVTHTYL (PMEL_HUMAN)
RKLVVTHTYY

SEQ ID NO: 140664 - protein, 10 aa, Artificial Sequence
  Description of Artificial Sequence: Synthetic peptide
  Seed: VLMAVVLASL (PMEL_HUMAN)
VTMAVVLASF

SEQ ID NO: 140665 - protein, 9 aa, Artificial Sequence
  Description of Artificial Sequence: Synthetic peptide
  Seed: VQMPTAEST (PMEL_HUMAN)
VTMPTAESY

SEQ ID NO: 140666 - protein, 10 aa, Artificial Sequence
  Description of Artificial Sequence: Synthetic peptide
  Seed: VLMAVVLASL (PMEL_HUMAN)
VMMAVVLASR

SEQ ID NO: 140667 - protein, 9 aa, Artificial Sequence
  Description of Artificial Sequence: Synthetic peptide
  Seed: VLASLIYRR (PMEL_HUMAN)
VIASLIYRK

SEQ ID NO: 140668 - protein, 10 aa, Artificial Sequence
  Description of Artificial Sequence: Synthetic peptide
  Seed: GPLLDGTATL (PMEL_HUMAN)
GDLLDGTATI

SEQ ID NO: 140669 - protein, 10 aa, Artificial Sequence
  Description of Artificial Sequence: Synthetic peptide
  Seed: LGQVPLIVGI (PMEL_HUMAN)
LMQVPLIVGL

SEQ ID NO: 140670 - protein, 9 aa, Artificial Sequence
  Description of Artificial Sequence: Synthetic peptide
  Seed: SLAVVSTQL (PMEL_HUMAN)
SLAVVSTQR

SEQ ID NO: 140671 - protein, 9 aa, Artificial Sequence
  Description of Artificial Sequence: Synthetic peptide
  Seed: RLVKRQVPL (PMEL_HUMAN)
RPVKRQVPL

SEQ ID NO: 140672 - protein, 11 aa, Artificial Sequence
  Description of Artificial Sequence: Synthetic peptide
  Seed: GSWSQKRSFVY (PMEL_HUMAN)
GQWSQKRSFVY

SEQ ID NO: 140673 - protein, 9 aa, Artificial Sequence
  Description of Artificial Sequence: Synthetic peptide
  Seed: LMAVVLASL (PMEL_HUMAN)
LMAVVLASY

SEQ ID NO: 140674 - protein, 9 aa, Artificial Sequence
  Description of Artificial Sequence: Synthetic peptide
  Seed: ANASFSIAL (PMEL_HUMAN)
AMASFSIAM

SEQ ID NO: 140675 - protein, 10 aa, Artificial Sequence
  Description of Artificial Sequence: Synthetic peptide
  Seed: ASSIMSTESI (PMEL_HUMAN)
AVSIMSTESW

SEQ ID NO: 140676 - protein, 10 aa, Artificial Sequence
  Description of Artificial Sequence: Synthetic peptide
  Seed: LVLMAVVLAS (PMEL_HUMAN)
LFLMAVVLAL

SEQ ID NO: 140677 - protein, 9 aa, Artificial Sequence
  Description of Artificial Sequence: Synthetic peptide
  Seed: VSCQGGLPK (PMEL_HUMAN)
VSCQGGLPM

SEQ ID NO: 140678 - protein, 9 aa, Artificial Sequence
  Description of Artificial Sequence: Synthetic peptide
  Seed: NFPGSQKVL (PMEL_HUMAN)
NLPGSQKVL

SEQ ID NO: 140679 - protein, 10 aa, Artificial Sequence
  Description of Artificial Sequence: Synthetic peptide
  Seed: SQKRSFVYVW (PMEL_HUMAN)
SIKRSFVYVF

SEQ ID NO: 140680 - protein, 11 aa, Artificial Sequence
  Description of Artificial Sequence: Synthetic peptide
  Seed: LGPLLDGTATL (PMEL_HUMAN)
LMPLLDGTATV

SEQ ID NO: 140681 - protein, 9 aa, Artificial Sequence
  Description of Artificial Sequence: Synthetic peptide
  Seed: VVLQAAIPL (PMEL_HUMAN)
VVLQAAIPV

SEQ ID NO: 140682 - protein, 9 aa, Artificial Sequence
  Description of Artificial Sequence: Synthetic peptide
  Seed: MTPEKVPVS (PMEL_HUMAN)
MQPEKVPVL

SEQ ID NO: 140683 - protein, 9 aa, Artificial Sequence
  Description of Artificial Sequence: Synthetic peptide
  Seed: RALVVTHTY (PMEL_HUMAN)
RTLVVTHTV

SEQ ID NO: 140684 - protein, 9 aa, Artificial Sequence
  Description of Artificial Sequence: Synthetic peptide
  Seed: LHLAVIGAL (PMEL_HUMAN)
LSLAVIGAF

SEQ ID NO: 140685 - protein, 11 aa, Artificial Sequence
  Description of Artificial Sequence: Synthetic peptide
  Seed: KVLPDGQVIWV (PMEL_HUMAN)
KVLPDGQVIWW

SEQ ID NO: 140686 - protein, 9 aa, Artificial Sequence
  Description of Artificial Sequence: Synthetic peptide
  Seed: VQMPTAEST (PMEL_HUMAN)
VMMPTAESF

SEQ ID NO: 140687 - protein, 10 aa, Artificial Sequence
  Description of Artificial Sequence: Synthetic peptide
  Seed: LHLAVIGALL (PMEL_HUMAN)
LLLAVIGALI

SEQ ID NO: 140688 - protein, 9 aa, Artificial Sequence
  Description of Artificial Sequence: Synthetic peptide
  Seed: RQVPLDCVL (PMEL_HUMAN)
RHVPLDCVL

SEQ ID NO: 140689 - protein, 9 aa, Artificial Sequence
  Description of Artificial Sequence: Synthetic peptide
  Seed: VVLQAAIPL (PMEL_HUMAN)
VTLQAAIPL

SEQ ID NO: 140690 - protein, 9 aa, Artificial Sequence
  Description of Artificial Sequence: Synthetic peptide
  Seed: TEWVETTAR (PMEL_HUMAN)
TDWVETTAF

SEQ ID NO: 140691 - protein, 11 aa, Artificial Sequence
  Description of Artificial Sequence: Synthetic peptide
  Seed: FGDSSGTLISR (PMEL_HUMAN)
FMDSSGTLISL

SEQ ID NO: 140692 - protein, 9 aa, Artificial Sequence
  Description of Artificial Sequence: Synthetic peptide
  Seed: ASFSIALNF (PMEL_HUMAN)
ALFSIALNW

SEQ ID NO: 140693 - protein, 9 aa, Artificial Sequence
  Description of Artificial Sequence: Synthetic peptide
  Seed: MLGTHTMEV (PMEL_HUMAN)
MIGTHTMEF

SEQ ID NO: 140694 - protein, 9 aa, Artificial Sequence
  Description of Artificial Sequence: Synthetic peptide
  Seed: YLAEADLSY (PMEL_HUMAN)
YYAEADLSL

SEQ ID NO: 140695 - protein, 8 aa, Artificial Sequence
  Description of Artificial Sequence: Synthetic peptide
  Seed: FGDSSGTL (PMEL_HUMAN)
FMDSSGTM

SEQ ID NO: 140696 - protein, 9 aa, Artificial Sequence
  Description of Artificial Sequence: Synthetic peptide
  Seed: TTDGHRPTA (PMEL_HUMAN)
TADGHRPTY

SEQ ID NO: 140697 - protein, 10 aa, Artificial Sequence
  Description of Artificial Sequence: Synthetic peptide
  Seed: YLAEADLSYT (PMEL_HUMAN)
YSAEADLSYL

SEQ ID NO: 140698 - protein, 9 aa, Artificial Sequence
  Description of Artificial Sequence: Synthetic peptide
  Seed: LMAVVLASL (PMEL_HUMAN)
LMAVVLASI

SEQ ID NO: 140699 - protein, 9 aa, Artificial Sequence
  Description of Artificial Sequence: Synthetic peptide
  Seed: RLMKQDFSV (PMEL_HUMAN)
REMKQDFSV

SEQ ID NO: 140700 - protein, 8 aa, Artificial Sequence
  Description of Artificial Sequence: Synthetic peptide
  Seed: FSVSVSQL (PMEL_HUMAN)
FAVSVSQM

SEQ ID NO: 140701 - protein, 10 aa, Artificial Sequence
  Description of Artificial Sequence: Synthetic peptide
  Seed: EVISTAPVQM (PMEL_HUMAN)
ESISTAPVQR

SEQ ID NO: 140702 - protein, 9 aa, Artificial Sequence
  Description of Artificial Sequence: Synthetic peptide
  Seed: TTPGQAPTA (PMEL_HUMAN)
TSPGQAPTL

SEQ ID NO: 140703 - protein, 9 aa, Artificial Sequence
  Description of Artificial Sequence: Synthetic peptide
  Seed: DQVPFSVSV (PMEL_HUMAN)
DTVPFSVSA

SEQ ID NO: 140704 - protein, 10 aa, Artificial Sequence
  Description of Artificial Sequence: Synthetic peptide
  Seed: EVMGTTLAEM (PMEL_HUMAN)
EMMGTTLAEI

SEQ ID NO: 140705 - protein, 10 aa, Artificial Sequence
  Description of Artificial Sequence: Synthetic peptide
  Seed: GQEAGLGQVP (PMEL_HUMAN)
GEEAGLGQVM

SEQ ID NO: 140706 - protein, 9 aa, Artificial Sequence
  Description of Artificial Sequence: Synthetic peptide
  Seed: GGPVSGLSI (PMEL_HUMAN)
GTPVSGLSM

SEQ ID NO: 140707 - protein, 9 aa, Artificial Sequence
  Description of Artificial Sequence: Synthetic peptide
  Seed: LIVGILLVL (PMEL_HUMAN)
LMVGILLVR

SEQ ID NO: 140708 - protein, 10 aa, Artificial Sequence
  Description of Artificial Sequence: Synthetic peptide
  Seed: THTMEVTVYH (PMEL_HUMAN)
TVTMEVTVYY

SEQ ID NO: 140709 - protein, 9 aa, Artificial Sequence
  Description of Artificial Sequence: Synthetic peptide
  Seed: TTPGQAPTA (PMEL_HUMAN)
TYPGQAPTL

SEQ ID NO: 140710 - protein, 8 aa, Artificial Sequence
  Description of Artificial Sequence: Synthetic peptide
  Seed: LLDGTATL (PMEL_HUMAN)
LIDGTATL

SEQ ID NO: 140711 - protein, 11 aa, Artificial Sequence
  Description of Artificial Sequence: Synthetic peptide
  Seed: QAVPSGEGDAF (PMEL_HUMAN)
QQVPSGEGDAL

SEQ ID NO: 140712 - protein, 10 aa, Artificial Sequence
  Description of Artificial Sequence: Synthetic peptide
  Seed: ASSIMSTESI (PMEL_HUMAN)
APSIMSTESF

SEQ ID NO: 140713 - protein, 9 aa, Artificial Sequence
  Description of Artificial Sequence: Synthetic peptide
  Seed: SITGSLGPL (PMEL_HUMAN)
SVTGSLGPF

SEQ ID NO: 140714 - protein, 9 aa, Artificial Sequence
  Description of Artificial Sequence: Synthetic peptide
  Seed: LYPEWTEAQ (PMEL_HUMAN)
LFPEWTEAI

SEQ ID NO: 140715 - protein, 9 aa, Artificial Sequence
  Description of Artificial Sequence: Synthetic peptide
  Seed: MAVVLASLI (PMEL_HUMAN)
MQVVLASLY

SEQ ID NO: 140716 - protein, 10 aa, Artificial Sequence
  Description of Artificial Sequence: Synthetic peptide
  Seed: SLAVVSTQLI (PMEL_HUMAN)
SMAVVSTQLL

SEQ ID NO: 140717 - protein, 10 aa, Artificial Sequence
  Description of Artificial Sequence: Synthetic peptide
  Seed: THTMEVTVYH (PMEL_HUMAN)
TLTMEVTVYY

SEQ ID NO: 140718 - protein, 9 aa, Artificial Sequence
  Description of Artificial Sequence: Synthetic peptide
  Seed: RNQPLTFAL (PMEL_HUMAN)
RTQPLTFAI

SEQ ID NO: 140719 - protein, 9 aa, Artificial Sequence
  Description of Artificial Sequence: Synthetic peptide
  Seed: ANASFSIAL (PMEL_HUMAN)
AAASFSIAM

SEQ ID NO: 140720 - protein, 9 aa, Artificial Sequence
  Description of Artificial Sequence: Synthetic peptide
  Seed: LPDGQVIWV (PMEL_HUMAN)
LIDGQVIWM

SEQ ID NO: 140721 - protein, 9 aa, Artificial Sequence
  Description of Artificial Sequence: Synthetic peptide
  Seed: VSNDGPTLI (PMEL_HUMAN)
VYNDGPTLY

SEQ ID NO: 140722 - protein, 10 aa, Artificial Sequence
  Description of Artificial Sequence: Synthetic peptide
  Seed: TAAQVTTTEW (PMEL_HUMAN)
TSAQVTTTEW

SEQ ID NO: 140723 - protein, 11 aa, Artificial Sequence
  Description of Artificial Sequence: Synthetic peptide
  Seed: RRGSRSYVPLA (PMEL_HUMAN)
RIGSRSYVPLA

SEQ ID NO: 140724 - protein, 9 aa, Artificial Sequence
  Description of Artificial Sequence: Synthetic peptide
  Seed: SITGSLGPL (PMEL_HUMAN)
SQTGSLGPV

SEQ ID NO: 140725 - protein, 9 aa, Artificial Sequence
  Description of Artificial Sequence: Synthetic peptide
  Seed: YHRRGSRSY (PMEL_HUMAN)
YWRRGSRSI

SEQ ID NO: 140726 - protein, 9 aa, Artificial Sequence
  Description of Artificial Sequence: Synthetic peptide
  Seed: LIVGILLVL (PMEL_HUMAN)
LVVGILLVI

SEQ ID NO: 140727 - protein, 9 aa, Artificial Sequence
  Description of Artificial Sequence: Synthetic peptide
  Seed: FTITDQVPF (PMEL_HUMAN)
FKITDQVPY

SEQ ID NO: 140728 - protein, 9 aa, Artificial Sequence
  Description of Artificial Sequence: Synthetic peptide
  Seed: ALNFPGSQK (PMEL_HUMAN)
AYNFPGSQR

SEQ ID NO: 140729 - protein, 9 aa, Artificial Sequence
  Description of Artificial Sequence: Synthetic peptide
  Seed: YHRRGSRSY (PMEL_HUMAN)
YSRRGSRSF

SEQ ID NO: 140730 - protein, 10 aa, Artificial Sequence
  Description of Artificial Sequence: Synthetic peptide
  Seed: LAEADLSYTW (PMEL_HUMAN)
LTEADLSYTY

SEQ ID NO: 140731 - protein, 9 aa, Artificial Sequence
  Description of Artificial Sequence: Synthetic peptide
  Seed: MTPAEVSIV (PMEL_HUMAN)
MMPAEVSIM

SEQ ID NO: 140732 - protein, 10 aa, Artificial Sequence
  Description of Artificial Sequence: Synthetic peptide
  Seed: RRLMKQDFSV (PMEL_HUMAN)
RILMKQDFSL

SEQ ID NO: 140733 - protein, 9 aa, Artificial Sequence
  Description of Artificial Sequence: Synthetic peptide
  Seed: SVPQLPHSS (PMEL_HUMAN)
SAPQLPHSM

SEQ ID NO: 140734 - protein, 10 aa, Artificial Sequence
  Description of Artificial Sequence: Synthetic peptide
  Seed: RALVVTHTYL (PMEL_HUMAN)
RQLVVTHTYF

SEQ ID NO: 140735 - protein, 10 aa, Artificial Sequence
  Description of Artificial Sequence: Synthetic peptide
  Seed: KRQVPLDCVL (PMEL_HUMAN)
KFQVPLDCVF

SEQ ID NO: 140736 - protein, 9 aa, Artificial Sequence
  Description of Artificial Sequence: Synthetic peptide
  Seed: QPVLPSPAC (PMEL_HUMAN)
QPVLPSPAF

SEQ ID NO: 140737 - protein, 10 aa, Artificial Sequence
  Description of Artificial Sequence: Synthetic peptide
  Seed: RGSRSYVPLA (PMEL_HUMAN)
RTSRSYVPLY

SEQ ID NO: 140738 - protein, 9 aa, Artificial Sequence
  Description of Artificial Sequence: Synthetic peptide
  Seed: GGPVSGLSI (PMEL_HUMAN)
GAPVSGLSF

SEQ ID NO: 140739 - protein, 9 aa, Artificial Sequence
  Description of Artificial Sequence: Synthetic peptide
  Seed: VLQAAIPLT (PMEL_HUMAN)
VLQAAIPLA

SEQ ID NO: 140740 - protein, 9 aa, Artificial Sequence
  Description of Artificial Sequence: Synthetic peptide
  Seed: FGDSSGTLI (PMEL_HUMAN)
FTDSSGTLF

SEQ ID NO: 140741 - protein, 9 aa, Artificial Sequence
  Description of Artificial Sequence: Synthetic peptide
  Seed: ESAEILQAV (PMEL_HUMAN)
ELAEILQAK

SEQ ID NO: 140742 - protein, 11 aa, Artificial Sequence
  Description of Artificial Sequence: Synthetic peptide
  Seed: MAVVLASLIYR (PMEL_HUMAN)
MSVVLASLIYK

SEQ ID NO: 140743 - protein, 9 aa, Artificial Sequence
  Description of Artificial Sequence: Synthetic peptide
  Seed: FPDGGPCPS (PMEL_HUMAN)
FMDGGPCPY

SEQ ID NO: 140744 - protein, 9 aa, Artificial Sequence
  Description of Artificial Sequence: Synthetic peptide
  Seed: LDGTATLRL (PMEL_HUMAN)
LEGTATLRL

SEQ ID NO: 140745 - protein, 9 aa, Artificial Sequence
  Description of Artificial Sequence: Synthetic peptide
  Seed: TAEAPNTTA (PMEL_HUMAN)
TSEAPNTTF

SEQ ID NO: 140746 - protein, 9 aa, Artificial Sequence
  Description of Artificial Sequence: Synthetic peptide
  Seed: ESAEILQAV (PMEL_HUMAN)
ELAEILQAV

SEQ ID NO: 140747 - protein, 10 aa, Artificial Sequence
  Description of Artificial Sequence: Synthetic peptide
  Seed: THTMEVTVYH (PMEL_HUMAN)
TDTMEVTVYK

SEQ ID NO: 140748 - protein, 9 aa, Artificial Sequence
  Description of Artificial Sequence: Synthetic peptide
  Seed: RQVPLDCVL (PMEL_HUMAN)
RVVPLDCVF

SEQ ID NO: 140749 - protein, 11 aa, Artificial Sequence
  Description of Artificial Sequence: Synthetic peptide
  Seed: SLKVSNDGPTL (PMEL_HUMAN)
SQKVSNDGPTF

SEQ ID NO: 140750 - protein, 9 aa, Artificial Sequence
  Description of Artificial Sequence: Synthetic peptide
  Seed: YLEPGPVTA (PMEL_HUMAN)
YSEPGPVTF

SEQ ID NO: 140751 - protein, 9 aa, Artificial Sequence
  Description of Artificial Sequence: Synthetic peptide
  Seed: ILKGGSGTY (PMEL_HUMAN)
IKKGGSGTF

SEQ ID NO: 140752 - protein, 9 aa, Artificial Sequence
  Description of Artificial Sequence: Synthetic peptide
  Seed: HTMEVTVYH (PMEL_HUMAN)
HTMEVTVYV

SEQ ID NO: 140753 - protein, 9 aa, Artificial Sequence
  Description of Artificial Sequence: Synthetic peptide
  Seed: VPLDCVLYR (PMEL_HUMAN)
VALDCVLYR

SEQ ID NO: 140754 - protein, 11 aa, Artificial Sequence
  Description of Artificial Sequence: Synthetic peptide
  Seed: KVLPDGQVIWV (PMEL_HUMAN)
KTLPDGQVIWI

SEQ ID NO: 140755 - protein, 9 aa, Artificial Sequence
  Description of Artificial Sequence: Synthetic peptide
  Seed: QVWGGQPVY (PMEL_HUMAN)
QSWGGQPVM

SEQ ID NO: 140756 - protein, 9 aa, Artificial Sequence
  Description of Artificial Sequence: Synthetic peptide
  Seed: SVQVPTTEV (PMEL_HUMAN)
SAQVPTTEH

SEQ ID NO: 140757 - protein, 9 aa, Artificial Sequence
  Description of Artificial Sequence: Synthetic peptide
  Seed: VLPSPACQL (PMEL_HUMAN)
VCPSPACQL

SEQ ID NO: 140758 - protein, 9 aa, Artificial Sequence
  Description of Artificial Sequence: Synthetic peptide
  Seed: VLKRCLLHL (PMEL_HUMAN)
VYKRCLLHY

SEQ ID NO: 140759 - protein, 10 aa, Artificial Sequence
  Description of Artificial Sequence: Synthetic peptide
  Seed: TTTEWVETTA (PMEL_HUMAN)
TVTEWVETTV

SEQ ID NO: 140760 - protein, 8 aa, Artificial Sequence
  Description of Artificial Sequence: Synthetic peptide
  Seed: TLDIVQGI (PMEL_HUMAN)
TFDIVQGI

SEQ ID NO: 140761 - protein, 9 aa, Artificial Sequence
  Description of Artificial Sequence: Synthetic peptide
  Seed: RGSRSYVPL (PMEL_HUMAN)
RTSRSYVPI

SEQ ID NO: 140762 - protein, 9 aa, Artificial Sequence
  Description of Artificial Sequence: Synthetic peptide
  Seed: RALVVTHTY (PMEL_HUMAN)
RVLVVTHTR

SEQ ID NO: 140763 - protein, 9 aa, Artificial Sequence
  Description of Artificial Sequence: Synthetic peptide
  Seed: VQMPTAEST (PMEL_HUMAN)
VRMPTAESA

SEQ ID NO: 140764 - protein, 10 aa, Artificial Sequence
  Description of Artificial Sequence: Synthetic peptide
  Seed: TMEVTVYHRR (PMEL_HUMAN)
TSEVTVYHRR

SEQ ID NO: 140765 - protein, 9 aa, Artificial Sequence
  Description of Artificial Sequence: Synthetic peptide
  Seed: SSHWLRLPR (PMEL_HUMAN)
STHWLRLPR

SEQ ID NO: 140766 - protein, 10 aa, Artificial Sequence
  Description of Artificial Sequence: Synthetic peptide
  Seed: GYLAEADLSY (PMEL_HUMAN)
GKLAEADLSF

SEQ ID NO: 140767 - protein, 10 aa, Artificial Sequence
  Description of Artificial Sequence: Synthetic peptide
  Seed: YRYGSFSVTL (PMEL_HUMAN)
YCYGSFSVTL

SEQ ID NO: 140768 - protein, 10 aa, Artificial Sequence
  Description of Artificial Sequence: Synthetic peptide
  Seed: AVVLASLIYR (PMEL_HUMAN)
AVVLASLIYK

SEQ ID NO: 140769 - protein, 9 aa, Artificial Sequence
  Description of Artificial Sequence: Synthetic peptide
  Seed: TLISRALVV (PMEL_HUMAN)
TTISRALVY

SEQ ID NO: 140770 - protein, 9 aa, Artificial Sequence
  Description of Artificial Sequence: Synthetic peptide
  Seed: GQVPLIVGI (PMEL_HUMAN)
GEVPLIVGV

SEQ ID NO: 140771 - protein, 9 aa, Artificial Sequence
  Description of Artificial Sequence: Synthetic peptide
  Seed: RTKAWNRQL (PMEL_HUMAN)
RLKAWNRQR

SEQ ID NO: 140772 - protein, 10 aa, Artificial Sequence
  Description of Artificial Sequence: Synthetic peptide
  Seed: TAEPSGTTSV (PMEL_HUMAN)
TTEPSGTTSL

SEQ ID NO: 140773 - protein, 11 aa, Artificial Sequence
  Description of Artificial Sequence: Synthetic peptide
  Seed: YLAEADLSYTW (PMEL_HUMAN)
YQAEADLSYTL

SEQ ID NO: 140774 - protein, 10 aa, Artificial Sequence
  Description of Artificial Sequence: Synthetic peptide
  Seed: MTPAEVSIVV (PMEL_HUMAN)
MKPAEVSIVY

SEQ ID NO: 140775 - protein, 10 aa, Artificial Sequence
  Description of Artificial Sequence: Synthetic peptide
  Seed: LAVIGALLAV (PMEL_HUMAN)
LEVIGALLAV

SEQ ID NO: 140776 - protein, 10 aa, Artificial Sequence
  Description of Artificial Sequence: Synthetic peptide
  Seed: MTPAEVSIVV (PMEL_HUMAN)
MKPAEVSIVL

SEQ ID NO: 140777 - protein, 10 aa, Artificial Sequence
  Description of Artificial Sequence: Synthetic peptide
  Seed: TGMTPAEVSI (PMEL_HUMAN)
TFMTPAEVSL

SEQ ID NO: 140778 - protein, 9 aa, Artificial Sequence
  Description of Artificial Sequence: Synthetic peptide
  Seed: AEADLSYTW (PMEL_HUMAN)
AMADLSYTV

SEQ ID NO: 140779 - protein, 9 aa, Artificial Sequence
  Description of Artificial Sequence: Synthetic peptide
  Seed: VLPSPACQL (PMEL_HUMAN)
VLPSPACQY

SEQ ID NO: 140780 - protein, 10 aa, Artificial Sequence
  Description of Artificial Sequence: Synthetic peptide
  Seed: GDSSGTLISR (PMEL_HUMAN)
GISSGTLISK

SEQ ID NO: 140781 - protein, 9 aa, Artificial Sequence
  Description of Artificial Sequence: Synthetic peptide
  Seed: SQKRSFVYV (PMEL_HUMAN)
SMKRSFVYA

SEQ ID NO: 140782 - protein, 9 aa, Artificial Sequence
  Description of Artificial Sequence: Synthetic peptide
  Seed: GQVPTTEVV (PMEL_HUMAN)
GQVPTTEVY

SEQ ID NO: 140783 - protein, 10 aa, Artificial Sequence
  Description of Artificial Sequence: Synthetic peptide
  Seed: HTMEVTVYHR (PMEL_HUMAN)
HIMEVTVYHR

SEQ ID NO: 140784 - protein, 9 aa, Artificial Sequence
  Description of Artificial Sequence: Synthetic peptide
  Seed: DQVPFSVSV (PMEL_HUMAN)
DTVPFSVSV

SEQ ID NO: 140785 - protein, 10 aa, Artificial Sequence
  Description of Artificial Sequence: Synthetic peptide
  Seed: MAVVLASLIY (PMEL_HUMAN)
MWVVLASLIR

SEQ ID NO: 140786 - protein, 9 aa, Artificial Sequence
  Description of Artificial Sequence: Synthetic peptide
  Seed: AEVSIVVLS (PMEL_HUMAN)
AEVSIVVLC

SEQ ID NO: 140787 - protein, 10 aa, Artificial Sequence
  Description of Artificial Sequence: Synthetic peptide
  Seed: AVIGALLAVG (PMEL_HUMAN)
ASIGALLAVV

SEQ ID NO: 140788 - protein, 9 aa, Artificial Sequence
  Description of Artificial Sequence: Synthetic peptide
  Seed: AEPSGTTSV (PMEL_HUMAN)
AMPSGTTSY

SEQ ID NO: 140789 - protein, 10 aa, Artificial Sequence
  Description of Artificial Sequence: Synthetic peptide
  Seed: KTWGQYWQVL (PMEL_HUMAN)
KRWGQYWQVF

SEQ ID NO: 140790 - protein, 9 aa, Artificial Sequence
  Description of Artificial Sequence: Synthetic peptide
  Seed: RALVVTHTY (PMEL_HUMAN)
RILVVTHTK

SEQ ID NO: 140791 - protein, 10 aa, Artificial Sequence
  Description of Artificial Sequence: Synthetic peptide
  Seed: SSSHWLRLPR (PMEL_HUMAN)
SPSHWLRLPK

SEQ ID NO: 140792 - protein, 10 aa, Artificial Sequence
  Description of Artificial Sequence: Synthetic peptide
  Seed: KTWGQYWQVL (PMEL_HUMAN)
KLWGQYWQVS

SEQ ID NO: 140793 - protein, 9 aa, Artificial Sequence
  Description of Artificial Sequence: Synthetic peptide
  Seed: RPTAEAPNT (PMEL_HUMAN)
RPTAEAPNL

SEQ ID NO: 140794 - protein, 10 aa, Artificial Sequence
  Description of Artificial Sequence: Synthetic peptide
  Seed: EVSIVVLSGT (PMEL_HUMAN)
EPSIVVLSGI

SEQ ID NO: 140795 - protein, 10 aa, Artificial Sequence
  Description of Artificial Sequence: Synthetic peptide
  Seed: VLMAVVLASL (PMEL_HUMAN)
VYMAVVLASM

SEQ ID NO: 140796 - protein, 9 aa, Artificial Sequence
  Description of Artificial Sequence: Synthetic peptide
  Seed: LLVLMAVVL (PMEL_HUMAN)
LQVLMAVVY

SEQ ID NO: 140797 - protein, 10 aa, Artificial Sequence
  Description of Artificial Sequence: Synthetic peptide
  Seed: MTPAEVSIVV (PMEL_HUMAN)
MLPAEVSIVM

SEQ ID NO: 140798 - protein, 10 aa, Artificial Sequence
  Description of Artificial Sequence: Synthetic peptide
  Seed: RGSRSYVPLA (PMEL_HUMAN)
RISRSYVPLV

SEQ ID NO: 140799 - protein, 10 aa, Artificial Sequence
  Description of Artificial Sequence: Synthetic peptide
  Seed: VYVWKTWGQY (PMEL_HUMAN)
VYVWKTWGQL

SEQ ID NO: 140800 - protein, 10 aa, Artificial Sequence
  Description of Artificial Sequence: Synthetic peptide
  Seed: EVMGTTLAEM (PMEL_HUMAN)
ESMGTTLAER

SEQ ID NO: 140801 - protein, 8 aa, Artificial Sequence
  Description of Artificial Sequence: Synthetic peptide
  Seed: RELPIPEP (PMEL_HUMAN)
RELPIPEV

SEQ ID NO: 140802 - protein, 9 aa, Artificial Sequence
  Description of Artificial Sequence: Synthetic peptide
  Seed: GILLVLMAV (PMEL_HUMAN)
GLLLVLMAV

SEQ ID NO: 140803 - protein, 10 aa, Artificial Sequence
  Description of Artificial Sequence: Synthetic peptide
  Seed: WKTWGQYWQV (PMEL_HUMAN)
WWTWGQYWQV

SEQ ID NO: 140804 - protein, 9 aa, Artificial Sequence
  Description of Artificial Sequence: Synthetic peptide
  Seed: ESTGMTPEK (PMEL_HUMAN)
EVTGMTPEK

SEQ ID NO: 140805 - protein, 10 aa, Artificial Sequence
  Description of Artificial Sequence: Synthetic peptide
  Seed: LPRIFCSCPI (PMEL_HUMAN)
LPRIFCSCPM

SEQ ID NO: 140806 - protein, 9 aa, Artificial Sequence
  Description of Artificial Sequence: Synthetic peptide
  Seed: YPQETDDAC (PMEL_HUMAN)
YFQETDDAY

SEQ ID NO: 140807 - protein, 9 aa, Artificial Sequence
  Description of Artificial Sequence: Synthetic peptide
  Seed: VLPDGQVIW (PMEL_HUMAN)
VTPDGQVIF

SEQ ID NO: 140808 - protein, 9 aa, Artificial Sequence
  Description of Artificial Sequence: Synthetic peptide
  Seed: RSYVPLAHS (PMEL_HUMAN)
RTYVPLAHL

SEQ ID NO: 140809 - protein, 9 aa, Artificial Sequence
  Description of Artificial Sequence: Synthetic peptide
  Seed: LYRYGSFSV (PMEL_HUMAN)
LWRYGSFSL

SEQ ID NO: 140810 - protein, 10 aa, Artificial Sequence
  Description of Artificial Sequence: Synthetic peptide
  Seed: MTPAEVSIVV (PMEL_HUMAN)
MLPAEVSIVS

SEQ ID NO: 140811 - protein, 9 aa, Artificial Sequence
  Description of Artificial Sequence: Synthetic peptide
  Seed: SQVWGGQPV (PMEL_HUMAN)
SKVWGGQPL

SEQ ID NO: 140812 - protein, 10 aa, Artificial Sequence
  Description of Artificial Sequence: Synthetic peptide
  Seed: SSHWLRLPRI (PMEL_HUMAN)
SWHWLRLPRR

SEQ ID NO: 140813 - protein, 9 aa, Artificial Sequence
  Description of Artificial Sequence: Synthetic peptide
  Seed: AVVSTQLIM (PMEL_HUMAN)
AQVSTQLII

SEQ ID NO: 140814 - protein, 10 aa, Artificial Sequence
  Description of Artificial Sequence: Synthetic peptide
  Seed: KTWGQYWQVL (PMEL_HUMAN)
KLWGQYWQVH

SEQ ID NO: 140815 - protein, 9 aa, Artificial Sequence
  Description of Artificial Sequence: Synthetic peptide
  Seed: GQVPTTEVV (PMEL_HUMAN)
GEVPTTEVP

SEQ ID NO: 140816 - protein, 10 aa, Artificial Sequence
  Description of Artificial Sequence: Synthetic peptide
  Seed: LADTNSLAVV (PMEL_HUMAN)
LLDTNSLAVL

SEQ ID NO: 140817 - protein, 9 aa, Artificial Sequence
  Description of Artificial Sequence: Synthetic peptide
  Seed: TTDGHRPTA (PMEL_HUMAN)
TVDGHRPTC

SEQ ID NO: 140818 - protein, 8 aa, Artificial Sequence
  Description of Artificial Sequence: Synthetic peptide
  Seed: YRYGSFSV (PMEL_HUMAN)
YRYGSFSI

SEQ ID NO: 140819 - protein, 10 aa, Artificial Sequence
  Description of Artificial Sequence: Synthetic peptide
  Seed: ESAEILQAVP (PMEL_HUMAN)
ETAEILQAVD

SEQ ID NO: 140820 - protein, 10 aa, Artificial Sequence
  Description of Artificial Sequence: Synthetic peptide
  Seed: RALDGGNKHF (PMEL_HUMAN)
RKLDGGNKHF

SEQ ID NO: 140821 - protein, 10 aa, Artificial Sequence
  Description of Artificial Sequence: Synthetic peptide
  Seed: RTKAWNRQLY (PMEL_HUMAN)
RYKAWNRQLY

SEQ ID NO: 140822 - protein, 10 aa, Artificial Sequence
  Description of Artificial Sequence: Synthetic peptide
  Seed: YRYGSFSVTL (PMEL_HUMAN)
YEYGSFSVTY

SEQ ID NO: 140823 - protein, 9 aa, Artificial Sequence
  Description of Artificial Sequence: Synthetic peptide
  Seed: HTMEVTVYH (PMEL_HUMAN)
HIMEVTVYY

SEQ ID NO: 140824 - protein, 9 aa, Artificial Sequence
  Description of Artificial Sequence: Synthetic peptide
  Seed: SSIMSTESI (PMEL_HUMAN)
SLIMSTESM

SEQ ID NO: 140825 - protein, 10 aa, Artificial Sequence
  Description of Artificial Sequence: Synthetic peptide
  Seed: MSTESITGSL (PMEL_HUMAN)
MRTESITGSV

SEQ ID NO: 140826 - protein, 10 aa, Artificial Sequence
  Description of Artificial Sequence: Synthetic peptide
  Seed: RRLMKQDFSV (PMEL_HUMAN)
RELMKQDFSI

SEQ ID NO: 140827 - protein, 9 aa, Artificial Sequence
  Description of Artificial Sequence: Synthetic peptide
  Seed: GQVPLIVGI (PMEL_HUMAN)
GQVPLIVGM

SEQ ID NO: 140828 - protein, 10 aa, Artificial Sequence
  Description of Artificial Sequence: Synthetic peptide
  Seed: AVVLASLIYR (PMEL_HUMAN)
ALVLASLIYK

SEQ ID NO: 140829 - protein, 9 aa, Artificial Sequence
  Description of Artificial Sequence: Synthetic peptide
  Seed: YVWKTWGQY (PMEL_HUMAN)
YSWKTWGQL

SEQ ID NO: 140830 - protein, 9 aa, Artificial Sequence
  Description of Artificial Sequence: Synthetic peptide
  Seed: VISTAPVQM (PMEL_HUMAN)
VPSTAPVQY

SEQ ID NO: 140831 - protein, 9 aa, Artificial Sequence
  Description of Artificial Sequence: Synthetic peptide
  Seed: YHRRGSRSY (PMEL_HUMAN)
YWRRGSRSL

SEQ ID NO: 140832 - protein, 10 aa, Artificial Sequence
  Description of Artificial Sequence: Synthetic peptide
  Seed: HTMEVTVYHR (PMEL_HUMAN)
HLMEVTVYHR

SEQ ID NO: 140833 - protein, 9 aa, Artificial Sequence
  Description of Artificial Sequence: Synthetic peptide
  Seed: FGDSSGTLI (PMEL_HUMAN)
FFDSSGTLF

SEQ ID NO: 140834 - protein, 9 aa, Artificial Sequence
  Description of Artificial Sequence: Synthetic peptide
  Seed: RNQPLTFAL (PMEL_HUMAN)
RTQPLTFAV

SEQ ID NO: 140835 - protein, 10 aa, Artificial Sequence
  Description of Artificial Sequence: Synthetic peptide
  Seed: RGSRSYVPLA (PMEL_HUMAN)
RCSRSYVPLK

SEQ ID NO: 140836 - protein, 9 aa, Artificial Sequence
  Description of Artificial Sequence: Synthetic peptide
  Seed: RALVVTHTY (PMEL_HUMAN)
RMLVVTHTK

SEQ ID NO: 140837 - protein, 9 aa, Artificial Sequence
  Description of Artificial Sequence: Synthetic peptide
  Seed: DGGNKHFLR (PMEL_HUMAN)
DVGNKHFLR

SEQ ID NO: 140838 - protein, 11 aa, Artificial Sequence
  Description of Artificial Sequence: Synthetic peptide
  Seed: FGDSSGTLISR (PMEL_HUMAN)
FIDSSGTLISC

SEQ ID NO: 140839 - protein, 9 aa, Artificial Sequence
  Description of Artificial Sequence: Synthetic peptide
  Seed: AVVLASLIY (PMEL_HUMAN)
AMVLASLIF

SEQ ID NO: 140840 - protein, 9 aa, Artificial Sequence
  Description of Artificial Sequence: Synthetic peptide
  Seed: TTDGHRPTA (PMEL_HUMAN)
TFDGHRPTM

SEQ ID NO: 140841 - protein, 9 aa, Artificial Sequence
  Description of Artificial Sequence: Synthetic peptide
  Seed: VQMPTAEST (PMEL_HUMAN)
VVMPTAESY

SEQ ID NO: 140842 - protein, 11 aa, Artificial Sequence
  Description of Artificial Sequence: Synthetic peptide
  Seed: YLAEADLSYTW (PMEL_HUMAN)
YKAEADLSYTW

SEQ ID NO: 140843 - protein, 10 aa, Artificial Sequence
  Description of Artificial Sequence: Synthetic peptide
  Seed: QILKGGSGTY (PMEL_HUMAN)
QLLKGGSGTF

SEQ ID NO: 140844 - protein, 8 aa, Artificial Sequence
  Description of Artificial Sequence: Synthetic peptide
  Seed: LHDPSGYL (PMEL_HUMAN)
LYDPSGYL

SEQ ID NO: 140845 - protein, 10 aa, Artificial Sequence
  Description of Artificial Sequence: Synthetic peptide
  Seed: RNQDWLGVSR (PMEL_HUMAN)
RVQDWLGVSR

SEQ ID NO: 140846 - protein, 11 aa, Artificial Sequence
  Description of Artificial Sequence: Synthetic peptide
  Seed: SQKRSFVYVWK (PMEL_HUMAN)
SAKRSFVYVWR

SEQ ID NO: 140847 - protein, 10 aa, Artificial Sequence
  Description of Artificial Sequence: Synthetic peptide
  Seed: LAEADLSYTW (PMEL_HUMAN)
LQEADLSYTW

SEQ ID NO: 140848 - protein, 10 aa, Artificial Sequence
  Description of Artificial Sequence: Synthetic peptide
  Seed: GPLLDGTATL (PMEL_HUMAN)
GILLDGTATI

SEQ ID NO: 140849 - protein, 11 aa, Artificial Sequence
  Description of Artificial Sequence: Synthetic peptide
  Seed: VLGGPVSGLSI (PMEL_HUMAN)
VQGGPVSGLSW

SEQ ID NO: 140850 - protein, 9 aa, Artificial Sequence
  Description of Artificial Sequence: Synthetic peptide
  Seed: LIVGILLVL (PMEL_HUMAN)
LSVGILLVW

SEQ ID NO: 140851 - protein, 9 aa, Artificial Sequence
  Description of Artificial Sequence: Synthetic peptide
  Seed: QPVLPSPAC (PMEL_HUMAN)
QAVLPSPAV

SEQ ID NO: 140852 - protein, 9 aa, Artificial Sequence
  Description of Artificial Sequence: Synthetic peptide
  Seed: AQRLCQPVL (PMEL_HUMAN)
AMRLCQPVF

SEQ ID NO: 140853 - protein, 9 aa, Artificial Sequence
  Description of Artificial Sequence: Synthetic peptide
  Seed: RTKAWNRQL (PMEL_HUMAN)
RMKAWNRQS

SEQ ID NO: 140854 - protein, 9 aa, Artificial Sequence
  Description of Artificial Sequence: Synthetic peptide
  Seed: VISTAPVQM (PMEL_HUMAN)
VWSTAPVQM

SEQ ID NO: 140855 - protein, 9 aa, Artificial Sequence
  Description of Artificial Sequence: Synthetic peptide
  Seed: RALVVTHTY (PMEL_HUMAN)
RLLVVTHTM

SEQ ID NO: 140856 - protein, 9 aa, Artificial Sequence
  Description of Artificial Sequence: Synthetic peptide
  Seed: QPLTFALQL (PMEL_HUMAN)
QPLTFALQM

SEQ ID NO: 140857 - protein, 11 aa, Artificial Sequence
  Description of Artificial Sequence: Synthetic peptide
  Seed: MAVVLASLIYR (PMEL_HUMAN)
MTVVLASLIYR

SEQ ID NO: 140858 - protein, 10 aa, Artificial Sequence
  Description of Artificial Sequence: Synthetic peptide
  Seed: SAEILQAVPS (PMEL_HUMAN)
SQEILQAVPA

SEQ ID NO: 140859 - protein, 9 aa, Artificial Sequence
  Description of Artificial Sequence: Synthetic peptide
  Seed: NFPGSQKVL (PMEL_HUMAN)
NYPGSQKVF

SEQ ID NO: 140860 - protein, 9 aa, Artificial Sequence
  Description of Artificial Sequence: Synthetic peptide
  Seed: YLAEADLSY (PMEL_HUMAN)
YLAEADLSL

SEQ ID NO: 140861 - protein, 10 aa, Artificial Sequence
  Description of Artificial Sequence: Synthetic peptide
  Seed: LAEADLSYTW (PMEL_HUMAN)
LDEADLSYTW

SEQ ID NO: 140862 - protein, 9 aa, Artificial Sequence
  Description of Artificial Sequence: Synthetic peptide
  Seed: RIFCSCPIG (PMEL_HUMAN)
RLFCSCPIK

SEQ ID NO: 140863 - protein, 10 aa, Artificial Sequence
  Description of Artificial Sequence: Synthetic peptide
  Seed: YRYGSFSVTL (PMEL_HUMAN)
YLYGSFSVTW

SEQ ID NO: 140864 - protein, 10 aa, Artificial Sequence
  Description of Artificial Sequence: Synthetic peptide
  Seed: AVPSGEGDAF (PMEL_HUMAN)
AMPSGEGDAM

SEQ ID NO: 140865 - protein, 9 aa, Artificial Sequence
  Description of Artificial Sequence: Synthetic peptide
  Seed: IMPGQEAGL (PMEL_HUMAN)
IAPGQEAGM

SEQ ID NO: 140866 - protein, 9 aa, Artificial Sequence
  Description of Artificial Sequence: Synthetic peptide
  Seed: ASFSIALNF (PMEL_HUMAN)
AYFSIALNI

SEQ ID NO: 140867 - protein, 11 aa, Artificial Sequence
  Description of Artificial Sequence: Synthetic peptide
  Seed: TEVISTAPVQM (PMEL_HUMAN)
TEVISTAPVQW

SEQ ID NO: 140868 - protein, 9 aa, Artificial Sequence
  Description of Artificial Sequence: Synthetic peptide
  Seed: YLAEADLSY (PMEL_HUMAN)
YKAEADLSM

SEQ ID NO: 140869 - protein, 10 aa, Artificial Sequence
  Description of Artificial Sequence: Synthetic peptide
  Seed: RQLYPEWTEA (PMEL_HUMAN)
RKLYPEWTEV

SEQ ID NO: 140870 - protein, 11 aa, Artificial Sequence
  Description of Artificial Sequence: Synthetic peptide
  Seed: KAWNRQLYPEW (PMEL_HUMAN)
KVWNRQLYPEW

SEQ ID NO: 140871 - protein, 9 aa, Artificial Sequence
  Description of Artificial Sequence: Synthetic peptide
  Seed: KHFLRNQPL (PMEL_HUMAN)
KYFLRNQPI

SEQ ID NO: 140872 - protein, 10 aa, Artificial Sequence
  Description of Artificial Sequence: Synthetic peptide
  Seed: RGSRSYVPLA (PMEL_HUMAN)
RESRSYVPLL

SEQ ID NO: 140873 - protein, 9 aa, Artificial Sequence
  Description of Artificial Sequence: Synthetic peptide
  Seed: RAMLGTHTM (PMEL_HUMAN)
RWMLGTHTY

SEQ ID NO: 140874 - protein, 9 aa, Artificial Sequence
  Description of Artificial Sequence: Synthetic peptide
  Seed: FGDSSGTLI (PMEL_HUMAN)
FTDSSGTLI

SEQ ID NO: 140875 - protein, 9 aa, Artificial Sequence
  Description of Artificial Sequence: Synthetic peptide
  Seed: AGLGQVPLI (PMEL_HUMAN)
AALGQVPLL

SEQ ID NO: 140876 - protein, 10 aa, Artificial Sequence
  Description of Artificial Sequence: Synthetic peptide
  Seed: KTWGQYWQVL (PMEL_HUMAN)
KSWGQYWQVY

SEQ ID NO: 140877 - protein, 9 aa, Artificial Sequence
  Description of Artificial Sequence: Synthetic peptide
  Seed: AQVTTTEWV (PMEL_HUMAN)
ALVTTTEWA

SEQ ID NO: 140878 - protein, 10 aa, Artificial Sequence
  Description of Artificial Sequence: Synthetic peptide
  Seed: GPLLDGTATL (PMEL_HUMAN)
GHLLDGTATI

SEQ ID NO: 140879 - protein, 10 aa, Artificial Sequence
  Description of Artificial Sequence: Synthetic peptide
  Seed: AVIGALLAVG (PMEL_HUMAN)
AVIGALLAVY

SEQ ID NO: 140880 - protein, 9 aa, Artificial Sequence
  Description of Artificial Sequence: Synthetic peptide
  Seed: AGLGQVPLI (PMEL_HUMAN)
ARLGQVPLL

SEQ ID NO: 140881 - protein, 10 aa, Artificial Sequence
  Description of Artificial Sequence: Synthetic peptide
  Seed: SRALVVTHTY (PMEL_HUMAN)
SAALVVTHTY

SEQ ID NO: 140882 - protein, 10 aa, Artificial Sequence
  Description of Artificial Sequence: Synthetic peptide
  Seed: THTMEVTVYH (PMEL_HUMAN)
TATMEVTVYY

SEQ ID NO: 140883 - protein, 11 aa, Artificial Sequence
  Description of Artificial Sequence: Synthetic peptide
  Seed: KHFLRNQPLTF (PMEL_HUMAN)
KYFLRNQPLTL

SEQ ID NO: 140884 - protein, 9 aa, Artificial Sequence
  Description of Artificial Sequence: Synthetic peptide
  Seed: RGGQVSLKV (PMEL_HUMAN)
RQGQVSLKL

SEQ ID NO: 140885 - protein, 9 aa, Artificial Sequence
  Description of Artificial Sequence: Synthetic peptide
  Seed: FLRNQPLTF (PMEL_HUMAN)
FSRNQPLTY

SEQ ID NO: 140886 - protein, 9 aa, Artificial Sequence
  Description of Artificial Sequence: Synthetic peptide
  Seed: CWRGGQVSL (PMEL_HUMAN)
CFRGGQVSF

SEQ ID NO: 140887 - protein, 10 aa, Artificial Sequence
  Description of Artificial Sequence: Synthetic peptide
  Seed: SHWLRLPRIF (PMEL_HUMAN)
SYWLRLPRIF

SEQ ID NO: 140888 - protein, 11 aa, Artificial Sequence
  Description of Artificial Sequence: Synthetic peptide
  Seed: SQKRSFVYVWK (PMEL_HUMAN)
SVKRSFVYVWK

SEQ ID NO: 140889 - protein, 9 aa, Artificial Sequence
  Description of Artificial Sequence: Synthetic peptide
  Seed: FLRNQPLTF (PMEL_HUMAN)
FPRNQPLTM

SEQ ID NO: 140890 - protein, 9 aa, Artificial Sequence
  Description of Artificial Sequence: Synthetic peptide
  Seed: QVWGGQPVY (PMEL_HUMAN)
QAWGGQPVM

SEQ ID NO: 140891 - protein, 9 aa, Artificial Sequence
  Description of Artificial Sequence: Synthetic peptide
  Seed: TPAEVSIVV (PMEL_HUMAN)
TMAEVSIVM

SEQ ID NO: 140892 - protein, 9 aa, Artificial Sequence
  Description of Artificial Sequence: Synthetic peptide
  Seed: YLAEADLSY (PMEL_HUMAN)
YIAEADLSF

SEQ ID NO: 140893 - protein, 9 aa, Artificial Sequence
  Description of Artificial Sequence: Synthetic peptide
  Seed: LYRYGSFSV (PMEL_HUMAN)
LFRYGSFSM

SEQ ID NO: 140894 - protein, 9 aa, Artificial Sequence
  Description of Artificial Sequence: Synthetic peptide
  Seed: TMEVTVYHR (PMEL_HUMAN)
TVEVTVYHR

SEQ ID NO: 140895 - protein, 9 aa, Artificial Sequence
  Description of Artificial Sequence: Synthetic peptide
  Seed: EVMGTTLAE (PMEL_HUMAN)
ETMGTTLAM

SEQ ID NO: 140896 - protein, 8 aa, Artificial Sequence
  Description of Artificial Sequence: Synthetic peptide
  Seed: SNDGPTLI (PMEL_HUMAN)
SYDGPTLM

SEQ ID NO: 140897 - protein, 9 aa, Artificial Sequence
  Description of Artificial Sequence: Synthetic peptide
  Seed: SVQVPTTEV (PMEL_HUMAN)
SMQVPTTEL

SEQ ID NO: 140898 - protein, 9 aa, Artificial Sequence
  Description of Artificial Sequence: Synthetic peptide
  Seed: VQVPTTEVI (PMEL_HUMAN)
VEVPTTEVA

SEQ ID NO: 140899 - protein, 10 aa, Artificial Sequence
  Description of Artificial Sequence: Synthetic peptide
  Seed: RALVVTHTYL (PMEL_HUMAN)
RLLVVTHTYI

SEQ ID NO: 140900 - protein, 10 aa, Artificial Sequence
  Description of Artificial Sequence: Synthetic peptide
  Seed: AMLGTHTMEV (PMEL_HUMAN)
AWLGTHTMEV

SEQ ID NO: 140901 - protein, 10 aa, Artificial Sequence
  Description of Artificial Sequence: Synthetic peptide
  Seed: MTPAEVSIVV (PMEL_HUMAN)
MGPAEVSIVI

SEQ ID NO: 140902 - protein, 10 aa, Artificial Sequence
  Description of Artificial Sequence: Synthetic peptide
  Seed: VPRNQDWLGV (PMEL_HUMAN)
VPRNQDWLGM

SEQ ID NO: 140903 - protein, 9 aa, Artificial Sequence
  Description of Artificial Sequence: Synthetic peptide
  Seed: ITDQVPFSV (PMEL_HUMAN)
INDQVPFSF

SEQ ID NO: 140904 - protein, 9 aa, Artificial Sequence
  Description of Artificial Sequence: Synthetic peptide
  Seed: RLMKQDFSV (PMEL_HUMAN)
RQMKQDFSY

SEQ ID NO: 140905 - protein, 9 aa, Artificial Sequence
  Description of Artificial Sequence: Synthetic peptide
  Seed: VVLQAAIPL (PMEL_HUMAN)
VKLQAAIPF

SEQ ID NO: 140906 - protein, 9 aa, Artificial Sequence
  Description of Artificial Sequence: Synthetic peptide
  Seed: SRALVVTHT (PMEL_HUMAN)
SRALVVTHV

SEQ ID NO: 140907 - protein, 9 aa, Artificial Sequence
  Description of Artificial Sequence: Synthetic peptide
  Seed: NFPGSQKVL (PMEL_HUMAN)
NTPGSQKVL

SEQ ID NO: 140908 - protein, 10 aa, Artificial Sequence
  Description of Artificial Sequence: Synthetic peptide
  Seed: RQVPLDCVLY (PMEL_HUMAN)
RTVPLDCVLY

SEQ ID NO: 140909 - protein, 9 aa, Artificial Sequence
  Description of Artificial Sequence: Synthetic peptide
  Seed: VMGTTLAEM (PMEL_HUMAN)
VLGTTLAEI

SEQ ID NO: 140910 - protein, 10 aa, Artificial Sequence
  Description of Artificial Sequence: Synthetic peptide
  Seed: KVLPDGQVIW (PMEL_HUMAN)
KELPDGQVIW

SEQ ID NO: 140911 - protein, 9 aa, Artificial Sequence
  Description of Artificial Sequence: Synthetic peptide
  Seed: ANASFSIAL (PMEL_HUMAN)
AAASFSIAV

SEQ ID NO: 140912 - protein, 10 aa, Artificial Sequence
  Description of Artificial Sequence: Synthetic peptide
  Seed: MSTESITGSL (PMEL_HUMAN)
MTTESITGSI

SEQ ID NO: 140913 - protein, 10 aa, Artificial Sequence
  Description of Artificial Sequence: Synthetic peptide
  Seed: LHLAVIGALL (PMEL_HUMAN)
LILAVIGALV

SEQ ID NO: 140914 - protein, 10 aa, Artificial Sequence
  Description of Artificial Sequence: Synthetic peptide
  Seed: RGSRSYVPLA (PMEL_HUMAN)
RNSRSYVPLS

SEQ ID NO: 140915 - protein, 9 aa, Artificial Sequence
  Description of Artificial Sequence: Synthetic peptide
  Seed: GSRSYVPLA (PMEL_HUMAN)
GARSYVPLA

SEQ ID NO: 140916 - protein, 9 aa, Artificial Sequence
  Description of Artificial Sequence: Synthetic peptide
  Seed: LNFPGSQKV (PMEL_HUMAN)
LGFPGSQKY

SEQ ID NO: 140917 - protein, 9 aa, Artificial Sequence
  Description of Artificial Sequence: Synthetic peptide
  Seed: SAFTITDQV (PMEL_HUMAN)
STFTITDQA

SEQ ID NO: 140918 - protein, 9 aa, Artificial Sequence
  Description of Artificial Sequence: Synthetic peptide
  Seed: TLIGANASF (PMEL_HUMAN)
TTIGANASF

SEQ ID NO: 140919 - protein, 10 aa, Artificial Sequence
  Description of Artificial Sequence: Synthetic peptide
  Seed: GPLLDGTATL (PMEL_HUMAN)
GLLLDGTATA

SEQ ID NO: 140920 - protein, 10 aa, Artificial Sequence
  Description of Artificial Sequence: Synthetic peptide
  Seed: VYVWKTWGQY (PMEL_HUMAN)
VWVWKTWGQF

SEQ ID NO: 140921 - protein, 10 aa, Artificial Sequence
  Description of Artificial Sequence: Synthetic peptide
  Seed: RQLYPEWTEA (PMEL_HUMAN)
RKLYPEWTEF

SEQ ID NO: 140922 - protein, 10 aa, Artificial Sequence
  Description of Artificial Sequence: Synthetic peptide
  Seed: SVPQLPHSSS (PMEL_HUMAN)
SEPQLPHSSA

SEQ ID NO: 140923 - protein, 10 aa, Artificial Sequence
  Description of Artificial Sequence: Synthetic peptide
  Seed: EVSIVVLSGT (PMEL_HUMAN)
EESIVVLSGI

SEQ ID NO: 140924 - protein, 9 aa, Artificial Sequence
  Description of Artificial Sequence: Synthetic peptide
  Seed: AGQVPTTEV (PMEL_HUMAN)
AAQVPTTEY

SEQ ID NO: 140925 - protein, 9 aa, Artificial Sequence
  Description of Artificial Sequence: Synthetic peptide
  Seed: VLYRYGSFS (PMEL_HUMAN)
VLYRYGSFL

SEQ ID NO: 140926 - protein, 9 aa, Artificial Sequence
  Description of Artificial Sequence: Synthetic peptide
  Seed: LHLAVIGAL (PMEL_HUMAN)
LELAVIGAF

SEQ ID NO: 140927 - protein, 9 aa, Artificial Sequence
  Description of Artificial Sequence: Synthetic peptide
  Seed: SVPQLPHSS (PMEL_HUMAN)
SSPQLPHSV

SEQ ID NO: 140928 - protein, 9 aa, Artificial Sequence
  Description of Artificial Sequence: Synthetic peptide
  Seed: TKAWNRQLY (PMEL_HUMAN)
TQAWNRQLF

SEQ ID NO: 140929 - protein, 9 aa, Artificial Sequence
  Description of Artificial Sequence: Synthetic peptide
  Seed: AAQVTTTEW (PMEL_HUMAN)
AVQVTTTEY

SEQ ID NO: 140930 - protein, 9 aa, Artificial Sequence
  Description of Artificial Sequence: Synthetic peptide
  Seed: LVLMAVVLA (PMEL_HUMAN)
LQLMAVVLL

SEQ ID NO: 140931 - protein, 10 aa, Artificial Sequence
  Description of Artificial Sequence: Synthetic peptide
  Seed: LAVIGALLAV (PMEL_HUMAN)
LTVIGALLAV

SEQ ID NO: 140932 - protein, 9 aa, Artificial Sequence
  Description of Artificial Sequence: Synthetic peptide
  Seed: SLAVVSTQL (PMEL_HUMAN)
SMAVVSTQA

SEQ ID NO: 140933 - protein, 10 aa, Artificial Sequence
  Description of Artificial Sequence: Synthetic peptide
  Seed: GPLLDGTATL (PMEL_HUMAN)
GDLLDGTATL

SEQ ID NO: 140934 - protein, 10 aa, Artificial Sequence
  Description of Artificial Sequence: Synthetic peptide
  Seed: LMAVVLASLI (PMEL_HUMAN)
LTAVVLASLV

SEQ ID NO: 140935 - protein, 9 aa, Artificial Sequence
  Description of Artificial Sequence: Synthetic peptide
  Seed: SQVWGGQPV (PMEL_HUMAN)
SMVWGGQPI

SEQ ID NO: 140936 - protein, 10 aa, Artificial Sequence
  Description of Artificial Sequence: Synthetic peptide
  Seed: TDQVPFSVSV (PMEL_HUMAN)
TPQVPFSVSV

SEQ ID NO: 140937 - protein, 10 aa, Artificial Sequence
  Description of Artificial Sequence: Synthetic peptide
  Seed: EVMGTTLAEM (PMEL_HUMAN)
ETMGTTLAEV

SEQ ID NO: 140938 - protein, 8 aa, Artificial Sequence
  Description of Artificial Sequence: Synthetic peptide
  Seed: LAHSSSAF (PMEL_HUMAN)
LQHSSSAF

SEQ ID NO: 140939 - protein, 11 aa, Artificial Sequence
  Description of Artificial Sequence: Synthetic peptide
  Seed: TVYHRRGSRSY (PMEL_HUMAN)
TMYHRRGSRSF

SEQ ID NO: 140940 - protein, 10 aa, Artificial Sequence
  Description of Artificial Sequence: Synthetic peptide
  Seed: LAVIGALLAV (PMEL_HUMAN)
LVVIGALLAA

SEQ ID NO: 140941 - protein, 9 aa, Artificial Sequence
  Description of Artificial Sequence: Synthetic peptide
  Seed: KAWNRQLYP (PMEL_HUMAN)
KIWNRQLYI

SEQ ID NO: 140942 - protein, 10 aa, Artificial Sequence
  Description of Artificial Sequence: Synthetic peptide
  Seed: RTKAWNRQLY (PMEL_HUMAN)
RQKAWNRQLM

SEQ ID NO: 140943 - protein, 9 aa, Artificial Sequence
  Description of Artificial Sequence: Synthetic peptide
  Seed: SVQVPTTEV (PMEL_HUMAN)
SIQVPTTEV

SEQ ID NO: 140944 - protein, 9 aa, Artificial Sequence
  Description of Artificial Sequence: Synthetic peptide
  Seed: HTMEVTVYH (PMEL_HUMAN)
HAMEVTVYY

SEQ ID NO: 140945 - protein, 8 aa, Artificial Sequence
  Description of Artificial Sequence: Synthetic peptide
  Seed: HFLRNQPL (PMEL_HUMAN)
HYLRNQPM

SEQ ID NO: 140946 - protein, 9 aa, Artificial Sequence
  Description of Artificial Sequence: Synthetic peptide
  Seed: SFVYVWKTW (PMEL_HUMAN)
SYVYVWKTI

SEQ ID NO: 140947 - protein, 10 aa, Artificial Sequence
  Description of Artificial Sequence: Synthetic peptide
  Seed: VLMAVVLASL (PMEL_HUMAN)
VKMAVVLASF

SEQ ID NO: 140948 - protein, 9 aa, Artificial Sequence
  Description of Artificial Sequence: Synthetic peptide
  Seed: RAMLGTHTM (PMEL_HUMAN)
RPMLGTHTL

SEQ ID NO: 140949 - protein, 10 aa, Artificial Sequence
  Description of Artificial Sequence: Synthetic peptide
  Seed: GDSSGTLISR (PMEL_HUMAN)
GCSSGTLISK

SEQ ID NO: 140950 - protein, 9 aa, Artificial Sequence
  Description of Artificial Sequence: Synthetic peptide
  Seed: GQVPTTEVV (PMEL_HUMAN)
GQVPTTEVW

SEQ ID NO: 140951 - protein, 9 aa, Artificial Sequence
  Description of Artificial Sequence: Synthetic peptide
  Seed: STAPVQMPT (PMEL_HUMAN)
SQAPVQMPM

SEQ ID NO: 140952 - protein, 9 aa, Artificial Sequence
  Description of Artificial Sequence: Synthetic peptide
  Seed: KVSNDGPTL (PMEL_HUMAN)
KTSNDGPTI

SEQ ID NO: 140953 - protein, 9 aa, Artificial Sequence
  Description of Artificial Sequence: Synthetic peptide
  Seed: GSWSQKRSF (PMEL_HUMAN)
GRWSQKRSF

SEQ ID NO: 140954 - protein, 9 aa, Artificial Sequence
  Description of Artificial Sequence: Synthetic peptide
  Seed: TYLEPGPVT (PMEL_HUMAN)
TFLEPGPVF

SEQ ID NO: 140955 - protein, 10 aa, Artificial Sequence
  Description of Artificial Sequence: Synthetic peptide
  Seed: AVVLASLIYR (PMEL_HUMAN)
AIVLASLIYR

SEQ ID NO: 140956 - protein, 9 aa, Artificial Sequence
  Description of Artificial Sequence: Synthetic peptide
  Seed: KHFLRNQPL (PMEL_HUMAN)
KWFLRNQPM

SEQ ID NO: 140957 - protein, 11 aa, Artificial Sequence
  Description of Artificial Sequence: Synthetic peptide
  Seed: RTKAWNRQLYP (PMEL_HUMAN)
RYKAWNRQLYK

SEQ ID NO: 140958 - protein, 10 aa, Artificial Sequence
  Description of Artificial Sequence: Synthetic peptide
  Seed: SSSHWLRLPR (PMEL_HUMAN)
SASHWLRLPK

SEQ ID NO: 140959 - protein, 9 aa, Artificial Sequence
  Description of Artificial Sequence: Synthetic peptide
  Seed: ITGSLGPLL (PMEL_HUMAN)
ILGSLGPLV

SEQ ID NO: 140960 - protein, 10 aa, Artificial Sequence
  Description of Artificial Sequence: Synthetic peptide
  Seed: VLMAVVLASL (PMEL_HUMAN)
VVMAVVLASV

SEQ ID NO: 140961 - protein, 9 aa, Artificial Sequence
  Description of Artificial Sequence: Synthetic peptide
  Seed: KVLPDGQVI (PMEL_HUMAN)
KALPDGQVH

SEQ ID NO: 140962 - protein, 9 aa, Artificial Sequence
  Description of Artificial Sequence: Synthetic peptide
  Seed: FSVSVSQLR (PMEL_HUMAN)
FVVSVSQLM

SEQ ID NO: 140963 - protein, 10 aa, Artificial Sequence
  Description of Artificial Sequence: Synthetic peptide
  Seed: EVMGTTLAEM (PMEL_HUMAN)
EIMGTTLAEW

SEQ ID NO: 140964 - protein, 9 aa, Artificial Sequence
  Description of Artificial Sequence: Synthetic peptide
  Seed: QVIWVNNTI (PMEL_HUMAN)
QAIWVNNTR

SEQ ID NO: 140965 - protein, 9 aa, Artificial Sequence
  Description of Artificial Sequence: Synthetic peptide
  Seed: RELPIPEPE (PMEL_HUMAN)
RELPIPEPT

SEQ ID NO: 140966 - protein, 9 aa, Artificial Sequence
  Description of Artificial Sequence: Synthetic peptide
  Seed: SPVPGTTDG (PMEL_HUMAN)
SPVPGTTDM

SEQ ID NO: 140967 - protein, 10 aa, Artificial Sequence
  Description of Artificial Sequence: Synthetic peptide
  Seed: YVPLAHSSSA (PMEL_HUMAN)
YSPLAHSSSL

SEQ ID NO: 140968 - protein, 9 aa, Artificial Sequence
  Description of Artificial Sequence: Synthetic peptide
  Seed: ASFSIALNF (PMEL_HUMAN)
ATFSIALNF

SEQ ID NO: 140969 - protein, 10 aa, Artificial Sequence
  Description of Artificial Sequence: Synthetic peptide
  Seed: RGSRSYVPLA (PMEL_HUMAN)
RSSRSYVPLA

SEQ ID NO: 140970 - protein, 9 aa, Artificial Sequence
  Description of Artificial Sequence: Synthetic peptide
  Seed: HTMEVTVYH (PMEL_HUMAN)
HPMEVTVYH

SEQ ID NO: 140971 - protein, 10 aa, Artificial Sequence
  Description of Artificial Sequence: Synthetic peptide
  Seed: VLMAVVLASL (PMEL_HUMAN)
VFMAVVLASY

SEQ ID NO: 140972 - protein, 9 aa, Artificial Sequence
  Description of Artificial Sequence: Synthetic peptide
  Seed: ITGSLGPLL (PMEL_HUMAN)
IIGSLGPLV

SEQ ID NO: 140973 - protein, 9 aa, Artificial Sequence
  Description of Artificial Sequence: Synthetic peptide
  Seed: LMAVVLASL (PMEL_HUMAN)
LKAVVLASY

SEQ ID NO: 140974 - protein, 9 aa, Artificial Sequence
  Description of Artificial Sequence: Synthetic peptide
  Seed: SQKRSFVYV (PMEL_HUMAN)
SMKRSFVYM

SEQ ID NO: 140975 - protein, 9 aa, Artificial Sequence
  Description of Artificial Sequence: Synthetic peptide
  Seed: FLRNQPLTF (PMEL_HUMAN)
FRRNQPLTF

SEQ ID NO: 140976 - protein, 10 aa, Artificial Sequence
  Description of Artificial Sequence: Synthetic peptide
  Seed: LVLMAVVLAS (PMEL_HUMAN)
LTLMAVVLAL

SEQ ID NO: 140977 - protein, 9 aa, Artificial Sequence
  Description of Artificial Sequence: Synthetic peptide
  Seed: EVMGTTLAE (PMEL_HUMAN)
EAMGTTLAK

SEQ ID NO: 140978 - protein, 9 aa, Artificial Sequence
  Description of Artificial Sequence: Synthetic peptide
  Seed: VQVPTTEVI (PMEL_HUMAN)
VQVPTTEVV

SEQ ID NO: 140979 - protein, 11 aa, Artificial Sequence
  Description of Artificial Sequence: Synthetic peptide
  Seed: RYGSFSVTLDI (PMEL_HUMAN)
RTGSFSVTLDY

SEQ ID NO: 140980 - protein, 10 aa, Artificial Sequence
  Description of Artificial Sequence: Synthetic peptide
  Seed: YRYGSFSVTL (PMEL_HUMAN)
YEYGSFSVTW

SEQ ID NO: 140981 - protein, 9 aa, Artificial Sequence
  Description of Artificial Sequence: Synthetic peptide
  Seed: YLEPGPVTA (PMEL_HUMAN)
YQEPGPVTV

SEQ ID NO: 140982 - protein, 9 aa, Artificial Sequence
  Description of Artificial Sequence: Synthetic peptide
  Seed: LQAAIPLTS (PMEL_HUMAN)
LGAAIPLTY

SEQ ID NO: 140983 - protein, 11 aa, Artificial Sequence
  Description of Artificial Sequence: Synthetic peptide
  Seed: RRRLMKQDFSV (PMEL_HUMAN)
RQRLMKQDFSV

SEQ ID NO: 140984 - protein, 10 aa, Artificial Sequence
  Description of Artificial Sequence: Synthetic peptide
  Seed: SGTYCLNVSL (PMEL_HUMAN)
SGTYCLNVSY

SEQ ID NO: 140985 - protein, 10 aa, Artificial Sequence
  Description of Artificial Sequence: Synthetic peptide
  Seed: RSFVYVWKTW (PMEL_HUMAN)
RIFVYVWKTW

SEQ ID NO: 140986 - protein, 9 aa, Artificial Sequence
  Description of Artificial Sequence: Synthetic peptide
  Seed: RALDGGNKH (PMEL_HUMAN)
RMLDGGNKL

SEQ ID NO: 140987 - protein, 10 aa, Artificial Sequence
  Description of Artificial Sequence: Synthetic peptide
  Seed: ASSIMSTESI (PMEL_HUMAN)
AGSIMSTESW

SEQ ID NO: 140988 - protein, 10 aa, Artificial Sequence
  Description of Artificial Sequence: Synthetic peptide
  Seed: RSFVYVWKTW (PMEL_HUMAN)
RTFVYVWKTY

SEQ ID NO: 140989 - protein, 10 aa, Artificial Sequence
  Description of Artificial Sequence: Synthetic peptide
  Seed: LGQVPLIVGI (PMEL_HUMAN)
LRQVPLIVGV

SEQ ID NO: 140990 - protein, 10 aa, Artificial Sequence
  Description of Artificial Sequence: Synthetic peptide
  Seed: SQVWGGQPVY (PMEL_HUMAN)
SFVWGGQPVY

SEQ ID NO: 140991 - protein, 9 aa, Artificial Sequence
  Description of Artificial Sequence: Synthetic peptide
  Seed: VVLQAAIPL (PMEL_HUMAN)
VQLQAAIPA

SEQ ID NO: 140992 - protein, 10 aa, Artificial Sequence
  Description of Artificial Sequence: Synthetic peptide
  Seed: RGSRSYVPLA (PMEL_HUMAN)
RTSRSYVPLP

SEQ ID NO: 140993 - protein, 9 aa, Artificial Sequence
  Description of Artificial Sequence: Synthetic peptide
  Seed: KHFLRNQPL (PMEL_HUMAN)
KEFLRNQPM

SEQ ID NO: 140994 - protein, 9 aa, Artificial Sequence
  Description of Artificial Sequence: Synthetic peptide
  Seed: AVIGALLAV (PMEL_HUMAN)
AFIGALLAY

SEQ ID NO: 140995 - protein, 9 aa, Artificial Sequence
  Description of Artificial Sequence: Synthetic peptide
  Seed: TTDGHRPTA (PMEL_HUMAN)
TIDGHRPTY

SEQ ID NO: 140996 - protein, 10 aa, Artificial Sequence
  Description of Artificial Sequence: Synthetic peptide
  Seed: SSSHWLRLPR (PMEL_HUMAN)
SISHWLRLPK

SEQ ID NO: 140997 - protein, 9 aa, Artificial Sequence
  Description of Artificial Sequence: Synthetic peptide
  Seed: VPTTEVIST (PMEL_HUMAN)
VPTTEVISV

SEQ ID NO: 140998 - protein, 9 aa, Artificial Sequence
  Description of Artificial Sequence: Synthetic peptide
  Seed: SITGSLGPL (PMEL_HUMAN)
SATGSLGPV

SEQ ID NO: 140999 - protein, 9 aa, Artificial Sequence
  Description of Artificial Sequence: Synthetic peptide
  Seed: KHFLRNQPL (PMEL_HUMAN)
KTFLRNQPF

SEQ ID NO: 141000 - protein, 9 aa, Artificial Sequence
  Description of Artificial Sequence: Synthetic peptide
  Seed: TTDGHRPTA (PMEL_HUMAN)
TRDGHRPTF

SEQ ID NO: 141001 - protein, 9 aa, Artificial Sequence
  Description of Artificial Sequence: Synthetic peptide
  Seed: AVIGALLAV (PMEL_HUMAN)
AQIGALLAS

SEQ ID NO: 141002 - protein, 9 aa, Artificial Sequence
  Description of Artificial Sequence: Synthetic peptide
  Seed: FGDSSGTLI (PMEL_HUMAN)
FMDSSGTLI

SEQ ID NO: 141003 - protein, 9 aa, Artificial Sequence
  Description of Artificial Sequence: Synthetic peptide
  Seed: TIINGSQVW (PMEL_HUMAN)
TVINGSQVW

SEQ ID NO: 141004 - protein, 9 aa, Artificial Sequence
  Description of Artificial Sequence: Synthetic peptide
  Seed: MTPAEVSIV (PMEL_HUMAN)
MAPAEVSIL

SEQ ID NO: 141005 - protein, 10 aa, Artificial Sequence
  Description of Artificial Sequence: Synthetic peptide
  Seed: RQLYPEWTEA (PMEL_HUMAN)
RILYPEWTEF

SEQ ID NO: 141006 - protein, 9 aa, Artificial Sequence
  Description of Artificial Sequence: Synthetic peptide
  Seed: AEILQAVPS (PMEL_HUMAN)
AEILQAVPT

SEQ ID NO: 141007 - protein, 10 aa, Artificial Sequence
  Description of Artificial Sequence: Synthetic peptide
  Seed: HTMEVTVYHR (PMEL_HUMAN)
HFMEVTVYHK

SEQ ID NO: 141008 - protein, 10 aa, Artificial Sequence
  Description of Artificial Sequence: Synthetic peptide
  Seed: TGMTPAEVSI (PMEL_HUMAN)
TFMTPAEVSV

SEQ ID NO: 141009 - protein, 9 aa, Artificial Sequence
  Description of Artificial Sequence: Synthetic peptide
  Seed: YLEPGPVTA (PMEL_HUMAN)
YWEPGPVTM

SEQ ID NO: 141010 - protein, 9 aa, Artificial Sequence
  Description of Artificial Sequence: Synthetic peptide
  Seed: VMGTTLAEM (PMEL_HUMAN)
VIGTTLAEV

SEQ ID NO: 141011 - protein, 11 aa, Artificial Sequence
  Description of Artificial Sequence: Synthetic peptide
  Seed: RQVPLDCVLYR (PMEL_HUMAN)
RVVPLDCVLYK

SEQ ID NO: 141012 - protein, 10 aa, Artificial Sequence
  Description of Artificial Sequence: Synthetic peptide
  Seed: AVIGALLAVG (PMEL_HUMAN)
AQIGALLAVG

SEQ ID NO: 141013 - protein, 9 aa, Artificial Sequence
  Description of Artificial Sequence: Synthetic peptide
  Seed: VLQAAIPLT (PMEL_HUMAN)
VIQAAIPLI

SEQ ID NO: 141014 - protein, 9 aa, Artificial Sequence
  Description of Artificial Sequence: Synthetic peptide
  Seed: RTKAWNRQL (PMEL_HUMAN)
RFKAWNRQY

SEQ ID NO: 141015 - protein, 8 aa, Artificial Sequence
  Description of Artificial Sequence: Synthetic peptide
  Seed: LLDGTATL (PMEL_HUMAN)
LADGTATI

SEQ ID NO: 141016 - protein, 10 aa, Artificial Sequence
  Description of Artificial Sequence: Synthetic peptide
  Seed: LAVIGALLAV (PMEL_HUMAN)
LTVIGALLAI

SEQ ID NO: 141017 - protein, 11 aa, Artificial Sequence
  Description of Artificial Sequence: Synthetic peptide
  Seed: RYGSFSVTLDI (PMEL_HUMAN)
REGSFSVTLDF

SEQ ID NO: 141018 - protein, 9 aa, Artificial Sequence
  Description of Artificial Sequence: Synthetic peptide
  Seed: VTAQVVLQA (PMEL_HUMAN)
VTAQVVLQY

SEQ ID NO: 141019 - protein, 10 aa, Artificial Sequence
  Description of Artificial Sequence: Synthetic peptide
  Seed: MPTAESTGMT (PMEL_HUMAN)
MKTAESTGMV

SEQ ID NO: 141020 - protein, 10 aa, Artificial Sequence
  Description of Artificial Sequence: Synthetic peptide
  Seed: QVLGGPVSGL (PMEL_HUMAN)
QVLGGPVSGV

SEQ ID NO: 141021 - protein, 9 aa, Artificial Sequence
  Description of Artificial Sequence: Synthetic peptide
  Seed: RNQPLTFAL (PMEL_HUMAN)
RQQPLTFAW

SEQ ID NO: 141022 - protein, 10 aa, Artificial Sequence
  Description of Artificial Sequence: Synthetic peptide
  Seed: RGSRSYVPLA (PMEL_HUMAN)
RESRSYVPLT

SEQ ID NO: 141023 - protein, 10 aa, Artificial Sequence
  Description of Artificial Sequence: Synthetic peptide
  Seed: YVWKTWGQYW (PMEL_HUMAN)
YTWKTWGQYF

SEQ ID NO: 141024 - protein, 10 aa, Artificial Sequence
  Description of Artificial Sequence: Synthetic peptide
  Seed: IESAEILQAV (PMEL_HUMAN)
IMSAEILQAA

SEQ ID NO: 141025 - protein, 10 aa, Artificial Sequence
  Description of Artificial Sequence: Synthetic peptide
  Seed: EVSIVVLSGT (PMEL_HUMAN)
EFSIVVLSGI

SEQ ID NO: 141026 - protein, 9 aa, Artificial Sequence
  Description of Artificial Sequence: Synthetic peptide
  Seed: KVSNDGPTL (PMEL_HUMAN)
KVSNDGPTI

SEQ ID NO: 141027 - protein, 9 aa, Artificial Sequence
  Description of Artificial Sequence: Synthetic peptide
  Seed: HSSSHWLRL (PMEL_HUMAN)
HTSSHWLRI

SEQ ID NO: 141028 - protein, 9 aa, Artificial Sequence
  Description of Artificial Sequence: Synthetic peptide
  Seed: RIFCSCPIG (PMEL_HUMAN)
RTFCSCPIY

SEQ ID NO: 141029 - protein, 10 aa, Artificial Sequence
  Description of Artificial Sequence: Synthetic peptide
  Seed: DGTATLRLVK (PMEL_HUMAN)
DKTATLRLVR

SEQ ID NO: 141030 - protein, 9 aa, Artificial Sequence
  Description of Artificial Sequence: Synthetic peptide
  Seed: VTLDIVQGI (PMEL_HUMAN)
VMLDIVQGM

SEQ ID NO: 141031 - protein, 9 aa, Artificial Sequence
  Description of Artificial Sequence: Synthetic peptide
  Seed: LIVGILLVL (PMEL_HUMAN)
LVVGILLVL

SEQ ID NO: 141032 - protein, 9 aa, Artificial Sequence
  Description of Artificial Sequence: Synthetic peptide
  Seed: GSFSVTLDI (PMEL_HUMAN)
GSFSVTLDY

SEQ ID NO: 141033 - protein, 10 aa, Artificial Sequence
  Description of Artificial Sequence: Synthetic peptide
  Seed: YRYGSFSVTL (PMEL_HUMAN)
YFYGSFSVTL

SEQ ID NO: 141034 - protein, 9 aa, Artificial Sequence
  Description of Artificial Sequence: Synthetic peptide
  Seed: VVLQAAIPL (PMEL_HUMAN)
VALQAAIPY

SEQ ID NO: 141035 - protein, 10 aa, Artificial Sequence
  Description of Artificial Sequence: Synthetic peptide
  Seed: MTPAEVSIVV (PMEL_HUMAN)
MLPAEVSIVA

SEQ ID NO: 141036 - protein, 10 aa, Artificial Sequence
  Description of Artificial Sequence: Synthetic peptide
  Seed: SGTYCLNVSL (PMEL_HUMAN)
SKTYCLNVSW

SEQ ID NO: 141037 - protein, 9 aa, Artificial Sequence
  Description of Artificial Sequence: Synthetic peptide
  Seed: MEVTVYHRR (PMEL_HUMAN)
MVVTVYHRK

SEQ ID NO: 141038 - protein, 10 aa, Artificial Sequence
  Description of Artificial Sequence: Synthetic peptide
  Seed: RGSRSYVPLA (PMEL_HUMAN)
RISRSYVPLA

SEQ ID NO: 141039 - protein, 9 aa, Artificial Sequence
  Description of Artificial Sequence: Synthetic peptide
  Seed: AGLGQVPLI (PMEL_HUMAN)
AILGQVPLM

SEQ ID NO: 141040 - protein, 9 aa, Artificial Sequence
  Description of Artificial Sequence: Synthetic peptide
  Seed: RLMKQDFSV (PMEL_HUMAN)
RVMKQDFSM

SEQ ID NO: 141041 - protein, 10 aa, Artificial Sequence
  Description of Artificial Sequence: Synthetic peptide
  Seed: RTKAWNRQLY (PMEL_HUMAN)
RWKAWNRQLY

SEQ ID NO: 141042 - protein, 9 aa, Artificial Sequence
  Description of Artificial Sequence: Synthetic peptide
  Seed: ESAEILQAV (PMEL_HUMAN)
EMAEILQAI

SEQ ID NO: 141043 - protein, 9 aa, Artificial Sequence
  Description of Artificial Sequence: Synthetic peptide
  Seed: YHRRGSRSY (PMEL_HUMAN)
YQRRGSRSF

SEQ ID NO: 141044 - protein, 10 aa, Artificial Sequence
  Description of Artificial Sequence: Synthetic peptide
  Seed: EVMGTTLAEM (PMEL_HUMAN)
ENMGTTLAER

SEQ ID NO: 141045 - protein, 10 aa, Artificial Sequence
  Description of Artificial Sequence: Synthetic peptide
  Seed: RNQDWLGVSR (PMEL_HUMAN)
RTQDWLGVSK

SEQ ID NO: 141046 - protein, 10 aa, Artificial Sequence
  Description of Artificial Sequence: Synthetic peptide
  Seed: YLAEADLSYT (PMEL_HUMAN)
YMAEADLSYD

SEQ ID NO: 141047 - protein, 9 aa, Artificial Sequence
  Description of Artificial Sequence: Synthetic peptide
  Seed: IMPGQEAGL (PMEL_HUMAN)
IFPGQEAGL

SEQ ID NO: 141048 - protein, 10 aa, Artificial Sequence
  Description of Artificial Sequence: Synthetic peptide
  Seed: LLDGTATLRL (PMEL_HUMAN)
LVDGTATLRL

SEQ ID NO: 141049 - protein, 9 aa, Artificial Sequence
  Description of Artificial Sequence: Synthetic peptide
  Seed: DQVPFSVSV (PMEL_HUMAN)
DVVPFSVSA

SEQ ID NO: 141050 - protein, 9 aa, Artificial Sequence
  Description of Artificial Sequence: Synthetic peptide
  Seed: KTWGQYWQV (PMEL_HUMAN)
KIWGQYWQY

SEQ ID NO: 141051 - protein, 10 aa, Artificial Sequence
  Description of Artificial Sequence: Synthetic peptide
  Seed: RQLYPEWTEA (PMEL_HUMAN)
RNLYPEWTEV

SEQ ID NO: 141052 - protein, 9 aa, Artificial Sequence
  Description of Artificial Sequence: Synthetic peptide
  Seed: MLGTHTMEV (PMEL_HUMAN)
MLGTHTMEA

SEQ ID NO: 141053 - protein, 9 aa, Artificial Sequence
  Description of Artificial Sequence: Synthetic peptide
  Seed: VSEVMGTTL (PMEL_HUMAN)
VTEVMGTTL

SEQ ID NO: 141054 - protein, 9 aa, Artificial Sequence
  Description of Artificial Sequence: Synthetic peptide
  Seed: RNQPLTFAL (PMEL_HUMAN)
RQQPLTFAY

SEQ ID NO: 141055 - protein, 11 aa, Artificial Sequence
  Description of Artificial Sequence: Synthetic peptide
  Seed: RALDGGNKHFL (PMEL_HUMAN)
RILDGGNKHFK

SEQ ID NO: 141056 - protein, 9 aa, Artificial Sequence
  Description of Artificial Sequence: Synthetic peptide
  Seed: GQVPTTEVV (PMEL_HUMAN)
GDVPTTEVF

SEQ ID NO: 141057 - protein, 9 aa, Artificial Sequence
  Description of Artificial Sequence: Synthetic peptide
  Seed: WSQKRSFVY (PMEL_HUMAN)
WFQKRSFVY

SEQ ID NO: 141058 - protein, 9 aa, Artificial Sequence
  Description of Artificial Sequence: Synthetic peptide
  Seed: SQKRSFVYV (PMEL_HUMAN)
SVKRSFVYS

SEQ ID NO: 141059 - protein, 10 aa, Artificial Sequence
  Description of Artificial Sequence: Synthetic peptide
  Seed: SLADTNSLAV (PMEL_HUMAN)
SMADTNSLAI

SEQ ID NO: 141060 - protein, 9 aa, Artificial Sequence
  Description of Artificial Sequence: Synthetic peptide
  Seed: FTITDQVPF (PMEL_HUMAN)
FGITDQVPW

SEQ ID NO: 141061 - protein, 10 aa, Artificial Sequence
  Description of Artificial Sequence: Synthetic peptide
  Seed: HFLRNQPLTF (PMEL_HUMAN)
HMLRNQPLTY

SEQ ID NO: 141062 - protein, 10 aa, Artificial Sequence
  Description of Artificial Sequence: Synthetic peptide
  Seed: EVMGTTLAEM (PMEL_HUMAN)
EPMGTTLAEM

SEQ ID NO: 141063 - protein, 9 aa, Artificial Sequence
  Description of Artificial Sequence: Synthetic peptide
  Seed: YHRRGSRSY (PMEL_HUMAN)
YWRRGSRSF

SEQ ID NO: 141064 - protein, 8 aa, Artificial Sequence
  Description of Artificial Sequence: Synthetic peptide
  Seed: AEAPNTTA (PMEL_HUMAN)
AEAPNTTM

SEQ ID NO: 141065 - protein, 8 aa, Artificial Sequence
  Description of Artificial Sequence: Synthetic peptide
  Seed: HTMEVTVY (PMEL_HUMAN)
HSMEVTVW

SEQ ID NO: 141066 - protein, 10 aa, Artificial Sequence
  Description of Artificial Sequence: Synthetic peptide
  Seed: VLMAVVLASL (PMEL_HUMAN)
VYMAVVLASA

SEQ ID NO: 141067 - protein, 9 aa, Artificial Sequence
  Description of Artificial Sequence: Synthetic peptide
  Seed: SQVWGGQPV (PMEL_HUMAN)
SIVWGGQPM

SEQ ID NO: 141068 - protein, 9 aa, Artificial Sequence
  Description of Artificial Sequence: Synthetic peptide
  Seed: KTWGQYWQV (PMEL_HUMAN)
KTWGQYWQR

SEQ ID NO: 141069 - protein, 9 aa, Artificial Sequence
  Description of Artificial Sequence: Synthetic peptide
  Seed: RLMKQDFSV (PMEL_HUMAN)
RAMKQDFSW

SEQ ID NO: 141070 - protein, 10 aa, Artificial Sequence
  Description of Artificial Sequence: Synthetic peptide
  Seed: KRQVPLDCVL (PMEL_HUMAN)
KRQVPLDCVF

SEQ ID NO: 141071 - protein, 9 aa, Artificial Sequence
  Description of Artificial Sequence: Synthetic peptide
  Seed: ESAEILQAV (PMEL_HUMAN)
ETAEILQAL

SEQ ID NO: 141072 - protein, 10 aa, Artificial Sequence
  Description of Artificial Sequence: Synthetic peptide
  Seed: LAEADLSYTW (PMEL_HUMAN)
LSEADLSYTY

SEQ ID NO: 141073 - protein, 9 aa, Artificial Sequence
  Description of Artificial Sequence: Synthetic peptide
  Seed: TIINGSQVW (PMEL_HUMAN)
TMINGSQVW

SEQ ID NO: 141074 - protein, 10 aa, Artificial Sequence
  Description of Artificial Sequence: Synthetic peptide
  Seed: KTWGQYWQVL (PMEL_HUMAN)
KAWGQYWQVW

SEQ ID NO: 141075 - protein, 9 aa, Artificial Sequence
  Description of Artificial Sequence: Synthetic peptide
  Seed: YLEPGPVTA (PMEL_HUMAN)
YPEPGPVTL

SEQ ID NO: 141076 - protein, 9 aa, Artificial Sequence
  Description of Artificial Sequence: Synthetic peptide
  Seed: LAVVSTQLI (PMEL_HUMAN)
LTVVSTQLI

SEQ ID NO: 141077 - protein, 10 aa, Artificial Sequence
  Description of Artificial Sequence: Synthetic peptide
  Seed: MLGTHTMEVT (PMEL_HUMAN)
MMGTHTMEVV

SEQ ID NO: 141078 - protein, 9 aa, Artificial Sequence
  Description of Artificial Sequence: Synthetic peptide
  Seed: RNQPLTFAL (PMEL_HUMAN)
RHQPLTFAF

SEQ ID NO: 141079 - protein, 9 aa, Artificial Sequence
  Description of Artificial Sequence: Synthetic peptide
  Seed: VISTAPVQM (PMEL_HUMAN)
VASTAPVQY

SEQ ID NO: 141080 - protein, 9 aa, Artificial Sequence
  Description of Artificial Sequence: Synthetic peptide
  Seed: VMGTTLAEM (PMEL_HUMAN)
VMGTTLAEV

SEQ ID NO: 141081 - protein, 9 aa, Artificial Sequence
  Description of Artificial Sequence: Synthetic peptide
  Seed: YPQETDDAC (PMEL_HUMAN)
YIQETDDAF

SEQ ID NO: 141082 - protein, 9 aa, Artificial Sequence
  Description of Artificial Sequence: Synthetic peptide
  Seed: ALDGGNKHF (PMEL_HUMAN)
AADGGNKHL

SEQ ID NO: 141083 - protein, 10 aa, Artificial Sequence
  Description of Artificial Sequence: Synthetic peptide
  Seed: YVPLAHSSSA (PMEL_HUMAN)
YGPLAHSSSM

SEQ ID NO: 141084 - protein, 8 aa, Artificial Sequence
  Description of Artificial Sequence: Synthetic peptide
  Seed: VLASLIYR (PMEL_HUMAN)
VMASLIYR

SEQ ID NO: 141085 - protein, 10 aa, Artificial Sequence
  Description of Artificial Sequence: Synthetic peptide
  Seed: AVPSGEGDAF (PMEL_HUMAN)
ATPSGEGDAM

SEQ ID NO: 141086 - protein, 10 aa, Artificial Sequence
  Description of Artificial Sequence: Synthetic peptide
  Seed: VSLADTNSLA (PMEL_HUMAN)
VVLADTNSLI

SEQ ID NO: 141087 - protein, 9 aa, Artificial Sequence
  Description of Artificial Sequence: Synthetic peptide
  Seed: KVLPDGQVI (PMEL_HUMAN)
KSLPDGQVY

SEQ ID NO: 141088 - protein, 10 aa, Artificial Sequence
  Description of Artificial Sequence: Synthetic peptide
  Seed: SVPQLPHSSS (PMEL_HUMAN)
SAPQLPHSSL

SEQ ID NO: 141089 - protein, 10 aa, Artificial Sequence
  Description of Artificial Sequence: Synthetic peptide
  Seed: AVPSGEGDAF (PMEL_HUMAN)
ALPSGEGDAL

SEQ ID NO: 141090 - protein, 9 aa, Artificial Sequence
  Description of Artificial Sequence: Synthetic peptide
  Seed: VTLDIVQGI (PMEL_HUMAN)
VALDIVQGY

SEQ ID NO: 141091 - protein, 9 aa, Artificial Sequence
  Description of Artificial Sequence: Synthetic peptide
  Seed: SVQVPTTEV (PMEL_HUMAN)
STQVPTTEV

SEQ ID NO: 141092 - protein, 11 aa, Artificial Sequence
  Description of Artificial Sequence: Synthetic peptide
  Seed: SPVPGTTDGHR (PMEL_HUMAN)
STVPGTTDGHK

SEQ ID NO: 141093 - protein, 11 aa, Artificial Sequence
  Description of Artificial Sequence: Synthetic peptide
  Seed: RALDGGNKHFL (PMEL_HUMAN)
RALDGGNKHFW

SEQ ID NO: 141094 - protein, 9 aa, Artificial Sequence
  Description of Artificial Sequence: Synthetic peptide
  Seed: KAWNRQLYP (PMEL_HUMAN)
KMWNRQLYY

SEQ ID NO: 141095 - protein, 10 aa, Artificial Sequence
  Description of Artificial Sequence: Synthetic peptide
  Seed: RGSRSYVPLA (PMEL_HUMAN)
RQSRSYVPLT

SEQ ID NO: 141096 - protein, 9 aa, Artificial Sequence
  Description of Artificial Sequence: Synthetic peptide
  Seed: YPQETDDAC (PMEL_HUMAN)
YGQETDDAY

SEQ ID NO: 141097 - protein, 11 aa, Artificial Sequence
  Description of Artificial Sequence: Synthetic peptide
  Seed: TWDFGDSSGTL (PMEL_HUMAN)
TSDFGDSSGTW

SEQ ID NO: 141098 - protein, 9 aa, Artificial Sequence
  Description of Artificial Sequence: Synthetic peptide
  Seed: CWRGGQVSL (PMEL_HUMAN)
CWRGGQVSM

SEQ ID NO: 141099 - protein, 9 aa, Artificial Sequence
  Description of Artificial Sequence: Synthetic peptide
  Seed: HWLRLPRIF (PMEL_HUMAN)
HYLRLPRII

SEQ ID NO: 141100 - protein, 11 aa, Artificial Sequence
  Description of Artificial Sequence: Synthetic peptide
  Seed: LYRYGSFSVTL (PMEL_HUMAN)
LGRYGSFSVTF

SEQ ID NO: 141101 - protein, 9 aa, Artificial Sequence
  Description of Artificial Sequence: Synthetic peptide
  Seed: ESAEILQAV (PMEL_HUMAN)
EEAEILQAM

SEQ ID NO: 141102 - protein, 9 aa, Artificial Sequence
  Description of Artificial Sequence: Synthetic peptide
  Seed: VPLDCVLYR (PMEL_HUMAN)
VMLDCVLYL

SEQ ID NO: 141103 - protein, 11 aa, Artificial Sequence
  Description of Artificial Sequence: Synthetic peptide
  Seed: FGDSSGTLISR (PMEL_HUMAN)
FLDSSGTLISF

SEQ ID NO: 141104 - protein, 10 aa, Artificial Sequence
  Description of Artificial Sequence: Synthetic peptide
  Seed: LDGGNKHFLR (PMEL_HUMAN)
LFGGNKHFLR

SEQ ID NO: 141105 - protein, 10 aa, Artificial Sequence
  Description of Artificial Sequence: Synthetic peptide
  Seed: MTPAEVSIVV (PMEL_HUMAN)
MVPAEVSIVT

SEQ ID NO: 141106 - protein, 9 aa, Artificial Sequence
  Description of Artificial Sequence: Synthetic peptide
  Seed: QVWGGQPVY (PMEL_HUMAN)
QVWGGQPVF

SEQ ID NO: 141107 - protein, 10 aa, Artificial Sequence
  Description of Artificial Sequence: Synthetic peptide
  Seed: RQVPLDCVLY (PMEL_HUMAN)
RYVPLDCVLY

SEQ ID NO: 141108 - protein, 9 aa, Artificial Sequence
  Description of Artificial Sequence: Synthetic peptide
  Seed: SVPQLPHSS (PMEL_HUMAN)
SLPQLPHSF

SEQ ID NO: 141109 - protein, 11 aa, Artificial Sequence
  Description of Artificial Sequence: Synthetic peptide
  Seed: FTITDQVPFSV (PMEL_HUMAN)
FIITDQVPFSV

SEQ ID NO: 141110 - protein, 9 aa, Artificial Sequence
  Description of Artificial Sequence: Synthetic peptide
  Seed: TEVVGTTPG (PMEL_HUMAN)
TEVVGTTPV

SEQ ID NO: 141111 - protein, 9 aa, Artificial Sequence
  Description of Artificial Sequence: Synthetic peptide
  Seed: AEVSIVVLS (PMEL_HUMAN)
AEVSIVVLT

SEQ ID NO: 141112 - protein, 10 aa, Artificial Sequence
  Description of Artificial Sequence: Synthetic peptide
  Seed: ESAEILQAVP (PMEL_HUMAN)
ETAEILQAVE

SEQ ID NO: 141113 - protein, 10 aa, Artificial Sequence
  Description of Artificial Sequence: Synthetic peptide
  Seed: LIGANASFSI (PMEL_HUMAN)
LMGANASFSL

SEQ ID NO: 141114 - protein, 9 aa, Artificial Sequence
  Description of Artificial Sequence: Synthetic peptide
  Seed: AEMSTPEAT (PMEL_HUMAN)
ADMSTPEAF

SEQ ID NO: 141115 - protein, 9 aa, Artificial Sequence
  Description of Artificial Sequence: Synthetic peptide
  Seed: FLRNQPLTF (PMEL_HUMAN)
FSRNQPLTI

SEQ ID NO: 141116 - protein, 9 aa, Artificial Sequence
  Description of Artificial Sequence: Synthetic peptide
  Seed: KVSNDGPTL (PMEL_HUMAN)
KFSNDGPTY

SEQ ID NO: 141117 - protein, 9 aa, Artificial Sequence
  Description of Artificial Sequence: Synthetic peptide
  Seed: LLDGTATLR (PMEL_HUMAN)
LSDGTATLL

SEQ ID NO: 141118 - protein, 11 aa, Artificial Sequence
  Description of Artificial Sequence: Synthetic peptide
  Seed: LYRYGSFSVTL (PMEL_HUMAN)
LQRYGSFSVTF

SEQ ID NO: 141119 - protein, 9 aa, Artificial Sequence
  Description of Artificial Sequence: Synthetic peptide
  Seed: SAFTITDQV (PMEL_HUMAN)
SMFTITDQL

SEQ ID NO: 141120 - protein, 10 aa, Artificial Sequence
  Description of Artificial Sequence: Synthetic peptide
  Seed: VTAQVVLQAA (PMEL_HUMAN)
VLAQVVLQAA

SEQ ID NO: 141121 - protein, 9 aa, Artificial Sequence
  Description of Artificial Sequence: Synthetic peptide
  Seed: FGDSSGTLI (PMEL_HUMAN)
FSDSSGTLI

SEQ ID NO: 141122 - protein, 9 aa, Artificial Sequence
  Description of Artificial Sequence: Synthetic peptide
  Seed: FSIALNFPG (PMEL_HUMAN)
FTIALNFPF

SEQ ID NO: 141123 - protein, 10 aa, Artificial Sequence
  Description of Artificial Sequence: Synthetic peptide
  Seed: KTWGQYWQVL (PMEL_HUMAN)
KVWGQYWQVV

SEQ ID NO: 141124 - protein, 9 aa, Artificial Sequence
  Description of Artificial Sequence: Synthetic peptide
  Seed: DQVPFSVSV (PMEL_HUMAN)
DQVPFSVSL

SEQ ID NO: 141125 - protein, 9 aa, Artificial Sequence
  Description of Artificial Sequence: Synthetic peptide
  Seed: LQAAIPLTS (PMEL_HUMAN)
LQAAIPLTH

SEQ ID NO: 141126 - protein, 10 aa, Artificial Sequence
  Description of Artificial Sequence: Synthetic peptide
  Seed: SLIYRRRLMK (PMEL_HUMAN)
SMIYRRRLMR

SEQ ID NO: 141127 - protein, 10 aa, Artificial Sequence
  Description of Artificial Sequence: Synthetic peptide
  Seed: TLAEMSTPEA (PMEL_HUMAN)
TVAEMSTPEV

SEQ ID NO: 141128 - protein, 10 aa, Artificial Sequence
  Description of Artificial Sequence: Synthetic peptide
  Seed: YVPLAHSSSA (PMEL_HUMAN)
YEPLAHSSSA

SEQ ID NO: 141129 - protein, 10 aa, Artificial Sequence
  Description of Artificial Sequence: Synthetic peptide
  Seed: EVMGTTLAEM (PMEL_HUMAN)
EAMGTTLAEL

SEQ ID NO: 141130 - protein, 10 aa, Artificial Sequence
  Description of Artificial Sequence: Synthetic peptide
  Seed: SCPIGENSPL (PMEL_HUMAN)
SYPIGENSPL

SEQ ID NO: 141131 - protein, 10 aa, Artificial Sequence
  Description of Artificial Sequence: Synthetic peptide
  Seed: VVLASLIYRR (PMEL_HUMAN)
VMLASLIYRF

SEQ ID NO: 141132 - protein, 9 aa, Artificial Sequence
  Description of Artificial Sequence: Synthetic peptide
  Seed: SVQVPTTEV (PMEL_HUMAN)
SVQVPTTEM

SEQ ID NO: 141133 - protein, 10 aa, Artificial Sequence
  Description of Artificial Sequence: Synthetic peptide
  Seed: EVMGTTLAEM (PMEL_HUMAN)
ESMGTTLAEK

SEQ ID NO: 141134 - protein, 11 aa, Artificial Sequence
  Description of Artificial Sequence: Synthetic peptide
  Seed: FGDSSGTLISR (PMEL_HUMAN)
FMDSSGTLISV

SEQ ID NO: 141135 - protein, 9 aa, Artificial Sequence
  Description of Artificial Sequence: Synthetic peptide
  Seed: ADTNSLAVV (PMEL_HUMAN)
AETNSLAVC

SEQ ID NO: 141136 - protein, 9 aa, Artificial Sequence
  Description of Artificial Sequence: Synthetic peptide
  Seed: SLAVVSTQL (PMEL_HUMAN)
SAAVVSTQY

SEQ ID NO: 141137 - protein, 9 aa, Artificial Sequence
  Description of Artificial Sequence: Synthetic peptide
  Seed: VTLDIVQGI (PMEL_HUMAN)
VRLDIVQGM

SEQ ID NO: 141138 - protein, 10 aa, Artificial Sequence
  Description of Artificial Sequence: Synthetic peptide
  Seed: SSHWLRLPRI (PMEL_HUMAN)
SAHWLRLPRR

SEQ ID NO: 141139 - protein, 8 aa, Artificial Sequence
  Description of Artificial Sequence: Synthetic peptide
  Seed: LADTNSLA (PMEL_HUMAN)
LADTNSLI

SEQ ID NO: 141140 - protein, 9 aa, Artificial Sequence
  Description of Artificial Sequence: Synthetic peptide
  Seed: SVQVPTTEV (PMEL_HUMAN)
SRQVPTTEM

SEQ ID NO: 141141 - protein, 9 aa, Artificial Sequence
  Description of Artificial Sequence: Synthetic peptide
  Seed: DAFELTVSC (PMEL_HUMAN)
DHFELTVSL

SEQ ID NO: 141142 - protein, 11 aa, Artificial Sequence
  Description of Artificial Sequence: Synthetic peptide
  Seed: RRGSRSYVPLA (PMEL_HUMAN)
RGGSRSYVPLV

SEQ ID NO: 141143 - protein, 9 aa, Artificial Sequence
  Description of Artificial Sequence: Synthetic peptide
  Seed: TWGQYWQVL (PMEL_HUMAN)
TYGQYWQVW

SEQ ID NO: 141144 - protein, 9 aa, Artificial Sequence
  Description of Artificial Sequence: Synthetic peptide
  Seed: RTKAWNRQL (PMEL_HUMAN)
RTKAWNRQM

SEQ ID NO: 141145 - protein, 10 aa, Artificial Sequence
  Description of Artificial Sequence: Synthetic peptide
  Seed: QEAGLGQVPL (PMEL_HUMAN)
QEAGLGQVPM

SEQ ID NO: 141146 - protein, 10 aa, Artificial Sequence
  Description of Artificial Sequence: Synthetic peptide
  Seed: KVSNDGPTLI (PMEL_HUMAN)
KSSNDGPTLW

SEQ ID NO: 141147 - protein, 9 aa, Artificial Sequence
  Description of Artificial Sequence: Synthetic peptide
  Seed: MPTAESTGM (PMEL_HUMAN)
MITAESTGF

SEQ ID NO: 141148 - protein, 9 aa, Artificial Sequence
  Description of Artificial Sequence: Synthetic peptide
  Seed: NFPGSQKVL (PMEL_HUMAN)
NSPGSQKVM

SEQ ID NO: 141149 - protein, 9 aa, Artificial Sequence
  Description of Artificial Sequence: Synthetic peptide
  Seed: TTDGHRPTA (PMEL_HUMAN)
TIDGHRPTL

SEQ ID NO: 141150 - protein, 10 aa, Artificial Sequence
  Description of Artificial Sequence: Synthetic peptide
  Seed: SVPQLPHSSS (PMEL_HUMAN)
SHPQLPHSSL

SEQ ID NO: 141151 - protein, 9 aa, Artificial Sequence
  Description of Artificial Sequence: Synthetic peptide
  Seed: YLEPGPVTA (PMEL_HUMAN)
YYEPGPVTY

SEQ ID NO: 141152 - protein, 9 aa, Artificial Sequence
  Description of Artificial Sequence: Synthetic peptide
  Seed: ALVVTHTYL (PMEL_HUMAN)
ALVVTHTYV

SEQ ID NO: 141153 - protein, 9 aa, Artificial Sequence
  Description of Artificial Sequence: Synthetic peptide
  Seed: VSRQLRTKA (PMEL_HUMAN)
VIRQLRTKK

SEQ ID NO: 141154 - protein, 10 aa, Artificial Sequence
  Description of Artificial Sequence: Synthetic peptide
  Seed: NSLAVVSTQL (PMEL_HUMAN)
NTLAVVSTQW

SEQ ID NO: 141155 - protein, 9 aa, Artificial Sequence
  Description of Artificial Sequence: Synthetic peptide
  Seed: AVVLASLIY (PMEL_HUMAN)
ARVLASLIY

SEQ ID NO: 141156 - protein, 10 aa, Artificial Sequence
  Description of Artificial Sequence: Synthetic peptide
  Seed: YVWKTWGQYW (PMEL_HUMAN)
YAWKTWGQYY

SEQ ID NO: 141157 - protein, 9 aa, Artificial Sequence
  Description of Artificial Sequence: Synthetic peptide
  Seed: TAPVQMPTA (PMEL_HUMAN)
TMPVQMPTM

SEQ ID NO: 141158 - protein, 10 aa, Artificial Sequence
  Description of Artificial Sequence: Synthetic peptide
  Seed: KTWGQYWQVL (PMEL_HUMAN)
KLWGQYWQVT

SEQ ID NO: 141159 - protein, 9 aa, Artificial Sequence
  Description of Artificial Sequence: Synthetic peptide
  Seed: TAEAPNTTA (PMEL_HUMAN)
TIEAPNTTF

SEQ ID NO: 141160 - protein, 9 aa, Artificial Sequence
  Description of Artificial Sequence: Synthetic peptide
  Seed: ESAEILQAV (PMEL_HUMAN)
ETAEILQAH

SEQ ID NO: 141161 - protein, 9 aa, Artificial Sequence
  Description of Artificial Sequence: Synthetic peptide
  Seed: HTMEVTVYH (PMEL_HUMAN)
HIMEVTVYL

SEQ ID NO: 141162 - protein, 8 aa, Artificial Sequence
  Description of Artificial Sequence: Synthetic peptide
  Seed: FGDSSGTL (PMEL_HUMAN)
FLDSSGTF

SEQ ID NO: 141163 - protein, 9 aa, Artificial Sequence
  Description of Artificial Sequence: Synthetic peptide
  Seed: VISTAPVQM (PMEL_HUMAN)
VFSTAPVQM

SEQ ID NO: 141164 - protein, 9 aa, Artificial Sequence
  Description of Artificial Sequence: Synthetic peptide
  Seed: SLADTNSLA (PMEL_HUMAN)
SIADTNSLA

SEQ ID NO: 141165 - protein, 9 aa, Artificial Sequence
  Description of Artificial Sequence: Synthetic peptide
  Seed: ASFSIALNF (PMEL_HUMAN)
AEFSIALNF

SEQ ID NO: 141166 - protein, 9 aa, Artificial Sequence
  Description of Artificial Sequence: Synthetic peptide
  Seed: LYRYGSFSV (PMEL_HUMAN)
LTRYGSFSA

SEQ ID NO: 141167 - protein, 9 aa, Artificial Sequence
  Description of Artificial Sequence: Synthetic peptide
  Seed: SSIMSTESI (PMEL_HUMAN)
STIMSTESL

SEQ ID NO: 141168 - protein, 9 aa, Artificial Sequence
  Description of Artificial Sequence: Synthetic peptide
  Seed: LTSCGSSPV (PMEL_HUMAN)
LTSCGSSPF

SEQ ID NO: 141169 - protein, 10 aa, Artificial Sequence
  Description of Artificial Sequence: Synthetic peptide
  Seed: VPLAHSSSAF (PMEL_HUMAN)
VCLAHSSSAY

SEQ ID NO: 141170 - protein, 11 aa, Artificial Sequence
  Description of Artificial Sequence: Synthetic peptide
  Seed: GYLAEADLSYT (PMEL_HUMAN)
GGLAEADLSYL

SEQ ID NO: 141171 - protein, 11 aa, Artificial Sequence
  Description of Artificial Sequence: Synthetic peptide
  Seed: RRGSRSYVPLA (PMEL_HUMAN)
RVGSRSYVPLK

SEQ ID NO: 141172 - protein, 10 aa, Artificial Sequence
  Description of Artificial Sequence: Synthetic peptide
  Seed: YVPLAHSSSA (PMEL_HUMAN)
YTPLAHSSSV

SEQ ID NO: 141173 - protein, 9 aa, Artificial Sequence
  Description of Artificial Sequence: Synthetic peptide
  Seed: SLAVVSTQL (PMEL_HUMAN)
SAAVVSTQH

SEQ ID NO: 141174 - protein, 10 aa, Artificial Sequence
  Description of Artificial Sequence: Synthetic peptide
  Seed: SVPQLPHSSS (PMEL_HUMAN)
SKPQLPHSSM

SEQ ID NO: 141175 - protein, 11 aa, Artificial Sequence
  Description of Artificial Sequence: Synthetic peptide
  Seed: HTMEVTVYHRR (PMEL_HUMAN)
HSMEVTVYHRK

SEQ ID NO: 141176 - protein, 9 aa, Artificial Sequence
  Description of Artificial Sequence: Synthetic peptide
  Seed: AVGATKVPR (PMEL_HUMAN)
AIGATKVPK

SEQ ID NO: 141177 - protein, 9 aa, Artificial Sequence
  Description of Artificial Sequence: Synthetic peptide
  Seed: RTKAWNRQL (PMEL_HUMAN)
RSKAWNRQT

SEQ ID NO: 141178 - protein, 11 aa, Artificial Sequence
  Description of Artificial Sequence: Synthetic peptide
  Seed: FTITDQVPFSV (PMEL_HUMAN)
FSITDQVPFSW

SEQ ID NO: 141179 - protein, 9 aa, Artificial Sequence
  Description of Artificial Sequence: Synthetic peptide
  Seed: YHRRGSRSY (PMEL_HUMAN)
YFRRGSRSY

SEQ ID NO: 141180 - protein, 9 aa, Artificial Sequence
  Description of Artificial Sequence: Synthetic peptide
  Seed: RALVVTHTY (PMEL_HUMAN)
RCLVVTHTY

SEQ ID NO: 141181 - protein, 9 aa, Artificial Sequence
  Description of Artificial Sequence: Synthetic peptide
  Seed: TTDGHRPTA (PMEL_HUMAN)
TTDGHRPTM

SEQ ID NO: 141182 - protein, 10 aa, Artificial Sequence
  Description of Artificial Sequence: Synthetic peptide
  Seed: YLAEADLSYT (PMEL_HUMAN)
YAAEADLSYL

SEQ ID NO: 141183 - protein, 9 aa, Artificial Sequence
  Description of Artificial Sequence: Synthetic peptide
  Seed: YVWKTWGQY (PMEL_HUMAN)
YIWKTWGQW

SEQ ID NO: 141184 - protein, 9 aa, Artificial Sequence
  Description of Artificial Sequence: Synthetic peptide
  Seed: HLAVIGALL (PMEL_HUMAN)
HMAVIGALF

SEQ ID NO: 141185 - protein, 8 aa, Artificial Sequence
  Description of Artificial Sequence: Synthetic peptide
  Seed: SNDGPTLI (PMEL_HUMAN)
SIDGPTLF

SEQ ID NO: 141186 - protein, 10 aa, Artificial Sequence
  Description of Artificial Sequence: Synthetic peptide
  Seed: SVPQLPHSSS (PMEL_HUMAN)
SDPQLPHSSM

SEQ ID NO: 141187 - protein, 9 aa, Artificial Sequence
  Description of Artificial Sequence: Synthetic peptide
  Seed: VTAQVVLQA (PMEL_HUMAN)
VTAQVVLQF

SEQ ID NO: 141188 - protein, 10 aa, Artificial Sequence
  Description of Artificial Sequence: Synthetic peptide
  Seed: VVLASLIYRR (PMEL_HUMAN)
VMLASLIYRK

SEQ ID NO: 141189 - protein, 11 aa, Artificial Sequence
  Description of Artificial Sequence: Synthetic peptide
  Seed: YLAEADLSYTW (PMEL_HUMAN)
YMAEADLSYTI

SEQ ID NO: 141190 - protein, 9 aa, Artificial Sequence
  Description of Artificial Sequence: Synthetic peptide
  Seed: HWLRLPRIF (PMEL_HUMAN)
HYLRLPRIF

SEQ ID NO: 141191 - protein, 11 aa, Artificial Sequence
  Description of Artificial Sequence: Synthetic peptide
  Seed: SYVPLAHSSSA (PMEL_HUMAN)
SRVPLAHSSSI

SEQ ID NO: 141192 - protein, 10 aa, Artificial Sequence
  Description of Artificial Sequence: Synthetic peptide
  Seed: LPHSSSHWLR (PMEL_HUMAN)
LWHSSSHWLR

SEQ ID NO: 141193 - protein, 11 aa, Artificial Sequence
  Description of Artificial Sequence: Synthetic peptide
  Seed: SQKRSFVYVWK (PMEL_HUMAN)
STKRSFVYVWK

SEQ ID NO: 141194 - protein, 11 aa, Artificial Sequence
  Description of Artificial Sequence: Synthetic peptide
  Seed: TTAAQVTTTEW (PMEL_HUMAN)
TKAAQVTTTEW

SEQ ID NO: 141195 - protein, 10 aa, Artificial Sequence
  Description of Artificial Sequence: Synthetic peptide
  Seed: DGTATLRLVK (PMEL_HUMAN)
DRTATLRLVR

SEQ ID NO: 141196 - protein, 9 aa, Artificial Sequence
  Description of Artificial Sequence: Synthetic peptide
  Seed: AEMSTPEAT (PMEL_HUMAN)
ADMSTPEAA

SEQ ID NO: 141197 - protein, 10 aa, Artificial Sequence
  Description of Artificial Sequence: Synthetic peptide
  Seed: GEGDAFELTV (PMEL_HUMAN)
GEGDAFELTW

SEQ ID NO: 141198 - protein, 9 aa, Artificial Sequence
  Description of Artificial Sequence: Synthetic peptide
  Seed: FGDSSGTLI (PMEL_HUMAN)
FCDSSGTLI

SEQ ID NO: 141199 - protein, 9 aa, Artificial Sequence
  Description of Artificial Sequence: Synthetic peptide
  Seed: MTPAEVSIV (PMEL_HUMAN)
MIPAEVSIL

SEQ ID NO: 141200 - protein, 10 aa, Artificial Sequence
  Description of Artificial Sequence: Synthetic peptide
  Seed: AVIGALLAVG (PMEL_HUMAN)
ALIGALLAVH

SEQ ID NO: 141201 - protein, 11 aa, Artificial Sequence
  Description of Artificial Sequence: Synthetic peptide
  Seed: FSVTLDIVQGI (PMEL_HUMAN)
FIVTLDIVQGI

SEQ ID NO: 141202 - protein, 9 aa, Artificial Sequence
  Description of Artificial Sequence: Synthetic peptide
  Seed: WSQKRSFVY (PMEL_HUMAN)
WYQKRSFVV

SEQ ID NO: 141203 - protein, 9 aa, Artificial Sequence
  Description of Artificial Sequence: Synthetic peptide
  Seed: IVVLSGTTA (PMEL_HUMAN)
ISVLSGTTF

SEQ ID NO: 141204 - protein, 9 aa, Artificial Sequence
  Description of Artificial Sequence: Synthetic peptide
  Seed: GSFSVTLDI (PMEL_HUMAN)
GIFSVTLDV

SEQ ID NO: 141205 - protein, 9 aa, Artificial Sequence
  Description of Artificial Sequence: Synthetic peptide
  Seed: SSIMSTESI (PMEL_HUMAN)
SMIMSTESW

SEQ ID NO: 141206 - protein, 9 aa, Artificial Sequence
  Description of Artificial Sequence: Synthetic peptide
  Seed: LSIGTGRAM (PMEL_HUMAN)
LPIGTGRAF

SEQ ID NO: 141207 - protein, 9 aa, Artificial Sequence
  Description of Artificial Sequence: Synthetic peptide
  Seed: RAMLGTHTM (PMEL_HUMAN)
RMMLGTHTH

SEQ ID NO: 141208 - protein, 9 aa, Artificial Sequence
  Description of Artificial Sequence: Synthetic peptide
  Seed: MTPEKVPVS (PMEL_HUMAN)
MTPEKVPVM

SEQ ID NO: 141209 - protein, 11 aa, Artificial Sequence
  Description of Artificial Sequence: Synthetic peptide
  Seed: VSLADTNSLAV (PMEL_HUMAN)
VSLADTNSLAF

SEQ ID NO: 141210 - protein, 9 aa, Artificial Sequence
  Description of Artificial Sequence: Synthetic peptide
  Seed: MTPEKVPVS (PMEL_HUMAN)
MGPEKVPVF

SEQ ID NO: 141211 - protein, 11 aa, Artificial Sequence
  Description of Artificial Sequence: Synthetic peptide
  Seed: VSLADTNSLAV (PMEL_HUMAN)
VALADTNSLAF

SEQ ID NO: 141212 - protein, 9 aa, Artificial Sequence
  Description of Artificial Sequence: Synthetic peptide
  Seed: LHDPSGYLA (PMEL_HUMAN)
LHDPSGYLM

SEQ ID NO: 141213 - protein, 9 aa, Artificial Sequence
  Description of Artificial Sequence: Synthetic peptide
  Seed: VPQLPHSSS (PMEL_HUMAN)
VPQLPHSST

SEQ ID NO: 141214 - protein, 9 aa, Artificial Sequence
  Description of Artificial Sequence: Synthetic peptide
  Seed: DQVPFSVSV (PMEL_HUMAN)
DRVPFSVSY

SEQ ID NO: 141215 - protein, 8 aa, Artificial Sequence
  Description of Artificial Sequence: Synthetic peptide
  Seed: FGDSSGTL (PMEL_HUMAN)
FQDSSGTL

SEQ ID NO: 141216 - protein, 10 aa, Artificial Sequence
  Description of Artificial Sequence: Synthetic peptide
  Seed: YVPLAHSSSA (PMEL_HUMAN)
YWPLAHSSSA

SEQ ID NO: 141217 - protein, 10 aa, Artificial Sequence
  Description of Artificial Sequence: Synthetic peptide
  Seed: AMLGTHTMEV (PMEL_HUMAN)
AMLGTHTMEL

SEQ ID NO: 141218 - protein, 10 aa, Artificial Sequence
  Description of Artificial Sequence: Synthetic peptide
  Seed: ESAEILQAVP (PMEL_HUMAN)
EVAEILQAVQ

SEQ ID NO: 141219 - protein, 10 aa, Artificial Sequence
  Description of Artificial Sequence: Synthetic peptide
  Seed: KRQVPLDCVL (PMEL_HUMAN)
KVQVPLDCVY

SEQ ID NO: 141220 - protein, 10 aa, Artificial Sequence
  Description of Artificial Sequence: Synthetic peptide
  Seed: THTMEVTVYH (PMEL_HUMAN)
TNTMEVTVYY

SEQ ID NO: 141221 - protein, 11 aa, Artificial Sequence
  Description of Artificial Sequence: Synthetic peptide
  Seed: QAVPSGEGDAF (PMEL_HUMAN)
QAVPSGEGDAY

SEQ ID NO: 141222 - protein, 10 aa, Artificial Sequence
  Description of Artificial Sequence: Synthetic peptide
  Seed: LVLMAVVLAS (PMEL_HUMAN)
LHLMAVVLAV

SEQ ID NO: 141223 - protein, 11 aa, Artificial Sequence
  Description of Artificial Sequence: Synthetic peptide
  Seed: HSSSHWLRLPR (PMEL_HUMAN)
HWSSHWLRLPR

SEQ ID NO: 141224 - protein, 9 aa, Artificial Sequence
  Description of Artificial Sequence: Synthetic peptide
  Seed: LMAVVLASL (PMEL_HUMAN)
LLAVVLAST

SEQ ID NO: 141225 - protein, 10 aa, Artificial Sequence
  Description of Artificial Sequence: Synthetic peptide
  Seed: KVSNDGPTLI (PMEL_HUMAN)
KQSNDGPTLV

SEQ ID NO: 141226 - protein, 9 aa, Artificial Sequence
  Description of Artificial Sequence: Synthetic peptide
  Seed: SVQVPTTEV (PMEL_HUMAN)
SIQVPTTEF

SEQ ID NO: 141227 - protein, 10 aa, Artificial Sequence
  Description of Artificial Sequence: Synthetic peptide
  Seed: RGSRSYVPLA (PMEL_HUMAN)
RSSRSYVPLT

SEQ ID NO: 141228 - protein, 9 aa, Artificial Sequence
  Description of Artificial Sequence: Synthetic peptide
  Seed: VIWVNNTII (PMEL_HUMAN)
VLWVNNTII

SEQ ID NO: 141229 - protein, 9 aa, Artificial Sequence
  Description of Artificial Sequence: Synthetic peptide
  Seed: VSVSQLRAL (PMEL_HUMAN)
VSVSQLRAM

SEQ ID NO: 141230 - protein, 9 aa, Artificial Sequence
  Description of Artificial Sequence: Synthetic peptide
  Seed: GQVPTTEVV (PMEL_HUMAN)
GIVPTTEVY

SEQ ID NO: 141231 - protein, 9 aa, Artificial Sequence
  Description of Artificial Sequence: Synthetic peptide
  Seed: ILKGGSGTY (PMEL_HUMAN)
ISKGGSGTY

SEQ ID NO: 141232 - protein, 10 aa, Artificial Sequence
  Description of Artificial Sequence: Synthetic peptide
  Seed: RQLYPEWTEA (PMEL_HUMAN)
RALYPEWTEF

SEQ ID NO: 141233 - protein, 9 aa, Artificial Sequence
  Description of Artificial Sequence: Synthetic peptide
  Seed: MTPEKVPVS (PMEL_HUMAN)
MFPEKVPVL

SEQ ID NO: 141234 - protein, 9 aa, Artificial Sequence
  Description of Artificial Sequence: Synthetic peptide
  Seed: QVIWVNNTI (PMEL_HUMAN)
QIIWVNNTL

SEQ ID NO: 141235 - protein, 9 aa, Artificial Sequence
  Description of Artificial Sequence: Synthetic peptide
  Seed: IVVLSGTTA (PMEL_HUMAN)
IMVLSGTTV

SEQ ID NO: 141236 - protein, 10 aa, Artificial Sequence
  Description of Artificial Sequence: Synthetic peptide
  Seed: AVIGALLAVG (PMEL_HUMAN)
ALIGALLAVK

SEQ ID NO: 141237 - protein, 10 aa, Artificial Sequence
  Description of Artificial Sequence: Synthetic peptide
  Seed: VPQLPHSSSH (PMEL_HUMAN)
VEQLPHSSSM

SEQ ID NO: 141238 - protein, 9 aa, Artificial Sequence
  Description of Artificial Sequence: Synthetic peptide
  Seed: LIVGILLVL (PMEL_HUMAN)
LMVGILLVV

SEQ ID NO: 141239 - protein, 9 aa, Artificial Sequence
  Description of Artificial Sequence: Synthetic peptide
  Seed: SSIMSTESI (PMEL_HUMAN)
SAIMSTESH

SEQ ID NO: 141240 - protein, 9 aa, Artificial Sequence
  Description of Artificial Sequence: Synthetic peptide
  Seed: VISTAPVQM (PMEL_HUMAN)
VISTAPVQL

SEQ ID NO: 141241 - protein, 10 aa, Artificial Sequence
  Description of Artificial Sequence: Synthetic peptide
  Seed: QVLGGPVSGL (PMEL_HUMAN)
QTLGGPVSGK

SEQ ID NO: 141242 - protein, 9 aa, Artificial Sequence
  Description of Artificial Sequence: Synthetic peptide
  Seed: QVIWVNNTI (PMEL_HUMAN)
QSIWVNNTR

SEQ ID NO: 141243 - protein, 9 aa, Artificial Sequence
  Description of Artificial Sequence: Synthetic peptide
  Seed: VLPSPACQL (PMEL_HUMAN)
VAPSPACQY

SEQ ID NO: 141244 - protein, 9 aa, Artificial Sequence
  Description of Artificial Sequence: Synthetic peptide
  Seed: YVWKTWGQY (PMEL_HUMAN)
YIWKTWGQY

SEQ ID NO: 141245 - protein, 9 aa, Artificial Sequence
  Description of Artificial Sequence: Synthetic peptide
  Seed: FSVSVSQLR (PMEL_HUMAN)
FSVSVSQLM

SEQ ID NO: 141246 - protein, 9 aa, Artificial Sequence
  Description of Artificial Sequence: Synthetic peptide
  Seed: ANASFSIAL (PMEL_HUMAN)
ASASFSIAM

SEQ ID NO: 141247 - protein, 9 aa, Artificial Sequence
  Description of Artificial Sequence: Synthetic peptide
  Seed: LSIGTGRAM (PMEL_HUMAN)
LPIGTGRAY

SEQ ID NO: 141248 - protein, 9 aa, Artificial Sequence
  Description of Artificial Sequence: Synthetic peptide
  Seed: MLGTHTMEV (PMEL_HUMAN)
MTGTHTMEV

SEQ ID NO: 141249 - protein, 10 aa, Artificial Sequence
  Description of Artificial Sequence: Synthetic peptide
  Seed: KVLPDGQVIW (PMEL_HUMAN)
KMLPDGQVIL

SEQ ID NO: 141250 - protein, 9 aa, Artificial Sequence
  Description of Artificial Sequence: Synthetic peptide
  Seed: AEADLSYTW (PMEL_HUMAN)
ARADLSYTY

SEQ ID NO: 141251 - protein, 9 aa, Artificial Sequence
  Description of Artificial Sequence: Synthetic peptide
  Seed: AVIGALLAV (PMEL_HUMAN)
APIGALLAA

SEQ ID NO: 141252 - protein, 9 aa, Artificial Sequence
  Description of Artificial Sequence: Synthetic peptide
  Seed: MTPEKVPVS (PMEL_HUMAN)
MCPEKVPVV

SEQ ID NO: 141253 - protein, 11 aa, Artificial Sequence
  Description of Artificial Sequence: Synthetic peptide
  Seed: QAVPSGEGDAF (PMEL_HUMAN)
QMVPSGEGDAW

SEQ ID NO: 141254 - protein, 10 aa, Artificial Sequence
  Description of Artificial Sequence: Synthetic peptide
  Seed: MTPAEVSIVV (PMEL_HUMAN)
MMPAEVSIVS

SEQ ID NO: 141255 - protein, 9 aa, Artificial Sequence
  Description of Artificial Sequence: Synthetic peptide
  Seed: ILKGGSGTY (PMEL_HUMAN)
IEKGGSGTF

SEQ ID NO: 141256 - protein, 11 aa, Artificial Sequence
  Description of Artificial Sequence: Synthetic peptide
  Seed: LVLMAVVLASL (PMEL_HUMAN)
LALMAVVLASV

SEQ ID NO: 141257 - protein, 9 aa, Artificial Sequence
  Description of Artificial Sequence: Synthetic peptide
  Seed: LMAVVLASL (PMEL_HUMAN)
LLAVVLASR

SEQ ID NO: 141258 - protein, 11 aa, Artificial Sequence
  Description of Artificial Sequence: Synthetic peptide
  Seed: RAMLGTHTMEV (PMEL_HUMAN)
RQMLGTHTMEV

SEQ ID NO: 141259 - protein, 11 aa, Artificial Sequence
  Description of Artificial Sequence: Synthetic peptide
  Seed: FSVSVSQLRAL (PMEL_HUMAN)
FSVSVSQLRAF

SEQ ID NO: 141260 - protein, 8 aa, Artificial Sequence
  Description of Artificial Sequence: Synthetic peptide
  Seed: QDFSVPQL (PMEL_HUMAN)
QEFSVPQF

SEQ ID NO: 141261 - protein, 9 aa, Artificial Sequence
  Description of Artificial Sequence: Synthetic peptide
  Seed: RIFCSCPIG (PMEL_HUMAN)
RTFCSCPIV

SEQ ID NO: 141262 - protein, 9 aa, Artificial Sequence
  Description of Artificial Sequence: Synthetic peptide
  Seed: GSRSYVPLA (PMEL_HUMAN)
GVRSYVPLK

SEQ ID NO: 141263 - protein, 10 aa, Artificial Sequence
  Description of Artificial Sequence: Synthetic peptide
  Seed: SQKRSFVYVW (PMEL_HUMAN)
SFKRSFVYVY

SEQ ID NO: 141264 - protein, 9 aa, Artificial Sequence
  Description of Artificial Sequence: Synthetic peptide
  Seed: VLPSPACQL (PMEL_HUMAN)
VFPSPACQI

SEQ ID NO: 141265 - protein, 10 aa, Artificial Sequence
  Description of Artificial Sequence: Synthetic peptide
  Seed: KTWGQYWQVL (PMEL_HUMAN)
KMWGQYWQVE

SEQ ID NO: 141266 - protein, 9 aa, Artificial Sequence
  Description of Artificial Sequence: Synthetic peptide
  Seed: RELPIPEPE (PMEL_HUMAN)
RELPIPEPC

SEQ ID NO: 141267 - protein, 9 aa, Artificial Sequence
  Description of Artificial Sequence: Synthetic peptide
  Seed: YLAEADLSY (PMEL_HUMAN)
YYAEADLSI

SEQ ID NO: 141268 - protein, 10 aa, Artificial Sequence
  Description of Artificial Sequence: Synthetic peptide
  Seed: LAVIGALLAV (PMEL_HUMAN)
LEVIGALLAA

SEQ ID NO: 141269 - protein, 9 aa, Artificial Sequence
  Description of Artificial Sequence: Synthetic peptide
  Seed: WQVLGGPVS (PMEL_HUMAN)
WKVLGGPVM

SEQ ID NO: 141270 - protein, 9 aa, Artificial Sequence
  Description of Artificial Sequence: Synthetic peptide
  Seed: FLRNQPLTF (PMEL_HUMAN)
FLRNQPLTR

SEQ ID NO: 141271 - protein, 9 aa, Artificial Sequence
  Description of Artificial Sequence: Synthetic peptide
  Seed: RAMLGTHTM (PMEL_HUMAN)
RMMLGTHTR

SEQ ID NO: 141272 - protein, 9 aa, Artificial Sequence
  Description of Artificial Sequence: Synthetic peptide
  Seed: HTMEVTVYH (PMEL_HUMAN)
HQMEVTVYK

SEQ ID NO: 141273 - protein, 8 aa, Artificial Sequence
  Description of Artificial Sequence: Synthetic peptide
  Seed: LAHSSSAF (PMEL_HUMAN)
LKHSSSAY

SEQ ID NO: 141274 - protein, 11 aa, Artificial Sequence
  Description of Artificial Sequence: Synthetic peptide
  Seed: IALNFPGSQKV (PMEL_HUMAN)
IMLNFPGSQKV

SEQ ID NO: 141275 - protein, 11 aa, Artificial Sequence
  Description of Artificial Sequence: Synthetic peptide
  Seed: RQVPLDCVLYR (PMEL_HUMAN)
RMVPLDCVLYF

SEQ ID NO: 141276 - protein, 10 aa, Artificial Sequence
  Description of Artificial Sequence: Synthetic peptide
  Seed: GRAMLGTHTM (PMEL_HUMAN)
GYAMLGTHTY

SEQ ID NO: 141277 - protein, 10 aa, Artificial Sequence
  Description of Artificial Sequence: Synthetic peptide
  Seed: YVPLAHSSSA (PMEL_HUMAN)
YMPLAHSSSL

SEQ ID NO: 141278 - protein, 10 aa, Artificial Sequence
  Description of Artificial Sequence: Synthetic peptide
  Seed: EVISTAPVQM (PMEL_HUMAN)
EGISTAPVQR

SEQ ID NO: 141279 - protein, 10 aa, Artificial Sequence
  Description of Artificial Sequence: Synthetic peptide
  Seed: LLHLAVIGAL (PMEL_HUMAN)
LLHLAVIGAI

SEQ ID NO: 141280 - protein, 10 aa, Artificial Sequence
  Description of Artificial Sequence: Synthetic peptide
  Seed: RALDGGNKHF (PMEL_HUMAN)
RTLDGGNKHF

SEQ ID NO: 141281 - protein, 9 aa, Artificial Sequence
  Description of Artificial Sequence: Synthetic peptide
  Seed: SQKRSFVYV (PMEL_HUMAN)
SVKRSFVYK

SEQ ID NO: 141282 - protein, 10 aa, Artificial Sequence
  Description of Artificial Sequence: Synthetic peptide
  Seed: KTWGQYWQVL (PMEL_HUMAN)
KIWGQYWQVA

SEQ ID NO: 141283 - protein, 9 aa, Artificial Sequence
  Description of Artificial Sequence: Synthetic peptide
  Seed: VSEVMGTTL (PMEL_HUMAN)
VAEVMGTTY

SEQ ID NO: 141284 - protein, 10 aa, Artificial Sequence
  Description of Artificial Sequence: Synthetic peptide
  Seed: HTMEVTVYHR (PMEL_HUMAN)
HPMEVTVYHR

SEQ ID NO: 141285 - protein, 9 aa, Artificial Sequence
  Description of Artificial Sequence: Synthetic peptide
  Seed: SLAVVSTQL (PMEL_HUMAN)
SIAVVSTQI

SEQ ID NO: 141286 - protein, 11 aa, Artificial Sequence
  Description of Artificial Sequence: Synthetic peptide
  Seed: VLGGPVSGLSI (PMEL_HUMAN)
VQGGPVSGLSL

SEQ ID NO: 141287 - protein, 10 aa, Artificial Sequence
  Description of Artificial Sequence: Synthetic peptide
  Seed: YVPLAHSSSA (PMEL_HUMAN)
YVPLAHSSSV

SEQ ID NO: 141288 - protein, 9 aa, Artificial Sequence
  Description of Artificial Sequence: Synthetic peptide
  Seed: RAMLGTHTM (PMEL_HUMAN)
RRMLGTHTL

SEQ ID NO: 141289 - protein, 11 aa, Artificial Sequence
  Description of Artificial Sequence: Synthetic peptide
  Seed: RYGSFSVTLDI (PMEL_HUMAN)
RRGSFSVTLDW

SEQ ID NO: 141290 - protein, 9 aa, Artificial Sequence
  Description of Artificial Sequence: Synthetic peptide
  Seed: KTWGQYWQV (PMEL_HUMAN)
KVWGQYWQL

SEQ ID NO: 141291 - protein, 11 aa, Artificial Sequence
  Description of Artificial Sequence: Synthetic peptide
  Seed: FLRNQPLTFAL (PMEL_HUMAN)
FLRNQPLTFAI

SEQ ID NO: 141292 - protein, 10 aa, Artificial Sequence
  Description of Artificial Sequence: Synthetic peptide
  Seed: SSHWLRLPRI (PMEL_HUMAN)
SVHWLRLPRK

SEQ ID NO: 141293 - protein, 10 aa, Artificial Sequence
  Description of Artificial Sequence: Synthetic peptide
  Seed: GSFSVTLDIV (PMEL_HUMAN)
GMFSVTLDIA

SEQ ID NO: 141294 - protein, 10 aa, Artificial Sequence
  Description of Artificial Sequence: Synthetic peptide
  Seed: ESITGSLGPL (PMEL_HUMAN)
EVITGSLGPY

SEQ ID NO: 141295 - protein, 9 aa, Artificial Sequence
  Description of Artificial Sequence: Synthetic peptide
  Seed: ADTNSLAVV (PMEL_HUMAN)
AETNSLAVM

SEQ ID NO: 141296 - protein, 9 aa, Artificial Sequence
  Description of Artificial Sequence: Synthetic peptide
  Seed: SQKRSFVYV (PMEL_HUMAN)
SNKRSFVYK

SEQ ID NO: 141297 - protein, 10 aa, Artificial Sequence
  Description of Artificial Sequence: Synthetic peptide
  Seed: GDSSGTLISR (PMEL_HUMAN)
GASSGTLISF

SEQ ID NO: 141298 - protein, 9 aa, Artificial Sequence
  Description of Artificial Sequence: Synthetic peptide
  Seed: TTPGQAPTA (PMEL_HUMAN)
TNPGQAPTM

SEQ ID NO: 141299 - protein, 9 aa, Artificial Sequence
  Description of Artificial Sequence: Synthetic peptide
  Seed: MTPAEVSIV (PMEL_HUMAN)
MGPAEVSIM

SEQ ID NO: 141300 - protein, 9 aa, Artificial Sequence
  Description of Artificial Sequence: Synthetic peptide
  Seed: VTLDIVQGI (PMEL_HUMAN)
VILDIVQGA

SEQ ID NO: 141301 - protein, 9 aa, Artificial Sequence
  Description of Artificial Sequence: Synthetic peptide
  Seed: YLEPGPVTA (PMEL_HUMAN)
YAEPGPVTI

SEQ ID NO: 141302 - protein, 10 aa, Artificial Sequence
  Description of Artificial Sequence: Synthetic peptide
  Seed: TMEVTVYHRR (PMEL_HUMAN)
TTEVTVYHRK

SEQ ID NO: 141303 - protein, 9 aa, Artificial Sequence
  Description of Artificial Sequence: Synthetic peptide
  Seed: CPIGENSPL (PMEL_HUMAN)
CAIGENSPM

SEQ ID NO: 141304 - protein, 10 aa, Artificial Sequence
  Description of Artificial Sequence: Synthetic peptide
  Seed: ESITGSLGPL (PMEL_HUMAN)
EAITGSLGPI

SEQ ID NO: 141305 - protein, 9 aa, Artificial Sequence
  Description of Artificial Sequence: Synthetic peptide
  Seed: ALNFPGSQK (PMEL_HUMAN)
ASNFPGSQR

SEQ ID NO: 141306 - protein, 8 aa, Artificial Sequence
  Description of Artificial Sequence: Synthetic peptide
  Seed: LNFPGSQK (PMEL_HUMAN)
LAFPGSQL

SEQ ID NO: 141307 - protein, 9 aa, Artificial Sequence
  Description of Artificial Sequence: Synthetic peptide
  Seed: RGSRSYVPL (PMEL_HUMAN)
RYSRSYVPK

SEQ ID NO: 141308 - protein, 9 aa, Artificial Sequence
  Description of Artificial Sequence: Synthetic peptide
  Seed: ESAEILQAV (PMEL_HUMAN)
EMAEILQAM

SEQ ID NO: 141309 - protein, 10 aa, Artificial Sequence
  Description of Artificial Sequence: Synthetic peptide
  Seed: VLMAVVLASL (PMEL_HUMAN)
VYMAVVLASV

SEQ ID NO: 141310 - protein, 9 aa, Artificial Sequence
  Description of Artificial Sequence: Synthetic peptide
  Seed: KQDFSVPQL (PMEL_HUMAN)
KQDFSVPQW

SEQ ID NO: 141311 - protein, 9 aa, Artificial Sequence
  Description of Artificial Sequence: Synthetic peptide
  Seed: RELPIPEPE (PMEL_HUMAN)
RELPIPEPA

SEQ ID NO: 141312 - protein, 9 aa, Artificial Sequence
  Description of Artificial Sequence: Synthetic peptide
  Seed: GPVTAQVVL (PMEL_HUMAN)
GPVTAQVVM

SEQ ID NO: 141313 - protein, 9 aa, Artificial Sequence
  Description of Artificial Sequence: Synthetic peptide
  Seed: YLEPGPVTA (PMEL_HUMAN)
YMEPGPVTF

SEQ ID NO: 141314 - protein, 9 aa, Artificial Sequence
  Description of Artificial Sequence: Synthetic peptide
  Seed: ILKGGSGTY (PMEL_HUMAN)
IIKGGSGTY

SEQ ID NO: 141315 - protein, 9 aa, Artificial Sequence
  Description of Artificial Sequence: Synthetic peptide
  Seed: MAVVLASLI (PMEL_HUMAN)
MMVVLASLL

SEQ ID NO: 141316 - protein, 9 aa, Artificial Sequence
  Description of Artificial Sequence: Synthetic peptide
  Seed: RSYVPLAHS (PMEL_HUMAN)
RQYVPLAHK

SEQ ID NO: 141317 - protein, 11 aa, Artificial Sequence
  Description of Artificial Sequence: Synthetic peptide
  Seed: FSVTLDIVQGI (PMEL_HUMAN)
FCVTLDIVQGV

SEQ ID NO: 141318 - protein, 9 aa, Artificial Sequence
  Description of Artificial Sequence: Synthetic peptide
  Seed: AEPSGTTSV (PMEL_HUMAN)
ANPSGTTSM

SEQ ID NO: 141319 - protein, 9 aa, Artificial Sequence
  Description of Artificial Sequence: Synthetic peptide
  Seed: KQDFSVPQL (PMEL_HUMAN)
KIDFSVPQM

SEQ ID NO: 141320 - protein, 9 aa, Artificial Sequence
  Description of Artificial Sequence: Synthetic peptide
  Seed: TTDGHRPTA (PMEL_HUMAN)
TYDGHRPTI

SEQ ID NO: 141321 - protein, 9 aa, Artificial Sequence
  Description of Artificial Sequence: Synthetic peptide
  Seed: AQVTTTEWV (PMEL_HUMAN)
ALVTTTEWL

SEQ ID NO: 141322 - protein, 9 aa, Artificial Sequence
  Description of Artificial Sequence: Synthetic peptide
  Seed: YLEPGPVTA (PMEL_HUMAN)
YSEPGPVTH

SEQ ID NO: 141323 - protein, 9 aa, Artificial Sequence
  Description of Artificial Sequence: Synthetic peptide
  Seed: HTMEVTVYH (PMEL_HUMAN)
HMMEVTVYL

SEQ ID NO: 141324 - protein, 9 aa, Artificial Sequence
  Description of Artificial Sequence: Synthetic peptide
  Seed: YVWKTWGQY (PMEL_HUMAN)
YSWKTWGQK

SEQ ID NO: 141325 - protein, 9 aa, Artificial Sequence
  Description of Artificial Sequence: Synthetic peptide
  Seed: KTWGQYWQV (PMEL_HUMAN)
KSWGQYWQW

SEQ ID NO: 141326 - protein, 10 aa, Artificial Sequence
  Description of Artificial Sequence: Synthetic peptide
  Seed: LVLMAVVLAS (PMEL_HUMAN)
LVLMAVVLAL

SEQ ID NO: 141327 - protein, 10 aa, Artificial Sequence
  Description of Artificial Sequence: Synthetic peptide
  Seed: RSFVYVWKTW (PMEL_HUMAN)
RMFVYVWKTW

SEQ ID NO: 141328 - protein, 9 aa, Artificial Sequence
  Description of Artificial Sequence: Synthetic peptide
  Seed: RALVVTHTY (PMEL_HUMAN)
RVLVVTHTL

SEQ ID NO: 141329 - protein, 9 aa, Artificial Sequence
  Description of Artificial Sequence: Synthetic peptide
  Seed: LSIGTGRAM (PMEL_HUMAN)
LQIGTGRAY

SEQ ID NO: 141330 - protein, 11 aa, Artificial Sequence
  Description of Artificial Sequence: Synthetic peptide
  Seed: RYGSFSVTLDI (PMEL_HUMAN)
RTGSFSVTLDW

SEQ ID NO: 141331 - protein, 9 aa, Artificial Sequence
  Description of Artificial Sequence: Synthetic peptide
  Seed: RQVPLDCVL (PMEL_HUMAN)
RMVPLDCVY

SEQ ID NO: 141332 - protein, 10 aa, Artificial Sequence
  Description of Artificial Sequence: Synthetic peptide
  Seed: EVMGTTLAEM (PMEL_HUMAN)
ETMGTTLAEY

SEQ ID NO: 141333 - protein, 10 aa, Artificial Sequence
  Description of Artificial Sequence: Synthetic peptide
  Seed: QILKGGSGTY (PMEL_HUMAN)
QKLKGGSGTY

SEQ ID NO: 141334 - protein, 9 aa, Artificial Sequence
  Description of Artificial Sequence: Synthetic peptide
  Seed: KVLPDGQVI (PMEL_HUMAN)
KVLPDGQVV

SEQ ID NO: 141335 - protein, 9 aa, Artificial Sequence
  Description of Artificial Sequence: Synthetic peptide
  Seed: YLEPGPVTA (PMEL_HUMAN)
YTEPGPVTV

SEQ ID NO: 141336 - protein, 9 aa, Artificial Sequence
  Description of Artificial Sequence: Synthetic peptide
  Seed: HLAVIGALL (PMEL_HUMAN)
HPAVIGALY

SEQ ID NO: 141337 - protein, 9 aa, Artificial Sequence
  Description of Artificial Sequence: Synthetic peptide
  Seed: YLEPGPVTA (PMEL_HUMAN)
YLEPGPVTM

SEQ ID NO: 141338 - protein, 9 aa, Artificial Sequence
  Description of Artificial Sequence: Synthetic peptide
  Seed: VLPDGQVIW (PMEL_HUMAN)
VAPDGQVIV

SEQ ID NO: 141339 - protein, 10 aa, Artificial Sequence
  Description of Artificial Sequence: Synthetic peptide
  Seed: SQKRSFVYVW (PMEL_HUMAN)
SVKRSFVYVF

SEQ ID NO: 141340 - protein, 11 aa, Artificial Sequence
  Description of Artificial Sequence: Synthetic peptide
  Seed: QAVPSGEGDAF (PMEL_HUMAN)
QPVPSGEGDAM

SEQ ID NO: 141341 - protein, 10 aa, Artificial Sequence
  Description of Artificial Sequence: Synthetic peptide
  Seed: YVWKTWGQYW (PMEL_HUMAN)
YTWKTWGQYY

SEQ ID NO: 141342 - protein, 9 aa, Artificial Sequence
  Description of Artificial Sequence: Synthetic peptide
  Seed: RLMKQDFSV (PMEL_HUMAN)
RMMKQDFSK

SEQ ID NO: 141343 - protein, 9 aa, Artificial Sequence
  Description of Artificial Sequence: Synthetic peptide
  Seed: RLMKQDFSV (PMEL_HUMAN)
RIMKQDFSY

SEQ ID NO: 141344 - protein, 10 aa, Artificial Sequence
  Description of Artificial Sequence: Synthetic peptide
  Seed: DWLGVSRQLR (PMEL_HUMAN)
DALGVSRQLR

SEQ ID NO: 141345 - protein, 10 aa, Artificial Sequence
  Description of Artificial Sequence: Synthetic peptide
  Seed: VLMAVVLASL (PMEL_HUMAN)
VFMAVVLASV

SEQ ID NO: 141346 - protein, 9 aa, Artificial Sequence
  Description of Artificial Sequence: Synthetic peptide
  Seed: GTYCLNVSL (PMEL_HUMAN)
GIYCLNVSF

SEQ ID NO: 141347 - protein, 9 aa, Artificial Sequence
  Description of Artificial Sequence: Synthetic peptide
  Seed: FSVSVSQLR (PMEL_HUMAN)
FVVSVSQLF

SEQ ID NO: 141348 - protein, 9 aa, Artificial Sequence
  Description of Artificial Sequence: Synthetic peptide
  Seed: LYRYGSFSV (PMEL_HUMAN)
LVRYGSFSV

SEQ ID NO: 141349 - protein, 9 aa, Artificial Sequence
  Description of Artificial Sequence: Synthetic peptide
  Seed: VISTAPVQM (PMEL_HUMAN)
VFSTAPVQL

SEQ ID NO: 141350 - protein, 9 aa, Artificial Sequence
  Description of Artificial Sequence: Synthetic peptide
  Seed: RAMLGTHTM (PMEL_HUMAN)
RQMLGTHTY

SEQ ID NO: 141351 - protein, 11 aa, Artificial Sequence
  Description of Artificial Sequence: Synthetic peptide
  Seed: KHFLRNQPLTF (PMEL_HUMAN)
KFFLRNQPLTF

SEQ ID NO: 141352 - protein, 10 aa, Artificial Sequence
  Description of Artificial Sequence: Synthetic peptide
  Seed: YGSFSVTLDI (PMEL_HUMAN)
YMSFSVTLDW

SEQ ID NO: 141353 - protein, 10 aa, Artificial Sequence
  Description of Artificial Sequence: Synthetic peptide
  Seed: YVPLAHSSSA (PMEL_HUMAN)
YKPLAHSSSV

SEQ ID NO: 141354 - protein, 11 aa, Artificial Sequence
  Description of Artificial Sequence: Synthetic peptide
  Seed: SPVPGTTDGHR (PMEL_HUMAN)
SAVPGTTDGHK

SEQ ID NO: 141355 - protein, 9 aa, Artificial Sequence
  Description of Artificial Sequence: Synthetic peptide
  Seed: VLPDGQVIW (PMEL_HUMAN)
VMPDGQVIL

SEQ ID NO: 141356 - protein, 10 aa, Artificial Sequence
  Description of Artificial Sequence: Synthetic peptide
  Seed: LVLMAVVLAS (PMEL_HUMAN)
LNLMAVVLAI

SEQ ID NO: 141357 - protein, 10 aa, Artificial Sequence
  Description of Artificial Sequence: Synthetic peptide
  Seed: GPLLDGTATL (PMEL_HUMAN)
GLLLDGTATM

SEQ ID NO: 141358 - protein, 9 aa, Artificial Sequence
  Description of Artificial Sequence: Synthetic peptide
  Seed: SQKRSFVYV (PMEL_HUMAN)
SKKRSFVYY

SEQ ID NO: 141359 - protein, 9 aa, Artificial Sequence
  Description of Artificial Sequence: Synthetic peptide
  Seed: YVWKTWGQY (PMEL_HUMAN)
YMWKTWGQF

SEQ ID NO: 141360 - protein, 9 aa, Artificial Sequence
  Description of Artificial Sequence: Synthetic peptide
  Seed: YRYGSFSVT (PMEL_HUMAN)
YYYGSFSVY

SEQ ID NO: 141361 - protein, 10 aa, Artificial Sequence
  Description of Artificial Sequence: Synthetic peptide
  Seed: RGSRSYVPLA (PMEL_HUMAN)
RCSRSYVPLL

SEQ ID NO: 141362 - protein, 10 aa, Artificial Sequence
  Description of Artificial Sequence: Synthetic peptide
  Seed: THTMEVTVYH (PMEL_HUMAN)
TATMEVTVYK

SEQ ID NO: 141363 - protein, 9 aa, Artificial Sequence
  Description of Artificial Sequence: Synthetic peptide
  Seed: KQDFSVPQL (PMEL_HUMAN)
KLDFSVPQW

SEQ ID NO: 141364 - protein, 9 aa, Artificial Sequence
  Description of Artificial Sequence: Synthetic peptide
  Seed: YLEPGPVTA (PMEL_HUMAN)
YPEPGPVTV

SEQ ID NO: 141365 - protein, 9 aa, Artificial Sequence
  Description of Artificial Sequence: Synthetic peptide
  Seed: HTMEVTVYH (PMEL_HUMAN)
HTMEVTVYM

SEQ ID NO: 141366 - protein, 11 aa, Artificial Sequence
  Description of Artificial Sequence: Synthetic peptide
  Seed: MAVVLASLIYR (PMEL_HUMAN)
MMVVLASLIYK

SEQ ID NO: 141367 - protein, 11 aa, Artificial Sequence
  Description of Artificial Sequence: Synthetic peptide
  Seed: RRGSRSYVPLA (PMEL_HUMAN)
REGSRSYVPLV

SEQ ID NO: 141368 - protein, 9 aa, Artificial Sequence
  Description of Artificial Sequence: Synthetic peptide
  Seed: QLHDPSGYL (PMEL_HUMAN)
QLHDPSGYV

SEQ ID NO: 141369 - protein, 11 aa, Artificial Sequence
  Description of Artificial Sequence: Synthetic peptide
  Seed: QLYPEWTEAQR (PMEL_HUMAN)
QVYPEWTEAQR

SEQ ID NO: 141370 - protein, 8 aa, Artificial Sequence
  Description of Artificial Sequence: Synthetic peptide
  Seed: TLDIVQGI (PMEL_HUMAN)
TSDIVQGI

SEQ ID NO: 141371 - protein, 10 aa, Artificial Sequence
  Description of Artificial Sequence: Synthetic peptide
  Seed: EVMGTTLAEM (PMEL_HUMAN)
ETMGTTLAER

SEQ ID NO: 141372 - protein, 9 aa, Artificial Sequence
  Description of Artificial Sequence: Synthetic peptide
  Seed: TLISRALVV (PMEL_HUMAN)
TTISRALVL

SEQ ID NO: 141373 - protein, 10 aa, Artificial Sequence
  Description of Artificial Sequence: Synthetic peptide
  Seed: ALDGGNKHFL (PMEL_HUMAN)
AWDGGNKHFL

SEQ ID NO: 141374 - protein, 11 aa, Artificial Sequence
  Description of Artificial Sequence: Synthetic peptide
  Seed: GYLAEADLSYT (PMEL_HUMAN)
GHLAEADLSYL

SEQ ID NO: 141375 - protein, 9 aa, Artificial Sequence
  Description of Artificial Sequence: Synthetic peptide
  Seed: ITDQVPFSV (PMEL_HUMAN)
IYDQVPFSV

SEQ ID NO: 141376 - protein, 9 aa, Artificial Sequence
  Description of Artificial Sequence: Synthetic peptide
  Seed: VPLIVGILL (PMEL_HUMAN)
VPLIVGILA

SEQ ID NO: 141377 - protein, 10 aa, Artificial Sequence
  Description of Artificial Sequence: Synthetic peptide
  Seed: LPHSSSHWLR (PMEL_HUMAN)
LVHSSSHWLR

SEQ ID NO: 141378 - protein, 10 aa, Artificial Sequence
  Description of Artificial Sequence: Synthetic peptide
  Seed: SITGSLGPLL (PMEL_HUMAN)
SITGSLGPLV

SEQ ID NO: 141379 - protein, 10 aa, Artificial Sequence
  Description of Artificial Sequence: Synthetic peptide
  Seed: YVPLAHSSSA (PMEL_HUMAN)
YHPLAHSSSM

SEQ ID NO: 141380 - protein, 10 aa, Artificial Sequence
  Description of Artificial Sequence: Synthetic peptide
  Seed: LAEADLSYTW (PMEL_HUMAN)
LTEADLSYTF

SEQ ID NO: 141381 - protein, 10 aa, Artificial Sequence
  Description of Artificial Sequence: Synthetic peptide
  Seed: ESAEILQAVP (PMEL_HUMAN)
EVAEILQAVY

SEQ ID NO: 141382 - protein, 11 aa, Artificial Sequence
  Description of Artificial Sequence: Synthetic peptide
  Seed: GYLAEADLSYT (PMEL_HUMAN)
GQLAEADLSYV

SEQ ID NO: 141383 - protein, 10 aa, Artificial Sequence
  Description of Artificial Sequence: Synthetic peptide
  Seed: RGSRSYVPLA (PMEL_HUMAN)
RVSRSYVPLS

SEQ ID NO: 141384 - protein, 9 aa, Artificial Sequence
  Description of Artificial Sequence: Synthetic peptide
  Seed: VLPSPACQL (PMEL_HUMAN)
VMPSPACQY

SEQ ID NO: 141385 - protein, 9 aa, Artificial Sequence
  Description of Artificial Sequence: Synthetic peptide
  Seed: FLRNQPLTF (PMEL_HUMAN)
FARNQPLTF

SEQ ID NO: 141386 - protein, 9 aa, Artificial Sequence
  Description of Artificial Sequence: Synthetic peptide
  Seed: RLMKQDFSV (PMEL_HUMAN)
RVMKQDFSV

SEQ ID NO: 141387 - protein, 9 aa, Artificial Sequence
  Description of Artificial Sequence: Synthetic peptide
  Seed: VPFSVSVSQ (PMEL_HUMAN)
VAFSVSVSM

SEQ ID NO: 141388 - protein, 9 aa, Artificial Sequence
  Description of Artificial Sequence: Synthetic peptide
  Seed: SGLSIGTGR (PMEL_HUMAN)
SYLSIGTGR

SEQ ID NO: 141389 - protein, 9 aa, Artificial Sequence
  Description of Artificial Sequence: Synthetic peptide
  Seed: AVVLASLIY (PMEL_HUMAN)
AQVLASLIL

SEQ ID NO: 141390 - protein, 10 aa, Artificial Sequence
  Description of Artificial Sequence: Synthetic peptide
  Seed: EVMGTTLAEM (PMEL_HUMAN)
EAMGTTLAEK

SEQ ID NO: 141391 - protein, 9 aa, Artificial Sequence
  Description of Artificial Sequence: Synthetic peptide
  Seed: LIVGILLVL (PMEL_HUMAN)
LTVGILLVA

SEQ ID NO: 141392 - protein, 10 aa, Artificial Sequence
  Description of Artificial Sequence: Synthetic peptide
  Seed: VSLADTNSLA (PMEL_HUMAN)
VGLADTNSLL

SEQ ID NO: 141393 - protein, 9 aa, Artificial Sequence
  Description of Artificial Sequence: Synthetic peptide
  Seed: YLEPGPVTA (PMEL_HUMAN)
YAEPGPVTT

SEQ ID NO: 141394 - protein, 10 aa, Artificial Sequence
  Description of Artificial Sequence: Synthetic peptide
  Seed: SSSHWLRLPR (PMEL_HUMAN)
SFSHWLRLPK

SEQ ID NO: 141395 - protein, 9 aa, Artificial Sequence
  Description of Artificial Sequence: Synthetic peptide
  Seed: YLEPGPVTA (PMEL_HUMAN)
YFEPGPVTL

SEQ ID NO: 141396 - protein, 11 aa, Artificial Sequence
  Description of Artificial Sequence: Synthetic peptide
  Seed: RRGSRSYVPLA (PMEL_HUMAN)
RYGSRSYVPLA

SEQ ID NO: 141397 - protein, 9 aa, Artificial Sequence
  Description of Artificial Sequence: Synthetic peptide
  Seed: LQAAIPLTS (PMEL_HUMAN)
LTAAIPLTY

SEQ ID NO: 141398 - protein, 10 aa, Artificial Sequence
  Description of Artificial Sequence: Synthetic peptide
  Seed: MKQDFSVPQL (PMEL_HUMAN)
MLQDFSVPQV

SEQ ID NO: 141399 - protein, 10 aa, Artificial Sequence
  Description of Artificial Sequence: Synthetic peptide
  Seed: LGQVPLIVGI (PMEL_HUMAN)
LKQVPLIVGV

SEQ ID NO: 141400 - protein, 9 aa, Artificial Sequence
  Description of Artificial Sequence: Synthetic peptide
  Seed: TIINGSQVW (PMEL_HUMAN)
TLINGSQVM

SEQ ID NO: 141401 - protein, 11 aa, Artificial Sequence
  Description of Artificial Sequence: Synthetic peptide
  Seed: QAVPSGEGDAF (PMEL_HUMAN)
QAVPSGEGDAL

SEQ ID NO: 141402 - protein, 9 aa, Artificial Sequence
  Description of Artificial Sequence: Synthetic peptide
  Seed: WQVLGGPVS (PMEL_HUMAN)
WEVLGGPVF

SEQ ID NO: 141403 - protein, 10 aa, Artificial Sequence
  Description of Artificial Sequence: Synthetic peptide
  Seed: TDQVPFSVSV (PMEL_HUMAN)
TFQVPFSVSV

SEQ ID NO: 141404 - protein, 9 aa, Artificial Sequence
  Description of Artificial Sequence: Synthetic peptide
  Seed: YVWKTWGQY (PMEL_HUMAN)
YLWKTWGQM

SEQ ID NO: 141405 - protein, 10 aa, Artificial Sequence
  Description of Artificial Sequence: Synthetic peptide
  Seed: KRQVPLDCVL (PMEL_HUMAN)
KQQVPLDCVF

SEQ ID NO: 141406 - protein, 9 aa, Artificial Sequence
  Description of Artificial Sequence: Synthetic peptide
  Seed: VLASLIYRR (PMEL_HUMAN)
VMASLIYRV

SEQ ID NO: 141407 - protein, 9 aa, Artificial Sequence
  Description of Artificial Sequence: Synthetic peptide
  Seed: ISRALVVTH (PMEL_HUMAN)
IARALVVTH

SEQ ID NO: 141408 - protein, 10 aa, Artificial Sequence
  Description of Artificial Sequence: Synthetic peptide
  Seed: SVPQLPHSSS (PMEL_HUMAN)
SKPQLPHSSL

SEQ ID NO: 141409 - protein, 9 aa, Artificial Sequence
  Description of Artificial Sequence: Synthetic peptide
  Seed: VSVSQLRAL (PMEL_HUMAN)
VAVSQLRAM

SEQ ID NO: 141410 - protein, 9 aa, Artificial Sequence
  Description of Artificial Sequence: Synthetic peptide
  Seed: MAVVLASLI (PMEL_HUMAN)
MAVVLASLL

SEQ ID NO: 141411 - protein, 11 aa, Artificial Sequence
  Description of Artificial Sequence: Synthetic peptide
  Seed: FSVTLDIVQGI (PMEL_HUMAN)
FMVTLDIVQGL

SEQ ID NO: 141412 - protein, 10 aa, Artificial Sequence
  Description of Artificial Sequence: Synthetic peptide
  Seed: ASSIMSTESI (PMEL_HUMAN)
ADSIMSTESW

SEQ ID NO: 141413 - protein, 9 aa, Artificial Sequence
  Description of Artificial Sequence: Synthetic peptide
  Seed: ASFSIALNF (PMEL_HUMAN)
AQFSIALNL

SEQ ID NO: 141414 - protein, 10 aa, Artificial Sequence
  Description of Artificial Sequence: Synthetic peptide
  Seed: KRCLLHLAVI (PMEL_HUMAN)
KRCLLHLAVM

SEQ ID NO: 141415 - protein, 9 aa, Artificial Sequence
  Description of Artificial Sequence: Synthetic peptide
  Seed: ASLIYRRRL (PMEL_HUMAN)
ASLIYRRRW

SEQ ID NO: 141416 - protein, 10 aa, Artificial Sequence
  Description of Artificial Sequence: Synthetic peptide
  Seed: EVSIVVLSGT (PMEL_HUMAN)
EVSIVVLSGL

SEQ ID NO: 141417 - protein, 10 aa, Artificial Sequence
  Description of Artificial Sequence: Synthetic peptide
  Seed: VPQLPHSSSH (PMEL_HUMAN)
VFQLPHSSSL

SEQ ID NO: 141418 - protein, 10 aa, Artificial Sequence
  Description of Artificial Sequence: Synthetic peptide
  Seed: KVLPDGQVIW (PMEL_HUMAN)
KQLPDGQVII

SEQ ID NO: 141419 - protein, 9 aa, Artificial Sequence
  Description of Artificial Sequence: Synthetic peptide
  Seed: TTDGHRPTA (PMEL_HUMAN)
TDDGHRPTL

SEQ ID NO: 141420 - protein, 9 aa, Artificial Sequence
  Description of Artificial Sequence: Synthetic peptide
  Seed: TLIGANASF (PMEL_HUMAN)
TFIGANASV

SEQ ID NO: 141421 - protein, 9 aa, Artificial Sequence
  Description of Artificial Sequence: Synthetic peptide
  Seed: GSFSVTLDI (PMEL_HUMAN)
GMFSVTLDL

SEQ ID NO: 141422 - protein, 9 aa, Artificial Sequence
  Description of Artificial Sequence: Synthetic peptide
  Seed: VLKRCLLHL (PMEL_HUMAN)
VFKRCLLHY

SEQ ID NO: 141423 - protein, 10 aa, Artificial Sequence
  Description of Artificial Sequence: Synthetic peptide
  Seed: SGTYCLNVSL (PMEL_HUMAN)
SITYCLNVSY

SEQ ID NO: 141424 - protein, 10 aa, Artificial Sequence
  Description of Artificial Sequence: Synthetic peptide
  Seed: LNFPGSQKVL (PMEL_HUMAN)
LTFPGSQKVY

SEQ ID NO: 141425 - protein, 11 aa, Artificial Sequence
  Description of Artificial Sequence: Synthetic peptide
  Seed: SLKVSNDGPTL (PMEL_HUMAN)
SMKVSNDGPTY

SEQ ID NO: 141426 - protein, 11 aa, Artificial Sequence
  Description of Artificial Sequence: Synthetic peptide
  Seed: YLEPGPVTAQV (PMEL_HUMAN)
YSEPGPVTAQL

SEQ ID NO: 141427 - protein, 9 aa, Artificial Sequence
  Description of Artificial Sequence: Synthetic peptide
  Seed: SAFTITDQV (PMEL_HUMAN)
SSFTITDQW

SEQ ID NO: 141428 - protein, 9 aa, Artificial Sequence
  Description of Artificial Sequence: Synthetic peptide
  Seed: LPSPACQLV (PMEL_HUMAN)
LASPACQLM

SEQ ID NO: 141429 - protein, 9 aa, Artificial Sequence
  Description of Artificial Sequence: Synthetic peptide
  Seed: GTYCLNVSL (PMEL_HUMAN)
GSYCLNVSV

SEQ ID NO: 141430 - protein, 9 aa, Artificial Sequence
  Description of Artificial Sequence: Synthetic peptide
  Seed: YLAEADLSY (PMEL_HUMAN)
YWAEADLSL

SEQ ID NO: 141431 - protein, 10 aa, Artificial Sequence
  Description of Artificial Sequence: Synthetic peptide
  Seed: MSTESITGSL (PMEL_HUMAN)
MATESITGSW

SEQ ID NO: 141432 - protein, 9 aa, Artificial Sequence
  Description of Artificial Sequence: Synthetic peptide
  Seed: RAMLGTHTM (PMEL_HUMAN)
RFMLGTHTW

SEQ ID NO: 141433 - protein, 9 aa, Artificial Sequence
  Description of Artificial Sequence: Synthetic peptide
  Seed: SLADTNSLA (PMEL_HUMAN)
SIADTNSLV

SEQ ID NO: 141434 - protein, 8 aa, Artificial Sequence
  Description of Artificial Sequence: Synthetic peptide
  Seed: AEAPNTTA (PMEL_HUMAN)
AEAPNTTL

SEQ ID NO: 141435 - protein, 9 aa, Artificial Sequence
  Description of Artificial Sequence: Synthetic peptide
  Seed: ANASFSIAL (PMEL_HUMAN)
ATASFSIAF

SEQ ID NO: 141436 - protein, 9 aa, Artificial Sequence
  Description of Artificial Sequence: Synthetic peptide
  Seed: SLIYRRRLM (PMEL_HUMAN)
SYIYRRRLF

SEQ ID NO: 141437 - protein, 10 aa, Artificial Sequence
  Description of Artificial Sequence: Synthetic peptide
  Seed: EVMGTTLAEM (PMEL_HUMAN)
EIMGTTLAEY

SEQ ID NO: 141438 - protein, 10 aa, Artificial Sequence
  Description of Artificial Sequence: Synthetic peptide
  Seed: KRCLLHLAVI (PMEL_HUMAN)
KRCLLHLAVR

SEQ ID NO: 141439 - protein, 10 aa, Artificial Sequence
  Description of Artificial Sequence: Synthetic peptide
  Seed: MTPAEVSIVV (PMEL_HUMAN)
MVPAEVSIVI

SEQ ID NO: 141440 - protein, 9 aa, Artificial Sequence
  Description of Artificial Sequence: Synthetic peptide
  Seed: HLAVIGALL (PMEL_HUMAN)
HQAVIGALM

SEQ ID NO: 141441 - protein, 8 aa, Artificial Sequence
  Description of Artificial Sequence: Synthetic peptide
  Seed: HSSSHWLR (PMEL_HUMAN)
HVSSHWLR

SEQ ID NO: 141442 - protein, 9 aa, Artificial Sequence
  Description of Artificial Sequence: Synthetic peptide
  Seed: VVLASLIYR (PMEL_HUMAN)
VLLASLIYR

SEQ ID NO: 141443 - protein, 9 aa, Artificial Sequence
  Description of Artificial Sequence: Synthetic peptide
  Seed: LPHSSSHWL (PMEL_HUMAN)
LAHSSSHWF

SEQ ID NO: 141444 - protein, 9 aa, Artificial Sequence
  Description of Artificial Sequence: Synthetic peptide
  Seed: VSLADTNSL (PMEL_HUMAN)
VHLADTNSY

SEQ ID NO: 141445 - protein, 9 aa, Artificial Sequence
  Description of Artificial Sequence: Synthetic peptide
  Seed: RQVPLDCVL (PMEL_HUMAN)
RMVPLDCVI

SEQ ID NO: 141446 - protein, 9 aa, Artificial Sequence
  Description of Artificial Sequence: Synthetic peptide
  Seed: RYGSFSVTL (PMEL_HUMAN)
RQGSFSVTW

SEQ ID NO: 141447 - protein, 10 aa, Artificial Sequence
  Description of Artificial Sequence: Synthetic peptide
  Seed: YRYGSFSVTL (PMEL_HUMAN)
YCYGSFSVTY

SEQ ID NO: 141448 - protein, 10 aa, Artificial Sequence
  Description of Artificial Sequence: Synthetic peptide
  Seed: MPTAESTGMT (PMEL_HUMAN)
MMTAESTGMA

SEQ ID NO: 141449 - protein, 9 aa, Artificial Sequence
  Description of Artificial Sequence: Synthetic peptide
  Seed: AEPSGTTSV (PMEL_HUMAN)
ASPSGTTSM

SEQ ID NO: 141450 - protein, 9 aa, Artificial Sequence
  Description of Artificial Sequence: Synthetic peptide
  Seed: VPLDCVLYR (PMEL_HUMAN)
VILDCVLYK

SEQ ID NO: 141451 - protein, 9 aa, Artificial Sequence
  Description of Artificial Sequence: Synthetic peptide
  Seed: EGPDASSIM (PMEL_HUMAN)
EMPDASSIL

SEQ ID NO: 141452 - protein, 9 aa, Artificial Sequence
  Description of Artificial Sequence: Synthetic peptide
  Seed: AQVTTTEWV (PMEL_HUMAN)
AIVTTTEWL

SEQ ID NO: 141453 - protein, 9 aa, Artificial Sequence
  Description of Artificial Sequence: Synthetic peptide
  Seed: SSPGCQPPA (PMEL_HUMAN)
SAPGCQPPV

SEQ ID NO: 141454 - protein, 9 aa, Artificial Sequence
  Description of Artificial Sequence: Synthetic peptide
  Seed: GQVPTTEVV (PMEL_HUMAN)
GEVPTTEVC

SEQ ID NO: 141455 - protein, 10 aa, Artificial Sequence
  Description of Artificial Sequence: Synthetic peptide
  Seed: LAEADLSYTW (PMEL_HUMAN)
LEEADLSYTW

SEQ ID NO: 141456 - protein, 8 aa, Artificial Sequence
  Description of Artificial Sequence: Synthetic peptide
  Seed: RSFVYVWK (PMEL_HUMAN)
RYFVYVWR

SEQ ID NO: 141457 - protein, 9 aa, Artificial Sequence
  Description of Artificial Sequence: Synthetic peptide
  Seed: MLGTHTMEV (PMEL_HUMAN)
MMGTHTMEM

SEQ ID NO: 141458 - protein, 9 aa, Artificial Sequence
  Description of Artificial Sequence: Synthetic peptide
  Seed: VVLQAAIPL (PMEL_HUMAN)
VSLQAAIPI

SEQ ID NO: 141459 - protein, 10 aa, Artificial Sequence
  Description of Artificial Sequence: Synthetic peptide
  Seed: MTPAEVSIVV (PMEL_HUMAN)
MWPAEVSIVW

SEQ ID NO: 141460 - protein, 10 aa, Artificial Sequence
  Description of Artificial Sequence: Synthetic peptide
  Seed: SQVWGGQPVY (PMEL_HUMAN)
SIVWGGQPVY

SEQ ID NO: 141461 - protein, 9 aa, Artificial Sequence
  Description of Artificial Sequence: Synthetic peptide
  Seed: RAMLGTHTM (PMEL_HUMAN)
RIMLGTHTY

SEQ ID NO: 141462 - protein, 10 aa, Artificial Sequence
  Description of Artificial Sequence: Synthetic peptide
  Seed: RRLMKQDFSV (PMEL_HUMAN)
RLLMKQDFSV

SEQ ID NO: 141463 - protein, 8 aa, Artificial Sequence
  Description of Artificial Sequence: Synthetic peptide
  Seed: TLDIVQGI (PMEL_HUMAN)
TTDIVQGV

SEQ ID NO: 141464 - protein, 9 aa, Artificial Sequence
  Description of Artificial Sequence: Synthetic peptide
  Seed: YLEPGPVTA (PMEL_HUMAN)
YVEPGPVTF

SEQ ID NO: 141465 - protein, 10 aa, Artificial Sequence
  Description of Artificial Sequence: Synthetic peptide
  Seed: RQLYPEWTEA (PMEL_HUMAN)
RSLYPEWTEI

SEQ ID NO: 141466 - protein, 9 aa, Artificial Sequence
  Description of Artificial Sequence: Synthetic peptide
  Seed: KVSNDGPTL (PMEL_HUMAN)
KISNDGPTV

SEQ ID NO: 141467 - protein, 9 aa, Artificial Sequence
  Description of Artificial Sequence: Synthetic peptide
  Seed: QPLTFALQL (PMEL_HUMAN)
QPLTFALQF

SEQ ID NO: 141468 - protein, 9 aa, Artificial Sequence
  Description of Artificial Sequence: Synthetic peptide
  Seed: GQVPLIVGI (PMEL_HUMAN)
GLVPLIVGY

SEQ ID NO: 141469 - protein, 10 aa, Artificial Sequence
  Description of Artificial Sequence: Synthetic peptide
  Seed: HTMEVTVYHR (PMEL_HUMAN)
HRMEVTVYHR

SEQ ID NO: 141470 - protein, 9 aa, Artificial Sequence
  Description of Artificial Sequence: Synthetic peptide
  Seed: LSIGTGRAM (PMEL_HUMAN)
LHIGTGRAF

SEQ ID NO: 141471 - protein, 10 aa, Artificial Sequence
  Description of Artificial Sequence: Synthetic peptide
  Seed: AVPSGEGDAF (PMEL_HUMAN)
APPSGEGDAY

SEQ ID NO: 141472 - protein, 9 aa, Artificial Sequence
  Description of Artificial Sequence: Synthetic peptide
  Seed: TTDGHRPTA (PMEL_HUMAN)
TVDGHRPTV

SEQ ID NO: 141473 - protein, 10 aa, Artificial Sequence
  Description of Artificial Sequence: Synthetic peptide
  Seed: ALDGGNKHFL (PMEL_HUMAN)
AGDGGNKHFL

SEQ ID NO: 141474 - protein, 9 aa, Artificial Sequence
  Description of Artificial Sequence: Synthetic peptide
  Seed: WQVLGGPVS (PMEL_HUMAN)
WLVLGGPVF

SEQ ID NO: 141475 - protein, 9 aa, Artificial Sequence
  Description of Artificial Sequence: Synthetic peptide
  Seed: ANASFSIAL (PMEL_HUMAN)
ATASFSIAM

SEQ ID NO: 141476 - protein, 9 aa, Artificial Sequence
  Description of Artificial Sequence: Synthetic peptide
  Seed: ESAEILQAV (PMEL_HUMAN)
EAAEILQAI

SEQ ID NO: 141477 - protein, 9 aa, Artificial Sequence
  Description of Artificial Sequence: Synthetic peptide
  Seed: TKAWNRQLY (PMEL_HUMAN)
TQAWNRQLM

SEQ ID NO: 141478 - protein, 9 aa, Artificial Sequence
  Description of Artificial Sequence: Synthetic peptide
  Seed: VVLASLIYR (PMEL_HUMAN)
VILASLIYK

SEQ ID NO: 141479 - protein, 10 aa, Artificial Sequence
  Description of Artificial Sequence: Synthetic peptide
  Seed: SGTYCLNVSL (PMEL_HUMAN)
STTYCLNVSF

SEQ ID NO: 141480 - protein, 9 aa, Artificial Sequence
  Description of Artificial Sequence: Synthetic peptide
  Seed: LNFPGSQKV (PMEL_HUMAN)
LMFPGSQKV

SEQ ID NO: 141481 - protein, 9 aa, Artificial Sequence
  Description of Artificial Sequence: Synthetic peptide
  Seed: AAQVTTTEW (PMEL_HUMAN)
ASQVTTTEY

SEQ ID NO: 141482 - protein, 9 aa, Artificial Sequence
  Description of Artificial Sequence: Synthetic peptide
  Seed: QPVLPSPAC (PMEL_HUMAN)
QPVLPSPAV

SEQ ID NO: 141483 - protein, 9 aa, Artificial Sequence
  Description of Artificial Sequence: Synthetic peptide
  Seed: TAEAPNTTA (PMEL_HUMAN)
TPEAPNTTA

SEQ ID NO: 141484 - protein, 10 aa, Artificial Sequence
  Description of Artificial Sequence: Synthetic peptide
  Seed: RQVPLDCVLY (PMEL_HUMAN)
RQVPLDCVLL

SEQ ID NO: 141485 - protein, 10 aa, Artificial Sequence
  Description of Artificial Sequence: Synthetic peptide
  Seed: RQLYPEWTEA (PMEL_HUMAN)
RKLYPEWTEM

SEQ ID NO: 141486 - protein, 10 aa, Artificial Sequence
  Description of Artificial Sequence: Synthetic peptide
  Seed: RTKAWNRQLY (PMEL_HUMAN)
RMKAWNRQLR

SEQ ID NO: 141487 - protein, 8 aa, Artificial Sequence
  Description of Artificial Sequence: Synthetic peptide
  Seed: SNDGPTLI (PMEL_HUMAN)
SFDGPTLI

SEQ ID NO: 141488 - protein, 10 aa, Artificial Sequence
  Description of Artificial Sequence: Synthetic peptide
  Seed: MTPAEVSIVV (PMEL_HUMAN)
MDPAEVSIVW

SEQ ID NO: 141489 - protein, 9 aa, Artificial Sequence
  Description of Artificial Sequence: Synthetic peptide
  Seed: SQKRSFVYV (PMEL_HUMAN)
SKKRSFVYF

SEQ ID NO: 141490 - protein, 9 aa, Artificial Sequence
  Description of Artificial Sequence: Synthetic peptide
  Seed: HLAVIGALL (PMEL_HUMAN)
HMAVIGALR

SEQ ID NO: 141491 - protein, 9 aa, Artificial Sequence
  Description of Artificial Sequence: Synthetic peptide
  Seed: AQVTTTEWV (PMEL_HUMAN)
AVVTTTEWV

SEQ ID NO: 141492 - protein, 10 aa, Artificial Sequence
  Description of Artificial Sequence: Synthetic peptide
  Seed: ASSIMSTESI (PMEL_HUMAN)
ALSIMSTESW

SEQ ID NO: 141493 - protein, 9 aa, Artificial Sequence
  Description of Artificial Sequence: Synthetic peptide
  Seed: GTYCLNVSL (PMEL_HUMAN)
GLYCLNVST

SEQ ID NO: 141494 - protein, 9 aa, Artificial Sequence
  Description of Artificial Sequence: Synthetic peptide
  Seed: VSEVMGTTL (PMEL_HUMAN)
VWEVMGTTM

SEQ ID NO: 141495 - protein, 9 aa, Artificial Sequence
  Description of Artificial Sequence: Synthetic peptide
  Seed: FTITDQVPF (PMEL_HUMAN)
FYITDQVPV

SEQ ID NO: 141496 - protein, 9 aa, Artificial Sequence
  Description of Artificial Sequence: Synthetic peptide
  Seed: VQMPTAEST (PMEL_HUMAN)
VGMPTAESY

SEQ ID NO: 141497 - protein, 9 aa, Artificial Sequence
  Description of Artificial Sequence: Synthetic peptide
  Seed: TPAEVSIVV (PMEL_HUMAN)
TGAEVSIVY

SEQ ID NO: 141498 - protein, 11 aa, Artificial Sequence
  Description of Artificial Sequence: Synthetic peptide
  Seed: SQKRSFVYVWK (PMEL_HUMAN)
SFKRSFVYVWR

SEQ ID NO: 141499 - protein, 11 aa, Artificial Sequence
  Description of Artificial Sequence: Synthetic peptide
  Seed: HSSSHWLRLPR (PMEL_HUMAN)
HFSSHWLRLPR

SEQ ID NO: 141500 - protein, 11 aa, Artificial Sequence
  Description of Artificial Sequence: Synthetic peptide
  Seed: YRYGSFSVTLD (PMEL_HUMAN)
YRYGSFSVTLL

SEQ ID NO: 141501 - protein, 11 aa, Artificial Sequence
  Description of Artificial Sequence: Synthetic peptide
  Seed: VWKTWGQYWQV (PMEL_HUMAN)
VLKTWGQYWQL

SEQ ID NO: 141502 - protein, 9 aa, Artificial Sequence
  Description of Artificial Sequence: Synthetic peptide
  Seed: EVMGTTLAE (PMEL_HUMAN)
EGMGTTLAR

SEQ ID NO: 141503 - protein, 10 aa, Artificial Sequence
  Description of Artificial Sequence: Synthetic peptide
  Seed: AVIGALLAVG (PMEL_HUMAN)
AQIGALLAVD

SEQ ID NO: 141504 - protein, 9 aa, Artificial Sequence
  Description of Artificial Sequence: Synthetic peptide
  Seed: FGDSSGTLI (PMEL_HUMAN)
FQDSSGTLF

SEQ ID NO: 141505 - protein, 9 aa, Artificial Sequence
  Description of Artificial Sequence: Synthetic peptide
  Seed: SVPQLPHSS (PMEL_HUMAN)
SCPQLPHSL

SEQ ID NO: 141506 - protein, 9 aa, Artificial Sequence
  Description of Artificial Sequence: Synthetic peptide
  Seed: RQVPLDCVL (PMEL_HUMAN)
REVPLDCVP

SEQ ID NO: 141507 - protein, 10 aa, Artificial Sequence
  Description of Artificial Sequence: Synthetic peptide
  Seed: ESITGSLGPL (PMEL_HUMAN)
ETITGSLGPA

SEQ ID NO: 141508 - protein, 10 aa, Artificial Sequence
  Description of Artificial Sequence: Synthetic peptide
  Seed: RSFVYVWKTW (PMEL_HUMAN)
RHFVYVWKTF

SEQ ID NO: 141509 - protein, 9 aa, Artificial Sequence
  Description of Artificial Sequence: Synthetic peptide
  Seed: LAVIGALLA (PMEL_HUMAN)
LAVIGALLL

SEQ ID NO: 141510 - protein, 8 aa, Artificial Sequence
  Description of Artificial Sequence: Synthetic peptide
  Seed: YGSFSVTL (PMEL_HUMAN)
YASFSVTV

SEQ ID NO: 141511 - protein, 10 aa, Artificial Sequence
  Description of Artificial Sequence: Synthetic peptide
  Seed: AVVLASLIYR (PMEL_HUMAN)
AMVLASLIYR

SEQ ID NO: 141512 - protein, 9 aa, Artificial Sequence
  Description of Artificial Sequence: Synthetic peptide
  Seed: RLMKQDFSV (PMEL_HUMAN)
RVMKQDFSF

SEQ ID NO: 141513 - protein, 9 aa, Artificial Sequence
  Description of Artificial Sequence: Synthetic peptide
  Seed: SVPQLPHSS (PMEL_HUMAN)
SNPQLPHSL

SEQ ID NO: 141514 - protein, 10 aa, Artificial Sequence
  Description of Artificial Sequence: Synthetic peptide
  Seed: RQLYPEWTEA (PMEL_HUMAN)
RFLYPEWTEV

SEQ ID NO: 141515 - protein, 9 aa, Artificial Sequence
  Description of Artificial Sequence: Synthetic peptide
  Seed: GTYCLNVSL (PMEL_HUMAN)
GMYCLNVSK

SEQ ID NO: 141516 - protein, 10 aa, Artificial Sequence
  Description of Artificial Sequence: Synthetic peptide
  Seed: SVPQLPHSSS (PMEL_HUMAN)
SFPQLPHSSV

SEQ ID NO: 141517 - protein, 11 aa, Artificial Sequence
  Description of Artificial Sequence: Synthetic peptide
  Seed: YLEPGPVTAQV (PMEL_HUMAN)
YGEPGPVTAQL

SEQ ID NO: 141518 - protein, 9 aa, Artificial Sequence
  Description of Artificial Sequence: Synthetic peptide
  Seed: SSIMSTESI (PMEL_HUMAN)
SGIMSTESY

SEQ ID NO: 141519 - protein, 11 aa, Artificial Sequence
  Description of Artificial Sequence: Synthetic peptide
  Seed: LYRYGSFSVTL (PMEL_HUMAN)
LKRYGSFSVTF

SEQ ID NO: 141520 - protein, 10 aa, Artificial Sequence
  Description of Artificial Sequence: Synthetic peptide
  Seed: RGSRSYVPLA (PMEL_HUMAN)
RNSRSYVPLA

SEQ ID NO: 141521 - protein, 9 aa, Artificial Sequence
  Description of Artificial Sequence: Synthetic peptide
  Seed: VQMPTAEST (PMEL_HUMAN)
VKMPTAESF

SEQ ID NO: 141522 - protein, 10 aa, Artificial Sequence
  Description of Artificial Sequence: Synthetic peptide
  Seed: YRYGSFSVTL (PMEL_HUMAN)
YYYGSFSVTH

SEQ ID NO: 141523 - protein, 9 aa, Artificial Sequence
  Description of Artificial Sequence: Synthetic peptide
  Seed: LNFPGSQKV (PMEL_HUMAN)
LAFPGSQKY

SEQ ID NO: 141524 - protein, 9 aa, Artificial Sequence
  Description of Artificial Sequence: Synthetic peptide
  Seed: ALLAVGATK (PMEL_HUMAN)
AVLAVGATK

SEQ ID NO: 141525 - protein, 9 aa, Artificial Sequence
  Description of Artificial Sequence: Synthetic peptide
  Seed: TPAEVSIVV (PMEL_HUMAN)
TRAEVSIVL

SEQ ID NO: 141526 - protein, 9 aa, Artificial Sequence
  Description of Artificial Sequence: Synthetic peptide
  Seed: KTWGQYWQV (PMEL_HUMAN)
KVWGQYWQM

SEQ ID NO: 141527 - protein, 10 aa, Artificial Sequence
  Description of Artificial Sequence: Synthetic peptide
  Seed: LAVVSTQLIM (PMEL_HUMAN)
LTVVSTQLIF

SEQ ID NO: 141528 - protein, 9 aa, Artificial Sequence
  Description of Artificial Sequence: Synthetic peptide
  Seed: FGDSSGTLI (PMEL_HUMAN)
FFDSSGTLI

SEQ ID NO: 141529 - protein, 10 aa, Artificial Sequence
  Description of Artificial Sequence: Synthetic peptide
  Seed: LKVSNDGPTL (PMEL_HUMAN)
LQVSNDGPTM

SEQ ID NO: 141530 - protein, 9 aa, Artificial Sequence
  Description of Artificial Sequence: Synthetic peptide
  Seed: TATLRLVKR (PMEL_HUMAN)
TSTLRLVKR

SEQ ID NO: 141531 - protein, 9 aa, Artificial Sequence
  Description of Artificial Sequence: Synthetic peptide
  Seed: AEILQAVPS (PMEL_HUMAN)
AEILQAVPM

SEQ ID NO: 141532 - protein, 9 aa, Artificial Sequence
  Description of Artificial Sequence: Synthetic peptide
  Seed: HTMEVTVYH (PMEL_HUMAN)
HPMEVTVYG

SEQ ID NO: 141533 - protein, 9 aa, Artificial Sequence
  Description of Artificial Sequence: Synthetic peptide
  Seed: SLGPLLDGT (PMEL_HUMAN)
SLGPLLDGM

SEQ ID NO: 141534 - protein, 11 aa, Artificial Sequence
  Description of Artificial Sequence: Synthetic peptide
  Seed: THTMEVTVYHR (PMEL_HUMAN)
TFTMEVTVYHR

SEQ ID NO: 141535 - protein, 9 aa, Artificial Sequence
  Description of Artificial Sequence: Synthetic peptide
  Seed: MLGTHTMEV (PMEL_HUMAN)
MIGTHTMEV

SEQ ID NO: 141536 - protein, 10 aa, Artificial Sequence
  Description of Artificial Sequence: Synthetic peptide
  Seed: SGTLISRALV (PMEL_HUMAN)
STTLISRALV

SEQ ID NO: 141537 - protein, 10 aa, Artificial Sequence
  Description of Artificial Sequence: Synthetic peptide
  Seed: AVIGALLAVG (PMEL_HUMAN)
ALIGALLAVT

SEQ ID NO: 141538 - protein, 9 aa, Artificial Sequence
  Description of Artificial Sequence: Synthetic peptide
  Seed: TLISRALVV (PMEL_HUMAN)
TAISRALVV

SEQ ID NO: 141539 - protein, 10 aa, Artificial Sequence
  Description of Artificial Sequence: Synthetic peptide
  Seed: TVSCQGGLPK (PMEL_HUMAN)
TMSCQGGLPK

SEQ ID NO: 141540 - protein, 10 aa, Artificial Sequence
  Description of Artificial Sequence: Synthetic peptide
  Seed: LIVGILLVLM (PMEL_HUMAN)
LIVGILLVLV

SEQ ID NO: 141541 - protein, 9 aa, Artificial Sequence
  Description of Artificial Sequence: Synthetic peptide
  Seed: LAVVSTQLI (PMEL_HUMAN)
LQVVSTQLI

SEQ ID NO: 141542 - protein, 11 aa, Artificial Sequence
  Description of Artificial Sequence: Synthetic peptide
  Seed: QAVPSGEGDAF (PMEL_HUMAN)
QPVPSGEGDAW

SEQ ID NO: 141543 - protein, 9 aa, Artificial Sequence
  Description of Artificial Sequence: Synthetic peptide
  Seed: VTAQVVLQA (PMEL_HUMAN)
VMAQVVLQI

SEQ ID NO: 141544 - protein, 9 aa, Artificial Sequence
  Description of Artificial Sequence: Synthetic peptide
  Seed: GQVPLIVGI (PMEL_HUMAN)
GEVPLIVGA

SEQ ID NO: 141545 - protein, 10 aa, Artificial Sequence
  Description of Artificial Sequence: Synthetic peptide
  Seed: LAVIGALLAV (PMEL_HUMAN)
LSVIGALLAA

SEQ ID NO: 141546 - protein, 10 aa, Artificial Sequence
  Description of Artificial Sequence: Synthetic peptide
  Seed: RQLYPEWTEA (PMEL_HUMAN)
RRLYPEWTEF

SEQ ID NO: 141547 - protein, 9 aa, Artificial Sequence
  Description of Artificial Sequence: Synthetic peptide
  Seed: LPSPACQLV (PMEL_HUMAN)
LPSPACQLW

SEQ ID NO: 141548 - protein, 11 aa, Artificial Sequence
  Description of Artificial Sequence: Synthetic peptide
  Seed: YLAEADLSYTW (PMEL_HUMAN)
YYAEADLSYTV

SEQ ID NO: 141549 - protein, 9 aa, Artificial Sequence
  Description of Artificial Sequence: Synthetic peptide
  Seed: KVSNDGPTL (PMEL_HUMAN)
KQSNDGPTL

SEQ ID NO: 141550 - protein, 10 aa, Artificial Sequence
  Description of Artificial Sequence: Synthetic peptide
  Seed: RGSRSYVPLA (PMEL_HUMAN)
RLSRSYVPLS

SEQ ID NO: 141551 - protein, 10 aa, Artificial Sequence
  Description of Artificial Sequence: Synthetic peptide
  Seed: YGSFSVTLDI (PMEL_HUMAN)
YHSFSVTLDW

SEQ ID NO: 141552 - protein, 10 aa, Artificial Sequence
  Description of Artificial Sequence: Synthetic peptide
  Seed: LIGANASFSI (PMEL_HUMAN)
LLGANASFSL

SEQ ID NO: 141553 - protein, 9 aa, Artificial Sequence
  Description of Artificial Sequence: Synthetic peptide
  Seed: TAEAPNTTA (PMEL_HUMAN)
TLEAPNTTL

SEQ ID NO: 141554 - protein, 9 aa, Artificial Sequence
  Description of Artificial Sequence: Synthetic peptide
  Seed: SYVPLAHSS (PMEL_HUMAN)
SFVPLAHSM

SEQ ID NO: 141555 - protein, 9 aa, Artificial Sequence
  Description of Artificial Sequence: Synthetic peptide
  Seed: GQVPLIVGI (PMEL_HUMAN)
GQVPLIVGA

SEQ ID NO: 141556 - protein, 10 aa, Artificial Sequence
  Description of Artificial Sequence: Synthetic peptide
  Seed: KTWGQYWQVL (PMEL_HUMAN)
KIWGQYWQVY

SEQ ID NO: 141557 - protein, 9 aa, Artificial Sequence
  Description of Artificial Sequence: Synthetic peptide
  Seed: YVWKTWGQY (PMEL_HUMAN)
YKWKTWGQM

SEQ ID NO: 141558 - protein, 9 aa, Artificial Sequence
  Description of Artificial Sequence: Synthetic peptide
  Seed: ITDQVPFSV (PMEL_HUMAN)
IFDQVPFSL

SEQ ID NO: 141559 - protein, 9 aa, Artificial Sequence
  Description of Artificial Sequence: Synthetic peptide
  Seed: RQVPLDCVL (PMEL_HUMAN)
REVPLDCVA

SEQ ID NO: 141560 - protein, 9 aa, Artificial Sequence
  Description of Artificial Sequence: Synthetic peptide
  Seed: SQKRSFVYV (PMEL_HUMAN)
SSKRSFVYY

SEQ ID NO: 141561 - protein, 9 aa, Artificial Sequence
  Description of Artificial Sequence: Synthetic peptide
  Seed: YLEPGPVTA (PMEL_HUMAN)
YIEPGPVTC

SEQ ID NO: 141562 - protein, 9 aa, Artificial Sequence
  Description of Artificial Sequence: Synthetic peptide
  Seed: VTAQVVLQA (PMEL_HUMAN)
VGAQVVLQV

SEQ ID NO: 141563 - protein, 11 aa, Artificial Sequence
  Description of Artificial Sequence: Synthetic peptide
  Seed: FSVTLDIVQGI (PMEL_HUMAN)
FQVTLDIVQGL

SEQ ID NO: 141564 - protein, 9 aa, Artificial Sequence
  Description of Artificial Sequence: Synthetic peptide
  Seed: DAFELTVSC (PMEL_HUMAN)
DVFELTVSF

SEQ ID NO: 141565 - protein, 11 aa, Artificial Sequence
  Description of Artificial Sequence: Synthetic peptide
  Seed: RQVPLDCVLYR (PMEL_HUMAN)
RAVPLDCVLYK

SEQ ID NO: 141566 - protein, 9 aa, Artificial Sequence
  Description of Artificial Sequence: Synthetic peptide
  Seed: VSVSQLRAL (PMEL_HUMAN)
VRVSQLRAM

SEQ ID NO: 141567 - protein, 9 aa, Artificial Sequence
  Description of Artificial Sequence: Synthetic peptide
  Seed: SQKRSFVYV (PMEL_HUMAN)
SLKRSFVYS

SEQ ID NO: 141568 - protein, 10 aa, Artificial Sequence
  Description of Artificial Sequence: Synthetic peptide
  Seed: SVPQLPHSSS (PMEL_HUMAN)
SLPQLPHSSF

SEQ ID NO: 141569 - protein, 9 aa, Artificial Sequence
  Description of Artificial Sequence: Synthetic peptide
  Seed: SQVWGGQPV (PMEL_HUMAN)
SVVWGGQPF

SEQ ID NO: 141570 - protein, 9 aa, Artificial Sequence
  Description of Artificial Sequence: Synthetic peptide
  Seed: LPIPEPEGP (PMEL_HUMAN)
LPIPEPEGA

SEQ ID NO: 141571 - protein, 9 aa, Artificial Sequence
  Description of Artificial Sequence: Synthetic peptide
  Seed: NFPGSQKVL (PMEL_HUMAN)
NVPGSQKVL

SEQ ID NO: 141572 - protein, 10 aa, Artificial Sequence
  Description of Artificial Sequence: Synthetic peptide
  Seed: MTPAEVSIVV (PMEL_HUMAN)
MYPAEVSIVL

SEQ ID NO: 141573 - protein, 9 aa, Artificial Sequence
  Description of Artificial Sequence: Synthetic peptide
  Seed: AGQVPTTEV (PMEL_HUMAN)
AAQVPTTEF

SEQ ID NO: 141574 - protein, 10 aa, Artificial Sequence
  Description of Artificial Sequence: Synthetic peptide
  Seed: FSVSVSQLRA (PMEL_HUMAN)
FAVSVSQLRK

SEQ ID NO: 141575 - protein, 9 aa, Artificial Sequence
  Description of Artificial Sequence: Synthetic peptide
  Seed: SLGPLLDGT (PMEL_HUMAN)
SIGPLLDGM

SEQ ID NO: 141576 - protein, 9 aa, Artificial Sequence
  Description of Artificial Sequence: Synthetic peptide
  Seed: RALDGGNKH (PMEL_HUMAN)
RNLDGGNKY

SEQ ID NO: 141577 - protein, 9 aa, Artificial Sequence
  Description of Artificial Sequence: Synthetic peptide
  Seed: KTWGQYWQV (PMEL_HUMAN)
KMWGQYWQG

SEQ ID NO: 141578 - protein, 11 aa, Artificial Sequence
  Description of Artificial Sequence: Synthetic peptide
  Seed: RTKAWNRQLYP (PMEL_HUMAN)
RIKAWNRQLYA

SEQ ID NO: 141579 - protein, 10 aa, Artificial Sequence
  Description of Artificial Sequence: Synthetic peptide
  Seed: RALDGGNKHF (PMEL_HUMAN)
RLLDGGNKHF

SEQ ID NO: 141580 - protein, 11 aa, Artificial Sequence
  Description of Artificial Sequence: Synthetic peptide
  Seed: RTKAWNRQLYP (PMEL_HUMAN)
RVKAWNRQLYI

SEQ ID NO: 141581 - protein, 9 aa, Artificial Sequence
  Description of Artificial Sequence: Synthetic peptide
  Seed: SEVMGTTLA (PMEL_HUMAN)
SEVMGTTLL

SEQ ID NO: 141582 - protein, 9 aa, Artificial Sequence
  Description of Artificial Sequence: Synthetic peptide
  Seed: RYGSFSVTL (PMEL_HUMAN)
RIGSFSVTV

SEQ ID NO: 141583 - protein, 11 aa, Artificial Sequence
  Description of Artificial Sequence: Synthetic peptide
  Seed: FSVTLDIVQGI (PMEL_HUMAN)
FRVTLDIVQGV

SEQ ID NO: 141584 - protein, 9 aa, Artificial Sequence
  Description of Artificial Sequence: Synthetic peptide
  Seed: ITDQVPFSV (PMEL_HUMAN)
IADQVPFSI

SEQ ID NO: 141585 - protein, 10 aa, Artificial Sequence
  Description of Artificial Sequence: Synthetic peptide
  Seed: RTKAWNRQLY (PMEL_HUMAN)
RVKAWNRQLL

SEQ ID NO: 141586 - protein, 10 aa, Artificial Sequence
  Description of Artificial Sequence: Synthetic peptide
  Seed: YGSFSVTLDI (PMEL_HUMAN)
YQSFSVTLDF

SEQ ID NO: 141587 - protein, 9 aa, Artificial Sequence
  Description of Artificial Sequence: Synthetic peptide
  Seed: KQDFSVPQL (PMEL_HUMAN)
KVDFSVPQM

SEQ ID NO: 141588 - protein, 9 aa, Artificial Sequence
  Description of Artificial Sequence: Synthetic peptide
  Seed: ANASFSIAL (PMEL_HUMAN)
ALASFSIAL

SEQ ID NO: 141589 - protein, 9 aa, Artificial Sequence
  Description of Artificial Sequence: Synthetic peptide
  Seed: RNQPLTFAL (PMEL_HUMAN)
REQPLTFAL

SEQ ID NO: 141590 - protein, 10 aa, Artificial Sequence
  Description of Artificial Sequence: Synthetic peptide
  Seed: TTEWVETTAR (PMEL_HUMAN)
TAEWVETTAR

SEQ ID NO: 141591 - protein, 9 aa, Artificial Sequence
  Description of Artificial Sequence: Synthetic peptide
  Seed: YLAEADLSY (PMEL_HUMAN)
YPAEADLSY

SEQ ID NO: 141592 - protein, 9 aa, Artificial Sequence
  Description of Artificial Sequence: Synthetic peptide
  Seed: AGQVPTTEV (PMEL_HUMAN)
ATQVPTTEL

SEQ ID NO: 141593 - protein, 10 aa, Artificial Sequence
  Description of Artificial Sequence: Synthetic peptide
  Seed: AVIGALLAVG (PMEL_HUMAN)
ATIGALLAVV

SEQ ID NO: 141594 - protein, 9 aa, Artificial Sequence
  Description of Artificial Sequence: Synthetic peptide
  Seed: ITDQVPFSV (PMEL_HUMAN)
INDQVPFSV

SEQ ID NO: 141595 - protein, 9 aa, Artificial Sequence
  Description of Artificial Sequence: Synthetic peptide
  Seed: VSCQGGLPK (PMEL_HUMAN)
VICQGGLPK

SEQ ID NO: 141596 - protein, 10 aa, Artificial Sequence
  Description of Artificial Sequence: Synthetic peptide
  Seed: YLAEADLSYT (PMEL_HUMAN)
YLAEADLSYF

SEQ ID NO: 141597 - protein, 9 aa, Artificial Sequence
  Description of Artificial Sequence: Synthetic peptide
  Seed: KHFLRNQPL (PMEL_HUMAN)
KMFLRNQPF

SEQ ID NO: 141598 - protein, 9 aa, Artificial Sequence
  Description of Artificial Sequence: Synthetic peptide
  Seed: HQILKGGSG (PMEL_HUMAN)
HRILKGGSA

SEQ ID NO: 141599 - protein, 10 aa, Artificial Sequence
  Description of Artificial Sequence: Synthetic peptide
  Seed: TPEATGMTPA (PMEL_HUMAN)
TPEATGMTPF

SEQ ID NO: 141600 - protein, 10 aa, Artificial Sequence
  Description of Artificial Sequence: Synthetic peptide
  Seed: AEILQAVPSG (PMEL_HUMAN)
AEILQAVPSL

SEQ ID NO: 141601 - protein, 10 aa, Artificial Sequence
  Description of Artificial Sequence: Synthetic peptide
  Seed: IALNFPGSQK (PMEL_HUMAN)
IELNFPGSQK

SEQ ID NO: 141602 - protein, 10 aa, Artificial Sequence
  Description of Artificial Sequence: Synthetic peptide
  Seed: LVLMAVVLAS (PMEL_HUMAN)
LYLMAVVLAL

SEQ ID NO: 141603 - protein, 9 aa, Artificial Sequence
  Description of Artificial Sequence: Synthetic peptide
  Seed: SVPQLPHSS (PMEL_HUMAN)
SYPQLPHSL

SEQ ID NO: 141604 - protein, 9 aa, Artificial Sequence
  Description of Artificial Sequence: Synthetic peptide
  Seed: RLVKRQVPL (PMEL_HUMAN)
RQVKRQVPL

SEQ ID NO: 141605 - protein, 10 aa, Artificial Sequence
  Description of Artificial Sequence: Synthetic peptide
  Seed: MTPAEVSIVV (PMEL_HUMAN)
MAPAEVSIVW

SEQ ID NO: 141606 - protein, 9 aa, Artificial Sequence
  Description of Artificial Sequence: Synthetic peptide
  Seed: FGDSSGTLI (PMEL_HUMAN)
FNDSSGTLV

SEQ ID NO: 141607 - protein, 9 aa, Artificial Sequence
  Description of Artificial Sequence: Synthetic peptide
  Seed: GSFSVTLDI (PMEL_HUMAN)
GMFSVTLDI

SEQ ID NO: 141608 - protein, 10 aa, Artificial Sequence
  Description of Artificial Sequence: Synthetic peptide
  Seed: VSLADTNSLA (PMEL_HUMAN)
VQLADTNSLI

SEQ ID NO: 141609 - protein, 11 aa, Artificial Sequence
  Description of Artificial Sequence: Synthetic peptide
  Seed: RALDGGNKHFL (PMEL_HUMAN)
RWLDGGNKHFY

SEQ ID NO: 141610 - protein, 9 aa, Artificial Sequence
  Description of Artificial Sequence: Synthetic peptide
  Seed: AEPSGTTSV (PMEL_HUMAN)
ASPSGTTSF

SEQ ID NO: 141611 - protein, 9 aa, Artificial Sequence
  Description of Artificial Sequence: Synthetic peptide
  Seed: VTLDIVQGI (PMEL_HUMAN)
VCLDIVQGW

SEQ ID NO: 141612 - protein, 10 aa, Artificial Sequence
  Description of Artificial Sequence: Synthetic peptide
  Seed: RALDGGNKHF (PMEL_HUMAN)
RMLDGGNKHL

SEQ ID NO: 141613 - protein, 11 aa, Artificial Sequence
  Description of Artificial Sequence: Synthetic peptide
  Seed: AVIGALLAVGA (PMEL_HUMAN)
ATIGALLAVGV

SEQ ID NO: 141614 - protein, 9 aa, Artificial Sequence
  Description of Artificial Sequence: Synthetic peptide
  Seed: ANASFSIAL (PMEL_HUMAN)
AKASFSIAF

SEQ ID NO: 141615 - protein, 10 aa, Artificial Sequence
  Description of Artificial Sequence: Synthetic peptide
  Seed: WKTWGQYWQV (PMEL_HUMAN)
WLTWGQYWQI

SEQ ID NO: 141616 - protein, 9 aa, Artificial Sequence
  Description of Artificial Sequence: Synthetic peptide
  Seed: LQAAIPLTS (PMEL_HUMAN)
LQAAIPLTI

SEQ ID NO: 141617 - protein, 10 aa, Artificial Sequence
  Description of Artificial Sequence: Synthetic peptide
  Seed: YRYGSFSVTL (PMEL_HUMAN)
YDYGSFSVTM

SEQ ID NO: 141618 - protein, 9 aa, Artificial Sequence
  Description of Artificial Sequence: Synthetic peptide
  Seed: TLIGANASF (PMEL_HUMAN)
TAIGANASI

SEQ ID NO: 141619 - protein, 9 aa, Artificial Sequence
  Description of Artificial Sequence: Synthetic peptide
  Seed: VWKTWGQYW (PMEL_HUMAN)
VAKTWGQYW

SEQ ID NO: 141620 - protein, 10 aa, Artificial Sequence
  Description of Artificial Sequence: Synthetic peptide
  Seed: YVPLAHSSSA (PMEL_HUMAN)
YEPLAHSSSV

SEQ ID NO: 141621 - protein, 9 aa, Artificial Sequence
  Description of Artificial Sequence: Synthetic peptide
  Seed: ANASFSIAL (PMEL_HUMAN)
ARASFSIAI

SEQ ID NO: 141622 - protein, 10 aa, Artificial Sequence
  Description of Artificial Sequence: Synthetic peptide
  Seed: YRYGSFSVTL (PMEL_HUMAN)
YMYGSFSVTL

SEQ ID NO: 141623 - protein, 9 aa, Artificial Sequence
  Description of Artificial Sequence: Synthetic peptide
  Seed: VLGGPVSGL (PMEL_HUMAN)
VVGGPVSGY

SEQ ID NO: 141624 - protein, 11 aa, Artificial Sequence
  Description of Artificial Sequence: Synthetic peptide
  Seed: AESTGMTPEKV (PMEL_HUMAN)
AESTGMTPEKW

SEQ ID NO: 141625 - protein, 9 aa, Artificial Sequence
  Description of Artificial Sequence: Synthetic peptide
  Seed: VLPSPACQL (PMEL_HUMAN)
VAPSPACQL

SEQ ID NO: 141626 - protein, 10 aa, Artificial Sequence
  Description of Artificial Sequence: Synthetic peptide
  Seed: YGSFSVTLDI (PMEL_HUMAN)
YISFSVTLDY

SEQ ID NO: 141627 - protein, 9 aa, Artificial Sequence
  Description of Artificial Sequence: Synthetic peptide
  Seed: RLMKQDFSV (PMEL_HUMAN)
RRMKQDFSC

SEQ ID NO: 141628 - protein, 10 aa, Artificial Sequence
  Description of Artificial Sequence: Synthetic peptide
  Seed: VVLASLIYRR (PMEL_HUMAN)
VALASLIYRK

SEQ ID NO: 141629 - protein, 10 aa, Artificial Sequence
  Description of Artificial Sequence: Synthetic peptide
  Seed: AVIGALLAVG (PMEL_HUMAN)
AIIGALLAVM

SEQ ID NO: 141630 - protein, 9 aa, Artificial Sequence
  Description of Artificial Sequence: Synthetic peptide
  Seed: SLAVVSTQL (PMEL_HUMAN)
SSAVVSTQI

SEQ ID NO: 141631 - protein, 10 aa, Artificial Sequence
  Description of Artificial Sequence: Synthetic peptide
  Seed: YLAEADLSYT (PMEL_HUMAN)
YVAEADLSYI

SEQ ID NO: 141632 - protein, 9 aa, Artificial Sequence
  Description of Artificial Sequence: Synthetic peptide
  Seed: FLRNQPLTF (PMEL_HUMAN)
FVRNQPLTV

SEQ ID NO: 141633 - protein, 9 aa, Artificial Sequence
  Description of Artificial Sequence: Synthetic peptide
  Seed: ITDQVPFSV (PMEL_HUMAN)
IMDQVPFSC

SEQ ID NO: 141634 - protein, 10 aa, Artificial Sequence
  Description of Artificial Sequence: Synthetic peptide
  Seed: RQLYPEWTEA (PMEL_HUMAN)
RPLYPEWTEL

SEQ ID NO: 141635 - protein, 9 aa, Artificial Sequence
  Description of Artificial Sequence: Synthetic peptide
  Seed: LTSCGSSPV (PMEL_HUMAN)
LLSCGSSPL

SEQ ID NO: 141636 - protein, 10 aa, Artificial Sequence
  Description of Artificial Sequence: Synthetic peptide
  Seed: RALVVTHTYL (PMEL_HUMAN)
RVLVVTHTYW

SEQ ID NO: 141637 - protein, 10 aa, Artificial Sequence
  Description of Artificial Sequence: Synthetic peptide
  Seed: SSHWLRLPRI (PMEL_HUMAN)
SQHWLRLPRR

SEQ ID NO: 141638 - protein, 10 aa, Artificial Sequence
  Description of Artificial Sequence: Synthetic peptide
  Seed: VLMAVVLASL (PMEL_HUMAN)
VQMAVVLASI

SEQ ID NO: 141639 - protein, 11 aa, Artificial Sequence
  Description of Artificial Sequence: Synthetic peptide
  Seed: YLAEADLSYTW (PMEL_HUMAN)
YYAEADLSYTW

SEQ ID NO: 141640 - protein, 9 aa, Artificial Sequence
  Description of Artificial Sequence: Synthetic peptide
  Seed: ATGMTPAEV (PMEL_HUMAN)
AAGMTPAEY

SEQ ID NO: 141641 - protein, 9 aa, Artificial Sequence
  Description of Artificial Sequence: Synthetic peptide
  Seed: LADTNSLAV (PMEL_HUMAN)
LTDTNSLAM

SEQ ID NO: 141642 - protein, 9 aa, Artificial Sequence
  Description of Artificial Sequence: Synthetic peptide
  Seed: KAWNRQLYP (PMEL_HUMAN)
KIWNRQLYK

SEQ ID NO: 141643 - protein, 10 aa, Artificial Sequence
  Description of Artificial Sequence: Synthetic peptide
  Seed: GTLISRALVV (PMEL_HUMAN)
GYLISRALVV

SEQ ID NO: 141644 - protein, 9 aa, Artificial Sequence
  Description of Artificial Sequence: Synthetic peptide
  Seed: RALDGGNKH (PMEL_HUMAN)
RQLDGGNKF

SEQ ID NO: 141645 - protein, 10 aa, Artificial Sequence
  Description of Artificial Sequence: Synthetic peptide
  Seed: VLMAVVLASL (PMEL_HUMAN)
VRMAVVLASV

SEQ ID NO: 141646 - protein, 9 aa, Artificial Sequence
  Description of Artificial Sequence: Synthetic peptide
  Seed: KVSNDGPTL (PMEL_HUMAN)
KISNDGPTF

SEQ ID NO: 141647 - protein, 9 aa, Artificial Sequence
  Description of Artificial Sequence: Synthetic peptide
  Seed: KQDFSVPQL (PMEL_HUMAN)
KIDFSVPQF

SEQ ID NO: 141648 - protein, 11 aa, Artificial Sequence
  Description of Artificial Sequence: Synthetic peptide
  Seed: RYGSFSVTLDI (PMEL_HUMAN)
RSGSFSVTLDF

SEQ ID NO: 141649 - protein, 10 aa, Artificial Sequence
  Description of Artificial Sequence: Synthetic peptide
  Seed: EVVGTTPGQA (PMEL_HUMAN)
EVVGTTPGQK

SEQ ID NO: 141650 - protein, 10 aa, Artificial Sequence
  Description of Artificial Sequence: Synthetic peptide
  Seed: LAVGATKVPR (PMEL_HUMAN)
LSVGATKVPR

SEQ ID NO: 141651 - protein, 9 aa, Artificial Sequence
  Description of Artificial Sequence: Synthetic peptide
  Seed: SLAVVSTQL (PMEL_HUMAN)
SPAVVSTQY

SEQ ID NO: 141652 - protein, 10 aa, Artificial Sequence
  Description of Artificial Sequence: Synthetic peptide
  Seed: YVPLAHSSSA (PMEL_HUMAN)
YMPLAHSSSF

SEQ ID NO: 141653 - protein, 11 aa, Artificial Sequence
  Description of Artificial Sequence: Synthetic peptide
  Seed: VQMPTAESTGM (PMEL_HUMAN)
VMMPTAESTGF

SEQ ID NO: 141654 - protein, 9 aa, Artificial Sequence
  Description of Artificial Sequence: Synthetic peptide
  Seed: GGPVSGLSI (PMEL_HUMAN)
GIPVSGLSL

SEQ ID NO: 141655 - protein, 10 aa, Artificial Sequence
  Description of Artificial Sequence: Synthetic peptide
  Seed: KVLPDGQVIW (PMEL_HUMAN)
KELPDGQVIY

SEQ ID NO: 141656 - protein, 9 aa, Artificial Sequence
  Description of Artificial Sequence: Synthetic peptide
  Seed: ITDQVPFSV (PMEL_HUMAN)
IADQVPFSC

SEQ ID NO: 141657 - protein, 9 aa, Artificial Sequence
  Description of Artificial Sequence: Synthetic peptide
  Seed: SSPGCQPPA (PMEL_HUMAN)
SVPGCQPPV

SEQ ID NO: 141658 - protein, 9 aa, Artificial Sequence
  Description of Artificial Sequence: Synthetic peptide
  Seed: SSIMSTESI (PMEL_HUMAN)
SRIMSTESM

SEQ ID NO: 141659 - protein, 9 aa, Artificial Sequence
  Description of Artificial Sequence: Synthetic peptide
  Seed: FTITDQVPF (PMEL_HUMAN)
FPITDQVPV

SEQ ID NO: 141660 - protein, 10 aa, Artificial Sequence
  Description of Artificial Sequence: Synthetic peptide
  Seed: MSTESITGSL (PMEL_HUMAN)
MSTESITGSY

SEQ ID NO: 141661 - protein, 10 aa, Artificial Sequence
  Description of Artificial Sequence: Synthetic peptide
  Seed: VPLAHSSSAF (PMEL_HUMAN)
VDLAHSSSAY

SEQ ID NO: 141662 - protein, 11 aa, Artificial Sequence
  Description of Artificial Sequence: Synthetic peptide
  Seed: SYVPLAHSSSA (PMEL_HUMAN)
SGVPLAHSSSL

SEQ ID NO: 141663 - protein, 9 aa, Artificial Sequence
  Description of Artificial Sequence: Synthetic peptide
  Seed: YHRRGSRSY (PMEL_HUMAN)
YTRRGSRSF

SEQ ID NO: 141664 - protein, 8 aa, Artificial Sequence
  Description of Artificial Sequence: Synthetic peptide
  Seed: AEAPNTTA (PMEL_HUMAN)
AEAPNTTI

SEQ ID NO: 141665 - protein, 9 aa, Artificial Sequence
  Description of Artificial Sequence: Synthetic peptide
  Seed: VVLASLIYR (PMEL_HUMAN)
VTLASLIYR

SEQ ID NO: 141666 - protein, 10 aa, Artificial Sequence
  Description of Artificial Sequence: Synthetic peptide
  Seed: RQLYPEWTEA (PMEL_HUMAN)
RQLYPEWTEF

SEQ ID NO: 141667 - protein, 9 aa, Artificial Sequence
  Description of Artificial Sequence: Synthetic peptide
  Seed: HLAVIGALL (PMEL_HUMAN)
HQAVIGALV

SEQ ID NO: 141668 - protein, 11 aa, Artificial Sequence
  Description of Artificial Sequence: Synthetic peptide
  Seed: VQMPTAESTGM (PMEL_HUMAN)
VQMPTAESTGL

SEQ ID NO: 141669 - protein, 11 aa, Artificial Sequence
  Description of Artificial Sequence: Synthetic peptide
  Seed: AVVLASLIYRR (PMEL_HUMAN)
AMVLASLIYRR

SEQ ID NO: 141670 - protein, 10 aa, Artificial Sequence
  Description of Artificial Sequence: Synthetic peptide
  Seed: FSVSVSQLRA (PMEL_HUMAN)
FQVSVSQLRR

SEQ ID NO: 141671 - protein, 10 aa, Artificial Sequence
  Description of Artificial Sequence: Synthetic peptide
  Seed: SSHWLRLPRI (PMEL_HUMAN)
STHWLRLPRY

SEQ ID NO: 141672 - protein, 11 aa, Artificial Sequence
  Description of Artificial Sequence: Synthetic peptide
  Seed: AEMSTPEATGM (PMEL_HUMAN)
AQMSTPEATGL

SEQ ID NO: 141673 - protein, 9 aa, Artificial Sequence
  Description of Artificial Sequence: Synthetic peptide
  Seed: LPDGQVIWV (PMEL_HUMAN)
LVDGQVIWI

SEQ ID NO: 141674 - protein, 9 aa, Artificial Sequence
  Description of Artificial Sequence: Synthetic peptide
  Seed: GSRSYVPLA (PMEL_HUMAN)
GTRSYVPLR

SEQ ID NO: 141675 - protein, 9 aa, Artificial Sequence
  Description of Artificial Sequence: Synthetic peptide
  Seed: MAVVLASLI (PMEL_HUMAN)
MMVVLASLM

SEQ ID NO: 141676 - protein, 10 aa, Artificial Sequence
  Description of Artificial Sequence: Synthetic peptide
  Seed: FSVSVSQLRA (PMEL_HUMAN)
FFVSVSQLRR

SEQ ID NO: 141677 - protein, 9 aa, Artificial Sequence
  Description of Artificial Sequence: Synthetic peptide
  Seed: TPAEVSIVV (PMEL_HUMAN)
TLAEVSIVY

SEQ ID NO: 141678 - protein, 11 aa, Artificial Sequence
  Description of Artificial Sequence: Synthetic peptide
  Seed: GQYWQVLGGPV (PMEL_HUMAN)
GLYWQVLGGPV

SEQ ID NO: 141679 - protein, 10 aa, Artificial Sequence
  Description of Artificial Sequence: Synthetic peptide
  Seed: YRYGSFSVTL (PMEL_HUMAN)
YAYGSFSVTL

SEQ ID NO: 141680 - protein, 9 aa, Artificial Sequence
  Description of Artificial Sequence: Synthetic peptide
  Seed: KEACMEISS (PMEL_HUMAN)
KEACMEIST

SEQ ID NO: 141681 - protein, 9 aa, Artificial Sequence
  Description of Artificial Sequence: Synthetic peptide
  Seed: LYPEWTEAQ (PMEL_HUMAN)
LFPEWTEAL

SEQ ID NO: 141682 - protein, 10 aa, Artificial Sequence
  Description of Artificial Sequence: Synthetic peptide
  Seed: YVPLAHSSSA (PMEL_HUMAN)
YGPLAHSSSI

SEQ ID NO: 141683 - protein, 10 aa, Artificial Sequence
  Description of Artificial Sequence: Synthetic peptide
  Seed: RSFVYVWKTW (PMEL_HUMAN)
RYFVYVWKTM

SEQ ID NO: 141684 - protein, 10 aa, Artificial Sequence
  Description of Artificial Sequence: Synthetic peptide
  Seed: IESAEILQAV (PMEL_HUMAN)
IYSAEILQAV

SEQ ID NO: 141685 - protein, 9 aa, Artificial Sequence
  Description of Artificial Sequence: Synthetic peptide
  Seed: QLVLHQILK (PMEL_HUMAN)
QVVLHQILK

SEQ ID NO: 141686 - protein, 10 aa, Artificial Sequence
  Description of Artificial Sequence: Synthetic peptide
  Seed: RGSRSYVPLA (PMEL_HUMAN)
RWSRSYVPLL

SEQ ID NO: 141687 - protein, 9 aa, Artificial Sequence
  Description of Artificial Sequence: Synthetic peptide
  Seed: KVLPDGQVI (PMEL_HUMAN)
KSLPDGQVV

SEQ ID NO: 141688 - protein, 9 aa, Artificial Sequence
  Description of Artificial Sequence: Synthetic peptide
  Seed: VLPDGQVIW (PMEL_HUMAN)
VTPDGQVII

SEQ ID NO: 141689 - protein, 11 aa, Artificial Sequence
  Description of Artificial Sequence: Synthetic peptide
  Seed: AEAPNTTAGQV (PMEL_HUMAN)
AEAPNTTAGQY

SEQ ID NO: 141690 - protein, 11 aa, Artificial Sequence
  Description of Artificial Sequence: Synthetic peptide
  Seed: GSQVWGGQPVY (PMEL_HUMAN)
GRQVWGGQPVY

SEQ ID NO: 141691 - protein, 9 aa, Artificial Sequence
  Description of Artificial Sequence: Synthetic peptide
  Seed: VQVPTTEVI (PMEL_HUMAN)
VLVPTTEVF

SEQ ID NO: 141692 - protein, 10 aa, Artificial Sequence
  Description of Artificial Sequence: Synthetic peptide
  Seed: GPLLDGTATL (PMEL_HUMAN)
GFLLDGTATV

SEQ ID NO: 141693 - protein, 10 aa, Artificial Sequence
  Description of Artificial Sequence: Synthetic peptide
  Seed: YVPLAHSSSA (PMEL_HUMAN)
YQPLAHSSSL

SEQ ID NO: 141694 - protein, 10 aa, Artificial Sequence
  Description of Artificial Sequence: Synthetic peptide
  Seed: LVLMAVVLAS (PMEL_HUMAN)
LALMAVVLAI

SEQ ID NO: 141695 - protein, 9 aa, Artificial Sequence
  Description of Artificial Sequence: Synthetic peptide
  Seed: QVWGGQPVY (PMEL_HUMAN)
QKWGGQPVY

SEQ ID NO: 141696 - protein, 10 aa, Artificial Sequence
  Description of Artificial Sequence: Synthetic peptide
  Seed: VLMAVVLASL (PMEL_HUMAN)
VSMAVVLASF

SEQ ID NO: 141697 - protein, 10 aa, Artificial Sequence
  Description of Artificial Sequence: Synthetic peptide
  Seed: YRYGSFSVTL (PMEL_HUMAN)
YLYGSFSVTF

SEQ ID NO: 141698 - protein, 9 aa, Artificial Sequence
  Description of Artificial Sequence: Synthetic peptide
  Seed: YRYGSFSVT (PMEL_HUMAN)
YRYGSFSVI

SEQ ID NO: 141699 - protein, 10 aa, Artificial Sequence
  Description of Artificial Sequence: Synthetic peptide
  Seed: YVPLAHSSSA (PMEL_HUMAN)
YGPLAHSSSV

SEQ ID NO: 141700 - protein, 9 aa, Artificial Sequence
  Description of Artificial Sequence: Synthetic peptide
  Seed: VLKRCLLHL (PMEL_HUMAN)
VMKRCLLHI

SEQ ID NO: 141701 - protein, 11 aa, Artificial Sequence
  Description of Artificial Sequence: Synthetic peptide
  Seed: KAWNRQLYPEW (PMEL_HUMAN)
KSWNRQLYPEY

SEQ ID NO: 141702 - protein, 10 aa, Artificial Sequence
  Description of Artificial Sequence: Synthetic peptide
  Seed: RALDGGNKHF (PMEL_HUMAN)
RQLDGGNKHF

SEQ ID NO: 141703 - protein, 9 aa, Artificial Sequence
  Description of Artificial Sequence: Synthetic peptide
  Seed: SAFTITDQV (PMEL_HUMAN)
SVFTITDQV

SEQ ID NO: 141704 - protein, 9 aa, Artificial Sequence
  Description of Artificial Sequence: Synthetic peptide
  Seed: ALVVTHTYL (PMEL_HUMAN)
AMVVTHTYL

SEQ ID NO: 141705 - protein, 9 aa, Artificial Sequence
  Description of Artificial Sequence: Synthetic peptide
  Seed: MAVVLASLI (PMEL_HUMAN)
MRVVLASLF

SEQ ID NO: 141706 - protein, 10 aa, Artificial Sequence
  Description of Artificial Sequence: Synthetic peptide
  Seed: THTMEVTVYH (PMEL_HUMAN)
TITMEVTVYR

SEQ ID NO: 141707 - protein, 9 aa, Artificial Sequence
  Description of Artificial Sequence: Synthetic peptide
  Seed: VQVPTTEVI (PMEL_HUMAN)
VTVPTTEVF

SEQ ID NO: 141708 - protein, 9 aa, Artificial Sequence
  Description of Artificial Sequence: Synthetic peptide
  Seed: VLPSPACQL (PMEL_HUMAN)
VLPSPACQF

SEQ ID NO: 141709 - protein, 9 aa, Artificial Sequence
  Description of Artificial Sequence: Synthetic peptide
  Seed: GSSPVPGTT (PMEL_HUMAN)
GVSPVPGTM

SEQ ID NO: 141710 - protein, 10 aa, Artificial Sequence
  Description of Artificial Sequence: Synthetic peptide
  Seed: KTWGQYWQVL (PMEL_HUMAN)
KMWGQYWQVN

SEQ ID NO: 141711 - protein, 9 aa, Artificial Sequence
  Description of Artificial Sequence: Synthetic peptide
  Seed: LYRYGSFSV (PMEL_HUMAN)
LWRYGSFSW

SEQ ID NO: 141712 - protein, 9 aa, Artificial Sequence
  Description of Artificial Sequence: Synthetic peptide
  Seed: EVMGTTLAE (PMEL_HUMAN)
ENMGTTLAR

SEQ ID NO: 141713 - protein, 11 aa, Artificial Sequence
  Description of Artificial Sequence: Synthetic peptide
  Seed: YVPLAHSSSAF (PMEL_HUMAN)
YPPLAHSSSAF

SEQ ID NO: 141714 - protein, 9 aa, Artificial Sequence
  Description of Artificial Sequence: Synthetic peptide
  Seed: ISRALVVTH (PMEL_HUMAN)
ISRALVVTL

SEQ ID NO: 141715 - protein, 9 aa, Artificial Sequence
  Description of Artificial Sequence: Synthetic peptide
  Seed: HTMEVTVYH (PMEL_HUMAN)
HCMEVTVYK

SEQ ID NO: 141716 - protein, 10 aa, Artificial Sequence
  Description of Artificial Sequence: Synthetic peptide
  Seed: RRLMKQDFSV (PMEL_HUMAN)
RFLMKQDFSM

SEQ ID NO: 141717 - protein, 10 aa, Artificial Sequence
  Description of Artificial Sequence: Synthetic peptide
  Seed: IFPDGGPCPS (PMEL_HUMAN)
IFPDGGPCPY

SEQ ID NO: 141718 - protein, 9 aa, Artificial Sequence
  Description of Artificial Sequence: Synthetic peptide
  Seed: QLRTKAWNR (PMEL_HUMAN)
QQRTKAWNR

SEQ ID NO: 141719 - protein, 10 aa, Artificial Sequence
  Description of Artificial Sequence: Synthetic peptide
  Seed: YVPLAHSSSA (PMEL_HUMAN)
YDPLAHSSSA

SEQ ID NO: 141720 - protein, 9 aa, Artificial Sequence
  Description of Artificial Sequence: Synthetic peptide
  Seed: RALVVTHTY (PMEL_HUMAN)
RLLVVTHTR

SEQ ID NO: 141721 - protein, 9 aa, Artificial Sequence
  Description of Artificial Sequence: Synthetic peptide
  Seed: RGGQVSLKV (PMEL_HUMAN)
RQGQVSLKV

SEQ ID NO: 141722 - protein, 9 aa, Artificial Sequence
  Description of Artificial Sequence: Synthetic peptide
  Seed: QVWGGQPVY (PMEL_HUMAN)
QSWGGQPVI

SEQ ID NO: 141723 - protein, 10 aa, Artificial Sequence
  Description of Artificial Sequence: Synthetic peptide
  Seed: ESITGSLGPL (PMEL_HUMAN)
ETITGSLGPF

SEQ ID NO: 141724 - protein, 9 aa, Artificial Sequence
  Description of Artificial Sequence: Synthetic peptide
  Seed: HLAVIGALL (PMEL_HUMAN)
HTAVIGALT

SEQ ID NO: 141725 - protein, 9 aa, Artificial Sequence
  Description of Artificial Sequence: Synthetic peptide
  Seed: SVPQLPHSS (PMEL_HUMAN)
SVPQLPHSV

SEQ ID NO: 141726 - protein, 9 aa, Artificial Sequence
  Description of Artificial Sequence: Synthetic peptide
  Seed: LPDGQVIWV (PMEL_HUMAN)
LTDGQVIWM

SEQ ID NO: 141727 - protein, 9 aa, Artificial Sequence
  Description of Artificial Sequence: Synthetic peptide
  Seed: RQVPLDCVL (PMEL_HUMAN)
RAVPLDCVM

SEQ ID NO: 141728 - protein, 11 aa, Artificial Sequence
  Description of Artificial Sequence: Synthetic peptide
  Seed: HSSSHWLRLPR (PMEL_HUMAN)
HVSSHWLRLPR

SEQ ID NO: 141729 - protein, 10 aa, Artificial Sequence
  Description of Artificial Sequence: Synthetic peptide
  Seed: VSLADTNSLA (PMEL_HUMAN)
VSLADTNSLV

SEQ ID NO: 141730 - protein, 10 aa, Artificial Sequence
  Description of Artificial Sequence: Synthetic peptide
  Seed: RSFVYVWKTW (PMEL_HUMAN)
RTFVYVWKTW

SEQ ID NO: 141731 - protein, 9 aa, Artificial Sequence
  Description of Artificial Sequence: Synthetic peptide
  Seed: GTHTMEVTV (PMEL_HUMAN)
GMHTMEVTV

SEQ ID NO: 141732 - protein, 9 aa, Artificial Sequence
  Description of Artificial Sequence: Synthetic peptide
  Seed: FTITDQVPF (PMEL_HUMAN)
FIITDQVPF

SEQ ID NO: 141733 - protein, 9 aa, Artificial Sequence
  Description of Artificial Sequence: Synthetic peptide
  Seed: SQVWGGQPV (PMEL_HUMAN)
SMVWGGQPM

SEQ ID NO: 141734 - protein, 10 aa, Artificial Sequence
  Description of Artificial Sequence: Synthetic peptide
  Seed: VVLASLIYRR (PMEL_HUMAN)
VILASLIYRK

SEQ ID NO: 141735 - protein, 9 aa, Artificial Sequence
  Description of Artificial Sequence: Synthetic peptide
  Seed: ITGSLGPLL (PMEL_HUMAN)
ISGSLGPLL

SEQ ID NO: 141736 - protein, 10 aa, Artificial Sequence
  Description of Artificial Sequence: Synthetic peptide
  Seed: YRYGSFSVTL (PMEL_HUMAN)
YAYGSFSVTI

SEQ ID NO: 141737 - protein, 9 aa, Artificial Sequence
  Description of Artificial Sequence: Synthetic peptide
  Seed: TAQVVLQAA (PMEL_HUMAN)
TAQVVLQAY

SEQ ID NO: 141738 - protein, 10 aa, Artificial Sequence
  Description of Artificial Sequence: Synthetic peptide
  Seed: EVSIVVLSGT (PMEL_HUMAN)
EQSIVVLSGV

SEQ ID NO: 141739 - protein, 11 aa, Artificial Sequence
  Description of Artificial Sequence: Synthetic peptide
  Seed: RRRLMKQDFSV (PMEL_HUMAN)
RRRLMKQDFSR

SEQ ID NO: 141740 - protein, 9 aa, Artificial Sequence
  Description of Artificial Sequence: Synthetic peptide
  Seed: GSRSYVPLA (PMEL_HUMAN)
GTRSYVPLK

SEQ ID NO: 141741 - protein, 10 aa, Artificial Sequence
  Description of Artificial Sequence: Synthetic peptide
  Seed: RQLYPEWTEA (PMEL_HUMAN)
RELYPEWTEL

SEQ ID NO: 141742 - protein, 9 aa, Artificial Sequence
  Description of Artificial Sequence: Synthetic peptide
  Seed: ITGSLGPLL (PMEL_HUMAN)
ILGSLGPLM

SEQ ID NO: 141743 - protein, 9 aa, Artificial Sequence
  Description of Artificial Sequence: Synthetic peptide
  Seed: YWQVLGGPV (PMEL_HUMAN)
YFQVLGGPV

SEQ ID NO: 141744 - protein, 9 aa, Artificial Sequence
  Description of Artificial Sequence: Synthetic peptide
  Seed: RQVPLDCVL (PMEL_HUMAN)
RQVPLDCVY

SEQ ID NO: 141745 - protein, 11 aa, Artificial Sequence
  Description of Artificial Sequence: Synthetic peptide
  Seed: RALDGGNKHFL (PMEL_HUMAN)
RLLDGGNKHFK

SEQ ID NO: 141746 - protein, 8 aa, Artificial Sequence
  Description of Artificial Sequence: Synthetic peptide
  Seed: LVKRQVPL (PMEL_HUMAN)
LMKRQVPL

SEQ ID NO: 141747 - protein, 9 aa, Artificial Sequence
  Description of Artificial Sequence: Synthetic peptide
  Seed: GQVPTTEVV (PMEL_HUMAN)
GVVPTTEVV

SEQ ID NO: 141748 - protein, 10 aa, Artificial Sequence
  Description of Artificial Sequence: Synthetic peptide
  Seed: TYLEPGPVTA (PMEL_HUMAN)
TFLEPGPVTY

SEQ ID NO: 141749 - protein, 9 aa, Artificial Sequence
  Description of Artificial Sequence: Synthetic peptide
  Seed: EVVGTTPGQ (PMEL_HUMAN)
ETVGTTPGL

SEQ ID NO: 141750 - protein, 9 aa, Artificial Sequence
  Description of Artificial Sequence: Synthetic peptide
  Seed: RALVVTHTY (PMEL_HUMAN)
RQLVVTHTM

SEQ ID NO: 141751 - protein, 9 aa, Artificial Sequence
  Description of Artificial Sequence: Synthetic peptide
  Seed: MAVVLASLI (PMEL_HUMAN)
MQVVLASLV

SEQ ID NO: 141752 - protein, 9 aa, Artificial Sequence
  Description of Artificial Sequence: Synthetic peptide
  Seed: IESAEILQA (PMEL_HUMAN)
IESAEILQL

SEQ ID NO: 141753 - protein, 10 aa, Artificial Sequence
  Description of Artificial Sequence: Synthetic peptide
  Seed: MPTAESTGMT (PMEL_HUMAN)
METAESTGMA

SEQ ID NO: 141754 - protein, 9 aa, Artificial Sequence
  Description of Artificial Sequence: Synthetic peptide
  Seed: RAMLGTHTM (PMEL_HUMAN)
RGMLGTHTK

SEQ ID NO: 141755 - protein, 11 aa, Artificial Sequence
  Description of Artificial Sequence: Synthetic peptide
  Seed: LGPLLDGTATL (PMEL_HUMAN)
LGPLLDGTATI

SEQ ID NO: 141756 - protein, 11 aa, Artificial Sequence
  Description of Artificial Sequence: Synthetic peptide
  Seed: YLAEADLSYTW (PMEL_HUMAN)
YPAEADLSYTW

SEQ ID NO: 141757 - protein, 9 aa, Artificial Sequence
  Description of Artificial Sequence: Synthetic peptide
  Seed: VLKRCLLHL (PMEL_HUMAN)
VLKRCLLHR

SEQ ID NO: 141758 - protein, 9 aa, Artificial Sequence
  Description of Artificial Sequence: Synthetic peptide
  Seed: LAVVSTQLI (PMEL_HUMAN)
LMVVSTQLY

SEQ ID NO: 141759 - protein, 9 aa, Artificial Sequence
  Description of Artificial Sequence: Synthetic peptide
  Seed: QKRSFVYVW (PMEL_HUMAN)
QRRSFVYVY

SEQ ID NO: 141760 - protein, 11 aa, Artificial Sequence
  Description of Artificial Sequence: Synthetic peptide
  Seed: AEMSTPEATGM (PMEL_HUMAN)
AEMSTPEATGI

SEQ ID NO: 141761 - protein, 9 aa, Artificial Sequence
  Description of Artificial Sequence: Synthetic peptide
  Seed: SYVPLAHSS (PMEL_HUMAN)
SYVPLAHSY

SEQ ID NO: 141762 - protein, 11 aa, Artificial Sequence
  Description of Artificial Sequence: Synthetic peptide
  Seed: HTMEVTVYHRR (PMEL_HUMAN)
HTMEVTVYHRG

SEQ ID NO: 141763 - protein, 9 aa, Artificial Sequence
  Description of Artificial Sequence: Synthetic peptide
  Seed: MSTPEATGM (PMEL_HUMAN)
MATPEATGL

SEQ ID NO: 141764 - protein, 9 aa, Artificial Sequence
  Description of Artificial Sequence: Synthetic peptide
  Seed: FLRNQPLTF (PMEL_HUMAN)
FGRNQPLTL

SEQ ID NO: 141765 - protein, 11 aa, Artificial Sequence
  Description of Artificial Sequence: Synthetic peptide
  Seed: YPQETDDACIF (PMEL_HUMAN)
YPQETDDACIW

SEQ ID NO: 141766 - protein, 9 aa, Artificial Sequence
  Description of Artificial Sequence: Synthetic peptide
  Seed: SQVWGGQPV (PMEL_HUMAN)
SHVWGGQPA

SEQ ID NO: 141767 - protein, 9 aa, Artificial Sequence
  Description of Artificial Sequence: Synthetic peptide
  Seed: SGLSIGTGR (PMEL_HUMAN)
STLSIGTGR

SEQ ID NO: 141768 - protein, 9 aa, Artificial Sequence
  Description of Artificial Sequence: Synthetic peptide
  Seed: DQVPFSVSV (PMEL_HUMAN)
DHVPFSVSI

SEQ ID NO: 141769 - protein, 9 aa, Artificial Sequence
  Description of Artificial Sequence: Synthetic peptide
  Seed: VLPDGQVIW (PMEL_HUMAN)
VWPDGQVIF

SEQ ID NO: 141770 - protein, 9 aa, Artificial Sequence
  Description of Artificial Sequence: Synthetic peptide
  Seed: ITDQVPFSV (PMEL_HUMAN)
IDDQVPFSL

SEQ ID NO: 141771 - protein, 9 aa, Artificial Sequence
  Description of Artificial Sequence: Synthetic peptide
  Seed: LADTNSLAV (PMEL_HUMAN)
LFDTNSLAF

SEQ ID NO: 141772 - protein, 10 aa, Artificial Sequence
  Description of Artificial Sequence: Synthetic peptide
  Seed: RQLRTKAWNR (PMEL_HUMAN)
RCLRTKAWNR

SEQ ID NO: 141773 - protein, 10 aa, Artificial Sequence
  Description of Artificial Sequence: Synthetic peptide
  Seed: RGSRSYVPLA (PMEL_HUMAN)
RLSRSYVPLT

SEQ ID NO: 141774 - protein, 9 aa, Artificial Sequence
  Description of Artificial Sequence: Synthetic peptide
  Seed: RLVKRQVPL (PMEL_HUMAN)
RIVKRQVPY

SEQ ID NO: 141775 - protein, 9 aa, Artificial Sequence
  Description of Artificial Sequence: Synthetic peptide
  Seed: VLASLIYRR (PMEL_HUMAN)
VMASLIYRR

SEQ ID NO: 141776 - protein, 10 aa, Artificial Sequence
  Description of Artificial Sequence: Synthetic peptide
  Seed: RLMKQDFSVP (PMEL_HUMAN)
RLMKQDFSVV

SEQ ID NO: 141777 - protein, 10 aa, Artificial Sequence
  Description of Artificial Sequence: Synthetic peptide
  Seed: SSHWLRLPRI (PMEL_HUMAN)
SFHWLRLPRK

SEQ ID NO: 141778 - protein, 9 aa, Artificial Sequence
  Description of Artificial Sequence: Synthetic peptide
  Seed: VPLIVGILL (PMEL_HUMAN)
VPLIVGILY

SEQ ID NO: 141779 - protein, 9 aa, Artificial Sequence
  Description of Artificial Sequence: Synthetic peptide
  Seed: RNQPLTFAL (PMEL_HUMAN)
RMQPLTFAM

SEQ ID NO: 141780 - protein, 10 aa, Artificial Sequence
  Description of Artificial Sequence: Synthetic peptide
  Seed: RNQDWLGVSR (PMEL_HUMAN)
RGQDWLGVSR

SEQ ID NO: 141781 - protein, 9 aa, Artificial Sequence
  Description of Artificial Sequence: Synthetic peptide
  Seed: RYGSFSVTL (PMEL_HUMAN)
RQGSFSVTY

SEQ ID NO: 141782 - protein, 9 aa, Artificial Sequence
  Description of Artificial Sequence: Synthetic peptide
  Seed: VQVPTTEVI (PMEL_HUMAN)
VMVPTTEVL

SEQ ID NO: 141783 - protein, 9 aa, Artificial Sequence
  Description of Artificial Sequence: Synthetic peptide
  Seed: KTWGQYWQV (PMEL_HUMAN)
KWWGQYWQY

SEQ ID NO: 141784 - protein, 10 aa, Artificial Sequence
  Description of Artificial Sequence: Synthetic peptide
  Seed: YRYGSFSVTL (PMEL_HUMAN)
YEYGSFSVTL

SEQ ID NO: 141785 - protein, 9 aa, Artificial Sequence
  Description of Artificial Sequence: Synthetic peptide
  Seed: AGQVPTTEV (PMEL_HUMAN)
ALQVPTTEY

SEQ ID NO: 141786 - protein, 9 aa, Artificial Sequence
  Description of Artificial Sequence: Synthetic peptide
  Seed: TTPGQAPTA (PMEL_HUMAN)
TVPGQAPTL

SEQ ID NO: 141787 - protein, 11 aa, Artificial Sequence
  Description of Artificial Sequence: Synthetic peptide
  Seed: FGDSSGTLISR (PMEL_HUMAN)
FVDSSGTLISC

SEQ ID NO: 141788 - protein, 9 aa, Artificial Sequence
  Description of Artificial Sequence: Synthetic peptide
  Seed: VLASLIYRR (PMEL_HUMAN)
VLASLIYRK

SEQ ID NO: 141789 - protein, 10 aa, Artificial Sequence
  Description of Artificial Sequence: Synthetic peptide
  Seed: AVPSGEGDAF (PMEL_HUMAN)
ALPSGEGDAW

SEQ ID NO: 141790 - protein, 9 aa, Artificial Sequence
  Description of Artificial Sequence: Synthetic peptide
  Seed: VISTAPVQM (PMEL_HUMAN)
VLSTAPVQY

SEQ ID NO: 141791 - protein, 10 aa, Artificial Sequence
  Description of Artificial Sequence: Synthetic peptide
  Seed: TLISRALVVT (PMEL_HUMAN)
TLISRALVVA

SEQ ID NO: 141792 - protein, 10 aa, Artificial Sequence
  Description of Artificial Sequence: Synthetic peptide
  Seed: GRAMLGTHTM (PMEL_HUMAN)
GRAMLGTHTL

SEQ ID NO: 141793 - protein, 10 aa, Artificial Sequence
  Description of Artificial Sequence: Synthetic peptide
  Seed: KTWGQYWQVL (PMEL_HUMAN)
KIWGQYWQVR

SEQ ID NO: 141794 - protein, 9 aa, Artificial Sequence
  Description of Artificial Sequence: Synthetic peptide
  Seed: YVWKTWGQY (PMEL_HUMAN)
YAWKTWGQF

SEQ ID NO: 141795 - protein, 9 aa, Artificial Sequence
  Description of Artificial Sequence: Synthetic peptide
  Seed: LAVVSTQLI (PMEL_HUMAN)
LPVVSTQLV

SEQ ID NO: 141796 - protein, 10 aa, Artificial Sequence
  Description of Artificial Sequence: Synthetic peptide
  Seed: LAHSSSAFTI (PMEL_HUMAN)
LTHSSSAFTF

SEQ ID NO: 141797 - protein, 9 aa, Artificial Sequence
  Description of Artificial Sequence: Synthetic peptide
  Seed: ITDQVPFSV (PMEL_HUMAN)
ITDQVPFSY

SEQ ID NO: 141798 - protein, 11 aa, Artificial Sequence
  Description of Artificial Sequence: Synthetic peptide
  Seed: KHFLRNQPLTF (PMEL_HUMAN)
KMFLRNQPLTY

SEQ ID NO: 141799 - protein, 9 aa, Artificial Sequence
  Description of Artificial Sequence: Synthetic peptide
  Seed: FSVSVSQLR (PMEL_HUMAN)
FAVSVSQLR

SEQ ID NO: 141800 - protein, 10 aa, Artificial Sequence
  Description of Artificial Sequence: Synthetic peptide
  Seed: RGSRSYVPLA (PMEL_HUMAN)
RGSRSYVPLR

SEQ ID NO: 141801 - protein, 9 aa, Artificial Sequence
  Description of Artificial Sequence: Synthetic peptide
  Seed: SAFTITDQV (PMEL_HUMAN)
STFTITDQL

SEQ ID NO: 141802 - protein, 10 aa, Artificial Sequence
  Description of Artificial Sequence: Synthetic peptide
  Seed: EVISTAPVQM (PMEL_HUMAN)
ETISTAPVQR

SEQ ID NO: 141803 - protein, 10 aa, Artificial Sequence
  Description of Artificial Sequence: Synthetic peptide
  Seed: VPQLPHSSSH (PMEL_HUMAN)
VMQLPHSSSL

SEQ ID NO: 141804 - protein, 8 aa, Artificial Sequence
  Description of Artificial Sequence: Synthetic peptide
  Seed: MAVVLASL (PMEL_HUMAN)
MPVVLASI

SEQ ID NO: 141805 - protein, 9 aa, Artificial Sequence
  Description of Artificial Sequence: Synthetic peptide
  Seed: MTPAEVSIV (PMEL_HUMAN)
MTPAEVSIM

SEQ ID NO: 141806 - protein, 9 aa, Artificial Sequence
  Description of Artificial Sequence: Synthetic peptide
  Seed: AVIGALLAV (PMEL_HUMAN)
AVIGALLAA

SEQ ID NO: 141807 - protein, 9 aa, Artificial Sequence
  Description of Artificial Sequence: Synthetic peptide
  Seed: RNQPLTFAL (PMEL_HUMAN)
RNQPLTFAF

SEQ ID NO: 141808 - protein, 9 aa, Artificial Sequence
  Description of Artificial Sequence: Synthetic peptide
  Seed: VSNDGPTLI (PMEL_HUMAN)
VANDGPTLM

SEQ ID NO: 141809 - protein, 9 aa, Artificial Sequence
  Description of Artificial Sequence: Synthetic peptide
  Seed: RNQPLTFAL (PMEL_HUMAN)
RAQPLTFAY

SEQ ID NO: 141810 - protein, 10 aa, Artificial Sequence
  Description of Artificial Sequence: Synthetic peptide
  Seed: LRLVKRQVPL (PMEL_HUMAN)
LPLVKRQVPL

SEQ ID NO: 141811 - protein, 10 aa, Artificial Sequence
  Description of Artificial Sequence: Synthetic peptide
  Seed: SGTYCLNVSL (PMEL_HUMAN)
SSTYCLNVSV

SEQ ID NO: 141812 - protein, 10 aa, Artificial Sequence
  Description of Artificial Sequence: Synthetic peptide
  Seed: MTPAEVSIVV (PMEL_HUMAN)
MKPAEVSIVM

SEQ ID NO: 141813 - protein, 11 aa, Artificial Sequence
  Description of Artificial Sequence: Synthetic peptide
  Seed: AEMSTPEATGM (PMEL_HUMAN)
AQMSTPEATGY

SEQ ID NO: 141814 - protein, 10 aa, Artificial Sequence
  Description of Artificial Sequence: Synthetic peptide
  Seed: RTKAWNRQLY (PMEL_HUMAN)
RMKAWNRQLK

SEQ ID NO: 141815 - protein, 8 aa, Artificial Sequence
  Description of Artificial Sequence: Synthetic peptide
  Seed: AEVSIVVL (PMEL_HUMAN)
AQVSIVVI

SEQ ID NO: 141816 - protein, 9 aa, Artificial Sequence
  Description of Artificial Sequence: Synthetic peptide
  Seed: NFPGSQKVL (PMEL_HUMAN)
NTPGSQKVM

SEQ ID NO: 141817 - protein, 9 aa, Artificial Sequence
  Description of Artificial Sequence: Synthetic peptide
  Seed: QLHDPSGYL (PMEL_HUMAN)
QMHDPSGYF

SEQ ID NO: 141818 - protein, 9 aa, Artificial Sequence
  Description of Artificial Sequence: Synthetic peptide
  Seed: MAVVLASLI (PMEL_HUMAN)
MAVVLASLF

SEQ ID NO: 141819 - protein, 9 aa, Artificial Sequence
  Description of Artificial Sequence: Synthetic peptide
  Seed: GTHTMEVTV (PMEL_HUMAN)
GQHTMEVTI

SEQ ID NO: 141820 - protein, 10 aa, Artificial Sequence
  Description of Artificial Sequence: Synthetic peptide
  Seed: ELTVSCQGGL (PMEL_HUMAN)
ERTVSCQGGV

SEQ ID NO: 141821 - protein, 10 aa, Artificial Sequence
  Description of Artificial Sequence: Synthetic peptide
  Seed: SLAVVSTQLI (PMEL_HUMAN)
SIAVVSTQLV

SEQ ID NO: 141822 - protein, 8 aa, Artificial Sequence
  Description of Artificial Sequence: Synthetic peptide
  Seed: LNFPGSQK (PMEL_HUMAN)
LVFPGSQL

SEQ ID NO: 141823 - protein, 9 aa, Artificial Sequence
  Description of Artificial Sequence: Synthetic peptide
  Seed: VPSGEGDAF (PMEL_HUMAN)
VPSGEGDAL

SEQ ID NO: 141824 - protein, 10 aa, Artificial Sequence
  Description of Artificial Sequence: Synthetic peptide
  Seed: CPIGENSPLL (PMEL_HUMAN)
CPIGENSPLW

SEQ ID NO: 141825 - protein, 10 aa, Artificial Sequence
  Description of Artificial Sequence: Synthetic peptide
  Seed: LAVGATKVPR (PMEL_HUMAN)
LVVGATKVPR

SEQ ID NO: 141826 - protein, 9 aa, Artificial Sequence
  Description of Artificial Sequence: Synthetic peptide
  Seed: ASFSIALNF (PMEL_HUMAN)
AQFSIALNY

SEQ ID NO: 141827 - protein, 9 aa, Artificial Sequence
  Description of Artificial Sequence: Synthetic peptide
  Seed: GTATLRLVK (PMEL_HUMAN)
GMATLRLVR

SEQ ID NO: 141828 - protein, 10 aa, Artificial Sequence
  Description of Artificial Sequence: Synthetic peptide
  Seed: NASFSIALNF (PMEL_HUMAN)
NSSFSIALNW

SEQ ID NO: 141829 - protein, 10 aa, Artificial Sequence
  Description of Artificial Sequence: Synthetic peptide
  Seed: ALDGGNKHFL (PMEL_HUMAN)
ATDGGNKHFF

SEQ ID NO: 141830 - protein, 9 aa, Artificial Sequence
  Description of Artificial Sequence: Synthetic peptide
  Seed: ESAEILQAV (PMEL_HUMAN)
EEAEILQAV

SEQ ID NO: 141831 - protein, 9 aa, Artificial Sequence
  Description of Artificial Sequence: Synthetic peptide
  Seed: MTPEKVPVS (PMEL_HUMAN)
MCPEKVPVM

SEQ ID NO: 141832 - protein, 9 aa, Artificial Sequence
  Description of Artificial Sequence: Synthetic peptide
  Seed: RGSRSYVPL (PMEL_HUMAN)
RNSRSYVPK

SEQ ID NO: 141833 - protein, 9 aa, Artificial Sequence
  Description of Artificial Sequence: Synthetic peptide
  Seed: TATLRLVKR (PMEL_HUMAN)
TVTLRLVKK

SEQ ID NO: 141834 - protein, 9 aa, Artificial Sequence
  Description of Artificial Sequence: Synthetic peptide
  Seed: YPQETDDAC (PMEL_HUMAN)
YTQETDDAF

SEQ ID NO: 141835 - protein, 10 aa, Artificial Sequence
  Description of Artificial Sequence: Synthetic peptide
  Seed: FSVSVSQLRA (PMEL_HUMAN)
FRVSVSQLRR

SEQ ID NO: 141836 - protein, 9 aa, Artificial Sequence
  Description of Artificial Sequence: Synthetic peptide
  Seed: AVVLASLIY (PMEL_HUMAN)
AEVLASLIY

SEQ ID NO: 141837 - protein, 10 aa, Artificial Sequence
  Description of Artificial Sequence: Synthetic peptide
  Seed: YVPLAHSSSA (PMEL_HUMAN)
YLPLAHSSSL

SEQ ID NO: 141838 - protein, 11 aa, Artificial Sequence
  Description of Artificial Sequence: Synthetic peptide
  Seed: RALDGGNKHFL (PMEL_HUMAN)
RVLDGGNKHFW

SEQ ID NO: 141839 - protein, 10 aa, Artificial Sequence
  Description of Artificial Sequence: Synthetic peptide
  Seed: MTPAEVSIVV (PMEL_HUMAN)
MRPAEVSIVI

SEQ ID NO: 141840 - protein, 9 aa, Artificial Sequence
  Description of Artificial Sequence: Synthetic peptide
  Seed: VVLSGTTAA (PMEL_HUMAN)
VALSGTTAF

SEQ ID NO: 141841 - protein, 10 aa, Artificial Sequence
  Description of Artificial Sequence: Synthetic peptide
  Seed: AVIGALLAVG (PMEL_HUMAN)
AMIGALLAVM

SEQ ID NO: 141842 - protein, 9 aa, Artificial Sequence
  Description of Artificial Sequence: Synthetic peptide
  Seed: SLADTNSLA (PMEL_HUMAN)
SLADTNSLM

SEQ ID NO: 141843 - protein, 9 aa, Artificial Sequence
  Description of Artificial Sequence: Synthetic peptide
  Seed: RNQPLTFAL (PMEL_HUMAN)
RMQPLTFAY

SEQ ID NO: 141844 - protein, 9 aa, Artificial Sequence
  Description of Artificial Sequence: Synthetic peptide
  Seed: TKAWNRQLY (PMEL_HUMAN)
TKAWNRQLF

SEQ ID NO: 141845 - protein, 9 aa, Artificial Sequence
  Description of Artificial Sequence: Synthetic peptide
  Seed: ALDGGNKHF (PMEL_HUMAN)
ASDGGNKHM

SEQ ID NO: 141846 - protein, 11 aa, Artificial Sequence
  Description of Artificial Sequence: Synthetic peptide
  Seed: RRGSRSYVPLA (PMEL_HUMAN)
RKGSRSYVPLV

SEQ ID NO: 141847 - protein, 10 aa, Artificial Sequence
  Description of Artificial Sequence: Synthetic peptide
  Seed: MTPAEVSIVV (PMEL_HUMAN)
MVPAEVSIVY

SEQ ID NO: 141848 - protein, 9 aa, Artificial Sequence
  Description of Artificial Sequence: Synthetic peptide
  Seed: VPQLPHSSS (PMEL_HUMAN)
VPQLPHSSF

SEQ ID NO: 141849 - protein, 9 aa, Artificial Sequence
  Description of Artificial Sequence: Synthetic peptide
  Seed: KVLPDGQVI (PMEL_HUMAN)
KMLPDGQVF

SEQ ID NO: 141850 - protein, 9 aa, Artificial Sequence
  Description of Artificial Sequence: Synthetic peptide
  Seed: VQVPTTEVI (PMEL_HUMAN)
VHVPTTEVL

SEQ ID NO: 141851 - protein, 9 aa, Artificial Sequence
  Description of Artificial Sequence: Synthetic peptide
  Seed: TTPGQAPTA (PMEL_HUMAN)
TTPGQAPTF

SEQ ID NO: 141852 - protein, 10 aa, Artificial Sequence
  Description of Artificial Sequence: Synthetic peptide
  Seed: MTPAEVSIVV (PMEL_HUMAN)
MAPAEVSIVV

SEQ ID NO: 141853 - protein, 9 aa, Artificial Sequence
  Description of Artificial Sequence: Synthetic peptide
  Seed: AVIGALLAV (PMEL_HUMAN)
AIIGALLAW

SEQ ID NO: 141854 - protein, 10 aa, Artificial Sequence
  Description of Artificial Sequence: Synthetic peptide
  Seed: VLMAVVLASL (PMEL_HUMAN)
VIMAVVLASA

SEQ ID NO: 141855 - protein, 9 aa, Artificial Sequence
  Description of Artificial Sequence: Synthetic peptide
  Seed: SAFTITDQV (PMEL_HUMAN)
SQFTITDQL

SEQ ID NO: 141856 - protein, 9 aa, Artificial Sequence
  Description of Artificial Sequence: Synthetic peptide
  Seed: GTYCLNVSL (PMEL_HUMAN)
GSYCLNVSW

SEQ ID NO: 141857 - protein, 9 aa, Artificial Sequence
  Description of Artificial Sequence: Synthetic peptide
  Seed: AVIGALLAV (PMEL_HUMAN)
AVIGALLAY

SEQ ID NO: 141858 - protein, 11 aa, Artificial Sequence
  Description of Artificial Sequence: Synthetic peptide
  Seed: MAVVLASLIYR (PMEL_HUMAN)
MGVVLASLIYK

SEQ ID NO: 141859 - protein, 9 aa, Artificial Sequence
  Description of Artificial Sequence: Synthetic peptide
  Seed: KHFLRNQPL (PMEL_HUMAN)
KRFLRNQPV

SEQ ID NO: 141860 - protein, 10 aa, Artificial Sequence
  Description of Artificial Sequence: Synthetic peptide
  Seed: LIVGILLVLM (PMEL_HUMAN)
LMVGILLVLI

SEQ ID NO: 141861 - protein, 10 aa, Artificial Sequence
  Description of Artificial Sequence: Synthetic peptide
  Seed: MPTAESTGMT (PMEL_HUMAN)
MYTAESTGMA

SEQ ID NO: 141862 - protein, 9 aa, Artificial Sequence
  Description of Artificial Sequence: Synthetic peptide
  Seed: EKVPVSEVM (PMEL_HUMAN)
EQVPVSEVL

SEQ ID NO: 141863 - protein, 9 aa, Artificial Sequence
  Description of Artificial Sequence: Synthetic peptide
  Seed: AVIGALLAV (PMEL_HUMAN)
ALIGALLAT

SEQ ID NO: 141864 - protein, 9 aa, Artificial Sequence
  Description of Artificial Sequence: Synthetic peptide
  Seed: TTTEWVETT (PMEL_HUMAN)
TTTEWVETA

SEQ ID NO: 141865 - protein, 9 aa, Artificial Sequence
  Description of Artificial Sequence: Synthetic peptide
  Seed: CPIGENSPL (PMEL_HUMAN)
CPIGENSPV

SEQ ID NO: 141866 - protein, 10 aa, Artificial Sequence
  Description of Artificial Sequence: Synthetic peptide
  Seed: YVPLAHSSSA (PMEL_HUMAN)
YGPLAHSSSF

SEQ ID NO: 141867 - protein, 9 aa, Artificial Sequence
  Description of Artificial Sequence: Synthetic peptide
  Seed: SLGPLLDGT (PMEL_HUMAN)
SLGPLLDGI

SEQ ID NO: 141868 - protein, 10 aa, Artificial Sequence
  Description of Artificial Sequence: Synthetic peptide
  Seed: RRLMKQDFSV (PMEL_HUMAN)
RFLMKQDFSL

SEQ ID NO: 141869 - protein, 10 aa, Artificial Sequence
  Description of Artificial Sequence: Synthetic peptide
  Seed: RTKAWNRQLY (PMEL_HUMAN)
RYKAWNRQLK

SEQ ID NO: 141870 - protein, 10 aa, Artificial Sequence
  Description of Artificial Sequence: Synthetic peptide
  Seed: GTATLRLVKR (PMEL_HUMAN)
GSATLRLVKK

SEQ ID NO: 141871 - protein, 9 aa, Artificial Sequence
  Description of Artificial Sequence: Synthetic peptide
  Seed: TPAEVSIVV (PMEL_HUMAN)
TTAEVSIVT

SEQ ID NO: 141872 - protein, 9 aa, Artificial Sequence
  Description of Artificial Sequence: Synthetic peptide
  Seed: KAWNRQLYP (PMEL_HUMAN)
KQWNRQLYK

SEQ ID NO: 141873 - protein, 9 aa, Artificial Sequence
  Description of Artificial Sequence: Synthetic peptide
  Seed: VLKRCLLHL (PMEL_HUMAN)
VLKRCLLHV

SEQ ID NO: 141874 - protein, 10 aa, Artificial Sequence
  Description of Artificial Sequence: Synthetic peptide
  Seed: VPLAHSSSAF (PMEL_HUMAN)
VPLAHSSSAM

SEQ ID NO: 141875 - protein, 9 aa, Artificial Sequence
  Description of Artificial Sequence: Synthetic peptide
  Seed: YLAEADLSY (PMEL_HUMAN)
YQAEADLSV

SEQ ID NO: 141876 - protein, 10 aa, Artificial Sequence
  Description of Artificial Sequence: Synthetic peptide
  Seed: TDQVPFSVSV (PMEL_HUMAN)
TMQVPFSVSI

SEQ ID NO: 141877 - protein, 9 aa, Artificial Sequence
  Description of Artificial Sequence: Synthetic peptide
  Seed: ESTGMTPEK (PMEL_HUMAN)
ETTGMTPEK

SEQ ID NO: 141878 - protein, 8 aa, Artificial Sequence
  Description of Artificial Sequence: Synthetic peptide
  Seed: HTMEVTVY (PMEL_HUMAN)
HQMEVTVY

SEQ ID NO: 141879 - protein, 10 aa, Artificial Sequence
  Description of Artificial Sequence: Synthetic peptide
  Seed: KTWGQYWQVL (PMEL_HUMAN)
KLWGQYWQVM

SEQ ID NO: 141880 - protein, 9 aa, Artificial Sequence
  Description of Artificial Sequence: Synthetic peptide
  Seed: VQVPTTEVI (PMEL_HUMAN)
VRVPTTEVA

SEQ ID NO: 141881 - protein, 9 aa, Artificial Sequence
  Description of Artificial Sequence: Synthetic peptide
  Seed: ESAEILQAV (PMEL_HUMAN)
EMAEILQAA

SEQ ID NO: 141882 - protein, 9 aa, Artificial Sequence
  Description of Artificial Sequence: Synthetic peptide
  Seed: RLMKQDFSV (PMEL_HUMAN)
RGMKQDFSY

SEQ ID NO: 141883 - protein, 10 aa, Artificial Sequence
  Description of Artificial Sequence: Synthetic peptide
  Seed: RALDGGNKHF (PMEL_HUMAN)
RILDGGNKHI

SEQ ID NO: 141884 - protein, 10 aa, Artificial Sequence
  Description of Artificial Sequence: Synthetic peptide
  Seed: MPTAESTGMT (PMEL_HUMAN)
MNTAESTGMI

SEQ ID NO: 141885 - protein, 10 aa, Artificial Sequence
  Description of Artificial Sequence: Synthetic peptide
  Seed: VPQLPHSSSH (PMEL_HUMAN)
VHQLPHSSSF

SEQ ID NO: 141886 - protein, 10 aa, Artificial Sequence
  Description of Artificial Sequence: Synthetic peptide
  Seed: GPLLDGTATL (PMEL_HUMAN)
GALLDGTATM

SEQ ID NO: 141887 - protein, 10 aa, Artificial Sequence
  Description of Artificial Sequence: Synthetic peptide
  Seed: SLIYRRRLMK (PMEL_HUMAN)
SKIYRRRLMK

SEQ ID NO: 141888 - protein, 9 aa, Artificial Sequence
  Description of Artificial Sequence: Synthetic peptide
  Seed: WSQKRSFVY (PMEL_HUMAN)
WRQKRSFVY

SEQ ID NO: 141889 - protein, 10 aa, Artificial Sequence
  Description of Artificial Sequence: Synthetic peptide
  Seed: ASSIMSTESI (PMEL_HUMAN)
AFSIMSTESW

SEQ ID NO: 141890 - protein, 10 aa, Artificial Sequence
  Description of Artificial Sequence: Synthetic peptide
  Seed: MTPAEVSIVV (PMEL_HUMAN)
MSPAEVSIVS

SEQ ID NO: 141891 - protein, 9 aa, Artificial Sequence
  Description of Artificial Sequence: Synthetic peptide
  Seed: YLEPGPVTA (PMEL_HUMAN)
YPEPGPVTI

SEQ ID NO: 141892 - protein, 9 aa, Artificial Sequence
  Description of Artificial Sequence: Synthetic peptide
  Seed: AGLGQVPLI (PMEL_HUMAN)
ALLGQVPLL

SEQ ID NO: 141893 - protein, 9 aa, Artificial Sequence
  Description of Artificial Sequence: Synthetic peptide
  Seed: AVIGALLAV (PMEL_HUMAN)
ASIGALLAI

SEQ ID NO: 141894 - protein, 9 aa, Artificial Sequence
  Description of Artificial Sequence: Synthetic peptide
  Seed: TPEATGMTP (PMEL_HUMAN)
TPEATGMTL

SEQ ID NO: 141895 - protein, 11 aa, Artificial Sequence
  Description of Artificial Sequence: Synthetic peptide
  Seed: QLPHSSSHWLR (PMEL_HUMAN)
QMPHSSSHWLR

SEQ ID NO: 141896 - protein, 10 aa, Artificial Sequence
  Description of Artificial Sequence: Synthetic peptide
  Seed: LKVSNDGPTL (PMEL_HUMAN)
LKVSNDGPTY

SEQ ID NO: 141897 - protein, 10 aa, Artificial Sequence
  Description of Artificial Sequence: Synthetic peptide
  Seed: GQVPLIVGIL (PMEL_HUMAN)
GQVPLIVGIF

SEQ ID NO: 141898 - protein, 10 aa, Artificial Sequence
  Description of Artificial Sequence: Synthetic peptide
  Seed: RGSRSYVPLA (PMEL_HUMAN)
RQSRSYVPLK

SEQ ID NO: 141899 - protein, 10 aa, Artificial Sequence
  Description of Artificial Sequence: Synthetic peptide
  Seed: MTPAEVSIVV (PMEL_HUMAN)
MTPAEVSIVM

SEQ ID NO: 141900 - protein, 9 aa, Artificial Sequence
  Description of Artificial Sequence: Synthetic peptide
  Seed: HTMEVTVYH (PMEL_HUMAN)
HWMEVTVYK

SEQ ID NO: 141901 - protein, 9 aa, Artificial Sequence
  Description of Artificial Sequence: Synthetic peptide
  Seed: FLRNQPLTF (PMEL_HUMAN)
FERNQPLTY

SEQ ID NO: 141902 - protein, 10 aa, Artificial Sequence
  Description of Artificial Sequence: Synthetic peptide
  Seed: AEADLSYTWD (PMEL_HUMAN)
AEADLSYTWF

SEQ ID NO: 141903 - protein, 9 aa, Artificial Sequence
  Description of Artificial Sequence: Synthetic peptide
  Seed: ITDQVPFSV (PMEL_HUMAN)
ILDQVPFSY

SEQ ID NO: 141904 - protein, 10 aa, Artificial Sequence
  Description of Artificial Sequence: Synthetic peptide
  Seed: LVLKRCLLHL (PMEL_HUMAN)
LLLKRCLLHV

SEQ ID NO: 141905 - protein, 10 aa, Artificial Sequence
  Description of Artificial Sequence: Synthetic peptide
  Seed: RRLMKQDFSV (PMEL_HUMAN)
RNLMKQDFSI

SEQ ID NO: 141906 - protein, 10 aa, Artificial Sequence
  Description of Artificial Sequence: Synthetic peptide
  Seed: STAPVQMPTA (PMEL_HUMAN)
STAPVQMPTI

SEQ ID NO: 141907 - protein, 10 aa, Artificial Sequence
  Description of Artificial Sequence: Synthetic peptide
  Seed: SCPIGENSPL (PMEL_HUMAN)
STPIGENSPM

SEQ ID NO: 141908 - protein, 10 aa, Artificial Sequence
  Description of Artificial Sequence: Synthetic peptide
  Seed: LIMPGQEAGL (PMEL_HUMAN)
LMMPGQEAGI

SEQ ID NO: 141909 - protein, 10 aa, Artificial Sequence
  Description of Artificial Sequence: Synthetic peptide
  Seed: GEGDAFELTV (PMEL_HUMAN)
GEGDAFELTI

SEQ ID NO: 141910 - protein, 10 aa, Artificial Sequence
  Description of Artificial Sequence: Synthetic peptide
  Seed: RGSRSYVPLA (PMEL_HUMAN)
RGSRSYVPLM

SEQ ID NO: 141911 - protein, 9 aa, Artificial Sequence
  Description of Artificial Sequence: Synthetic peptide
  Seed: RLMKQDFSV (PMEL_HUMAN)
REMKQDFSL

SEQ ID NO: 141912 - protein, 9 aa, Artificial Sequence
  Description of Artificial Sequence: Synthetic peptide
  Seed: FTITDQVPF (PMEL_HUMAN)
FGITDQVPL

SEQ ID NO: 141913 - protein, 10 aa, Artificial Sequence
  Description of Artificial Sequence: Synthetic peptide
  Seed: YGSFSVTLDI (PMEL_HUMAN)
YRSFSVTLDW

SEQ ID NO: 141914 - protein, 9 aa, Artificial Sequence
  Description of Artificial Sequence: Synthetic peptide
  Seed: ALNFPGSQK (PMEL_HUMAN)
ASNFPGSQF

SEQ ID NO: 141915 - protein, 10 aa, Artificial Sequence
  Description of Artificial Sequence: Synthetic peptide
  Seed: MKQDFSVPQL (PMEL_HUMAN)
MRQDFSVPQF

SEQ ID NO: 141916 - protein, 9 aa, Artificial Sequence
  Description of Artificial Sequence: Synthetic peptide
  Seed: AVVLASLIY (PMEL_HUMAN)
AAVLASLIW

SEQ ID NO: 141917 - protein, 11 aa, Artificial Sequence
  Description of Artificial Sequence: Synthetic peptide
  Seed: LYRYGSFSVTL (PMEL_HUMAN)
LERYGSFSVTF

SEQ ID NO: 141918 - protein, 10 aa, Artificial Sequence
  Description of Artificial Sequence: Synthetic peptide
  Seed: RGSRSYVPLA (PMEL_HUMAN)
RGSRSYVPLK

SEQ ID NO: 141919 - protein, 10 aa, Artificial Sequence
  Description of Artificial Sequence: Synthetic peptide
  Seed: LAVIGALLAV (PMEL_HUMAN)
LWVIGALLAA

SEQ ID NO: 141920 - protein, 10 aa, Artificial Sequence
  Description of Artificial Sequence: Synthetic peptide
  Seed: ASSIMSTESI (PMEL_HUMAN)
AASIMSTESW

SEQ ID NO: 141921 - protein, 9 aa, Artificial Sequence
  Description of Artificial Sequence: Synthetic peptide
  Seed: GTYCLNVSL (PMEL_HUMAN)
GTYCLNVSW

SEQ ID NO: 141922 - protein, 11 aa, Artificial Sequence
  Description of Artificial Sequence: Synthetic peptide
  Seed: KVLPDGQVIWV (PMEL_HUMAN)
KLLPDGQVIWM

SEQ ID NO: 141923 - protein, 10 aa, Artificial Sequence
  Description of Artificial Sequence: Synthetic peptide
  Seed: SVPQLPHSSS (PMEL_HUMAN)
STPQLPHSSA

SEQ ID NO: 141924 - protein, 9 aa, Artificial Sequence
  Description of Artificial Sequence: Synthetic peptide
  Seed: EVVGTTPGQ (PMEL_HUMAN)
ETVGTTPGF

SEQ ID NO: 141925 - protein, 10 aa, Artificial Sequence
  Description of Artificial Sequence: Synthetic peptide
  Seed: RALVVTHTYL (PMEL_HUMAN)
RSLVVTHTYM

SEQ ID NO: 141926 - protein, 10 aa, Artificial Sequence
  Description of Artificial Sequence: Synthetic peptide
  Seed: RALDGGNKHF (PMEL_HUMAN)
RVLDGGNKHF

SEQ ID NO: 141927 - protein, 9 aa, Artificial Sequence
  Description of Artificial Sequence: Synthetic peptide
  Seed: AEVSIVVLS (PMEL_HUMAN)
AEVSIVVLW

SEQ ID NO: 141928 - protein, 10 aa, Artificial Sequence
  Description of Artificial Sequence: Synthetic peptide
  Seed: AVVLASLIYR (PMEL_HUMAN)
AHVLASLIYK

SEQ ID NO: 141929 - protein, 10 aa, Artificial Sequence
  Description of Artificial Sequence: Synthetic peptide
  Seed: GILLVLMAVV (PMEL_HUMAN)
GLLLVLMAVV

SEQ ID NO: 141930 - protein, 9 aa, Artificial Sequence
  Description of Artificial Sequence: Synthetic peptide
  Seed: LYRYGSFSV (PMEL_HUMAN)
LMRYGSFSK

SEQ ID NO: 141931 - protein, 9 aa, Artificial Sequence
  Description of Artificial Sequence: Synthetic peptide
  Seed: RAMLGTHTM (PMEL_HUMAN)
RTMLGTHTF

SEQ ID NO: 141932 - protein, 9 aa, Artificial Sequence
  Description of Artificial Sequence: Synthetic peptide
  Seed: AQRLCQPVL (PMEL_HUMAN)
AHRLCQPVF

SEQ ID NO: 141933 - protein, 10 aa, Artificial Sequence
  Description of Artificial Sequence: Synthetic peptide
  Seed: TTEVISTAPV (PMEL_HUMAN)
TSEVISTAPV

SEQ ID NO: 141934 - protein, 9 aa, Artificial Sequence
  Description of Artificial Sequence: Synthetic peptide
  Seed: DAFELTVSC (PMEL_HUMAN)
DTFELTVSV

SEQ ID NO: 141935 - protein, 10 aa, Artificial Sequence
  Description of Artificial Sequence: Synthetic peptide
  Seed: QVLGGPVSGL (PMEL_HUMAN)
QILGGPVSGW

SEQ ID NO: 141936 - protein, 8 aa, Artificial Sequence
  Description of Artificial Sequence: Synthetic peptide
  Seed: LAHSSSAF (PMEL_HUMAN)
LMHSSSAY

SEQ ID NO: 141937 - protein, 9 aa, Artificial Sequence
  Description of Artificial Sequence: Synthetic peptide
  Seed: TYLEPGPVT (PMEL_HUMAN)
TWLEPGPVY

SEQ ID NO: 141938 - protein, 9 aa, Artificial Sequence
  Description of Artificial Sequence: Synthetic peptide
  Seed: VSVSQLRAL (PMEL_HUMAN)
VSVSQLRAV

SEQ ID NO: 141939 - protein, 11 aa, Artificial Sequence
  Description of Artificial Sequence: Synthetic peptide
  Seed: RALDGGNKHFL (PMEL_HUMAN)
RMLDGGNKHFI

SEQ ID NO: 141940 - protein, 9 aa, Artificial Sequence
  Description of Artificial Sequence: Synthetic peptide
  Seed: ANASFSIAL (PMEL_HUMAN)
AQASFSIAF

SEQ ID NO: 141941 - protein, 9 aa, Artificial Sequence
  Description of Artificial Sequence: Synthetic peptide
  Seed: ESAEILQAV (PMEL_HUMAN)
ESAEILQAT

SEQ ID NO: 141942 - protein, 9 aa, Artificial Sequence
  Description of Artificial Sequence: Synthetic peptide
  Seed: ALDGGNKHF (PMEL_HUMAN)
AFDGGNKHV

SEQ ID NO: 141943 - protein, 9 aa, Artificial Sequence
  Description of Artificial Sequence: Synthetic peptide
  Seed: KVLPDGQVI (PMEL_HUMAN)
KALPDGQVV

SEQ ID NO: 141944 - protein, 9 aa, Artificial Sequence
  Description of Artificial Sequence: Synthetic peptide
  Seed: SSPGCQPPA (PMEL_HUMAN)
SPPGCQPPA

SEQ ID NO: 141945 - protein, 9 aa, Artificial Sequence
  Description of Artificial Sequence: Synthetic peptide
  Seed: TLISRALVV (PMEL_HUMAN)
TVISRALVY

SEQ ID NO: 141946 - protein, 9 aa, Artificial Sequence
  Description of Artificial Sequence: Synthetic peptide
  Seed: SSPGCQPPA (PMEL_HUMAN)
SGPGCQPPM

SEQ ID NO: 141947 - protein, 10 aa, Artificial Sequence
  Description of Artificial Sequence: Synthetic peptide
  Seed: LQLHDPSGYL (PMEL_HUMAN)
LILHDPSGYY

SEQ ID NO: 141948 - protein, 10 aa, Artificial Sequence
  Description of Artificial Sequence: Synthetic peptide
  Seed: YGSFSVTLDI (PMEL_HUMAN)
YKSFSVTLDY

SEQ ID NO: 141949 - protein, 9 aa, Artificial Sequence
  Description of Artificial Sequence: Synthetic peptide
  Seed: SEVMGTTLA (PMEL_HUMAN)
SEVMGTTLF

SEQ ID NO: 141950 - protein, 9 aa, Artificial Sequence
  Description of Artificial Sequence: Synthetic peptide
  Seed: KQDFSVPQL (PMEL_HUMAN)
KHDFSVPQF

SEQ ID NO: 141951 - protein, 9 aa, Artificial Sequence
  Description of Artificial Sequence: Synthetic peptide
  Seed: GTATLRLVK (PMEL_HUMAN)
GIATLRLVK

SEQ ID NO: 141952 - protein, 9 aa, Artificial Sequence
  Description of Artificial Sequence: Synthetic peptide
  Seed: WSQKRSFVY (PMEL_HUMAN)
WSQKRSFVM

SEQ ID NO: 141953 - protein, 10 aa, Artificial Sequence
  Description of Artificial Sequence: Synthetic peptide
  Seed: RALDGGNKHF (PMEL_HUMAN)
RALDGGNKHL

SEQ ID NO: 141954 - protein, 9 aa, Artificial Sequence
  Description of Artificial Sequence: Synthetic peptide
  Seed: SVPQLPHSS (PMEL_HUMAN)
SIPQLPHSL

SEQ ID NO: 141955 - protein, 11 aa, Artificial Sequence
  Description of Artificial Sequence: Synthetic peptide
  Seed: MAVVLASLIYR (PMEL_HUMAN)
MHVVLASLIYK

SEQ ID NO: 141956 - protein, 11 aa, Artificial Sequence
  Description of Artificial Sequence: Synthetic peptide
  Seed: LPIPEPEGPDA (PMEL_HUMAN)
LPIPEPEGPDM

SEQ ID NO: 141957 - protein, 10 aa, Artificial Sequence
  Description of Artificial Sequence: Synthetic peptide
  Seed: MTPAEVSIVV (PMEL_HUMAN)
MKPAEVSIVT

SEQ ID NO: 141958 - protein, 9 aa, Artificial Sequence
  Description of Artificial Sequence: Synthetic peptide
  Seed: SLIYRRRLM (PMEL_HUMAN)
SYIYRRRLM

SEQ ID NO: 141959 - protein, 9 aa, Artificial Sequence
  Description of Artificial Sequence: Synthetic peptide
  Seed: YLAEADLSY (PMEL_HUMAN)
YIAEADLSY

SEQ ID NO: 141960 - protein, 9 aa, Artificial Sequence
  Description of Artificial Sequence: Synthetic peptide
  Seed: CPIGENSPL (PMEL_HUMAN)
CAIGENSPY

SEQ ID NO: 141961 - protein, 9 aa, Artificial Sequence
  Description of Artificial Sequence: Synthetic peptide
  Seed: LYRYGSFSV (PMEL_HUMAN)
LVRYGSFSI

SEQ ID NO: 141962 - protein, 9 aa, Artificial Sequence
  Description of Artificial Sequence: Synthetic peptide
  Seed: VTLDIVQGI (PMEL_HUMAN)
VALDIVQGA

SEQ ID NO: 141963 - protein, 10 aa, Artificial Sequence
  Description of Artificial Sequence: Synthetic peptide
  Seed: ELTVSCQGGL (PMEL_HUMAN)
ETTVSCQGGV

SEQ ID NO: 141964 - protein, 9 aa, Artificial Sequence
  Description of Artificial Sequence: Synthetic peptide
  Seed: GSWSQKRSF (PMEL_HUMAN)
GQWSQKRSY

SEQ ID NO: 141965 - protein, 9 aa, Artificial Sequence
  Description of Artificial Sequence: Synthetic peptide
  Seed: LIYRRRLMK (PMEL_HUMAN)
LFYRRRLMK

SEQ ID NO: 141966 - protein, 9 aa, Artificial Sequence
  Description of Artificial Sequence: Synthetic peptide
  Seed: IMPGQEAGL (PMEL_HUMAN)
IIPGQEAGM

SEQ ID NO: 141967 - protein, 10 aa, Artificial Sequence
  Description of Artificial Sequence: Synthetic peptide
  Seed: SQVWGGQPVY (PMEL_HUMAN)
SIVWGGQPVF

SEQ ID NO: 141968 - protein, 9 aa, Artificial Sequence
  Description of Artificial Sequence: Synthetic peptide
  Seed: RTKAWNRQL (PMEL_HUMAN)
RAKAWNRQI

SEQ ID NO: 141969 - protein, 9 aa, Artificial Sequence
  Description of Artificial Sequence: Synthetic peptide
  Seed: VQVPTTEVI (PMEL_HUMAN)
VQVPTTEVY

SEQ ID NO: 141970 - protein, 9 aa, Artificial Sequence
  Description of Artificial Sequence: Synthetic peptide
  Seed: MLGTHTMEV (PMEL_HUMAN)
MSGTHTMEY

SEQ ID NO: 141971 - protein, 10 aa, Artificial Sequence
  Description of Artificial Sequence: Synthetic peptide
  Seed: LAHSSSAFTI (PMEL_HUMAN)
LTHSSSAFTM

SEQ ID NO: 141972 - protein, 9 aa, Artificial Sequence
  Description of Artificial Sequence: Synthetic peptide
  Seed: ISRALVVTH (PMEL_HUMAN)
IMRALVVTL

SEQ ID NO: 141973 - protein, 8 aa, Artificial Sequence
  Description of Artificial Sequence: Synthetic peptide
  Seed: STPEATGM (PMEL_HUMAN)
SAPEATGL

SEQ ID NO: 141974 - protein, 11 aa, Artificial Sequence
  Description of Artificial Sequence: Synthetic peptide
  Seed: TYLEPGPVTAQ (PMEL_HUMAN)
TFLEPGPVTAL

SEQ ID NO: 141975 - protein, 9 aa, Artificial Sequence
  Description of Artificial Sequence: Synthetic peptide
  Seed: QVWGGQPVY (PMEL_HUMAN)
QTWGGQPVF

SEQ ID NO: 141976 - protein, 9 aa, Artificial Sequence
  Description of Artificial Sequence: Synthetic peptide
  Seed: VLYRYGSFS (PMEL_HUMAN)
VMYRYGSFI

SEQ ID NO: 141977 - protein, 9 aa, Artificial Sequence
  Description of Artificial Sequence: Synthetic peptide
  Seed: ISRALVVTH (PMEL_HUMAN)
IIRALVVTF

SEQ ID NO: 141978 - protein, 9 aa, Artificial Sequence
  Description of Artificial Sequence: Synthetic peptide
  Seed: LIYRRRLMK (PMEL_HUMAN)
LSYRRRLMR

SEQ ID NO: 141979 - protein, 10 aa, Artificial Sequence
  Description of Artificial Sequence: Synthetic peptide
  Seed: AVVLASLIYR (PMEL_HUMAN)
ARVLASLIYK

SEQ ID NO: 141980 - protein, 9 aa, Artificial Sequence
  Description of Artificial Sequence: Synthetic peptide
  Seed: KVLPDGQVI (PMEL_HUMAN)
KSLPDGQVM

SEQ ID NO: 141981 - protein, 9 aa, Artificial Sequence
  Description of Artificial Sequence: Synthetic peptide
  Seed: VPLIVGILL (PMEL_HUMAN)
VPLIVGILF

SEQ ID NO: 141982 - protein, 9 aa, Artificial Sequence
  Description of Artificial Sequence: Synthetic peptide
  Seed: DSSGTLISR (PMEL_HUMAN)
DWSGTLISR

SEQ ID NO: 141983 - protein, 8 aa, Artificial Sequence
  Description of Artificial Sequence: Synthetic peptide
  Seed: SNDGPTLI (PMEL_HUMAN)
SFDGPTLF

SEQ ID NO: 141984 - protein, 9 aa, Artificial Sequence
  Description of Artificial Sequence: Synthetic peptide
  Seed: RLMKQDFSV (PMEL_HUMAN)
RRMKQDFST

SEQ ID NO: 141985 - protein, 9 aa, Artificial Sequence
  Description of Artificial Sequence: Synthetic peptide
  Seed: YWQVLGGPV (PMEL_HUMAN)
YFQVLGGPL

SEQ ID NO: 141986 - protein, 8 aa, Artificial Sequence
  Description of Artificial Sequence: Synthetic peptide
  Seed: FGDSSGTL (PMEL_HUMAN)
FADSSGTI

SEQ ID NO: 141987 - protein, 9 aa, Artificial Sequence
  Description of Artificial Sequence: Synthetic peptide
  Seed: VLPSPACQL (PMEL_HUMAN)
VSPSPACQL

SEQ ID NO: 141988 - protein, 10 aa, Artificial Sequence
  Description of Artificial Sequence: Synthetic peptide
  Seed: AVPSGEGDAF (PMEL_HUMAN)
AVPSGEGDAM

SEQ ID NO: 141989 - protein, 10 aa, Artificial Sequence
  Description of Artificial Sequence: Synthetic peptide
  Seed: QVLGGPVSGL (PMEL_HUMAN)
QLLGGPVSGR

SEQ ID NO: 141990 - protein, 9 aa, Artificial Sequence
  Description of Artificial Sequence: Synthetic peptide
  Seed: YLEPGPVTA (PMEL_HUMAN)
YSEPGPVTY

SEQ ID NO: 141991 - protein, 10 aa, Artificial Sequence
  Description of Artificial Sequence: Synthetic peptide
  Seed: ALDGGNKHFL (PMEL_HUMAN)
ATDGGNKHFL

SEQ ID NO: 141992 - protein, 9 aa, Artificial Sequence
  Description of Artificial Sequence: Synthetic peptide
  Seed: TTPGQAPTA (PMEL_HUMAN)
TMPGQAPTV

SEQ ID NO: 141993 - protein, 10 aa, Artificial Sequence
  Description of Artificial Sequence: Synthetic peptide
  Seed: AVVLASLIYR (PMEL_HUMAN)
AYVLASLIYR

SEQ ID NO: 141994 - protein, 8 aa, Artificial Sequence
  Description of Artificial Sequence: Synthetic peptide
  Seed: FGDSSGTL (PMEL_HUMAN)
FLDSSGTV

SEQ ID NO: 141995 - protein, 10 aa, Artificial Sequence
  Description of Artificial Sequence: Synthetic peptide
  Seed: SCPIGENSPL (PMEL_HUMAN)
STPIGENSPL

SEQ ID NO: 141996 - protein, 9 aa, Artificial Sequence
  Description of Artificial Sequence: Synthetic peptide
  Seed: LADTNSLAV (PMEL_HUMAN)
LTDTNSLAW

SEQ ID NO: 141997 - protein, 9 aa, Artificial Sequence
  Description of Artificial Sequence: Synthetic peptide
  Seed: VTAQVVLQA (PMEL_HUMAN)
VAAQVVLQM

SEQ ID NO: 141998 - protein, 9 aa, Artificial Sequence
  Description of Artificial Sequence: Synthetic peptide
  Seed: ALNFPGSQK (PMEL_HUMAN)
AVNFPGSQY

SEQ ID NO: 141999 - protein, 10 aa, Artificial Sequence
  Description of Artificial Sequence: Synthetic peptide
  Seed: RSFVYVWKTW (PMEL_HUMAN)
RVFVYVWKTL

SEQ ID NO: 142000 - protein, 11 aa, Artificial Sequence
  Description of Artificial Sequence: Synthetic peptide
  Seed: MAVVLASLIYR (PMEL_HUMAN)
MKVVLASLIYK

SEQ ID NO: 142001 - protein, 9 aa, Artificial Sequence
  Description of Artificial Sequence: Synthetic peptide
  Seed: DAFELTVSC (PMEL_HUMAN)
DIFELTVSF

SEQ ID NO: 142002 - protein, 10 aa, Artificial Sequence
  Description of Artificial Sequence: Synthetic peptide
  Seed: TDQVPFSVSV (PMEL_HUMAN)
TQQVPFSVSV

SEQ ID NO: 142003 - protein, 9 aa, Artificial Sequence
  Description of Artificial Sequence: Synthetic peptide
  Seed: VLMAVVLAS (PMEL_HUMAN)
VQMAVVLAV

SEQ ID NO: 142004 - protein, 10 aa, Artificial Sequence
  Description of Artificial Sequence: Synthetic peptide
  Seed: LPSPACQLVL (PMEL_HUMAN)
LPSPACQLVW

SEQ ID NO: 142005 - protein, 9 aa, Artificial Sequence
  Description of Artificial Sequence: Synthetic peptide
  Seed: ADTNSLAVV (PMEL_HUMAN)
AETNSLAVL

SEQ ID NO: 142006 - protein, 9 aa, Artificial Sequence
  Description of Artificial Sequence: Synthetic peptide
  Seed: SQKRSFVYV (PMEL_HUMAN)
SSKRSFVYC

SEQ ID NO: 142007 - protein, 9 aa, Artificial Sequence
  Description of Artificial Sequence: Synthetic peptide
  Seed: GQVPTTEVV (PMEL_HUMAN)
GRVPTTEVY

SEQ ID NO: 142008 - protein, 10 aa, Artificial Sequence
  Description of Artificial Sequence: Synthetic peptide
  Seed: KVLPDGQVIW (PMEL_HUMAN)
KTLPDGQVIY

SEQ ID NO: 142009 - protein, 9 aa, Artificial Sequence
  Description of Artificial Sequence: Synthetic peptide
  Seed: FGDSSGTLI (PMEL_HUMAN)
FFDSSGTLT

SEQ ID NO: 142010 - protein, 9 aa, Artificial Sequence
  Description of Artificial Sequence: Synthetic peptide
  Seed: KVSNDGPTL (PMEL_HUMAN)
KISNDGPTY

SEQ ID NO: 142011 - protein, 9 aa, Artificial Sequence
  Description of Artificial Sequence: Synthetic peptide
  Seed: EVVGTTPGQ (PMEL_HUMAN)
EIVGTTPGM

SEQ ID NO: 142012 - protein, 9 aa, Artificial Sequence
  Description of Artificial Sequence: Synthetic peptide
  Seed: VISTAPVQM (PMEL_HUMAN)
VQSTAPVQL

SEQ ID NO: 142013 - protein, 9 aa, Artificial Sequence
  Description of Artificial Sequence: Synthetic peptide
  Seed: CPIGENSPL (PMEL_HUMAN)
CLIGENSPY

SEQ ID NO: 142014 - protein, 9 aa, Artificial Sequence
  Description of Artificial Sequence: Synthetic peptide
  Seed: AQRLCQPVL (PMEL_HUMAN)
AKRLCQPVF

SEQ ID NO: 142015 - protein, 10 aa, Artificial Sequence
  Description of Artificial Sequence: Synthetic peptide
  Seed: MSTESITGSL (PMEL_HUMAN)
MTTESITGSL

SEQ ID NO: 142016 - protein, 11 aa, Artificial Sequence
  Description of Artificial Sequence: Synthetic peptide
  Seed: RYGSFSVTLDI (PMEL_HUMAN)
RQGSFSVTLDW

SEQ ID NO: 142017 - protein, 9 aa, Artificial Sequence
  Description of Artificial Sequence: Synthetic peptide
  Seed: TTAAQVTTT (PMEL_HUMAN)
TTAAQVTTI

SEQ ID NO: 142018 - protein, 9 aa, Artificial Sequence
  Description of Artificial Sequence: Synthetic peptide
  Seed: FLRNQPLTF (PMEL_HUMAN)
FYRNQPLTF

SEQ ID NO: 142019 - protein, 10 aa, Artificial Sequence
  Description of Artificial Sequence: Synthetic peptide
  Seed: RTKAWNRQLY (PMEL_HUMAN)
RVKAWNRQLW

SEQ ID NO: 142020 - protein, 9 aa, Artificial Sequence
  Description of Artificial Sequence: Synthetic peptide
  Seed: LNFPGSQKV (PMEL_HUMAN)
LIFPGSQKL

SEQ ID NO: 142021 - protein, 9 aa, Artificial Sequence
  Description of Artificial Sequence: Synthetic peptide
  Seed: NFPGSQKVL (PMEL_HUMAN)
NAPGSQKVL

SEQ ID NO: 142022 - protein, 9 aa, Artificial Sequence
  Description of Artificial Sequence: Synthetic peptide
  Seed: LIVGILLVL (PMEL_HUMAN)
LTVGILLVI

SEQ ID NO: 142023 - protein, 10 aa, Artificial Sequence
  Description of Artificial Sequence: Synthetic peptide
  Seed: YRYGSFSVTL (PMEL_HUMAN)
YFYGSFSVTM

SEQ ID NO: 142024 - protein, 9 aa, Artificial Sequence
  Description of Artificial Sequence: Synthetic peptide
  Seed: VPFSVSVSQ (PMEL_HUMAN)
VAFSVSVSF

SEQ ID NO: 142025 - protein, 9 aa, Artificial Sequence
  Description of Artificial Sequence: Synthetic peptide
  Seed: LTSCGSSPV (PMEL_HUMAN)
LTSCGSSPY

SEQ ID NO: 142026 - protein, 9 aa, Artificial Sequence
  Description of Artificial Sequence: Synthetic peptide
  Seed: HSSSHWLRL (PMEL_HUMAN)
HSSSHWLRK

SEQ ID NO: 142027 - protein, 10 aa, Artificial Sequence
  Description of Artificial Sequence: Synthetic peptide
  Seed: RNQDWLGVSR (PMEL_HUMAN)
RAQDWLGVSL

SEQ ID NO: 142028 - protein, 10 aa, Artificial Sequence
  Description of Artificial Sequence: Synthetic peptide
  Seed: FSVSVSQLRA (PMEL_HUMAN)
FSVSVSQLRK

SEQ ID NO: 142029 - protein, 10 aa, Artificial Sequence
  Description of Artificial Sequence: Synthetic peptide
  Seed: ELTVSCQGGL (PMEL_HUMAN)
EHTVSCQGGV

SEQ ID NO: 142030 - protein, 10 aa, Artificial Sequence
  Description of Artificial Sequence: Synthetic peptide
  Seed: ESITGSLGPL (PMEL_HUMAN)
EIITGSLGPR

SEQ ID NO: 142031 - protein, 9 aa, Artificial Sequence
  Description of Artificial Sequence: Synthetic peptide
  Seed: RNQPLTFAL (PMEL_HUMAN)
RSQPLTFAW

SEQ ID NO: 142032 - protein, 9 aa, Artificial Sequence
  Description of Artificial Sequence: Synthetic peptide
  Seed: TTPGQAPTA (PMEL_HUMAN)
TVPGQAPTV

SEQ ID NO: 142033 - protein, 9 aa, Artificial Sequence
  Description of Artificial Sequence: Synthetic peptide
  Seed: FLRNQPLTF (PMEL_HUMAN)
FQRNQPLTL

SEQ ID NO: 142034 - protein, 9 aa, Artificial Sequence
  Description of Artificial Sequence: Synthetic peptide
  Seed: NQDWLGVSR (PMEL_HUMAN)
NVDWLGVSY

SEQ ID NO: 142035 - protein, 9 aa, Artificial Sequence
  Description of Artificial Sequence: Synthetic peptide
  Seed: SLAVVSTQL (PMEL_HUMAN)
SPAVVSTQF

SEQ ID NO: 142036 - protein, 9 aa, Artificial Sequence
  Description of Artificial Sequence: Synthetic peptide
  Seed: GQVPTTEVV (PMEL_HUMAN)
GMVPTTEVL

SEQ ID NO: 142037 - protein, 9 aa, Artificial Sequence
  Description of Artificial Sequence: Synthetic peptide
  Seed: VSCQGGLPK (PMEL_HUMAN)
VVCQGGLPL

SEQ ID NO: 142038 - protein, 10 aa, Artificial Sequence
  Description of Artificial Sequence: Synthetic peptide
  Seed: MTPAEVSIVV (PMEL_HUMAN)
MIPAEVSIVF

SEQ ID NO: 142039 - protein, 9 aa, Artificial Sequence
  Description of Artificial Sequence: Synthetic peptide
  Seed: RELPIPEPE (PMEL_HUMAN)
RELPIPEPF

SEQ ID NO: 142040 - protein, 8 aa, Artificial Sequence
  Description of Artificial Sequence: Synthetic peptide
  Seed: SEVMGTTL (PMEL_HUMAN)
SDVMGTTL

SEQ ID NO: 142041 - protein, 9 aa, Artificial Sequence
  Description of Artificial Sequence: Synthetic peptide
  Seed: TTPGQAPTA (PMEL_HUMAN)
TVPGQAPTM

SEQ ID NO: 142042 - protein, 9 aa, Artificial Sequence
  Description of Artificial Sequence: Synthetic peptide
  Seed: AQRLCQPVL (PMEL_HUMAN)
AERLCQPVM

SEQ ID NO: 142043 - protein, 9 aa, Artificial Sequence
  Description of Artificial Sequence: Synthetic peptide
  Seed: SITGSLGPL (PMEL_HUMAN)
SITGSLGPV

SEQ ID NO: 142044 - protein, 9 aa, Artificial Sequence
  Description of Artificial Sequence: Synthetic peptide
  Seed: VISTAPVQM (PMEL_HUMAN)
VVSTAPVQY

SEQ ID NO: 142045 - protein, 10 aa, Artificial Sequence
  Description of Artificial Sequence: Synthetic peptide
  Seed: RALDGGNKHF (PMEL_HUMAN)
RWLDGGNKHY

SEQ ID NO: 142046 - protein, 10 aa, Artificial Sequence
  Description of Artificial Sequence: Synthetic peptide
  Seed: EATGMTPAEV (PMEL_HUMAN)
ETTGMTPAEI

SEQ ID NO: 142047 - protein, 10 aa, Artificial Sequence
  Description of Artificial Sequence: Synthetic peptide
  Seed: RGSRSYVPLA (PMEL_HUMAN)
RTSRSYVPLL

SEQ ID NO: 142048 - protein, 10 aa, Artificial Sequence
  Description of Artificial Sequence: Synthetic peptide
  Seed: SGTYCLNVSL (PMEL_HUMAN)
SETYCLNVSF

SEQ ID NO: 142049 - protein, 8 aa, Artificial Sequence
  Description of Artificial Sequence: Synthetic peptide
  Seed: FGDSSGTL (PMEL_HUMAN)
FVDSSGTL

SEQ ID NO: 142050 - protein, 9 aa, Artificial Sequence
  Description of Artificial Sequence: Synthetic peptide
  Seed: SLIYRRRLM (PMEL_HUMAN)
SMIYRRRLL

SEQ ID NO: 142051 - protein, 10 aa, Artificial Sequence
  Description of Artificial Sequence: Synthetic peptide
  Seed: GPLLDGTATL (PMEL_HUMAN)
GSLLDGTATA

SEQ ID NO: 142052 - protein, 9 aa, Artificial Sequence
  Description of Artificial Sequence: Synthetic peptide
  Seed: VLPDGQVIW (PMEL_HUMAN)
VYPDGQVIF

SEQ ID NO: 142053 - protein, 9 aa, Artificial Sequence
  Description of Artificial Sequence: Synthetic peptide
  Seed: TAEAPNTTA (PMEL_HUMAN)
TPEAPNTTL

SEQ ID NO: 142054 - protein, 9 aa, Artificial Sequence
  Description of Artificial Sequence: Synthetic peptide
  Seed: LLHLAVIGA (PMEL_HUMAN)
LLHLAVIGL

SEQ ID NO: 142055 - protein, 10 aa, Artificial Sequence
  Description of Artificial Sequence: Synthetic peptide
  Seed: RTKAWNRQLY (PMEL_HUMAN)
RLKAWNRQLK

SEQ ID NO: 142056 - protein, 9 aa, Artificial Sequence
  Description of Artificial Sequence: Synthetic peptide
  Seed: TPAEVSIVV (PMEL_HUMAN)
THAEVSIVM

SEQ ID NO: 142057 - protein, 10 aa, Artificial Sequence
  Description of Artificial Sequence: Synthetic peptide
  Seed: KRQVPLDCVL (PMEL_HUMAN)
KPQVPLDCVY

SEQ ID NO: 142058 - protein, 9 aa, Artificial Sequence
  Description of Artificial Sequence: Synthetic peptide
  Seed: LMAVVLASL (PMEL_HUMAN)
LSAVVLASV

SEQ ID NO: 142059 - protein, 10 aa, Artificial Sequence
  Description of Artificial Sequence: Synthetic peptide
  Seed: RELPIPEPEG (PMEL_HUMAN)
RELPIPEPEM

SEQ ID NO: 142060 - protein, 10 aa, Artificial Sequence
  Description of Artificial Sequence: Synthetic peptide
  Seed: MTPAEVSIVV (PMEL_HUMAN)
MQPAEVSIVF

SEQ ID NO: 142061 - protein, 10 aa, Artificial Sequence
  Description of Artificial Sequence: Synthetic peptide
  Seed: SSHWLRLPRI (PMEL_HUMAN)
SMHWLRLPRK

SEQ ID NO: 142062 - protein, 10 aa, Artificial Sequence
  Description of Artificial Sequence: Synthetic peptide
  Seed: VVLASLIYRR (PMEL_HUMAN)
VTLASLIYRR

SEQ ID NO: 142063 - protein, 9 aa, Artificial Sequence
  Description of Artificial Sequence: Synthetic peptide
  Seed: THTMEVTVY (PMEL_HUMAN)
THTMEVTVF

SEQ ID NO: 142064 - protein, 10 aa, Artificial Sequence
  Description of Artificial Sequence: Synthetic peptide
  Seed: KVLPDGQVIW (PMEL_HUMAN)
KCLPDGQVIW

SEQ ID NO: 142065 - protein, 9 aa, Artificial Sequence
  Description of Artificial Sequence: Synthetic peptide
  Seed: VISTAPVQM (PMEL_HUMAN)
VTSTAPVQL

SEQ ID NO: 142066 - protein, 9 aa, Artificial Sequence
  Description of Artificial Sequence: Synthetic peptide
  Seed: KHFLRNQPL (PMEL_HUMAN)
KRFLRNQPY

SEQ ID NO: 142067 - protein, 9 aa, Artificial Sequence
  Description of Artificial Sequence: Synthetic peptide
  Seed: AVVSTQLIM (PMEL_HUMAN)
AKVSTQLIL

SEQ ID NO: 142068 - protein, 10 aa, Artificial Sequence
  Description of Artificial Sequence: Synthetic peptide
  Seed: ESAEILQAVP (PMEL_HUMAN)
EVAEILQAVC

SEQ ID NO: 142069 - protein, 10 aa, Artificial Sequence
  Description of Artificial Sequence: Synthetic peptide
  Seed: SVPQLPHSSS (PMEL_HUMAN)
SYPQLPHSSA

SEQ ID NO: 142070 - protein, 9 aa, Artificial Sequence
  Description of Artificial Sequence: Synthetic peptide
  Seed: AEPSGTTSV (PMEL_HUMAN)
AMPSGTTSL

SEQ ID NO: 142071 - protein, 9 aa, Artificial Sequence
  Description of Artificial Sequence: Synthetic peptide
  Seed: KVLPDGQVI (PMEL_HUMAN)
KMLPDGQVI

SEQ ID NO: 142072 - protein, 10 aa, Artificial Sequence
  Description of Artificial Sequence: Synthetic peptide
  Seed: HTMEVTVYHR (PMEL_HUMAN)
HAMEVTVYHR

SEQ ID NO: 142073 - protein, 11 aa, Artificial Sequence
  Description of Artificial Sequence: Synthetic peptide
  Seed: HQILKGGSGTY (PMEL_HUMAN)
HQILKGGSGTF

SEQ ID NO: 142074 - protein, 9 aa, Artificial Sequence
  Description of Artificial Sequence: Synthetic peptide
  Seed: IYRRRLMKQ (PMEL_HUMAN)
ISRRRLMKA

SEQ ID NO: 142075 - protein, 10 aa, Artificial Sequence
  Description of Artificial Sequence: Synthetic peptide
  Seed: RALVVTHTYL (PMEL_HUMAN)
RTLVVTHTYM

SEQ ID NO: 142076 - protein, 9 aa, Artificial Sequence
  Description of Artificial Sequence: Synthetic peptide
  Seed: VTLDIVQGI (PMEL_HUMAN)
VTLDIVQGR

SEQ ID NO: 142077 - protein, 9 aa, Artificial Sequence
  Description of Artificial Sequence: Synthetic peptide
  Seed: YLEPGPVTA (PMEL_HUMAN)
YREPGPVTM

SEQ ID NO: 142078 - protein, 9 aa, Artificial Sequence
  Description of Artificial Sequence: Synthetic peptide
  Seed: VSVSQLRAL (PMEL_HUMAN)
VQVSQLRAL

SEQ ID NO: 142079 - protein, 9 aa, Artificial Sequence
  Description of Artificial Sequence: Synthetic peptide
  Seed: LADTNSLAV (PMEL_HUMAN)
LMDTNSLAM

SEQ ID NO: 142080 - protein, 11 aa, Artificial Sequence
  Description of Artificial Sequence: Synthetic peptide
  Seed: APTAEPSGTTS (PMEL_HUMAN)
APTAEPSGTTA

SEQ ID NO: 142081 - protein, 10 aa, Artificial Sequence
  Description of Artificial Sequence: Synthetic peptide
  Seed: HTMEVTVYHR (PMEL_HUMAN)
HQMEVTVYHK

SEQ ID NO: 142082 - protein, 9 aa, Artificial Sequence
  Description of Artificial Sequence: Synthetic peptide
  Seed: VQVPTTEVI (PMEL_HUMAN)
VPVPTTEVY

SEQ ID NO: 142083 - protein, 10 aa, Artificial Sequence
  Description of Artificial Sequence: Synthetic peptide
  Seed: YRYGSFSVTL (PMEL_HUMAN)
YNYGSFSVTM

SEQ ID NO: 142084 - protein, 10 aa, Artificial Sequence
  Description of Artificial Sequence: Synthetic peptide
  Seed: MPTAESTGMT (PMEL_HUMAN)
MWTAESTGML

SEQ ID NO: 142085 - protein, 9 aa, Artificial Sequence
  Description of Artificial Sequence: Synthetic peptide
  Seed: MLGTHTMEV (PMEL_HUMAN)
MQGTHTMEI

SEQ ID NO: 142086 - protein, 9 aa, Artificial Sequence
  Description of Artificial Sequence: Synthetic peptide
  Seed: QLVLHQILK (PMEL_HUMAN)
QMVLHQILR

SEQ ID NO: 142087 - protein, 9 aa, Artificial Sequence
  Description of Artificial Sequence: Synthetic peptide
  Seed: YLEPGPVTA (PMEL_HUMAN)
YWEPGPVTF

SEQ ID NO: 142088 - protein, 9 aa, Artificial Sequence
  Description of Artificial Sequence: Synthetic peptide
  Seed: AVVLASLIY (PMEL_HUMAN)
ATVLASLIK

SEQ ID NO: 142089 - protein, 9 aa, Artificial Sequence
  Description of Artificial Sequence: Synthetic peptide
  Seed: VLPSPACQL (PMEL_HUMAN)
VFPSPACQL

SEQ ID NO: 142090 - protein, 9 aa, Artificial Sequence
  Description of Artificial Sequence: Synthetic peptide
  Seed: SVPQLPHSS (PMEL_HUMAN)
SLPQLPHSL

SEQ ID NO: 142091 - protein, 10 aa, Artificial Sequence
  Description of Artificial Sequence: Synthetic peptide
  Seed: IESAEILQAV (PMEL_HUMAN)
IQSAEILQAI

SEQ ID NO: 142092 - protein, 10 aa, Artificial Sequence
  Description of Artificial Sequence: Synthetic peptide
  Seed: VLMAVVLASL (PMEL_HUMAN)
VVMAVVLASR

SEQ ID NO: 142093 - protein, 10 aa, Artificial Sequence
  Description of Artificial Sequence: Synthetic peptide
  Seed: GPLLDGTATL (PMEL_HUMAN)
GWLLDGTATM

SEQ ID NO: 142094 - protein, 9 aa, Artificial Sequence
  Description of Artificial Sequence: Synthetic peptide
  Seed: RTKAWNRQL (PMEL_HUMAN)
RIKAWNRQI

SEQ ID NO: 142095 - protein, 9 aa, Artificial Sequence
  Description of Artificial Sequence: Synthetic peptide
  Seed: LPSPACQLV (PMEL_HUMAN)
LPSPACQLF

SEQ ID NO: 142096 - protein, 9 aa, Artificial Sequence
  Description of Artificial Sequence: Synthetic peptide
  Seed: FLRNQPLTF (PMEL_HUMAN)
FIRNQPLTY

SEQ ID NO: 142097 - protein, 10 aa, Artificial Sequence
  Description of Artificial Sequence: Synthetic peptide
  Seed: VVLASLIYRR (PMEL_HUMAN)
VFLASLIYRK

SEQ ID NO: 142098 - protein, 9 aa, Artificial Sequence
  Description of Artificial Sequence: Synthetic peptide
  Seed: YVWKTWGQY (PMEL_HUMAN)
YPWKTWGQL

SEQ ID NO: 142099 - protein, 10 aa, Artificial Sequence
  Description of Artificial Sequence: Synthetic peptide
  Seed: SAEILQAVPS (PMEL_HUMAN)
SPEILQAVPA

SEQ ID NO: 142100 - protein, 9 aa, Artificial Sequence
  Description of Artificial Sequence: Synthetic peptide
  Seed: RALVVTHTY (PMEL_HUMAN)
RPLVVTHTY

SEQ ID NO: 142101 - protein, 9 aa, Artificial Sequence
  Description of Artificial Sequence: Synthetic peptide
  Seed: TTDGHRPTA (PMEL_HUMAN)
TGDGHRPTL

SEQ ID NO: 142102 - protein, 9 aa, Artificial Sequence
  Description of Artificial Sequence: Synthetic peptide
  Seed: AEADLSYTW (PMEL_HUMAN)
AEADLSYTS

SEQ ID NO: 142103 - protein, 11 aa, Artificial Sequence
  Description of Artificial Sequence: Synthetic peptide
  Seed: MTPEKVPVSEV (PMEL_HUMAN)
MLPEKVPVSEL

SEQ ID NO: 142104 - protein, 10 aa, Artificial Sequence
  Description of Artificial Sequence: Synthetic peptide
  Seed: RALDGGNKHF (PMEL_HUMAN)
RKLDGGNKHY

SEQ ID NO: 142105 - protein, 9 aa, Artificial Sequence
  Description of Artificial Sequence: Synthetic peptide
  Seed: TATLRLVKR (PMEL_HUMAN)
TMTLRLVKR

SEQ ID NO: 142106 - protein, 10 aa, Artificial Sequence
  Description of Artificial Sequence: Synthetic peptide
  Seed: YVPLAHSSSA (PMEL_HUMAN)
YFPLAHSSSI

SEQ ID NO: 142107 - protein, 9 aa, Artificial Sequence
  Description of Artificial Sequence: Synthetic peptide
  Seed: SQVWGGQPV (PMEL_HUMAN)
SHVWGGQPV

SEQ ID NO: 142108 - protein, 9 aa, Artificial Sequence
  Description of Artificial Sequence: Synthetic peptide
  Seed: MTPEKVPVS (PMEL_HUMAN)
MAPEKVPVV

SEQ ID NO: 142109 - protein, 9 aa, Artificial Sequence
  Description of Artificial Sequence: Synthetic peptide
  Seed: KEACMEISS (PMEL_HUMAN)
KEACMEISM

SEQ ID NO: 142110 - protein, 10 aa, Artificial Sequence
  Description of Artificial Sequence: Synthetic peptide
  Seed: KRQVPLDCVL (PMEL_HUMAN)
KCQVPLDCVF

SEQ ID NO: 142111 - protein, 9 aa, Artificial Sequence
  Description of Artificial Sequence: Synthetic peptide
  Seed: LQAAIPLTS (PMEL_HUMAN)
LQAAIPLTF

SEQ ID NO: 142112 - protein, 8 aa, Artificial Sequence
  Description of Artificial Sequence: Synthetic peptide
  Seed: RELPIPEP (PMEL_HUMAN)
RDLPIPEI

SEQ ID NO: 142113 - protein, 10 aa, Artificial Sequence
  Description of Artificial Sequence: Synthetic peptide
  Seed: MTPAEVSIVV (PMEL_HUMAN)
MDPAEVSIVL

SEQ ID NO: 142114 - protein, 10 aa, Artificial Sequence
  Description of Artificial Sequence: Synthetic peptide
  Seed: RQVPLDCVLY (PMEL_HUMAN)
RKVPLDCVLY

SEQ ID NO: 142115 - protein, 10 aa, Artificial Sequence
  Description of Artificial Sequence: Synthetic peptide
  Seed: GPLLDGTATL (PMEL_HUMAN)
GILLDGTATM

SEQ ID NO: 142116 - protein, 10 aa, Artificial Sequence
  Description of Artificial Sequence: Synthetic peptide
  Seed: LIYRRRLMKQ (PMEL_HUMAN)
LTYRRRLMKK

SEQ ID NO: 142117 - protein, 10 aa, Artificial Sequence
  Description of Artificial Sequence: Synthetic peptide
  Seed: SVTLDIVQGI (PMEL_HUMAN)
SFTLDIVQGV

SEQ ID NO: 142118 - protein, 10 aa, Artificial Sequence
  Description of Artificial Sequence: Synthetic peptide
  Seed: YRYGSFSVTL (PMEL_HUMAN)
YWYGSFSVTM

SEQ ID NO: 142119 - protein, 8 aa, Artificial Sequence
  Description of Artificial Sequence: Synthetic peptide
  Seed: AEMSTPEA (PMEL_HUMAN)
AEMSTPEM

SEQ ID NO: 142120 - protein, 9 aa, Artificial Sequence
  Description of Artificial Sequence: Synthetic peptide
  Seed: SEVMGTTLA (PMEL_HUMAN)
SDVMGTTLL

SEQ ID NO: 142121 - protein, 9 aa, Artificial Sequence
  Description of Artificial Sequence: Synthetic peptide
  Seed: KVSNDGPTL (PMEL_HUMAN)
KTSNDGPTK

SEQ ID NO: 142122 - protein, 10 aa, Artificial Sequence
  Description of Artificial Sequence: Synthetic peptide
  Seed: NSLAVVSTQL (PMEL_HUMAN)
NFLAVVSTQI

SEQ ID NO: 142123 - protein, 9 aa, Artificial Sequence
  Description of Artificial Sequence: Synthetic peptide
  Seed: QGIESAEIL (PMEL_HUMAN)
QAIESAEIL

SEQ ID NO: 142124 - protein, 10 aa, Artificial Sequence
  Description of Artificial Sequence: Synthetic peptide
  Seed: TLISRALVVT (PMEL_HUMAN)
TMISRALVVA

SEQ ID NO: 142125 - protein, 9 aa, Artificial Sequence
  Description of Artificial Sequence: Synthetic peptide
  Seed: LSGTTAAQV (PMEL_HUMAN)
LLGTTAAQV

SEQ ID NO: 142126 - protein, 10 aa, Artificial Sequence
  Description of Artificial Sequence: Synthetic peptide
  Seed: GTATLRLVKR (PMEL_HUMAN)
GTATLRLVKK

SEQ ID NO: 142127 - protein, 10 aa, Artificial Sequence
  Description of Artificial Sequence: Synthetic peptide
  Seed: LMAVVLASLI (PMEL_HUMAN)
LMAVVLASLC

SEQ ID NO: 142128 - protein, 9 aa, Artificial Sequence
  Description of Artificial Sequence: Synthetic peptide
  Seed: QLVLHQILK (PMEL_HUMAN)
QVVLHQILR

SEQ ID NO: 142129 - protein, 9 aa, Artificial Sequence
  Description of Artificial Sequence: Synthetic peptide
  Seed: VLPDGQVIW (PMEL_HUMAN)
VSPDGQVIW

SEQ ID NO: 142130 - protein, 10 aa, Artificial Sequence
  Description of Artificial Sequence: Synthetic peptide
  Seed: YVWKTWGQYW (PMEL_HUMAN)
YQWKTWGQYF

SEQ ID NO: 142131 - protein, 10 aa, Artificial Sequence
  Description of Artificial Sequence: Synthetic peptide
  Seed: MKQDFSVPQL (PMEL_HUMAN)
MQQDFSVPQI

SEQ ID NO: 142132 - protein, 10 aa, Artificial Sequence
  Description of Artificial Sequence: Synthetic peptide
  Seed: GTYCLNVSLA (PMEL_HUMAN)
GLYCLNVSLV

SEQ ID NO: 142133 - protein, 9 aa, Artificial Sequence
  Description of Artificial Sequence: Synthetic peptide
  Seed: ISRALVVTH (PMEL_HUMAN)
IGRALVVTK

SEQ ID NO: 142134 - protein, 11 aa, Artificial Sequence
  Description of Artificial Sequence: Synthetic peptide
  Seed: RALDGGNKHFL (PMEL_HUMAN)
RFLDGGNKHFY

SEQ ID NO: 142135 - protein, 11 aa, Artificial Sequence
  Description of Artificial Sequence: Synthetic peptide
  Seed: YVPLAHSSSAF (PMEL_HUMAN)
YGPLAHSSSAF

SEQ ID NO: 142136 - protein, 10 aa, Artificial Sequence
  Description of Artificial Sequence: Synthetic peptide
  Seed: MSTESITGSL (PMEL_HUMAN)
MGTESITGSV

SEQ ID NO: 142137 - protein, 10 aa, Artificial Sequence
  Description of Artificial Sequence: Synthetic peptide
  Seed: WKTWGQYWQV (PMEL_HUMAN)
WMTWGQYWQV

SEQ ID NO: 142138 - protein, 9 aa, Artificial Sequence
  Description of Artificial Sequence: Synthetic peptide
  Seed: LNFPGSQKV (PMEL_HUMAN)
LVFPGSQKY

SEQ ID NO: 142139 - protein, 9 aa, Artificial Sequence
  Description of Artificial Sequence: Synthetic peptide
  Seed: MTPEKVPVS (PMEL_HUMAN)
MNPEKVPVL

SEQ ID NO: 142140 - protein, 9 aa, Artificial Sequence
  Description of Artificial Sequence: Synthetic peptide
  Seed: AVIGALLAV (PMEL_HUMAN)
AAIGALLAY

SEQ ID NO: 142141 - protein, 9 aa, Artificial Sequence
  Description of Artificial Sequence: Synthetic peptide
  Seed: SYVPLAHSS (PMEL_HUMAN)
SFVPLAHSI

SEQ ID NO: 142142 - protein, 8 aa, Artificial Sequence
  Description of Artificial Sequence: Synthetic peptide
  Seed: FGDSSGTL (PMEL_HUMAN)
FYDSSGTM

SEQ ID NO: 142143 - protein, 9 aa, Artificial Sequence
  Description of Artificial Sequence: Synthetic peptide
  Seed: YVWKTWGQY (PMEL_HUMAN)
YTWKTWGQK

SEQ ID NO: 142144 - protein, 9 aa, Artificial Sequence
  Description of Artificial Sequence: Synthetic peptide
  Seed: RAMLGTHTM (PMEL_HUMAN)
RPMLGTHTS

SEQ ID NO: 142145 - protein, 9 aa, Artificial Sequence
  Description of Artificial Sequence: Synthetic peptide
  Seed: SPLLSGQQV (PMEL_HUMAN)
SHLLSGQQV

SEQ ID NO: 142146 - protein, 9 aa, Artificial Sequence
  Description of Artificial Sequence: Synthetic peptide
  Seed: KVLPDGQVI (PMEL_HUMAN)
KVLPDGQVW

SEQ ID NO: 142147 - protein, 10 aa, Artificial Sequence
  Description of Artificial Sequence: Synthetic peptide
  Seed: LKVSNDGPTL (PMEL_HUMAN)
LKVSNDGPTF

SEQ ID NO: 142148 - protein, 9 aa, Artificial Sequence
  Description of Artificial Sequence: Synthetic peptide
  Seed: LSIGTGRAM (PMEL_HUMAN)
LHIGTGRAY

SEQ ID NO: 142149 - protein, 9 aa, Artificial Sequence
  Description of Artificial Sequence: Synthetic peptide
  Seed: RNQPLTFAL (PMEL_HUMAN)
RHQPLTFAM

SEQ ID NO: 142150 - protein, 9 aa, Artificial Sequence
  Description of Artificial Sequence: Synthetic peptide
  Seed: AEMSTPEAT (PMEL_HUMAN)
AQMSTPEAL

SEQ ID NO: 142151 - protein, 9 aa, Artificial Sequence
  Description of Artificial Sequence: Synthetic peptide
  Seed: RQVPLDCVL (PMEL_HUMAN)
RIVPLDCVF

SEQ ID NO: 142152 - protein, 10 aa, Artificial Sequence
  Description of Artificial Sequence: Synthetic peptide
  Seed: LADTNSLAVV (PMEL_HUMAN)
LVDTNSLAVF

SEQ ID NO: 142153 - protein, 9 aa, Artificial Sequence
  Description of Artificial Sequence: Synthetic peptide
  Seed: ALLAVGATK (PMEL_HUMAN)
AALAVGATR

SEQ ID NO: 142154 - protein, 9 aa, Artificial Sequence
  Description of Artificial Sequence: Synthetic peptide
  Seed: TPAEVSIVV (PMEL_HUMAN)
TSAEVSIVF

SEQ ID NO: 142155 - protein, 10 aa, Artificial Sequence
  Description of Artificial Sequence: Synthetic peptide
  Seed: EVISTAPVQM (PMEL_HUMAN)
EQISTAPVQY

SEQ ID NO: 142156 - protein, 10 aa, Artificial Sequence
  Description of Artificial Sequence: Synthetic peptide
  Seed: AVPSGEGDAF (PMEL_HUMAN)
ASPSGEGDAL

SEQ ID NO: 142157 - protein, 9 aa, Artificial Sequence
  Description of Artificial Sequence: Synthetic peptide
  Seed: FTITDQVPF (PMEL_HUMAN)
FLITDQVPM

SEQ ID NO: 142158 - protein, 9 aa, Artificial Sequence
  Description of Artificial Sequence: Synthetic peptide
  Seed: AQVVLQAAI (PMEL_HUMAN)
ALVVLQAAI

SEQ ID NO: 142159 - protein, 9 aa, Artificial Sequence
  Description of Artificial Sequence: Synthetic peptide
  Seed: VPLAHSSSA (PMEL_HUMAN)
VHLAHSSSV

SEQ ID NO: 142160 - protein, 9 aa, Artificial Sequence
  Description of Artificial Sequence: Synthetic peptide
  Seed: FTITDQVPF (PMEL_HUMAN)
FKITDQVPI

SEQ ID NO: 142161 - protein, 9 aa, Artificial Sequence
  Description of Artificial Sequence: Synthetic peptide
  Seed: IYRRRLMKQ (PMEL_HUMAN)
IQRRRLMKK

SEQ ID NO: 142162 - protein, 10 aa, Artificial Sequence
  Description of Artificial Sequence: Synthetic peptide
  Seed: YVPLAHSSSA (PMEL_HUMAN)
YGPLAHSSSL

SEQ ID NO: 142163 - protein, 9 aa, Artificial Sequence
  Description of Artificial Sequence: Synthetic peptide
  Seed: IESAEILQA (PMEL_HUMAN)
IDSAEILQL

SEQ ID NO: 142164 - protein, 9 aa, Artificial Sequence
  Description of Artificial Sequence: Synthetic peptide
  Seed: VTLDIVQGI (PMEL_HUMAN)
VVLDIVQGF

SEQ ID NO: 142165 - protein, 10 aa, Artificial Sequence
  Description of Artificial Sequence: Synthetic peptide
  Seed: MAVVLASLIY (PMEL_HUMAN)
MGVVLASLIY

SEQ ID NO: 142166 - protein, 9 aa, Artificial Sequence
  Description of Artificial Sequence: Synthetic peptide
  Seed: KVLPDGQVI (PMEL_HUMAN)
KTLPDGQVL

SEQ ID NO: 142167 - protein, 10 aa, Artificial Sequence
  Description of Artificial Sequence: Synthetic peptide
  Seed: THTMEVTVYH (PMEL_HUMAN)
TSTMEVTVYR

SEQ ID NO: 142168 - protein, 10 aa, Artificial Sequence
  Description of Artificial Sequence: Synthetic peptide
  Seed: SVPQLPHSSS (PMEL_HUMAN)
SKPQLPHSSI

SEQ ID NO: 142169 - protein, 9 aa, Artificial Sequence
  Description of Artificial Sequence: Synthetic peptide
  Seed: ISRALVVTH (PMEL_HUMAN)
ISRALVVTF

SEQ ID NO: 142170 - protein, 9 aa, Artificial Sequence
  Description of Artificial Sequence: Synthetic peptide
  Seed: TVYHRRGSR (PMEL_HUMAN)
TVYHRRGSK

SEQ ID NO: 142171 - protein, 10 aa, Artificial Sequence
  Description of Artificial Sequence: Synthetic peptide
  Seed: GLSIGTGRAM (PMEL_HUMAN)
GASIGTGRAF

SEQ ID NO: 142172 - protein, 9 aa, Artificial Sequence
  Description of Artificial Sequence: Synthetic peptide
  Seed: MLGTHTMEV (PMEL_HUMAN)
MTGTHTMEM

SEQ ID NO: 142173 - protein, 8 aa, Artificial Sequence
  Description of Artificial Sequence: Synthetic peptide
  Seed: SNDGPTLI (PMEL_HUMAN)
SLDGPTLL

SEQ ID NO: 142174 - protein, 9 aa, Artificial Sequence
  Description of Artificial Sequence: Synthetic peptide
  Seed: VLPSPACQL (PMEL_HUMAN)
VLPSPACQV

SEQ ID NO: 142175 - protein, 10 aa, Artificial Sequence
  Description of Artificial Sequence: Synthetic peptide
  Seed: RALDGGNKHF (PMEL_HUMAN)
RQLDGGNKHI

SEQ ID NO: 142176 - protein, 9 aa, Artificial Sequence
  Description of Artificial Sequence: Synthetic peptide
  Seed: AEPSGTTSV (PMEL_HUMAN)
ASPSGTTSY

SEQ ID NO: 142177 - protein, 10 aa, Artificial Sequence
  Description of Artificial Sequence: Synthetic peptide
  Seed: MTPAEVSIVV (PMEL_HUMAN)
MNPAEVSIVV

SEQ ID NO: 142178 - protein, 10 aa, Artificial Sequence
  Description of Artificial Sequence: Synthetic peptide
  Seed: RTKAWNRQLY (PMEL_HUMAN)
RVKAWNRQLY

SEQ ID NO: 142179 - protein, 10 aa, Artificial Sequence
  Description of Artificial Sequence: Synthetic peptide
  Seed: RQLYPEWTEA (PMEL_HUMAN)
RMLYPEWTEF

SEQ ID NO: 142180 - protein, 10 aa, Artificial Sequence
  Description of Artificial Sequence: Synthetic peptide
  Seed: GYLAEADLSY (PMEL_HUMAN)
GKLAEADLSY

SEQ ID NO: 142181 - protein, 9 aa, Artificial Sequence
  Description of Artificial Sequence: Synthetic peptide
  Seed: VSRQLRTKA (PMEL_HUMAN)
VSRQLRTKK

SEQ ID NO: 142182 - protein, 10 aa, Artificial Sequence
  Description of Artificial Sequence: Synthetic peptide
  Seed: VSLADTNSLA (PMEL_HUMAN)
VNLADTNSLV

SEQ ID NO: 142183 - protein, 10 aa, Artificial Sequence
  Description of Artificial Sequence: Synthetic peptide
  Seed: GPLLDGTATL (PMEL_HUMAN)
GLLLDGTATV

SEQ ID NO: 142184 - protein, 10 aa, Artificial Sequence
  Description of Artificial Sequence: Synthetic peptide
  Seed: MTPAEVSIVV (PMEL_HUMAN)
MFPAEVSIVF

SEQ ID NO: 142185 - protein, 10 aa, Artificial Sequence
  Description of Artificial Sequence: Synthetic peptide
  Seed: AVIGALLAVG (PMEL_HUMAN)
AMIGALLAVI

SEQ ID NO: 142186 - protein, 9 aa, Artificial Sequence
  Description of Artificial Sequence: Synthetic peptide
  Seed: QLVLHQILK (PMEL_HUMAN)
QSVLHQILR

SEQ ID NO: 142187 - protein, 9 aa, Artificial Sequence
  Description of Artificial Sequence: Synthetic peptide
  Seed: SGEGDAFEL (PMEL_HUMAN)
SIEGDAFEM

SEQ ID NO: 142188 - protein, 9 aa, Artificial Sequence
  Description of Artificial Sequence: Synthetic peptide
  Seed: GSWSQKRSF (PMEL_HUMAN)
GLWSQKRSY

SEQ ID NO: 142189 - protein, 10 aa, Artificial Sequence
  Description of Artificial Sequence: Synthetic peptide
  Seed: ASSIMSTESI (PMEL_HUMAN)
ACSIMSTESW

SEQ ID NO: 142190 - protein, 9 aa, Artificial Sequence
  Description of Artificial Sequence: Synthetic peptide
  Seed: HTMEVTVYH (PMEL_HUMAN)
HMMEVTVYV

SEQ ID NO: 142191 - protein, 10 aa, Artificial Sequence
  Description of Artificial Sequence: Synthetic peptide
  Seed: SVPQLPHSSS (PMEL_HUMAN)
SQPQLPHSSM

SEQ ID NO: 142192 - protein, 9 aa, Artificial Sequence
  Description of Artificial Sequence: Synthetic peptide
  Seed: SAFTITDQV (PMEL_HUMAN)
SAFTITDQF

SEQ ID NO: 142193 - protein, 9 aa, Artificial Sequence
  Description of Artificial Sequence: Synthetic peptide
  Seed: WQVLGGPVS (PMEL_HUMAN)
WKVLGGPVF

SEQ ID NO: 142194 - protein, 9 aa, Artificial Sequence
  Description of Artificial Sequence: Synthetic peptide
  Seed: ESAEILQAV (PMEL_HUMAN)
ELAEILQAL

SEQ ID NO: 142195 - protein, 9 aa, Artificial Sequence
  Description of Artificial Sequence: Synthetic peptide
  Seed: DQVPFSVSV (PMEL_HUMAN)
DRVPFSVSA

SEQ ID NO: 142196 - protein, 8 aa, Artificial Sequence
  Description of Artificial Sequence: Synthetic peptide
  Seed: AEMSTPEA (PMEL_HUMAN)
AEMSTPEV

SEQ ID NO: 142197 - protein, 9 aa, Artificial Sequence
  Description of Artificial Sequence: Synthetic peptide
  Seed: KQDFSVPQL (PMEL_HUMAN)
KFDFSVPQV

SEQ ID NO: 142198 - protein, 10 aa, Artificial Sequence
  Description of Artificial Sequence: Synthetic peptide
  Seed: KTWGQYWQVL (PMEL_HUMAN)
KMWGQYWQVH

SEQ ID NO: 142199 - protein, 10 aa, Artificial Sequence
  Description of Artificial Sequence: Synthetic peptide
  Seed: FSVSVSQLRA (PMEL_HUMAN)
FLVSVSQLRR

SEQ ID NO: 142200 - protein, 9 aa, Artificial Sequence
  Description of Artificial Sequence: Synthetic peptide
  Seed: VTAQVVLQA (PMEL_HUMAN)
VIAQVVLQL

SEQ ID NO: 142201 - protein, 9 aa, Artificial Sequence
  Description of Artificial Sequence: Synthetic peptide
  Seed: AEVSIVVLS (PMEL_HUMAN)
AEVSIVVLL

SEQ ID NO: 142202 - protein, 10 aa, Artificial Sequence
  Description of Artificial Sequence: Synthetic peptide
  Seed: VPLAHSSSAF (PMEL_HUMAN)
VQLAHSSSAL

SEQ ID NO: 142203 - protein, 10 aa, Artificial Sequence
  Description of Artificial Sequence: Synthetic peptide
  Seed: WKTWGQYWQV (PMEL_HUMAN)
WMTWGQYWQL

SEQ ID NO: 142204 - protein, 10 aa, Artificial Sequence
  Description of Artificial Sequence: Synthetic peptide
  Seed: YVPLAHSSSA (PMEL_HUMAN)
YQPLAHSSSA

SEQ ID NO: 142205 - protein, 9 aa, Artificial Sequence
  Description of Artificial Sequence: Synthetic peptide
  Seed: AAIPLTSCG (PMEL_HUMAN)
AAIPLTSCH

SEQ ID NO: 142206 - protein, 9 aa, Artificial Sequence
  Description of Artificial Sequence: Synthetic peptide
  Seed: VTAQVVLQA (PMEL_HUMAN)
VMAQVVLQV

SEQ ID NO: 142207 - protein, 9 aa, Artificial Sequence
  Description of Artificial Sequence: Synthetic peptide
  Seed: GQVPLIVGI (PMEL_HUMAN)
GAVPLIVGV

SEQ ID NO: 142208 - protein, 9 aa, Artificial Sequence
  Description of Artificial Sequence: Synthetic peptide
  Seed: ITDQVPFSV (PMEL_HUMAN)
IVDQVPFSW

SEQ ID NO: 142209 - protein, 9 aa, Artificial Sequence
  Description of Artificial Sequence: Synthetic peptide
  Seed: WQVLGGPVS (PMEL_HUMAN)
WQVLGGPVF

SEQ ID NO: 142210 - protein, 9 aa, Artificial Sequence
  Description of Artificial Sequence: Synthetic peptide
  Seed: GSRSYVPLA (PMEL_HUMAN)
GTRSYVPLM

SEQ ID NO: 142211 - protein, 10 aa, Artificial Sequence
  Description of Artificial Sequence: Synthetic peptide
  Seed: VSLADTNSLA (PMEL_HUMAN)
VYLADTNSLI

SEQ ID NO: 142212 - protein, 11 aa, Artificial Sequence
  Description of Artificial Sequence: Synthetic peptide
  Seed: HQILKGGSGTY (PMEL_HUMAN)
HHILKGGSGTY

SEQ ID NO: 142213 - protein, 9 aa, Artificial Sequence
  Description of Artificial Sequence: Synthetic peptide
  Seed: HLAVIGALL (PMEL_HUMAN)
HMAVIGALL

SEQ ID NO: 142214 - protein, 9 aa, Artificial Sequence
  Description of Artificial Sequence: Synthetic peptide
  Seed: TIINGSQVW (PMEL_HUMAN)
TSINGSQVW

SEQ ID NO: 142215 - protein, 11 aa, Artificial Sequence
  Description of Artificial Sequence: Synthetic peptide
  Seed: LGPLLDGTATL (PMEL_HUMAN)
LHPLLDGTATI

SEQ ID NO: 142216 - protein, 9 aa, Artificial Sequence
  Description of Artificial Sequence: Synthetic peptide
  Seed: FGDSSGTLI (PMEL_HUMAN)
FWDSSGTLM

SEQ ID NO: 142217 - protein, 9 aa, Artificial Sequence
  Description of Artificial Sequence: Synthetic peptide
  Seed: KTWGQYWQV (PMEL_HUMAN)
KLWGQYWQK

SEQ ID NO: 142218 - protein, 9 aa, Artificial Sequence
  Description of Artificial Sequence: Synthetic peptide
  Seed: ISRALVVTH (PMEL_HUMAN)
IVRALVVTK

SEQ ID NO: 142219 - protein, 9 aa, Artificial Sequence
  Description of Artificial Sequence: Synthetic peptide
  Seed: FTITDQVPF (PMEL_HUMAN)
FMITDQVPY

SEQ ID NO: 142220 - protein, 10 aa, Artificial Sequence
  Description of Artificial Sequence: Synthetic peptide
  Seed: LVLKRCLLHL (PMEL_HUMAN)
LTLKRCLLHV

SEQ ID NO: 142221 - protein, 10 aa, Artificial Sequence
  Description of Artificial Sequence: Synthetic peptide
  Seed: VPLAHSSSAF (PMEL_HUMAN)
VMLAHSSSAL

SEQ ID NO: 142222 - protein, 8 aa, Homo sapiens
  Native (PMEL_HUMAN)
AQVTTTEW

SEQ ID NO: 142223 - protein, 10 aa, Homo sapiens
  Native (PMEL_HUMAN)
EVVGTTPGQA

SEQ ID NO: 142224 - protein, 9 aa, Homo sapiens
  Native (PMEL_HUMAN)
GSRSYVPLA

SEQ ID NO: 142225 - protein, 8 aa, Homo sapiens
  Native (PMEL_HUMAN)
QLVLHQIL

SEQ ID NO: 142226 - protein, 9 aa, Homo sapiens
  Native (PMEL_HUMAN)
VPTTEVIST

SEQ ID NO: 142227 - protein, 9 aa, Homo sapiens
  Native (PMEL_HUMAN)
VSEVMGTTL

SEQ ID NO: 142228 - protein, 10 aa, Homo sapiens
  Native (PMEL_HUMAN)
VPTTEVISTA

SEQ ID NO: 142229 - protein, 10 aa, Homo sapiens
  Native (PMEL_HUMAN)
TTEWVETTAR

SEQ ID NO: 142230 - protein, 9 aa, Homo sapiens
  Native (PMEL_HUMAN)
ARELPIPEP

SEQ ID NO: 142231 - protein, 9 aa, Homo sapiens
  Native (PMEL_HUMAN)
STGMTPEKV

SEQ ID NO: 142232 - protein, 10 aa, Homo sapiens
  Native (PMEL_HUMAN)
ATLRLVKRQV

SEQ ID NO: 142233 - protein, 9 aa, Homo sapiens
  Native (PMEL_HUMAN)
KAWNRQLYP

SEQ ID NO: 142234 - protein, 10 aa, Homo sapiens
  Native (PMEL_HUMAN)
VLMAVVLASL

SEQ ID NO: 142235 - protein, 10 aa, Homo sapiens
  Native (PMEL_HUMAN)
WSQKRSFVYV

SEQ ID NO: 142236 - protein, 11 aa, Homo sapiens
  Native (PMEL_HUMAN)
GPVSGLSIGTG

SEQ ID NO: 142237 - protein, 9 aa, Homo sapiens
  Native (PMEL_HUMAN)
QLRTKAWNR

SEQ ID NO: 142238 - protein, 11 aa, Homo sapiens
  Native (PMEL_HUMAN)
FELTVSCQGGL

SEQ ID NO: 142239 - protein, 9 aa, Homo sapiens
  Native (PMEL_HUMAN)
SIGTGRAML

SEQ ID NO: 142240 - protein, 11 aa, Homo sapiens
  Native (PMEL_HUMAN)
ALNFPGSQKVL

SEQ ID NO: 142241 - protein, 9 aa, Homo sapiens
  Native (PMEL_HUMAN)
QLPHSSSHW

SEQ ID NO: 142242 - protein, 10 aa, Homo sapiens
  Native (PMEL_HUMAN)
EVISTAPVQM

SEQ ID NO: 142243 - protein, 10 aa, Homo sapiens
  Native (PMEL_HUMAN)
MSTESITGSL

SEQ ID NO: 142244 - protein, 9 aa, Homo sapiens
  Native (PMEL_HUMAN)
KEACMEISS

SEQ ID NO: 142245 - protein, 11 aa, Homo sapiens
  Native (PMEL_HUMAN)
RYGSFSVTLDI

SEQ ID NO: 142246 - protein, 9 aa, Homo sapiens
  Native (PMEL_HUMAN)
SRALVVTHT

SEQ ID NO: 142247 - protein, 10 aa, Homo sapiens
  Native (PMEL_HUMAN)
TYLEPGPVTA

SEQ ID NO: 142248 - protein, 9 aa, Homo sapiens
  Native (PMEL_HUMAN)
RGGQVSLKV

SEQ ID NO: 142249 - protein, 11 aa, Homo sapiens
  Native (PMEL_HUMAN)
AEMSTPEATGM

SEQ ID NO: 142250 - protein, 11 aa, Homo sapiens
  Native (PMEL_HUMAN)
RNQPLTFALQL

SEQ ID NO: 142251 - protein, 8 aa, Homo sapiens
  Native (PMEL_HUMAN)
VPLIVGIL

SEQ ID NO: 142252 - protein, 9 aa, Homo sapiens
  Native (PMEL_HUMAN)
VVLQAAIPL

SEQ ID NO: 142253 - protein, 10 aa, Homo sapiens
  Native (PMEL_HUMAN)
LIYRRRLMKQ

SEQ ID NO: 142254 - protein, 9 aa, Homo sapiens
  Native (PMEL_HUMAN)
EAQRLDCWR

SEQ ID NO: 142255 - protein, 8 aa, Homo sapiens
  Native (PMEL_HUMAN)
LADTNSLA

SEQ ID NO: 142256 - protein, 9 aa, Homo sapiens
  Native (PMEL_HUMAN)
SYVPLAHSS

SEQ ID NO: 142257 - protein, 10 aa, Homo sapiens
  Native (PMEL_HUMAN)
MAVVLASLIY

SEQ ID NO: 142258 - protein, 10 aa, Homo sapiens
  Native (PMEL_HUMAN)
RALVVTHTYL

SEQ ID NO: 142259 - protein, 8 aa, Homo sapiens
  Native (PMEL_HUMAN)
LIYRRRLM

SEQ ID NO: 142260 - protein, 9 aa, Homo sapiens
  Native (PMEL_HUMAN)
GLGQVPLIV

SEQ ID NO: 142261 - protein, 10 aa, Homo sapiens
  Native (PMEL_HUMAN)
VLYRYGSFSV

SEQ ID NO: 142262 - protein, 9 aa, Homo sapiens
  Native (PMEL_HUMAN)
LPIPEPEGP

SEQ ID NO: 142263 - protein, 9 aa, Homo sapiens
  Native (PMEL_HUMAN)
LLAVGATKV

SEQ ID NO: 142264 - protein, 10 aa, Homo sapiens
  Native (PMEL_HUMAN)
NSLAVVSTQL

SEQ ID NO: 142265 - protein, 10 aa, Homo sapiens
  Native (PMEL_HUMAN)
SAEILQAVPS

SEQ ID NO: 142266 - protein, 8 aa, Homo sapiens
  Native (PMEL_HUMAN)
TEVISTAP

SEQ ID NO: 142267 - protein, 9 aa, Homo sapiens
  Native (PMEL_HUMAN)
MTPEKVPVS

SEQ ID NO: 142268 - protein, 10 aa, Homo sapiens
  Native (PMEL_HUMAN)
CQLVLHQILK

SEQ ID NO: 142269 - protein, 10 aa, Homo sapiens
  Native (PMEL_HUMAN)
GLSIGTGRAM

SEQ ID NO: 142270 - protein, 11 aa, Homo sapiens
  Native (PMEL_HUMAN)
SPGCQPPAQRL

SEQ ID NO: 142271 - protein, 8 aa, Homo sapiens
  Native (PMEL_HUMAN)
APVQMPTA

SEQ ID NO: 142272 - protein, 9 aa, Homo sapiens
  Native (PMEL_HUMAN)
VWKTWGQYW

SEQ ID NO: 142273 - protein, 10 aa, Homo sapiens
  Native (PMEL_HUMAN)
YLAEADLSYT

SEQ ID NO: 142274 - protein, 9 aa, Homo sapiens
  Native (PMEL_HUMAN)
PEATGMTPA

SEQ ID NO: 142275 - protein, 10 aa, Homo sapiens
  Native (PMEL_HUMAN)
RPTAEAPNTT

SEQ ID NO: 142276 - protein, 11 aa, Homo sapiens
  Native (PMEL_HUMAN)
NQDWLGVSRQL

SEQ ID NO: 142277 - protein, 9 aa, Homo sapiens
  Native (PMEL_HUMAN)
KRSFVYVWK

SEQ ID NO: 142278 - protein, 9 aa, Homo sapiens
  Native (PMEL_HUMAN)
ESTGMTPEK

SEQ ID NO: 142279 - protein, 8 aa, Homo sapiens
  Native (PMEL_HUMAN)
TYLEPGPV

SEQ ID NO: 142280 - protein, 11 aa, Homo sapiens
  Native (PMEL_HUMAN)
TTAAQVTTTEW

SEQ ID NO: 142281 - protein, 8 aa, Homo sapiens
  Native (PMEL_HUMAN)
LAVGATKV

SEQ ID NO: 142282 - protein, 8 aa, Homo sapiens
  Native (PMEL_HUMAN)
YGSFSVTL

SEQ ID NO: 142283 - protein, 10 aa, Homo sapiens
  Native (PMEL_HUMAN)
TLAEMSTPEA

SEQ ID NO: 142284 - protein, 8 aa, Homo sapiens
  Native (PMEL_HUMAN)
HRRGSRSY

SEQ ID NO: 142285 - protein, 10 aa, Homo sapiens
  Native (PMEL_HUMAN)
VSGLSIGTGR

SEQ ID NO: 142286 - protein, 9 aa, Homo sapiens
  Native (PMEL_HUMAN)
LPSPACQLV

SEQ ID NO: 142287 - protein, 10 aa, Homo sapiens
  Native (PMEL_HUMAN)
ALNFPGSQKV

SEQ ID NO: 142288 - protein, 9 aa, Homo sapiens
  Native (PMEL_HUMAN)
GSFSVTLDI

SEQ ID NO: 142289 - protein, 8 aa, Homo sapiens
  Native (PMEL_HUMAN)
QVPLIVGI

SEQ ID NO: 142290 - protein, 9 aa, Homo sapiens
  Native (PMEL_HUMAN)
RNQPLTFAL

SEQ ID NO: 142291 - protein, 9 aa, Homo sapiens
  Native (PMEL_HUMAN)
MLGTHTMEV

SEQ ID NO: 142292 - protein, 10 aa, Homo sapiens
  Native (PMEL_HUMAN)
NQPLTFALQL

SEQ ID NO: 142293 - protein, 11 aa, Homo sapiens
  Native (PMEL_HUMAN)
HFLRNQPLTFA

SEQ ID NO: 142294 - protein, 9 aa, Homo sapiens
  Native (PMEL_HUMAN)
QKRSFVYVW

SEQ ID NO: 142295 - protein, 9 aa, Homo sapiens
  Native (PMEL_HUMAN)
SVQVPTTEV

SEQ ID NO: 142296 - protein, 9 aa, Homo sapiens
  Native (PMEL_HUMAN)
RALDGGNKH

SEQ ID NO: 142297 - protein, 11 aa, Homo sapiens
  Native (PMEL_HUMAN)
WDFGDSSGTLI

SEQ ID NO: 142298 - protein, 10 aa, Homo sapiens
  Native (PMEL_HUMAN)
APVQMPTAES

SEQ ID NO: 142299 - protein, 11 aa, Homo sapiens
  Native (PMEL_HUMAN)
IMSTESITGSL

SEQ ID NO: 142300 - protein, 11 aa, Homo sapiens
  Native (PMEL_HUMAN)
VYPQETDDACI

SEQ ID NO: 142301 - protein, 8 aa, Homo sapiens
  Native (PMEL_HUMAN)
AESTGMTP

SEQ ID NO: 142302 - protein, 11 aa, Homo sapiens
  Native (PMEL_HUMAN)
HLAVIGALLAV

SEQ ID NO: 142303 - protein, 10 aa, Homo sapiens
  Native (PMEL_HUMAN)
TSVQVPTTEV

SEQ ID NO: 142304 - protein, 9 aa, Homo sapiens
  Native (PMEL_HUMAN)
DGTATLRLV

SEQ ID NO: 142305 - protein, 10 aa, Homo sapiens
  Native (PMEL_HUMAN)
AWNRQLYPEW

SEQ ID NO: 142306 - protein, 11 aa, Homo sapiens
  Native (PMEL_HUMAN)
MLGTHTMEVTV

SEQ ID NO: 142307 - protein, 9 aa, Homo sapiens
  Native (PMEL_HUMAN)
DIVQGIESA

SEQ ID NO: 142308 - protein, 9 aa, Homo sapiens
  Native (PMEL_HUMAN)
MTPAEVSIV

SEQ ID NO: 142309 - protein, 10 aa, Homo sapiens
  Native (PMEL_HUMAN)
VTAQVVLQAA

SEQ ID NO: 142310 - protein, 9 aa, Homo sapiens
  Native (PMEL_HUMAN)
QLYPEWTEA

SEQ ID NO: 142311 - protein, 11 aa, Homo sapiens
  Native (PMEL_HUMAN)
MEISSPGCQPP

SEQ ID NO: 142312 - protein, 9 aa, Homo sapiens
  Native (PMEL_HUMAN)
SQVWGGQPV

SEQ ID NO: 142313 - protein, 9 aa, Homo sapiens
  Native (PMEL_HUMAN)
ANASFSIAL

SEQ ID NO: 142314 - protein, 11 aa, Homo sapiens
  Native (PMEL_HUMAN)
ISRALVVTHTY

SEQ ID NO: 142315 - protein, 9 aa, Homo sapiens
  Native (PMEL_HUMAN)
SPGCQPPAQ

SEQ ID NO: 142316 - protein, 11 aa, Homo sapiens
  Native (PMEL_HUMAN)
VWKTWGQYWQV

SEQ ID NO: 142317 - protein, 10 aa, Homo sapiens
  Native (PMEL_HUMAN)
AVPSGEGDAF

SEQ ID NO: 142318 - protein, 10 aa, Homo sapiens
  Native (PMEL_HUMAN)
LGQVPLIVGI

SEQ ID NO: 142319 - protein, 11 aa, Homo sapiens
  Native (PMEL_HUMAN)
VSLADTNSLAV

SEQ ID NO: 142320 - protein, 10 aa, Homo sapiens
  Native (PMEL_HUMAN)
AEADLSYTWD

SEQ ID NO: 142321 - protein, 11 aa, Homo sapiens
  Native (PMEL_HUMAN)
YRYGSFSVTLD

SEQ ID NO: 142322 - protein, 8 aa, Homo sapiens
  Native (PMEL_HUMAN)
FPGSQKVL

SEQ ID NO: 142323 - protein, 10 aa, Homo sapiens
  Native (PMEL_HUMAN)
SVTLDIVQGI

SEQ ID NO: 142324 - protein, 11 aa, Homo sapiens
  Native (PMEL_HUMAN)
TLRLVKRQVPL

SEQ ID NO: 142325 - protein, 11 aa, Homo sapiens
  Native (PMEL_HUMAN)
YPQETDDACIF

SEQ ID NO: 142326 - protein, 10 aa, Homo sapiens
  Native (PMEL_HUMAN)
PEKVPVSEVM

SEQ ID NO: 142327 - protein, 11 aa, Homo sapiens
  Native (PMEL_HUMAN)
CVLYRYGSFSV

SEQ ID NO: 142328 - protein, 11 aa, Homo sapiens
  Native (PMEL_HUMAN)
DGTATLRLVKR

SEQ ID NO: 142329 - protein, 8 aa, Homo sapiens
  Native (PMEL_HUMAN)
LAVVSTQL

SEQ ID NO: 142330 - protein, 9 aa, Homo sapiens
  Native (PMEL_HUMAN)
QLVLHQILK

SEQ ID NO: 142331 - protein, 8 aa, Homo sapiens
  Native (PMEL_HUMAN)
RQLRTKAW

SEQ ID NO: 142332 - protein, 11 aa, Homo sapiens
  Native (PMEL_HUMAN)
RRRLMKQDFSV

SEQ ID NO: 142333 - protein, 8 aa, Homo sapiens
  Native (PMEL_HUMAN)
SHWLRLPR

SEQ ID NO: 142334 - protein, 10 aa, Homo sapiens
  Native (PMEL_HUMAN)
VLPSPACQLV

SEQ ID NO: 142335 - protein, 10 aa, Homo sapiens
  Native (PMEL_HUMAN)
HLAVIGALLA

SEQ ID NO: 142336 - protein, 9 aa, Homo sapiens
  Native (PMEL_HUMAN)
SEVMGTTLA

SEQ ID NO: 142337 - protein, 11 aa, Homo sapiens
  Native (PMEL_HUMAN)
VLKRCLLHLAV

SEQ ID NO: 142338 - protein, 8 aa, Homo sapiens
  Native (PMEL_HUMAN)
LGGPVSGL

SEQ ID NO: 142339 - protein, 9 aa, Homo sapiens
  Native (PMEL_HUMAN)
ATGMTPAEV

SEQ ID NO: 142340 - protein, 9 aa, Homo sapiens
  Native (PMEL_HUMAN)
QETDDACIF

SEQ ID NO: 142341 - protein, 10 aa, Homo sapiens
  Native (PMEL_HUMAN)
ATKVPRNQDW

SEQ ID NO: 142342 - protein, 9 aa, Homo sapiens
  Native (PMEL_HUMAN)
MDLVLKRCL

SEQ ID NO: 142343 - protein, 11 aa, Homo sapiens
  Native (PMEL_HUMAN)
GYLAEADLSYT

SEQ ID NO: 142344 - protein, 9 aa, Homo sapiens
  Native (PMEL_HUMAN)
FPGSQKVLP

SEQ ID NO: 142345 - protein, 10 aa, Homo sapiens
  Native (PMEL_HUMAN)
AEAPNTTAGQ

SEQ ID NO: 142346 - protein, 9 aa, Homo sapiens
  Native (PMEL_HUMAN)
CQPPAQRLC

SEQ ID NO: 142347 - protein, 8 aa, Homo sapiens
  Native (PMEL_HUMAN)
GPVSGLSI

SEQ ID NO: 142348 - protein, 9 aa, Homo sapiens
  Native (PMEL_HUMAN)
LYPEWTEAQ

SEQ ID NO: 142349 - protein, 11 aa, Homo sapiens
  Native (PMEL_HUMAN)
AEADLSYTWDF

SEQ ID NO: 142350 - protein, 11 aa, Homo sapiens
  Native (PMEL_HUMAN)
QLIMPGQEAGL

SEQ ID NO: 142351 - protein, 11 aa, Homo sapiens
  Native (PMEL_HUMAN)
GATKVPRNQDW

SEQ ID NO: 142352 - protein, 9 aa, Homo sapiens
  Native (PMEL_HUMAN)
FSVSVSQLR

SEQ ID NO: 142353 - protein, 9 aa, Homo sapiens
  Native (PMEL_HUMAN)
LVLKRCLLH

SEQ ID NO: 142354 - protein, 8 aa, Homo sapiens
  Native (PMEL_HUMAN)
EVTVYHRR

SEQ ID NO: 142355 - protein, 10 aa, Homo sapiens
  Native (PMEL_HUMAN)
YPEWTEAQRL

SEQ ID NO: 142356 - protein, 10 aa, Homo sapiens
  Native (PMEL_HUMAN)
SITGSLGPLL

SEQ ID NO: 142357 - protein, 9 aa, Homo sapiens
  Native (PMEL_HUMAN)
ADLSYTWDF

SEQ ID NO: 142358 - protein, 8 aa, Homo sapiens
  Native (PMEL_HUMAN)
FSVPQLPH

SEQ ID NO: 142359 - protein, 9 aa, Homo sapiens
  Native (PMEL_HUMAN)
NDGPTLIGA

SEQ ID NO: 142360 - protein, 11 aa, Homo sapiens
  Native (PMEL_HUMAN)
SQLRALDGGNK

SEQ ID NO: 142361 - protein, 11 aa, Homo sapiens
  Native (PMEL_HUMAN)
LVLMAVVLASL

SEQ ID NO: 142362 - protein, 10 aa, Homo sapiens
  Native (PMEL_HUMAN)
HFLRNQPLTF

SEQ ID NO: 142363 - protein, 9 aa, Homo sapiens
  Native (PMEL_HUMAN)
ALVVTHTYL

SEQ ID NO: 142364 - protein, 11 aa, Homo sapiens
  Native (PMEL_HUMAN)
SPACQLVLHQI

SEQ ID NO: 142365 - protein, 9 aa, Homo sapiens
  Native (PMEL_HUMAN)
GLSIGTGRA

SEQ ID NO: 142366 - protein, 11 aa, Homo sapiens
  Native (PMEL_HUMAN)
RPTAEAPNTTA

SEQ ID NO: 142367 - protein, 10 aa, Homo sapiens
  Native (PMEL_HUMAN)
AESTGMTPEK

SEQ ID NO: 142368 - protein, 11 aa, Homo sapiens
  Native (PMEL_HUMAN)
SRALVVTHTYL

SEQ ID NO: 142369 - protein, 9 aa, Homo sapiens
  Native (PMEL_HUMAN)
PEWTEAQRL

SEQ ID NO: 142370 - protein, 9 aa, Homo sapiens
  Native (PMEL_HUMAN)
SSPGCQPPA

SEQ ID NO: 142371 - protein, 11 aa, Homo sapiens
  Native (PMEL_HUMAN)
QLYPEWTEAQR

SEQ ID NO: 142372 - protein, 9 aa, Homo sapiens
  Native (PMEL_HUMAN)
VSLADTNSL

SEQ ID NO: 142373 - protein, 8 aa, Homo sapiens
  Native (PMEL_HUMAN)
HFLRNQPL

SEQ ID NO: 142374 - protein, 10 aa, Homo sapiens
  Native (PMEL_HUMAN)
EMSTPEATGM

SEQ ID NO: 142375 - protein, 11 aa, Homo sapiens
  Native (PMEL_HUMAN)
WSQKRSFVYVW

SEQ ID NO: 142376 - protein, 8 aa, Homo sapiens
  Native (PMEL_HUMAN)
ITGSLGPL

SEQ ID NO: 142377 - protein, 9 aa, Homo sapiens
  Native (PMEL_HUMAN)
GTYCLNVSL

SEQ ID NO: 142378 - protein, 11 aa, Homo sapiens
  Native (PMEL_HUMAN)
LRNQPLTFALQ

SEQ ID NO: 142379 - protein, 8 aa, Homo sapiens
  Native (PMEL_HUMAN)
FGDSSGTL

SEQ ID NO: 142380 - protein, 9 aa, Homo sapiens
  Native (PMEL_HUMAN)
EGPDASSIM

SEQ ID NO: 142381 - protein, 9 aa, Homo sapiens
  Native (PMEL_HUMAN)
PAEVSIVVL

SEQ ID NO: 142382 - protein, 11 aa, Homo sapiens
  Native (PMEL_HUMAN)
TPGQAPTAEPS

SEQ ID NO: 142383 - protein, 9 aa, Homo sapiens
  Native (PMEL_HUMAN)
GGPCPSGSW

SEQ ID NO: 142384 - protein, 8 aa, Homo sapiens
  Native (PMEL_HUMAN)
VETTAREL

SEQ ID NO: 142385 - protein, 8 aa, Homo sapiens
  Native (PMEL_HUMAN)
TLDIVQGI

SEQ ID NO: 142386 - protein, 9 aa, Homo sapiens
  Native (PMEL_HUMAN)
RSYVPLAHS

SEQ ID NO: 142387 - protein, 8 aa, Homo sapiens
  Native (PMEL_HUMAN)
SSSHWLRL

SEQ ID NO: 142388 - protein, 11 aa, Homo sapiens
  Native (PMEL_HUMAN)
TNSLAVVSTQL

SEQ ID NO: 142389 - protein, 9 aa, Homo sapiens
  Native (PMEL_HUMAN)
LQLHDPSGY

SEQ ID NO: 142390 - protein, 11 aa, Homo sapiens
  Native (PMEL_HUMAN)
MTPEKVPVSEV

SEQ ID NO: 142391 - protein, 11 aa, Homo sapiens
  Native (PMEL_HUMAN)
RQLRTKAWNRQ

SEQ ID NO: 142392 - protein, 9 aa, Homo sapiens
  Native (PMEL_HUMAN)
WVETTAREL

SEQ ID NO: 142393 - protein, 9 aa, Homo sapiens
  Native (PMEL_HUMAN)
IPLTSCGSS

SEQ ID NO: 142394 - protein, 9 aa, Homo sapiens
  Native (PMEL_HUMAN)
TATLRLVKR

SEQ ID NO: 142395 - protein, 11 aa, Homo sapiens
  Native (PMEL_HUMAN)
PVSGLSIGTGR

SEQ ID NO: 142396 - protein, 10 aa, Homo sapiens
  Native (PMEL_HUMAN)
GIESAEILQA

SEQ ID NO: 142397 - protein, 9 aa, Homo sapiens
  Native (PMEL_HUMAN)
HWLRLPRIF

SEQ ID NO: 142398 - protein, 8 aa, Homo sapiens
  Native (PMEL_HUMAN)
AEADLSYT

SEQ ID NO: 142399 - protein, 10 aa, Homo sapiens
  Native (PMEL_HUMAN)
TAEPSGTTSV

SEQ ID NO: 142400 - protein, 8 aa, Homo sapiens
  Native (PMEL_HUMAN)
RSFVYVWK

SEQ ID NO: 142401 - protein, 10 aa, Homo sapiens
  Native (PMEL_HUMAN)
QVLGGPVSGL

SEQ ID NO: 142402 - protein, 9 aa, Homo sapiens
  Native (PMEL_HUMAN)
FGDSSGTLI

SEQ ID NO: 142403 - protein, 9 aa, Homo sapiens
  Native (PMEL_HUMAN)
IPEPEGPDA

SEQ ID NO: 142404 - protein, 11 aa, Homo sapiens
  Native (PMEL_HUMAN)
GQVPLIVGILL

SEQ ID NO: 142405 - protein, 8 aa, Homo sapiens
  Native (PMEL_HUMAN)
ADTNSLAV

SEQ ID NO: 142406 - protein, 11 aa, Homo sapiens
  Native (PMEL_HUMAN)
SQKVLPDGQVI

SEQ ID NO: 142407 - protein, 11 aa, Homo sapiens
  Native (PMEL_HUMAN)
WQVLGGPVSGL

SEQ ID NO: 142408 - protein, 11 aa, Homo sapiens
  Native (PMEL_HUMAN)
SSPVPGTTDGH

SEQ ID NO: 142409 - protein, 11 aa, Homo sapiens
  Native (PMEL_HUMAN)
SLADTNSLAVV

SEQ ID NO: 142410 - protein, 9 aa, Homo sapiens
  Native (PMEL_HUMAN)
EGDAFELTV

SEQ ID NO: 142411 - protein, 11 aa, Homo sapiens
  Native (PMEL_HUMAN)
FSVSVSQLRAL

SEQ ID NO: 142412 - protein, 11 aa, Homo sapiens
  Native (PMEL_HUMAN)
ILKGGSGTYCL

SEQ ID NO: 142413 - protein, 10 aa, Homo sapiens
  Native (PMEL_HUMAN)
IALNFPGSQK

SEQ ID NO: 142414 - protein, 10 aa, Homo sapiens
  Native (PMEL_HUMAN)
LPKEACMEIS

SEQ ID NO: 142415 - protein, 11 aa, Homo sapiens
  Native (PMEL_HUMAN)
IPEPEGPDASS

SEQ ID NO: 142416 - protein, 9 aa, Homo sapiens
  Native (PMEL_HUMAN)
VPVSEVMGT

SEQ ID NO: 142417 - protein, 9 aa, Homo sapiens
  Native (PMEL_HUMAN)
PEGPDASSI

SEQ ID NO: 142418 - protein, 10 aa, Homo sapiens
  Native (PMEL_HUMAN)
DWLGVSRQLR

SEQ ID NO: 142419 - protein, 11 aa, Homo sapiens
  Native (PMEL_HUMAN)
LRTKAWNRQLY

SEQ ID NO: 142420 - protein, 10 aa, Homo sapiens
  Native (PMEL_HUMAN)
VQGIESAEIL

SEQ ID NO: 142421 - protein, 8 aa, Homo sapiens
  Native (PMEL_HUMAN)
MAVVLASL

SEQ ID NO: 142422 - protein, 9 aa, Homo sapiens
  Native (PMEL_HUMAN)
VLKRCLLHL

SEQ ID NO: 142423 - protein, 11 aa, Homo sapiens
  Native (PMEL_HUMAN)
VPTTEVISTAP

SEQ ID NO: 142424 - protein, 9 aa, Homo sapiens
  Native (PMEL_HUMAN)
EVVGTTPGQ

SEQ ID NO: 142425 - protein, 9 aa, Homo sapiens
  Native (PMEL_HUMAN)
LEPGPVTAQ

SEQ ID NO: 142426 - protein, 10 aa, Homo sapiens
  Native (PMEL_HUMAN)
GALLAVGATK

SEQ ID NO: 142427 - protein, 10 aa, Homo sapiens
  Native (PMEL_HUMAN)
WKTWGQYWQV

SEQ ID NO: 142428 - protein, 9 aa, Homo sapiens
  Native (PMEL_HUMAN)
RLPRIFCSC

SEQ ID NO: 142429 - protein, 11 aa, Homo sapiens
  Native (PMEL_HUMAN)
LEPGPVTAQVV

SEQ ID NO: 142430 - protein, 8 aa, Homo sapiens
  Native (PMEL_HUMAN)
TGSLGPLL

SEQ ID NO: 142431 - protein, 10 aa, Homo sapiens
  Native (PMEL_HUMAN)
SGTLISRALV

SEQ ID NO: 142432 - protein, 11 aa, Homo sapiens
  Native (PMEL_HUMAN)
TEVVGTTPGQA

SEQ ID NO: 142433 - protein, 9 aa, Homo sapiens
  Native (PMEL_HUMAN)
FPDGGPCPS

SEQ ID NO: 142434 - protein, 9 aa, Homo sapiens
  Native (PMEL_HUMAN)
VETTARELP

SEQ ID NO: 142435 - protein, 11 aa, Homo sapiens
  Native (PMEL_HUMAN)
VLASLIYRRRL

SEQ ID NO: 142436 - protein, 9 aa, Homo sapiens
  Native (PMEL_HUMAN)
HQILKGGSG

SEQ ID NO: 142437 - protein, 11 aa, Homo sapiens
  Native (PMEL_HUMAN)
GLSIGTGRAML

SEQ ID NO: 142438 - protein, 9 aa, Homo sapiens
  Native (PMEL_HUMAN)
LSGTTAAQV

SEQ ID NO: 142439 - protein, 11 aa, Homo sapiens
  Native (PMEL_HUMAN)
TLIGANASFSI

SEQ ID NO: 142440 - protein, 9 aa, Homo sapiens
  Native (PMEL_HUMAN)
WQVLGGPVS

SEQ ID NO: 142441 - protein, 8 aa, Homo sapiens
  Native (PMEL_HUMAN)
SAEILQAV

SEQ ID NO: 142442 - protein, 9 aa, Homo sapiens
  Native (PMEL_HUMAN)
IYRRRLMKQ

SEQ ID NO: 142443 - protein, 8 aa, Homo sapiens
  Native (PMEL_HUMAN)
SRSYVPLA

SEQ ID NO: 142444 - protein, 9 aa, Homo sapiens
  Native (PMEL_HUMAN)
VQVPTTEVI

SEQ ID NO: 142445 - protein, 8 aa, Homo sapiens
  Native (PMEL_HUMAN)
HDPSGYLA

SEQ ID NO: 142446 - protein, 9 aa, Homo sapiens
  Native (PMEL_HUMAN)
MSTPEATGM

SEQ ID NO: 142447 - protein, 9 aa, Homo sapiens
  Native (PMEL_HUMAN)
QVIWVNNTI

SEQ ID NO: 142448 - protein, 10 aa, Homo sapiens
  Native (PMEL_HUMAN)
GSQVWGGQPV

SEQ ID NO: 142449 - protein, 11 aa, Homo sapiens
  Native (PMEL_HUMAN)
RSFVYVWKTWG

SEQ ID NO: 142450 - protein, 8 aa, Homo sapiens
  Native (PMEL_HUMAN)
QDFSVPQL

SEQ ID NO: 142451 - protein, 11 aa, Homo sapiens
  Native (PMEL_HUMAN)
VVLSGTTAAQV

SEQ ID NO: 142452 - protein, 10 aa, Homo sapiens
  Native (PMEL_HUMAN)
EAPNTTAGQV

SEQ ID NO: 142453 - protein, 9 aa, Homo sapiens
  Native (PMEL_HUMAN)
VSCQGGLPK

SEQ ID NO: 142454 - protein, 9 aa, Homo sapiens
  Native (PMEL_HUMAN)
AAIPLTSCG

SEQ ID NO: 142455 - protein, 9 aa, Homo sapiens
  Native (PMEL_HUMAN)
QVWGGQPVY

SEQ ID NO: 142456 - protein, 9 aa, Homo sapiens
  Native (PMEL_HUMAN)
QGIESAEIL

SEQ ID NO: 142457 - protein, 11 aa, Homo sapiens
  Native (PMEL_HUMAN)
GPTLIGANASF

SEQ ID NO: 142458 - protein, 9 aa, Homo sapiens
  Native (PMEL_HUMAN)
SGTLISRAL

SEQ ID NO: 142459 - protein, 10 aa, Homo sapiens
  Native (PMEL_HUMAN)
GSRSYVPLAH

SEQ ID NO: 142460 - protein, 11 aa, Homo sapiens
  Native (PMEL_HUMAN)
FTITDQVPFSV

SEQ ID NO: 142461 - protein, 11 aa, Homo sapiens
  Native (PMEL_HUMAN)
MAVVLASLIYR

SEQ ID NO: 142462 - protein, 8 aa, Homo sapiens
  Native (PMEL_HUMAN)
SVSVSQLR

SEQ ID NO: 142463 - protein, 10 aa, Homo sapiens
  Native (PMEL_HUMAN)
SLADTNSLAV

SEQ ID NO: 142464 - protein, 11 aa, Homo sapiens
  Native (PMEL_HUMAN)
AVIGALLAVGA

SEQ ID NO: 142465 - protein, 10 aa, Homo sapiens
  Native (PMEL_HUMAN)
GRAMLGTHTM

SEQ ID NO: 142466 - protein, 9 aa, Homo sapiens
  Native (PMEL_HUMAN)
QPVLPSPAC

SEQ ID NO: 142467 - protein, 9 aa, Homo sapiens
  Native (PMEL_HUMAN)
GMTPEKVPV

SEQ ID NO: 142468 - protein, 9 aa, Homo sapiens
  Native (PMEL_HUMAN)
MAVVLASLI

SEQ ID NO: 142469 - protein, 8 aa, Homo sapiens
  Native (PMEL_HUMAN)
ALVVTHTY

SEQ ID NO: 142470 - protein, 9 aa, Homo sapiens
  Native (PMEL_HUMAN)
TYLEPGPVT

SEQ ID NO: 142471 - protein, 10 aa, Homo sapiens
  Native (PMEL_HUMAN)
YRRRLMKQDF

SEQ ID NO: 142472 - protein, 10 aa, Homo sapiens
  Native (PMEL_HUMAN)
GPDASSIMST

SEQ ID NO: 142473 - protein, 10 aa, Homo sapiens
  Native (PMEL_HUMAN)
KVLPDGQVIW

SEQ ID NO: 142474 - protein, 11 aa, Homo sapiens
  Native (PMEL_HUMAN)
EVTVYHRRGSR

SEQ ID NO: 142475 - protein, 11 aa, Homo sapiens
  Native (PMEL_HUMAN)
TTTEWVETTAR

SEQ ID NO: 142476 - protein, 8 aa, Homo sapiens
  Native (PMEL_HUMAN)
SSGTLISR

SEQ ID NO: 142477 - protein, 10 aa, Homo sapiens
  Native (PMEL_HUMAN)
NTIINGSQVW

SEQ ID NO: 142478 - protein, 11 aa, Homo sapiens
  Native (PMEL_HUMAN)
KVLPDGQVIWV

SEQ ID NO: 142479 - protein, 9 aa, Homo sapiens
  Native (PMEL_HUMAN)
TLISRALVV

SEQ ID NO: 142480 - protein, 9 aa, Homo sapiens
  Native (PMEL_HUMAN)
LLDGTATLR

SEQ ID NO: 142481 - protein, 9 aa, Homo sapiens
  Native (PMEL_HUMAN)
TVYHRRGSR

SEQ ID NO: 142482 - protein, 11 aa, Homo sapiens
  Native (PMEL_HUMAN)
YLAEADLSYTW

SEQ ID NO: 142483 - protein, 11 aa, Homo sapiens
  Native (PMEL_HUMAN)
ESITGSLGPLL

SEQ ID NO: 142484 - protein, 8 aa, Homo sapiens
  Native (PMEL_HUMAN)
IINGSQVW

SEQ ID NO: 142485 - protein, 9 aa, Homo sapiens
  Native (PMEL_HUMAN)
TLRLVKRQV

SEQ ID NO: 142486 - protein, 11 aa, Homo sapiens
  Native (PMEL_HUMAN)
GALLAVGATKV

SEQ ID NO: 142487 - protein, 9 aa, Homo sapiens
  Native (PMEL_HUMAN)
HTYLEPGPV

SEQ ID NO: 142488 - protein, 8 aa, Homo sapiens
  Native (PMEL_HUMAN)
VLQAAIPL

SEQ ID NO: 142489 - protein, 9 aa, Homo sapiens
  Native (PMEL_HUMAN)
ITGSLGPLL

SEQ ID NO: 142490 - protein, 9 aa, Homo sapiens
  Native (PMEL_HUMAN)
GEGDAFELT

SEQ ID NO: 142491 - protein, 11 aa, Homo sapiens
  Native (PMEL_HUMAN)
GQEAGLGQVPL

SEQ ID NO: 142492 - protein, 9 aa, Homo sapiens
  Native (PMEL_HUMAN)
SFVYVWKTW

SEQ ID NO: 142493 - protein, 10 aa, Homo sapiens
  Native (PMEL_HUMAN)
SGSWSQKRSF

SEQ ID NO: 142494 - protein, 10 aa, Homo sapiens
  Native (PMEL_HUMAN)
TVSCQGGLPK

SEQ ID NO: 142495 - protein, 10 aa, Homo sapiens
  Native (PMEL_HUMAN)
TMEVTVYHRR

SEQ ID NO: 142496 - protein, 9 aa, Homo sapiens
  Native (PMEL_HUMAN)
GSSPVPGTT

SEQ ID NO: 142497 - protein, 10 aa, Homo sapiens
  Native (PMEL_HUMAN)
RTKAWNRQLY

SEQ ID NO: 142498 - protein, 11 aa, Homo sapiens
  Native (PMEL_HUMAN)
TLDIVQGIESA

SEQ ID NO: 142499 - protein, 11 aa, Homo sapiens
  Native (PMEL_HUMAN)
VYVWKTWGQYW

SEQ ID NO: 142500 - protein, 9 aa, Homo sapiens
  Native (PMEL_HUMAN)
SSIMSTESI

SEQ ID NO: 142501 - protein, 10 aa, Homo sapiens
  Native (PMEL_HUMAN)
QETDDACIFP

SEQ ID NO: 142502 - protein, 10 aa, Homo sapiens
  Native (PMEL_HUMAN)
GMTPAEVSIV

SEQ ID NO: 142503 - protein, 11 aa, Homo sapiens
  Native (PMEL_HUMAN)
GQYWQVLGGPV

SEQ ID NO: 142504 - protein, 9 aa, Homo sapiens
  Native (PMEL_HUMAN)
VLASLIYRR

SEQ ID NO: 142505 - protein, 10 aa, Homo sapiens
  Native (PMEL_HUMAN)
SQVWGGQPVY

SEQ ID NO: 142506 - protein, 11 aa, Homo sapiens
  Native (PMEL_HUMAN)
MPGQEAGLGQV

SEQ ID NO: 142507 - protein, 8 aa, Homo sapiens
  Native (PMEL_HUMAN)
GHRPTAEA

SEQ ID NO: 142508 - protein, 10 aa, Homo sapiens
  Native (PMEL_HUMAN)
ESTGMTPEKV

SEQ ID NO: 142509 - protein, 9 aa, Homo sapiens
  Native (PMEL_HUMAN)
TEVISTAPV

SEQ ID NO: 142510 - protein, 9 aa, Homo sapiens
  Native (PMEL_HUMAN)
AEVSIVVLS

SEQ ID NO: 142511 - protein, 9 aa, Homo sapiens
  Native (PMEL_HUMAN)
GANASFSIA

SEQ ID NO: 142512 - protein, 11 aa, Homo sapiens
  Native (PMEL_HUMAN)
LMKQDFSVPQL

SEQ ID NO: 142513 - protein, 11 aa, Homo sapiens
  Native (PMEL_HUMAN)
LLHLAVIGALL

SEQ ID NO: 142514 - protein, 8 aa, Homo sapiens
  Native (PMEL_HUMAN)
LKGGSGTY

SEQ ID NO: 142515 - protein, 11 aa, Homo sapiens
  Native (PMEL_HUMAN)
HQILKGGSGTY

SEQ ID NO: 142516 - protein, 10 aa, Homo sapiens
  Native (PMEL_HUMAN)
TTEVISTAPV

SEQ ID NO: 142517 - protein, 8 aa, Homo sapiens
  Native (PMEL_HUMAN)
ATLRLVKR

SEQ ID NO: 142518 - protein, 9 aa, Homo sapiens
  Native (PMEL_HUMAN)
KVLPDGQVI

SEQ ID NO: 142519 - protein, 10 aa, Homo sapiens
  Native (PMEL_HUMAN)
SRALVVTHTY

SEQ ID NO: 142520 - protein, 9 aa, Homo sapiens
  Native (PMEL_HUMAN)
TTDGHRPTA

SEQ ID NO: 142521 - protein, 8 aa, Homo sapiens
  Native (PMEL_HUMAN)
LHDPSGYL

SEQ ID NO: 142522 - protein, 11 aa, Homo sapiens
  Native (PMEL_HUMAN)
GLGQVPLIVGI

SEQ ID NO: 142523 - protein, 9 aa, Homo sapiens
  Native (PMEL_HUMAN)
STAPVQMPT

SEQ ID NO: 142524 - protein, 9 aa, Homo sapiens
  Native (PMEL_HUMAN)
WLGVSRQLR

SEQ ID NO: 142525 - protein, 9 aa, Homo sapiens
  Native (PMEL_HUMAN)
DSSGTLISR

SEQ ID NO: 142526 - protein, 10 aa, Homo sapiens
  Native (PMEL_HUMAN)
TDQVPFSVSV

SEQ ID NO: 142527 - protein, 10 aa, Homo sapiens
  Native (PMEL_HUMAN)
AEILQAVPSG

SEQ ID NO: 142528 - protein, 9 aa, Homo sapiens
  Native (PMEL_HUMAN)
SPLLSGQQV

SEQ ID NO: 142529 - protein, 10 aa, Homo sapiens
  Native (PMEL_HUMAN)
PVPGTTDGHR

SEQ ID NO: 142530 - protein, 9 aa, Homo sapiens
  Native (PMEL_HUMAN)
RELPIPEPE

SEQ ID NO: 142531 - protein, 10 aa, Homo sapiens
  Native (PMEL_HUMAN)
LAVVSTQLIM

SEQ ID NO: 142532 - protein, 9 aa, Homo sapiens
  Native (PMEL_HUMAN)
PGCQPPAQR

SEQ ID NO: 142533 - protein, 9 aa, Homo sapiens
  Native (PMEL_HUMAN)
LASLIYRRR

SEQ ID NO: 142534 - protein, 8 aa, Homo sapiens
  Native (PMEL_HUMAN)
LVVTHTYL

SEQ ID NO: 142535 - protein, 9 aa, Homo sapiens
  Native (PMEL_HUMAN)
RGSRSYVPL

SEQ ID NO: 142536 - protein, 10 aa, Homo sapiens
  Native (PMEL_HUMAN)
ASSIMSTESI

SEQ ID NO: 142537 - protein, 9 aa, Homo sapiens
  Native (PMEL_HUMAN)
SRSYVPLAH

SEQ ID NO: 142538 - protein, 11 aa, Homo sapiens
  Native (PMEL_HUMAN)
VPLIVGILLVL

SEQ ID NO: 142539 - protein, 8 aa, Homo sapiens
  Native (PMEL_HUMAN)
MPGQEAGL

SEQ ID NO: 142540 - protein, 9 aa, Homo sapiens
  Native (PMEL_HUMAN)
SGYLAEADL

SEQ ID NO: 142541 - protein, 9 aa, Homo sapiens
  Native (PMEL_HUMAN)
VTLDIVQGI

SEQ ID NO: 142542 - protein, 9 aa, Homo sapiens
  Native (PMEL_HUMAN)
EVMGTTLAE

SEQ ID NO: 142543 - protein, 10 aa, Homo sapiens
  Native (PMEL_HUMAN)
RELPIPEPEG

SEQ ID NO: 142544 - protein, 10 aa, Homo sapiens
  Native (PMEL_HUMAN)
LPSPACQLVL

SEQ ID NO: 142545 - protein, 10 aa, Homo sapiens
  Native (PMEL_HUMAN)
VPLDCVLYRY

SEQ ID NO: 142546 - protein, 8 aa, Homo sapiens
  Native (PMEL_HUMAN)
CQLVLHQI

SEQ ID NO: 142547 - protein, 11 aa, Homo sapiens
  Native (PMEL_HUMAN)
SAFTITDQVPF

SEQ ID NO: 142548 - protein, 9 aa, Homo sapiens
  Native (PMEL_HUMAN)
VLYRYGSFS

SEQ ID NO: 142549 - protein, 9 aa, Homo sapiens
  Native (PMEL_HUMAN)
AQVVLQAAI

SEQ ID NO: 142550 - protein, 11 aa, Homo sapiens
  Native (PMEL_HUMAN)
SLKVSNDGPTL

SEQ ID NO: 142551 - protein, 10 aa, Homo sapiens
  Native (PMEL_HUMAN)
LAHSSSAFTI

SEQ ID NO: 142552 - protein, 10 aa, Homo sapiens
  Native (PMEL_HUMAN)
EPGPVTAQVV

SEQ ID NO: 142553 - protein, 9 aa, Homo sapiens
  Native (PMEL_HUMAN)
VLMAVVLAS

SEQ ID NO: 142554 - protein, 10 aa, Homo sapiens
  Native (PMEL_HUMAN)
EPSGTTSVQV

SEQ ID NO: 142555 - protein, 10 aa, Homo sapiens
  Native (PMEL_HUMAN)
LNFPGSQKVL

SEQ ID NO: 142556 - protein, 10 aa, Homo sapiens
  Native (PMEL_HUMAN)
QILKGGSGTY

SEQ ID NO: 142557 - protein, 10 aa, Homo sapiens
  Native (PMEL_HUMAN)
STAPVQMPTA

SEQ ID NO: 142558 - protein, 10 aa, Homo sapiens
  Native (PMEL_HUMAN)
LSIGTGRAML

SEQ ID NO: 142559 - protein, 9 aa, Homo sapiens
  Native (PMEL_HUMAN)
CQLVLHQIL

SEQ ID NO: 142560 - protein, 11 aa, Homo sapiens
  Native (PMEL_HUMAN)
SGTLISRALVV

SEQ ID NO: 142561 - protein, 10 aa, Homo sapiens
  Native (PMEL_HUMAN)
VPLIVGILLV

SEQ ID NO: 142562 - protein, 9 aa, Homo sapiens
  Native (PMEL_HUMAN)
VVLSGTTAA

SEQ ID NO: 142563 - protein, 10 aa, Homo sapiens
  Native (PMEL_HUMAN)
YVPLAHSSSA

SEQ ID NO: 142564 - protein, 8 aa, Homo sapiens
  Native (PMEL_HUMAN)
LRNQPLTF

SEQ ID NO: 142565 - protein, 8 aa, Homo sapiens
  Native (PMEL_HUMAN)
QEAGLGQV

SEQ ID NO: 142566 - protein, 11 aa, Homo sapiens
  Native (PMEL_HUMAN)
VQMPTAESTGM

SEQ ID NO: 142567 - protein, 11 aa, Homo sapiens
  Native (PMEL_HUMAN)
SRQLRTKAWNR

SEQ ID NO: 142568 - protein, 10 aa, Homo sapiens
  Native (PMEL_HUMAN)
THTYLEPGPV

SEQ ID NO: 142569 - protein, 10 aa, Homo sapiens
  Native (PMEL_HUMAN)
ESAEILQAVP

SEQ ID NO: 142570 - protein, 10 aa, Homo sapiens
  Native (PMEL_HUMAN)
RLDCWRGGQV

SEQ ID NO: 142571 - protein, 9 aa, Homo sapiens
  Native (PMEL_HUMAN)
HRRGSRSYV

SEQ ID NO: 142572 - protein, 8 aa, Homo sapiens
  Native (PMEL_HUMAN)
LPSPACQL

SEQ ID NO: 142573 - protein, 10 aa, Homo sapiens
  Native (PMEL_HUMAN)
IVQGIESAEI

SEQ ID NO: 142574 - protein, 10 aa, Homo sapiens
  Native (PMEL_HUMAN)
GQVPLIVGIL

SEQ ID NO: 142575 - protein, 8 aa, Homo sapiens
  Native (PMEL_HUMAN)
SFSIALNF

SEQ ID NO: 142576 - protein, 9 aa, Homo sapiens
  Native (PMEL_HUMAN)
HLAVIGALL

SEQ ID NO: 142577 - protein, 10 aa, Homo sapiens
  Native (PMEL_HUMAN)
ALLAVGATKV

SEQ ID NO: 142578 - protein, 11 aa, Homo sapiens
  Native (PMEL_HUMAN)
AVVLASLIYRR

SEQ ID NO: 142579 - protein, 8 aa, Homo sapiens
  Native (PMEL_HUMAN)
SPGCQPPA

SEQ ID NO: 142580 - protein, 11 aa, Homo sapiens
  Native (PMEL_HUMAN)
SSPGCQPPAQR

SEQ ID NO: 142581 - protein, 10 aa, Homo sapiens
  Native (PMEL_HUMAN)
EPEGPDASSI

SEQ ID NO: 142582 - protein, 10 aa, Homo sapiens
  Native (PMEL_HUMAN)
SLGPLLDGTA

SEQ ID NO: 142583 - protein, 10 aa, Homo sapiens
  Native (PMEL_HUMAN)
RLMKQDFSVP

SEQ ID NO: 142584 - protein, 9 aa, Homo sapiens
  Native (PMEL_HUMAN)
ADTNSLAVV

SEQ ID NO: 142585 - protein, 10 aa, Homo sapiens
  Native (PMEL_HUMAN)
GEGDAFELTV

SEQ ID NO: 142586 - protein, 9 aa, Homo sapiens
  Native (PMEL_HUMAN)
GPLLDGTAT

SEQ ID NO: 142587 - protein, 10 aa, Homo sapiens
  Native (PMEL_HUMAN)
TTTEWVETTA

SEQ ID NO: 142588 - protein, 9 aa, Homo sapiens
  Native (PMEL_HUMAN)
SLGPLLDGT

SEQ ID NO: 142589 - protein, 11 aa, Homo sapiens
  Native (PMEL_HUMAN)
TESITGSLGPL

SEQ ID NO: 142590 - protein, 9 aa, Homo sapiens
  Native (PMEL_HUMAN)
MEVTVYHRR

SEQ ID NO: 142591 - protein, 10 aa, Homo sapiens
  Native (PMEL_HUMAN)
SPVPGTTDGH

SEQ ID NO: 142592 - protein, 9 aa, Homo sapiens
  Native (PMEL_HUMAN)
THTMEVTVY

SEQ ID NO: 142593 - protein, 10 aa, Homo sapiens
  Native (PMEL_HUMAN)
FLRNQPLTFA

SEQ ID NO: 142594 - protein, 10 aa, Homo sapiens
  Native (PMEL_HUMAN)
AFTITDQVPF

SEQ ID NO: 142595 - protein, 9 aa, Homo sapiens
  Native (PMEL_HUMAN)
TMEVTVYHR

SEQ ID NO: 142596 - protein, 11 aa, Homo sapiens
  Native (PMEL_HUMAN)
NRQLYPEWTEA

SEQ ID NO: 142597 - protein, 11 aa, Homo sapiens
  Native (PMEL_HUMAN)
YVPLAHSSSAF

SEQ ID NO: 142598 - protein, 11 aa, Homo sapiens
  Native (PMEL_HUMAN)
PEPEGPDASSI

SEQ ID NO: 142599 - protein, 11 aa, Homo sapiens
  Native (PMEL_HUMAN)
MTPAEVSIVVL

SEQ ID NO: 142600 - protein, 10 aa, Homo sapiens
  Native (PMEL_HUMAN)
LGGPVSGLSI

SEQ ID NO: 142601 - protein, 10 aa, Homo sapiens
  Native (PMEL_HUMAN)
SSGTLISRAL

SEQ ID NO: 142602 - protein, 11 aa, Homo sapiens
  Native (PMEL_HUMAN)
TAESTGMTPEK

SEQ ID NO: 142603 - protein, 8 aa, Homo sapiens
  Native (PMEL_HUMAN)
MEISSPGC

SEQ ID NO: 142604 - protein, 8 aa, Homo sapiens
  Native (PMEL_HUMAN)
SWSQKRSF

SEQ ID NO: 142605 - protein, 9 aa, Homo sapiens
  Native (PMEL_HUMAN)
RPTAEAPNT

SEQ ID NO: 142606 - protein, 11 aa, Homo sapiens
  Native (PMEL_HUMAN)
LPHSSSHWLRL

SEQ ID NO: 142607 - protein, 10 aa, Homo sapiens
  Native (PMEL_HUMAN)
GPLLDGTATL

SEQ ID NO: 142608 - protein, 9 aa, Homo sapiens
  Native (PMEL_HUMAN)
EKVPVSEVM

SEQ ID NO: 142609 - protein, 10 aa, Homo sapiens
  Native (PMEL_HUMAN)
RGSRSYVPLA

SEQ ID NO: 142610 - protein, 11 aa, Homo sapiens
  Native (PMEL_HUMAN)
KRSFVYVWKTW

SEQ ID NO: 142611 - protein, 9 aa, Homo sapiens
  Native (PMEL_HUMAN)
VSRQLRTKA

SEQ ID NO: 142612 - protein, 10 aa, Homo sapiens
  Native (PMEL_HUMAN)
QMPTAESTGM

SEQ ID NO: 142613 - protein, 9 aa, Homo sapiens
  Native (PMEL_HUMAN)
TTAAQVTTT

SEQ ID NO: 142614 - protein, 11 aa, Homo sapiens
  Native (PMEL_HUMAN)
EPGPVTAQVVL

SEQ ID NO: 142615 - protein, 9 aa, Homo sapiens
  Native (PMEL_HUMAN)
RQVPLDCVL

SEQ ID NO: 142616 - protein, 9 aa, Homo sapiens
  Native (PMEL_HUMAN)
HTMEVTVYH

SEQ ID NO: 142617 - protein, 10 aa, Homo sapiens
  Native (PMEL_HUMAN)
SLAVVSTQLI

SEQ ID NO: 142618 - protein, 10 aa, Homo sapiens
  Native (PMEL_HUMAN)
SLIYRRRLMK

SEQ ID NO: 142619 - protein, 9 aa, Homo sapiens
  Native (PMEL_HUMAN)
LDGTATLRL

SEQ ID NO: 142620 - protein, 8 aa, Homo sapiens
  Native (PMEL_HUMAN)
MTPEKVPV

SEQ ID NO: 142621 - protein, 9 aa, Homo sapiens
  Native (PMEL_HUMAN)
PEKVPVSEV

SEQ ID NO: 142622 - protein, 11 aa, Homo sapiens
  Native (PMEL_HUMAN)
RRGSRSYVPLA

SEQ ID NO: 142623 - protein, 10 aa, Homo sapiens
  Native (PMEL_HUMAN)
VTVYHRRGSR

SEQ ID NO: 142624 - protein, 10 aa, Homo sapiens
  Native (PMEL_HUMAN)
VSEVMGTTLA

SEQ ID NO: 142625 - protein, 10 aa, Homo sapiens
  Native (PMEL_HUMAN)
QLHDPSGYLA

SEQ ID NO: 142626 - protein, 9 aa, Homo sapiens
  Native (PMEL_HUMAN)
LRALDGGNK

SEQ ID NO: 142627 - protein, 11 aa, Homo sapiens
  Native (PMEL_HUMAN)
SSSAFTITDQV

SEQ ID NO: 142628 - protein, 10 aa, Homo sapiens
  Native (PMEL_HUMAN)
TLISRALVVT

SEQ ID NO: 142629 - protein, 11 aa, Homo sapiens
  Native (PMEL_HUMAN)
TPEKVPVSEVM

SEQ ID NO: 142630 - protein, 9 aa, Homo sapiens
  Native (PMEL_HUMAN)
LTSCGSSPV

SEQ ID NO: 142631 - protein, 10 aa, Homo sapiens
  Native (PMEL_HUMAN)
LRTKAWNRQL

SEQ ID NO: 142632 - protein, 10 aa, Homo sapiens
  Native (PMEL_HUMAN)
LAVGATKVPR

SEQ ID NO: 142633 - protein, 9 aa, Homo sapiens
  Native (PMEL_HUMAN)
VPFSVSVSQ

SEQ ID NO: 142634 - protein, 11 aa, Homo sapiens
  Native (PMEL_HUMAN)
PLLDGTATLRL

SEQ ID NO: 142635 - protein, 9 aa, Homo sapiens
  Native (PMEL_HUMAN)
TTTEWVETT

SEQ ID NO: 142636 - protein, 10 aa, Homo sapiens
  Native (PMEL_HUMAN)
ILLVLMAVVL

SEQ ID NO: 142637 - protein, 10 aa, Homo sapiens
  Native (PMEL_HUMAN)
APTAEPSGTT

SEQ ID NO: 142638 - protein, 9 aa, Homo sapiens
  Native (PMEL_HUMAN)
LIVGILLVL

SEQ ID NO: 142639 - protein, 9 aa, Homo sapiens
  Native (PMEL_HUMAN)
AESTGMTPE

SEQ ID NO: 142640 - protein, 11 aa, Homo sapiens
  Native (PMEL_HUMAN)
GSQVWGGQPVY

SEQ ID NO: 142641 - protein, 10 aa, Homo sapiens
  Native (PMEL_HUMAN)
LIVGILLVLM

SEQ ID NO: 142642 - protein, 8 aa, Homo sapiens
  Native (PMEL_HUMAN)
IVGILLVL

SEQ ID NO: 142643 - protein, 8 aa, Homo sapiens
  Native (PMEL_HUMAN)
VPFSVSVS

SEQ ID NO: 142644 - protein, 11 aa, Homo sapiens
  Native (PMEL_HUMAN)
ITDQVPFSVSV

SEQ ID NO: 142645 - protein, 11 aa, Homo sapiens
  Native (PMEL_HUMAN)
FPDGGPCPSGS

SEQ ID NO: 142646 - protein, 9 aa, Homo sapiens
  Native (PMEL_HUMAN)
VPGTTDGHR

SEQ ID NO: 142647 - protein, 8 aa, Homo sapiens
  Native (PMEL_HUMAN)
LVLKRCLL

SEQ ID NO: 142648 - protein, 9 aa, Homo sapiens
  Native (PMEL_HUMAN)
ILKGGSGTY

SEQ ID NO: 142649 - protein, 10 aa, Homo sapiens
  Native (PMEL_HUMAN)
VPQLPHSSSH

SEQ ID NO: 142650 - protein, 8 aa, Homo sapiens
  Native (PMEL_HUMAN)
GLGQVPLI

SEQ ID NO: 142651 - protein, 9 aa, Homo sapiens
  Native (PMEL_HUMAN)
GPVTAQVVL

SEQ ID NO: 142652 - protein, 8 aa, Homo sapiens
  Native (PMEL_HUMAN)
DLVLKRCL

SEQ ID NO: 142653 - protein, 9 aa, Homo sapiens
  Native (PMEL_HUMAN)
LNFPGSQKV

SEQ ID NO: 142654 - protein, 9 aa, Homo sapiens
  Native (PMEL_HUMAN)
SVPQLPHSS

SEQ ID NO: 142655 - protein, 9 aa, Homo sapiens
  Native (PMEL_HUMAN)
AEAPNTTAG

SEQ ID NO: 142656 - protein, 10 aa, Homo sapiens
  Native (PMEL_HUMAN)
SQKRSFVYVW

SEQ ID NO: 142657 - protein, 8 aa, Homo sapiens
  Native (PMEL_HUMAN)
VIWVNNTI

SEQ ID NO: 142658 - protein, 9 aa, Homo sapiens
  Native (PMEL_HUMAN)
PGPVTAQVV

SEQ ID NO: 142659 - protein, 8 aa, Homo sapiens
  Native (PMEL_HUMAN)
QRLCQPVL

SEQ ID NO: 142660 - protein, 9 aa, Homo sapiens
  Native (PMEL_HUMAN)
APNTTAGQV

SEQ ID NO: 142661 - protein, 8 aa, Homo sapiens
  Native (PMEL_HUMAN)
QVPTTEVI

SEQ ID NO: 142662 - protein, 10 aa, Homo sapiens
  Native (PMEL_HUMAN)
KRSFVYVWKT

SEQ ID NO: 142663 - protein, 9 aa, Homo sapiens
  Native (PMEL_HUMAN)
SGLSIGTGR

SEQ ID NO: 142664 - protein, 10 aa, Homo sapiens
  Native (PMEL_HUMAN)
MEISSPGCQP

SEQ ID NO: 142665 - protein, 8 aa, Homo sapiens
  Native (PMEL_HUMAN)
TPAEVSIV

SEQ ID NO: 142666 - protein, 10 aa, Homo sapiens
  Native (PMEL_HUMAN)
GYLAEADLSY

SEQ ID NO: 142667 - protein, 9 aa, Homo sapiens
  Native (PMEL_HUMAN)
AEADLSYTW

SEQ ID NO: 142668 - protein, 11 aa, Homo sapiens
  Native (PMEL_HUMAN)
SVPQLPHSSSH

SEQ ID NO: 142669 - protein, 10 aa, Homo sapiens
  Native (PMEL_HUMAN)
TPEKVPVSEV

SEQ ID NO: 142670 - protein, 10 aa, Homo sapiens
  Native (PMEL_HUMAN)
TPGQAPTAEP

SEQ ID NO: 142671 - protein, 8 aa, Homo sapiens
  Native (PMEL_HUMAN)
VPLAHSSS

SEQ ID NO: 142672 - protein, 10 aa, Homo sapiens
  Native (PMEL_HUMAN)
DSSGTLISRA

SEQ ID NO: 142673 - protein, 11 aa, Homo sapiens
  Native (PMEL_HUMAN)
RAMLGTHTMEV

SEQ ID NO: 142674 - protein, 9 aa, Homo sapiens
  Native (PMEL_HUMAN)
YRYGSFSVT

SEQ ID NO: 142675 - protein, 9 aa, Homo sapiens
  Native (PMEL_HUMAN)
GGPVSGLSI

SEQ ID NO: 142676 - protein, 11 aa, Homo sapiens
  Native (PMEL_HUMAN)
MPTAESTGMTP

SEQ ID NO: 142677 - protein, 8 aa, Homo sapiens
  Native (PMEL_HUMAN)
AEMSTPEA

SEQ ID NO: 142678 - protein, 9 aa, Homo sapiens
  Native (PMEL_HUMAN)
GMTPAEVSI

SEQ ID NO: 142679 - protein, 9 aa, Homo sapiens
  Native (PMEL_HUMAN)
PLIVGILLV

SEQ ID NO: 142680 - protein, 8 aa, Homo sapiens
  Native (PMEL_HUMAN)
SIMSTESI

SEQ ID NO: 142681 - protein, 8 aa, Homo sapiens
  Native (PMEL_HUMAN)
RRLMKQDF

SEQ ID NO: 142682 - protein, 10 aa, Homo sapiens
  Native (PMEL_HUMAN)
EATGMTPAEV

SEQ ID NO: 142683 - protein, 9 aa, Homo sapiens
  Native (PMEL_HUMAN)
STESITGSL

SEQ ID NO: 142684 - protein, 10 aa, Homo sapiens
  Native (PMEL_HUMAN)
VYHRRGSRSY

SEQ ID NO: 142685 - protein, 10 aa, Homo sapiens
  Native (PMEL_HUMAN)
LIGANASFSI

SEQ ID NO: 142686 - protein, 11 aa, Homo sapiens
  Native (PMEL_HUMAN)
TEVISTAPVQM

SEQ ID NO: 142687 - protein, 10 aa, Homo sapiens
  Native (PMEL_HUMAN)
LQLHDPSGYL

SEQ ID NO: 142688 - protein, 11 aa, Homo sapiens
  Native (PMEL_HUMAN)
LLAVGATKVPR

SEQ ID NO: 142689 - protein, 8 aa, Homo sapiens
  Native (PMEL_HUMAN)
SLADTNSL

SEQ ID NO: 142690 - protein, 9 aa, Homo sapiens
  Native (PMEL_HUMAN)
DWLGVSRQL

SEQ ID NO: 142691 - protein, 9 aa, Homo sapiens
  Native (PMEL_HUMAN)
ASLIYRRRL

SEQ ID NO: 142692 - protein, 11 aa, Homo sapiens
  Native (PMEL_HUMAN)
QEAGLGQVPLI

SEQ ID NO: 142693 - protein, 10 aa, Homo sapiens
  Native (PMEL_HUMAN)
QKRSFVYVWK

SEQ ID NO: 142694 - protein, 9 aa, Homo sapiens
  Native (PMEL_HUMAN)
AAQVTTTEW

SEQ ID NO: 142695 - protein, 11 aa, Homo sapiens
  Native (PMEL_HUMAN)
AEPSGTTSVQV

SEQ ID NO: 142696 - protein, 9 aa, Homo sapiens
  Native (PMEL_HUMAN)
GQVPTTEVV

SEQ ID NO: 142697 - protein, 11 aa, Homo sapiens
  Native (PMEL_HUMAN)
ALDGGNKHFLR

SEQ ID NO: 142698 - protein, 10 aa, Homo sapiens
  Native (PMEL_HUMAN)
VLPDGQVIWV

SEQ ID NO: 142699 - protein, 10 aa, Homo sapiens
  Native (PMEL_HUMAN)
VSRQLRTKAW

SEQ ID NO: 142700 - protein, 8 aa, Homo sapiens
  Native (PMEL_HUMAN)
TEWVETTA

SEQ ID NO: 142701 - protein, 9 aa, Homo sapiens
  Native (PMEL_HUMAN)
VPQLPHSSS

SEQ ID NO: 142702 - protein, 9 aa, Homo sapiens
  Native (PMEL_HUMAN)
DAFELTVSC

SEQ ID NO: 142703 - protein, 8 aa, Homo sapiens
  Native (PMEL_HUMAN)
THTMEVTV

SEQ ID NO: 142704 - protein, 8 aa, Homo sapiens
  Native (PMEL_HUMAN)
AEILQAVP

SEQ ID NO: 142705 - protein, 9 aa, Homo sapiens
  Native (PMEL_HUMAN)
YWQVLGGPV

SEQ ID NO: 142706 - protein, 9 aa, Homo sapiens
  Native (PMEL_HUMAN)
LHLAVIGAL

SEQ ID NO: 142707 - protein, 8 aa, Homo sapiens
  Native (PMEL_HUMAN)
AQRLCQPV

SEQ ID NO: 142708 - protein, 8 aa, Homo sapiens
  Native (PMEL_HUMAN)
RQVPLDCV

SEQ ID NO: 142709 - protein, 11 aa, Homo sapiens
  Native (PMEL_HUMAN)
LRALDGGNKHF

SEQ ID NO: 142710 - protein, 9 aa, Homo sapiens
  Native (PMEL_HUMAN)
RTKAWNRQL

SEQ ID NO: 142711 - protein, 8 aa, Homo sapiens
  Native (PMEL_HUMAN)
KAWNRQLY

SEQ ID NO: 142712 - protein, 11 aa, Homo sapiens
  Native (PMEL_HUMAN)
LHDPSGYLAEA

SEQ ID NO: 142713 - protein, 8 aa, Homo sapiens
  Native (PMEL_HUMAN)
LVKRQVPL

SEQ ID NO: 142714 - protein, 10 aa, Homo sapiens
  Native (PMEL_HUMAN)
GTHTMEVTVY

SEQ ID NO: 142715 - protein, 9 aa, Homo sapiens
  Native (PMEL_HUMAN)
RRRLMKQDF

SEQ ID NO: 142716 - protein, 10 aa, Homo sapiens
  Native (PMEL_HUMAN)
MKQDFSVPQL

SEQ ID NO: 142717 - protein, 9 aa, Homo sapiens
  Native (PMEL_HUMAN)
TKAWNRQLY

SEQ ID NO: 142718 - protein, 8 aa, Homo sapiens
  Native (PMEL_HUMAN)
WRGGQVSL

SEQ ID NO: 142719 - protein, 11 aa, Homo sapiens
  Native (PMEL_HUMAN)
GPVTAQVVLQA

SEQ ID NO: 142720 - protein, 8 aa, Homo sapiens
  Native (PMEL_HUMAN)
AEAPNTTA

SEQ ID NO: 142721 - protein, 9 aa, Homo sapiens
  Native (PMEL_HUMAN)
GILLVLMAV

SEQ ID NO: 142722 - protein, 11 aa, Homo sapiens
  Native (PMEL_HUMAN)
RLPRIFCSCPI

SEQ ID NO: 142723 - protein, 11 aa, Homo sapiens
  Native (PMEL_HUMAN)
RELPIPEPEGP

SEQ ID NO: 142724 - protein, 8 aa, Homo sapiens
  Native (PMEL_HUMAN)
LDGGNKHF

SEQ ID NO: 142725 - protein, 8 aa, Homo sapiens
  Native (PMEL_HUMAN)
LAHSSSAF

SEQ ID NO: 142726 - protein, 11 aa, Homo sapiens
  Native (PMEL_HUMAN)
SSSHWLRLPRI

SEQ ID NO: 142727 - protein, 10 aa, Homo sapiens
  Native (PMEL_HUMAN)
VETTARELPI

SEQ ID NO: 142728 - protein, 9 aa, Homo sapiens
  Native (PMEL_HUMAN)
TWGQYWQVL

SEQ ID NO: 142729 - protein, 9 aa, Homo sapiens
  Native (PMEL_HUMAN)
SAFTITDQV

SEQ ID NO: 142730 - protein, 11 aa, Homo sapiens
  Native (PMEL_HUMAN)
RRLMKQDFSVP

SEQ ID NO: 142731 - protein, 10 aa, Homo sapiens
  Native (PMEL_HUMAN)
QVPLDCVLYR

SEQ ID NO: 142732 - protein, 10 aa, Homo sapiens
  Native (PMEL_HUMAN)
AVIGALLAVG

SEQ ID NO: 142733 - protein, 9 aa, Homo sapiens
  Native (PMEL_HUMAN)
EPGPVTAQV

SEQ ID NO: 142734 - protein, 10 aa, Homo sapiens
  Native (PMEL_HUMAN)
ILKGGSGTYC

SEQ ID NO: 142735 - protein, 8 aa, Homo sapiens
  Native (PMEL_HUMAN)
VLPDGQVI

SEQ ID NO: 142736 - protein, 9 aa, Homo sapiens
  Native (PMEL_HUMAN)
IESAEILQA

SEQ ID NO: 142737 - protein, 9 aa, Homo sapiens
  Native (PMEL_HUMAN)
VSNDGPTLI

SEQ ID NO: 142738 - protein, 8 aa, Homo sapiens
  Native (PMEL_HUMAN)
GPVTAQVV

SEQ ID NO: 142739 - protein, 8 aa, Homo sapiens
  Native (PMEL_HUMAN)
SNDGPTLI

SEQ ID NO: 142740 - protein, 9 aa, Homo sapiens
  Native (PMEL_HUMAN)
YPEWTEAQR

SEQ ID NO: 142741 - protein, 10 aa, Homo sapiens
  Native (PMEL_HUMAN)
LLVLMAVVLA

SEQ ID NO: 142742 - protein, 10 aa, Homo sapiens
  Native (PMEL_HUMAN)
GQEAGLGQVP

SEQ ID NO: 142743 - protein, 11 aa, Homo sapiens
  Native (PMEL_HUMAN)
GPCPSGSWSQK

SEQ ID NO: 142744 - protein, 11 aa, Homo sapiens
  Native (PMEL_HUMAN)
NNTIINGSQVW

SEQ ID NO: 142745 - protein, 10 aa, Homo sapiens
  Native (PMEL_HUMAN)
AHSSSAFTIT

SEQ ID NO: 142746 - protein, 11 aa, Homo sapiens
  Native (PMEL_HUMAN)
AESTGMTPEKV

SEQ ID NO: 142747 - protein, 8 aa, Homo sapiens
  Native (PMEL_HUMAN)
TGMTPAEV

SEQ ID NO: 142748 - protein, 9 aa, Homo sapiens
  Native (PMEL_HUMAN)
FSIALNFPG

SEQ ID NO: 142749 - protein, 11 aa, Homo sapiens
  Native (PMEL_HUMAN)
VPFSVSVSQLR

SEQ ID NO: 142750 - protein, 11 aa, Homo sapiens
  Native (PMEL_HUMAN)
RSYVPLAHSSS

SEQ ID NO: 142751 - protein, 8 aa, Homo sapiens
  Native (PMEL_HUMAN)
MGTTLAEM

SEQ ID NO: 142752 - protein, 8 aa, Homo sapiens
  Native (PMEL_HUMAN)
NASFSIAL

SEQ ID NO: 142753 - protein, 11 aa, Homo sapiens
  Native (PMEL_HUMAN)
VLPSPACQLVL

SEQ ID NO: 142754 - protein, 11 aa, Homo sapiens
  Native (PMEL_HUMAN)
FALQLHDPSGY

SEQ ID NO: 142755 - protein, 8 aa, Homo sapiens
  Native (PMEL_HUMAN)
FSVSVSQL

SEQ ID NO: 142756 - protein, 8 aa, Homo sapiens
  Native (PMEL_HUMAN)
HSSSHWLR

SEQ ID NO: 142757 - protein, 9 aa, Homo sapiens
  Native (PMEL_HUMAN)
LHDPSGYLA

SEQ ID NO: 142758 - protein, 9 aa, Homo sapiens
  Native (PMEL_HUMAN)
PLDCVLYRY

SEQ ID NO: 142759 - protein, 10 aa, Homo sapiens
  Native (PMEL_HUMAN)
FPDGGPCPSG

SEQ ID NO: 142760 - protein, 11 aa, Homo sapiens
  Native (PMEL_HUMAN)
LPKEACMEISS

SEQ ID NO: 142761 - protein, 11 aa, Homo sapiens
  Native (PMEL_HUMAN)
RQVPLDCVLYR

SEQ ID NO: 142762 - protein, 8 aa, Homo sapiens
  Native (PMEL_HUMAN)
SLIYRRRL

SEQ ID NO: 142763 - protein, 10 aa, Homo sapiens
  Native (PMEL_HUMAN)
LLHLAVIGAL

SEQ ID NO: 142764 - protein, 9 aa, Homo sapiens
  Native (PMEL_HUMAN)
DPSGYLAEA

SEQ ID NO: 142765 - protein, 10 aa, Homo sapiens
  Native (PMEL_HUMAN)
NNTIINGSQV

SEQ ID NO: 142766 - protein, 8 aa, Homo sapiens
  Native (PMEL_HUMAN)
MTPAEVSI

SEQ ID NO: 142767 - protein, 8 aa, Homo sapiens
  Native (PMEL_HUMAN)
VWGGQPVY

SEQ ID NO: 142768 - protein, 10 aa, Homo sapiens
  Native (PMEL_HUMAN)
DGTATLRLVK

SEQ ID NO: 142769 - protein, 10 aa, Homo sapiens
  Native (PMEL_HUMAN)
SPGCQPPAQR

SEQ ID NO: 142770 - protein, 8 aa, Homo sapiens
  Native (PMEL_HUMAN)
EVISTAPV

SEQ ID NO: 142771 - protein, 8 aa, Homo sapiens
  Native (PMEL_HUMAN)
NQPLTFAL

SEQ ID NO: 142772 - protein, 11 aa, Homo sapiens
  Native (PMEL_HUMAN)
THTMEVTVYHR

SEQ ID NO: 142773 - protein, 10 aa, Homo sapiens
  Native (PMEL_HUMAN)
GDSSGTLISR

SEQ ID NO: 142774 - protein, 11 aa, Homo sapiens
  Native (PMEL_HUMAN)
APTAEPSGTTS

SEQ ID NO: 142775 - protein, 10 aa, Homo sapiens
  Native (PMEL_HUMAN)
IPLTSCGSSP

SEQ ID NO: 142776 - protein, 9 aa, Homo sapiens
  Native (PMEL_HUMAN)
LPDGQVIWV

SEQ ID NO: 142777 - protein, 9 aa, Homo sapiens
  Native (PMEL_HUMAN)
NFPGSQKVL

SEQ ID NO: 142778 - protein, 9 aa, Homo sapiens
  Native (PMEL_HUMAN)
GVSRQLRTK

SEQ ID NO: 142779 - protein, 10 aa, Homo sapiens
  Native (PMEL_HUMAN)
NKHFLRNQPL

SEQ ID NO: 142780 - protein, 10 aa, Homo sapiens
  Native (PMEL_HUMAN)
PFSVSVSQLR

SEQ ID NO: 142781 - protein, 11 aa, Homo sapiens
  Native (PMEL_HUMAN)
VLYRYGSFSVT

SEQ ID NO: 142782 - protein, 9 aa, Homo sapiens
  Native (PMEL_HUMAN)
TEVVGTTPG

SEQ ID NO: 142783 - protein, 9 aa, Homo sapiens
  Native (PMEL_HUMAN)
LMAVVLASL

SEQ ID NO: 142784 - protein, 9 aa, Homo sapiens
  Native (PMEL_HUMAN)
RRGSRSYVP

SEQ ID NO: 142785 - protein, 8 aa, Homo sapiens
  Native (PMEL_HUMAN)
SIGTGRAM

SEQ ID NO: 142786 - protein, 10 aa, Homo sapiens
  Native (PMEL_HUMAN)
GTATLRLVKR

SEQ ID NO: 142787 - protein, 10 aa, Homo sapiens
  Native (PMEL_HUMAN)
EVSIVVLSGT

SEQ ID NO: 142788 - protein, 10 aa, Homo sapiens
  Native (PMEL_HUMAN)
LAVIGALLAV

SEQ ID NO: 142789 - protein, 8 aa, Homo sapiens
  Native (PMEL_HUMAN)
QLHDPSGY

SEQ ID NO: 142790 - protein, 10 aa, Homo sapiens
  Native (PMEL_HUMAN)
LVLMAVVLAS

SEQ ID NO: 142791 - protein, 8 aa, Homo sapiens
  Native (PMEL_HUMAN)
QPVLPSPA

SEQ ID NO: 142792 - protein, 8 aa, Homo sapiens
  Native (PMEL_HUMAN)
TPGQAPTA

SEQ ID NO: 142793 - protein, 10 aa, Homo sapiens
  Native (PMEL_HUMAN)
AVVLASLIYR

SEQ ID NO: 142794 - protein, 8 aa, Homo sapiens
  Native (PMEL_HUMAN)
TESITGSL

SEQ ID NO: 142795 - protein, 9 aa, Homo sapiens
  Native (PMEL_HUMAN)
LRNQPLTFA

SEQ ID NO: 142796 - protein, 10 aa, Homo sapiens
  Native (PMEL_HUMAN)
GILLVLMAVV

SEQ ID NO: 142797 - protein, 10 aa, Homo sapiens
  Native (PMEL_HUMAN)
ESITGSLGPL

SEQ ID NO: 142798 - protein, 10 aa, Homo sapiens
  Native (PMEL_HUMAN)
QLPHSSSHWL

SEQ ID NO: 142799 - protein, 9 aa, Homo sapiens
  Native (PMEL_HUMAN)
TDQVPFSVS

SEQ ID NO: 142800 - protein, 9 aa, Homo sapiens
  Native (PMEL_HUMAN)
FELTVSCQG

SEQ ID NO: 142801 - protein, 10 aa, Homo sapiens
  Native (PMEL_HUMAN)
APNTTAGQVP

SEQ ID NO: 142802 - protein, 9 aa, Homo sapiens
  Native (PMEL_HUMAN)
ALDGGNKHF

SEQ ID NO: 142803 - protein, 9 aa, Homo sapiens
  Native (PMEL_HUMAN)
QVPLDCVLY

SEQ ID NO: 142804 - protein, 9 aa, Homo sapiens
  Native (PMEL_HUMAN)
GENSPLLSG

SEQ ID NO: 142805 - protein, 9 aa, Homo sapiens
  Native (PMEL_HUMAN)
QDFSVPQLP

SEQ ID NO: 142806 - protein, 11 aa, Homo sapiens
  Native (PMEL_HUMAN)
TEWVETTAREL

SEQ ID NO: 142807 - protein, 8 aa, Homo sapiens
  Native (PMEL_HUMAN)
VVLASLIY

SEQ ID NO: 142808 - protein, 8 aa, Homo sapiens
  Native (PMEL_HUMAN)
CQPPAQRL

SEQ ID NO: 142809 - protein, 9 aa, Homo sapiens
  Native (PMEL_HUMAN)
APTAEPSGT

SEQ ID NO: 142810 - protein, 11 aa, Homo sapiens
  Native (PMEL_HUMAN)
QKVLPDGQVIW

SEQ ID NO: 142811 - protein, 9 aa, Homo sapiens
  Native (PMEL_HUMAN)
YLAEADLSY

SEQ ID NO: 142812 - protein, 9 aa, Homo sapiens
  Native (PMEL_HUMAN)
APVQMPTAE

SEQ ID NO: 142813 - protein, 10 aa, Homo sapiens
  Native (PMEL_HUMAN)
KVSNDGPTLI

SEQ ID NO: 142814 - protein, 10 aa, Homo sapiens
  Native (PMEL_HUMAN)
RRGSRSYVPL

SEQ ID NO: 142815 - protein, 8 aa, Homo sapiens
  Native (PMEL_HUMAN)
SQKRSFVY

SEQ ID NO: 142816 - protein, 11 aa, Homo sapiens
  Native (PMEL_HUMAN)
RALDGGNKHFL

SEQ ID NO: 142817 - protein, 11 aa, Homo sapiens
  Native (PMEL_HUMAN)
APNTTAGQVPT

SEQ ID NO: 142818 - protein, 9 aa, Homo sapiens
  Native (PMEL_HUMAN)
FLRNQPLTF

SEQ ID NO: 142819 - protein, 9 aa, Homo sapiens
  Native (PMEL_HUMAN)
SLADTNSLA

SEQ ID NO: 142820 - protein, 11 aa, Homo sapiens
  Native (PMEL_HUMAN)
RTKAWNRQLYP

SEQ ID NO: 142821 - protein, 11 aa, Homo sapiens
  Native (PMEL_HUMAN)
LTVSCQGGLPK

SEQ ID NO: 142822 - protein, 8 aa, Homo sapiens
  Native (PMEL_HUMAN)
VQVPTTEV

SEQ ID NO: 142823 - protein, 11 aa, Homo sapiens
  Native (PMEL_HUMAN)
ALQLHDPSGYL

SEQ ID NO: 142824 - protein, 8 aa, Homo sapiens
  Native (PMEL_HUMAN)
GQVPTTEV

SEQ ID NO: 142825 - protein, 10 aa, Homo sapiens
  Native (PMEL_HUMAN)
MDLVLKRCLL

SEQ ID NO: 142826 - protein, 10 aa, Homo sapiens
  Native (PMEL_HUMAN)
RSYVPLAHSS

SEQ ID NO: 142827 - protein, 10 aa, Homo sapiens
  Native (PMEL_HUMAN)
VSLADTNSLA

SEQ ID NO: 142828 - protein, 8 aa, Homo sapiens
  Native (PMEL_HUMAN)
VSNDGPTL

SEQ ID NO: 142829 - protein, 10 aa, Homo sapiens
  Native (PMEL_HUMAN)
KEACMEISSP

SEQ ID NO: 142830 - protein, 9 aa, Homo sapiens
  Native (PMEL_HUMAN)
WSQKRSFVY

SEQ ID NO: 142831 - protein, 10 aa, Homo sapiens
  Native (PMEL_HUMAN)
ASFSIALNFP

SEQ ID NO: 142832 - protein, 11 aa, Homo sapiens
  Native (PMEL_HUMAN)
GVSRQLRTKAW

SEQ ID NO: 142833 - protein, 8 aa, Homo sapiens
  Native (PMEL_HUMAN)
TDQVPFSV

SEQ ID NO: 142834 - protein, 9 aa, Homo sapiens
  Native (PMEL_HUMAN)
TESITGSLG

SEQ ID NO: 142835 - protein, 10 aa, Homo sapiens
  Native (PMEL_HUMAN)
RRLMKQDFSV

SEQ ID NO: 142836 - protein, 11 aa, Homo sapiens
  Native (PMEL_HUMAN)
QRLDCWRGGQV

SEQ ID NO: 142837 - protein, 9 aa, Homo sapiens
  Native (PMEL_HUMAN)
GTLISRALV

SEQ ID NO: 142838 - protein, 10 aa, Homo sapiens
  Native (PMEL_HUMAN)
VYVWKTWGQY

SEQ ID NO: 142839 - protein, 9 aa, Homo sapiens
  Native (PMEL_HUMAN)
SRQLRTKAW

SEQ ID NO: 142840 - protein, 10 aa, Homo sapiens
  Native (PMEL_HUMAN)
TESITGSLGP

SEQ ID NO: 142841 - protein, 11 aa, Homo sapiens
  Native (PMEL_HUMAN)
KHFLRNQPLTF

SEQ ID NO: 142842 - protein, 10 aa, Homo sapiens
  Native (PMEL_HUMAN)
QLRALDGGNK

SEQ ID NO: 142843 - protein, 8 aa, Homo sapiens
  Native (PMEL_HUMAN)
VLYRYGSF

SEQ ID NO: 142844 - protein, 9 aa, Homo sapiens
  Native (PMEL_HUMAN)
VIWVNNTII

SEQ ID NO: 142845 - protein, 10 aa, Homo sapiens
  Native (PMEL_HUMAN)
LYPEWTEAQR

SEQ ID NO: 142846 - protein, 10 aa, Homo sapiens
  Native (PMEL_HUMAN)
YPQETDDACI

SEQ ID NO: 142847 - protein, 8 aa, Homo sapiens
  Native (PMEL_HUMAN)
GDSSGTLI

SEQ ID NO: 142848 - protein, 11 aa, Homo sapiens
  Native (PMEL_HUMAN)
GQVPTTEVVGT

SEQ ID NO: 142849 - protein, 8 aa, Homo sapiens
  Native (PMEL_HUMAN)
ILLVLMAV

SEQ ID NO: 142850 - protein, 9 aa, Homo sapiens
  Native (PMEL_HUMAN)
SLIYRRRLM

SEQ ID NO: 142851 - protein, 9 aa, Homo sapiens
  Native (PMEL_HUMAN)
GQVPLIVGI

SEQ ID NO: 142852 - protein, 10 aa, Homo sapiens
  Native (PMEL_HUMAN)
KRQVPLDCVL

SEQ ID NO: 142853 - protein, 11 aa, Homo sapiens
  Native (PMEL_HUMAN)
ANASFSIALNF

SEQ ID NO: 142854 - protein, 11 aa, Homo sapiens
  Native (PMEL_HUMAN)
LGPLLDGTATL

SEQ ID NO: 142855 - protein, 9 aa, Homo sapiens
  Native (PMEL_HUMAN)
VLGGPVSGL

SEQ ID NO: 142856 - protein, 10 aa, Homo sapiens
  Native (PMEL_HUMAN)
LPRIFCSCPI

SEQ ID NO: 142857 - protein, 9 aa, Homo sapiens
  Native (PMEL_HUMAN)
EAGLGQVPL

SEQ ID NO: 142858 - protein, 11 aa, Homo sapiens
  Native (PMEL_HUMAN)
CSCPIGENSPL

SEQ ID NO: 142859 - protein, 10 aa, Homo sapiens
  Native (PMEL_HUMAN)
VLASLIYRRR

SEQ ID NO: 142860 - protein, 9 aa, Homo sapiens
  Native (PMEL_HUMAN)
SHWLRLPRI

SEQ ID NO: 142861 - protein, 9 aa, Homo sapiens
  Native (PMEL_HUMAN)
VPLDCVLYR

SEQ ID NO: 142862 - protein, 11 aa, Homo sapiens
  Native (PMEL_HUMAN)
HSSSHWLRLPR

SEQ ID NO: 142863 - protein, 11 aa, Homo sapiens
  Native (PMEL_HUMAN)
VPSGEGDAFEL

SEQ ID NO: 142864 - protein, 11 aa, Homo sapiens
  Native (PMEL_HUMAN)
EPEGPDASSIM

SEQ ID NO: 142865 - protein, 9 aa, Homo sapiens
  Native (PMEL_HUMAN)
SGEGDAFEL

SEQ ID NO: 142866 - protein, 10 aa, Homo sapiens
  Native (PMEL_HUMAN)
SSHWLRLPRI

SEQ ID NO: 142867 - protein, 11 aa, Homo sapiens
  Native (PMEL_HUMAN)
QPVLPSPACQL

SEQ ID NO: 142868 - protein, 8 aa, Homo sapiens
  Native (PMEL_HUMAN)
SPACQLVL

SEQ ID NO: 142869 - protein, 10 aa, Homo sapiens
  Native (PMEL_HUMAN)
LKRCLLHLAV

SEQ ID NO: 142870 - protein, 9 aa, Homo sapiens
  Native (PMEL_HUMAN)
AGLGQVPLI

SEQ ID NO: 142871 - protein, 9 aa, Homo sapiens
  Native (PMEL_HUMAN)
YLEPGPVTA

SEQ ID NO: 142872 - protein, 9 aa, Homo sapiens
  Native (PMEL_HUMAN)
KHFLRNQPL

SEQ ID NO: 142873 - protein, 10 aa, Homo sapiens
  Native (PMEL_HUMAN)
VLSGTTAAQV

SEQ ID NO: 142874 - protein, 11 aa, Homo sapiens
  Native (PMEL_HUMAN)
HRRGSRSYVPL

SEQ ID NO: 142875 - protein, 9 aa, Homo sapiens
  Native (PMEL_HUMAN)
ISRALVVTH

SEQ ID NO: 142876 - protein, 8 aa, Homo sapiens
  Native (PMEL_HUMAN)
AQVVLQAA

SEQ ID NO: 142877 - protein, 9 aa, Homo sapiens
  Native (PMEL_HUMAN)
TIINGSQVW

SEQ ID NO: 142878 - protein, 9 aa, Homo sapiens
  Native (PMEL_HUMAN)
LLVLMAVVL

SEQ ID NO: 142879 - protein, 9 aa, Homo sapiens
  Native (PMEL_HUMAN)
IVGILLVLM

SEQ ID NO: 142880 - protein, 11 aa, Homo sapiens
  Native (PMEL_HUMAN)
VPTTEVVGTTP

SEQ ID NO: 142881 - protein, 11 aa, Homo sapiens
  Native (PMEL_HUMAN)
LDGTATLRLVK

SEQ ID NO: 142882 - protein, 9 aa, Homo sapiens
  Native (PMEL_HUMAN)
TTAGQVPTT

SEQ ID NO: 142883 - protein, 10 aa, Homo sapiens
  Native (PMEL_HUMAN)
RYGSFSVTLD

SEQ ID NO: 142884 - protein, 11 aa, Homo sapiens
  Native (PMEL_HUMAN)
DCWRGGQVSLK

SEQ ID NO: 142885 - protein, 10 aa, Homo sapiens
  Native (PMEL_HUMAN)
GSFSVTLDIV

SEQ ID NO: 142886 - protein, 9 aa, Homo sapiens
  Native (PMEL_HUMAN)
DLVLKRCLL

SEQ ID NO: 142887 - protein, 11 aa, Homo sapiens
  Native (PMEL_HUMAN)
AQVVLQAAIPL

SEQ ID NO: 142888 - protein, 11 aa, Homo sapiens
  Native (PMEL_HUMAN)
LLDGTATLRLV

SEQ ID NO: 142889 - protein, 9 aa, Homo sapiens
  Native (PMEL_HUMAN)
GCQPPAQRL

SEQ ID NO: 142890 - protein, 9 aa, Homo sapiens
  Native (PMEL_HUMAN)
WNRQLYPEW

SEQ ID NO: 142891 - protein, 11 aa, Homo sapiens
  Native (PMEL_HUMAN)
FGDSSGTLISR

SEQ ID NO: 142892 - protein, 11 aa, Homo sapiens
  Native (PMEL_HUMAN)
CPIGENSPLLS

SEQ ID NO: 142893 - protein, 9 aa, Homo sapiens
  Native (PMEL_HUMAN)
CQGGLPKEA

SEQ ID NO: 142894 - protein, 9 aa, Homo sapiens
  Native (PMEL_HUMAN)
IVVLSGTTA

SEQ ID NO: 142895 - protein, 8 aa, Homo sapiens
  Native (PMEL_HUMAN)
LNFPGSQK

SEQ ID NO: 142896 - protein, 9 aa, Homo sapiens
  Native (PMEL_HUMAN)
TAEAPNTTA

SEQ ID NO: 142897 - protein, 10 aa, Homo sapiens
  Native (PMEL_HUMAN)
GPTLIGANAS

SEQ ID NO: 142898 - protein, 8 aa, Homo sapiens
  Native (PMEL_HUMAN)
LAVIGALL

SEQ ID NO: 142899 - protein, 11 aa, Homo sapiens
  Native (PMEL_HUMAN)
AMLGTHTMEVT

SEQ ID NO: 142900 - protein, 11 aa, Homo sapiens
  Native (PMEL_HUMAN)
QAVPSGEGDAF

SEQ ID NO: 142901 - protein, 10 aa, Homo sapiens
  Native (PMEL_HUMAN)
LVLKRCLLHL

SEQ ID NO: 142902 - protein, 10 aa, Homo sapiens
  Native (PMEL_HUMAN)
SSAFTITDQV

SEQ ID NO: 142903 - protein, 10 aa, Homo sapiens
  Native (PMEL_HUMAN)
MPTAESTGMT

SEQ ID NO: 142904 - protein, 10 aa, Homo sapiens
  Native (PMEL_HUMAN)
LRLVKRQVPL

SEQ ID NO: 142905 - protein, 9 aa, Homo sapiens
  Native (PMEL_HUMAN)
VSVSQLRAL

SEQ ID NO: 142906 - protein, 9 aa, Homo sapiens
  Native (PMEL_HUMAN)
THTYLEPGP

SEQ ID NO: 142907 - protein, 9 aa, Homo sapiens
  Native (PMEL_HUMAN)
GQEAGLGQV

SEQ ID NO: 142908 - protein, 9 aa, Homo sapiens
  Native (PMEL_HUMAN)
KTWGQYWQV

SEQ ID NO: 142909 - protein, 11 aa, Homo sapiens
  Native (PMEL_HUMAN)
LYPEWTEAQRL

SEQ ID NO: 142910 - protein, 10 aa, Homo sapiens
  Native (PMEL_HUMAN)
TGMTPAEVSI

SEQ ID NO: 142911 - protein, 11 aa, Homo sapiens
  Native (PMEL_HUMAN)
SGYLAEADLSY

SEQ ID NO: 142912 - protein, 11 aa, Homo sapiens
  Native (PMEL_HUMAN)
AEVSIVVLSGT

SEQ ID NO: 142913 - protein, 9 aa, Homo sapiens
  Native (PMEL_HUMAN)
PIGENSPLL

SEQ ID NO: 142914 - protein, 9 aa, Homo sapiens
  Native (PMEL_HUMAN)
TPEATGMTP

SEQ ID NO: 142915 - protein, 8 aa, Homo sapiens
  Native (PMEL_HUMAN)
IGENSPLL

SEQ ID NO: 142916 - protein, 11 aa, Homo sapiens
  Native (PMEL_HUMAN)
GEGDAFELTVS

SEQ ID NO: 142917 - protein, 10 aa, Homo sapiens
  Native (PMEL_HUMAN)
AAQVTTTEWV

SEQ ID NO: 142918 - protein, 10 aa, Homo sapiens
  Native (PMEL_HUMAN)
RQVPLDCVLY

SEQ ID NO: 142919 - protein, 11 aa, Homo sapiens
  Native (PMEL_HUMAN)
HTMEVTVYHRR

SEQ ID NO: 142920 - protein, 10 aa, Homo sapiens
  Native (PMEL_HUMAN)
MLGTHTMEVT

SEQ ID NO: 142921 - protein, 9 aa, Homo sapiens
  Native (PMEL_HUMAN)
VLPDGQVIW

SEQ ID NO: 142922 - protein, 10 aa, Homo sapiens
  Native (PMEL_HUMAN)
WTEAQRLDCW

SEQ ID NO: 142923 - protein, 10 aa, Homo sapiens
  Native (PMEL_HUMAN)
CLLHLAVIGA

SEQ ID NO: 142924 - protein, 10 aa, Homo sapiens
  Native (PMEL_HUMAN)
ALDGGNKHFL

SEQ ID NO: 142925 - protein, 10 aa, Homo sapiens
  Native (PMEL_HUMAN)
IESAEILQAV

SEQ ID NO: 142926 - protein, 11 aa, Homo sapiens
  Native (PMEL_HUMAN)
SQVWGGQPVYP

SEQ ID NO: 142927 - protein, 9 aa, Homo sapiens
  Native (PMEL_HUMAN)
LAVIGALLA

SEQ ID NO: 142928 - protein, 11 aa, Homo sapiens
  Native (PMEL_HUMAN)
KRQVPLDCVLY

SEQ ID NO: 142929 - protein, 10 aa, Homo sapiens
  Native (PMEL_HUMAN)
ELTVSCQGGL

SEQ ID NO: 142930 - protein, 11 aa, Homo sapiens
  Native (PMEL_HUMAN)
IALNFPGSQKV

SEQ ID NO: 142931 - protein, 10 aa, Homo sapiens
  Native (PMEL_HUMAN)
SVPQLPHSSS

SEQ ID NO: 142932 - protein, 11 aa, Homo sapiens
  Native (PMEL_HUMAN)
SEVMGTTLAEM

SEQ ID NO: 142933 - protein, 9 aa, Homo sapiens
  Native (PMEL_HUMAN)
TGRAMLGTH

SEQ ID NO: 142934 - protein, 10 aa, Homo sapiens
  Native (PMEL_HUMAN)
VPTTEVVGTT

SEQ ID NO: 142935 - protein, 11 aa, Homo sapiens
  Native (PMEL_HUMAN)
VLGGPVSGLSI

SEQ ID NO: 142936 - protein, 10 aa, Homo sapiens
  Native (PMEL_HUMAN)
SVSVSQLRAL

SEQ ID NO: 142937 - protein, 10 aa, Homo sapiens
  Native (PMEL_HUMAN)
LIMPGQEAGL

SEQ ID NO: 142938 - protein, 8 aa, Homo sapiens
  Native (PMEL_HUMAN)
HLAVIGAL

SEQ ID NO: 142939 - protein, 10 aa, Homo sapiens
  Native (PMEL_HUMAN)
DGGPCPSGSW

SEQ ID NO: 142940 - protein, 11 aa, Homo sapiens
  Native (PMEL_HUMAN)
YLEPGPVTAQV

SEQ ID NO: 142941 - protein, 8 aa, Homo sapiens
  Native (PMEL_HUMAN)
ETDDACIF

SEQ ID NO: 142942 - protein, 11 aa, Homo sapiens
  Native (PMEL_HUMAN)
SGLSIGTGRAM

SEQ ID NO: 142943 - protein, 10 aa, Homo sapiens
  Native (PMEL_HUMAN)
SGTYCLNVSL

SEQ ID NO: 142944 - protein, 9 aa, Homo sapiens
  Native (PMEL_HUMAN)
QAAIPLTSC

SEQ ID NO: 142945 - protein, 10 aa, Homo sapiens
  Native (PMEL_HUMAN)
VVLASLIYRR

SEQ ID NO: 142946 - protein, 11 aa, Homo sapiens
  Native (PMEL_HUMAN)
VPVSEVMGTTL

SEQ ID NO: 142947 - protein, 8 aa, Homo sapiens
  Native (PMEL_HUMAN)
TGMTPEKV

SEQ ID NO: 142948 - protein, 9 aa, Homo sapiens
  Native (PMEL_HUMAN)
ITDQVPFSV

SEQ ID NO: 142949 - protein, 9 aa, Homo sapiens
  Native (PMEL_HUMAN)
KRCLLHLAV

SEQ ID NO: 142950 - protein, 11 aa, Homo sapiens
  Native (PMEL_HUMAN)
VPQLPHSSSHW

SEQ ID NO: 142951 - protein, 10 aa, Homo sapiens
  Native (PMEL_HUMAN)
LLDGTATLRL

SEQ ID NO: 142952 - protein, 10 aa, Homo sapiens
  Native (PMEL_HUMAN)
FSVSVSQLRA

SEQ ID NO: 142953 - protein, 11 aa, Homo sapiens
  Native (PMEL_HUMAN)
SIALNFPGSQK

SEQ ID NO: 142954 - protein, 8 aa, Homo sapiens
  Native (PMEL_HUMAN)
LPIPEPEG

SEQ ID NO: 142955 - protein, 10 aa, Homo sapiens
  Native (PMEL_HUMAN)
PQLPHSSSHW

SEQ ID NO: 142956 - protein, 11 aa, Homo sapiens
  Native (PMEL_HUMAN)
STPEATGMTPA

SEQ ID NO: 142957 - protein, 9 aa, Homo sapiens
  Native (PMEL_HUMAN)
AEILQAVPS

SEQ ID NO: 142958 - protein, 9 aa, Homo sapiens
  Native (PMEL_HUMAN)
HSSSHWLRL

SEQ ID NO: 142959 - protein, 9 aa, Homo sapiens
  Native (PMEL_HUMAN)
VMGTTLAEM

SEQ ID NO: 142960 - protein, 9 aa, Homo sapiens
  Native (PMEL_HUMAN)
LAVGATKVP

SEQ ID NO: 142961 - protein, 11 aa, Homo sapiens
  Native (PMEL_HUMAN)
VTAQVVLQAAI

SEQ ID NO: 142962 - protein, 11 aa, Homo sapiens
  Native (PMEL_HUMAN)
IGALLAVGATK

SEQ ID NO: 142963 - protein, 11 aa, Homo sapiens
  Native (PMEL_HUMAN)
TVYHRRGSRSY

SEQ ID NO: 142964 - protein, 9 aa, Homo sapiens
  Native (PMEL_HUMAN)
AVVLASLIY

SEQ ID NO: 142965 - protein, 9 aa, Homo sapiens
  Native (PMEL_HUMAN)
LDGGNKHFL

SEQ ID NO: 142966 - protein, 10 aa, Homo sapiens
  Native (PMEL_HUMAN)
VPVSEVMGTT

SEQ ID NO: 142967 - protein, 11 aa, Homo sapiens
  Native (PMEL_HUMAN)
AEAPNTTAGQV

SEQ ID NO: 142968 - protein, 10 aa, Homo sapiens
  Native (PMEL_HUMAN)
GANASFSIAL

SEQ ID NO: 142969 - protein, 9 aa, Homo sapiens
  Native (PMEL_HUMAN)
ETTARELPI

SEQ ID NO: 142970 - protein, 11 aa, Homo sapiens
  Native (PMEL_HUMAN)
GIESAEILQAV

SEQ ID NO: 142971 - protein, 8 aa, Homo sapiens
  Native (PMEL_HUMAN)
QGIESAEI

SEQ ID NO: 142972 - protein, 11 aa, Homo sapiens
  Native (PMEL_HUMAN)
FVYVWKTWGQY

SEQ ID NO: 142973 - protein, 9 aa, Homo sapiens
  Native (PMEL_HUMAN)
VPSGEGDAF

SEQ ID NO: 142974 - protein, 9 aa, Homo sapiens
  Native (PMEL_HUMAN)
LPHSSSHWL

SEQ ID NO: 142975 - protein, 8 aa, Homo sapiens
  Native (PMEL_HUMAN)
SVSQLRAL

SEQ ID NO: 142976 - protein, 10 aa, Homo sapiens
  Native (PMEL_HUMAN)
HDPSGYLAEA

SEQ ID NO: 142977 - protein, 9 aa, Homo sapiens
  Native (PMEL_HUMAN)
LAVVSTQLI

SEQ ID NO: 142978 - protein, 9 aa, Homo sapiens
  Native (PMEL_HUMAN)
RIFCSCPIG

SEQ ID NO: 142979 - protein, 8 aa, Homo sapiens
  Native (PMEL_HUMAN)
LEPGPVTA

SEQ ID NO: 142980 - protein, 10 aa, Homo sapiens
  Native (PMEL_HUMAN)
SIVVLSGTTA

SEQ ID NO: 142981 - protein, 8 aa, Homo sapiens
  Native (PMEL_HUMAN)
LHLAVIGA

SEQ ID NO: 142982 - protein, 9 aa, Homo sapiens
  Native (PMEL_HUMAN)
PLAHSSSAF

SEQ ID NO: 142983 - protein, 10 aa, Homo sapiens
  Native (PMEL_HUMAN)
ALQLHDPSGY

SEQ ID NO: 142984 - protein, 8 aa, Homo sapiens
  Native (PMEL_HUMAN)
VSRQLRTK

SEQ ID NO: 142985 - protein, 10 aa, Homo sapiens
  Native (PMEL_HUMAN)
LDGGNKHFLR

SEQ ID NO: 142986 - protein, 9 aa, Homo sapiens
  Native (PMEL_HUMAN)
VQGIESAEI

SEQ ID NO: 142987 - protein, 9 aa, Homo sapiens
  Native (PMEL_HUMAN)
IGANASFSI

SEQ ID NO: 142988 - protein, 8 aa, Homo sapiens
  Native (PMEL_HUMAN)
RSYVPLAH

SEQ ID NO: 142989 - protein, 11 aa, Homo sapiens
  Native (PMEL_HUMAN)
IPLTSCGSSPV

SEQ ID NO: 142990 - protein, 10 aa, Homo sapiens
  Native (PMEL_HUMAN)
CPIGENSPLL

SEQ ID NO: 142991 - protein, 10 aa, Homo sapiens
  Native (PMEL_HUMAN)
SCPIGENSPL

SEQ ID NO: 142992 - protein, 9 aa, Homo sapiens
  Native (PMEL_HUMAN)
GHRPTAEAP

SEQ ID NO: 142993 - protein, 9 aa, Homo sapiens
  Native (PMEL_HUMAN)
CWRGGQVSL

SEQ ID NO: 142994 - protein, 9 aa, Homo sapiens
  Native (PMEL_HUMAN)
VPLIVGILL

SEQ ID NO: 142995 - protein, 9 aa, Homo sapiens
  Native (PMEL_HUMAN)
VQMPTAEST

SEQ ID NO: 142996 - protein, 11 aa, Homo sapiens
  Native (PMEL_HUMAN)
APVQMPTAEST

SEQ ID NO: 142997 - protein, 10 aa, Homo sapiens
  Native (PMEL_HUMAN)
IFPDGGPCPS

SEQ ID NO: 142998 - protein, 10 aa, Homo sapiens
  Native (PMEL_HUMAN)
PLLDGTATLR

SEQ ID NO: 142999 - protein, 9 aa, Homo sapiens
  Native (PMEL_HUMAN)
AVGATKVPR

SEQ ID NO: 143000 - protein, 11 aa, Homo sapiens
  Native (PMEL_HUMAN)
FLRNQPLTFAL

SEQ ID NO: 143001 - protein, 9 aa, Homo sapiens
  Native (PMEL_HUMAN)
QRLCQPVLP

SEQ ID NO: 143002 - protein, 8 aa, Homo sapiens
  Native (PMEL_HUMAN)
LMKQDFSV

SEQ ID NO: 143003 - protein, 10 aa, Homo sapiens
  Native (PMEL_HUMAN)
LPHSSSHWLR

SEQ ID NO: 143004 - protein, 9 aa, Homo sapiens
  Native (PMEL_HUMAN)
AGQVPTTEV

SEQ ID NO: 143005 - protein, 11 aa, Homo sapiens
  Native (PMEL_HUMAN)
ASLIYRRRLMK

SEQ ID NO: 143006 - protein, 10 aa, Homo sapiens
  Native (PMEL_HUMAN)
AEVSIVVLSG

SEQ ID NO: 143007 - protein, 9 aa, Homo sapiens
  Native (PMEL_HUMAN)
TAPVQMPTA

SEQ ID NO: 143008 - protein, 10 aa, Homo sapiens
  Native (PMEL_HUMAN)
TITDQVPFSV

SEQ ID NO: 143009 - protein, 10 aa, Homo sapiens
  Native (PMEL_HUMAN)
VGILLVLMAV

SEQ ID NO: 143010 - protein, 9 aa, Homo sapiens
  Native (PMEL_HUMAN)
VLQAAIPLT

SEQ ID NO: 143011 - protein, 9 aa, Homo sapiens
  Native (PMEL_HUMAN)
GPVSGLSIG

SEQ ID NO: 143012 - protein, 8 aa, Homo sapiens
  Native (PMEL_HUMAN)
QPVYPQET

SEQ ID NO: 143013 - protein, 8 aa, Homo sapiens
  Native (PMEL_HUMAN)
FVYVWKTW

SEQ ID NO: 143014 - protein, 10 aa, Homo sapiens
  Native (PMEL_HUMAN)
SSSHWLRLPR

SEQ ID NO: 143015 - protein, 9 aa, Homo sapiens
  Native (PMEL_HUMAN)
RLVKRQVPL

SEQ ID NO: 143016 - protein, 10 aa, Homo sapiens
  Native (PMEL_HUMAN)
TAGQVPTTEV

SEQ ID NO: 143017 - protein, 11 aa, Homo sapiens
  Native (PMEL_HUMAN)
VLMAVVLASLI

SEQ ID NO: 143018 - protein, 11 aa, Homo sapiens
  Native (PMEL_HUMAN)
LPIPEPEGPDA

SEQ ID NO: 143019 - protein, 10 aa, Homo sapiens
  Native (PMEL_HUMAN)
CWRGGQVSLK

SEQ ID NO: 143020 - protein, 10 aa, Homo sapiens
  Native (PMEL_HUMAN)
WDFGDSSGTL

SEQ ID NO: 143021 - protein, 11 aa, Homo sapiens
  Native (PMEL_HUMAN)
VVLASLIYRRR

SEQ ID NO: 143022 - protein, 10 aa, Homo sapiens
  Native (PMEL_HUMAN)
YGSFSVTLDI

SEQ ID NO: 143023 - protein, 11 aa, Homo sapiens
  Native (PMEL_HUMAN)
TPAEVSIVVLS

SEQ ID NO: 143024 - protein, 10 aa, Homo sapiens
  Native (PMEL_HUMAN)
TQLIMPGQEA

SEQ ID NO: 143025 - protein, 9 aa, Homo sapiens
  Native (PMEL_HUMAN)
KRQVPLDCV

SEQ ID NO: 143026 - protein, 10 aa, Homo sapiens
  Native (PMEL_HUMAN)
AEMSTPEATG

SEQ ID NO: 143027 - protein, 11 aa, Homo sapiens
  Native (PMEL_HUMAN)
LAEADLSYTWD

SEQ ID NO: 143028 - protein, 11 aa, Homo sapiens
  Native (PMEL_HUMAN)
GSWSQKRSFVY

SEQ ID NO: 143029 - protein, 9 aa, Homo sapiens
  Native (PMEL_HUMAN)
DQVPFSVSV

SEQ ID NO: 143030 - protein, 9 aa, Homo sapiens
  Native (PMEL_HUMAN)
ILLVLMAVV

SEQ ID NO: 143031 - protein, 9 aa, Homo sapiens
  Native (PMEL_HUMAN)
TAQVVLQAA

SEQ ID NO: 143032 - protein, 8 aa, Homo sapiens
  Native (PMEL_HUMAN)
IYRRRLMK

SEQ ID NO: 143033 - protein, 10 aa, Homo sapiens
  Native (PMEL_HUMAN)
QDWLGVSRQL

SEQ ID NO: 143034 - protein, 9 aa, Homo sapiens
  Native (PMEL_HUMAN)
GSWSQKRSF

SEQ ID NO: 143035 - protein, 11 aa, Homo sapiens
  Native (PMEL_HUMAN)
SPVPGTTDGHR

SEQ ID NO: 143036 - protein, 9 aa, Homo sapiens
  Native (PMEL_HUMAN)
AEPSGTTSV

SEQ ID NO: 143037 - protein, 9 aa, Homo sapiens
  Native (PMEL_HUMAN)
LLHLAVIGA

SEQ ID NO: 143038 - protein, 8 aa, Homo sapiens
  Native (PMEL_HUMAN)
LPHSSSHW

SEQ ID NO: 143039 - protein, 9 aa, Homo sapiens
  Native (PMEL_HUMAN)
SPACQLVLH

SEQ ID NO: 143040 - protein, 9 aa, Homo sapiens
  Native (PMEL_HUMAN)
QVPLIVGIL

SEQ ID NO: 143041 - protein, 9 aa, Homo sapiens
  Native (PMEL_HUMAN)
GTHTMEVTV

SEQ ID NO: 143042 - protein, 9 aa, Homo sapiens
  Native (PMEL_HUMAN)
PFSVSVSQL

SEQ ID NO: 143043 - protein, 9 aa, Homo sapiens
  Native (PMEL_HUMAN)
AQVTTTEWV

SEQ ID NO: 143044 - protein, 10 aa, Homo sapiens
  Native (PMEL_HUMAN)
LQAAIPLTSC

SEQ ID NO: 143045 - protein, 10 aa, Homo sapiens
  Native (PMEL_HUMAN)
KTWGQYWQVL

SEQ ID NO: 143046 - protein, 10 aa, Homo sapiens
  Native (PMEL_HUMAN)
LADTNSLAVV

SEQ ID NO: 143047 - protein, 10 aa, Homo sapiens
  Native (PMEL_HUMAN)
LKVSNDGPTL

SEQ ID NO: 143048 - protein, 8 aa, Homo sapiens
  Native (PMEL_HUMAN)
LPDGQVIW

SEQ ID NO: 143049 - protein, 9 aa, Homo sapiens
  Native (PMEL_HUMAN)
CVLYRYGSF

SEQ ID NO: 143050 - protein, 10 aa, Homo sapiens
  Native (PMEL_HUMAN)
QVPLIVGILL

SEQ ID NO: 143051 - protein, 8 aa, Homo sapiens
  Native (PMEL_HUMAN)
RELPIPEP

SEQ ID NO: 143052 - protein, 8 aa, Homo sapiens
  Native (PMEL_HUMAN)
VPRNQDWL

SEQ ID NO: 143053 - protein, 9 aa, Homo sapiens
  Native (PMEL_HUMAN)
WRGGQVSLK

SEQ ID NO: 143054 - protein, 8 aa, Homo sapiens
  Native (PMEL_HUMAN)
STPEATGM

SEQ ID NO: 143055 - protein, 8 aa, Homo sapiens
  Native (PMEL_HUMAN)
ISTAPVQM

SEQ ID NO: 143056 - protein, 10 aa, Homo sapiens
  Native (PMEL_HUMAN)
LHLAVIGALL

SEQ ID NO: 143057 - protein, 11 aa, Homo sapiens
  Native (PMEL_HUMAN)
LYRYGSFSVTL

SEQ ID NO: 143058 - protein, 10 aa, Homo sapiens
  Native (PMEL_HUMAN)
SWSQKRSFVY

SEQ ID NO: 143059 - protein, 10 aa, Homo sapiens
  Native (PMEL_HUMAN)
TPEATGMTPA

SEQ ID NO: 143060 - protein, 9 aa, Homo sapiens
  Native (PMEL_HUMAN)
VPTTEVVGT

SEQ ID NO: 143061 - protein, 10 aa, Homo sapiens
  Native (PMEL_HUMAN)
QVIWVNNTII

SEQ ID NO: 143062 - protein, 10 aa, Homo sapiens
  Native (PMEL_HUMAN)
VPRNQDWLGV

SEQ ID NO: 143063 - protein, 8 aa, Homo sapiens
  Native (PMEL_HUMAN)
VPQLPHSS

SEQ ID NO: 143064 - protein, 9 aa, Homo sapiens
  Native (PMEL_HUMAN)
LVLMAVVLA

SEQ ID NO: 143065 - protein, 9 aa, Homo sapiens
  Native (PMEL_HUMAN)
SITGSLGPL

SEQ ID NO: 143066 - protein, 11 aa, Homo sapiens
  Native (PMEL_HUMAN)
TYLEPGPVTAQ

SEQ ID NO: 143067 - protein, 9 aa, Homo sapiens
  Native (PMEL_HUMAN)
AVVSTQLIM

SEQ ID NO: 143068 - protein, 10 aa, Homo sapiens
  Native (PMEL_HUMAN)
NASFSIALNF

SEQ ID NO: 143069 - protein, 10 aa, Homo sapiens
  Native (PMEL_HUMAN)
RQLYPEWTEA

SEQ ID NO: 143070 - protein, 11 aa, Homo sapiens
  Native (PMEL_HUMAN)
SQKRSFVYVWK

SEQ ID NO: 143071 - protein, 8 aa, Homo sapiens
  Native (PMEL_HUMAN)
LLDGTATL

SEQ ID NO: 143072 - protein, 10 aa, Homo sapiens
  Native (PMEL_HUMAN)
SHWLRLPRIF

SEQ ID NO: 143073 - protein, 8 aa, Homo sapiens
  Native (PMEL_HUMAN)
HSSSAFTI

SEQ ID NO: 143074 - protein, 11 aa, Homo sapiens
  Native (PMEL_HUMAN)
KAWNRQLYPEW

SEQ ID NO: 143075 - protein, 10 aa, Homo sapiens
  Native (PMEL_HUMAN)
RQLRTKAWNR

SEQ ID NO: 143076 - protein, 11 aa, Homo sapiens
  Native (PMEL_HUMAN)
TTAGQVPTTEV

SEQ ID NO: 143077 - protein, 9 aa, Homo sapiens
  Native (PMEL_HUMAN)
CPSGSWSQK

SEQ ID NO: 143078 - protein, 10 aa, Homo sapiens
  Native (PMEL_HUMAN)
WRGGQVSLKV

SEQ ID NO: 143079 - protein, 9 aa, Homo sapiens
  Native (PMEL_HUMAN)
QLHDPSGYL

SEQ ID NO: 143080 - protein, 11 aa, Homo sapiens
  Native (PMEL_HUMAN)
VPLAHSSSAFT

SEQ ID NO: 143081 - protein, 10 aa, Homo sapiens
  Native (PMEL_HUMAN)
KRCLLHLAVI

SEQ ID NO: 143082 - protein, 8 aa, Homo sapiens
  Native (PMEL_HUMAN)
AMLGTHTM

SEQ ID NO: 143083 - protein, 9 aa, Homo sapiens
  Native (PMEL_HUMAN)
RSFVYVWKT

SEQ ID NO: 143084 - protein, 11 aa, Homo sapiens
  Native (PMEL_HUMAN)
QLPHSSSHWLR

SEQ ID NO: 143085 - protein, 8 aa, Homo sapiens
  Native (PMEL_HUMAN)
VLASLIYR

SEQ ID NO: 143086 - protein, 9 aa, Homo sapiens
  Native (PMEL_HUMAN)
NTIINGSQV

SEQ ID NO: 143087 - protein, 9 aa, Homo sapiens
  Native (PMEL_HUMAN)
TTPGQAPTA

SEQ ID NO: 143088 - protein, 8 aa, Homo sapiens
  Native (PMEL_HUMAN)
TYCLNVSL

SEQ ID NO: 143089 - protein, 11 aa, Homo sapiens
  Native (PMEL_HUMAN)
VPGTTDGHRPT

SEQ ID NO: 143090 - protein, 10 aa, Homo sapiens
  Native (PMEL_HUMAN)
VLKRCLLHLA

SEQ ID NO: 143091 - protein, 9 aa, Homo sapiens
  Native (PMEL_HUMAN)
YPQETDDAC

SEQ ID NO: 143092 - protein, 11 aa, Homo sapiens
  Native (PMEL_HUMAN)
SSHWLRLPRIF

SEQ ID NO: 143093 - protein, 8 aa, Homo sapiens
  Native (PMEL_HUMAN)
YRYGSFSV

SEQ ID NO: 143094 - protein, 9 aa, Homo sapiens
  Native (PMEL_HUMAN)
CQPVLPSPA

SEQ ID NO: 143095 - protein, 9 aa, Homo sapiens
  Native (PMEL_HUMAN)
NQDWLGVSR

SEQ ID NO: 143096 - protein, 11 aa, Homo sapiens
  Native (PMEL_HUMAN)
FSVTLDIVQGI

SEQ ID NO: 143097 - protein, 9 aa, Homo sapiens
  Native (PMEL_HUMAN)
LQAAIPLTS

SEQ ID NO: 143098 - protein, 9 aa, Homo sapiens
  Native (PMEL_HUMAN)
DGGNKHFLR

SEQ ID NO: 143099 - protein, 9 aa, Homo sapiens
  Native (PMEL_HUMAN)
PLLDGTATL

SEQ ID NO: 143100 - protein, 9 aa, Homo sapiens
  Native (PMEL_HUMAN)
LDCWRGGQV

SEQ ID NO: 143101 - protein, 8 aa, Homo sapiens
  Native (PMEL_HUMAN)
WQVLGGPV

SEQ ID NO: 143102 - protein, 10 aa, Homo sapiens
  Native (PMEL_HUMAN)
GPVSGLSIGT

SEQ ID NO: 143103 - protein, 9 aa, Homo sapiens
  Native (PMEL_HUMAN)
AQRLCQPVL

SEQ ID NO: 143104 - protein, 11 aa, Homo sapiens
  Native (PMEL_HUMAN)
IGANASFSIAL

SEQ ID NO: 143105 - protein, 9 aa, Homo sapiens
  Native (PMEL_HUMAN)
GPTLIGANA

SEQ ID NO: 143106 - protein, 8 aa, Homo sapiens
  Native (PMEL_HUMAN)
GEGDAFEL

SEQ ID NO: 143107 - protein, 9 aa, Homo sapiens
  Native (PMEL_HUMAN)
SPVPGTTDG

SEQ ID NO: 143108 - protein, 9 aa, Homo sapiens
  Native (PMEL_HUMAN)
TEWVETTAR

SEQ ID NO: 143109 - protein, 10 aa, Homo sapiens
  Native (PMEL_HUMAN)
RALDGGNKHF

SEQ ID NO: 143110 - protein, 9 aa, Homo sapiens
  Native (PMEL_HUMAN)
PSPACQLVL

SEQ ID NO: 143111 - protein, 8 aa, Homo sapiens
  Native (PMEL_HUMAN)
VLMAVVLA

SEQ ID NO: 143112 - protein, 10 aa, Homo sapiens
  Native (PMEL_HUMAN)
LEPGPVTAQV

SEQ ID NO: 143113 - protein, 10 aa, Homo sapiens
  Native (PMEL_HUMAN)
TPAEVSIVVL

SEQ ID NO: 143114 - protein, 9 aa, Homo sapiens
  Native (PMEL_HUMAN)
DFGDSSGTL

SEQ ID NO: 143115 - protein, 11 aa, Homo sapiens
  Native (PMEL_HUMAN)
IESAEILQAVP

SEQ ID NO: 143116 - protein, 10 aa, Homo sapiens
  Native (PMEL_HUMAN)
VPLAHSSSAF

SEQ ID NO: 143117 - protein, 10 aa, Homo sapiens
  Native (PMEL_HUMAN)
GTLISRALVV

SEQ ID NO: 143118 - protein, 10 aa, Homo sapiens
  Native (PMEL_HUMAN)
GTYCLNVSLA

SEQ ID NO: 143119 - protein, 9 aa, Homo sapiens
  Native (PMEL_HUMAN)
LYRYGSFSV

SEQ ID NO: 143120 - protein, 10 aa, Homo sapiens
  Native (PMEL_HUMAN)
GLPKEACMEI

SEQ ID NO: 143121 - protein, 9 aa, Homo sapiens
  Native (PMEL_HUMAN)
LTVSCQGGL

SEQ ID NO: 143122 - protein, 10 aa, Homo sapiens
  Native (PMEL_HUMAN)
YVWKTWGQYW

SEQ ID NO: 143123 - protein, 10 aa, Homo sapiens
  Native (PMEL_HUMAN)
PTLIGANASF

SEQ ID NO: 143124 - protein, 8 aa, Homo sapiens
  Native (PMEL_HUMAN)
EADLSYTW

SEQ ID NO: 143125 - protein, 8 aa, Homo sapiens
  Native (PMEL_HUMAN)
VPLDCVLY

SEQ ID NO: 143126 - protein, 11 aa, Homo sapiens
  Native (PMEL_HUMAN)
GMTPAEVSIVV

SEQ ID NO: 143127 - protein, 10 aa, Homo sapiens
  Native (PMEL_HUMAN)
GQVIWVNNTI

SEQ ID NO: 143128 - protein, 10 aa, Homo sapiens
  Native (PMEL_HUMAN)
LMAVVLASLI

SEQ ID NO: 143129 - protein, 9 aa, Homo sapiens
  Native (PMEL_HUMAN)
SQKRSFVYV

SEQ ID NO: 143130 - protein, 9 aa, Homo sapiens
  Native (PMEL_HUMAN)
DGHRPTAEA

SEQ ID NO: 143131 - protein, 10 aa, Homo sapiens
  Native (PMEL_HUMAN)
THTMEVTVYH

SEQ ID NO: 143132 - protein, 11 aa, Homo sapiens
  Native (PMEL_HUMAN)
SCPIGENSPLL

SEQ ID NO: 143133 - protein, 8 aa, Homo sapiens
  Native (PMEL_HUMAN)
TEVVGTTP

SEQ ID NO: 143134 - protein, 9 aa, Homo sapiens
  Native (PMEL_HUMAN)
LPRIFCSCP

SEQ ID NO: 143135 - protein, 8 aa, Homo sapiens
  Native (PMEL_HUMAN)
HTMEVTVY

SEQ ID NO: 143136 - protein, 11 aa, Homo sapiens
  Native (PMEL_HUMAN)
SYVPLAHSSSA

SEQ ID NO: 143137 - protein, 9 aa, Homo sapiens
  Native (PMEL_HUMAN)
GSGTYCLNV

SEQ ID NO: 143138 - protein, 11 aa, Homo sapiens
  Native (PMEL_HUMAN)
PPAQRLCQPVL

SEQ ID NO: 143139 - protein, 10 aa, Homo sapiens
  Native (PMEL_HUMAN)
AMLGTHTMEV

SEQ ID NO: 143140 - protein, 9 aa, Artificial Sequence
  Description of Artificial Sequence: Synthetic peptide
  Seed: AAIPLTSCG (PMEL_HUMAN)
  misc_feature (2)..(2): Xaa can be Ala, Val, Ser, Gln, Thr, Ile, Gly, Met, Glu, Leu, Asn, Cys, Phe, Pro, Asp, Tyr, Lys, or Ar g
  misc_feature (9)..(9): Xaa can be Tyr, Phe, Met, His, Leu, Ile, Val, Ala, Lys, Trp, Arg, Gln, Pro, Thr, Cys, Ser, or Gly
AXIPLTSCX

SEQ ID NO: 143141 - protein, 9 aa, Artificial Sequence
  Description of Artificial Sequence: Synthetic peptide
  Seed: AAQVTTTEW (PMEL_HUMAN)
  misc_feature (2)..(2): Xaa can be Ala, Ser, Gly, Val, Gln, Thr, Ile, Met, Leu, Phe, Tyr, Asn, Glu, Trp, Cys, Pro, Asp, Lys, His, or Arg
  misc_feature (9)..(9): Xaa can be Tyr, Phe, Trp, Met, Leu, Ile, Val, His, Lys, Ala, Arg, Cys, Thr, or Gln
AXQVTTTEX

SEQ ID NO: 143142 - protein, 10 aa, Artificial Sequence
  Description of Artificial Sequence: Synthetic peptide
  Seed: AAQVTTTEWV (PMEL_HUMAN)
  misc_feature (2)..(2): Xaa can be Met, Ala, Cys, Phe, Gly, Arg, Thr, Leu, Lys, Trp, Asp, Ser, Gln, Pro, Ile, Tyr, Asn, Val, His, or Glu
  misc_feature (10)..(10): Xaa can be Val, or Leu
AXQVTTTEWX

SEQ ID NO: 143143 - protein, 9 aa, Artificial Sequence
  Description of Artificial Sequence: Synthetic peptide
  Seed: ADLSYTWDF (PMEL_HUMAN)
  misc_feature (2)..(2): Xaa can be Glu, Asp, or Gln
  misc_feature (9)..(9): Xaa can be Tyr, Phe, Leu, Trp, Val, Ile, Met, His, Pro, Ala, Cys, or Thr
AXLSYTWDX

SEQ ID NO: 143144 - protein, 8 aa, Artificial Sequence
  Description of Artificial Sequence: Synthetic peptide
  Seed: ADTNSLAV (PMEL_HUMAN)
  misc_feature (2)..(2): Xaa can be Glu, or Asp
  misc_feature (8)..(8): Xaa can be Ile, Leu, Phe, Val, Met, Ala, Thr, or Cys
AXTNSLAX

SEQ ID NO: 143145 - protein, 9 aa, Artificial Sequence
  Description of Artificial Sequence: Synthetic peptide
  Seed: ADTNSLAVV (PMEL_HUMAN)
  misc_feature (2)..(2): Xaa can be Glu, Asp, or Gln
  misc_feature (9)..(9): Xaa can be Cys, Ile, Phe, Ala, Val, Leu, Met, Trp, Thr, Pro, Tyr, Glu, Gln, Ser, Asp, Arg, or Gly
AXTNSLAVX

SEQ ID NO: 143146 - protein, 8 aa, Artificial Sequence
  Description of Artificial Sequence: Synthetic peptide
  Seed: AEADLSYT (PMEL_HUMAN)
  misc_feature (2)..(2): Xaa can be , or Glu
  misc_feature (8)..(8): Xaa can be Pro, Leu, Val, Phe, Met, Thr, Ser, Ile, Cys, or Ala
AXADLSYX

SEQ ID NO: 143147 - protein, 9 aa, Artificial Sequence
  Description of Artificial Sequence: Synthetic peptide
  Seed: AEADLSYTW (PMEL_HUMAN)
  misc_feature (2)..(2): Xaa can be Glu, Gln, Asp, Leu, Met, Ile, Ala, Ser, Thr, Pro, Lys, Cys, Arg, Asn, Val, His, Gly, Phe, Tyr, or Trp
  misc_feature (9)..(9): Xaa can be Phe, Trp, Tyr, Val, Leu, Ile, Met, Cys, Ala, Thr, Pro, Gly, Lys, His, Ser, Arg, Glu, Asn, Gln, or Asp
AXADLSYTX

SEQ ID NO: 143148 - protein, 10 aa, Artificial Sequence
  Description of Artificial Sequence: Synthetic peptide
  Seed: AEADLSYTWD (PMEL_HUMAN)
  misc_feature (2)..(2): Xaa can be Glu, Gln, or Asp
  misc_feature (10)..(10): Xaa can be Trp, His, Pro, Asp, Met, Phe, Tyr, Gln, Glu, Gly, Leu, Lys, Ala, Asn, Ile, Thr, Cys, Ser, Val, or Arg
AXADLSYTWX

SEQ ID NO: 143149 - protein, 11 aa, Artificial Sequence
  Description of Artificial Sequence: Synthetic peptide
  Seed: AEADLSYTWDF (PMEL_HUMAN)
  misc_feature (2)..(2): Xaa can be Glu, Gln, or Asp
  misc_feature (11)..(11): Xaa can be Trp, Met, Lys, Arg, Asn, Thr, Val, Tyr, Glu, Ile, Gln, Gly, Phe, Ser, His, Leu, Cys, Ala, Pro, or Asp
AXADLSYTWDX

SEQ ID NO: 143150 - protein, 8 aa, Artificial Sequence
  Description of Artificial Sequence: Synthetic peptide
  Seed: AEAPNTTA (PMEL_HUMAN)
  misc_feature (2)..(2): Xaa can be Glu, Asp, or Gln
  misc_feature (8)..(8): Xaa can be Leu, Phe, Ala, Met, Trp, Tyr, Val, Ile, Cys, Pro, Ser, Gly, or Thr
AXAPNTTX

SEQ ID NO: 143151 - protein, 9 aa, Artificial Sequence
  Description of Artificial Sequence: Synthetic peptide
  Seed: AEAPNTTAG (PMEL_HUMAN)
  misc_feature (2)..(2): Xaa can be Glu, Asp, Gln, Ala, Ser, Val, Asn, Pro, Thr, Ile, or Gly
  misc_feature (9)..(9): Xaa can be Leu, Met, Phe, Val, Ile, Ala, Pro, Cys, Trp, Tyr, Thr, Gly, Arg, Lys, Ser, Asp, Gln, Asn, His, or Glu
AXAPNTTAX

SEQ ID NO: 143152 - protein, 10 aa, Artificial Sequence
  Description of Artificial Sequence: Synthetic peptide
  Seed: AEAPNTTAGQ (PMEL_HUMAN)
  misc_feature (2)..(2): Xaa can be Glu, Asp, or Gln
  misc_feature (10)..(10): Xaa can be Ala, Cys, Val, Met, Leu, Ile, Ser, Trp, Pro, Tyr, Gly, Glu, Asp, Gln, Phe, or Thr
AXAPNTTAGX

SEQ ID NO: 143153 - protein, 11 aa, Artificial Sequence
  Description of Artificial Sequence: Synthetic peptide
  Seed: AEAPNTTAGQV (PMEL_HUMAN)
  misc_feature (2)..(2): Xaa can be Glu, Asp, Gln, Leu, Val, Ile, Met, Ala, Lys, Thr, Asn, Ser, His, Arg, or Gly
  misc_feature (11)..(11): Xaa can be Trp, Ile, Leu, Val, Phe, Met, Cys, Tyr, Ala, Thr, Pro, Arg, His, Gly, Ser, or Lys
AXAPNTTAGQX

SEQ ID NO: 143154 - protein, 8 aa, Artificial Sequence
  Description of Artificial Sequence: Synthetic peptide
  Seed: AEILQAVP (PMEL_HUMAN)
  misc_feature (2)..(2): Xaa can be Glu, or Asp
  misc_feature (8)..(8): Xaa can be Ala, Ile, Leu, Val, Met, Cys, Ser, Gly, Phe, Pro, or Thr
AXILQAVX

SEQ ID NO: 143155 - protein, 9 aa, Artificial Sequence
  Description of Artificial Sequence: Synthetic peptide
  Seed: AEILQAVPS (PMEL_HUMAN)
  misc_feature (2)..(2): Xaa can be Glu, Asp, or Gln
  misc_feature (9)..(9): Xaa can be Cys, Met, Leu, Val, Phe, Ile, Ala, Pro, Ser, Thr, Tyr, Lys, Arg, Asn, His, Gln, Trp, Gly, Glu, or Asp
AXILQAVPX

SEQ ID NO: 143156 - protein, 10 aa, Artificial Sequence
  Description of Artificial Sequence: Synthetic peptide
  Seed: AEILQAVPSG (PMEL_HUMAN)
  misc_feature (2)..(2): Xaa can be Glu, Asp, or Gln
  misc_feature (10)..(10): Xaa can be Met, Ala, Cys, Leu, Ile, Phe, Val, Glu, Thr, Tyr, Gln, Pro, Ser, Gly, or Trp
AXILQAVPSX

SEQ ID NO: 143157 - protein, 8 aa, Artificial Sequence
  Description of Artificial Sequence: Synthetic peptide
  Seed: AEMSTPEA (PMEL_HUMAN)
  misc_feature (2)..(2): Xaa can be Glu, Asp, or Gln
  misc_feature (8)..(8): Xaa can be Leu, Phe, Ala, Val, Cys, Met, Ile, Pro, Gly, Ser, Tyr, or Thr
AXMSTPEX

SEQ ID NO: 143158 - protein, 9 aa, Artificial Sequence
  Description of Artificial Sequence: Synthetic peptide
  Seed: AEMSTPEAT (PMEL_HUMAN)
  misc_feature (2)..(2): Xaa can be Glu, Asp, Gln, Ala, Ser, Asn, Thr, Lys, Met, His, Val, or Pro
  misc_feature (9)..(9): Xaa can be Trp, Leu, Phe, Met, Thr, Pro, Val, Tyr, Ile, Cys, Ala, Gly, Lys, Ser, Arg, Asn, Asp, Glu, Gln, or His
AXMSTPEAX

SEQ ID NO: 143159 - protein, 10 aa, Artificial Sequence
  Description of Artificial Sequence: Synthetic peptide
  Seed: AEMSTPEATG (PMEL_HUMAN)
  misc_feature (2)..(2): Xaa can be Glu, Asp, Gln, Lys, Ser, Asn, or His
  misc_feature (10)..(10): Xaa can be Trp, Leu, Ile, Met, Cys, Val, Ala, Tyr, Phe, Pro, Thr, Arg, Lys, His, Asp, Gln, Glu, Ser, Gly, or Asn
AXMSTPEATX

SEQ ID NO: 143160 - protein, 11 aa, Artificial Sequence
  Description of Artificial Sequence: Synthetic peptide
  Seed: AEMSTPEATGM (PMEL_HUMAN)
  misc_feature (2)..(2): Xaa can be Glu, Gln, Asp, Met, Arg, Ala, Leu, Ile, Val, Ser, Thr, Lys, Gly, His, Asn, Pro, Tyr, Cys, Phe, or Trp
  misc_feature (11)..(11): Xaa can be Phe, Tyr, Leu, Trp, Met, Ile, Val, His, Cys, Lys, Ala, Thr, Arg, Glu, Gln, Asn, Asp, Gly, Pro, or Ser
AXMSTPEATGX

SEQ ID NO: 143161 - protein, 9 aa, Artificial Sequence
  Description of Artificial Sequence: Synthetic peptide
  Seed: AEPSGTTSV (PMEL_HUMAN)
  misc_feature (2)..(2): Xaa can be Ala, Glu, Ser, Val, Ile, Thr, Gln, Gly, Leu, Met, Asp, Arg, Asn, His, Cys, Phe, Pro, Tyr, Trp, or Lys
  misc_feature (9)..(9): Xaa can be Ile, Leu, Val, Tyr, Phe, Met, Cys, Ala, Trp, His, Thr, Lys, Arg, Pro, Gln, Ser, Glu, Gly, Asp, or Asn
AXPSGTTSX

SEQ ID NO: 143162 - protein, 11 aa, Artificial Sequence
  Description of Artificial Sequence: Synthetic peptide
  Seed: AEPSGTTSVQV (PMEL_HUMAN)
  misc_feature (2)..(2): Xaa can be Glu, Gln, Val, Ile, Asp, Met, or Leu
  misc_feature (11)..(11): Xaa can be Leu, Ile, Val, Phe, Met, Cys, Ala, Trp, Thr, Ser, Gly, Tyr, or Pro
AXPSGTTSVQX

SEQ ID NO: 143163 - protein, 8 aa, Artificial Sequence
  Description of Artificial Sequence: Synthetic peptide
  Seed: AESTGMTP (PMEL_HUMAN)
  misc_feature (2)..(2): Xaa can be Glu, Asp, or Gln
  misc_feature (8)..(8): Xaa can be Leu, Met, Ile, Ala, Val, Phe, Thr, Cys, Ser, Gly, or Pro
AXSTGMTX

SEQ ID NO: 143164 - protein, 9 aa, Artificial Sequence
  Description of Artificial Sequence: Synthetic peptide
  Seed: AESTGMTPE (PMEL_HUMAN)
  misc_feature (2)..(2): Xaa can be Glu, Asp, or Gln
  misc_feature (9)..(9): Xaa can be Ala, Cys, Pro, Ile, Val, Met, Leu, Phe, Ser, Asp, Tyr, Gln, Gly, Thr, or Glu
AXSTGMTPX

SEQ ID NO: 143165 - protein, 10 aa, Artificial Sequence
  Description of Artificial Sequence: Synthetic peptide
  Seed: AESTGMTPEK (PMEL_HUMAN)
  misc_feature (2)..(2): Xaa can be Val, Thr, Ser, Ile, Ala, His, Arg, Leu, Asp, Trp, Phe, Met, Lys, Gly, Asn, Gln, Glu, Cys, Pro, or Tyr
  misc_feature (10)..(10): Xaa can be Lys, Arg, or Tyr
AXSTGMTPEX

SEQ ID NO: 143166 - protein, 11 aa, Artificial Sequence
  Description of Artificial Sequence: Synthetic peptide
  Seed: AESTGMTPEKV (PMEL_HUMAN)
  misc_feature (2)..(2): Xaa can be Glu, Asp, or Gln
  misc_feature (11)..(11): Xaa can be Tyr, Trp, Phe, Met, Leu, Thr, Ile, Ala, Val, Gly, His, Pro, Ser, or Cys
AXSTGMTPEKX

SEQ ID NO: 143167 - protein, 8 aa, Artificial Sequence
  Description of Artificial Sequence: Synthetic peptide
  Seed: AEVSIVVL (PMEL_HUMAN)
  misc_feature (2)..(2): Xaa can be Glu, Asp, Gln, Asn, Gly, Met, Ser, Ala, Leu, His, Pro, Thr, Ile, or Val
  misc_feature (8)..(8): Xaa can be Ile, Val, Leu, Trp, Tyr, Ala, Met, Phe, Thr, Cys, Pro, Gly, Ser, Lys, or His
AXVSIVVX

SEQ ID NO: 143168 - protein, 9 aa, Artificial Sequence
  Description of Artificial Sequence: Synthetic peptide
  Seed: AEVSIVVLS (PMEL_HUMAN)
  misc_feature (2)..(2): Xaa can be Glu, Asp, Gln, Asn, Arg, Ser, Lys, or Ala
  misc_feature (9)..(9): Xaa can be Trp, Ile, Phe, Tyr, Leu, Ala, Met, Pro, Thr, Val, Cys, Gly, Ser, Lys, Arg, Asp, His, Asn, Glu, or Gln
AXVSIVVLX

SEQ ID NO: 143169 - protein, 10 aa, Artificial Sequence
  Description of Artificial Sequence: Synthetic peptide
  Seed: AEVSIVVLSG (PMEL_HUMAN)
  misc_feature (2)..(2): Xaa can be Glu, Asp, Gln, or Lys
  misc_feature (10)..(10): Xaa can be Trp, Ala, Cys, Leu, Phe, Ile, Val, Tyr, Met, Asn, Lys, Gly, Glu, Arg, Thr, Ser, Asp, His, Gln, or Pro
AXVSIVVLSX

SEQ ID NO: 143170 - protein, 11 aa, Artificial Sequence
  Description of Artificial Sequence: Synthetic peptide
  Seed: AEVSIVVLSGT (PMEL_HUMAN)
  misc_feature (2)..(2): Xaa can be , or Glu
  misc_feature (11)..(11): Xaa can be Ala, Pro, Leu, Thr, Cys, Val, Phe, Met, Ser, or Ile
AXVSIVVLSGX

SEQ ID NO: 143171 - protein, 10 aa, Artificial Sequence
  Description of Artificial Sequence: Synthetic peptide
  Seed: AFTITDQVPF (PMEL_HUMAN)
  misc_feature (2)..(2): Xaa can be Met, Gln, Tyr, Leu, Asn, His, Ala, Ser, Val, Glu, Cys, Pro, Gly, Trp, Phe, Asp, Lys, Thr, Ile, or Arg
  misc_feature (10)..(10): Xaa can be Phe, Tyr, Trp, Met, Leu, or Ile
AXTITDQVPX

SEQ ID NO: 143172 - protein, 9 aa, Artificial Sequence
  Description of Artificial Sequence: Synthetic peptide
  Seed: AGLGQVPLI (PMEL_HUMAN)
  misc_feature (2)..(2): Xaa can be Arg, Gln, Leu, Met, Thr, Ala, Ser, Ile, Val, Lys, Gly, Asn, Glu, Cys, Phe, Tyr, His, Asp, Pro, or Trp
  misc_feature (9)..(9): Xaa can be Val, Leu, Met, Ile, Phe, Tyr, Lys, Ala, Arg, Cys, Thr, Trp, Pro, Ser, Gly, His, Asn, Glu, or Gln
AXLGQVPLX

SEQ ID NO: 143173 - protein, 9 aa, Artificial Sequence
  Description of Artificial Sequence: Synthetic peptide
  Seed: AGQVPTTEV (PMEL_HUMAN)
  misc_feature (2)..(2): Xaa can be Ala, Ser, Val, Thr, Gln, Gly, Ile, Met, Phe, Leu, Glu, Cys, Arg, Pro, Asn, Asp, Tyr, His, Trp, or Lys
  misc_feature (9)..(9): Xaa can be Phe, Val, Tyr, Met, Leu, Ile, Lys, His, Arg, Trp, Ala, Cys, Thr, Gln, Pro, Gly, Asn, or Se r
AXQVPTTEX

SEQ ID NO: 143174 - protein, 9 aa, Artificial Sequence
  Description of Artificial Sequence: Synthetic peptide
  Seed: AHSSSAFTI (PMEL_HUMAN)
  misc_feature (2)..(2): Xaa can be His, Gln, Met, Lys, Arg, Ala, Ser, Glu, Tyr, Asn, Gly, Thr, Ile, Phe, Pro, Leu, Val, Asp, Trp, or Cys
  misc_feature (9)..(9): Xaa can be Leu, Phe, Tyr, Met, Ile, Val, Ala, Trp, His, Gly, Cys, Ser, Pro, or Thr
AXSSSAFTX

SEQ ID NO: 143175 - protein, 10 aa, Artificial Sequence
  Description of Artificial Sequence: Synthetic peptide
  Seed: AHSSSAFTIT (PMEL_HUMAN)
  misc_feature (2)..(2): Xaa can be , or His
  misc_feature (10)..(10): Xaa can be Met, Thr, Cys, Val, Leu, Ala, or Ile
AXSSSAFTIX

SEQ ID NO: 143176 - protein, 9 aa, Artificial Sequence
  Description of Artificial Sequence: Synthetic peptide
  Seed: ALDGGNKHF (PMEL_HUMAN)
  misc_feature (2)..(2): Xaa can be Ala, Tyr, Thr, Leu, Val, Ser, Ile, Gly, Phe, Met, Asn, Trp, Gln, Glu, Cys, Arg, Asp, Pro, His, or Lys
  misc_feature (9)..(9): Xaa can be Ile, Leu, Val, Trp, Tyr, Met, Phe, Lys, Ala, Cys, Arg, Thr, His, Ser, Pro, or Gln
AXDGGNKHX

SEQ ID NO: 143177 - protein, 10 aa, Artificial Sequence
  Description of Artificial Sequence: Synthetic peptide
  Seed: ALDGGNKHFL (PMEL_HUMAN)
  misc_feature (2)..(2): Xaa can be Thr, Ala, Val, Met, Ser, Ile, Leu, Tyr, Phe, Arg, Gly, Gln, Trp, Cys, Asn, Asp, Glu, His, Pro, or Lys
  misc_feature (10)..(10): Xaa can be Trp, Lys, Ile, Met, Tyr, Leu, Phe, Val, Arg, His, Cys, Ala, Thr, Gln, Glu, Asn, Ser, Gly, or Pro
AXDGGNKHFX

SEQ ID NO: 143178 - protein, 11 aa, Artificial Sequence
  Description of Artificial Sequence: Synthetic peptide
  Seed: ALDGGNKHFLR (PMEL_HUMAN)
  misc_feature (2)..(2): Xaa can be Thr, Ser, Val, Ile, Ala, Leu, Met, Gln, Gly, Asn, Cys, Phe, Trp, Tyr, Glu, Asp, Pro, or Ly s
  misc_feature (11)..(11): Xaa can be Tyr, Lys, Arg, Phe, His, Trp, Gln, Met, Leu, Ile, Val, Thr, Asn, Ala, Glu, or Cys
AXDGGNKHFLX

SEQ ID NO: 143179 - protein, 9 aa, Artificial Sequence
  Description of Artificial Sequence: Synthetic peptide
  Seed: ALLAVGATK (PMEL_HUMAN)
  misc_feature (2)..(2): Xaa can be Ala, Thr, Met, Ile, Leu, Ser, Val, Cys, Gly, Gln, Pro, Asn, Tyr, Asp, Trp, Phe, Glu, or Hi s
  misc_feature (9)..(9): Xaa can be Arg, Lys, Leu, Met, Phe, Tyr, His, Val, Ile, Trp, Cys, Gln, Ala, or Thr
AXLAVGATX

SEQ ID NO: 143180 - protein, 10 aa, Artificial Sequence
  Description of Artificial Sequence: Synthetic peptide
  Seed: ALLAVGATKV (PMEL_HUMAN)
  misc_feature (2)..(2): Xaa can be Gln, Leu, Met, Ile, Val, Phe, Thr, Tyr, Trp, Ala, Gly, Ser, Glu, Asn, His, Cys, Asp, Pro, Lys, or Arg
  misc_feature (10)..(10): Xaa can be Ile, Leu, Val, Arg, Lys, Met, Ala, Tyr, Phe, Thr, Cys, or Trp
AXLAVGATKX

SEQ ID NO: 143181 - protein, 9 aa, Artificial Sequence
  Description of Artificial Sequence: Synthetic peptide
  Seed: ALNFPGSQK (PMEL_HUMAN)
  misc_feature (2)..(2): Xaa can be Ala, Thr, Ser, Val, Gly, Ile, Gln, Met, Leu, Glu, Asn, Cys, Phe, Pro, Tyr, Asp, Trp, Lys, His, or Arg
  misc_feature (9)..(9): Xaa can be Tyr, Arg, Phe, Lys, Met, Leu, His, Trp, Val, Ile, Ala, Cys, Gly, Ser, Gln, Pro, or Thr
AXNFPGSQX

SEQ ID NO: 143182 - protein, 10 aa, Artificial Sequence
  Description of Artificial Sequence: Synthetic peptide
  Seed: ALNFPGSQKV (PMEL_HUMAN)
  misc_feature (2)..(2): Xaa can be Leu, Met, Gln, Ile, Val, Glu, Thr, Ala, or Ser
  misc_feature (10)..(10): Xaa can be Lys, Ile, Val, Arg, Tyr, Leu, Cys, Phe, Ala, Met, Trp, Gly, Asp, His, Glu, Ser, Gln, Thr, Asn, or Pro
AXNFPGSQKX

SEQ ID NO: 143183 - protein, 11 aa, Artificial Sequence
  Description of Artificial Sequence: Synthetic peptide
  Seed: ALNFPGSQKVL (PMEL_HUMAN)
  misc_feature (2)..(2): Xaa can be Leu, or Met
  misc_feature (11)..(11): Xaa can be Val, Leu, or Ile
AXNFPGSQKVX

SEQ ID NO: 143184 - protein, 10 aa, Artificial Sequence
  Description of Artificial Sequence: Synthetic peptide
  Seed: ALQLHDPSGY (PMEL_HUMAN)
  misc_feature (2)..(2): Xaa can be Met, Gln, Gly, Leu, Ala, Val, Ile, Ser, Thr, Glu, Lys, Asn, Asp, His, Cys, Pro, Tyr, Arg, Trp, or Phe
  misc_feature (10)..(10): Xaa can be Phe, Tyr, Lys, Arg, Met, or Trp
AXQLHDPSGX

SEQ ID NO: 143185 - protein, 11 aa, Artificial Sequence
  Description of Artificial Sequence: Synthetic peptide
  Seed: ALQLHDPSGYL (PMEL_HUMAN)
  misc_feature (2)..(2): Xaa can be Met, Leu, Phe, Tyr, Trp, Ser, Ile, Glu, Asn, Val, Pro, Asp, His, Gly, Thr, Lys, Gln, Cys, Arg, or Ala
  misc_feature (11)..(11): Xaa can be Val, Leu, or Ile
AXQLHDPSGYX

SEQ ID NO: 143186 - protein, 8 aa, Artificial Sequence
  Description of Artificial Sequence: Synthetic peptide
  Seed: ALVVTHTY (PMEL_HUMAN)
  misc_feature (2)..(2): Xaa can be Gln, Ala, Ser, Val, Met, Gly, Glu, Thr, Ile, Lys, Arg, Leu, Asn, Asp, Phe, Pro, His, Trp, Tyr, or Cys
  misc_feature (8)..(8): Xaa can be Tyr, Phe, Met, Leu, Ile, His, Val, or Trp
AXVVTHTX

SEQ ID NO: 143187 - protein, 9 aa, Artificial Sequence
  Description of Artificial Sequence: Synthetic peptide
  Seed: ALVVTHTYL (PMEL_HUMAN)
  misc_feature (2)..(2): Xaa can be Gln, Thr, Leu, Met, Ile, Ser, Val, Ala, Gly, Asn, Glu, Arg, Phe, Tyr, Asp, Cys, His, Pro, Trp, or Lys
  misc_feature (9)..(9): Xaa can be Tyr, Phe, Leu, Met, Val, Ile, Arg, Lys, Trp, Ala, His, or Cys
AXVVTHTYX

SEQ ID NO: 143188 - protein, 8 aa, Artificial Sequence
  Description of Artificial Sequence: Synthetic peptide
  Seed: AMLGTHTM (PMEL_HUMAN)
  misc_feature (2)..(2): Xaa can be Gln, Met, Lys, Ile, Glu, Ala, Leu, Val, Thr, Ser, Tyr, Asn, Phe, His, Arg, Pro, or Gly
  misc_feature (8)..(8): Xaa can be Tyr, Phe, Met, Leu, Trp, or Ile
AXLGTHTX

SEQ ID NO: 143189 - protein, 10 aa, Artificial Sequence
  Description of Artificial Sequence: Synthetic peptide
  Seed: AMLGTHTMEV (PMEL_HUMAN)
  misc_feature (2)..(2): Xaa can be Gln, Met, Leu, Val, Phe, Ile, Tyr, His, Lys, Cys, Asn, Thr, Ser, Ala, Arg, Asp, Pro, Trp, Gly, or Glu
  misc_feature (10)..(10): Xaa can be Leu, Ala, Val, Ile, Met, Thr, Cys, Phe, or Trp
AXLGTHTMEX

SEQ ID NO: 143190 - protein, 11 aa, Artificial Sequence
  Description of Artificial Sequence: Synthetic peptide
  Seed: AMLGTHTMEVT (PMEL_HUMAN)
  misc_feature (2)..(2): Xaa can be Leu, Met, Phe, Ile, or Tyr
  misc_feature (11)..(11): Xaa can be Val, Asp, Ser, Cys, Glu, Gln, Met, Ile, Pro, Arg, Asn, Ala, Lys, Thr, Trp, Gly, Tyr, Leu, Phe, or His
AXLGTHTMEVX

SEQ ID NO: 143191 - protein, 9 aa, Artificial Sequence
  Description of Artificial Sequence: Synthetic peptide
  Seed: ANASFSIAL (PMEL_HUMAN)
  misc_feature (2)..(2): Xaa can be Ala, Gln, Met, Arg, Ser, Gly, Ile, Thr, Val, Leu, Glu, Asn, Lys, His, Cys, Pro, Asp, Tyr, Phe, or Trp
  misc_feature (9)..(9): Xaa can be Leu, Tyr, Met, Phe, Ile, Val, Lys, His, Trp, Arg, Ala, Cys, Gly, Thr, Ser, Gln, Asn, or Pr o
AXASFSIAX

SEQ ID NO: 143192 - protein, 11 aa, Artificial Sequence
  Description of Artificial Sequence: Synthetic peptide
  Seed: ANASFSIALNF (PMEL_HUMAN)
  misc_feature (2)..(2): Xaa can be Ser, Tyr, Asn, Thr, Phe, Gln, Glu, Asp, Gly, Leu, Pro, Val, Lys, Ile, Ala, Arg, Cys, Met, His, or Trp
  misc_feature (11)..(11): Xaa can be Met, Phe, Tyr, or Trp
AXASFSIALNX

SEQ ID NO: 143193 - protein, 9 aa, Artificial Sequence
  Description of Artificial Sequence: Synthetic peptide
  Seed: APNTTAGQV (PMEL_HUMAN)
  misc_feature (2)..(2): Xaa can be Pro, or Ala
  misc_feature (9)..(9): Xaa can be Ala, Ile, Val, Leu, Tyr, Gly, Phe, Ser, Met, Thr, Pro, or Cys
AXNTTAGQX

SEQ ID NO: 143194 - protein, 10 aa, Artificial Sequence
  Description of Artificial Sequence: Synthetic peptide
  Seed: APNTTAGQVP (PMEL_HUMAN)
  misc_feature (2)..(2): Xaa can be Pro, or Ala
  misc_feature (10)..(10): Xaa can be Ala, Leu, Tyr, Lys, Ser, Pro, Trp, Arg, Cys, Thr, Gln, Gly, Phe, Met, Val, or Ile
AXNTTAGQVX

SEQ ID NO: 143195 - protein, 11 aa, Artificial Sequence
  Description of Artificial Sequence: Synthetic peptide
  Seed: APNTTAGQVPT (PMEL_HUMAN)
  misc_feature (2)..(2): Xaa can be , or Pro
  misc_feature (11)..(11): Xaa can be Ile, Arg, Thr, Met, Val, Cys, Pro, Lys, Ser, Tyr, Gly, Trp, Gln, His, Phe, Ala, or Leu
AXNTTAGQVPX

SEQ ID NO: 143196 - protein, 9 aa, Artificial Sequence
  Description of Artificial Sequence: Synthetic peptide
  Seed: APTAEPSGT (PMEL_HUMAN)
  misc_feature (2)..(2): Xaa can be Pro, or Ala
  misc_feature (9)..(9): Xaa can be Ala, Val, Leu, Pro, Gly, Thr, Met, Cys, Ser, Phe, Ile, or Tyr
AXTAEPSGX

SEQ ID NO: 143197 - protein, 10 aa, Artificial Sequence
  Description of Artificial Sequence: Synthetic peptide
  Seed: APTAEPSGTT (PMEL_HUMAN)
  misc_feature (2)..(2): Xaa can be , or Pro
  misc_feature (10)..(10): Xaa can be Met, Phe, Val, Tyr, Ile, Leu, Pro, Ala, Gly, Thr, Ser, or Cys
AXTAEPSGTX

SEQ ID NO: 143198 - protein, 11 aa, Artificial Sequence
  Description of Artificial Sequence: Synthetic peptide
  Seed: APTAEPSGTTS (PMEL_HUMAN)
  misc_feature (2)..(2): Xaa can be Pro, Ala, or Val
  misc_feature (11)..(11): Xaa can be Ala, Met, Leu, Phe, Cys, Pro, Lys, Arg, Thr, Ile, Gly, Val, His, Asn, Glu, Tyr, Trp, Ser, or Gln
AXTAEPSGTTX

SEQ ID NO: 143199 - protein, 8 aa, Artificial Sequence
  Description of Artificial Sequence: Synthetic peptide
  Seed: APVQMPTA (PMEL_HUMAN)
  misc_feature (2)..(2): Xaa can be , or Pro
  misc_feature (8)..(8): Xaa can be Ser, Pro, Ala, Phe, Ile, Leu, Val, Thr, Cys, Gly, or Met
AXVQMPTX

SEQ ID NO: 143200 - protein, 9 aa, Artificial Sequence
  Description of Artificial Sequence: Synthetic peptide
  Seed: APVQMPTAE (PMEL_HUMAN)
  misc_feature (2)..(2): Xaa can be Pro, Ala, Val, Gly, Ser, Leu, Ile, or Thr
  misc_feature (9)..(9): Xaa can be Ala, Val, Pro, Cys, Leu, Thr, Ile, Met, Asn, His, Lys, Trp, Arg, Tyr, Gly, Asp, Gln, Glu, Ser, or Phe
AXVQMPTAX

SEQ ID NO: 143201 - protein, 10 aa, Artificial Sequence
  Description of Artificial Sequence: Synthetic peptide
  Seed: APVQMPTAES (PMEL_HUMAN)
  misc_feature (2)..(2): Xaa can be Pro, or Ala
  misc_feature (10)..(10): Xaa can be Ala, Met, Cys, Tyr, Pro, Phe, Gly, Val, Ser, Thr, Leu, Arg, or Ile
AXVQMPTAEX

SEQ ID NO: 143202 - protein, 11 aa, Artificial Sequence
  Description of Artificial Sequence: Synthetic peptide
  Seed: APVQMPTAEST (PMEL_HUMAN)
  misc_feature (2)..(2): Xaa can be , or Pro
  misc_feature (11)..(11): Xaa can be Cys, Val, Met, Leu, Thr, Gly, Tyr, Phe, Trp, Ile, Ala, Pro, or Ser
AXVQMPTAESX

SEQ ID NO: 143203 - protein, 8 aa, Artificial Sequence
  Description of Artificial Sequence: Synthetic peptide
  Seed: AQRLCQPV (PMEL_HUMAN)
  misc_feature (2)..(2): Xaa can be Gln, Ala, or Glu
  misc_feature (8)..(8): Xaa can be Ile, Val, or Leu
AXRLCQPX

SEQ ID NO: 143204 - protein, 9 aa, Artificial Sequence
  Description of Artificial Sequence: Synthetic peptide
  Seed: AQRLCQPVL (PMEL_HUMAN)
  misc_feature (2)..(2): Xaa can be Ser, Val, Thr, Met, Ile, Tyr, Glu, Ala, Arg, Gln, Phe, Leu, Trp, Gly, His, Asp, Asn, Lys, Pro, or Cys
  misc_feature (9)..(9): Xaa can be Tyr, Phe, Leu, Ile, Met, Lys, Ala, Val, Ser, Arg, Gly, Thr, Trp, His, Pro, Cys, Gln, Asn, or Glu
AXRLCQPVX

SEQ ID NO: 143205 - protein, 8 aa, Artificial Sequence
  Description of Artificial Sequence: Synthetic peptide
  Seed: AQVTTTEW (PMEL_HUMAN)
  misc_feature (2)..(2): Xaa can be Gln, Glu, Lys, Met, Asp, Arg, Leu, Ala, Val, Thr, Ile, Ser, Asn, Gly, Tyr, His, Phe, or Pr o
  misc_feature (8)..(8): Xaa can be Tyr, Phe, Met, Leu, Trp, Ile, or His
AXVTTTEX

SEQ ID NO: 143206 - protein, 9 aa, Artificial Sequence
  Description of Artificial Sequence: Synthetic peptide
  Seed: AQVTTTEWV (PMEL_HUMAN)
  misc_feature (2)..(2): Xaa can be Met, Gln, Leu, Val, Ile, Thr, Ser, Ala, or Glu
  misc_feature (9)..(9): Xaa can be Leu, Phe, Trp, Val, Ile, Ala, Met, Thr, or Tyr
AXVTTTEWX

SEQ ID NO: 143207 - protein, 8 aa, Artificial Sequence
  Description of Artificial Sequence: Synthetic peptide
  Seed: AQVVLQAA (PMEL_HUMAN)
  misc_feature (2)..(2): Xaa can be Glu, His, Asp, Gln, Ala, Arg, Met, Thr, Gly, Pro, Ser, Asn, Leu, Val, Ile, or Lys
  misc_feature (8)..(8): Xaa can be Val, Ile, Leu, Met, Ala, Phe, Thr, Cys, Pro, Gly, Ser, Tyr, Lys, or Glu
AXVVLQAX

SEQ ID NO: 143208 - protein, 9 aa, Artificial Sequence
  Description of Artificial Sequence: Synthetic peptide
  Seed: AQVVLQAAI (PMEL_HUMAN)
  misc_feature (2)..(2): Xaa can be Glu, Gln, His, Asp, Arg, Met, Leu, Lys, Ile, Val, Ala, Asn, Ser, Thr, Gly, Pro, Phe, Tyr, Cys, or Trp
  misc_feature (9)..(9): Xaa can be Phe, Tyr, Leu, Met, Val, Ile, Trp, Ala, Thr, Cys, Pro, His, Ser, Lys, Arg, Gly, Glu, Asn, Gln, or Asp
AXVVLQAAX

SEQ ID NO: 143209 - protein, 11 aa, Artificial Sequence
  Description of Artificial Sequence: Synthetic peptide
  Seed: AQVVLQAAIPL (PMEL_HUMAN)
  misc_feature (2)..(2): Xaa can be Gln, Lys, Met, Arg, His, Ala, Ile, Ser, Tyr, Thr, Leu, Phe, Trp, or Val
  misc_feature (11)..(11): Xaa can be Val, Tyr, Phe, Met, Leu, or Ile
AXVVLQAAIPX

SEQ ID NO: 143210 - protein, 9 aa, Artificial Sequence
  Description of Artificial Sequence: Synthetic peptide
  Seed: ARELPIPEP (PMEL_HUMAN)
  misc_feature (2)..(2): Xaa can be Arg, His, Gln, Tyr, or Lys
  misc_feature (9)..(9): Xaa can be Leu, Ala, Val, Phe, Ile, Met, Gly, Lys, Tyr, Cys, Thr, Pro, Ser, Arg, or Trp
AXELPIPEX

SEQ ID NO: 143211 - protein, 9 aa, Artificial Sequence
  Description of Artificial Sequence: Synthetic peptide
  Seed: ASFSIALNF (PMEL_HUMAN)
  misc_feature (2)..(2): Xaa can be Arg, Gln, Met, Ala, Ser, Thr, Tyr, Leu, Glu, Val, Ile, Pro, Phe, Gly, Cys, His, Asp, Asn, Lys, or Trp
  misc_feature (9)..(9): Xaa can be Trp, Ile, Val, Met, Tyr, Arg, Leu, Phe, Lys, His, Ala, Cys, Gly, Thr, Ser, Pro, Asn, or Gl n
AXFSIALNX

SEQ ID NO: 143212 - protein, 10 aa, Artificial Sequence
  Description of Artificial Sequence: Synthetic peptide
  Seed: ASFSIALNFP (PMEL_HUMAN)
  misc_feature (2)..(2): Xaa can be Ser, Thr, Ala, Val, Met, or Ile
  misc_feature (10)..(10): Xaa can be Trp, Tyr, Phe, Met, Leu, Val, Ile, Asn, Arg, Ala, Asp, Glu, Lys, Thr, Cys, His, Gly, Gln, Ser, or Pro
AXFSIALNFX

SEQ ID NO: 143213 - protein, 9 aa, Artificial Sequence
  Description of Artificial Sequence: Synthetic peptide
  Seed: ASLIYRRRL (PMEL_HUMAN)
  misc_feature (2)..(2): Xaa can be Ala, Thr, Ser, Met, Gly, Leu, Pro, Glu, Asp, Cys, Ile, Gln, Asn, or Val
  misc_feature (9)..(9): Xaa can be Trp, Tyr, Leu, Met, Phe, Ile, or Val
AXLIYRRRX

SEQ ID NO: 143214 - protein, 11 aa, Artificial Sequence
  Description of Artificial Sequence: Synthetic peptide
  Seed: ASLIYRRRLMK (PMEL_HUMAN)
  misc_feature (2)..(2): Xaa can be Tyr, Trp, Val, Asn, Gln, Arg, Lys, Glu, Thr, Asp, Gly, Ser, Ile, Ala, Met, His, Leu, Phe, Pro, or Cys
  misc_feature (11)..(11): Xaa can be Tyr, Arg, or Lys
AXLIYRRRLMX

SEQ ID NO: 143215 - protein, 10 aa, Artificial Sequence
  Description of Artificial Sequence: Synthetic peptide
  Seed: ASSIMSTESI (PMEL_HUMAN)
  misc_feature (2)..(2): Xaa can be Ser, Thr, His, Lys, Gln, Ala, Leu, Cys, Trp, Arg, Met, Tyr, Phe, Asp, Val, Pro, Glu, Asn, Ile, or Gly
  misc_feature (10)..(10): Xaa can be Leu, Trp, Tyr, Phe, Met, or Ile
AXSIMSTESX

SEQ ID NO: 143216 - protein, 9 aa, Artificial Sequence
  Description of Artificial Sequence: Synthetic peptide
  Seed: ATGMTPAEV (PMEL_HUMAN)
  misc_feature (2)..(2): Xaa can be Ala, Ser, Thr, Val, Gly, Ile, Met, Leu, Gln, Asn, Cys, Tyr, Phe, Glu, Pro, or Asp
  misc_feature (9)..(9): Xaa can be Tyr, Phe, Met, Leu, Val, His, Ile, Lys, Arg, Ala, Trp, Cys, or Thr
AXGMTPAEX

SEQ ID NO: 143217 - protein, 10 aa, Artificial Sequence
  Description of Artificial Sequence: Synthetic peptide
  Seed: ATKVPRNQDW (PMEL_HUMAN)
  misc_feature (2)..(2): Xaa can be Ser, Thr, Asn, Leu, Asp, Ile, Ala, Cys, Gly, Met, Val, or Gln
  misc_feature (10)..(10): Xaa can be Trp, or Phe
AXKVPRNQDX

SEQ ID NO: 143218 - protein, 8 aa, Artificial Sequence
  Description of Artificial Sequence: Synthetic peptide
  Seed: ATLRLVKR (PMEL_HUMAN)
  misc_feature (2)..(2): Xaa can be Thr, Leu, Phe, Met, Val, or Tyr
  misc_feature (8)..(8): Xaa can be , or Arg
AXLRLVKX

SEQ ID NO: 143219 - protein, 10 aa, Artificial Sequence
  Description of Artificial Sequence: Synthetic peptide
  Seed: ATLRLVKRQV (PMEL_HUMAN)
  misc_feature (2)..(2): Xaa can be Thr, Ser, Ala, Gln, Phe, Met, Arg, Val, or Tyr
  misc_feature (10)..(10): Xaa can be Lys, Ala, or Val
AXLRLVKRQX

SEQ ID NO: 143220 - protein, 9 aa, Artificial Sequence
  Description of Artificial Sequence: Synthetic peptide
  Seed: AVGATKVPR (PMEL_HUMAN)
  misc_feature (2)..(2): Xaa can be Ala, Val, Thr, Ser, Ile, Gln, Pro, Tyr, Gly, Asn, Leu, Trp, Met, Phe, or Asp
  misc_feature (9)..(9): Xaa can be Lys, Arg, Leu, Met, Tyr, Phe, Ile, or Val
AXGATKVPX

SEQ ID NO: 143221 - protein, 9 aa, Artificial Sequence
  Description of Artificial Sequence: Synthetic peptide
  Seed: AVIGALLAV (PMEL_HUMAN)
  misc_feature (2)..(2): Xaa can be Pro, Ala, Gln, Leu, Met, Ser, Val, Thr, Ile, Arg, Gly, Cys, Glu, Phe, Asn, His, Tyr, Trp, Asp, or Lys
  misc_feature (9)..(9): Xaa can be Leu, Ile, Phe, Trp, Tyr, Arg, Val, Met, Lys, Ala, His, Cys, Thr, Ser, Gln, Gly, Pro, Glu, Asn, or Asp
AXIGALLAX

SEQ ID NO: 143222 - protein, 10 aa, Artificial Sequence
  Description of Artificial Sequence: Synthetic peptide
  Seed: AVIGALLAVG (PMEL_HUMAN)
  misc_feature (2)..(2): Xaa can be Met, Ala, Gln, Leu, Val, Ile, Ser, Thr, Phe, Trp, Tyr, Glu, Asn, Arg, Lys, Pro, Cys, Gly, Asp, or His
  misc_feature (10)..(10): Xaa can be Ile, Val, Ala, Leu, Glu, Arg, Lys, Met, Gly, Cys, Asn, Tyr, Gln, Asp, Pro, Thr, Ser, Phe, His, or Trp
AXIGALLAVX

SEQ ID NO: 143223 - protein, 11 aa, Artificial Sequence
  Description of Artificial Sequence: Synthetic peptide
  Seed: AVIGALLAVGA (PMEL_HUMAN)
  misc_feature (2)..(2): Xaa can be Gln, Met, Leu, Val, Ile, Thr, Ser, or Ala
  misc_feature (11)..(11): Xaa can be Val, Ile, Ala, Leu, Met, Thr, Ser, Cys, or Phe
AXIGALLAVGX

SEQ ID NO: 143224 - protein, 10 aa, Artificial Sequence
  Description of Artificial Sequence: Synthetic peptide
  Seed: AVPSGEGDAF (PMEL_HUMAN)
  misc_feature (2)..(2): Xaa can be Ala, Arg, Val, Tyr, Thr, Ser, Met, Ile, Pro, Gln, Phe, Gly, Leu, Trp, Cys, Lys, Glu, His, Asn, or Asp
  misc_feature (10)..(10): Xaa can be Tyr, Phe, Arg, Lys, Leu, Met, Trp, Ile, Val, His, Ala, Cys, or Gln
AXPSGEGDAX

SEQ ID NO: 143225 - protein, 9 aa, Artificial Sequence
  Description of Artificial Sequence: Synthetic peptide
  Seed: AVVLASLIY (PMEL_HUMAN)
  misc_feature (2)..(2): Xaa can be Gln, Met, Ala, Ser, Thr, Lys, His, Val, Pro, Ile, Gly, Leu, Asn, Arg, Glu, Tyr, Asp, Phe, Cys, or Trp
  misc_feature (9)..(9): Xaa can be Tyr, Phe, Met, Leu, Trp, His, Lys, Val, Ile, Arg, Ala, Thr, or Gly
AXVLASLIX

SEQ ID NO: 143226 - protein, 10 aa, Artificial Sequence
  Description of Artificial Sequence: Synthetic peptide
  Seed: AVVLASLIYR (PMEL_HUMAN)
  misc_feature (2)..(2): Xaa can be Tyr, Arg, Thr, Trp, Met, Lys, Phe, Gln, Pro, Gly, Asn, Glu, Val, Leu, Ser, Ala, Asp, Cys, Ile, or His
  misc_feature (10)..(10): Xaa can be Tyr, Lys, Arg, or His
AXVLASLIYX

SEQ ID NO: 143227 - protein, 11 aa, Artificial Sequence
  Description of Artificial Sequence: Synthetic peptide
  Seed: AVVLASLIYRR (PMEL_HUMAN)
  misc_feature (2)..(2): Xaa can be Lys, Gly, Pro, Cys, Ser, Ala, Phe, Trp, His, Tyr, Asn, Arg, Glu, Met, Leu, Thr, Ile, Asp, Gln, or Val
  misc_feature (11)..(11): Xaa can be Glu, Thr, Ile, His, Tyr, Cys, Lys, Ser, Gln, Arg, Met, Asp, Ala, Val, Trp, Phe, Asn, Pro, Gly, or Leu
AXVLASLIYRX

SEQ ID NO: 143228 - protein, 9 aa, Artificial Sequence
  Description of Artificial Sequence: Synthetic peptide
  Seed: AVVSTQLIM (PMEL_HUMAN)
  misc_feature (2)..(2): Xaa can be Ala, Gln, Gly, Val, Thr, Ser, Ile, Leu, Met, Asn, Lys, His, Cys, Glu, Phe, Asp, Pro, Arg, Tyr, or Trp
  misc_feature (9)..(9): Xaa can be Phe, Tyr, Met, Leu, Trp, Val, Ile, His, Lys, Arg, Ala, Gly, or Cys
AXVSTQLIX

SEQ ID NO: 143229 - protein, 10 aa, Artificial Sequence
  Description of Artificial Sequence: Synthetic peptide
  Seed: AWNRQLYPEW (PMEL_HUMAN)
  misc_feature (2)..(2): Xaa can be Tyr, Trp, or Phe
  misc_feature (10)..(10): Xaa can be Trp, Phe, Leu, Ile, Val, or Met
AXNRQLYPEX

SEQ ID NO: 143230 - protein, 10 aa, Artificial Sequence
  Description of Artificial Sequence: Synthetic peptide
  Seed: CLLHLAVIGA (PMEL_HUMAN)
  misc_feature (2)..(2): Xaa can be Leu, Met, Ala, Ser, Ile, Lys, His, Thr, Gly, Val, Gln, Phe, Arg, Tyr, Trp, Asn, Glu, Cys, Asp, or Pro
  misc_feature (10)..(10): Xaa can be Val, Ala, Leu, Ile, Met, or Thr
CXLHLAVIGX

SEQ ID NO: 143231 - protein, 9 aa, Artificial Sequence
  Description of Artificial Sequence: Synthetic peptide
  Seed: CPIGENSPL (PMEL_HUMAN)
  misc_feature (2)..(2): Xaa can be Pro, Ala, His, Val, Ile, Gln, Met, Leu, Ser, Thr, Gly, Cys, Phe, Arg, Tyr, or Lys
  misc_feature (9)..(9): Xaa can be Met, Tyr, Phe, Trp, Leu, Val, Ile, Ala, His, Ser, Gly, Pro, Cys, Gln, or Thr
CXIGENSPX

SEQ ID NO: 143232 - protein, 10 aa, Artificial Sequence
  Description of Artificial Sequence: Synthetic peptide
  Seed: CPIGENSPLL (PMEL_HUMAN)
  misc_feature (2)..(2): Xaa can be Pro, Ala, Met, Val, Ser, Ile, Gly, or Thr
  misc_feature (10)..(10): Xaa can be Trp, Tyr, Phe, Ile, Leu, Met, His, Val, Thr, Ala, Pro, Cys, or Ser
CXIGENSPLX

SEQ ID NO: 143233 - protein, 11 aa, Artificial Sequence
  Description of Artificial Sequence: Synthetic peptide
  Seed: CPIGENSPLLS (PMEL_HUMAN)
  misc_feature (2)..(2): Xaa can be , or Pro
  misc_feature (11)..(11): Xaa can be Pro, Phe, Thr, Ser, Ile, Met, Leu, Val, Cys, or Ala
CXIGENSPLLX

SEQ ID NO: 143234 - protein, 9 aa, Artificial Sequence
  Description of Artificial Sequence: Synthetic peptide
  Seed: CPSGSWSQK (PMEL_HUMAN)
  misc_feature (2)..(2): Xaa can be Thr, Val, Ile, Ala, Leu, Ser, Met, Pro, Asn, Phe, Gly, Gln, Asp, Tyr, or Glu
  misc_feature (9)..(9): Xaa can be Lys, Arg, Tyr, or His
CXSGSWSQX

SEQ ID NO: 143235 - protein, 9 aa, Artificial Sequence
  Description of Artificial Sequence: Synthetic peptide
  Seed: CQGGLPKEA (PMEL_HUMAN)
  misc_feature (2)..(2): Xaa can be His, Arg, or Gln
  misc_feature (9)..(9): Xaa can be Ala, Val, Met, Ile, Cys, Leu, or Thr
CXGGLPKEX

SEQ ID NO: 143236 - protein, 8 aa, Artificial Sequence
  Description of Artificial Sequence: Synthetic peptide
  Seed: CQLVLHQI (PMEL_HUMAN)
  misc_feature (2)..(2): Xaa can be Gln, Ala, Ser, Glu, His, Leu, Val, Gly, Ile, Asp, Met, Asn, Thr, Pro, or Lys
  misc_feature (8)..(8): Xaa can be Val, Ile, Leu, Met, Ala, Cys, or Phe
CXLVLHQX

SEQ ID NO: 143237 - protein, 9 aa, Artificial Sequence
  Description of Artificial Sequence: Synthetic peptide
  Seed: CQLVLHQIL (PMEL_HUMAN)
  misc_feature (2)..(2): Xaa can be Glu, Gln, His, Ser, Arg, Ala, Met, Asp, Leu, Lys, Gly, Pro, Ile, Val, Thr, Asn, Phe, or Cy s
  misc_feature (9)..(9): Xaa can be Tyr, Phe, Val, Met, Ile, Leu, Trp, Ala, Pro, His, Cys, or Thr
CXLVLHQIX

SEQ ID NO: 143238 - protein, 10 aa, Artificial Sequence
  Description of Artificial Sequence: Synthetic peptide
  Seed: CQLVLHQILK (PMEL_HUMAN)
  misc_feature (2)..(2): Xaa can be Leu, Trp, Phe, Tyr, Asn, Ile, Ala, Ser, Cys, Arg, Lys, Met, Val, Glu, Pro, Gly, Gln, Thr, Asp, or His
  misc_feature (10)..(10): Xaa can be Arg, or Lys
CXLVLHQILX

SEQ ID NO: 143239 - protein, 8 aa, Artificial Sequence
  Description of Artificial Sequence: Synthetic peptide
  Seed: CQPPAQRL (PMEL_HUMAN)
  misc_feature (2)..(2): Xaa can be Ala, Tyr, Ser, Ile, Val, Arg, Thr, Gly, Gln, Phe, Met, Leu, His, Pro, Glu, Trp, Cys, Asn, or Asp
  misc_feature (8)..(8): Xaa can be Leu, Ile, Met, Val, Phe, Tyr, or Trp
CXPPAQRX

SEQ ID NO: 143240 - protein, 9 aa, Artificial Sequence
  Description of Artificial Sequence: Synthetic peptide
  Seed: CQPPAQRLC (PMEL_HUMAN)
  misc_feature (2)..(2): Xaa can be Gln, Ala, Val, Met, Leu, Ser, Glu, Ile, Gly, Asn, Thr, Pro, or Asp
  misc_feature (9)..(9): Xaa can be Val, Ile, Leu, Met, Ala, Phe, or Cys
CXPPAQRLX

SEQ ID NO: 143241 - protein, 9 aa, Artificial Sequence
  Description of Artificial Sequence: Synthetic peptide
  Seed: CQPVLPSPA (PMEL_HUMAN)
  misc_feature (2)..(2): Xaa can be His, Arg, Gln, or Pro
  misc_feature (9)..(9): Xaa can be Ala, Val, Leu, Ile, Cys, Thr, or Met
CXPVLPSPX

SEQ ID NO: 143242 - protein, 11 aa, Artificial Sequence
  Description of Artificial Sequence: Synthetic peptide
  Seed: CSCPIGENSPL (PMEL_HUMAN)
  misc_feature (2)..(2): Xaa can be Ala, Ser, Thr, Val, Gly, Ile, Gln, Leu, Met, Cys, Phe, Glu, Asn, Pro, Tyr, Trp, Lys, His, Arg, or Asp
  misc_feature (11)..(11): Xaa can be Leu, Met, Lys, Arg, Trp, Phe, Tyr, His, Ile, Val, Cys, Ala, or Gln
CXCPIGENSPX

SEQ ID NO: 143243 - protein, 9 aa, Artificial Sequence
  Description of Artificial Sequence: Synthetic peptide
  Seed: CVLYRYGSF (PMEL_HUMAN)
  misc_feature (2)..(2): Xaa can be Gln, Met, Val, Leu, Ile, Ala, Pro, Thr, Ser, Gly, Asn, Phe, Lys, Arg, His, Glu, Trp, Tyr, Cys, or Asp
  misc_feature (9)..(9): Xaa can be Tyr, Leu, Met, Phe, Ile, Trp, Val, Ala, or His
CXLYRYGSX

SEQ ID NO: 143244 - protein, 11 aa, Artificial Sequence
  Description of Artificial Sequence: Synthetic peptide
  Seed: CVLYRYGSFSV (PMEL_HUMAN)
  misc_feature (2)..(2): Xaa can be Phe, Tyr, Met, Leu, Ser, Trp, His, Val, Thr, Arg, Ile, Lys, Gly, Gln, Ala, Asn, or Cys
  misc_feature (11)..(11): Xaa can be Val, Ile, Leu, Ala, Met, or Thr
CXLYRYGSFSX

SEQ ID NO: 143245 - protein, 9 aa, Artificial Sequence
  Description of Artificial Sequence: Synthetic peptide
  Seed: CWRGGQVSL (PMEL_HUMAN)
  misc_feature (2)..(2): Xaa can be Arg, Tyr, Gln, Ala, Gly, Met, Trp, Ser, Phe, Glu, Val, Asn, His, Lys, Ile, Thr, Leu, Cys, Asp, or Pro
  misc_feature (9)..(9): Xaa can be Leu, Met, Phe, Ile, Tyr, Val, Lys, Arg, Trp, Ala, His, or Cys
CXRGGQVSX

SEQ ID NO: 143246 - protein, 10 aa, Artificial Sequence
  Description of Artificial Sequence: Synthetic peptide
  Seed: CWRGGQVSLK (PMEL_HUMAN)
  misc_feature (2)..(2): Xaa can be Ala, Leu, Trp, Ile, Ser, Val, Phe, Thr, Tyr, Met, Asp, Gly, Gln, Asn, or Pro
  misc_feature (10)..(10): Xaa can be Arg, or Lys
CXRGGQVSLX

SEQ ID NO: 143247 - protein, 9 aa, Artificial Sequence
  Description of Artificial Sequence: Synthetic peptide
  Seed: DAFELTVSC (PMEL_HUMAN)
  misc_feature (2)..(2): Xaa can be His, Pro, Ala, Arg, Gln, Gly, Ser, Val, Lys, Glu, Ile, Asn, Met, Thr, Leu, Asp, Cys, Phe, Tyr, or Trp
  misc_feature (9)..(9): Xaa can be Tyr, Ile, Leu, Val, Phe, Met, Ala, Cys, Thr, Trp, Pro, Gly, Ser, His, Arg, Lys, Glu, Gln, Asn, or Asp
DXFELTVSX

SEQ ID NO: 143248 - protein, 11 aa, Artificial Sequence
  Description of Artificial Sequence: Synthetic peptide
  Seed: DCWRGGQVSLK (PMEL_HUMAN)
  misc_feature (2)..(2): Xaa can be Val, Thr, Ile, Asn, Met, Cys, Ala, Glu, Gly, Leu, Gln, Ser, Phe, or Pro
  misc_feature (11)..(11): Xaa can be Arg, Lys, His, Tyr, or Gln
DXWRGGQVSLX

SEQ ID NO: 143249 - protein, 9 aa, Artificial Sequence
  Description of Artificial Sequence: Synthetic peptide
  Seed: DFGDSSGTL (PMEL_HUMAN)
  misc_feature (2)..(2): Xaa can be Tyr, Arg, Phe, Trp, Ala, or Ile
  misc_feature (9)..(9): Xaa can be Leu, Met, Phe, or Tyr
DXGDSSGTX

SEQ ID NO: 143250 - protein, 9 aa, Artificial Sequence
  Description of Artificial Sequence: Synthetic peptide
  Seed: DGGNKHFLR (PMEL_HUMAN)
  misc_feature (2)..(2): Xaa can be Val, Thr, Ala, Ile, Phe, Asn, Met, Cys, Gly, Pro, Gln, Tyr, Ser, Leu, His, Trp, Asp, Glu, Lys, or Arg
  misc_feature (9)..(9): Xaa can be Arg, Lys, Tyr, Leu, Met, His, or Phe
DXGNKHFLX

SEQ ID NO: 143251 - protein, 10 aa, Artificial Sequence
  Description of Artificial Sequence: Synthetic peptide
  Seed: DGGPCPSGSW (PMEL_HUMAN)
  misc_feature (2)..(2): Xaa can be Ala, Ile, Pro, Val, Phe, Ser, Cys, Gly, Met, Thr, or Leu
  misc_feature (10)..(10): Xaa can be Trp, or Phe
DXGPCPSGSX

SEQ ID NO: 143252 - protein, 9 aa, Artificial Sequence
  Description of Artificial Sequence: Synthetic peptide
  Seed: DGHRPTAEA (PMEL_HUMAN)
  misc_feature (2)..(2): Xaa can be Pro, Ala, Ile, Leu, Met, Gly, or Val
  misc_feature (9)..(9): Xaa can be Ala, Ile, Leu, Val, Met, Gly, Cys, Phe, Ser, Thr, Tyr, or Pro
DXHRPTAEX

SEQ ID NO: 143253 - protein, 9 aa, Artificial Sequence
  Description of Artificial Sequence: Synthetic peptide
  Seed: DGTATLRLV (PMEL_HUMAN)
  misc_feature (2)..(2): Xaa can be Ala, Pro, Val, Gly, Gln, Ser, Ile, Met, Thr, Glu, or Leu
  misc_feature (9)..(9): Xaa can be Ile, Val, Leu, Met, Ala, Cys, or Phe
DXTATLRLX

SEQ ID NO: 143254 - protein, 10 aa, Artificial Sequence
  Description of Artificial Sequence: Synthetic peptide
  Seed: DGTATLRLVK (PMEL_HUMAN)
  misc_feature (2)..(2): Xaa can be Thr, Met, Tyr, Trp, His, Gly, Val, Lys, Glu, Ser, Ile, Pro, Gln, Asp, Phe, Arg, Ala, Leu, Cys, or Asn
  misc_feature (10)..(10): Xaa can be Lys, Arg, or Tyr
DXTATLRLVX

SEQ ID NO: 143255 - protein, 11 aa, Artificial Sequence
  Description of Artificial Sequence: Synthetic peptide
  Seed: DGTATLRLVKR (PMEL_HUMAN)
  misc_feature (2)..(2): Xaa can be Tyr, Ile, Asn, Met, Gly, Thr, Ser, Trp, Ala, Leu, Phe, Gln, or Val
  misc_feature (11)..(11): Xaa can be Arg, or Lys
DXTATLRLVKX

SEQ ID NO: 143256 - protein, 9 aa, Artificial Sequence
  Description of Artificial Sequence: Synthetic peptide
  Seed: DIVQGIESA (PMEL_HUMAN)
  misc_feature (2)..(2): Xaa can be Thr, Ala, Leu, Val, Ser, Ile, Met, Gly, Gln, or Asn
  misc_feature (9)..(9): Xaa can be Val, Ile, Leu, Ala, Met, Thr, or Phe
DXVQGIESX

SEQ ID NO: 143257 - protein, 8 aa, Artificial Sequence
  Description of Artificial Sequence: Synthetic peptide
  Seed: DLVLKRCL (PMEL_HUMAN)
  misc_feature (2)..(2): Xaa can be Leu, Met, Pro, Ala, Gln, Gly, Ile, Val, His, Phe, Ser, Arg, Cys, Asn, Lys, Thr, or Tyr
  misc_feature (8)..(8): Xaa can be Leu, Met, Ile, Phe, or Val
DXVLKRCX

SEQ ID NO: 143258 - protein, 9 aa, Artificial Sequence
  Description of Artificial Sequence: Synthetic peptide
  Seed: DLVLKRCLL (PMEL_HUMAN)
  misc_feature (2)..(2): Xaa can be Met, Pro, Leu, Ile, Ala, Gln, Gly, Val, Phe, Asn, Ser, Arg, Cys, Lys, Tyr, Thr, or His
  misc_feature (9)..(9): Xaa can be Leu, Met, Ile, Val, Phe, or Ala
DXVLKRCLX

SEQ ID NO: 143259 - protein, 9 aa, Artificial Sequence
  Description of Artificial Sequence: Synthetic peptide
  Seed: DPSGYLAEA (PMEL_HUMAN)
  misc_feature (2)..(2): Xaa can be Pro, or Ala
  misc_feature (9)..(9): Xaa can be Ala, Ile, Leu, Met, Val, Phe, Tyr, Pro, or Thr
DXSGYLAEX

SEQ ID NO: 143260 - protein, 9 aa, Artificial Sequence
  Description of Artificial Sequence: Synthetic peptide
  Seed: DQVPFSVSV (PMEL_HUMAN)
  misc_feature (2)..(2): Xaa can be Glu, Arg, His, Gln, Ala, Val, Asp, Ile, Thr, Ser, Pro, Leu, Lys, Met, Gly, Asn, Phe, Cys, Tyr, or Trp
  misc_feature (9)..(9): Xaa can be Phe, Leu, Tyr, Ile, Met, Val, Ala, Cys, Thr, Trp, His, Pro, Ser, Gly, Lys, Asp, Glu, Gln, Arg, or Asn
DXVPFSVSX

SEQ ID NO: 143261 - protein, 9 aa, Artificial Sequence
  Description of Artificial Sequence: Synthetic peptide
  Seed: DSSGTLISR (PMEL_HUMAN)
  misc_feature (2)..(2): Xaa can be Thr, Ile, Val, Ala, Ser, Gly, Leu, Met, Tyr, Phe, Cys, Asp, Asn, Gln, Trp, Lys, Glu, Pro, His, or Arg
  misc_feature (9)..(9): Xaa can be Arg, Lys, Tyr, Phe, Leu, Met, His, Gln, Ile, Val, Trp, or Ala
DXSGTLISX

SEQ ID NO: 143262 - protein, 10 aa, Artificial Sequence
  Description of Artificial Sequence: Synthetic peptide
  Seed: DSSGTLISRA (PMEL_HUMAN)
  misc_feature (2)..(2): Xaa can be Ala, Val, Thr, Ile, Ser, Met, Leu, or Gln
  misc_feature (10)..(10): Xaa can be Val, Ile, Leu, Ala, or Met
DXSGTLISRX

SEQ ID NO: 143263 - protein, 9 aa, Artificial Sequence
  Description of Artificial Sequence: Synthetic peptide
  Seed: DWLGVSRQL (PMEL_HUMAN)
  misc_feature (2)..(2): Xaa can be Tyr, Phe, or Trp
  misc_feature (9)..(9): Xaa can be Phe, Leu, Trp, Ile, Val, or Met
DXLGVSRQX

SEQ ID NO: 143264 - protein, 10 aa, Artificial Sequence
  Description of Artificial Sequence: Synthetic peptide
  Seed: DWLGVSRQLR (PMEL_HUMAN)
  misc_feature (2)..(2): Xaa can be Tyr, Phe, Asn, Val, Met, Ile, Thr, Ser, Gly, Trp, Ala, Gln, Leu, Lys, Glu, Arg, His, Pro, Cys, or Asp
  misc_feature (10)..(10): Xaa can be Arg, or Lys
DXLGVSRQLX

SEQ ID NO: 143265 - protein, 8 aa, Artificial Sequence
  Description of Artificial Sequence: Synthetic peptide
  Seed: EADLSYTW (PMEL_HUMAN)
  misc_feature (2)..(2): Xaa can be Met, Pro, Ser, Thr, Tyr, Ile, Val, Gly, Phe, Asn, Cys, Trp, Leu, Glu, or Ala
  misc_feature (8)..(8): Xaa can be Trp, Phe, or Tyr
EXDLSYTX

SEQ ID NO: 143266 - protein, 9 aa, Artificial Sequence
  Description of Artificial Sequence: Synthetic peptide
  Seed: EAGLGQVPL (PMEL_HUMAN)
  misc_feature (2)..(2): Xaa can be Ala, Pro, Val, Ser, Gln, Ile, Leu, Gly, Thr, Asn, Arg, Met, Phe, Asp, or Glu
  misc_feature (9)..(9): Xaa can be Lys, Tyr, Arg, Leu, Phe, Met, Ile, Val, Ala, or His
EXGLGQVPX

SEQ ID NO: 143267 - protein, 10 aa, Artificial Sequence
  Description of Artificial Sequence: Synthetic peptide
  Seed: EAPNTTAGQV (PMEL_HUMAN)
  misc_feature (2)..(2): Xaa can be Val, Thr, Ile, Ala, Ser, Leu, or Met
  misc_feature (10)..(10): Xaa can be Val, Ile, Ala, or Leu
EXPNTTAGQX

SEQ ID NO: 143268 - protein, 9 aa, Artificial Sequence
  Description of Artificial Sequence: Synthetic peptide
  Seed: EAQRLDCWR (PMEL_HUMAN)
  misc_feature (2)..(2): Xaa can be Leu, Phe, Ile, Trp, Ser, Val, Thr, Met, Tyr, Ala, Gln, Gly, or Asn
  misc_feature (9)..(9): Xaa can be Arg, or Lys
EXQRLDCWX

SEQ ID NO: 143269 - protein, 10 aa, Artificial Sequence
  Description of Artificial Sequence: Synthetic peptide
  Seed: EATGMTPAEV (PMEL_HUMAN)
  misc_feature (2)..(2): Xaa can be Thr, Val, Ser, Ala, Ile, Met, Phe, Pro, Asn, Cys, Leu, Tyr, Gly, Gln, or Trp
  misc_feature (10)..(10): Xaa can be Val, Ile, Leu, Ala, Met, or Thr
EXTGMTPAEX

SEQ ID NO: 143270 - protein, 9 aa, Artificial Sequence
  Description of Artificial Sequence: Synthetic peptide
  Seed: EGDAFELTV (PMEL_HUMAN)
  misc_feature (2)..(2): Xaa can be Ala, Arg, Leu, Tyr, Phe, Thr, Val, Met, Ile, Ser, Asn, Gly, Pro, Trp, Cys, His, Gln, Glu, Lys, or Asp
  misc_feature (9)..(9): Xaa can be Leu, Met, Ile, Phe, Val, Tyr, Cys, Ala, Thr, or Trp
EXDAFELTX

SEQ ID NO: 143271 - protein, 9 aa, Artificial Sequence
  Description of Artificial Sequence: Synthetic peptide
  Seed: EGPDASSIM (PMEL_HUMAN)
  misc_feature (2)..(2): Xaa can be Ala, Met, Ser, Val, Leu, Ile, Phe, Gly, Thr, Tyr, Asn, Cys, Gln, Arg, Trp, Pro, Asp, Glu, or His
  misc_feature (9)..(9): Xaa can be Met, Lys, Leu, Phe, Tyr, Arg, Ile, Val, His, or Trp
EXPDASSIX

SEQ ID NO: 143272 - protein, 9 aa, Artificial Sequence
  Description of Artificial Sequence: Synthetic peptide
  Seed: EKVPVSEVM (PMEL_HUMAN)
  misc_feature (2)..(2): Xaa can be His, Arg, Met, Gln, Ala, Ile, Leu, Val, Lys, Asn, Glu, Tyr, Ser, Pro, Thr, Gly, Phe, Asp, Trp, or Cys
  misc_feature (9)..(9): Xaa can be Tyr, Phe, Leu, Met, Ile, His, Trp, Val, Thr, Ala, Cys, or Gly
EXVPVSEVX

SEQ ID NO: 143273 - protein, 10 aa, Artificial Sequence
  Description of Artificial Sequence: Synthetic peptide
  Seed: ELTVSCQGGL (PMEL_HUMAN)
  misc_feature (2)..(2): Xaa can be Ser, Val, Lys, Leu, Met, Tyr, Arg, Asp, Trp, Phe, Glu, Thr, Cys, Pro, Ile, Ala, Asn, His, Gln, or Gly
  misc_feature (10)..(10): Xaa can be Val, Leu, or Ile
EXTVSCQGGX

SEQ ID NO: 143274 - protein, 10 aa, Artificial Sequence
  Description of Artificial Sequence: Synthetic peptide
  Seed: EMSTPEATGM (PMEL_HUMAN)
  misc_feature (2)..(2): Xaa can be Met, Leu, Ile, Ala, Ser, Gln, Val, Glu, His, Tyr, Pro, Thr, Phe, or Gly
  misc_feature (10)..(10): Xaa can be Tyr, Phe, or Met
EXSTPEATGX

SEQ ID NO: 143275 - protein, 10 aa, Artificial Sequence
  Description of Artificial Sequence: Synthetic peptide
  Seed: EPEGPDASSI (PMEL_HUMAN)
  misc_feature (2)..(2): Xaa can be , or Pro
  misc_feature (10)..(10): Xaa can be Met, Val, Ile, Ala, Phe, or Leu
EXEGPDASSX

SEQ ID NO: 143276 - protein, 11 aa, Artificial Sequence
  Description of Artificial Sequence: Synthetic peptide
  Seed: EPEGPDASSIM (PMEL_HUMAN)
  misc_feature (2)..(2): Xaa can be Pro, Ala, Val, Ser, or Thr
  misc_feature (11)..(11): Xaa can be Phe, Tyr, Trp, Met, Leu, or Ile
EXEGPDASSIX

SEQ ID NO: 143277 - protein, 9 aa, Artificial Sequence
  Description of Artificial Sequence: Synthetic peptide
  Seed: EPGPVTAQV (PMEL_HUMAN)
  misc_feature (2)..(2): Xaa can be Pro, Ala, Val, Ser, Gly, Gln, Ile, Met, Thr, Leu, Glu, or Cys
  misc_feature (9)..(9): Xaa can be Ile, Val, Tyr, Phe, Leu, Met, Ala, Cys, His, Trp, Pro, Ser, Gly, or Thr
EXGPVTAQX

SEQ ID NO: 143278 - protein, 10 aa, Artificial Sequence
  Description of Artificial Sequence: Synthetic peptide
  Seed: EPGPVTAQVV (PMEL_HUMAN)
  misc_feature (2)..(2): Xaa can be Pro, or Ala
  misc_feature (10)..(10): Xaa can be Ala, Leu, Met, Ile, Val, Tyr, Cys, Ser, Pro, Thr, or Phe
EXGPVTAQVX

SEQ ID NO: 143279 - protein, 11 aa, Artificial Sequence
  Description of Artificial Sequence: Synthetic peptide
  Seed: EPGPVTAQVVL (PMEL_HUMAN)
  misc_feature (2)..(2): Xaa can be Pro, Ala, Val, Cys, Thr, Gly, or Ser
  misc_feature (11)..(11): Xaa can be Trp, Tyr, Phe, Ile, Leu, Ala, Thr, Ser, Met, Gly, Pro, Cys, or Val
EXGPVTAQVVX

SEQ ID NO: 143280 - protein, 10 aa, Artificial Sequence
  Description of Artificial Sequence: Synthetic peptide
  Seed: EPSGTTSVQV (PMEL_HUMAN)
  misc_feature (2)..(2): Xaa can be Pro, or Ala
  misc_feature (10)..(10): Xaa can be Val, Leu, Ile, Tyr, Thr, Phe, Ala, or Met
EXSGTTSVQX

SEQ ID NO: 143281 - protein, 9 aa, Artificial Sequence
  Description of Artificial Sequence: Synthetic peptide
  Seed: ESAEILQAV (PMEL_HUMAN)
  misc_feature (2)..(2): Xaa can be Val, Thr, Ala, Ile, Glu, Ser, Met, Leu, Gln, Gly, Asp, Asn, Arg, Pro, Phe, Cys, Tyr, Lys, His, or Trp
  misc_feature (9)..(9): Xaa can be Arg, Leu, Lys, Phe, Met, Val, Tyr, Ile, Trp, Ala, Cys, His, Thr, Gln, Ser, Glu, Gly, Pro, or Asn
EXAEILQAX

SEQ ID NO: 143282 - protein, 10 aa, Artificial Sequence
  Description of Artificial Sequence: Synthetic peptide
  Seed: ESAEILQAVP (PMEL_HUMAN)
  misc_feature (2)..(2): Xaa can be Val, Thr, Ser, Ile, Ala, Leu, Met, Asn, Gly, Gln, Phe, Pro, or Cys
  misc_feature (10)..(10): Xaa can be Val, Ile, Leu, Met, Ala, Thr, His, Ser, Trp, Arg, Glu, Lys, Tyr, Gly, Cys, Phe, Asn, Pro, Gln, or Asp
EXAEILQAVX

SEQ ID NO: 143283 - protein, 10 aa, Artificial Sequence
  Description of Artificial Sequence: Synthetic peptide
  Seed: ESITGSLGPL (PMEL_HUMAN)
  misc_feature (2)..(2): Xaa can be Thr, Val, Ile, Ser, Ala, Met, Leu, Gln, Asn, Pro, Glu, Phe, Gly, Cys, Trp, Asp, Tyr, Lys, His, or Arg
  misc_feature (10)..(10): Xaa can be Ile, Val, Tyr, Arg, Lys, Trp, Met, Phe, Leu, His, Ala, Gln, Thr, Asn, Glu, Cys, or Ser
EXITGSLGPX

SEQ ID NO: 143284 - protein, 11 aa, Artificial Sequence
  Description of Artificial Sequence: Synthetic peptide
  Seed: ESITGSLGPLL (PMEL_HUMAN)
  misc_feature (2)..(2): Xaa can be Thr, Ser, Cys, Ala, Gly, Val, Leu, Pro, Gln, Asn, Phe, Met, or Ile
  misc_feature (11)..(11): Xaa can be Trp, Phe, Leu, or Tyr
EXITGSLGPLX

SEQ ID NO: 143285 - protein, 9 aa, Artificial Sequence
  Description of Artificial Sequence: Synthetic peptide
  Seed: ESTGMTPEK (PMEL_HUMAN)
  misc_feature (2)..(2): Xaa can be Val, Thr, Ala, Ile, Ser, Leu, Met, Gly, Phe, Tyr, Trp, Glu, Asp, Cys, Gln, Pro, or Asn
  misc_feature (9)..(9): Xaa can be Arg, Lys, Tyr, Phe, Leu, His, Met, Ile, Val, Ala, or Gln
EXTGMTPEX

SEQ ID NO: 143286 - protein, 10 aa, Artificial Sequence
  Description of Artificial Sequence: Synthetic peptide
  Seed: ESTGMTPEKV (PMEL_HUMAN)
  misc_feature (2)..(2): Xaa can be Thr, Val, Ser, Ile, or Ala
  misc_feature (10)..(10): Xaa can be Val, Leu, Ile, or Ala
EXTGMTPEKX

SEQ ID NO: 143287 - protein, 8 aa, Artificial Sequence
  Description of Artificial Sequence: Synthetic peptide
  Seed: ETDDACIF (PMEL_HUMAN)
  misc_feature (2)..(2): Xaa can be Thr, Ala, Ser, Leu, Ile, Phe, Val, Met, Gln, Cys, Asn, Tyr, Trp, or Gly
  misc_feature (8)..(8): Xaa can be Leu, Met, Ile, Phe, or Val
EXDDACIX

SEQ ID NO: 143288 - protein, 9 aa, Artificial Sequence
  Description of Artificial Sequence: Synthetic peptide
  Seed: ETTARELPI (PMEL_HUMAN)
  misc_feature (2)..(2): Xaa can be Thr, Val, Ser, Ile, or Ala
  misc_feature (9)..(9): Xaa can be Val, Ile, Leu, or Ala
EXTARELPX

SEQ ID NO: 143289 - protein, 8 aa, Artificial Sequence
  Description of Artificial Sequence: Synthetic peptide
  Seed: EVISTAPV (PMEL_HUMAN)
  misc_feature (2)..(2): Xaa can be Thr, Val, Ser, Ile, or Ala
  misc_feature (8)..(8): Xaa can be Val, Leu, Ile, or Ala
EXISTAPX

SEQ ID NO: 143290 - protein, 10 aa, Artificial Sequence
  Description of Artificial Sequence: Synthetic peptide
  Seed: EVISTAPVQM (PMEL_HUMAN)
  misc_feature (2)..(2): Xaa can be Val, Thr, Ile, Ala, Ser, Met, Leu, Gln, Gly, Glu, Phe, Asn, Cys, Tyr, Pro, Trp, His, Asp, Lys, or Arg
  misc_feature (10)..(10): Xaa can be Tyr, Lys, Arg, Phe, Trp, Met, Leu, Val, His, Ala, Ile, Gln, Asn, Thr, or Glu
EXISTAPVQX

SEQ ID NO: 143291 - protein, 9 aa, Artificial Sequence
  Description of Artificial Sequence: Synthetic peptide
  Seed: EVMGTTLAE (PMEL_HUMAN)
  misc_feature (2)..(2): Xaa can be Thr, Val, Ala, Ile, Ser, Leu, Met, Gly, Cys, Asn, Gln, Phe, Trp, Asp, Tyr, Pro, Glu, His, or Lys
  misc_feature (9)..(9): Xaa can be Arg, Lys, Tyr, His, Phe, Met, Leu, Val, Ala, Gln, Ile, Trp, Asn, Thr, Cys, Gly, Glu, or Se r
EXMGTTLAX

SEQ ID NO: 143292 - protein, 10 aa, Artificial Sequence
  Description of Artificial Sequence: Synthetic peptide
  Seed: EVMGTTLAEM (PMEL_HUMAN)
  misc_feature (2)..(2): Xaa can be Val, Thr, Ala, Ser, Ile, Met, Leu, Gln, Pro, Gly, Asn, Glu, Cys, Phe, Asp, Lys, Tyr, His, Trp, or Arg
  misc_feature (10)..(10): Xaa can be Tyr, Lys, Arg, Phe, Trp, Val, Ile, Met, Leu, Ala, His, Thr, Gln, Cys, Glu, Asn, or Ser
EXMGTTLAEX

SEQ ID NO: 143293 - protein, 10 aa, Artificial Sequence
  Description of Artificial Sequence: Synthetic peptide
  Seed: EVSIVVLSGT (PMEL_HUMAN)
  misc_feature (2)..(2): Xaa can be Thr, Leu, Asp, Cys, Gln, Lys, Arg, Ile, Met, Asn, Pro, His, Tyr, Trp, Glu, Ser, Gly, Phe, Ala, or Val
  misc_feature (10)..(10): Xaa can be Leu, Met, Ala, Thr, Ile, Val, Cys, or Ser
EXSIVVLSGX

SEQ ID NO: 143294 - protein, 8 aa, Artificial Sequence
  Description of Artificial Sequence: Synthetic peptide
  Seed: EVTVYHRR (PMEL_HUMAN)
  misc_feature (2)..(2): Xaa can be Val, Met, Trp, Thr, Tyr, Phe, Ile, Ser, Leu, or Ala
  misc_feature (8)..(8): Xaa can be Arg, or Lys
EXTVYHRX

SEQ ID NO: 143295 - protein, 11 aa, Artificial Sequence
  Description of Artificial Sequence: Synthetic peptide
  Seed: EVTVYHRRGSR (PMEL_HUMAN)
  misc_feature (2)..(2): Xaa can be Ala, Trp, Phe, Tyr, Val, Cys, Ile, His, Thr, Gln, Met, Leu, Asn, Gly, or Ser
  misc_feature (11)..(11): Xaa can be , or Arg
EXTVYHRRGSX

SEQ ID NO: 143296 - protein, 9 aa, Artificial Sequence
  Description of Artificial Sequence: Synthetic peptide
  Seed: EVVGTTPGQ (PMEL_HUMAN)
  misc_feature (2)..(2): Xaa can be Val, Thr, Ile, Ala, Leu, Ser, Met, Gly, Asn, Trp, Asp, Pro, Glu, Cys, Tyr, Gln, Phe, Lys, or His
  misc_feature (9)..(9): Xaa can be Arg, Lys, Tyr, Val, Leu, Phe, His, Met, Ile, Gln, Ala, Trp, or Thr
EXVGTTPGX

SEQ ID NO: 143297 - protein, 10 aa, Artificial Sequence
  Description of Artificial Sequence: Synthetic peptide
  Seed: EVVGTTPGQA (PMEL_HUMAN)
  misc_feature (2)..(2): Xaa can be Val, Thr, Ile, Ser, Ala, Met, Leu, Gln, Gly, Asn, Phe, Trp, Cys, Pro, Tyr, Asp, Glu, Lys, or His
  misc_feature (10)..(10): Xaa can be Arg, Lys, Tyr, Phe, Val, Leu, Met, Gln, His, Ile, Ala, Trp, Asn, Glu, Thr, or Cys
EXVGTTPGQX

SEQ ID NO: 143298 - protein, 11 aa, Artificial Sequence
  Description of Artificial Sequence: Synthetic peptide
  Seed: FALQLHDPSGY (PMEL_HUMAN)
  misc_feature (2)..(2): Xaa can be Ala, Ser, Met, Pro, Gln, Thr, Gly, Val, Lys, Ile, Leu, Asn, Asp, Trp, His, Arg, Glu, Tyr, Phe, or Cys
  misc_feature (11)..(11): Xaa can be Phe, Tyr, Lys, Met, Arg, Trp, Leu, or His
FXLQLHDPSGX

SEQ ID NO: 143299 - protein, 9 aa, Artificial Sequence
  Description of Artificial Sequence: Synthetic peptide
  Seed: FELTVSCQG (PMEL_HUMAN)
  misc_feature (2)..(2): Xaa can be Glu, or Asp
  misc_feature (9)..(9): Xaa can be Ile, Val, Pro, Leu, Cys, Ala, Tyr, Met, Phe, Thr, Ser, Asp, or Gly
FXLTVSCQX

SEQ ID NO: 143300 - protein, 11 aa, Artificial Sequence
  Description of Artificial Sequence: Synthetic peptide
  Seed: FELTVSCQGGL (PMEL_HUMAN)
  misc_feature (2)..(2): Xaa can be , or Glu
  misc_feature (11)..(11): Xaa can be Met, Ile, Phe, Leu, Ala, Val, or Cys
FXLTVSCQGGX

SEQ ID NO: 143301 - protein, 8 aa, Artificial Sequence
  Description of Artificial Sequence: Synthetic peptide
  Seed: FGDSSGTL (PMEL_HUMAN)
  misc_feature (2)..(2): Xaa can be Ala, Ile, Val, Leu, Ser, Phe, Tyr, Gly, Thr, Trp, Met, Asn, Pro, Cys, Asp, Gln, Arg, His, Glu, or Lys
  misc_feature (8)..(8): Xaa can be Leu, Ile, Phe, Met, Val, Tyr, Trp, Cys, Lys, Arg, Ala, or Thr
FXDSSGTX

SEQ ID NO: 143302 - protein, 9 aa, Artificial Sequence
  Description of Artificial Sequence: Synthetic peptide
  Seed: FGDSSGTLI (PMEL_HUMAN)
  misc_feature (2)..(2): Xaa can be Tyr, Ala, Ser, Thr, Leu, Phe, Val, Trp, Ile, Met, Gly, Arg, Gln, Pro, Cys, Asn, His, Asp, Glu, or Lys
  misc_feature (9)..(9): Xaa can be Leu, Tyr, Lys, Ile, Met, Val, Phe, Trp, Arg, Ala, Cys, Thr, His, Gln, Ser, Pro, Gly, Glu, Asn, or Asp
FXDSSGTLX

SEQ ID NO: 143303 - protein, 11 aa, Artificial Sequence
  Description of Artificial Sequence: Synthetic peptide
  Seed: FGDSSGTLISR (PMEL_HUMAN)
  misc_feature (2)..(2): Xaa can be Ala, Thr, Ile, Ser, Val, Gly, Met, Leu, Phe, Cys, Gln, Tyr, Asn, Trp, Pro, Asp, Arg, Glu, His, or Lys
  misc_feature (11)..(11): Xaa can be Phe, Met, Ile, Val, Lys, Arg, Leu, Tyr, Trp, His, Cys, Ala, Thr, Ser, Gln, Gly, Glu, Asn, Pro, or Asp
FXDSSGTLISX

SEQ ID NO: 143304 - protein, 9 aa, Artificial Sequence
  Description of Artificial Sequence: Synthetic peptide
  Seed: FLRNQPLTF (PMEL_HUMAN)
  misc_feature (2)..(2): Xaa can be Ala, Pro, Gln, Ser, Tyr, Val, Thr, Ile, Arg, Met, Leu, Phe, Glu, Trp, Gly, Asp, Asn, His, Lys, or Cys
  misc_feature (9)..(9): Xaa can be Tyr, Trp, Phe, Val, Met, Ile, Leu, His, Lys, Arg, Ala, Cys, Thr, Ser, Gln, Gly, Pro, Asn, or Glu
FXRNQPLTX

SEQ ID NO: 143305 - protein, 10 aa, Artificial Sequence
  Description of Artificial Sequence: Synthetic peptide
  Seed: FLRNQPLTFA (PMEL_HUMAN)
  misc_feature (2)..(2): Xaa can be Leu, Met, Val, Ile, Gln, Thr, Ala, or Ser
  misc_feature (10)..(10): Xaa can be Val, Ala, Leu, Ile, Met, Thr, Gly, Pro, Cys, or Ser
FXRNQPLTFX

SEQ ID NO: 143306 - protein, 11 aa, Artificial Sequence
  Description of Artificial Sequence: Synthetic peptide
  Seed: FLRNQPLTFAL (PMEL_HUMAN)
  misc_feature (2)..(2): Xaa can be Leu, Met, Gln, Val, Ile, Thr, Ala, or Pro
  misc_feature (11)..(11): Xaa can be Leu, Val, Ile, Met, Thr, Ala, Ser, Asn, Trp, Tyr, Arg, His, Cys, Lys, Gln, Pro, Phe, Gly, Glu, or Asp
FXRNQPLTFAX

SEQ ID NO: 143307 - protein, 9 aa, Artificial Sequence
  Description of Artificial Sequence: Synthetic peptide
  Seed: FPDGGPCPS (PMEL_HUMAN)
  misc_feature (2)..(2): Xaa can be Pro, Ala, Phe, Val, Tyr, Ile, Met, Ser, Trp, Leu, Gly, Thr, Cys, Asp, Gln, Glu, Asn, or Hi s
  misc_feature (9)..(9): Xaa can be Tyr, Phe, Leu, Met, Trp, Ile, Val, Ala, Cys, His, Lys, Asn, Thr, Arg, Gln, Glu, Gly, Ser, or Pro
FXDGGPCPX

SEQ ID NO: 143308 - protein, 10 aa, Artificial Sequence
  Description of Artificial Sequence: Synthetic peptide
  Seed: FPDGGPCPSG (PMEL_HUMAN)
  misc_feature (2)..(2): Xaa can be Pro, Ala, Val, Tyr, Phe, Ser, Met, Leu, Thr, Ile, Glu, Gly, Cys, Gln, Trp, Asp, Asn, or Hi s
  misc_feature (10)..(10): Xaa can be Tyr, Phe, Leu, Met, Trp, Ile, Val, Ala, Cys, Ser, Arg, Pro, Gly, His, Lys, Thr, Asn, Gln, or Glu
FXDGGPCPSX

SEQ ID NO: 143309 - protein, 11 aa, Artificial Sequence
  Description of Artificial Sequence: Synthetic peptide
  Seed: FPDGGPCPSGS (PMEL_HUMAN)
  misc_feature (2)..(2): Xaa can be Pro, Ala, Tyr, Val, Ile, Phe, Met, Trp, or Gly
  misc_feature (11)..(11): Xaa can be Leu, Phe, Met, Ile, Pro, Ala, Tyr, Val, Lys, Arg, Gly, Thr, Ser, Trp, or Cys
FXDGGPCPSGX

SEQ ID NO: 143310 - protein, 8 aa, Artificial Sequence
  Description of Artificial Sequence: Synthetic peptide
  Seed: FPGSQKVL (PMEL_HUMAN)
  misc_feature (2)..(2): Xaa can be , or Pro
  misc_feature (8)..(8): Xaa can be Phe, Ile, Ala, Val, Met, or Leu
FXGSQKVX

SEQ ID NO: 143311 - protein, 9 aa, Artificial Sequence
  Description of Artificial Sequence: Synthetic peptide
  Seed: FPGSQKVLP (PMEL_HUMAN)
  misc_feature (2)..(2): Xaa can be Pro, or Ala
  misc_feature (9)..(9): Xaa can be Leu, Ala, Pro, Trp, Val, Arg, Met, Ile, Ser, Cys, Phe, Thr, Gly, or Tyr
FXGSQKVLX

SEQ ID NO: 143312 - protein, 9 aa, Artificial Sequence
  Description of Artificial Sequence: Synthetic peptide
  Seed: FSIALNFPG (PMEL_HUMAN)
  misc_feature (2)..(2): Xaa can be Ser, Ala, Thr, Met, Val, Gly, Cys, Asp, Gln, Phe, Lys, Leu, Ile, His, Pro, Glu, Asn, or Ty r
  misc_feature (9)..(9): Xaa can be Trp, Phe, Ile, Met, Tyr, Leu, Val, or Gly
FXIALNFPX

SEQ ID NO: 143313 - protein, 8 aa, Artificial Sequence
  Description of Artificial Sequence: Synthetic peptide
  Seed: FSVPQLPH (PMEL_HUMAN)
  misc_feature (2)..(2): Xaa can be Ala, Ser, Thr, Ile, Val, or Gly
  misc_feature (8)..(8): Xaa can be Tyr, Phe, Leu, His, Met, Lys, Val, or Ile
FXVPQLPX

SEQ ID NO: 143314 - protein, 8 aa, Artificial Sequence
  Description of Artificial Sequence: Synthetic peptide
  Seed: FSVSVSQL (PMEL_HUMAN)
  misc_feature (2)..(2): Xaa can be Ser, Ala, Gly, Ile, Val, Gln, Thr, Met, Asn, Asp, Leu, Glu, Pro, Phe, His, Arg, or Tyr
  misc_feature (8)..(8): Xaa can be Leu, Ile, Val, Lys, Tyr, Met, Phe, Arg, or His
FXVSVSQX

SEQ ID NO: 143315 - protein, 9 aa, Artificial Sequence
  Description of Artificial Sequence: Synthetic peptide
  Seed: FSVSVSQLR (PMEL_HUMAN)
  misc_feature (2)..(2): Xaa can be Ala, Thr, Leu, Met, Val, Ser, Ile, Gly, Phe, Gln, Cys, Asn, Pro, Tyr, Glu, Trp, Asp, Lys, Arg, or His
  misc_feature (9)..(9): Xaa can be Arg, Tyr, Lys, Phe, Leu, Met, Val, Trp, Ile, His, Ala, Gln, Cys, Thr, or Ser
FXVSVSQLX

SEQ ID NO: 143316 - protein, 10 aa, Artificial Sequence
  Description of Artificial Sequence: Synthetic peptide
  Seed: FSVSVSQLRA (PMEL_HUMAN)
  misc_feature (2)..(2): Xaa can be Ile, Ser, Thr, Ala, Val, Pro, Leu, Met, Asn, Glu, Arg, Cys, Asp, Tyr, Gly, Trp, His, Gln, Lys, or Phe
  misc_feature (10)..(10): Xaa can be Lys, Arg, Val, Ser, Asn, Ile, Thr, Tyr, Met, Gly, Glu, Gln, Phe, Asp, His, Ala, Cys, Leu, Trp, or Pro
FXVSVSQLRX

SEQ ID NO: 143317 - protein, 11 aa, Artificial Sequence
  Description of Artificial Sequence: Synthetic peptide
  Seed: FSVSVSQLRAL (PMEL_HUMAN)
  misc_feature (2)..(2): Xaa can be Ala, Ser, Gly, Thr, Val, Ile, Pro, Glu, Cys, Arg, Tyr, Trp, Met, Phe, Asn, Gln, Asp, Leu, His, or Lys
  misc_feature (11)..(11): Xaa can be Tyr, Met, Phe, Trp, Leu, Ile, His, Lys, or Val
FXVSVSQLRAX

SEQ ID NO: 143318 - protein, 11 aa, Artificial Sequence
  Description of Artificial Sequence: Synthetic peptide
  Seed: FSVTLDIVQGI (PMEL_HUMAN)
  misc_feature (2)..(2): Xaa can be Met, Leu, Ile, Val, Gln, Thr, Gly, Asn, Phe, Arg, Trp, Pro, Lys, Cys, Ser, Ala, Asp, His, Glu, or Tyr
  misc_feature (11)..(11): Xaa can be Ile, Leu, Val, Ala, Met, Thr, or Cys
FXVTLDIVQGX

SEQ ID NO: 143319 - protein, 9 aa, Artificial Sequence
  Description of Artificial Sequence: Synthetic peptide
  Seed: FTITDQVPF (PMEL_HUMAN)
  misc_feature (2)..(2): Xaa can be Pro, Ala, Met, Gln, Leu, Ile, Val, Thr, Tyr, Ser, Phe, Glu, Gly, Lys, Asn, Cys, His, Trp, Asp, or Arg
  misc_feature (9)..(9): Xaa can be Tyr, Phe, Leu, Met, Trp, Lys, Ile, Val, His, Arg, Ala, Thr, Cys, Ser, Gly, Pro, Gln, Asn, Asp, or Glu
FXITDQVPX

SEQ ID NO: 143320 - protein, 11 aa, Artificial Sequence
  Description of Artificial Sequence: Synthetic peptide
  Seed: FTITDQVPFSV (PMEL_HUMAN)
  misc_feature (2)..(2): Xaa can be Met, Leu, Thr, Ser, Ala, Val, Ile, Gln, Gly, Phe, Pro, Cys, Asn, Asp, Glu, Trp, Lys, His, Arg, or Tyr
  misc_feature (11)..(11): Xaa can be Val, Trp, Phe, Leu, Ile, Met, Ala, Tyr, Ser, Cys, or Thr
FXITDQVPFSX

SEQ ID NO: 143321 - protein, 8 aa, Artificial Sequence
  Description of Artificial Sequence: Synthetic peptide
  Seed: FVYVWKTW (PMEL_HUMAN)
  misc_feature (2)..(2): Xaa can be Ser, Thr, Gly, Val, Ile, Cys, Asn, Ala, or Asp
  misc_feature (8)..(8): Xaa can be Trp, or Phe
FXYVWKTX

SEQ ID NO: 143322 - protein, 11 aa, Artificial Sequence
  Description of Artificial Sequence: Synthetic peptide
  Seed: FVYVWKTWGQY (PMEL_HUMAN)
  misc_feature (2)..(2): Xaa can be Met, Gln, Leu, Ala, Tyr, Lys, Ser, Phe, Glu, Asn, Pro, Thr, Trp, Val, Ile, His, Asp, Arg, or Gly
  misc_feature (11)..(11): Xaa can be Tyr, Phe, or Met
FXYVWKTWGQX

SEQ ID NO: 143323 - protein, 10 aa, Artificial Sequence
  Description of Artificial Sequence: Synthetic peptide
  Seed: GALLAVGATK (PMEL_HUMAN)
  misc_feature (2)..(2): Xaa can be Ala, Ile, Val, Leu, Met, Thr, Gly, Ser, Phe, Gln, Tyr, Asn, Glu, Cys, Lys, His, Trp, Asp, Arg, or Pro
  misc_feature (10)..(10): Xaa can be Lys, Arg, Tyr, Met, Leu, or Phe
GXLLAVGATX

SEQ ID NO: 143324 - protein, 11 aa, Artificial Sequence
  Description of Artificial Sequence: Synthetic peptide
  Seed: GALLAVGATKV (PMEL_HUMAN)
  misc_feature (2)..(2): Xaa can be Tyr, Phe, Met, Lys, Ser, Leu, Arg, Ile, or Ala
  misc_feature (11)..(11): Xaa can be Val, Leu, or Ile
GXLLAVGATKX

SEQ ID NO: 143325 - protein, 9 aa, Artificial Sequence
  Description of Artificial Sequence: Synthetic peptide
  Seed: GANASFSIA (PMEL_HUMAN)
  misc_feature (2)..(2): Xaa can be Ala, Thr, Ser, Val, Ile, Gly, Met, Gln, Leu, Asn, Phe, Cys, Pro, Tyr, or Glu
  misc_feature (9)..(9): Xaa can be Tyr, Lys, Phe, Met, Leu, His, Ile, Val, Ala, Arg, Ser, or Trp
GXNASFSIX

SEQ ID NO: 143326 - protein, 10 aa, Artificial Sequence
  Description of Artificial Sequence: Synthetic peptide
  Seed: GANASFSIAL (PMEL_HUMAN)
  misc_feature (2)..(2): Xaa can be Ala, Ser, Thr, Val, Gly, Ile, Arg, Gln, Asp, or Met
  misc_feature (10)..(10): Xaa can be Tyr, Lys, Arg, Phe, Leu, Met, His, or Ile
GXNASFSIAX

SEQ ID NO: 143327 - protein, 11 aa, Artificial Sequence
  Description of Artificial Sequence: Synthetic peptide
  Seed: GATKVPRNQDW (PMEL_HUMAN)
  misc_feature (2)..(2): Xaa can be Thr, Ser, Ile, Cys, Leu, Met, Ala, Val, or Gly
  misc_feature (11)..(11): Xaa can be Trp, or Phe
GXTKVPRNQDX

SEQ ID NO: 143328 - protein, 9 aa, Artificial Sequence
  Description of Artificial Sequence: Synthetic peptide
  Seed: GCQPPAQRL (PMEL_HUMAN)
  misc_feature (2)..(2): Xaa can be Ala, Ser, Val, Thr, Gly, Ile, Leu, Met, Gln, Asn, Tyr, Cys, Phe, Pro, or Asp
  misc_feature (9)..(9): Xaa can be Leu, Tyr, Met, Phe, Ile, Val, Lys, Arg, Trp, Cys, or Ala
GXQPPAQRX

SEQ ID NO: 143329 - protein, 8 aa, Artificial Sequence
  Description of Artificial Sequence: Synthetic peptide
  Seed: GDSSGTLI (PMEL_HUMAN)
  misc_feature (2)..(2): Xaa can be Asp, or Glu
  misc_feature (8)..(8): Xaa can be Ile, Leu, Val, Phe, or Met
GXSSGTLX

SEQ ID NO: 143330 - protein, 10 aa, Artificial Sequence
  Description of Artificial Sequence: Synthetic peptide
  Seed: GDSSGTLISR (PMEL_HUMAN)
  misc_feature (2)..(2): Xaa can be Ser, Thr, Ala, Val, Gly, Leu, Met, Cys, Ile, Gln, Pro, Phe, Trp, Glu, Asn, Tyr, Asp, Arg, Lys, or His
  misc_feature (10)..(10): Xaa can be Arg, Lys, Tyr, Phe, Leu, Met, Trp, Ile, Val, or His
GXSSGTLISX

SEQ ID NO: 143331 - protein, 8 aa, Artificial Sequence
  Description of Artificial Sequence: Synthetic peptide
  Seed: GEGDAFEL (PMEL_HUMAN)
  misc_feature (2)..(2): Xaa can be Glu, or Asp
  misc_feature (8)..(8): Xaa can be Trp, Met, Phe, Ile, Leu, Cys, Val, Ala, Pro, Tyr, or Thr
GXGDAFEX

SEQ ID NO: 143332 - protein, 9 aa, Artificial Sequence
  Description of Artificial Sequence: Synthetic peptide
  Seed: GEGDAFELT (PMEL_HUMAN)
  misc_feature (2)..(2): Xaa can be Glu, Asp, or Gln
  misc_feature (9)..(9): Xaa can be Cys, Leu, Ala, Met, Val, Ile, Thr, Phe, Pro, Gly, Arg, Glu, Lys, Gln, Tyr, Trp, Asp, or Se r
GXGDAFELX

SEQ ID NO: 143333 - protein, 10 aa, Artificial Sequence
  Description of Artificial Sequence: Synthetic peptide
  Seed: GEGDAFELTV (PMEL_HUMAN)
  misc_feature (2)..(2): Xaa can be Glu, Gln, Asp, Met, Leu, Ile, Val, or Lys
  misc_feature (10)..(10): Xaa can be Ile, Val, Leu, Phe, Met, Trp, Tyr, Ala, Cys, Thr, Gly, Gln, Pro, Arg, His, Lys, Ser, or Gl u
GXGDAFELTX

SEQ ID NO: 143334 - protein, 11 aa, Artificial Sequence
  Description of Artificial Sequence: Synthetic peptide
  Seed: GEGDAFELTVS (PMEL_HUMAN)
  misc_feature (2)..(2): Xaa can be Glu, or Asp
  misc_feature (11)..(11): Xaa can be Ala, Leu, Trp, Phe, Pro, Ile, Thr, Ser, Tyr, Met, Cys, Gly, or Val
GXGDAFELTVX

SEQ ID NO: 143335 - protein, 9 aa, Artificial Sequence
  Description of Artificial Sequence: Synthetic peptide
  Seed: GENSPLLSG (PMEL_HUMAN)
  misc_feature (2)..(2): Xaa can be Glu, Asp, Gln, or Lys
  misc_feature (9)..(9): Xaa can be Trp, Ile, Pro, Ala, Leu, Tyr, Cys, Val, Phe, Met, Thr, Asn, Glu, Lys, Arg, Asp, Gly, Ser, His, or Gln
GXNSPLLSX

SEQ ID NO: 143336 - protein, 9 aa, Artificial Sequence
  Description of Artificial Sequence: Synthetic peptide
  Seed: GGPCPSGSW (PMEL_HUMAN)
  misc_feature (2)..(2): Xaa can be Ala, Thr, Ser, Cys, Leu, Met, Ile, Val, or Gly
  misc_feature (9)..(9): Xaa can be Trp, or Phe
GXPCPSGSX

SEQ ID NO: 143337 - protein, 9 aa, Artificial Sequence
  Description of Artificial Sequence: Synthetic peptide
  Seed: GGPVSGLSI (PMEL_HUMAN)
  misc_feature (2)..(2): Xaa can be Ala, Arg, Ser, Val, Thr, Tyr, Ile, Leu, Gln, Gly, Asn, Met, Phe, His, Cys, Glu, Asp, Pro, Lys, or Trp
  misc_feature (9)..(9): Xaa can be Leu, Ile, Phe, Met, Val, Tyr, Lys, Arg, Cys, Ala, Trp, His, or Thr
GXPVSGLSX

SEQ ID NO: 143338 - protein, 8 aa, Artificial Sequence
  Description of Artificial Sequence: Synthetic peptide
  Seed: GHRPTAEA (PMEL_HUMAN)
  misc_feature (2)..(2): Xaa can be , or His
  misc_feature (8)..(8): Xaa can be , or Ala
GXRPTAEX

SEQ ID NO: 143339 - protein, 9 aa, Artificial Sequence
  Description of Artificial Sequence: Synthetic peptide
  Seed: GHRPTAEAP (PMEL_HUMAN)
  misc_feature (2)..(2): Xaa can be His, Gln, Arg, Glu, Pro, or Lys
  misc_feature (9)..(9): Xaa can be Ala, Val, Leu, Ile, Cys, Met, Thr, Phe, Pro, Gly, or Ser
GXRPTAEAX

SEQ ID NO: 143340 - protein, 10 aa, Artificial Sequence
  Description of Artificial Sequence: Synthetic peptide
  Seed: GIESAEILQA (PMEL_HUMAN)
  misc_feature (2)..(2): Xaa can be Asn, Ile, Cys, Phe, Met, Val, Trp, Arg, Gln, Glu, Thr, Tyr, Ser, Ala, Lys, Asp, Pro, Leu, His, or Gly
  misc_feature (10)..(10): Xaa can be , or Ala
GXESAEILQX

SEQ ID NO: 143341 - protein, 11 aa, Artificial Sequence
  Description of Artificial Sequence: Synthetic peptide
  Seed: GIESAEILQAV (PMEL_HUMAN)
  misc_feature (2)..(2): Xaa can be Leu, Met, Gln, Ile, Val, Thr, Tyr, or Phe
  misc_feature (11)..(11): Xaa can be Val, Leu, Ile, Met, Thr, or Ala
GXESAEILQAX

SEQ ID NO: 143342 - protein, 9 aa, Artificial Sequence
  Description of Artificial Sequence: Synthetic peptide
  Seed: GILLVLMAV (PMEL_HUMAN)
  misc_feature (2)..(2): Xaa can be Gln, Leu, Met, Thr, Ile, Val, Ala, Ser, Glu, Asn, Gly, Asp, or Cys
  misc_feature (9)..(9): Xaa can be Val, Ile, Leu, Ala, Met, Thr, Ser, Cys, Phe, or Trp
GXLLVLMAX

SEQ ID NO: 143343 - protein, 10 aa, Artificial Sequence
  Description of Artificial Sequence: Synthetic peptide
  Seed: GILLVLMAVV (PMEL_HUMAN)
  misc_feature (2)..(2): Xaa can be Met, Leu, Gln, Tyr, Arg, Lys, Thr, Phe, Ile, Ser, Cys, Ala, Glu, Val, His, Gly, Asn, Asp, Pro, or Trp
  misc_feature (10)..(10): Xaa can be Leu, Val, Ile, Ala, Met, Thr, Glu, Lys, Gln, His, Cys, Arg, Trp, Asp, Asn, Gly, Tyr, Ser, Pro, or Phe
GXLLVLMAVX

SEQ ID NO: 143344 - protein, 8 aa, Artificial Sequence
  Description of Artificial Sequence: Synthetic peptide
  Seed: GLGQVPLI (PMEL_HUMAN)
  misc_feature (2)..(2): Xaa can be Gln, Ala, Met, Ser, Glu, Val, or Leu
  misc_feature (8)..(8): Xaa can be Ile, Val, Leu, or Met
GXGQVPLX

SEQ ID NO: 143345 - protein, 9 aa, Artificial Sequence
  Description of Artificial Sequence: Synthetic peptide
  Seed: GLGQVPLIV (PMEL_HUMAN)
  misc_feature (2)..(2): Xaa can be Gln, Met, Leu, Ile, Glu, Ala, Val, Ser, or Thr
  misc_feature (9)..(9): Xaa can be Val, Trp, Ile, Leu, Phe, Met, Ala, Tyr, or Cys
GXGQVPLIX

SEQ ID NO: 143346 - protein, 11 aa, Artificial Sequence
  Description of Artificial Sequence: Synthetic peptide
  Seed: GLGQVPLIVGI (PMEL_HUMAN)
  misc_feature (2)..(2): Xaa can be Leu, Met, Ile, or Val
  misc_feature (11)..(11): Xaa can be Val, Leu, Met, Ile, or Ala
GXGQVPLIVGX

SEQ ID NO: 143347 - protein, 10 aa, Artificial Sequence
  Description of Artificial Sequence: Synthetic peptide
  Seed: GLPKEACMEI (PMEL_HUMAN)
  misc_feature (2)..(2): Xaa can be Met, Leu, Val, Ile, or Gln
  misc_feature (10)..(10): Xaa can be Val, Met, Ile, Ala, or Leu
GXPKEACMEX

SEQ ID NO: 143348 - protein, 9 aa, Artificial Sequence
  Description of Artificial Sequence: Synthetic peptide
  Seed: GLSIGTGRA (PMEL_HUMAN)
  misc_feature (2)..(2): Xaa can be Met, Leu, Ile, Val, Gln, Thr, or Ala
  misc_feature (9)..(9): Xaa can be Val, Leu, Ile, or Ala
GXSIGTGRX

SEQ ID NO: 143349 - protein, 10 aa, Artificial Sequence
  Description of Artificial Sequence: Synthetic peptide
  Seed: GLSIGTGRAM (PMEL_HUMAN)
  misc_feature (2)..(2): Xaa can be Ala, Gln, Val, Met, Ser, Thr, Ile, Leu, Gly, Glu, Cys, Tyr, Phe, Arg, His, Asp, Lys, Asn, Trp, or Pro
  misc_feature (10)..(10): Xaa can be Phe, Tyr, Leu, Met, Trp, His, Val, Lys, Ile, Cys, Ala, or Arg
GXSIGTGRAX

SEQ ID NO: 143350 - protein, 11 aa, Artificial Sequence
  Description of Artificial Sequence: Synthetic peptide
  Seed: GLSIGTGRAML (PMEL_HUMAN)
  misc_feature (2)..(2): Xaa can be Leu, or Met
  misc_feature (11)..(11): Xaa can be Val, or Leu
GXSIGTGRAMX

SEQ ID NO: 143351 - protein, 9 aa, Artificial Sequence
  Description of Artificial Sequence: Synthetic peptide
  Seed: GMTPAEVSI (PMEL_HUMAN)
  misc_feature (2)..(2): Xaa can be Gln, Met, Leu, Thr, Ile, Glu, Val, Ala, Ser, Gly, Asn, Phe, Cys, Pro, Lys, Tyr, Asp, Arg, Trp, or His
  misc_feature (9)..(9): Xaa can be Tyr, Phe, Leu, Met, Val, Ile, Trp, His, Ala, Cys, or Thr
GXTPAEVSX

SEQ ID NO: 143352 - protein, 10 aa, Artificial Sequence
  Description of Artificial Sequence: Synthetic peptide
  Seed: GMTPAEVSIV (PMEL_HUMAN)
  misc_feature (2)..(2): Xaa can be Met, Gln, Leu, Thr, Val, or Ile
  misc_feature (10)..(10): Xaa can be Val, Ile, Met, Leu, Ala, or Phe
GXTPAEVSIX

SEQ ID NO: 143353 - protein, 11 aa, Artificial Sequence
  Description of Artificial Sequence: Synthetic peptide
  Seed: GMTPAEVSIVV (PMEL_HUMAN)
  misc_feature (2)..(2): Xaa can be Leu, Met, or Glu
  misc_feature (11)..(11): Xaa can be Val, Ala, Met, Leu, or Ile
GXTPAEVSIVX

SEQ ID NO: 143354 - protein, 9 aa, Artificial Sequence
  Description of Artificial Sequence: Synthetic peptide
  Seed: GMTPEKVPV (PMEL_HUMAN)
  misc_feature (2)..(2): Xaa can be Gln, Met, Leu, Ile, Val, Glu, Thr, or Ala
  misc_feature (9)..(9): Xaa can be Val, Trp, Phe, Leu, Ile, Ala, Met, or Tyr
GXTPEKVPX

SEQ ID NO: 143355 - protein, 11 aa, Artificial Sequence
  Description of Artificial Sequence: Synthetic peptide
  Seed: GPCPSGSWSQK (PMEL_HUMAN)
  misc_feature (2)..(2): Xaa can be Pro, or Ala
  misc_feature (11)..(11): Xaa can be Ala, Leu, Ile, Tyr, Pro, Arg, Cys, Trp, Phe, Gly, Thr, Met, Lys, Val, or Ser
GXCPSGSWSQX

SEQ ID NO: 143356 - protein, 10 aa, Artificial Sequence
  Description of Artificial Sequence: Synthetic peptide
  Seed: GPDASSIMST (PMEL_HUMAN)
  misc_feature (2)..(2): Xaa can be , or Pro
  misc_feature (10)..(10): Xaa can be Val, Cys, Phe, Leu, Ile, Thr, Ala, Pro, Gly, Met, or Ser
GXDASSIMSX

SEQ ID NO: 143357 - protein, 9 aa, Artificial Sequence
  Description of Artificial Sequence: Synthetic peptide
  Seed: GPLLDGTAT (PMEL_HUMAN)
  misc_feature (2)..(2): Xaa can be Pro, or Ala
  misc_feature (9)..(9): Xaa can be Met, Leu, Ala, Cys, Thr, Ile, Val, Tyr, Arg, Lys, Ser, Gly, Phe, or Pro
GXLLDGTAX

SEQ ID NO: 143358 - protein, 10 aa, Artificial Sequence
  Description of Artificial Sequence: Synthetic peptide
  Seed: GPLLDGTATL (PMEL_HUMAN)
  misc_feature (2)..(2): Xaa can be Pro, Phe, Tyr, Ala, Met, Ile, Ser, Leu, Asp, Lys, Gln, Asn, Glu, Gly, His, Val, Arg, Thr, Cys, or Trp
  misc_feature (10)..(10): Xaa can be Met, Ala, Leu, Cys, Thr, Val, Ile, Phe, Ser, Tyr, Gly, Trp, or Pro
GXLLDGTATX

SEQ ID NO: 143359 - protein, 9 aa, Artificial Sequence
  Description of Artificial Sequence: Synthetic peptide
  Seed: GPTLIGANA (PMEL_HUMAN)
  misc_feature (2)..(2): Xaa can be , or Pro
  misc_feature (9)..(9): Xaa can be Ser, Ile, Tyr, Gly, Thr, Leu, Val, Pro, Ala, Phe, Met, or Cys
GXTLIGANX

SEQ ID NO: 143360 - protein, 10 aa, Artificial Sequence
  Description of Artificial Sequence: Synthetic peptide
  Seed: GPTLIGANAS (PMEL_HUMAN)
  misc_feature (2)..(2): Xaa can be , or Pro
  misc_feature (10)..(10): Xaa can be Pro, Tyr, Val, Met, Ile, Cys, Leu, Gly, Phe, Thr, Ala, or Ser
GXTLIGANAX

SEQ ID NO: 143361 - protein, 11 aa, Artificial Sequence
  Description of Artificial Sequence: Synthetic peptide
  Seed: GPTLIGANASF (PMEL_HUMAN)
  misc_feature (2)..(2): Xaa can be Pro, Gln, Met, Cys, Tyr, Asp, Phe, Leu, Ser, Ile, Asn, Val, Trp, Arg, Gly, Ala, His, Lys, Thr, or Glu
  misc_feature (11)..(11): Xaa can be Phe, Tyr, Met, Ala, Gly, Trp, Val, Thr, Cys, Ile, Ser, Pro, or Leu
GXTLIGANASX

SEQ ID NO: 143362 - protein, 8 aa, Artificial Sequence
  Description of Artificial Sequence: Synthetic peptide
  Seed: GPVSGLSI (PMEL_HUMAN)
  misc_feature (2)..(2): Xaa can be , or Pro
  misc_feature (8)..(8): Xaa can be Ile, Leu, Val, Phe, Met, or Ala
GXVSGLSX

SEQ ID NO: 143363 - protein, 9 aa, Artificial Sequence
  Description of Artificial Sequence: Synthetic peptide
  Seed: GPVSGLSIG (PMEL_HUMAN)
  misc_feature (2)..(2): Xaa can be Pro, or Ala
  misc_feature (9)..(9): Xaa can be Ala, Cys, Thr, Tyr, Val, Phe, Pro, Gly, Ile, Met, Ser, or Leu
GXVSGLSIX

SEQ ID NO: 143364 - protein, 10 aa, Artificial Sequence
  Description of Artificial Sequence: Synthetic peptide
  Seed: GPVSGLSIGT (PMEL_HUMAN)
  misc_feature (2)..(2): Xaa can be , or Pro
  misc_feature (10)..(10): Xaa can be Ser, Cys, Leu, Thr, Val, Met, Phe, Pro, Ile, Ala, Tyr, or Gly
GXVSGLSIGX

SEQ ID NO: 143365 - protein, 11 aa, Artificial Sequence
  Description of Artificial Sequence: Synthetic peptide
  Seed: GPVSGLSIGTG (PMEL_HUMAN)
  misc_feature (2)..(2): Xaa can be , or Pro
  misc_feature (11)..(11): Xaa can be Lys, Phe, Gly, Val, Ser, Met, Thr, Cys, Tyr, Ala, Leu, Ile, or Pro
GXVSGLSIGTX

SEQ ID NO: 143366 - protein, 8 aa, Artificial Sequence
  Description of Artificial Sequence: Synthetic peptide
  Seed: GPVTAQVV (PMEL_HUMAN)
  misc_feature (2)..(2): Xaa can be , or Pro
  misc_feature (8)..(8): Xaa can be Ala, Val, Phe, Met, Leu, or Ile
GXVTAQVX

SEQ ID NO: 143367 - protein, 9 aa, Artificial Sequence
  Description of Artificial Sequence: Synthetic peptide
  Seed: GPVTAQVVL (PMEL_HUMAN)
  misc_feature (2)..(2): Xaa can be Pro, Ala, Val, or Ser
  misc_feature (9)..(9): Xaa can be Tyr, Leu, Val, Ala, Ile, Met, Phe, Ser, Trp, Pro, Thr, Cys, Gly, or His
GXVTAQVVX

SEQ ID NO: 143368 - protein, 11 aa, Artificial Sequence
  Description of Artificial Sequence: Synthetic peptide
  Seed: GPVTAQVVLQA (PMEL_HUMAN)
  misc_feature (2)..(2): Xaa can be , or Pro
  misc_feature (11)..(11): Xaa can be Ala, Leu, Cys, Val, Ile, Phe, or Met
GXVTAQVVLQX

SEQ ID NO: 143369 - protein, 9 aa, Artificial Sequence
  Description of Artificial Sequence: Synthetic peptide
  Seed: GQEAGLGQV (PMEL_HUMAN)
  misc_feature (2)..(2): Xaa can be Met, Gln, Leu, Ile, or Val
  misc_feature (9)..(9): Xaa can be Trp, Val, Phe, Ile, Leu, Ala, or Met
GXEAGLGQX

SEQ ID NO: 143370 - protein, 10 aa, Artificial Sequence
  Description of Artificial Sequence: Synthetic peptide
  Seed: GQEAGLGQVP (PMEL_HUMAN)
  misc_feature (2)..(2): Xaa can be Glu, Asp, Gln, Gly, Arg, Met, Ala, Thr, Trp, Phe, Asn, Pro, His, Val, Tyr, Lys, Leu, Ser, Ile, or Cys
  misc_feature (10)..(10): Xaa can be Ala, Ile, Pro, Val, Thr, Leu, Met, Cys, Phe, Gln, Tyr, Asn, Glu, Arg, His, Lys, Trp, Gly, Asp, or Ser
GXEAGLGQVX

SEQ ID NO: 143371 - protein, 11 aa, Artificial Sequence
  Description of Artificial Sequence: Synthetic peptide
  Seed: GQEAGLGQVPL (PMEL_HUMAN)
  misc_feature (2)..(2): Xaa can be Gln, or Met
  misc_feature (11)..(11): Xaa can be Trp, Leu, or Phe
GXEAGLGQVPX

SEQ ID NO: 143372 - protein, 10 aa, Artificial Sequence
  Description of Artificial Sequence: Synthetic peptide
  Seed: GQVIWVNNTI (PMEL_HUMAN)
  misc_feature (2)..(2): Xaa can be Gln, Met, Leu, Ile, Val, Thr, Glu, Tyr, Phe, Trp, Ser, Asn, Cys, His, Gly, Lys, Arg, or Al a
  misc_feature (10)..(10): Xaa can be Val, Leu, Ile, Trp, Ala, Phe, Met, or Tyr
GXVIWVNNTX

SEQ ID NO: 143373 - protein, 9 aa, Artificial Sequence
  Description of Artificial Sequence: Synthetic peptide
  Seed: GQVPLIVGI (PMEL_HUMAN)
  misc_feature (2)..(2): Xaa can be Glu, Arg, Met, Leu, Gln, Asp, His, Ala, Lys, Ile, Val, Asn, Thr, Gly, Ser, Pro, Tyr, Phe, Trp, or Cys
  misc_feature (9)..(9): Xaa can be Val, Tyr, Phe, Leu, Ile, Met, Trp, Ala, Thr, Lys, Arg, Cys, Pro, Ser, Gly, His, Gln, Glu, Asn, or Asp
GXVPLIVGX

SEQ ID NO: 143374 - protein, 10 aa, Artificial Sequence
  Description of Artificial Sequence: Synthetic peptide
  Seed: GQVPLIVGIL (PMEL_HUMAN)
  misc_feature (2)..(2): Xaa can be Leu, Met, Glu, Gln, Val, Ile, Thr, Ala, Ser, Lys, Arg, Asp, Asn, Gly, His, or Pro
  misc_feature (10)..(10): Xaa can be Tyr, Phe, Val, Leu, Ile, Ala, Met, Trp, Pro, Cys, Ser, Thr, Asp, His, Glu, Gln, Gly, Arg, Asn, or Lys
GXVPLIVGIX

SEQ ID NO: 143375 - protein, 11 aa, Artificial Sequence
  Description of Artificial Sequence: Synthetic peptide
  Seed: GQVPLIVGILL (PMEL_HUMAN)
  misc_feature (2)..(2): Xaa can be Arg, Gln, Leu, Met, Val, or Glu
  misc_feature (11)..(11): Xaa can be Phe, Val, Trp, Leu, Met, Tyr, Ile, Ala, Lys, Cys, Glu, Arg, Ser, His, Pro, Gly, Asn, Gln, or Thr
GXVPLIVGILX

SEQ ID NO: 143376 - protein, 8 aa, Artificial Sequence
  Description of Artificial Sequence: Synthetic peptide
  Seed: GQVPTTEV (PMEL_HUMAN)
  misc_feature (2)..(2): Xaa can be Gln, Ser, Met, Ala, Glu, Gly, or Leu
  misc_feature (8)..(8): Xaa can be Ile, Val, Leu, Phe, or Met
GXVPTTEX

SEQ ID NO: 143377 - protein, 9 aa, Artificial Sequence
  Description of Artificial Sequence: Synthetic peptide
  Seed: GQVPTTEVV (PMEL_HUMAN)
  misc_feature (2)..(2): Xaa can be Glu, Gln, Arg, Asp, His, Met, Leu, Val, Ile, Gly, Lys, Ala, Pro, Thr, Asn, Ser, Phe, Tyr, Cys, or Trp
  misc_feature (9)..(9): Xaa can be Tyr, Phe, Met, Leu, Val, Ile, Trp, Ala, His, Thr, Cys, Arg, Gly, Ser, Lys, Pro, Asp, Gln, Asn, or Glu
GXVPTTEVX

SEQ ID NO: 143378 - protein, 11 aa, Artificial Sequence
  Description of Artificial Sequence: Synthetic peptide
  Seed: GQVPTTEVVGT (PMEL_HUMAN)
  misc_feature (2)..(2): Xaa can be Gln, Met, Glu, Leu, Val, or Ile
  misc_feature (11)..(11): Xaa can be Ile, Val, Leu, Met, Phe, Ala, Cys, Tyr, Thr, or Trp
GXVPTTEVVGX

SEQ ID NO: 143379 - protein, 11 aa, Artificial Sequence
  Description of Artificial Sequence: Synthetic peptide
  Seed: GQYWQVLGGPV (PMEL_HUMAN)
  misc_feature (2)..(2): Xaa can be Met, Leu, Gln, Ile, or Val
  misc_feature (11)..(11): Xaa can be Val, Ala, Ile, Thr, Met, or Leu
GXYWQVLGGPX

SEQ ID NO: 143380 - protein, 10 aa, Artificial Sequence
  Description of Artificial Sequence: Synthetic peptide
  Seed: GRAMLGTHTM (PMEL_HUMAN)
  misc_feature (2)..(2): Xaa can be Arg, Gln, Tyr, Phe, Ile, Leu, Val, Trp, Ser, His, Lys, Met, Asn, Cys, Glu, Thr, Ala, Pro, Gly, or Asp
  misc_feature (10)..(10): Xaa can be Tyr, Phe, Met, Leu, Ile, Val, His, Trp, Gln, Cys, Thr, Ala, Lys, or Arg
GXAMLGTHTX

SEQ ID NO: 143381 - protein, 9 aa, Artificial Sequence
  Description of Artificial Sequence: Synthetic peptide
  Seed: GSFSVTLDI (PMEL_HUMAN)
  misc_feature (2)..(2): Xaa can be Ala, Gln, Leu, Met, Ile, Val, Thr, Ser, Gly, Asn, Glu, Cys, Asp, Phe, or Pro
  misc_feature (9)..(9): Xaa can be Trp, Leu, Phe, Ile, Val, Tyr, Met, Ala, Thr, Cys, His, Lys, or Arg
GXFSVTLDX

SEQ ID NO: 143382 - protein, 10 aa, Artificial Sequence
  Description of Artificial Sequence: Synthetic peptide
  Seed: GSFSVTLDIV (PMEL_HUMAN)
  misc_feature (2)..(2): Xaa can be Leu, Met, Val, Ile, Thr, Gln, Ala, or Ser
  misc_feature (10)..(10): Xaa can be Ile, Leu, Val, Ala, Met, or Thr
GXFSVTLDIX

SEQ ID NO: 143383 - protein, 9 aa, Artificial Sequence
  Description of Artificial Sequence: Synthetic peptide
  Seed: GSGTYCLNV (PMEL_HUMAN)
  misc_feature (2)..(2): Xaa can be Ala, Thr, Ser, or Val
  misc_feature (9)..(9): Xaa can be Leu, Ile, Val, or Met
GXGTYCLNX

SEQ ID NO: 143384 - protein, 10 aa, Artificial Sequence
  Description of Artificial Sequence: Synthetic peptide
  Seed: GSQVWGGQPV (PMEL_HUMAN)
  misc_feature (2)..(2): Xaa can be Met, Leu, Phe, Tyr, Lys, His, Arg, Glu, Ala, Pro, Thr, Asn, Ser, Ile, Gly, Val, Asp, Cys, Trp, or Gln
  misc_feature (10)..(10): Xaa can be Val, Leu, Ile, or Ala
GXQVWGGQPX

SEQ ID NO: 143385 - protein, 11 aa, Artificial Sequence
  Description of Artificial Sequence: Synthetic peptide
  Seed: GSQVWGGQPVY (PMEL_HUMAN)
  misc_feature (2)..(2): Xaa can be Ser, Ala, Met, Gln, Arg, Thr, Leu, Val, Tyr, Ile, His, Trp, Phe, Lys, Gly, Cys, Glu, Pro, Asn, or Asp
  misc_feature (11)..(11): Xaa can be Tyr, Phe, Met, Trp, Lys, Leu, or His
GXQVWGGQPVX

SEQ ID NO: 143386 - protein, 9 aa, Artificial Sequence
  Description of Artificial Sequence: Synthetic peptide
  Seed: GSRSYVPLA (PMEL_HUMAN)
  misc_feature (2)..(2): Xaa can be Thr, Val, Ala, Ser, Tyr, Met, Ile, Gln, Phe, Gly, Leu, Trp, Asn, Lys, Arg, Pro, Cys, or Hi s
  misc_feature (9)..(9): Xaa can be Lys, Ile, Met, Leu, Arg, Tyr, Val, Ala, Ser, Gly, Thr, Asn, Gln, Pro, His, Phe, Cys, Glu, or Trp
GXRSYVPLX

SEQ ID NO: 143387 - protein, 10 aa, Artificial Sequence
  Description of Artificial Sequence: Synthetic peptide
  Seed: GSRSYVPLAH (PMEL_HUMAN)
  misc_feature (2)..(2): Xaa can be Thr, Ser, Ala, Val, Tyr, Ile, Met, Gly, Phe, Trp, Gln, Leu, His, Glu, Asn, or Cys
  misc_feature (10)..(10): Xaa can be Lys, Ala, Tyr, Val, Ile, Phe, Met, Leu, Arg, Ser, His, Gly, Cys, Thr, Pro, Gln, or Asn
GXRSYVPLAX

SEQ ID NO: 143388 - protein, 9 aa, Artificial Sequence
  Description of Artificial Sequence: Synthetic peptide
  Seed: GSSPVPGTT (PMEL_HUMAN)
  misc_feature (2)..(2): Xaa can be Ala, Ser, Thr, Val, Ile, Gly, Gln, Leu, Met, Asn, Glu, Pro, Cys, Asp, Phe, Tyr, Trp, Arg, or Lys
  misc_feature (9)..(9): Xaa can be Tyr, Phe, Met, Leu, Lys, His, Arg, Val, Ile, Trp, Ala, Cys, Thr, Ser, Pro, Asn, Gln, or Gl y
GXSPVPGTX

SEQ ID NO: 143389 - protein, 9 aa, Artificial Sequence
  Description of Artificial Sequence: Synthetic peptide
  Seed: GSWSQKRSF (PMEL_HUMAN)
  misc_feature (2)..(2): Xaa can be Arg, Gln, Ala, Thr, Ser, Met, Leu, Phe, Glu, Val, Gly, Lys, Tyr, Asn, Ile, His, Trp, Asp, Pro, or Cys
  misc_feature (9)..(9): Xaa can be Tyr, Phe, Trp, Met, Leu, Val, Ile, His, Lys, Ala, Arg, or Cys
GXWSQKRSX

SEQ ID NO: 143390 - protein, 11 aa, Artificial Sequence
  Description of Artificial Sequence: Synthetic peptide
  Seed: GSWSQKRSFVY (PMEL_HUMAN)
  misc_feature (2)..(2): Xaa can be Gln, Met, Ser, Thr, Leu, Ala, Val, Trp, Tyr, Phe, Ile, or Glu
  misc_feature (11)..(11): Xaa can be Tyr, Phe, Trp, or Met
GXWSQKRSFVX

SEQ ID NO: 143391 - protein, 9 aa, Artificial Sequence
  Description of Artificial Sequence: Synthetic peptide
  Seed: GTATLRLVK (PMEL_HUMAN)
  misc_feature (2)..(2): Xaa can be Thr, Val, Ser, Leu, Met, Ala, Ile, Trp, Gly, Asn, Gln, Tyr, Phe, Cys, or Asp
  misc_feature (9)..(9): Xaa can be Arg, Lys, Tyr, His, Ala, or Val
GXATLRLVX

SEQ ID NO: 143392 - protein, 10 aa, Artificial Sequence
  Description of Artificial Sequence: Synthetic peptide
  Seed: GTATLRLVKR (PMEL_HUMAN)
  misc_feature (2)..(2): Xaa can be Met, Leu, Val, Thr, Phe, Ala, Gln, Gly, Ile, Trp, Ser, Tyr, or Asn
  misc_feature (10)..(10): Xaa can be Arg, Lys, Tyr, or Leu
GXATLRLVKX

SEQ ID NO: 143393 - protein, 9 aa, Artificial Sequence
  Description of Artificial Sequence: Synthetic peptide
  Seed: GTHTMEVTV (PMEL_HUMAN)
  misc_feature (2)..(2): Xaa can be Ala, Gln, Ser, Leu, Met, Thr, Val, Gly, Ile, Glu, Asn, Asp, Cys, or Phe
  misc_feature (9)..(9): Xaa can be Tyr, Ile, Val, Leu, Phe, Met, Trp, Ala, Lys, Thr, His, Arg, or Cys
GXHTMEVTX

SEQ ID NO: 143394 - protein, 10 aa, Artificial Sequence
  Description of Artificial Sequence: Synthetic peptide
  Seed: GTHTMEVTVY (PMEL_HUMAN)
  misc_feature (2)..(2): Xaa can be Ala, Thr, Gln, Met, Ser, Lys, Leu, Val, Pro, Ile, His, Glu, Arg, Tyr, Trp, Phe, Asn, or Gl y
  misc_feature (10)..(10): Xaa can be Tyr, Phe, Met, Trp, Leu, Lys, or His
GXHTMEVTVX

SEQ ID NO: 143395 - protein, 9 aa, Artificial Sequence
  Description of Artificial Sequence: Synthetic peptide
  Seed: GTLISRALV (PMEL_HUMAN)
  misc_feature (2)..(2): Xaa can be Ser, Thr, Val, Ala, Met, Ile, Gln, Leu, Asn, Gly, Tyr, or Phe
  misc_feature (9)..(9): Xaa can be Lys, Val, Leu, Ala, or Ile
GXLISRALX

SEQ ID NO: 143396 - protein, 10 aa, Artificial Sequence
  Description of Artificial Sequence: Synthetic peptide
  Seed: GTLISRALVV (PMEL_HUMAN)
  misc_feature (2)..(2): Xaa can be Pro, Ile, Ser, Trp, Cys, Phe, Gly, Asp, His, Gln, Glu, Ala, Thr, Arg, Met, Leu, Tyr, Asn, Val, or Lys
  misc_feature (10)..(10): Xaa can be Leu, Ile, Val, or Ala
GXLISRALVX

SEQ ID NO: 143397 - protein, 9 aa, Artificial Sequence
  Description of Artificial Sequence: Synthetic peptide
  Seed: GTYCLNVSL (PMEL_HUMAN)
  misc_feature (2)..(2): Xaa can be Met, Leu, Gln, Ile, Val, Ala, Thr, Ser, Gly, Asn, Glu, Arg, Phe, Asp, Tyr, His, Cys, Trp, Lys, or Pro
  misc_feature (9)..(9): Xaa can be Tyr, Phe, Met, Leu, Arg, Trp, Val, Ile, Lys, His, Ala, Thr, Cys, Ser, or Pro
GXYCLNVSX

SEQ ID NO: 143398 - protein, 10 aa, Artificial Sequence
  Description of Artificial Sequence: Synthetic peptide
  Seed: GTYCLNVSLA (PMEL_HUMAN)
  misc_feature (2)..(2): Xaa can be Met, Leu, Val, Ile, Thr, Gln, Ser, or Ala
  misc_feature (10)..(10): Xaa can be Val, Ala, Leu, Ile, Tyr, Asp, Lys, Arg, Glu, Trp, Asn, Met, His, Cys, Thr, Gly, Gln, Phe, Pro, or Ser
GXYCLNVSLX

SEQ ID NO: 143399 - protein, 9 aa, Artificial Sequence
  Description of Artificial Sequence: Synthetic peptide
  Seed: GVSRQLRTK (PMEL_HUMAN)
  misc_feature (2)..(2): Xaa can be Gln, Ala, Met, Leu, Ser, Ile, Thr, Val, or Tyr
  misc_feature (9)..(9): Xaa can be Lys, or Arg
GXSRQLRTX

SEQ ID NO: 143400 - protein, 11 aa, Artificial Sequence
  Description of Artificial Sequence: Synthetic peptide
  Seed: GVSRQLRTKAW (PMEL_HUMAN)
  misc_feature (2)..(2): Xaa can be Thr, Ile, Val, Ser, Cys, Ala, Met, or Gly
  misc_feature (11)..(11): Xaa can be , or Trp
GXSRQLRTKAX

SEQ ID NO: 143401 - protein, 10 aa, Artificial Sequence
  Description of Artificial Sequence: Synthetic peptide
  Seed: GYLAEADLSY (PMEL_HUMAN)
  misc_feature (2)..(2): Xaa can be Arg, Gln, Met, Tyr, Ile, Lys, Val, Leu, Asp, Ser, Gly, Thr, Trp, Phe, Cys, His, Pro, Asn, Ala, or Glu
  misc_feature (10)..(10): Xaa can be Tyr, Phe, Met, Trp, or Leu
GXLAEADLSX

SEQ ID NO: 143402 - protein, 11 aa, Artificial Sequence
  Description of Artificial Sequence: Synthetic peptide
  Seed: GYLAEADLSYT (PMEL_HUMAN)
  misc_feature (2)..(2): Xaa can be Phe, Tyr, Lys, Leu, Val, Arg, Met, Ala, Trp, Ser, His, Gly, Thr, Ile, Asn, Cys, Gln, or Gl u
  misc_feature (11)..(11): Xaa can be Val, Ala, Leu, Ile, Met, Thr, Ser, or Phe
GXLAEADLSYX

SEQ ID NO: 143403 - protein, 8 aa, Artificial Sequence
  Description of Artificial Sequence: Synthetic peptide
  Seed: HDPSGYLA (PMEL_HUMAN)
  misc_feature (2)..(2): Xaa can be Glu, or Asp
  misc_feature (8)..(8): Xaa can be Ile, Ala, Leu, Val, Phe, Met, Thr, Ser, Pro, or Cys
HXPSGYLX

SEQ ID NO: 143404 - protein, 10 aa, Artificial Sequence
  Description of Artificial Sequence: Synthetic peptide
  Seed: HDPSGYLAEA (PMEL_HUMAN)
  misc_feature (2)..(2): Xaa can be Glu, Leu, Phe, Val, His, Ala, Met, Cys, Asp, Arg, Gln, Thr, Ser, Lys, Pro, Tyr, Asn, Trp, Gly, or Ile
  misc_feature (10)..(10): Xaa can be Ile, Phe, Val, Ala, Leu, Met, Tyr, Thr, Gly, Pro, Ser, or Cys
HXPSGYLAEX

SEQ ID NO: 143405 - protein, 8 aa, Artificial Sequence
  Description of Artificial Sequence: Synthetic peptide
  Seed: HFLRNQPL (PMEL_HUMAN)
  misc_feature (2)..(2): Xaa can be Tyr, Phe, or Trp
  misc_feature (8)..(8): Xaa can be Phe, Met, Tyr, Leu, Ile, or Val
HXLRNQPX

SEQ ID NO: 143406 - protein, 10 aa, Artificial Sequence
  Description of Artificial Sequence: Synthetic peptide
  Seed: HFLRNQPLTF (PMEL_HUMAN)
  misc_feature (2)..(2): Xaa can be Arg, Tyr, Gln, Trp, Phe, Met, His, Val, Leu, Ser, Lys, Ile, Glu, Ala, Thr, Asp, Gly, Cys, Asn, or Pro
  misc_feature (10)..(10): Xaa can be Tyr, Phe, Met, Leu, Trp, Ile, Val, His, Cys, Lys, Arg, or Ala
HXLRNQPLTX

SEQ ID NO: 143407 - protein, 11 aa, Artificial Sequence
  Description of Artificial Sequence: Synthetic peptide
  Seed: HFLRNQPLTFA (PMEL_HUMAN)
  misc_feature (2)..(2): Xaa can be Phe, Tyr, Met, Ser, Ile, Leu, or Trp
  misc_feature (11)..(11): Xaa can be Val, Leu, Ile, or Ala
HXLRNQPLTFX

SEQ ID NO: 143408 - protein, 8 aa, Artificial Sequence
  Description of Artificial Sequence: Synthetic peptide
  Seed: HLAVIGAL (PMEL_HUMAN)
  misc_feature (2)..(2): Xaa can be Gln, Ala, Gly, Val, Ser, Leu, Glu, Met, Asn, Thr, or Ile
  misc_feature (8)..(8): Xaa can be Ile, Val, Leu, Phe, or Met
HXAVIGAX

SEQ ID NO: 143409 - protein, 9 aa, Artificial Sequence
  Description of Artificial Sequence: Synthetic peptide
  Seed: HLAVIGALL (PMEL_HUMAN)
  misc_feature (2)..(2): Xaa can be Thr, Leu, Ala, Met, Val, Gln, Ile, Arg, Ser, Gly, Pro, Asn, Glu, Phe, Cys, Asp, Tyr, His, Trp, or Lys
  misc_feature (9)..(9): Xaa can be Leu, Tyr, Phe, Lys, Met, Arg, Val, Ile, Trp, His, Ala, Thr, Ser, Cys, Gly, Gln, or Pro
HXAVIGALX

SEQ ID NO: 143410 - protein, 10 aa, Artificial Sequence
  Description of Artificial Sequence: Synthetic peptide
  Seed: HLAVIGALLA (PMEL_HUMAN)
  misc_feature (2)..(2): Xaa can be Met, Leu, Ile, Val, Gln, or Thr
  misc_feature (10)..(10): Xaa can be Val, Leu, Ile, Arg, His, Asp, Met, Gln, Thr, Trp, Tyr, Lys, Asn, Gly, Ser, Cys, Glu, Phe, Ala, or Pro
HXAVIGALLX

SEQ ID NO: 143411 - protein, 11 aa, Artificial Sequence
  Description of Artificial Sequence: Synthetic peptide
  Seed: HLAVIGALLAV (PMEL_HUMAN)
  misc_feature (2)..(2): Xaa can be Met, Gln, Leu, Thr, Phe, Tyr, Ser, Glu, Val, Arg, Trp, Ala, Cys, Lys, His, Asn, Ile, Asp, Gly, or Pro
  misc_feature (11)..(11): Xaa can be Ile, Leu, Val, Ala, or Met
HXAVIGALLAX

SEQ ID NO: 143412 - protein, 9 aa, Artificial Sequence
  Description of Artificial Sequence: Synthetic peptide
  Seed: HQILKGGSG (PMEL_HUMAN)
  misc_feature (2)..(2): Xaa can be His, Gln, Arg, Pro, Lys, Glu, Asn, Ala, Gly, Asp, or Ser
  misc_feature (9)..(9): Xaa can be Ala, Leu, Val, Ile, Cys, Met, Pro, Ser, Thr, Gly, Phe, or Tyr
HXILKGGSX

SEQ ID NO: 143413 - protein, 11 aa, Artificial Sequence
  Description of Artificial Sequence: Synthetic peptide
  Seed: HQILKGGSGTY (PMEL_HUMAN)
  misc_feature (2)..(2): Xaa can be Gly, Arg, Ala, Glu, Gln, Ser, Asn, His, Thr, Val, Ile, Met, Leu, Pro, Tyr, Lys, Asp, Cys, Trp, or Phe
  misc_feature (11)..(11): Xaa can be Tyr, Phe, Leu, Met, Trp, Lys, His, Arg, Ile, Asn, Val, Glu, Cys, Ala, Gln, Pro, Gly, Asp, or Ser
HXILKGGSGTX

SEQ ID NO: 143414 - protein, 8 aa, Artificial Sequence
  Description of Artificial Sequence: Synthetic peptide
  Seed: HRRGSRSY (PMEL_HUMAN)
  misc_feature (2)..(2): Xaa can be Gln, Tyr, Arg, Glu, Lys, His, Phe, or Met
  misc_feature (8)..(8): Xaa can be Tyr, Phe, Leu, or Met
HXRGSRSX

SEQ ID NO: 143415 - protein, 9 aa, Artificial Sequence
  Description of Artificial Sequence: Synthetic peptide
  Seed: HRRGSRSYV (PMEL_HUMAN)
  misc_feature (2)..(2): Xaa can be Arg, His, Gln, Tyr, Ala, Phe, Ser, Met, Thr, Lys, Trp, Gly, Asn, or Glu
  misc_feature (9)..(9): Xaa can be Phe, Leu, Tyr, Met, Ile, Val, Ala, Cys, Thr, Pro, Trp, Lys, His, or Arg
HXRGSRSYX

SEQ ID NO: 143416 - protein, 11 aa, Artificial Sequence
  Description of Artificial Sequence: Synthetic peptide
  Seed: HRRGSRSYVPL (PMEL_HUMAN)
  misc_feature (2)..(2): Xaa can be , or Arg
  misc_feature (11)..(11): Xaa can be Lys, Tyr, Arg, Val, Phe, Leu, Ile, or Met
HXRGSRSYVPX

SEQ ID NO: 143417 - protein, 8 aa, Artificial Sequence
  Description of Artificial Sequence: Synthetic peptide
  Seed: HSSSAFTI (PMEL_HUMAN)
  misc_feature (2)..(2): Xaa can be Ala, Gln, Thr, Ser, Met, Leu, Glu, Gly, Ile, or Val
  misc_feature (8)..(8): Xaa can be Ile, Val, Leu, or Met
HXSSAFTX

SEQ ID NO: 143418 - protein, 8 aa, Artificial Sequence
  Description of Artificial Sequence: Synthetic peptide
  Seed: HSSSHWLR (PMEL_HUMAN)
  misc_feature (2)..(2): Xaa can be Ser, Gln, Phe, Val, Trp, Thr, Met, Tyr, Ile, Leu, Ala, His, Arg, Cys, Pro, Asn, Lys, or Gl y
  misc_feature (8)..(8): Xaa can be Arg, or Lys
HXSSHWLX

SEQ ID NO: 143419 - protein, 9 aa, Artificial Sequence
  Description of Artificial Sequence: Synthetic peptide
  Seed: HSSSHWLRL (PMEL_HUMAN)
  misc_feature (2)..(2): Xaa can be Thr, Ser, Arg, Tyr, Met, Gln, Ile, Ala, Val, Gly, Asn, Phe, Cys, Leu, Glu, His, Trp, Lys, Asp, or Pro
  misc_feature (9)..(9): Xaa can be Leu, Tyr, Met, Trp, Phe, Ile, Lys, Val, Ala, His, Arg, Ser, Cys, Gly, or Thr
HXSSHWLRX

SEQ ID NO: 143420 - protein, 11 aa, Artificial Sequence
  Description of Artificial Sequence: Synthetic peptide
  Seed: HSSSHWLRLPR (PMEL_HUMAN)
  misc_feature (2)..(2): Xaa can be Gln, Gly, Pro, Thr, Met, Ser, Asn, Ile, Lys, Trp, Phe, Val, Ala, Leu, Tyr, Cys, His, Arg, Asp, or Glu
  misc_feature (11)..(11): Xaa can be Arg, or Lys
HXSSHWLRLPX

SEQ ID NO: 143421 - protein, 8 aa, Artificial Sequence
  Description of Artificial Sequence: Synthetic peptide
  Seed: HTMEVTVY (PMEL_HUMAN)
  misc_feature (2)..(2): Xaa can be Ala, Ser, Thr, Gln, Pro, Val, Met, Ile, Gly, Glu, Lys, Leu, Phe, Asp, Tyr, Arg, His, Asn, Cys, or Trp
  misc_feature (8)..(8): Xaa can be Tyr, Phe, Leu, Met, Trp, Lys, Val, Ile, His, Ala, Pro, or Arg
HXMEVTVX

SEQ ID NO: 143422 - protein, 9 aa, Artificial Sequence
  Description of Artificial Sequence: Synthetic peptide
  Seed: HTMEVTVYH (PMEL_HUMAN)
  misc_feature (2)..(2): Xaa can be Pro, Ala, Thr, Ser, Val, Ile, Met, Leu, Asn, Gln, Tyr, Gly, Cys, Phe, Trp, Arg, Lys, Glu, Asp, or His
  misc_feature (9)..(9): Xaa can be Tyr, Lys, Arg, Phe, Met, Leu, Val, Ile, His, Trp, Gln, Thr, Ala, Glu, Ser, Asn, Cys, Gly, Pro, or Asp
HXMEVTVYX

SEQ ID NO: 143423 - protein, 10 aa, Artificial Sequence
  Description of Artificial Sequence: Synthetic peptide
  Seed: HTMEVTVYHR (PMEL_HUMAN)
  misc_feature (2)..(2): Xaa can be Thr, Val, Leu, Met, Ile, Ser, Ala, Phe, Tyr, Gln, His, Lys, Pro, Trp, Gly, Glu, Cys, Asn, Asp, or Arg
  misc_feature (10)..(10): Xaa can be Arg, Lys, His, Tyr, Met, Phe, Val, Ala, Leu, Gln, Ile, Glu, Ser, or Thr
HXMEVTVYHX

SEQ ID NO: 143424 - protein, 11 aa, Artificial Sequence
  Description of Artificial Sequence: Synthetic peptide
  Seed: HTMEVTVYHRR (PMEL_HUMAN)
  misc_feature (2)..(2): Xaa can be Tyr, Thr, Phe, Ser, Leu, Gln, Ile, Val, Ala, Met, Gly, Trp, Cys, Asp, Asn, Arg, Glu, Lys, Pro, or His
  misc_feature (11)..(11): Xaa can be Arg, Lys, Thr, Met, Leu, Glu, Gln, Asp, Val, His, Trp, Ala, Pro, Phe, Ile, Gly, Tyr, Asn, Ser, or Cys
HXMEVTVYHRX

SEQ ID NO: 143425 - protein, 9 aa, Artificial Sequence
  Description of Artificial Sequence: Synthetic peptide
  Seed: HTYLEPGPV (PMEL_HUMAN)
  misc_feature (2)..(2): Xaa can be Ala, Leu, Met, Gln, Thr, Val, Ile, Ser, Gly, Asn, Glu, Cys, Phe, Tyr, Asp, Pro, or Trp
  misc_feature (9)..(9): Xaa can be Tyr, Leu, Lys, Met, Val, Phe, Ile, His, Arg, Trp, Ala, Thr, Ser, Cys, Pro, or Gln
HXYLEPGPX

SEQ ID NO: 143426 - protein, 9 aa, Artificial Sequence
  Description of Artificial Sequence: Synthetic peptide
  Seed: HWLRLPRIF (PMEL_HUMAN)
  misc_feature (2)..(2): Xaa can be Arg, Tyr, Phe, Trp, His, Lys, Ala, Gln, Met, or Ser
  misc_feature (9)..(9): Xaa can be Leu, Phe, Tyr, Met, Trp, Ile, Val, His, Arg, Ala, or Lys
HXLRLPRIX

SEQ ID NO: 143427 - protein, 10 aa, Artificial Sequence
  Description of Artificial Sequence: Synthetic peptide
  Seed: IALNFPGSQK (PMEL_HUMAN)
  misc_feature (2)..(2): Xaa can be Ala, Ser, Thr, Met, Gly, Ile, Val, Leu, Gln, Pro, Glu, Cys, Asp, Asn, Phe, Trp, Lys, Arg, Tyr, or His
  misc_feature (10)..(10): Xaa can be Lys, Arg, Tyr, Phe, Leu, Met, His, Val, Trp, Ile, or Ala
IXLNFPGSQX

SEQ ID NO: 143428 - protein, 11 aa, Artificial Sequence
  Description of Artificial Sequence: Synthetic peptide
  Seed: IALNFPGSQKV (PMEL_HUMAN)
  misc_feature (2)..(2): Xaa can be Leu, Met, Ala, Phe, Ser, Tyr, Thr, Lys, Gly, Ile, Trp, Arg, or Val
  misc_feature (11)..(11): Xaa can be Val, Leu, Ile, Ala, or Met
IXLNFPGSQKX

SEQ ID NO: 143429 - protein, 9 aa, Artificial Sequence
  Description of Artificial Sequence: Synthetic peptide
  Seed: IESAEILQA (PMEL_HUMAN)
  misc_feature (2)..(2): Xaa can be Glu, Asp, Gln, or Ala
  misc_feature (9)..(9): Xaa can be Leu, Phe, Ala, Ile, Met, Val, Cys, Tyr, Trp, Lys, Pro, Glu, Thr, Gly, Gln, Arg, or Ser
IXSAEILQX

SEQ ID NO: 143430 - protein, 10 aa, Artificial Sequence
  Description of Artificial Sequence: Synthetic peptide
  Seed: IESAEILQAV (PMEL_HUMAN)
  misc_feature (2)..(2): Xaa can be Glu, Met, Leu, Gln, Asp, Thr, Phe, Ile, Val, Ala, Trp, Tyr, Gly, His, Cys, Lys, Ser, Pro, Arg, or Asn
  misc_feature (10)..(10): Xaa can be Ile, Val, Leu, Ala, Met, Phe, Thr, Cys, Ser, Gly, Pro, Trp, or Tyr
IXSAEILQAX

SEQ ID NO: 143431 - protein, 11 aa, Artificial Sequence
  Description of Artificial Sequence: Synthetic peptide
  Seed: IESAEILQAVP (PMEL_HUMAN)
  misc_feature (2)..(2): Xaa can be , or Glu
  misc_feature (11)..(11): Xaa can be Ala, Val, Leu, Met, Cys, Ile, Pro, Phe, or Thr
IXSAEILQAVX

SEQ ID NO: 143432 - protein, 10 aa, Artificial Sequence
  Description of Artificial Sequence: Synthetic peptide
  Seed: IFPDGGPCPS (PMEL_HUMAN)
  misc_feature (2)..(2): Xaa can be Tyr, Phe, Trp, Met, Leu, Ala, Val, Ile, His, Gln, Thr, Gly, Ser, Cys, Pro, Arg, Lys, or As n
  misc_feature (10)..(10): Xaa can be Tyr, Leu, Phe, Met, Ile, Val, Trp, Lys, His, Arg, Ala, Cys, Gln, Ser, Thr, Gly, Pro, or As n
IXPDGGPCPX

SEQ ID NO: 143433 - protein, 11 aa, Artificial Sequence
  Description of Artificial Sequence: Synthetic peptide
  Seed: IGALLAVGATK (PMEL_HUMAN)
  misc_feature (2)..(2): Xaa can be Ala, Ser, Thr, Gly, Pro, Tyr, Leu, Ile, Lys, Arg, Trp, Met, Gln, His, Glu, Val, Phe, Cys, Asn, or Asp
  misc_feature (11)..(11): Xaa can be Lys, Phe, Leu, Tyr, Met, or Arg
IXALLAVGATX

SEQ ID NO: 143434 - protein, 9 aa, Artificial Sequence
  Description of Artificial Sequence: Synthetic peptide
  Seed: IGANASFSI (PMEL_HUMAN)
  misc_feature (2)..(2): Xaa can be Ser, Ala, Thr, Val, Gly, Ile, Asn, Leu, Cys, Gln, or Met
  misc_feature (9)..(9): Xaa can be Leu, Val, Ile, Met, or Phe
IXANASFSX

SEQ ID NO: 143435 - protein, 11 aa, Artificial Sequence
  Description of Artificial Sequence: Synthetic peptide
  Seed: IGANASFSIAL (PMEL_HUMAN)
  misc_feature (2)..(2): Xaa can be Ala, Ser, Thr, Val, Pro, Ile, or Gly
  misc_feature (11)..(11): Xaa can be Leu, Met, Ile, Val, or Phe
IXANASFSIAX

SEQ ID NO: 143436 - protein, 8 aa, Artificial Sequence
  Description of Artificial Sequence: Synthetic peptide
  Seed: IGENSPLL (PMEL_HUMAN)
  misc_feature (2)..(2): Xaa can be Ile, Ala, Thr, Ser, Val, Phe, Leu, Met, Gly, Trp, Pro, Cys, Asn, Gln, Tyr, or Asp
  misc_feature (8)..(8): Xaa can be Leu, Met, Ile, Phe, or Val
IXENSPLX

SEQ ID NO: 143437 - protein, 8 aa, Artificial Sequence
  Description of Artificial Sequence: Synthetic peptide
  Seed: IINGSQVW (PMEL_HUMAN)
  misc_feature (2)..(2): Xaa can be Thr, Ser, Val, Asn, Pro, Ala, Leu, Cys, Phe, Asp, Gly, Trp, Gln, Ile, or Met
  misc_feature (8)..(8): Xaa can be Trp, or Phe
IXNGSQVX

SEQ ID NO: 143438 - protein, 9 aa, Artificial Sequence
  Description of Artificial Sequence: Synthetic peptide
  Seed: ILKGGSGTY (PMEL_HUMAN)
  misc_feature (2)..(2): Xaa can be Ala, Ser, Val, Thr, Ile, Met, Phe, Tyr, Leu, Arg, Gln, Gly, Pro, His, Trp, Asn, Lys, Asp, Cys, or Glu
  misc_feature (9)..(9): Xaa can be Phe, Met, Leu, Tyr, Trp, Ile, His, Val, Ala, Lys, Arg, Cys, Thr, Gln, Ser, Glu, Pro, Gly, or Asn
IXKGGSGTX

SEQ ID NO: 143439 - protein, 10 aa, Artificial Sequence
  Description of Artificial Sequence: Synthetic peptide
  Seed: ILKGGSGTYC (PMEL_HUMAN)
  misc_feature (2)..(2): Xaa can be Gln, Leu, Met, Val, Ile, Thr, Ser, or Ala
  misc_feature (10)..(10): Xaa can be Tyr, Phe, Met, Cys, Arg, Trp, Ala, Pro, Asn, Gly, Thr, Ile, Gln, Lys, Asp, Glu, Leu, His, Ser, or Val
IXKGGSGTYX

SEQ ID NO: 143440 - protein, 11 aa, Artificial Sequence
  Description of Artificial Sequence: Synthetic peptide
  Seed: ILKGGSGTYCL (PMEL_HUMAN)
  misc_feature (2)..(2): Xaa can be Leu, Gln, Met, Ile, Val, Gly, Glu, Thr, Ala, Ser, Tyr, Pro, Phe, Cys, Asn, Lys, or Arg
  misc_feature (11)..(11): Xaa can be Tyr, Phe, Met, Trp, Leu, Val, or His
IXKGGSGTYCX

SEQ ID NO: 143441 - protein, 8 aa, Artificial Sequence
  Description of Artificial Sequence: Synthetic peptide
  Seed: ILLVLMAV (PMEL_HUMAN)
  misc_feature (2)..(2): Xaa can be Leu, or Met
  misc_feature (8)..(8): Xaa can be Ile, Val, or Leu
IXLVLMAX

SEQ ID NO: 143442 - protein, 9 aa, Artificial Sequence
  Description of Artificial Sequence: Synthetic peptide
  Seed: ILLVLMAVV (PMEL_HUMAN)
  misc_feature (2)..(2): Xaa can be Gln, Leu, Met, Val, Thr, Ala, Glu, Ser, Gly, Ile, Asn, or Asp
  misc_feature (9)..(9): Xaa can be Val, Ile, Leu, Ala, Met, Thr, Phe, or Cys
IXLVLMAVX

SEQ ID NO: 143443 - protein, 10 aa, Artificial Sequence
  Description of Artificial Sequence: Synthetic peptide
  Seed: ILLVLMAVVL (PMEL_HUMAN)
  misc_feature (2)..(2): Xaa can be Leu, Met, or Ile
  misc_feature (10)..(10): Xaa can be Val, Ile, or Leu
IXLVLMAVVX

SEQ ID NO: 143444 - protein, 9 aa, Artificial Sequence
  Description of Artificial Sequence: Synthetic peptide
  Seed: IMPGQEAGL (PMEL_HUMAN)
  misc_feature (2)..(2): Xaa can be Ala, Leu, Met, Gln, Phe, Tyr, Gly, Val, Ile, Ser, Thr, Arg, Cys, Asn, Glu, Trp, Pro, His, Lys, or Asp
  misc_feature (9)..(9): Xaa can be Leu, Tyr, Met, Lys, Phe, Arg, Ile, Val, Trp, Ala, His, or Cys
IXPGQEAGX

SEQ ID NO: 143445 - protein, 11 aa, Artificial Sequence
  Description of Artificial Sequence: Synthetic peptide
  Seed: IMSTESITGSL (PMEL_HUMAN)
  misc_feature (2)..(2): Xaa can be Leu, Met, Gln, Ile, or Val
  misc_feature (11)..(11): Xaa can be Trp, Leu, Ile, Phe, Val, Ala, or Met
IXSTESITGSX

SEQ ID NO: 143446 - protein, 9 aa, Artificial Sequence
  Description of Artificial Sequence: Synthetic peptide
  Seed: IPEPEGPDA (PMEL_HUMAN)
  misc_feature (2)..(2): Xaa can be Pro, Ala, Ser, Ile, Val, Phe, Gly, or Thr
  misc_feature (9)..(9): Xaa can be Tyr, Phe, Leu, Met, His, Cys, Trp, Ala, Val, Pro, Ile, or Thr
IXEPEGPDX

SEQ ID NO: 143447 - protein, 11 aa, Artificial Sequence
  Description of Artificial Sequence: Synthetic peptide
  Seed: IPEPEGPDASS (PMEL_HUMAN)
  misc_feature (2)..(2): Xaa can be Pro, Ala, Val, or Ile
  misc_feature (11)..(11): Xaa can be Leu, Met, Phe, Ala, Ile, Trp, Arg, Lys, Thr, Gly, Val, Pro, Ser, Cys, or Tyr
IXEPEGPDASX

SEQ ID NO: 143448 - protein, 9 aa, Artificial Sequence
  Description of Artificial Sequence: Synthetic peptide
  Seed: IPLTSCGSS (PMEL_HUMAN)
  misc_feature (2)..(2): Xaa can be Pro, or Ala
  misc_feature (9)..(9): Xaa can be Ala, Leu, Val, Ser, Tyr, Met, Cys, Pro, Phe, Ile, Gly, or Thr
IXLTSCGSX

SEQ ID NO: 143449 - protein, 10 aa, Artificial Sequence
  Description of Artificial Sequence: Synthetic peptide
  Seed: IPLTSCGSSP (PMEL_HUMAN)
  misc_feature (2)..(2): Xaa can be , or Pro
  misc_feature (10)..(10): Xaa can be Ile, Val, Gly, Thr, Phe, Pro, Cys, Met, Leu, Tyr, Ala, or Ser
IXLTSCGSSX

SEQ ID NO: 143450 - protein, 11 aa, Artificial Sequence
  Description of Artificial Sequence: Synthetic peptide
  Seed: IPLTSCGSSPV (PMEL_HUMAN)
  misc_feature (2)..(2): Xaa can be , or Pro
  misc_feature (11)..(11): Xaa can be Pro, Ala, Cys, Ser, Ile, Tyr, Val, Phe, Leu, Met, Gly, or Thr
IXLTSCGSSPX

SEQ ID NO: 143451 - protein, 9 aa, Artificial Sequence
  Description of Artificial Sequence: Synthetic peptide
  Seed: ISRALVVTH (PMEL_HUMAN)
  misc_feature (2)..(2): Xaa can be Thr, Ser, Ala, Met, Val, Gln, Ile, Phe, Tyr, Leu, Gly, Trp, Asn, Cys, Pro, Arg, Glu, Lys, Asp, or His
  misc_feature (9)..(9): Xaa can be Tyr, Phe, Met, Lys, Leu, Val, Ala, Ile, Arg, His, Trp, Ser, Gly, Cys, Thr, Pro, Gln, Asn, or Glu
IXRALVVTX

SEQ ID NO: 143452 - protein, 11 aa, Artificial Sequence
  Description of Artificial Sequence: Synthetic peptide
  Seed: ISRALVVTHTY (PMEL_HUMAN)
  misc_feature (2)..(2): Xaa can be Thr, Ser, Gln, Met, Trp, Ile, Tyr, Val, Phe, Ala, Leu, His, Asn, Cys, Pro, Gly, Glu, Arg, Lys, or Asp
  misc_feature (11)..(11): Xaa can be Phe, Trp, Tyr, Met, or Leu
IXRALVVTHTX

SEQ ID NO: 143453 - protein, 8 aa, Artificial Sequence
  Description of Artificial Sequence: Synthetic peptide
  Seed: ISTAPVQM (PMEL_HUMAN)
  misc_feature (2)..(2): Xaa can be Ala, Ser, Thr, Val, Ile, Gly, Gln, Met, Asp, Asn, Leu, Cys, Phe, Glu, His, Arg, Pro, or Ty r
  misc_feature (8)..(8): Xaa can be Leu, Lys, Arg, Tyr, Phe, Met, Ile, Val, His, or Trp
IXTAPVQX

SEQ ID NO: 143454 - protein, 9 aa, Artificial Sequence
  Description of Artificial Sequence: Synthetic peptide
  Seed: ITDQVPFSV (PMEL_HUMAN)
  misc_feature (2)..(2): Xaa can be Phe, Tyr, Ala, Thr, Leu, Met, Ser, Trp, Ile, Val, Gly, Cys, Arg, Gln, Asn, Pro, His, Glu, Asp, or Lys
  misc_feature (9)..(9): Xaa can be Lys, Val, Met, Leu, Tyr, Trp, Ile, Phe, Arg, Cys, Ala, His, Thr, Gln, Ser, Pro, Gly, Asn, or Glu
IXDQVPFSX

SEQ ID NO: 143455 - protein, 11 aa, Artificial Sequence
  Description of Artificial Sequence: Synthetic peptide
  Seed: ITDQVPFSVSV (PMEL_HUMAN)
  misc_feature (2)..(2): Xaa can be Ala, Ser, Leu, Ile, Val, Met, Thr, Cys, Gly, Tyr, Pro, Phe, Gln, Trp, Asn, Glu, Asp, Lys, His, or Arg
  misc_feature (11)..(11): Xaa can be Val, Leu, Trp, Met, Phe, Ile, Tyr, Cys, Ala, Lys, or Thr
IXDQVPFSVSX

SEQ ID NO: 143456 - protein, 8 aa, Artificial Sequence
  Description of Artificial Sequence: Synthetic peptide
  Seed: ITGSLGPL (PMEL_HUMAN)
  misc_feature (2)..(2): Xaa can be Ala, Thr, or Ser
  misc_feature (8)..(8): Xaa can be Leu, Tyr, Met, Lys, or Phe
IXGSLGPX

SEQ ID NO: 143457 - protein, 9 aa, Artificial Sequence
  Description of Artificial Sequence: Synthetic peptide
  Seed: ITGSLGPLL (PMEL_HUMAN)
  misc_feature (2)..(2): Xaa can be Ala, Thr, Met, Ile, Val, Leu, Ser, Gly, Arg, Gln, Asn, Phe, Pro, Tyr, Glu, Cys, Asp, Trp, His, or Lys
  misc_feature (9)..(9): Xaa can be Leu, Trp, Met, Phe, Tyr, Lys, Val, Arg, Ile, Ala, His, Cys, or Thr
IXGSLGPLX

SEQ ID NO: 143458 - protein, 8 aa, Artificial Sequence
  Description of Artificial Sequence: Synthetic peptide
  Seed: IVGILLVL (PMEL_HUMAN)
  misc_feature (2)..(2): Xaa can be Ala, Ser, Thr, Gly, Val, Ile, Gln, Met, Leu, or Asn
  misc_feature (8)..(8): Xaa can be Leu, Tyr, Phe, Met, Ile, Val, His, or Lys
IXGILLVX

SEQ ID NO: 143459 - protein, 9 aa, Artificial Sequence
  Description of Artificial Sequence: Synthetic peptide
  Seed: IVGILLVLM (PMEL_HUMAN)
  misc_feature (2)..(2): Xaa can be Thr, Ser, Ala, Val, Gly, Ile, Met, or Leu
  misc_feature (9)..(9): Xaa can be Leu, Met, Phe, Tyr, Val, or Ile
IXGILLVLX

SEQ ID NO: 143460 - protein, 10 aa, Artificial Sequence
  Description of Artificial Sequence: Synthetic peptide
  Seed: IVQGIESAEI (PMEL_HUMAN)
  misc_feature (2)..(2): Xaa can be Leu, Met, Ile, Val, Gln, Thr, or Ala
  misc_feature (10)..(10): Xaa can be Val, Ile, Leu, Ala, or Met
IXQGIESAEX

SEQ ID NO: 143461 - protein, 9 aa, Artificial Sequence
  Description of Artificial Sequence: Synthetic peptide
  Seed: IVVLSGTTA (PMEL_HUMAN)
  misc_feature (2)..(2): Xaa can be Pro, Ala, Val, Ser, Thr, Gly, Ile, Leu, Met, Gln, Asn, Cys, Phe, Asp, Glu, or Tyr
  misc_feature (9)..(9): Xaa can be Tyr, Phe, Met, Leu, His, Val, Ile, Lys, Ala, Arg, Trp, Gln, Thr, Cys, Ser, Glu, Pro, or Gl y
IXVLSGTTX

SEQ ID NO: 143462 - protein, 8 aa, Artificial Sequence
  Description of Artificial Sequence: Synthetic peptide
  Seed: IYRRRLMK (PMEL_HUMAN)
  misc_feature (2)..(2): Xaa can be Tyr, Gln, Val, Met, Thr, Ser, or Phe
  misc_feature (8)..(8): Xaa can be , or Lys
IXRRRLMX

SEQ ID NO: 143463 - protein, 9 aa, Artificial Sequence
  Description of Artificial Sequence: Synthetic peptide
  Seed: IYRRRLMKQ (PMEL_HUMAN)
  misc_feature (2)..(2): Xaa can be Thr, Ser, Val, Met, Tyr, Gln, Phe, Ile, Ala, Leu, Gly, Trp, Asn, Lys, Arg, His, or Cys
  misc_feature (9)..(9): Xaa can be Lys, Val, Ala, Ser, Met, Ile, Tyr, Leu, Arg, Gly, Thr, Gln, Pro, Phe, Cys, Asn, Glu, or Hi s
IXRRRLMKX

SEQ ID NO: 143464 - protein, 8 aa, Artificial Sequence
  Description of Artificial Sequence: Synthetic peptide
  Seed: KAWNRQLY (PMEL_HUMAN)
  misc_feature (2)..(2): Xaa can be Ser, Ala, Thr, Gln, Val, Met, Leu, Asn, Ile, Lys, Cys, Pro, Gly, His, Tyr, Asp, Glu, Trp, or Phe
  misc_feature (8)..(8): Xaa can be Tyr, Trp, Phe, Leu, Met, Ile, or Val
KXWNRQLX

SEQ ID NO: 143465 - protein, 9 aa, Artificial Sequence
  Description of Artificial Sequence: Synthetic peptide
  Seed: KAWNRQLYP (PMEL_HUMAN)
  misc_feature (2)..(2): Xaa can be Ser, Thr, Met, Val, Tyr, Ala, Phe, Ile, Trp, Leu, Gly, Gln, Asn, Cys, His, Lys, or Arg
  misc_feature (9)..(9): Xaa can be Lys, Ala, Val, Tyr, Met, Ile, Leu, Gly, Ser, Arg, Thr, Pro, Cys, His, Phe, Asn, Gln, or Gl u
KXWNRQLYX

SEQ ID NO: 143466 - protein, 11 aa, Artificial Sequence
  Description of Artificial Sequence: Synthetic peptide
  Seed: KAWNRQLYPEW (PMEL_HUMAN)
  misc_feature (2)..(2): Xaa can be Thr, Ser, Ala, Val, Ile, Met, Leu, Gln, Cys, Asp, Gly, Pro, or Asn
  misc_feature (11)..(11): Xaa can be Trp, Phe, Met, Tyr, Leu, or Ile
KXWNRQLYPEX

SEQ ID NO: 143467 - protein, 9 aa, Artificial Sequence
  Description of Artificial Sequence: Synthetic peptide
  Seed: KEACMEISS (PMEL_HUMAN)
  misc_feature (2)..(2): Xaa can be Glu, Asp, or Gln
  misc_feature (9)..(9): Xaa can be Met, Ile, Leu, Val, Ala, Phe, Cys, Pro, Ser, Asp, Gly, Thr, Trp, Tyr, or Glu
KXACMEISX

SEQ ID NO: 143468 - protein, 10 aa, Artificial Sequence
  Description of Artificial Sequence: Synthetic peptide
  Seed: KEACMEISSP (PMEL_HUMAN)
  misc_feature (2)..(2): Xaa can be Glu, or Asp
  misc_feature (10)..(10): Xaa can be Leu, Ala, Ser, Gly, Ile, Trp, Met, Tyr, Phe, Cys, Val, Pro, or Thr
KXACMEISSX

SEQ ID NO: 143469 - protein, 9 aa, Artificial Sequence
  Description of Artificial Sequence: Synthetic peptide
  Seed: KHFLRNQPL (PMEL_HUMAN)
  misc_feature (2)..(2): Xaa can be Gln, Arg, His, Met, Tyr, Leu, Lys, Glu, Ala, Phe, Ser, Pro, Trp, Val, Gly, Thr, Asn, Asp, Ile, or Cys
  misc_feature (9)..(9): Xaa can be Phe, Tyr, Met, Leu, Ile, Val, Trp, His, Ala, Cys, Thr, Gly, Ser, Pro, Gln, Lys, Glu, Arg, or Asn
KXFLRNQPX

SEQ ID NO: 143470 - protein, 11 aa, Artificial Sequence
  Description of Artificial Sequence: Synthetic peptide
  Seed: KHFLRNQPLTF (PMEL_HUMAN)
  misc_feature (2)..(2): Xaa can be Arg, Gln, Tyr, Trp, His, Phe, Met, Lys, Leu, Glu, Ala, Gly, Pro, Cys, Ser, Val, Ile, Thr, Asp, or Asn
  misc_feature (11)..(11): Xaa can be Phe, Tyr, Met, Leu, Trp, Ile, Val, His, Thr, Lys, Cys, Gln, Ala, Arg, Ser, Gly, or Pro
KXFLRNQPLTX

SEQ ID NO: 143471 - protein, 9 aa, Artificial Sequence
  Description of Artificial Sequence: Synthetic peptide
  Seed: KQDFSVPQL (PMEL_HUMAN)
  misc_feature (2)..(2): Xaa can be Glu, Ala, Tyr, Thr, Arg, Ile, Ser, Val, Met, Gln, Leu, Gly, Asp, Phe, His, Cys, Trp, Pro, Asn, or Lys
  misc_feature (9)..(9): Xaa can be Met, Val, Tyr, Ile, Trp, Phe, Leu, Cys, Ala, Arg, Thr, Lys, Ser, His, Pro, Gln, Gly, Glu, or Asp
KXDFSVPQX

SEQ ID NO: 143472 - protein, 9 aa, Artificial Sequence
  Description of Artificial Sequence: Synthetic peptide
  Seed: KRCLLHLAV (PMEL_HUMAN)
  misc_feature (2)..(2): Xaa can be Arg, His, Gln, Ala, Ser, Lys, Asn, Glu, Gly, Tyr, Phe, Met, Asp, Thr, Pro, Cys, Ile, Val, Trp, or Leu
  misc_feature (9)..(9): Xaa can be Leu, Phe, Met, Tyr, Ile, Val, Ala, Lys, Cys, Thr, Pro, Arg, His, Trp, Gln, Gly, or Ser
KXCLLHLAX

SEQ ID NO: 143473 - protein, 10 aa, Artificial Sequence
  Description of Artificial Sequence: Synthetic peptide
  Seed: KRCLLHLAVI (PMEL_HUMAN)
  misc_feature (2)..(2): Xaa can be Arg, or Gln
  misc_feature (10)..(10): Xaa can be Leu, His, Lys, Ala, Gly, Gln, Tyr, Trp, Phe, Arg, Thr, Ile, Ser, Cys, Val, or Met
KXCLLHLAVX

SEQ ID NO: 143474 - protein, 9 aa, Artificial Sequence
  Description of Artificial Sequence: Synthetic peptide
  Seed: KRQVPLDCV (PMEL_HUMAN)
  misc_feature (2)..(2): Xaa can be Arg, Phe, Tyr, Gln, Ala, His, Asn, Glu, Ser, or Gly
  misc_feature (9)..(9): Xaa can be Leu, Met, Tyr, Phe, Val, Ile, Ala, Lys, Arg, Cys, His, or Trp
KXQVPLDCX

SEQ ID NO: 143475 - protein, 10 aa, Artificial Sequence
  Description of Artificial Sequence: Synthetic peptide
  Seed: KRQVPLDCVL (PMEL_HUMAN)
  misc_feature (2)..(2): Xaa can be Arg, Gln, Met, His, Leu, Thr, Trp, Ala, Lys, Val, Asn, Cys, Asp, Gly, Pro, Tyr, Ile, Glu, Ser, or Phe
  misc_feature (10)..(10): Xaa can be Tyr, Trp, Phe, Ile, Met, Leu, His, Val, Lys, or Arg
KXQVPLDCVX

SEQ ID NO: 143476 - protein, 11 aa, Artificial Sequence
  Description of Artificial Sequence: Synthetic peptide
  Seed: KRQVPLDCVLY (PMEL_HUMAN)
  misc_feature (2)..(2): Xaa can be Arg, Met, Tyr, Gln, Lys, Val, Ser, Ala, Phe, His, or Thr
  misc_feature (11)..(11): Xaa can be Tyr, Phe, Trp, Met, Leu, His, Arg, Lys, Val, Ala, or Ile
KXQVPLDCVLX

SEQ ID NO: 143477 - protein, 9 aa, Artificial Sequence
  Description of Artificial Sequence: Synthetic peptide
  Seed: KRSFVYVWK (PMEL_HUMAN)
  misc_feature (2)..(2): Xaa can be , or Arg
  misc_feature (9)..(9): Xaa can be Phe, Val, Trp, Ile, Tyr, His, Met, Arg, Lys, or Leu
KXSFVYVWX

SEQ ID NO: 143478 - protein, 10 aa, Artificial Sequence
  Description of Artificial Sequence: Synthetic peptide
  Seed: KRSFVYVWKT (PMEL_HUMAN)
  misc_feature (2)..(2): Xaa can be Arg, Gln, or Lys
  misc_feature (10)..(10): Xaa can be Leu, Met, Val, Ile, Lys, Trp, Phe, Tyr, Ser, Gly, Asn, Cys, Glu, Arg, Gln, His, Pro, Thr, or Ala
KXSFVYVWKX

SEQ ID NO: 143479 - protein, 11 aa, Artificial Sequence
  Description of Artificial Sequence: Synthetic peptide
  Seed: KRSFVYVWKTW (PMEL_HUMAN)
  misc_feature (2)..(2): Xaa can be Ser, Arg, Ala, Thr, Ile, Cys, Asn, Gly, Val, His, Gln, Lys, Phe, Leu, Tyr, or Met
  misc_feature (11)..(11): Xaa can be Trp, Phe, Tyr, Met, Leu, or Ile
KXSFVYVWKTX

SEQ ID NO: 143480 - protein, 9 aa, Artificial Sequence
  Description of Artificial Sequence: Synthetic peptide
  Seed: KTWGQYWQV (PMEL_HUMAN)
  misc_feature (2)..(2): Xaa can be Met, Leu, Thr, Gln, Ser, Ile, Val, Ala, Trp, Phe, Tyr, Glu, Gly, Asn, Asp, Cys, His, Pro, Lys, or Arg
  misc_feature (9)..(9): Xaa can be Tyr, Trp, Val, Lys, Arg, Phe, Ile, Met, Leu, His, Ala, Thr, Cys, Gln, Ser, Gly, Pro, Glu, Asp, or Asn
KXWGQYWQX

SEQ ID NO: 143481 - protein, 10 aa, Artificial Sequence
  Description of Artificial Sequence: Synthetic peptide
  Seed: KTWGQYWQVL (PMEL_HUMAN)
  misc_feature (2)..(2): Xaa can be Met, Thr, Leu, Val, Ile, Gln, Tyr, Ala, Trp, Phe, Ser, Lys, Glu, His, Arg, Asp, Cys, Pro, Gly, or Asn
  misc_feature (10)..(10): Xaa can be Phe, Met, Ile, Trp, Tyr, Leu, Val, Ala, Cys, Gly, Thr, Arg, Lys, Asp, Glu, Asn, Ser, His, Pro, or Gln
KXWGQYWQVX

SEQ ID NO: 143482 - protein, 9 aa, Artificial Sequence
  Description of Artificial Sequence: Synthetic peptide
  Seed: KVLPDGQVI (PMEL_HUMAN)
  misc_feature (2)..(2): Xaa can be Gln, Ala, Met, Leu, Ser, Thr, Val, Ile, Gly, Asn, Asp, Arg, Cys, Glu, Pro, Phe, His, Tyr, Lys, or Trp
  misc_feature (9)..(9): Xaa can be Leu, Trp, Phe, Met, Tyr, Val, Ile, Lys, Arg, His, Ala, Cys, Thr, Ser, Pro, Gln, or Gly
KXLPDGQVX

SEQ ID NO: 143483 - protein, 10 aa, Artificial Sequence
  Description of Artificial Sequence: Synthetic peptide
  Seed: KVLPDGQVIW (PMEL_HUMAN)
  misc_feature (2)..(2): Xaa can be Glu, Gln, Thr, Ser, Met, Ala, Val, Ile, Leu, Gly, Cys, Pro, Asn, Arg, Lys, His, Trp, Asp, Phe, or Tyr
  misc_feature (10)..(10): Xaa can be Trp, Phe, Tyr, Leu, Met, Ile, Lys, Val, Cys, Arg, His, Thr, or Ala
KXLPDGQVIX

SEQ ID NO: 143484 - protein, 11 aa, Artificial Sequence
  Description of Artificial Sequence: Synthetic peptide
  Seed: KVLPDGQVIWV (PMEL_HUMAN)
  misc_feature (2)..(2): Xaa can be Thr, Ser, Gln, Met, Leu, Ala, Val, Ile, Gly, Cys, Glu, Phe, Asn, Tyr, Asp, Lys, Pro, Trp, Arg, or His
  misc_feature (11)..(11): Xaa can be Trp, Phe, Leu, Tyr, Met, Val, Ile, Cys, Ala, Thr, His, Arg, Gly, Lys, Gln, Ser, or Pro
KXLPDGQVIWX

SEQ ID NO: 143485 - protein, 9 aa, Artificial Sequence
  Description of Artificial Sequence: Synthetic peptide
  Seed: KVSNDGPTL (PMEL_HUMAN)
  misc_feature (2)..(2): Xaa can be Leu, Ala, Gln, Arg, Met, Ser, Val, Ile, Thr, Gly, Tyr, Glu, Asn, Phe, Asp, Lys, Pro, Trp, His, or Cys
  misc_feature (9)..(9): Xaa can be Met, Phe, Tyr, Leu, Trp, Lys, Val, Ile, Arg, His, Ala, Cys, Thr, or Gln
KXSNDGPTX

SEQ ID NO: 143486 - protein, 10 aa, Artificial Sequence
  Description of Artificial Sequence: Synthetic peptide
  Seed: KVSNDGPTLI (PMEL_HUMAN)
  misc_feature (2)..(2): Xaa can be Gln, Met, Leu, Ile, Ser, Thr, Val, Ala, Glu, Cys, Gly, Lys, Asn, Phe, Pro, Asp, Trp, His, Tyr, or Arg
  misc_feature (10)..(10): Xaa can be Trp, Phe, Leu, Met, Tyr, Val, Ile, Ala, Cys, or Thr
KXSNDGPTLX

SEQ ID NO: 143487 - protein, 8 aa, Artificial Sequence
  Description of Artificial Sequence: Synthetic peptide
  Seed: LADTNSLA (PMEL_HUMAN)
  misc_feature (2)..(2): Xaa can be Ala, Ile, Val, Thr, Ser, Gly, Asn, Met, Asp, Gln, Cys, Tyr, Phe, Leu, Trp, Pro, Glu, Lys, or His
  misc_feature (8)..(8): Xaa can be Leu, Phe, Met, Ile, Val, Tyr, Ala, Cys, or Trp
LXDTNSLX

SEQ ID NO: 143488 - protein, 9 aa, Artificial Sequence
  Description of Artificial Sequence: Synthetic peptide
  Seed: LADTNSLAV (PMEL_HUMAN)
  misc_feature (2)..(2): Xaa can be Tyr, Phe, Ala, Ser, Thr, Pro, Ile, Val, Met, Gln, Leu, Gly, Glu, Trp, Asn, Cys, Arg, Asp, His, or Lys
  misc_feature (9)..(9): Xaa can be Ile, Leu, Met, Phe, Val, Tyr, Trp, Cys, Ala, Lys, Arg, Thr, His, Gln, Ser, Pro, Gly, or Gl u
LXDTNSLAX

SEQ ID NO: 143489 - protein, 10 aa, Artificial Sequence
  Description of Artificial Sequence: Synthetic peptide
  Seed: LADTNSLAVV (PMEL_HUMAN)
  misc_feature (2)..(2): Xaa can be Ala, Thr, Ser, Leu, Val, Met, Ile, Gly, Gln, Tyr, Phe, Asn, Cys, Pro, Glu, Trp, or Asp
  misc_feature (10)..(10): Xaa can be Leu, Met, Phe, Ile, Val, Lys, Tyr, Cys, Trp, Arg, Ala, or Thr
LXDTNSLAVX

SEQ ID NO: 143490 - protein, 10 aa, Artificial Sequence
  Description of Artificial Sequence: Synthetic peptide
  Seed: LAEADLSYTW (PMEL_HUMAN)
  misc_feature (2)..(2): Xaa can be Pro, Thr, Ser, Ala, Arg, His, Val, Cys, Gly, Asn, Met, Tyr, Asp, Lys, Ile, Trp, Phe, Glu, Gln, or Leu
  misc_feature (10)..(10): Xaa can be Tyr, Trp, Phe, Met, Ile, Leu, or Val
LXEADLSYTX

SEQ ID NO: 143491 - protein, 11 aa, Artificial Sequence
  Description of Artificial Sequence: Synthetic peptide
  Seed: LAEADLSYTWD (PMEL_HUMAN)
  misc_feature (2)..(2): Xaa can be Ala, Thr, Ser, Val, Met, Ile, or Gly
  misc_feature (11)..(11): Xaa can be Trp, Asn, Asp, Gly, Pro, Ser, Ile, Phe, Val, Tyr, Ala, His, Gln, Lys, Cys, Arg, Glu, Met, Thr, or Leu
LXEADLSYTWX

SEQ ID NO: 143492 - protein, 8 aa, Artificial Sequence
  Description of Artificial Sequence: Synthetic peptide
  Seed: LAHSSSAF (PMEL_HUMAN)
  misc_feature (2)..(2): Xaa can be Gln, Ala, Met, Val, Thr, Lys, Ser, Arg, His, Ile, Glu, Leu, Gly, Pro, Tyr, Trp, Asn, or Ph e
  misc_feature (8)..(8): Xaa can be Phe, Tyr, Met, Leu, Ile, His, Trp, Val, or Ala
LXHSSSAX

SEQ ID NO: 143493 - protein, 10 aa, Artificial Sequence
  Description of Artificial Sequence: Synthetic peptide
  Seed: LAHSSSAFTI (PMEL_HUMAN)
  misc_feature (2)..(2): Xaa can be Ser, Pro, Ile, Thr, Val, Met, Ala, Cys, Arg, Leu, Tyr, Lys, Asn, His, Gln, Trp, Gly, Asp, Glu, or Phe
  misc_feature (10)..(10): Xaa can be Val, Ile, Leu, Met, Phe, Trp, Tyr, Gly, Asn, or Cys
LXHSSSAFTX

SEQ ID NO: 143494 - protein, 9 aa, Artificial Sequence
  Description of Artificial Sequence: Synthetic peptide
  Seed: LASLIYRRR (PMEL_HUMAN)
  misc_feature (2)..(2): Xaa can be Met, Thr, Leu, Phe, Gly, Val, Gln, Tyr, Ala, Ser, Ile, Trp, Asn, Asp, or Pro
  misc_feature (9)..(9): Xaa can be Arg, Lys, or Tyr
LXSLIYRRX

SEQ ID NO: 143495 - protein, 8 aa, Artificial Sequence
  Description of Artificial Sequence: Synthetic peptide
  Seed: LAVGATKV (PMEL_HUMAN)
  misc_feature (2)..(2): Xaa can be Ala, Ser, Gln, Pro, Met, Gly, Glu, Asn, Leu, or Val
  misc_feature (8)..(8): Xaa can be Ile, Val, Leu, Met, Phe, or Tyr
LXVGATKX

SEQ ID NO: 143496 - protein, 9 aa, Artificial Sequence
  Description of Artificial Sequence: Synthetic peptide
  Seed: LAVGATKVP (PMEL_HUMAN)
  misc_feature (2)..(2): Xaa can be Ala, Ser, Val, Thr, Gln, Gly, Ile, Met, Asn, Leu, Cys, Phe, Glu, Asp, Pro, Lys, or Tyr
  misc_feature (9)..(9): Xaa can be Tyr, Phe, Met, Leu, His, Ile, Val, Trp, Ala, Cys, Arg, Ser, Gln, Thr, Pro, or Lys
LXVGATKVX

SEQ ID NO: 143497 - protein, 10 aa, Artificial Sequence
  Description of Artificial Sequence: Synthetic peptide
  Seed: LAVGATKVPR (PMEL_HUMAN)
  misc_feature (2)..(2): Xaa can be Ala, Val, Thr, Ser, Gly, Met, Ile, Gln, Cys, Leu, Glu, Asn, Asp, Trp, Phe, Pro, Tyr, His, Arg, or Lys
  misc_feature (10)..(10): Xaa can be Arg, Lys, Tyr, Phe, His, Leu, Met, Ile, or Val
LXVGATKVPX

SEQ ID NO: 143498 - protein, 8 aa, Artificial Sequence
  Description of Artificial Sequence: Synthetic peptide
  Seed: LAVIGALL (PMEL_HUMAN)
  misc_feature (2)..(2): Xaa can be Ala, Ser, Pro, Gly, Thr, Gln, Glu, Asn, Met, or Val
  misc_feature (8)..(8): Xaa can be Val, Leu, Ile, Met, Tyr, Phe, Lys, or His
LXVIGALX

SEQ ID NO: 143499 - protein, 9 aa, Artificial Sequence
  Description of Artificial Sequence: Synthetic peptide
  Seed: LAVIGALLA (PMEL_HUMAN)
  misc_feature (2)..(2): Xaa can be Pro, Ala, Ser, Thr, Gly, Val, Met, Ile, Cys, Leu, Gln, Phe, Asn, or Asp
  misc_feature (9)..(9): Xaa can be Tyr, Met, Phe, Leu, Lys, Ile, Val, Arg, His, Ala, Cys, Trp, Ser, Gly, Pro, or Thr
LXVIGALLX

SEQ ID NO: 143500 - protein, 10 aa, Artificial Sequence
  Description of Artificial Sequence: Synthetic peptide
  Seed: LAVIGALLAV (PMEL_HUMAN)
  misc_feature (2)..(2): Xaa can be Ala, Gly, Ser, Val, Thr, Gln, Leu, Met, Arg, Tyr, Cys, Pro, His, Ile, Trp, Phe, Asp, Asn, Lys, or Glu
  misc_feature (10)..(10): Xaa can be Leu, Met, Ala, Thr, Val, Ile, Tyr, Phe, Ser, Lys, or Arg
LXVIGALLAX

SEQ ID NO: 143501 - protein, 8 aa, Artificial Sequence
  Description of Artificial Sequence: Synthetic peptide
  Seed: LAVVSTQL (PMEL_HUMAN)
  misc_feature (2)..(2): Xaa can be Ala, Ser, Gly, Pro, Gln, Asp, Thr, Met, Asn, Glu, Val, Ile, or Leu
  misc_feature (8)..(8): Xaa can be Ile, Leu, Val, Lys, Phe, Met, Tyr, His, or Arg
LXVVSTQX

SEQ ID NO: 143502 - protein, 9 aa, Artificial Sequence
  Description of Artificial Sequence: Synthetic peptide
  Seed: LAVVSTQLI (PMEL_HUMAN)
  misc_feature (2)..(2): Xaa can be Ala, Gln, Ser, Gly, Pro, Glu, Val, Thr, Asn, Ile, Met, Leu, Phe, Cys, Asp, Tyr, Trp, His, Arg, or Lys
  misc_feature (9)..(9): Xaa can be Trp, Phe, Leu, Tyr, Met, Val, Ile, Lys, Cys, Arg, His, or Ala
LXVVSTQLX

SEQ ID NO: 143503 - protein, 10 aa, Artificial Sequence
  Description of Artificial Sequence: Synthetic peptide
  Seed: LAVVSTQLIM (PMEL_HUMAN)
  misc_feature (2)..(2): Xaa can be Met, Ser, Thr, Ala, Pro, Gln, Trp, Phe, Val, Tyr, Leu, Cys, His, Glu, Asn, Asp, Lys, Arg, Gly, or Ile
  misc_feature (10)..(10): Xaa can be Phe, Tyr, Trp, Met, Leu, Ile, or His
LXVVSTQLIX

SEQ ID NO: 143504 - protein, 9 aa, Artificial Sequence
  Description of Artificial Sequence: Synthetic peptide
  Seed: LDCWRGGQV (PMEL_HUMAN)
  misc_feature (2)..(2): Xaa can be Glu, or Asp
  misc_feature (9)..(9): Xaa can be Ile, Phe, Val, Leu, or Met
LXCWRGGQX

SEQ ID NO: 143505 - protein, 8 aa, Artificial Sequence
  Description of Artificial Sequence: Synthetic peptide
  Seed: LDGGNKHF (PMEL_HUMAN)
  misc_feature (2)..(2): Xaa can be Glu, or Asp
  misc_feature (8)..(8): Xaa can be Leu, Phe, or Met
LXGGNKHX

SEQ ID NO: 143506 - protein, 9 aa, Artificial Sequence
  Description of Artificial Sequence: Synthetic peptide
  Seed: LDGGNKHFL (PMEL_HUMAN)
  misc_feature (2)..(2): Xaa can be Glu, Gln, Arg, Asp, Ala, Tyr, Phe, Asn, Gly, Met, Ser, Ile, Val, Thr, His, or Leu
  misc_feature (9)..(9): Xaa can be Leu, Met, Phe, Ile, Val, Trp, Cys, Ala, Thr, or Tyr
LXGGNKHFX

SEQ ID NO: 143507 - protein, 10 aa, Artificial Sequence
  Description of Artificial Sequence: Synthetic peptide
  Seed: LDGGNKHFLR (PMEL_HUMAN)
  misc_feature (2)..(2): Xaa can be Ile, Trp, Leu, Gln, Phe, Val, Ala, Tyr, Ser, Met, Thr, Lys, Arg, Gly, Glu, Asp, Asn, Pro, Cys, or His
  misc_feature (10)..(10): Xaa can be Arg, or Lys
LXGGNKHFLX

SEQ ID NO: 143508 - protein, 9 aa, Artificial Sequence
  Description of Artificial Sequence: Synthetic peptide
  Seed: LDGTATLRL (PMEL_HUMAN)
  misc_feature (2)..(2): Xaa can be Glu, or Asp
  misc_feature (9)..(9): Xaa can be Val, Leu, Ile, Phe, Met, Ala, or Cys
LXGTATLRX

SEQ ID NO: 143509 - protein, 11 aa, Artificial Sequence
  Description of Artificial Sequence: Synthetic peptide
  Seed: LDGTATLRLVK (PMEL_HUMAN)
  misc_feature (2)..(2): Xaa can be Tyr, Leu, Gln, Phe, Trp, His, Glu, Pro, Lys, Cys, Ile, Ser, Arg, Met, Asn, Gly, Val, Ala, Thr, or Asp
  misc_feature (11)..(11): Xaa can be , or Lys
LXGTATLRLVX

SEQ ID NO: 143510 - protein, 8 aa, Artificial Sequence
  Description of Artificial Sequence: Synthetic peptide
  Seed: LEPGPVTA (PMEL_HUMAN)
  misc_feature (2)..(2): Xaa can be , or Glu
  misc_feature (8)..(8): Xaa can be Ile, Leu, Cys, Val, Ala, or Met
LXPGPVTX

SEQ ID NO: 143511 - protein, 9 aa, Artificial Sequence
  Description of Artificial Sequence: Synthetic peptide
  Seed: LEPGPVTAQ (PMEL_HUMAN)
  misc_feature (2)..(2): Xaa can be Glu, Asp, or Gln
  misc_feature (9)..(9): Xaa can be Val, Cys, Ala, Ile, Leu, Pro, Thr, Met, Glu, Asp, Phe, Ser, Gln, Tyr, or Gly
LXPGPVTAX

SEQ ID NO: 143512 - protein, 10 aa, Artificial Sequence
  Description of Artificial Sequence: Synthetic peptide
  Seed: LEPGPVTAQV (PMEL_HUMAN)
  misc_feature (2)..(2): Xaa can be Glu, Gln, Ala, Asp, Pro, Val, Leu, Ser, or Met
  misc_feature (10)..(10): Xaa can be Leu, Val, Ile, Met, Phe, Ala, Gly, Tyr, Ser, Pro, Cys, Thr, or Trp
LXPGPVTAQX

SEQ ID NO: 143513 - protein, 11 aa, Artificial Sequence
  Description of Artificial Sequence: Synthetic peptide
  Seed: LEPGPVTAQVV (PMEL_HUMAN)
  misc_feature (2)..(2): Xaa can be , or Glu
  misc_feature (11)..(11): Xaa can be Phe, Leu, Gly, Ala, Pro, Met, Ile, Ser, Cys, Thr, or Val
LXPGPVTAQVX

SEQ ID NO: 143514 - protein, 8 aa, Artificial Sequence
  Description of Artificial Sequence: Synthetic peptide
  Seed: LGGPVSGL (PMEL_HUMAN)
  misc_feature (2)..(2): Xaa can be Ala, Ser, Thr, Val, Gly, Ile, Phe, His, Leu, Arg, Gln, Asn, Tyr, or Met
  misc_feature (8)..(8): Xaa can be Leu, Lys, Phe, Val, Ile, Tyr, Met, or Arg
LXGPVSGX

SEQ ID NO: 143515 - protein, 10 aa, Artificial Sequence
  Description of Artificial Sequence: Synthetic peptide
  Seed: LGGPVSGLSI (PMEL_HUMAN)
  misc_feature (2)..(2): Xaa can be Arg, Ala, Ser, Gly, Thr, Gln, Asn, Val, Ile, Met, Leu, Cys, Pro, Phe, Lys, Trp, His, Glu, Asp, or Tyr
  misc_feature (10)..(10): Xaa can be Leu, Phe, Ile, Met, Val, Lys, Tyr, Cys, Arg, Ala, His, Trp, or Gln
LXGPVSGLSX

SEQ ID NO: 143516 - protein, 11 aa, Artificial Sequence
  Description of Artificial Sequence: Synthetic peptide
  Seed: LGPLLDGTATL (PMEL_HUMAN)
  misc_feature (2)..(2): Xaa can be Ala, Gly, Thr, Ser, Val, Ile, Trp, Arg, Lys, Asn, Gln, Tyr, Glu, His, Leu, Met, Phe, Asp, Cys, or Pro
  misc_feature (11)..(11): Xaa can be Met, Val, Ala, Leu, Ile, Lys, Phe, Tyr, Arg, or Trp
LXPLLDGTATX

SEQ ID NO: 143517 - protein, 10 aa, Artificial Sequence
  Description of Artificial Sequence: Synthetic peptide
  Seed: LGQVPLIVGI (PMEL_HUMAN)
  misc_feature (2)..(2): Xaa can be Met, Leu, Pro, Arg, Lys, Phe, Ala, Trp, His, Val, Asn, Ser, Gln, Ile, Tyr, Gly, Asp, Glu, Cys, or Thr
  misc_feature (10)..(10): Xaa can be Met, Ala, Val, Leu, Ile, or Thr
LXQVPLIVGX

SEQ ID NO: 143518 - protein, 8 aa, Artificial Sequence
  Description of Artificial Sequence: Synthetic peptide
  Seed: LHDPSGYL (PMEL_HUMAN)
  misc_feature (2)..(2): Xaa can be Ala, Phe, Tyr, Ser, Val, Trp, Gly, Ile, Thr, Leu, Met, Cys, Asp, Pro, Asn, His, Arg, Gln, Glu, or Lys
  misc_feature (8)..(8): Xaa can be Leu, Phe, Ile, Met, Val, Tyr, Cys, Trp, or Ala
LXDPSGYX

SEQ ID NO: 143519 - protein, 9 aa, Artificial Sequence
  Description of Artificial Sequence: Synthetic peptide
  Seed: LHDPSGYLA (PMEL_HUMAN)
  misc_feature (2)..(2): Xaa can be His, Arg, Gln, Pro, Lys, Glu, Tyr, Asn, Met, Ala, Asp, Gly, Leu, or Phe
  misc_feature (9)..(9): Xaa can be Leu, Ile, Phe, Met, Val, Ala, Trp, Cys, Pro, Tyr, or Thr
LXDPSGYLX

SEQ ID NO: 143520 - protein, 11 aa, Artificial Sequence
  Description of Artificial Sequence: Synthetic peptide
  Seed: LHDPSGYLAEA (PMEL_HUMAN)
  misc_feature (2)..(2): Xaa can be His, Pro, Leu, Ala, Thr, Gly, Asp, Tyr, Trp, Phe, Arg, Ile, Met, Cys, Ser, Gln, Lys, Val, Glu, or Asn
  misc_feature (11)..(11): Xaa can be Ala, Leu, Cys, Val, Ile, or Met
LXDPSGYLAEX

SEQ ID NO: 143521 - protein, 8 aa, Artificial Sequence
  Description of Artificial Sequence: Synthetic peptide
  Seed: LHLAVIGA (PMEL_HUMAN)
  misc_feature (2)..(2): Xaa can be , or His
  misc_feature (8)..(8): Xaa can be Ile, Val, Ala, Leu, Met, or Cys
LXLAVIGX

SEQ ID NO: 143522 - protein, 9 aa, Artificial Sequence
  Description of Artificial Sequence: Synthetic peptide
  Seed: LHLAVIGAL (PMEL_HUMAN)
  misc_feature (2)..(2): Xaa can be His, Gln, Arg, Lys, Met, Pro, Glu, Leu, Tyr, Ser, Ala, Phe, Ile, Asn, Thr, Val, Gly, Cys, or Trp
  misc_feature (9)..(9): Xaa can be Phe, Tyr, Met, Leu, Ala, Val, Ile, His, Trp, Thr, Cys, Gly, Pro, or Ser
LXLAVIGAX

SEQ ID NO: 143523 - protein, 10 aa, Artificial Sequence
  Description of Artificial Sequence: Synthetic peptide
  Seed: LHLAVIGALL (PMEL_HUMAN)
  misc_feature (2)..(2): Xaa can be Met, Leu, His, Ala, Cys, Lys, Asn, Glu, Val, Phe, Tyr, Thr, Arg, Trp, Ile, Gly, Asp, Ser, Gln, or Pro
  misc_feature (10)..(10): Xaa can be Thr, Val, Ile, Met, Ala, Leu, Cys, Gly, Ser, Phe, Pro, or Trp
LXLAVIGALX

SEQ ID NO: 143524 - protein, 10 aa, Artificial Sequence
  Description of Artificial Sequence: Synthetic peptide
  Seed: LIGANASFSI (PMEL_HUMAN)
  misc_feature (2)..(2): Xaa can be Met, Leu, Gln, Ile, Thr, Val, Ser, or Ala
  misc_feature (10)..(10): Xaa can be Val, Ile, Leu, Ala, Met, Thr, or Phe
LXGANASFSX

SEQ ID NO: 143525 - protein, 10 aa, Artificial Sequence
  Description of Artificial Sequence: Synthetic peptide
  Seed: LIMPGQEAGL (PMEL_HUMAN)
  misc_feature (2)..(2): Xaa can be Arg, Leu, Met, Gln, Ile, Val, Thr, Ala, Ser, Gly, Asn, Glu, Phe, Tyr, Trp, Pro, Cys, Lys, Asp, or His
  misc_feature (10)..(10): Xaa can be Val, Arg, Lys, Leu, Phe, Trp, Ile, Met, Tyr, Ala, Cys, Thr, His, or Gln
LXMPGQEAGX

SEQ ID NO: 143526 - protein, 9 aa, Artificial Sequence
  Description of Artificial Sequence: Synthetic peptide
  Seed: LIVGILLVL (PMEL_HUMAN)
  misc_feature (2)..(2): Xaa can be Met, Arg, Gln, Leu, Thr, Ala, Ile, Ser, Val, Gly, Glu, Asp, Asn, Tyr, Phe, Pro, Cys, Lys, His, or Trp
  misc_feature (9)..(9): Xaa can be Tyr, Leu, Phe, Trp, Met, Val, Ile, Lys, Arg, His, Ala, Thr, Cys, Ser, or Gln
LXVGILLVX

SEQ ID NO: 143527 - protein, 10 aa, Artificial Sequence
  Description of Artificial Sequence: Synthetic peptide
  Seed: LIVGILLVLM (PMEL_HUMAN)
  misc_feature (2)..(2): Xaa can be Met, Val, Leu, Ile, Gln, Thr, Ala, or Ser
  misc_feature (10)..(10): Xaa can be Ile, Leu, Val, Ala, Met, or Thr
LXVGILLVLX

SEQ ID NO: 143528 - protein, 8 aa, Artificial Sequence
  Description of Artificial Sequence: Synthetic peptide
  Seed: LIYRRRLM (PMEL_HUMAN)
  misc_feature (2)..(2): Xaa can be Met, Leu, Ala, Pro, Val, Ile, Gln, Ser, Trp, Phe, Arg, Asn, Lys, Gly, Thr, Tyr, Glu, or As p
  misc_feature (8)..(8): Xaa can be Leu, Met, Ile, Phe, Val, or Ala
LXYRRRLX

SEQ ID NO: 143529 - protein, 9 aa, Artificial Sequence
  Description of Artificial Sequence: Synthetic peptide
  Seed: LIYRRRLMK (PMEL_HUMAN)
  misc_feature (2)..(2): Xaa can be Thr, Ser, Val, Met, Ala, Ile, Tyr, Leu, Gln, Phe, Gly, Trp, Asn, Cys, Arg, His, Asp, Lys, Glu, or Pro
  misc_feature (9)..(9): Xaa can be Lys, Arg, Ala, Val, Tyr, Ile, Met, His, Ser, Leu, Gly, Gln, Phe, Thr, Cys, Asn, or Pro
LXYRRRLMX

SEQ ID NO: 143530 - protein, 10 aa, Artificial Sequence
  Description of Artificial Sequence: Synthetic peptide
  Seed: LIYRRRLMKQ (PMEL_HUMAN)
  misc_feature (2)..(2): Xaa can be Met, Ile, Leu, Val, Thr, Ala, Ser, Gln, or Phe
  misc_feature (10)..(10): Xaa can be Lys, Arg, Tyr, His, Glu, Asp, Ala, Ile, Val, Pro, Trp, Ser, Thr, Phe, Gly, Cys, Asn, Met, Gln, or Leu
LXYRRRLMKX

SEQ ID NO: 143531 - protein, 8 aa, Artificial Sequence
  Description of Artificial Sequence: Synthetic peptide
  Seed: LKGGSGTY (PMEL_HUMAN)
  misc_feature (2)..(2): Xaa can be Gln, Met, or Lys
  misc_feature (8)..(8): Xaa can be Tyr, Phe, or Met
LXGGSGTX

SEQ ID NO: 143532 - protein, 10 aa, Artificial Sequence
  Description of Artificial Sequence: Synthetic peptide
  Seed: LKRCLLHLAV (PMEL_HUMAN)
  misc_feature (2)..(2): Xaa can be Ser, Tyr, Met, Gln, Trp, His, Gly, Lys, Ala, Arg, Asp, Phe, Thr, Leu, Ile, Asn, Glu, Pro, Val, or Cys
  misc_feature (10)..(10): Xaa can be Met, Ile, Leu, Val, or Phe
LXRCLLHLAX

SEQ ID NO: 143533 - protein, 10 aa, Artificial Sequence
  Description of Artificial Sequence: Synthetic peptide
  Seed: LKVSNDGPTL (PMEL_HUMAN)
  misc_feature (2)..(2): Xaa can be Gln, Arg, Met, Lys, Leu, His, Glu, Ala, Ile, Asn, Ser, Tyr, Thr, Gly, Phe, Val, or Pro
  misc_feature (10)..(10): Xaa can be Tyr, Phe, Met, Leu, Trp, Ile, His, or Val
LXVSNDGPTX

SEQ ID NO: 143534 - protein, 9 aa, Artificial Sequence
  Description of Artificial Sequence: Synthetic peptide
  Seed: LLAVGATKV (PMEL_HUMAN)
  misc_feature (2)..(2): Xaa can be Met, Leu, Gln, Ile, Val, Thr, Ala, Ser, Glu, Gly, Asp, Asn, Phe, Pro, or Tyr
  misc_feature (9)..(9): Xaa can be Ile, Val, Arg, Leu, Lys, Trp, Phe, Met, Tyr, Ala, Thr, or Cys
LXAVGATKX

SEQ ID NO: 143535 - protein, 11 aa, Artificial Sequence
  Description of Artificial Sequence: Synthetic peptide
  Seed: LLAVGATKVPR (PMEL_HUMAN)
  misc_feature (2)..(2): Xaa can be Val, Thr, Met, Ile, Ala, His, Pro, Lys, Gln, Leu, Glu, Arg, Gly, Cys, Trp, Phe, Asp, Asn, Tyr, or Ser
  misc_feature (11)..(11): Xaa can be Arg, or Lys
LXAVGATKVPX

SEQ ID NO: 143536 - protein, 8 aa, Artificial Sequence
  Description of Artificial Sequence: Synthetic peptide
  Seed: LLDGTATL (PMEL_HUMAN)
  misc_feature (2)..(2): Xaa can be Tyr, Phe, Ala, Trp, Ser, Val, Met, Ile, Gly, Thr, Leu, Asn, Gln, Cys, Asp, Pro, Arg, His, or Glu
  misc_feature (8)..(8): Xaa can be Leu, Phe, Met, Ile, Val, Tyr, Ala, Trp, or Cys
LXDGTATX

SEQ ID NO: 143537 - protein, 9 aa, Artificial Sequence
  Description of Artificial Sequence: Synthetic peptide
  Seed: LLDGTATLR (PMEL_HUMAN)
  misc_feature (2)..(2): Xaa can be Thr, Ser, Ala, Val, Met, Ile, Leu, Gln, Tyr, Phe, Gly, Cys, Trp, Pro, Asn, Asp, Glu, His, Lys, or Arg
  misc_feature (9)..(9): Xaa can be Tyr, Lys, Arg, Leu, Met, Phe, Ile, Val, Trp, His, Gln, Ala, Thr, Cys, Ser, Asn, or Glu
LXDGTATLX

SEQ ID NO: 143538 - protein, 10 aa, Artificial Sequence
  Description of Artificial Sequence: Synthetic peptide
  Seed: LLDGTATLRL (PMEL_HUMAN)
  misc_feature (2)..(2): Xaa can be Ala, Leu, Met, Val, Ser, Thr, Tyr, Ile, Gly, Phe, Gln, Cys, Trp, Pro, Asn, Glu, His, or As p
  misc_feature (10)..(10): Xaa can be Leu, Phe, Met, Val, Ile, Tyr, Trp, Cys, Lys, or Ala
LXDGTATLRX

SEQ ID NO: 143539 - protein, 11 aa, Artificial Sequence
  Description of Artificial Sequence: Synthetic peptide
  Seed: LLDGTATLRLV (PMEL_HUMAN)
  misc_feature (2)..(2): Xaa can be Leu, Met, or Ile
  misc_feature (11)..(11): Xaa can be Leu, Val, Met, or Ile
LXDGTATLRLX

SEQ ID NO: 143540 - protein, 9 aa, Artificial Sequence
  Description of Artificial Sequence: Synthetic peptide
  Seed: LLHLAVIGA (PMEL_HUMAN)
  misc_feature (2)..(2): Xaa can be Met, Leu, Val, Ile, Gln, Thr, Ala, or Ser
  misc_feature (9)..(9): Xaa can be Val, Leu, Ile, Ala, Met, Thr, or Ser
LXHLAVIGX

SEQ ID NO: 143541 - protein, 10 aa, Artificial Sequence
  Description of Artificial Sequence: Synthetic peptide
  Seed: LLHLAVIGAL (PMEL_HUMAN)
  misc_feature (2)..(2): Xaa can be Met, Leu, Ile, Val, Gln, Ser, or Thr
  misc_feature (10)..(10): Xaa can be Val, Ala, Ile, Leu, Thr, Met, or Ser
LXHLAVIGAX

SEQ ID NO: 143542 - protein, 11 aa, Artificial Sequence
  Description of Artificial Sequence: Synthetic peptide
  Seed: LLHLAVIGALL (PMEL_HUMAN)
  misc_feature (2)..(2): Xaa can be Met, Trp, Lys, Val, Pro, Leu, Asn, Ala, Phe, Ser, Gly, Thr, Gln, His, Cys, Arg, Tyr, Ile, Glu, or Asp
  misc_feature (11)..(11): Xaa can be Leu, Val, or Ile
LXHLAVIGALX

SEQ ID NO: 143543 - protein, 9 aa, Artificial Sequence
  Description of Artificial Sequence: Synthetic peptide
  Seed: LLVLMAVVL (PMEL_HUMAN)
  misc_feature (2)..(2): Xaa can be Arg, Gln, Met, Ala, Leu, Thr, Ser, Ile, Val, Gly, Asn, Cys, Pro, Phe, Lys, Glu, Trp, Asp, Tyr, or His
  misc_feature (9)..(9): Xaa can be Tyr, Phe, Leu, Met, Val, Ile, His, Trp, Lys, Ala, or Arg
LXVLMAVVX

SEQ ID NO: 143544 - protein, 10 aa, Artificial Sequence
  Description of Artificial Sequence: Synthetic peptide
  Seed: LLVLMAVVLA (PMEL_HUMAN)
  misc_feature (2)..(2): Xaa can be Leu, Met, Phe, Ile, Gln, Lys, Thr, Ser, Tyr, or Arg
  misc_feature (10)..(10): Xaa can be Val, Leu, Ala, or Ile
LXVLMAVVLX

SEQ ID NO: 143545 - protein, 9 aa, Artificial Sequence
  Description of Artificial Sequence: Synthetic peptide
  Seed: LMAVVLASL (PMEL_HUMAN)
  misc_feature (2)..(2): Xaa can be Met, Gln, Leu, Val, Ala, Ile, Thr, Ser, Pro, Gly, Arg, Asn, Glu, Lys, Asp, His, Phe, Cys, Tyr, or Trp
  misc_feature (9)..(9): Xaa can be Leu, Tyr, Phe, Met, Val, Ile, Lys, Arg, Trp, His, Ala, Thr, Ser, Cys, Gly, or Pro
LXAVVLASX

SEQ ID NO: 143546 - protein, 10 aa, Artificial Sequence
  Description of Artificial Sequence: Synthetic peptide
  Seed: LMAVVLASLI (PMEL_HUMAN)
  misc_feature (2)..(2): Xaa can be Met, Ile, Leu, Gln, Val, Thr, Ser, Ala, or Gly
  misc_feature (10)..(10): Xaa can be Val, Ile, Leu, Ala, Met, Thr, Asp, Arg, Cys, Pro, Glu, Trp, Tyr, Lys, Gln, Ser, Asn, Phe, Gly, or His
LXAVVLASLX

SEQ ID NO: 143547 - protein, 11 aa, Artificial Sequence
  Description of Artificial Sequence: Synthetic peptide
  Seed: LMAVVLASLIY (PMEL_HUMAN)
  misc_feature (2)..(2): Xaa can be Gln, Lys, Met, Arg, Leu, His, Thr, Val, Ser, Ile, Tyr, Phe, or Ala
  misc_feature (11)..(11): Xaa can be Tyr, Phe, Met, or Leu
LXAVVLASLIX

SEQ ID NO: 143548 - protein, 8 aa, Artificial Sequence
  Description of Artificial Sequence: Synthetic peptide
  Seed: LMKQDFSV (PMEL_HUMAN)
  misc_feature (2)..(2): Xaa can be Met, or Trp
  misc_feature (8)..(8): Xaa can be , or Val
LXKQDFSX

SEQ ID NO: 143549 - protein, 11 aa, Artificial Sequence
  Description of Artificial Sequence: Synthetic peptide
  Seed: LMKQDFSVPQL (PMEL_HUMAN)
  misc_feature (2)..(2): Xaa can be Met, or Leu
  misc_feature (11)..(11): Xaa can be Ile, Leu, or Val
LXKQDFSVPQX

SEQ ID NO: 143550 - protein, 8 aa, Artificial Sequence
  Description of Artificial Sequence: Synthetic peptide
  Seed: LNFPGSQK (PMEL_HUMAN)
  misc_feature (2)..(2): Xaa can be Ala, Ser, Gly, Val, Thr, Ile, Asn, Leu, Gln, Met, Pro, Cys, Asp, Phe, or Tyr
  misc_feature (8)..(8): Xaa can be Leu, Met, Lys, Arg, Phe, Ile, Val, Tyr, Ala, Trp, or Cys
LXFPGSQX

SEQ ID NO: 143551 - protein, 9 aa, Artificial Sequence
  Description of Artificial Sequence: Synthetic peptide
  Seed: LNFPGSQKV (PMEL_HUMAN)
  misc_feature (2)..(2): Xaa can be Ala, Gln, Ser, Arg, Thr, Val, Ile, Leu, Gly, Met, Glu, Pro, Asn, Asp, Phe, Cys, Lys, His, Tyr, or Trp
  misc_feature (9)..(9): Xaa can be Phe, Val, Leu, Met, Ile, Tyr, Trp, Ala, Cys, Lys, Thr, His, Arg, Ser, Pro, or Gly
LXFPGSQKX

SEQ ID NO: 143552 - protein, 10 aa, Artificial Sequence
  Description of Artificial Sequence: Synthetic peptide
  Seed: LNFPGSQKVL (PMEL_HUMAN)
  misc_feature (2)..(2): Xaa can be Ala, Ser, Thr, Gln, Val, Gly, Ile, Met, Leu, Arg, Glu, Pro, Asp, Asn, Tyr, Phe, Cys, His, Trp, or Lys
  misc_feature (10)..(10): Xaa can be Leu, Phe, Tyr, Met, Val, Ile, Trp, His, Lys, Ala, Cys, Ser, Gln, Thr, or Arg
LXFPGSQKVX

SEQ ID NO: 143553 - protein, 8 aa, Artificial Sequence
  Description of Artificial Sequence: Synthetic peptide
  Seed: LPDGQVIW (PMEL_HUMAN)
  misc_feature (2)..(2): Xaa can be , or Pro
  misc_feature (8)..(8): Xaa can be , or Trp
LXDGQVIX

SEQ ID NO: 143554 - protein, 9 aa, Artificial Sequence
  Description of Artificial Sequence: Synthetic peptide
  Seed: LPDGQVIWV (PMEL_HUMAN)
  misc_feature (2)..(2): Xaa can be Ala, Tyr, Val, Ser, Phe, Ile, Leu, Pro, Trp, Thr, Met, Gly, Gln, Glu, Asn, Cys, His, Asp, Arg, or Lys
  misc_feature (9)..(9): Xaa can be Leu, Met, Phe, Ile, Val, Tyr, Ala, Cys, Trp, Thr, Ser, or His
LXDGQVIWX

SEQ ID NO: 143555 - protein, 8 aa, Artificial Sequence
  Description of Artificial Sequence: Synthetic peptide
  Seed: LPHSSSHW (PMEL_HUMAN)
  misc_feature (2)..(2): Xaa can be , or Pro
  misc_feature (8)..(8): Xaa can be Phe, or Trp
LXHSSSHX

SEQ ID NO: 143556 - protein, 9 aa, Artificial Sequence
  Description of Artificial Sequence: Synthetic peptide
  Seed: LPHSSSHWL (PMEL_HUMAN)
  misc_feature (2)..(2): Xaa can be Pro, Ala, Val, Met, Ile, Ser, Leu, Thr, Phe, or Gly
  misc_feature (9)..(9): Xaa can be Trp, Tyr, Phe, Met, Val, Leu, Ile, His, Ala, Cys, Ser, Pro, or Thr
LXHSSSHWX

SEQ ID NO: 143557 - protein, 10 aa, Artificial Sequence
  Description of Artificial Sequence: Synthetic peptide
  Seed: LPHSSSHWLR (PMEL_HUMAN)
  misc_feature (2)..(2): Xaa can be Met, Thr, Tyr, Asn, Ser, Ala, Pro, Leu, Gln, Gly, Cys, Ile, Phe, Val, Arg, Trp, His, Lys, Glu, or Asp
  misc_feature (10)..(10): Xaa can be Arg, Lys, Tyr, or His
LXHSSSHWLX

SEQ ID NO: 143558 - protein, 11 aa, Artificial Sequence
  Description of Artificial Sequence: Synthetic peptide
  Seed: LPHSSSHWLRL (PMEL_HUMAN)
  misc_feature (2)..(2): Xaa can be , or Pro
  misc_feature (11)..(11): Xaa can be Ile, Val, Ala, Cys, Met, Leu, or Phe
LXHSSSHWLRX

SEQ ID NO: 143559 - protein, 8 aa, Artificial Sequence
  Description of Artificial Sequence: Synthetic peptide
  Seed: LPIPEPEG (PMEL_HUMAN)
  misc_feature (2)..(2): Xaa can be , or Pro
  misc_feature (8)..(8): Xaa can be Ala, Phe, Cys, Leu, Val, Met, Ile, Thr, Ser, Pro, or Gly
LXIPEPEX

SEQ ID NO: 143560 - protein, 9 aa, Artificial Sequence
  Description of Artificial Sequence: Synthetic peptide
  Seed: LPIPEPEGP (PMEL_HUMAN)
  misc_feature (2)..(2): Xaa can be Pro, Ala, or Val
  misc_feature (9)..(9): Xaa can be Met, Leu, Ala, Val, Ile, Phe, Pro, Gln, Tyr, His, Thr, Ser, Gly, Lys, Trp, Cys, or Arg
LXIPEPEGX

SEQ ID NO: 143561 - protein, 11 aa, Artificial Sequence
  Description of Artificial Sequence: Synthetic peptide
  Seed: LPIPEPEGPDA (PMEL_HUMAN)
  misc_feature (2)..(2): Xaa can be Pro, Ala, Val, Thr, Ser, Ile, or Gly
  misc_feature (11)..(11): Xaa can be Tyr, Phe, Leu, Ala, Val, Ile, Met, Thr, Trp, Pro, Lys, Cys, Glu, His, Gln, Ser, Arg, or Gl y
LXIPEPEGPDX

SEQ ID NO: 143562 - protein, 9 aa, Artificial Sequence
  Description of Artificial Sequence: Synthetic peptide
  Seed: LPKEACMEI (PMEL_HUMAN)
  misc_feature (2)..(2): Xaa can be Pro, Ala, Met, Val, Ser, Gly, Ile, Leu, Thr, Phe, Gln, Glu, Tyr, Trp, Asp, or Cys
  misc_feature (9)..(9): Xaa can be Tyr, Leu, Met, Ile, Trp, Phe, Val, Ala, Cys, Pro, Lys, Thr, Glu, Arg, Ser, His, or Gly
LXKEACMEX

SEQ ID NO: 143563 - protein, 10 aa, Artificial Sequence
  Description of Artificial Sequence: Synthetic peptide
  Seed: LPKEACMEIS (PMEL_HUMAN)
  misc_feature (2)..(2): Xaa can be , or Pro
  misc_feature (10)..(10): Xaa can be Ala, Pro, Tyr, Met, Cys, Ile, Leu, Val, Thr, Phe, or Ser
LXKEACMEIX

SEQ ID NO: 143564 - protein, 11 aa, Artificial Sequence
  Description of Artificial Sequence: Synthetic peptide
  Seed: LPKEACMEISS (PMEL_HUMAN)
  misc_feature (2)..(2): Xaa can be , or Pro
  misc_feature (11)..(11): Xaa can be Phe, Val, Gly, Met, Pro, Cys, Ser, Ile, Ala, Thr, or Leu
LXKEACMEISX

SEQ ID NO: 143565 - protein, 9 aa, Artificial Sequence
  Description of Artificial Sequence: Synthetic peptide
  Seed: LPRIFCSCP (PMEL_HUMAN)
  misc_feature (2)..(2): Xaa can be Pro, or Ala
  misc_feature (9)..(9): Xaa can be Ala, Tyr, Ile, Val, Pro, Leu, Thr, Phe, Cys, Ser, or Met
LXRIFCSCX

SEQ ID NO: 143566 - protein, 10 aa, Artificial Sequence
  Description of Artificial Sequence: Synthetic peptide
  Seed: LPRIFCSCPI (PMEL_HUMAN)
  misc_feature (2)..(2): Xaa can be Pro, Ser, Arg, Asp, Glu, Met, Thr, Lys, Asn, Leu, Trp, His, Gly, Ile, Phe, Val, Ala, Cys, Tyr, or Gln
  misc_feature (10)..(10): Xaa can be Val, Met, Phe, Leu, Ile, Cys, Ser, Gly, Ala, Trp, Tyr, Thr, or Pro
LXRIFCSCPX

SEQ ID NO: 143567 - protein, 8 aa, Artificial Sequence
  Description of Artificial Sequence: Synthetic peptide
  Seed: LPSPACQL (PMEL_HUMAN)
  misc_feature (2)..(2): Xaa can be Pro, or Ala
  misc_feature (8)..(8): Xaa can be Trp, Ile, Leu, Tyr, Val, Pro, Thr, Met, Phe, or Ala
LXSPACQX

SEQ ID NO: 143568 - protein, 9 aa, Artificial Sequence
  Description of Artificial Sequence: Synthetic peptide
  Seed: LPSPACQLV (PMEL_HUMAN)
  misc_feature (2)..(2): Xaa can be Pro, Gln, Ala, Ser, Leu, Ile, Val, Met, Gly, Thr, Glu, Cys, Phe, Asn, Tyr, or Asp
  misc_feature (9)..(9): Xaa can be Trp, Leu, Met, Tyr, Ile, Val, Phe, Ala, Cys, Arg, Pro, Lys, Gly, His, Ser, or Thr
LXSPACQLX

SEQ ID NO: 143569 - protein, 10 aa, Artificial Sequence
  Description of Artificial Sequence: Synthetic peptide
  Seed: LPSPACQLVL (PMEL_HUMAN)
  misc_feature (2)..(2): Xaa can be Pro, Ala, Ser, Met, Ile, Thr, Val, Leu, or Gly
  misc_feature (10)..(10): Xaa can be Leu, Trp, Tyr, Met, Phe, Ile, Val, Ala, Lys, Gly, Pro, Arg, His, Gln, Ser, Cys, or Thr
LXSPACQLVX

SEQ ID NO: 143570 - protein, 9 aa, Artificial Sequence
  Description of Artificial Sequence: Synthetic peptide
  Seed: LQAAIPLTS (PMEL_HUMAN)
  misc_feature (2)..(2): Xaa can be Gln, Met, Lys, His, Leu, Ala, Arg, Ser, Glu, Val, Ile, Asn, Thr, Phe, Trp, Gly, Tyr, Pro, or Cys
  misc_feature (9)..(9): Xaa can be Phe, Tyr, Met, Leu, Ile, His, Trp, Val, Ala, Gly, Thr, Ser, Asn, or Cys
LXAAIPLTX

SEQ ID NO: 143571 - protein, 10 aa, Artificial Sequence
  Description of Artificial Sequence: Synthetic peptide
  Seed: LQAAIPLTSC (PMEL_HUMAN)
  misc_feature (2)..(2): Xaa can be Gln, Glu, Val, Met, Leu, Ser, Ala, or Ile
  misc_feature (10)..(10): Xaa can be Ile, Val, Leu, Met, Ala, Phe, or Cys
LXAAIPLTSX

SEQ ID NO: 143572 - protein, 9 aa, Artificial Sequence
  Description of Artificial Sequence: Synthetic peptide
  Seed: LQLHDPSGY (PMEL_HUMAN)
  misc_feature (2)..(2): Xaa can be Ala, Val, Gln, Met, Leu, Ile, Ser, Glu, Lys, His, Arg, Gly, Asp, Thr, Pro, Tyr, Phe, Asn, Cys, or Trp
  misc_feature (9)..(9): Xaa can be Tyr, Phe, Met, Leu, Trp, Lys, Ile, His, Val, or Arg
LXLHDPSGX

SEQ ID NO: 143573 - protein, 10 aa, Artificial Sequence
  Description of Artificial Sequence: Synthetic peptide
  Seed: LQLHDPSGYL (PMEL_HUMAN)
  misc_feature (2)..(2): Xaa can be Gln, Leu, Met, Tyr, Asp, Cys, Phe, Trp, His, Val, Asn, Arg, Ala, Pro, Glu, Lys, Thr, Ser, Gly, or Ile
  misc_feature (10)..(10): Xaa can be Phe, Tyr, Ile, Met, Ala, Val, Leu, Trp, or His
LXLHDPSGYX

SEQ ID NO: 143574 - protein, 9 aa, Artificial Sequence
  Description of Artificial Sequence: Synthetic peptide
  Seed: LRALDGGNK (PMEL_HUMAN)
  misc_feature (2)..(2): Xaa can be Arg, or Ala
  misc_feature (9)..(9): Xaa can be Leu, Tyr, Met, Arg, Ile, Phe, or Lys
LXALDGGNX

SEQ ID NO: 143575 - protein, 11 aa, Artificial Sequence
  Description of Artificial Sequence: Synthetic peptide
  Seed: LRALDGGNKHF (PMEL_HUMAN)
  misc_feature (2)..(2): Xaa can be Arg, or Tyr
  misc_feature (11)..(11): Xaa can be Phe, Tyr, Lys, Trp, Met, Ile, Val, Leu, or Arg
LXALDGGNKHX

SEQ ID NO: 143576 - protein, 10 aa, Artificial Sequence
  Description of Artificial Sequence: Synthetic peptide
  Seed: LRLVKRQVPL (PMEL_HUMAN)
  misc_feature (2)..(2): Xaa can be Arg, Ile, Leu, Ala, Met, Pro, Gly, Ser, Lys, His, Asn, Cys, Gln, Val, Phe, Glu, Tyr, Thr, Trp, or Asp
  misc_feature (10)..(10): Xaa can be Ile, Ala, Val, Leu, Met, Phe, Tyr, Lys, or Arg
LXLVKRQVPX

SEQ ID NO: 143577 - protein, 8 aa, Artificial Sequence
  Description of Artificial Sequence: Synthetic peptide
  Seed: LRNQPLTF (PMEL_HUMAN)
  misc_feature (2)..(2): Xaa can be Arg, Tyr, Ala, Phe, Gln, Glu, Trp, His, Ser, Met, Gly, Asn, Lys, Thr, Val, Asp, Pro, Ile, or Leu
  misc_feature (8)..(8): Xaa can be Leu, Met, Tyr, Phe, Ile, Val, Trp, or Lys
LXNQPLTX

SEQ ID NO: 143578 - protein, 9 aa, Artificial Sequence
  Description of Artificial Sequence: Synthetic peptide
  Seed: LRNQPLTFA (PMEL_HUMAN)
  misc_feature (2)..(2): Xaa can be Arg, His, Tyr, Phe, Gln, Trp, Gly, Ser, Lys, Met, Ala, Thr, Val, Ile, or Leu
  misc_feature (9)..(9): Xaa can be Leu, Phe, Met, Tyr, Ile, Val, Ala, Pro, Cys, Arg, Thr, Trp, His, or Lys
LXNQPLTFX

SEQ ID NO: 143579 - protein, 10 aa, Artificial Sequence
  Description of Artificial Sequence: Synthetic peptide
  Seed: LRNQPLTFAL (PMEL_HUMAN)
  misc_feature (2)..(2): Xaa can be Arg, His, Tyr, Gln, Lys, or Phe
  misc_feature (10)..(10): Xaa can be Leu, Phe, Met, Tyr, Ile, Val, Cys, Trp, His, Arg, Lys, or Ala
LXNQPLTFAX

SEQ ID NO: 143580 - protein, 11 aa, Artificial Sequence
  Description of Artificial Sequence: Synthetic peptide
  Seed: LRNQPLTFALQ (PMEL_HUMAN)
  misc_feature (2)..(2): Xaa can be , or Arg
  misc_feature (11)..(11): Xaa can be Phe, Thr, Ser, Gly, Asn, Leu, Tyr, Met, Val, Pro, Trp, His, Cys, Gln, Asp, Ala, Arg, Ile, Lys, or Glu
LXNQPLTFALX

SEQ ID NO: 143581 - protein, 10 aa, Artificial Sequence
  Description of Artificial Sequence: Synthetic peptide
  Seed: LRTKAWNRQL (PMEL_HUMAN)
  misc_feature (2)..(2): Xaa can be , or Arg
  misc_feature (10)..(10): Xaa can be Lys, Phe, Tyr, Trp, Leu, Met, Arg, or Ile
LXTKAWNRQX

SEQ ID NO: 143582 - protein, 11 aa, Artificial Sequence
  Description of Artificial Sequence: Synthetic peptide
  Seed: LRTKAWNRQLY (PMEL_HUMAN)
  misc_feature (2)..(2): Xaa can be Arg, Gln, Ser, Thr, or Met
  misc_feature (11)..(11): Xaa can be Tyr, or Phe
LXTKAWNRQLX

SEQ ID NO: 143583 - protein, 9 aa, Artificial Sequence
  Description of Artificial Sequence: Synthetic peptide
  Seed: LSGTTAAQV (PMEL_HUMAN)
  misc_feature (2)..(2): Xaa can be Ala, Met, Ile, Leu, Val, Thr, Ser, Gln, Gly, Phe, Asn, Pro, Glu, Cys, Tyr, Trp, or Asp
  misc_feature (9)..(9): Xaa can be Trp, Leu, Val, Met, Tyr, Phe, Ile, Ala, Lys, or His
LXGTTAAQX

SEQ ID NO: 143584 - protein, 9 aa, Artificial Sequence
  Description of Artificial Sequence: Synthetic peptide
  Seed: LSIGTGRAM (PMEL_HUMAN)
  misc_feature (2)..(2): Xaa can be Ala, Gln, Pro, Tyr, Ser, Phe, Met, Val, Ile, Thr, Arg, Gly, Asn, Leu, His, Lys, Cys, Asp, Glu, or Trp
  misc_feature (9)..(9): Xaa can be Leu, Met, Trp, Ile, Val, Tyr, Phe, His, Lys, Ala, Arg, Cys, Thr, Ser, Gln, Gly, Asn, or Pr o
LXIGTGRAX

SEQ ID NO: 143585 - protein, 10 aa, Artificial Sequence
  Description of Artificial Sequence: Synthetic peptide
  Seed: LSIGTGRAML (PMEL_HUMAN)
  misc_feature (2)..(2): Xaa can be Ala, Ser, Thr, Val, Met, Gly, Ile, Cys, Gln, Leu, Phe, Asp, Asn, Glu, or Pro
  misc_feature (10)..(10): Xaa can be Trp, Tyr, Phe, Met, Leu, Ile, Lys, Val, or His
LXIGTGRAMX

SEQ ID NO: 143586 - protein, 9 aa, Artificial Sequence
  Description of Artificial Sequence: Synthetic peptide
  Seed: LTSCGSSPV (PMEL_HUMAN)
  misc_feature (2)..(2): Xaa can be Met, Leu, Ala, Val, Ile, Thr, Ser, Gln, Gly, Phe, Tyr, Pro, or Cys
  misc_feature (9)..(9): Xaa can be Phe, Tyr, Met, Leu, Val, Ile, Ala, Trp, Thr, Cys, Ser, or His
LXSCGSSPX

SEQ ID NO: 143587 - protein, 9 aa, Artificial Sequence
  Description of Artificial Sequence: Synthetic peptide
  Seed: LTVSCQGGL (PMEL_HUMAN)
  misc_feature (2)..(2): Xaa can be Thr, Ser, Ala, Val, Leu, Met, Ile, Gln, Gly, Cys, Phe, Asn, or Pro
  misc_feature (9)..(9): Xaa can be Trp, Leu, Ile, Val, Ala, Phe, Met, or Tyr
LXVSCQGGX

SEQ ID NO: 143588 - protein, 11 aa, Artificial Sequence
  Description of Artificial Sequence: Synthetic peptide
  Seed: LTVSCQGGLPK (PMEL_HUMAN)
  misc_feature (2)..(2): Xaa can be Ala, Val, Ser, Thr, Ile, Gly, Glu, Asn, Leu, Met, Gln, Asp, Phe, Pro, Arg, or Cys
  misc_feature (11)..(11): Xaa can be Lys, Arg, Tyr, Phe, Met, His, or Leu
LXVSCQGGLPX

SEQ ID NO: 143589 - protein, 8 aa, Artificial Sequence
  Description of Artificial Sequence: Synthetic peptide
  Seed: LVKRQVPL (PMEL_HUMAN)
  misc_feature (2)..(2): Xaa can be Leu, Met, Lys, Pro, Ile, Arg, Ala, Val, Gln, Tyr, His, Phe, Asn, Thr, Gly, Ser, or Trp
  misc_feature (8)..(8): Xaa can be Leu, Met, Ile, Phe, Val, or Ala
LXKRQVPX

SEQ ID NO: 143590 - protein, 8 aa, Artificial Sequence
  Description of Artificial Sequence: Synthetic peptide
  Seed: LVLKRCLL (PMEL_HUMAN)
  misc_feature (2)..(2): Xaa can be Pro, Met, Leu, Ala, Arg, Gln, Val, Ile, Lys, Phe, Asn, Trp, Gly, Tyr, His, or Ser
  misc_feature (8)..(8): Xaa can be Leu, Met, Ile, Phe, or Val
LXLKRCLX

SEQ ID NO: 143591 - protein, 9 aa, Artificial Sequence
  Description of Artificial Sequence: Synthetic peptide
  Seed: LVLKRCLLH (PMEL_HUMAN)
  misc_feature (2)..(2): Xaa can be Thr, Leu, Met, Ile, Val, Ser, Ala, Gly, Asn, Gln, Tyr, Phe, Asp, Glu, or Pro
  misc_feature (9)..(9): Xaa can be Lys, Arg, Tyr, or His
LXLKRCLLX

SEQ ID NO: 143592 - protein, 10 aa, Artificial Sequence
  Description of Artificial Sequence: Synthetic peptide
  Seed: LVLKRCLLHL (PMEL_HUMAN)
  misc_feature (2)..(2): Xaa can be Met, Pro, Leu, Gln, His, Arg, Ala, Gly, Asp, Lys, Tyr, Ile, Asn, Cys, Thr, Glu, Phe, Val, Trp, or Ser
  misc_feature (10)..(10): Xaa can be Val, Ile, Leu, Ala, Met, or Phe
LXLKRCLLHX

SEQ ID NO: 143593 - protein, 9 aa, Artificial Sequence
  Description of Artificial Sequence: Synthetic peptide
  Seed: LVLMAVVLA (PMEL_HUMAN)
  misc_feature (2)..(2): Xaa can be Met, Gln, Leu, Val, Ile, Thr, Ser, or Ala
  misc_feature (9)..(9): Xaa can be Val, Leu, Ile, Ala, Met, or Thr
LXLMAVVLX

SEQ ID NO: 143594 - protein, 10 aa, Artificial Sequence
  Description of Artificial Sequence: Synthetic peptide
  Seed: LVLMAVVLAS (PMEL_HUMAN)
  misc_feature (2)..(2): Xaa can be Met, Ile, Phe, Gln, Asn, Trp, Tyr, Lys, Ala, Cys, Arg, Leu, His, Glu, Ser, Pro, Val, Gly, Thr, or Asp
  misc_feature (10)..(10): Xaa can be Ser, Ala, Val, Thr, Met, Ile, Leu, or Cys
LXLMAVVLAX

SEQ ID NO: 143595 - protein, 11 aa, Artificial Sequence
  Description of Artificial Sequence: Synthetic peptide
  Seed: LVLMAVVLASL (PMEL_HUMAN)
  misc_feature (2)..(2): Xaa can be Phe, Tyr, Lys, Met, Ala, Arg, Ser, Leu, Asp, Ile, Gly, Pro, Trp, His, Val, Cys, Asn, Thr, Gln, or Glu
  misc_feature (11)..(11): Xaa can be Leu, Val, Ala, Ile, Met, or Thr
LXLMAVVLASX

SEQ ID NO: 143596 - protein, 8 aa, Artificial Sequence
  Description of Artificial Sequence: Synthetic peptide
  Seed: LVVTHTYL (PMEL_HUMAN)
  misc_feature (2)..(2): Xaa can be Ser, Ala, Thr, Gly, or Val
  misc_feature (8)..(8): Xaa can be Leu, Phe, Tyr, Met, Ile, or Val
LXVTHTYX

SEQ ID NO: 143597 - protein, 9 aa, Artificial Sequence
  Description of Artificial Sequence: Synthetic peptide
  Seed: LYPEWTEAQ (PMEL_HUMAN)
  misc_feature (2)..(2): Xaa can be Tyr, Phe, Trp, His, Ala, Gln, Val, Ile, Ser, Leu, Met, Gly, Thr, Arg, Asn, Pro, Cys, Lys, or Glu
  misc_feature (9)..(9): Xaa can be Phe, Leu, Met, Tyr, Ile, Val, Trp, Ala, His, Cys, Arg, Lys, Thr, Ser, or Gln
LXPEWTEAX

SEQ ID NO: 143598 - protein, 10 aa, Artificial Sequence
  Description of Artificial Sequence: Synthetic peptide
  Seed: LYPEWTEAQR (PMEL_HUMAN)
  misc_feature (2)..(2): Xaa can be Met, Leu, Ile, Val, Ser, Tyr, Thr, Gln, Phe, Ala, Asn, His, Gly, or Trp
  misc_feature (10)..(10): Xaa can be Arg, Lys, Tyr, or Leu
LXPEWTEAQX

SEQ ID NO: 143599 - protein, 11 aa, Artificial Sequence
  Description of Artificial Sequence: Synthetic peptide
  Seed: LYPEWTEAQRL (PMEL_HUMAN)
  misc_feature (2)..(2): Xaa can be Tyr, Phe, Trp, Arg, Met, His, or Leu
  misc_feature (11)..(11): Xaa can be Phe, Met, Leu, Trp, Ile, Tyr, or Val
LXPEWTEAQRX

SEQ ID NO: 143600 - protein, 9 aa, Artificial Sequence
  Description of Artificial Sequence: Synthetic peptide
  Seed: LYRYGSFSV (PMEL_HUMAN)
  misc_feature (2)..(2): Xaa can be Ser, Thr, Tyr, Met, Val, Phe, Ala, Trp, Gln, Ile, Leu, Gly, His, Arg, Asn, Cys, Pro, or Ly s
  misc_feature (9)..(9): Xaa can be Lys, Met, Tyr, Leu, Ala, Ile, Val, Phe, Gly, Ser, Arg, Pro, Thr, Trp, His, Asn, Cys, or Gl n
LXRYGSFSX

SEQ ID NO: 143601 - protein, 11 aa, Artificial Sequence
  Description of Artificial Sequence: Synthetic peptide
  Seed: LYRYGSFSVTL (PMEL_HUMAN)
  misc_feature (2)..(2): Xaa can be Tyr, Arg, Ile, Gln, Ser, Met, Phe, Asn, Glu, Cys, Gly, Ala, Asp, Lys, Thr, Trp, His, Pro, Val, or Leu
  misc_feature (11)..(11): Xaa can be Ile, Trp, Met, Leu, Phe, Val, or Tyr
LXRYGSFSVTX

SEQ ID NO: 143602 - protein, 8 aa, Artificial Sequence
  Description of Artificial Sequence: Synthetic peptide
  Seed: MAVVLASL (PMEL_HUMAN)
  misc_feature (2)..(2): Xaa can be Gln, Ala, Thr, Pro, Ser, Gly, Glu, Met, Leu, Asn, Asp, His, Lys, Val, or Ile
  misc_feature (8)..(8): Xaa can be Ile, Val, Leu, Met, Phe, Tyr, Ala, Cys, or His
MXVVLASX

SEQ ID NO: 143603 - protein, 9 aa, Artificial Sequence
  Description of Artificial Sequence: Synthetic peptide
  Seed: MAVVLASLI (PMEL_HUMAN)
  misc_feature (2)..(2): Xaa can be Pro, Ser, Ala, Thr, Gln, Met, Lys, Val, Gly, Leu, Ile, His, Asn, Glu, Cys, Arg, Asp, Phe, Tyr, or Trp
  misc_feature (9)..(9): Xaa can be Trp, Phe, Tyr, Met, Leu, Ile, Val, Ala, Thr, His, Cys, Lys, Gly, Asn, Ser, Arg, Pro, Gln, Glu, or Asp
MXVVLASLX

SEQ ID NO: 143604 - protein, 10 aa, Artificial Sequence
  Description of Artificial Sequence: Synthetic peptide
  Seed: MAVVLASLIY (PMEL_HUMAN)
  misc_feature (2)..(2): Xaa can be Pro, Gln, Ser, Met, Lys, His, Ala, Thr, Glu, Arg, Cys, Leu, Phe, Tyr, Asn, Ile, Trp, Gly, Val, or Asp
  misc_feature (10)..(10): Xaa can be Lys, Trp, Arg, Met, Phe, Tyr, Leu, Ile, His, Val, Gly, Ala, Thr, Ser, Gln, or Asn
MXVVLASLIX

SEQ ID NO: 143605 - protein, 11 aa, Artificial Sequence
  Description of Artificial Sequence: Synthetic peptide
  Seed: MAVVLASLIYR (PMEL_HUMAN)
  misc_feature (2)..(2): Xaa can be Thr, Tyr, Asp, Ile, Asn, Val, Met, Lys, Ala, Cys, Pro, His, Trp, Ser, Gln, Leu, Arg, Glu, Gly, or Phe
  misc_feature (11)..(11): Xaa can be Lys, Arg, or Tyr
MXVVLASLIYX

SEQ ID NO: 143606 - protein, 9 aa, Artificial Sequence
  Description of Artificial Sequence: Synthetic peptide
  Seed: MDLVLKRCL (PMEL_HUMAN)
  misc_feature (2)..(2): Xaa can be Glu, or Asp
  misc_feature (9)..(9): Xaa can be Met, Phe, Ile, Val, Leu, Cys, Thr, Pro, or Ala
MXLVLKRCX

SEQ ID NO: 143607 - protein, 10 aa, Artificial Sequence
  Description of Artificial Sequence: Synthetic peptide
  Seed: MDLVLKRCLL (PMEL_HUMAN)
  misc_feature (2)..(2): Xaa can be Glu, Pro, Met, Leu, Ser, Gly, Thr, Asn, Val, Trp, Ala, Tyr, Arg, Phe, Gln, Lys, His, Ile, Asp, or Cys
  misc_feature (10)..(10): Xaa can be Met, Leu, Ile, Phe, Val, Ala, or Thr
MXLVLKRCLX

SEQ ID NO: 143608 - protein, 8 aa, Artificial Sequence
  Description of Artificial Sequence: Synthetic peptide
  Seed: MEISSPGC (PMEL_HUMAN)
  misc_feature (2)..(2): Xaa can be Glu, or Asp
  misc_feature (8)..(8): Xaa can be Leu, Ile, Val, Cys, Met, Ala, Phe, Thr, or Pro
MXISSPGX

SEQ ID NO: 143609 - protein, 10 aa, Artificial Sequence
  Description of Artificial Sequence: Synthetic peptide
  Seed: MEISSPGCQP (PMEL_HUMAN)
  misc_feature (2)..(2): Xaa can be Glu, Asp, or Gln
  misc_feature (10)..(10): Xaa can be Val, Cys, Met, Ile, Leu, Ala, Phe, Lys, Glu, Thr, Asp, Ser, Trp, Arg, Gln, Gly, Pro, or Ty r
MXISSPGCQX

SEQ ID NO: 143610 - protein, 11 aa, Artificial Sequence
  Description of Artificial Sequence: Synthetic peptide
  Seed: MEISSPGCQPP (PMEL_HUMAN)
  misc_feature (2)..(2): Xaa can be Glu, Asp, or Gln
  misc_feature (11)..(11): Xaa can be Ala, Leu, Cys, Val, Met, Ile, Thr, Ser, Pro, Gly, Tyr, Phe, Trp, or Lys
MXISSPGCQPX

SEQ ID NO: 143611 - protein, 9 aa, Artificial Sequence
  Description of Artificial Sequence: Synthetic peptide
  Seed: MEVTVYHRR (PMEL_HUMAN)
  misc_feature (2)..(2): Xaa can be Thr, Val, Met, Ile, Leu, Gln, Ala, Ser, Cys, His, Tyr, Pro, Glu, Gly, Trp, Phe, Asn, Asp, Arg, or Lys
  misc_feature (9)..(9): Xaa can be Arg, Lys, Tyr, Leu, Val, Met, Phe, Ile, His, Gln, Ala, Glu, or Ser
MXVTVYHRX

SEQ ID NO: 143612 - protein, 8 aa, Artificial Sequence
  Description of Artificial Sequence: Synthetic peptide
  Seed: MGTTLAEM (PMEL_HUMAN)
  misc_feature (2)..(2): Xaa can be Ala, Ser, Thr, Gly, or Val
  misc_feature (8)..(8): Xaa can be Leu, Tyr, Met, Phe, Ile, or Val
MXTTLAEX

SEQ ID NO: 143613 - protein, 10 aa, Artificial Sequence
  Description of Artificial Sequence: Synthetic peptide
  Seed: MKQDFSVPQL (PMEL_HUMAN)
  misc_feature (2)..(2): Xaa can be Arg, Met, Gln, Leu, Lys, Ser, Thr, Tyr, His, Val, Ala, Ile, Asp, Gly, Cys, Asn, Glu, Trp, Pro, or Phe
  misc_feature (10)..(10): Xaa can be Leu, Ile, Val, Met, Phe, Tyr, Ala, Trp, His, Thr, Cys, Lys, or Arg
MXQDFSVPQX

SEQ ID NO: 143614 - protein, 9 aa, Artificial Sequence
  Description of Artificial Sequence: Synthetic peptide
  Seed: MLGTHTMEV (PMEL_HUMAN)
  misc_feature (2)..(2): Xaa can be Leu, Met, Ala, Gln, Thr, Ser, Ile, Val, Phe, Arg, Gly, Tyr, Asn, Glu, Trp, Asp, Cys, Pro, His, or Lys
  misc_feature (9)..(9): Xaa can be Met, Ile, Leu, Tyr, Val, Phe, Arg, Trp, Lys, Ala, Cys, His, Thr, or Ser
MXGTHTMEX

SEQ ID NO: 143615 - protein, 10 aa, Artificial Sequence
  Description of Artificial Sequence: Synthetic peptide
  Seed: MLGTHTMEVT (PMEL_HUMAN)
  misc_feature (2)..(2): Xaa can be Met, Leu, Ile, Gln, Val, or Thr
  misc_feature (10)..(10): Xaa can be Val, Ile, Leu, Ala, Gly, His, Ser, Glu, Cys, Thr, Pro, Asn, Gln, Lys, Met, Arg, Asp, Trp, Phe, or Tyr
MXGTHTMEVX

SEQ ID NO: 143616 - protein, 11 aa, Artificial Sequence
  Description of Artificial Sequence: Synthetic peptide
  Seed: MLGTHTMEVTV (PMEL_HUMAN)
  misc_feature (2)..(2): Xaa can be Met, Leu, or Ile
  misc_feature (11)..(11): Xaa can be Val, Ile, Ala, or Leu
MXGTHTMEVTX

SEQ ID NO: 143617 - protein, 8 aa, Artificial Sequence
  Description of Artificial Sequence: Synthetic peptide
  Seed: MPGQEAGL (PMEL_HUMAN)
  misc_feature (2)..(2): Xaa can be , or Pro
  misc_feature (8)..(8): Xaa can be Val, Ala, or Leu
MXGQEAGX

SEQ ID NO: 143618 - protein, 11 aa, Artificial Sequence
  Description of Artificial Sequence: Synthetic peptide
  Seed: MPGQEAGLGQV (PMEL_HUMAN)
  misc_feature (2)..(2): Xaa can be , or Pro
  misc_feature (11)..(11): Xaa can be Tyr, Ser, Ala, Val, Cys, Ile, Gly, Pro, Leu, Trp, Met, Phe, or Thr
MXGQEAGLGQX

SEQ ID NO: 143619 - protein, 9 aa, Artificial Sequence
  Description of Artificial Sequence: Synthetic peptide
  Seed: MPTAESTGM (PMEL_HUMAN)
  misc_feature (2)..(2): Xaa can be Pro, Ala, Val, Leu, Gln, Met, Ile, Ser, Thr, Gly, Glu, Trp, Tyr, Phe, Cys, Asn, Asp, Lys, or His
  misc_feature (9)..(9): Xaa can be Tyr, Phe, Met, Trp, Leu, Ile, Val, Ala, Thr, His, Ser, Pro, Cys, or Gly
MXTAESTGX

SEQ ID NO: 143620 - protein, 10 aa, Artificial Sequence
  Description of Artificial Sequence: Synthetic peptide
  Seed: MPTAESTGMT (PMEL_HUMAN)
  misc_feature (2)..(2): Xaa can be Pro, Asp, Asn, Val, Lys, Ser, Gly, Ala, Leu, Met, Cys, Arg, Thr, His, Trp, Phe, Tyr, Glu, Ile, or Gln
  misc_feature (10)..(10): Xaa can be Leu, Met, Val, Ile, Ala, Thr, Ser, Pro, Cys, or Phe
MXTAESTGMX

SEQ ID NO: 143621 - protein, 11 aa, Artificial Sequence
  Description of Artificial Sequence: Synthetic peptide
  Seed: MPTAESTGMTP (PMEL_HUMAN)
  misc_feature (2)..(2): Xaa can be Pro, Ala, or Val
  misc_feature (11)..(11): Xaa can be Leu, Met, Ala, Arg, Gly, Glu, Asn, Tyr, Phe, Trp, Ser, Cys, Thr, Gln, Val, His, Pro, Ile, or Lys
MXTAESTGMTX

SEQ ID NO: 143622 - protein, 10 aa, Artificial Sequence
  Description of Artificial Sequence: Synthetic peptide
  Seed: MSTESITGSL (PMEL_HUMAN)
  misc_feature (2)..(2): Xaa can be Thr, Ala, Ser, Val, Gly, Leu, Gln, Met, Ile, Asn, Glu, Asp, Phe, Arg, Tyr, His, Trp, Pro, Cys, or Lys
  misc_feature (10)..(10): Xaa can be Ile, Leu, Tyr, Trp, Val, Phe, Ala, Lys, Arg, Met, His, or Thr
MXTESITGSX

SEQ ID NO: 143623 - protein, 9 aa, Artificial Sequence
  Description of Artificial Sequence: Synthetic peptide
  Seed: MSTPEATGM (PMEL_HUMAN)
  misc_feature (2)..(2): Xaa can be Pro, Arg, Ala, Ser, Val, Met, Thr, Gln, Ile, Gly, Leu, Cys, Asn, Phe, Tyr, Glu, Asp, Trp, Lys, or His
  misc_feature (9)..(9): Xaa can be Phe, Leu, Tyr, Met, Trp, Lys, Arg, Ile, Val, His, Ala, Cys, Ser, Gln, or Thr
MXTPEATGX

SEQ ID NO: 143624 - protein, 8 aa, Artificial Sequence
  Description of Artificial Sequence: Synthetic peptide
  Seed: MTPAEVSI (PMEL_HUMAN)
  misc_feature (2)..(2): Xaa can be Ser, Ala, Gln, Gly, Met, Glu, Val, Thr, or Leu
  misc_feature (8)..(8): Xaa can be Ile, Leu, Val, or Met
MXPAEVSX

SEQ ID NO: 143625 - protein, 9 aa, Artificial Sequence
  Description of Artificial Sequence: Synthetic peptide
  Seed: MTPAEVSIV (PMEL_HUMAN)
  misc_feature (2)..(2): Xaa can be Ala, Ser, Val, Leu, Ile, Thr, Gln, Met, Pro, Gly, Arg, Glu, Asn, Asp, Phe, His, Tyr, Cys, Trp, or Lys
  misc_feature (9)..(9): Xaa can be Tyr, Met, Leu, Val, Ile, Phe, Lys, Arg, Ala, His, Cys, Trp, Thr, Pro, or Gln
MXPAEVSIX

SEQ ID NO: 143626 - protein, 10 aa, Artificial Sequence
  Description of Artificial Sequence: Synthetic peptide
  Seed: MTPAEVSIVV (PMEL_HUMAN)
  misc_feature (2)..(2): Xaa can be Leu, Gly, Gln, Val, Ser, Met, Thr, Asn, Ala, Ile, Asp, Tyr, Phe, Glu, Cys, Trp, Lys, Arg, His, or Pro
  misc_feature (10)..(10): Xaa can be Gly, Asp, Ser, Trp, Ala, Glu, Pro, Phe, Val, His, Cys, Ile, Thr, Leu, Gln, Asn, Tyr, Met, Lys, or Arg
MXPAEVSIVX

SEQ ID NO: 143627 - protein, 11 aa, Artificial Sequence
  Description of Artificial Sequence: Synthetic peptide
  Seed: MTPAEVSIVVL (PMEL_HUMAN)
  misc_feature (2)..(2): Xaa can be Ala, Thr, Ser, Val, Ile, Gly, Met, Leu, Cys, Asn, Gln, Glu, Asp, Pro, or Phe
  misc_feature (11)..(11): Xaa can be Trp, Lys, Leu, Phe, Arg, Met, Tyr, Ile, or Val
MXPAEVSIVVX

SEQ ID NO: 143628 - protein, 8 aa, Artificial Sequence
  Description of Artificial Sequence: Synthetic peptide
  Seed: MTPEKVPV (PMEL_HUMAN)
  misc_feature (2)..(2): Xaa can be Ala, Gly, Thr, Ser, Ile, Val, Phe, Met, Leu, Tyr, Cys, Gln, Asn, Trp, or Pro
  misc_feature (8)..(8): Xaa can be Leu, Met, Tyr, Ile, Phe, Lys, Val, Trp, or Arg
MXPEKVPX

SEQ ID NO: 143629 - protein, 9 aa, Artificial Sequence
  Description of Artificial Sequence: Synthetic peptide
  Seed: MTPEKVPVS (PMEL_HUMAN)
  misc_feature (2)..(2): Xaa can be Ala, Ser, Ile, Val, Met, Thr, Leu, Gly, Phe, Pro, Cys, Gln, Asn, Tyr, Trp, Lys, His, Glu, Arg, or Asp
  misc_feature (9)..(9): Xaa can be Val, Phe, Met, Leu, Ile, Cys, Tyr, Ala, Thr, Trp, Lys, Ser, Arg, Gln, Pro, His, Gly, Asn, or Glu
MXPEKVPVX

SEQ ID NO: 143630 - protein, 11 aa, Artificial Sequence
  Description of Artificial Sequence: Synthetic peptide
  Seed: MTPEKVPVSEV (PMEL_HUMAN)
  misc_feature (2)..(2): Xaa can be Ala, Val, Leu, Thr, Ser, Gly, Met, Ile, Gln, Cys, Phe, Asn, Tyr, Pro, Trp, Glu, or Asp
  misc_feature (11)..(11): Xaa can be Met, Leu, Phe, Lys, Val, Ile, Tyr, Arg, Trp, Ala, Cys, or Thr
MXPEKVPVSEX

SEQ ID NO: 143631 - protein, 8 aa, Artificial Sequence
  Description of Artificial Sequence: Synthetic peptide
  Seed: NASFSIAL (PMEL_HUMAN)
  misc_feature (2)..(2): Xaa can be Ala, Ser, Thr, Val, or Ile
  misc_feature (8)..(8): Xaa can be Met, Lys, Leu, Phe, or Tyr
NXSFSIAX

SEQ ID NO: 143632 - protein, 10 aa, Artificial Sequence
  Description of Artificial Sequence: Synthetic peptide
  Seed: NASFSIALNF (PMEL_HUMAN)
  misc_feature (2)..(2): Xaa can be Lys, Met, Arg, Pro, Thr, Tyr, Ser, Phe, Ile, Leu, Val, His, Gln, Asn, Cys, Gly, Trp, Ala, Glu, or Asp
  misc_feature (10)..(10): Xaa can be Tyr, Phe, Trp, Met, Leu, or Ile
NXSFSIALNX

SEQ ID NO: 143633 - protein, 9 aa, Artificial Sequence
  Description of Artificial Sequence: Synthetic peptide
  Seed: NDGPTLIGA (PMEL_HUMAN)
  misc_feature (2)..(2): Xaa can be Glu, Asp, or Gln
  misc_feature (9)..(9): Xaa can be Ala, Ile, Val, Met, Cys, Leu, Pro, Thr, Phe, Ser, Gly, or Tyr
NXGPTLIGX

SEQ ID NO: 143634 - protein, 9 aa, Artificial Sequence
  Description of Artificial Sequence: Synthetic peptide
  Seed: NFPGSQKVL (PMEL_HUMAN)
  misc_feature (2)..(2): Xaa can be Ala, Tyr, Ser, Phe, Arg, Thr, Val, Gly, Leu, Ile, Gln, Trp, Cys, Asn, Met, His, Lys, Glu, Asp, or Pro
  misc_feature (9)..(9): Xaa can be Met, Leu, Phe, Tyr, Ile, Val, Lys, Trp, Arg, Ala, His, or Cys
NXPGSQKVX

SEQ ID NO: 143635 - protein, 10 aa, Artificial Sequence
  Description of Artificial Sequence: Synthetic peptide
  Seed: NKHFLRNQPL (PMEL_HUMAN)
  misc_feature (2)..(2): Xaa can be Arg, Met, His, Leu, Pro, Ala, Tyr, Glu, Trp, Gly, Cys, Ile, Ser, Gln, Lys, Asn, Asp, Phe, Val, or Thr
  misc_feature (10)..(10): Xaa can be Val, Ile, Met, Leu, Phe, or Ala
NXHFLRNQPX

SEQ ID NO: 143636 - protein, 10 aa, Artificial Sequence
  Description of Artificial Sequence: Synthetic peptide
  Seed: NNTIINGSQV (PMEL_HUMAN)
  misc_feature (2)..(2): Xaa can be Thr, Val, Phe, Glu, Asn, Ser, Ile, Lys, Tyr, Arg, Gln, Cys, Trp, Met, His, Asp, Leu, Ala, Pro, or Gly
  misc_feature (10)..(10): Xaa can be Val, Ile, Leu, or Ala
NXTIINGSQX

SEQ ID NO: 143637 - protein, 11 aa, Artificial Sequence
  Description of Artificial Sequence: Synthetic peptide
  Seed: NNTIINGSQVW (PMEL_HUMAN)
  misc_feature (2)..(2): Xaa can be Ala, Thr, Ser, Cys, Ile, Asn, Leu, Asp, Phe, Val, Pro, Gly, Met, Gln, or Trp
  misc_feature (11)..(11): Xaa can be Trp, or Phe
NXTIINGSQVX

SEQ ID NO: 143638 - protein, 9 aa, Artificial Sequence
  Description of Artificial Sequence: Synthetic peptide
  Seed: NQDWLGVSR (PMEL_HUMAN)
  misc_feature (2)..(2): Xaa can be Thr, Val, Ala, Ser, Ile, Met, Tyr, Phe, Trp, Leu, Gln, Glu, Gly, Asn, Cys, Pro, Asp, His, or Arg
  misc_feature (9)..(9): Xaa can be Phe, Arg, Lys, Tyr, Leu, Met, Ile, Val, Trp, His, or Gln
NXDWLGVSX

SEQ ID NO: 143639 - protein, 11 aa, Artificial Sequence
  Description of Artificial Sequence: Synthetic peptide
  Seed: NQDWLGVSRQL (PMEL_HUMAN)
  misc_feature (2)..(2): Xaa can be His, Glu, Gln, Arg, Tyr, Met, Asp, Phe, Leu, or Ala
  misc_feature (11)..(11): Xaa can be Leu, Phe, Met, Trp, Ile, Val, Tyr, or Cys
NXDWLGVSRQX

SEQ ID NO: 143640 - protein, 8 aa, Artificial Sequence
  Description of Artificial Sequence: Synthetic peptide
  Seed: NQPLTFAL (PMEL_HUMAN)
  misc_feature (2)..(2): Xaa can be His, Arg, Gln, Gly, Val, Glu, Ala, Ser, Met, Asn, Pro, Thr, Lys, Ile, or Leu
  misc_feature (8)..(8): Xaa can be Ile, Leu, Val, Met, Ala, Cys, Phe, or Thr
NXPLTFAX

SEQ ID NO: 143641 - protein, 10 aa, Artificial Sequence
  Description of Artificial Sequence: Synthetic peptide
  Seed: NQPLTFALQL (PMEL_HUMAN)
  misc_feature (2)..(2): Xaa can be Tyr, Lys, Ile, Thr, Leu, Val, Ala, Gly, Trp, Asn, Ser, Met, Glu, Gln, His, Asp, Phe, Pro, Cys, or Arg
  misc_feature (10)..(10): Xaa can be Met, or Leu
NXPLTFALQX

SEQ ID NO: 143642 - protein, 11 aa, Artificial Sequence
  Description of Artificial Sequence: Synthetic peptide
  Seed: NRQLYPEWTEA (PMEL_HUMAN)
  misc_feature (2)..(2): Xaa can be , or Arg
  misc_feature (11)..(11): Xaa can be , or Ala
NXQLYPEWTEX

SEQ ID NO: 143643 - protein, 10 aa, Artificial Sequence
  Description of Artificial Sequence: Synthetic peptide
  Seed: NSLAVVSTQL (PMEL_HUMAN)
  misc_feature (2)..(2): Xaa can be Thr, Ser, Ala, Cys, Val, Ile, Gln, Met, Leu, Phe, Gly, His, Trp, Asn, Lys, Pro, Tyr, Arg, Glu, or Asp
  misc_feature (10)..(10): Xaa can be Met, Ile, Leu, Val, Ala, Trp, Phe, Tyr, or Thr
NXLAVVSTQX

SEQ ID NO: 143644 - protein, 9 aa, Artificial Sequence
  Description of Artificial Sequence: Synthetic peptide
  Seed: NTIINGSQV (PMEL_HUMAN)
  misc_feature (2)..(2): Xaa can be Ala, Thr, Ser, Ile, Val, Gly, Met, Leu, Gln, Phe, Glu, Tyr, Cys, or Asn
  misc_feature (9)..(9): Xaa can be Phe, Tyr, Leu, Lys, Met, Ile, Val, Arg, Trp, or Ala
NXIINGSQX

SEQ ID NO: 143645 - protein, 10 aa, Artificial Sequence
  Description of Artificial Sequence: Synthetic peptide
  Seed: NTIINGSQVW (PMEL_HUMAN)
  misc_feature (2)..(2): Xaa can be Pro, Thr, Ser, Val, Cys, Ala, Asn, Tyr, Phe, Leu, Gln, Trp, Asp, Met, Glu, Ile, or Gly
  misc_feature (10)..(10): Xaa can be Trp, Phe, Tyr, Leu, or Met
NXIINGSQVX

SEQ ID NO: 143646 - protein, 9 aa, Artificial Sequence
  Description of Artificial Sequence: Synthetic peptide
  Seed: PAEVSIVVL (PMEL_HUMAN)
  misc_feature (2)..(2): Xaa can be Ala, Ser, Phe, Tyr, Thr, Ile, Arg, or Val
  misc_feature (9)..(9): Xaa can be Leu, Met, Val, Phe, or Ile
PXEVSIVVX

SEQ ID NO: 143647 - protein, 9 aa, Artificial Sequence
  Description of Artificial Sequence: Synthetic peptide
  Seed: PEATGMTPA (PMEL_HUMAN)
  misc_feature (2)..(2): Xaa can be , or Glu
  misc_feature (9)..(9): Xaa can be Pro, Ala, Cys, Leu, Val, or Ile
PXATGMTPX

SEQ ID NO: 143648 - protein, 9 aa, Artificial Sequence
  Description of Artificial Sequence: Synthetic peptide
  Seed: PEGPDASSI (PMEL_HUMAN)
  misc_feature (2)..(2): Xaa can be , or Glu
  misc_feature (9)..(9): Xaa can be Ile, Leu, Val, or Ala
PXGPDASSX

SEQ ID NO: 143649 - protein, 9 aa, Artificial Sequence
  Description of Artificial Sequence: Synthetic peptide
  Seed: PEKVPVSEV (PMEL_HUMAN)
  misc_feature (2)..(2): Xaa can be Glu, or Asp
  misc_feature (9)..(9): Xaa can be Leu, Ile, Val, Thr, Phe, Met, Ala, Cys, or Pro
PXKVPVSEX

SEQ ID NO: 143650 - protein, 10 aa, Artificial Sequence
  Description of Artificial Sequence: Synthetic peptide
  Seed: PEKVPVSEVM (PMEL_HUMAN)
  misc_feature (2)..(2): Xaa can be , or Glu
  misc_feature (10)..(10): Xaa can be Met, or Leu
PXKVPVSEVX

SEQ ID NO: 143651 - protein, 11 aa, Artificial Sequence
  Description of Artificial Sequence: Synthetic peptide
  Seed: PEPEGPDASSI (PMEL_HUMAN)
  misc_feature (2)..(2): Xaa can be , or Glu
  misc_feature (11)..(11): Xaa can be Ile, Met, Val, Ala, or Leu
PXPEGPDASSX

SEQ ID NO: 143652 - protein, 9 aa, Artificial Sequence
  Description of Artificial Sequence: Synthetic peptide
  Seed: PEWTEAQRL (PMEL_HUMAN)
  misc_feature (2)..(2): Xaa can be , or Glu
  misc_feature (9)..(9): Xaa can be Phe, Leu, Ile, Met, Val, Pro, or Ala
PXWTEAQRX

SEQ ID NO: 143653 - protein, 9 aa, Artificial Sequence
  Description of Artificial Sequence: Synthetic peptide
  Seed: PFSVSVSQL (PMEL_HUMAN)
  misc_feature (2)..(2): Xaa can be Tyr, Phe, Trp, Ala, or Met
  misc_feature (9)..(9): Xaa can be Phe, Leu, Met, Trp, Tyr, Val, or Ile
PXSVSVSQX

SEQ ID NO: 143654 - protein, 10 aa, Artificial Sequence
  Description of Artificial Sequence: Synthetic peptide
  Seed: PFSVSVSQLR (PMEL_HUMAN)
  misc_feature (2)..(2): Xaa can be Asn, Thr, Tyr, Phe, Glu, Asp, His, Met, Ile, Ser, Leu, Cys, Ala, Lys, Trp, Gln, Val, or Ar g
  misc_feature (10)..(10): Xaa can be Arg, or Lys
PXSVSVSQLX

SEQ ID NO: 143655 - protein, 9 aa, Artificial Sequence
  Description of Artificial Sequence: Synthetic peptide
  Seed: PGCQPPAQR (PMEL_HUMAN)
  misc_feature (2)..(2): Xaa can be Val, Ile, Ala, Thr, Met, Gln, Leu, Trp, Gly, Asn, Tyr, Ser, or Phe
  misc_feature (9)..(9): Xaa can be Arg, or Lys
PXCQPPAQX

SEQ ID NO: 143656 - protein, 9 aa, Artificial Sequence
  Description of Artificial Sequence: Synthetic peptide
  Seed: PGPVTAQVV (PMEL_HUMAN)
  misc_feature (2)..(2): Xaa can be Ala, Ser, Gln, Pro, Val, Met, Glu, Thr, Leu, or Gly
  misc_feature (9)..(9): Xaa can be Val, Leu, Ile, Met, or Cys
PXPVTAQVX

SEQ ID NO: 143657 - protein, 9 aa, Artificial Sequence
  Description of Artificial Sequence: Synthetic peptide
  Seed: PIGENSPLL (PMEL_HUMAN)
  misc_feature (2)..(2): Xaa can be Ala, Val, Met, Phe, or Ile
  misc_feature (9)..(9): Xaa can be Leu, or Met
PXGENSPLX

SEQ ID NO: 143658 - protein, 9 aa, Artificial Sequence
  Description of Artificial Sequence: Synthetic peptide
  Seed: PLAHSSSAF (PMEL_HUMAN)
  misc_feature (2)..(2): Xaa can be Val, Met, Ala, Ile, Leu, Gln, Glu, Gly, Thr, Ser, Phe, Arg, Asn, Tyr, or Pro
  misc_feature (9)..(9): Xaa can be Tyr, Phe, or Met
PXAHSSSAX

SEQ ID NO: 143659 - protein, 9 aa, Artificial Sequence
  Description of Artificial Sequence: Synthetic peptide
  Seed: PLDCVLYRY (PMEL_HUMAN)
  misc_feature (2)..(2): Xaa can be Thr, Val, Gly, Ser, Ala, Leu, Glu, Ile, Cys, Phe, Trp, Gln, Asn, Tyr, Met, or Asp
  misc_feature (9)..(9): Xaa can be Tyr, or Phe
PXDCVLYRX

SEQ ID NO: 143660 - protein, 9 aa, Artificial Sequence
  Description of Artificial Sequence: Synthetic peptide
  Seed: PLIVGILLV (PMEL_HUMAN)
  misc_feature (2)..(2): Xaa can be Leu, or Met
  misc_feature (9)..(9): Xaa can be Val, Leu, or Ile
PXIVGILLX

SEQ ID NO: 143661 - protein, 9 aa, Artificial Sequence
  Description of Artificial Sequence: Synthetic peptide
  Seed: PLLDGTATL (PMEL_HUMAN)
  misc_feature (2)..(2): Xaa can be Met, Leu, Gln, Ala, Val, Ile, Thr, Phe, Ser, Tyr, Gly, Glu, Pro, Asp, Asn, Trp, Cys, Arg, Lys, or His
  misc_feature (9)..(9): Xaa can be Tyr, Phe, Leu, Met, Val, Ile, Trp, or Ala
PXLDGTATX

SEQ ID NO: 143662 - protein, 10 aa, Artificial Sequence
  Description of Artificial Sequence: Synthetic peptide
  Seed: PLLDGTATLR (PMEL_HUMAN)
  misc_feature (2)..(2): Xaa can be Met, Leu, Ile, Ser, Ala, Gly, Thr, Val, Phe, Gln, Tyr, or Trp
  misc_feature (10)..(10): Xaa can be Arg, or Lys
PXLDGTATLX

SEQ ID NO: 143663 - protein, 11 aa, Artificial Sequence
  Description of Artificial Sequence: Synthetic peptide
  Seed: PLLDGTATLRL (PMEL_HUMAN)
  misc_feature (2)..(2): Xaa can be Leu, or Met
  misc_feature (11)..(11): Xaa can be Leu, Val, or Met
PXLDGTATLRX

SEQ ID NO: 143664 - protein, 11 aa, Artificial Sequence
  Description of Artificial Sequence: Synthetic peptide
  Seed: PPAQRLCQPVL (PMEL_HUMAN)
  misc_feature (2)..(2): Xaa can be , or Pro
  misc_feature (11)..(11): Xaa can be , or Leu
PXAQRLCQPVX

SEQ ID NO: 143665 - protein, 10 aa, Artificial Sequence
  Description of Artificial Sequence: Synthetic peptide
  Seed: PQLPHSSSHW (PMEL_HUMAN)
  misc_feature (2)..(2): Xaa can be Ser, Ala, Thr, Phe, Met, Gly, Val, Gln, Asn, Ile, Cys, Leu, Asp, or Pro
  misc_feature (10)..(10): Xaa can be Trp, or Phe
PXLPHSSSHX

SEQ ID NO: 143666 - protein, 9 aa, Artificial Sequence
  Description of Artificial Sequence: Synthetic peptide
  Seed: PSPACQLVL (PMEL_HUMAN)
  misc_feature (2)..(2): Xaa can be Ala, Met, Ile, Val, Ser, Phe, Leu, Thr, Tyr, or Gly
  misc_feature (9)..(9): Xaa can be Leu, Met, Ile, Val, or Phe
PXPACQLVX

SEQ ID NO: 143667 - protein, 10 aa, Artificial Sequence
  Description of Artificial Sequence: Synthetic peptide
  Seed: PTLIGANASF (PMEL_HUMAN)
  misc_feature (2)..(2): Xaa can be Met, Gln, Val, Gly, Arg, Ala, Ser, Cys, Thr, Ile, Tyr, Leu, Lys, Trp, Phe, His, or Asn
  misc_feature (10)..(10): Xaa can be Tyr, Phe, Trp, or Met
PXLIGANASX

SEQ ID NO: 143668 - protein, 10 aa, Artificial Sequence
  Description of Artificial Sequence: Synthetic peptide
  Seed: PVPGTTDGHR (PMEL_HUMAN)
  misc_feature (2)..(2): Xaa can be Ala, Ile, Thr, or Val
  misc_feature (10)..(10): Xaa can be , or Arg
PXPGTTDGHX

SEQ ID NO: 143669 - protein, 11 aa, Artificial Sequence
  Description of Artificial Sequence: Synthetic peptide
  Seed: PVSGLSIGTGR (PMEL_HUMAN)
  misc_feature (2)..(2): Xaa can be Gly, Thr, Ala, Ile, Val, Ser, Phe, Leu, Met, or Tyr
  misc_feature (11)..(11): Xaa can be Arg, or Lys
PXSGLSIGTGX

SEQ ID NO: 143670 - protein, 9 aa, Artificial Sequence
  Description of Artificial Sequence: Synthetic peptide
  Seed: QAAIPLTSC (PMEL_HUMAN)
  misc_feature (2)..(2): Xaa can be Pro, Ala, Ser, Gly, Val, Thr, Leu, Ile, Gln, Asn, Met, Cys, Glu, Asp, Phe, Tyr, or Lys
  misc_feature (9)..(9): Xaa can be Tyr, Phe, Met, Leu, Val, Lys, Ile, His, Arg, Ala, Trp, Ser, Thr, Pro, Cys, Gln, Glu, Asn, or Gly
QXAIPLTSX

SEQ ID NO: 143671 - protein, 11 aa, Artificial Sequence
  Description of Artificial Sequence: Synthetic peptide
  Seed: QAVPSGEGDAF (PMEL_HUMAN)
  misc_feature (2)..(2): Xaa can be His, Pro, Ala, Gly, Arg, Met, Gln, Glu, Ile, Thr, Leu, Ser, Val, Tyr, Asp, Asn, Trp, Lys, Cys, or Phe
  misc_feature (11)..(11): Xaa can be Met, Leu, Lys, Tyr, Phe, Trp, Arg, Ile, Val, His, Cys, Ala, Gln, Gly, Ser, Thr, Pro, Asn, or Glu
QXVPSGEGDAX

SEQ ID NO: 143672 - protein, 8 aa, Artificial Sequence
  Description of Artificial Sequence: Synthetic peptide
  Seed: QDFSVPQL (PMEL_HUMAN)
  misc_feature (2)..(2): Xaa can be Glu, Asp, Gln, Ala, Ser, Met, Asn, Pro, Ile, Leu, Val, Gly, Phe, Cys, Thr, Lys, Tyr, Trp, Arg, or His
  misc_feature (8)..(8): Xaa can be Ile, Val, Leu, Met, Phe, Thr, Cys, Tyr, Ala, Pro, Trp, Ser, Lys, Gly, or His
QXFSVPQX

SEQ ID NO: 143673 - protein, 9 aa, Artificial Sequence
  Description of Artificial Sequence: Synthetic peptide
  Seed: QDFSVPQLP (PMEL_HUMAN)
  misc_feature (2)..(2): Xaa can be Glu, Asp, Gln, or Ala
  misc_feature (9)..(9): Xaa can be Leu, Thr, Met, Ala, Val, Ile, Pro, Phe, Cys, Gly, Ser, Lys, Trp, Asn, Glu, Arg, Gln, Asp, Tyr, or His
QXFSVPQLX

SEQ ID NO: 143674 - protein, 10 aa, Artificial Sequence
  Description of Artificial Sequence: Synthetic peptide
  Seed: QDWLGVSRQL (PMEL_HUMAN)
  misc_feature (2)..(2): Xaa can be Glu, Asp, or Gln
  misc_feature (10)..(10): Xaa can be Phe, Leu, Met, Ile, Pro, Cys, Ala, Thr, Val, Tyr, or Trp
QXWLGVSRQX

SEQ ID NO: 143675 - protein, 8 aa, Artificial Sequence
  Description of Artificial Sequence: Synthetic peptide
  Seed: QEAGLGQV (PMEL_HUMAN)
  misc_feature (2)..(2): Xaa can be Glu, or Asp
  misc_feature (8)..(8): Xaa can be Met, Phe, Leu, Ile, Ala, Pro, Cys, Val, or Thr
QXAGLGQX

SEQ ID NO: 143676 - protein, 9 aa, Artificial Sequence
  Description of Artificial Sequence: Synthetic peptide
  Seed: QEAGLGQVP (PMEL_HUMAN)
  misc_feature (2)..(2): Xaa can be Glu, Asp, Gln, Ala, or Ser
  misc_feature (9)..(9): Xaa can be Leu, Phe, Met, Thr, Pro, Tyr, Ile, Cys, Ala, Val, Trp, Lys, Ser, Glu, Gly, Arg, Asn, His, Gln, or Asp
QXAGLGQVX

SEQ ID NO: 143677 - protein, 10 aa, Artificial Sequence
  Description of Artificial Sequence: Synthetic peptide
  Seed: QEAGLGQVPL (PMEL_HUMAN)
  misc_feature (2)..(2): Xaa can be Glu, Gln, or Asp
  misc_feature (10)..(10): Xaa can be Leu, Ala, Trp, Phe, Val, Cys, Tyr, Ile, Glu, Pro, Gly, Ser, His, Thr, Asp, or Met
QXAGLGQVPX

SEQ ID NO: 143678 - protein, 11 aa, Artificial Sequence
  Description of Artificial Sequence: Synthetic peptide
  Seed: QEAGLGQVPLI (PMEL_HUMAN)
  misc_feature (2)..(2): Xaa can be Glu, Gln, Asp, or Lys
  misc_feature (11)..(11): Xaa can be Trp, Cys, Ala, Tyr, Phe, Pro, His, Gly, Thr, Ser, Leu, Val, Ile, or Met
QXAGLGQVPLX

SEQ ID NO: 143679 - protein, 9 aa, Artificial Sequence
  Description of Artificial Sequence: Synthetic peptide
  Seed: QETDDACIF (PMEL_HUMAN)
  misc_feature (2)..(2): Xaa can be Glu, Asp, Gln, Met, Ala, Pro, Leu, Ile, Val, Thr, Ser, Phe, or Gly
  misc_feature (9)..(9): Xaa can be Tyr, Phe, Met, Trp, Leu, Ala, Ile, Val, His, Thr, Pro, Ser, Gly, Lys, or Cys
QXTDDACIX

SEQ ID NO: 143680 - protein, 10 aa, Artificial Sequence
  Description of Artificial Sequence: Synthetic peptide
  Seed: QETDDACIFP (PMEL_HUMAN)
  misc_feature (2)..(2): Xaa can be , or Glu
  misc_feature (10)..(10): Xaa can be Cys, Met, Ser, Ala, Thr, Gly, Pro, Leu, Phe, Val, or Ile
QXTDDACIFX

SEQ ID NO: 143681 - protein, 8 aa, Artificial Sequence
  Description of Artificial Sequence: Synthetic peptide
  Seed: QGIESAEI (PMEL_HUMAN)
  misc_feature (2)..(2): Xaa can be Gln, Ala, Met, Ser, Glu, Leu, or Gly
  misc_feature (8)..(8): Xaa can be Val, Ile, Leu, Phe, or Met
QXIESAEX

SEQ ID NO: 143682 - protein, 9 aa, Artificial Sequence
  Description of Artificial Sequence: Synthetic peptide
  Seed: QGIESAEIL (PMEL_HUMAN)
  misc_feature (2)..(2): Xaa can be Thr, Ala, Ser, Val, Gln, Ile, Phe, Leu, Tyr, Met, Gly, Arg, Asn, Glu, His, Asp, Trp, Pro, or Cys
  misc_feature (9)..(9): Xaa can be Leu, Lys, Met, Arg, Phe, Tyr, Ile, Val, or Trp
QXIESAEIX

SEQ ID NO: 143683 - protein, 10 aa, Artificial Sequence
  Description of Artificial Sequence: Synthetic peptide
  Seed: QILKGGSGTY (PMEL_HUMAN)
  misc_feature (2)..(2): Xaa can be Thr, Ala, Met, Gln, Val, Ser, Ile, Leu, Gly, Phe, Asn, Arg, Cys, Glu, Lys, Pro, Asp, Tyr, His, or Trp
  misc_feature (10)..(10): Xaa can be Tyr, Phe, Arg, Lys, Met, Trp, Leu, or His
QXLKGGSGTX

SEQ ID NO: 143684 - protein, 9 aa, Artificial Sequence
  Description of Artificial Sequence: Synthetic peptide
  Seed: QKRSFVYVW (PMEL_HUMAN)
  misc_feature (2)..(2): Xaa can be Gln, Met, Lys, Ala, His, Glu, Arg, Leu, Ser, Gly, Thr, Asn, Ile, Val, Tyr, Phe, or Trp
  misc_feature (9)..(9): Xaa can be Phe, Tyr, Met, Leu, His, Ile, Trp, Val, Ala, Ser, Thr, or Gly
QXRSFVYVX

SEQ ID NO: 143685 - protein, 10 aa, Artificial Sequence
  Description of Artificial Sequence: Synthetic peptide
  Seed: QKRSFVYVWK (PMEL_HUMAN)
  misc_feature (2)..(2): Xaa can be Arg, Met, Tyr, Leu, Pro, Thr, Ser, Gly, Asn, Ile, Cys, Gln, Ala, Glu, Lys, Phe, Val, Trp, His, or Asp
  misc_feature (10)..(10): Xaa can be Lys, Arg, Phe, Tyr, Val, Ile, Met, or Leu
QXRSFVYVWX

SEQ ID NO: 143686 - protein, 11 aa, Artificial Sequence
  Description of Artificial Sequence: Synthetic peptide
  Seed: QKVLPDGQVIW (PMEL_HUMAN)
  misc_feature (2)..(2): Xaa can be Glu, Gln, Asp, Thr, Met, Ala, Ile, Lys, Arg, Ser, or Val
  misc_feature (11)..(11): Xaa can be Trp, Tyr, Phe, Met, Ile, His, Lys, Leu, or Val
QXVLPDGQVIX

SEQ ID NO: 143687 - protein, 8 aa, Artificial Sequence
  Description of Artificial Sequence: Synthetic peptide
  Seed: QLHDPSGY (PMEL_HUMAN)
  misc_feature (2)..(2): Xaa can be Gln, Met, Leu, Val, Ile, or Ala
  misc_feature (8)..(8): Xaa can be Tyr, or Phe
QXHDPSGX

SEQ ID NO: 143688 - protein, 9 aa, Artificial Sequence
  Description of Artificial Sequence: Synthetic peptide
  Seed: QLHDPSGYL (PMEL_HUMAN)
  misc_feature (2)..(2): Xaa can be Ala, Leu, Ile, Val, Gln, Ser, Gly, Thr, Met, Arg, Glu, Asn, Tyr, Pro, Cys, Phe, Trp, Lys, His, or Asp
  misc_feature (9)..(9): Xaa can be Tyr, Phe, Leu, Met, Val, Ile, His, Lys, Trp, Ala, Arg, Thr, Gln, or Cys
QXHDPSGYX

SEQ ID NO: 143689 - protein, 10 aa, Artificial Sequence
  Description of Artificial Sequence: Synthetic peptide
  Seed: QLHDPSGYLA (PMEL_HUMAN)
  misc_feature (2)..(2): Xaa can be Met, Leu, Val, Ile, Thr, or Gln
  misc_feature (10)..(10): Xaa can be Val, Leu, Ile, Met, or Ala
QXHDPSGYLX

SEQ ID NO: 143690 - protein, 11 aa, Artificial Sequence
  Description of Artificial Sequence: Synthetic peptide
  Seed: QLIMPGQEAGL (PMEL_HUMAN)
  misc_feature (2)..(2): Xaa can be Gln, Leu, Met, Ile, or Val
  misc_feature (11)..(11): Xaa can be Trp, Phe, Leu, Met, Val, Tyr, or Ile
QXIMPGQEAGX

SEQ ID NO: 143691 - protein, 9 aa, Artificial Sequence
  Description of Artificial Sequence: Synthetic peptide
  Seed: QLPHSSSHW (PMEL_HUMAN)
  misc_feature (2)..(2): Xaa can be Thr, Ala, Ser, Val, Met, Asn, Phe, Leu, Ile, Gly, Cys, Pro, Asp, or Gln
  misc_feature (9)..(9): Xaa can be Trp, Phe, or Leu
QXPHSSSHX

SEQ ID NO: 143692 - protein, 10 aa, Artificial Sequence
  Description of Artificial Sequence: Synthetic peptide
  Seed: QLPHSSSHWL (PMEL_HUMAN)
  misc_feature (2)..(2): Xaa can be Met, Phe, Arg, Leu, Trp, Pro, Asn, Lys, Gln, Val, Asp, His, Glu, Thr, Ala, Ser, Gly, Tyr, Ile, or Cys
  misc_feature (10)..(10): Xaa can be Leu, Met, Phe, or Val
QXPHSSSHWX

SEQ ID NO: 143693 - protein, 11 aa, Artificial Sequence
  Description of Artificial Sequence: Synthetic peptide
  Seed: QLPHSSSHWLR (PMEL_HUMAN)
  misc_feature (2)..(2): Xaa can be Thr, Ser, Ile, Tyr, Trp, Met, Gln, Val, Phe, Leu, Gly, Asn, Arg, or Ala
  misc_feature (11)..(11): Xaa can be Arg, or Lys
QXPHSSSHWLX

SEQ ID NO: 143694 - protein, 10 aa, Artificial Sequence
  Description of Artificial Sequence: Synthetic peptide
  Seed: QLRALDGGNK (PMEL_HUMAN)
  misc_feature (2)..(2): Xaa can be Val, Thr, Ser, Met, Ile, Leu, or Ala
  misc_feature (10)..(10): Xaa can be Arg, Lys, or Tyr
QXRALDGGNX

SEQ ID NO: 143695 - protein, 9 aa, Artificial Sequence
  Description of Artificial Sequence: Synthetic peptide
  Seed: QLRTKAWNR (PMEL_HUMAN)
  misc_feature (2)..(2): Xaa can be Thr, Leu, Val, Ile, Met, Trp, Tyr, Asp, Gln, Gly, Phe, Ala, Asn, Ser, His, Cys, Pro, or Gl u
  misc_feature (9)..(9): Xaa can be Arg, Lys, Tyr, or His
QXRTKAWNX

SEQ ID NO: 143696 - protein, 8 aa, Artificial Sequence
  Description of Artificial Sequence: Synthetic peptide
  Seed: QLVLHQIL (PMEL_HUMAN)
  misc_feature (2)..(2): Xaa can be Pro, Leu, Ala, or Met
  misc_feature (8)..(8): Xaa can be Leu, Ile, or Met
QXVLHQIX

SEQ ID NO: 143697 - protein, 9 aa, Artificial Sequence
  Description of Artificial Sequence: Synthetic peptide
  Seed: QLVLHQILK (PMEL_HUMAN)
  misc_feature (2)..(2): Xaa can be Thr, Met, Ser, Leu, Val, Ala, Ile, Glu, Gly, Cys, Phe, Asn, Asp, Gln, Pro, Trp, or Tyr
  misc_feature (9)..(9): Xaa can be Lys, Arg, Tyr, His, Leu, Phe, or Met
QXVLHQILX

SEQ ID NO: 143698 - protein, 9 aa, Artificial Sequence
  Description of Artificial Sequence: Synthetic peptide
  Seed: QLYPEWTEA (PMEL_HUMAN)
  misc_feature (2)..(2): Xaa can be Gln, Leu, Met, Ile, Val, Glu, Thr, Ala, Ser, Asn, Gly, or Asp
  misc_feature (9)..(9): Xaa can be Val, Ile, Leu, Ala, Met, Phe, Thr, Cys, Tyr, or Trp
QXYPEWTEX

SEQ ID NO: 143699 - protein, 11 aa, Artificial Sequence
  Description of Artificial Sequence: Synthetic peptide
  Seed: QLYPEWTEAQR (PMEL_HUMAN)
  misc_feature (2)..(2): Xaa can be Val, Thr, Leu, Met, Pro, Trp, Tyr, Ser, Asp, Phe, Ala, Glu, Gln, Cys, Gly, Ile, Asn, or Hi s
  misc_feature (11)..(11): Xaa can be Arg, Lys, Tyr, Gln, or His
QXYPEWTEAQX

SEQ ID NO: 143700 - protein, 10 aa, Artificial Sequence
  Description of Artificial Sequence: Synthetic peptide
  Seed: QMPTAESTGM (PMEL_HUMAN)
  misc_feature (2)..(2): Xaa can be Met, Ala, Leu, Val, Ile, Ser, Thr, Gln, Phe, Tyr, Lys, His, Gly, Asn, Pro, Trp, or Glu
  misc_feature (10)..(10): Xaa can be Tyr, Leu, Phe, or Met
QXPTAESTGX

SEQ ID NO: 143701 - protein, 9 aa, Artificial Sequence
  Description of Artificial Sequence: Synthetic peptide
  Seed: QPLTFALQL (PMEL_HUMAN)
  misc_feature (2)..(2): Xaa can be Pro, Ala, His, Arg, Gln, Ser, Val, Thr, Met, Gly, Ile, Cys, Glu, or Lys
  misc_feature (9)..(9): Xaa can be Leu, Trp, Tyr, Phe, Ile, Met, Val, Ala, Cys, Thr, Ser, His, Gly, or Pro
QXLTFALQX

SEQ ID NO: 143702 - protein, 8 aa, Artificial Sequence
  Description of Artificial Sequence: Synthetic peptide
  Seed: QPVLPSPA (PMEL_HUMAN)
  misc_feature (2)..(2): Xaa can be , or Pro
  misc_feature (8)..(8): Xaa can be Ser, Val, Phe, Ile, Leu, Thr, Ala, Met, Pro, or Cys
QXVLPSPX

SEQ ID NO: 143703 - protein, 9 aa, Artificial Sequence
  Description of Artificial Sequence: Synthetic peptide
  Seed: QPVLPSPAC (PMEL_HUMAN)
  misc_feature (2)..(2): Xaa can be Pro, Ala, His, Arg, Gln, Val, Ser, Gly, Thr, Lys, Ile, Met, Leu, Glu, Cys, Asn, or Asp
  misc_feature (9)..(9): Xaa can be Ala, Leu, Tyr, Val, Ile, Phe, Met, Cys, Pro, Thr, Ser, Gly, Trp, His, Arg, Gln, Glu, Lys, Asn, or Asp
QXVLPSPAX

SEQ ID NO: 143704 - protein, 11 aa, Artificial Sequence
  Description of Artificial Sequence: Synthetic peptide
  Seed: QPVLPSPACQL (PMEL_HUMAN)
  misc_feature (2)..(2): Xaa can be Pro, Ala, Cys, Val, Gly, Thr, or Ser
  misc_feature (11)..(11): Xaa can be Trp, Ala, Leu, Tyr, Phe, Ile, Thr, Gly, Cys, Met, Ser, Pro, or Val
QXVLPSPACQX

SEQ ID NO: 143705 - protein, 8 aa, Artificial Sequence
  Description of Artificial Sequence: Synthetic peptide
  Seed: QPVYPQET (PMEL_HUMAN)
  misc_feature (2)..(2): Xaa can be , or Pro
  misc_feature (8)..(8): Xaa can be Val, Leu, Met, Ile, Thr, Pro, or Ala
QXVYPQEX

SEQ ID NO: 143706 - protein, 8 aa, Artificial Sequence
  Description of Artificial Sequence: Synthetic peptide
  Seed: QRLCQPVL (PMEL_HUMAN)
  misc_feature (2)..(2): Xaa can be His, Arg, or Gln
  misc_feature (8)..(8): Xaa can be Leu, Ile, Met, or Val
QXLCQPVX

SEQ ID NO: 143707 - protein, 9 aa, Artificial Sequence
  Description of Artificial Sequence: Synthetic peptide
  Seed: QRLCQPVLP (PMEL_HUMAN)
  misc_feature (2)..(2): Xaa can be His, Arg, Gln, Pro, or Lys
  misc_feature (9)..(9): Xaa can be Ala, Ile, Leu, Val, Thr, Met, Pro, Gly, Ser, Cys, or Phe
QXLCQPVLX

SEQ ID NO: 143708 - protein, 11 aa, Artificial Sequence
  Description of Artificial Sequence: Synthetic peptide
  Seed: QRLDCWRGGQV (PMEL_HUMAN)
  misc_feature (2)..(2): Xaa can be , or Arg
  misc_feature (11)..(11): Xaa can be Val, Tyr, Met, Phe, Ile, or Leu
QXLDCWRGGQX

SEQ ID NO: 143709 - protein, 9 aa, Artificial Sequence
  Description of Artificial Sequence: Synthetic peptide
  Seed: QVIWVNNTI (PMEL_HUMAN)
  misc_feature (2)..(2): Xaa can be Thr, Ala, Val, Gln, Ile, Ser, Met, Leu, Pro, Glu, Asn, Gly, Asp, Cys, Phe, His, Lys, Tyr, or Arg
  misc_feature (9)..(9): Xaa can be Val, Arg, Trp, Ile, Lys, Leu, Phe, Met, Ala, Tyr, Thr, His, Cys, Ser, or Gln
QXIWVNNTX

SEQ ID NO: 143710 - protein, 10 aa, Artificial Sequence
  Description of Artificial Sequence: Synthetic peptide
  Seed: QVIWVNNTII (PMEL_HUMAN)
  misc_feature (2)..(2): Xaa can be Thr, Val, Ser, Ile, Ala, Leu, or Met
  misc_feature (10)..(10): Xaa can be Val, Ile, Ala, Leu, Met, Thr, or Ser
QXIWVNNTIX

SEQ ID NO: 143711 - protein, 10 aa, Artificial Sequence
  Description of Artificial Sequence: Synthetic peptide
  Seed: QVLGGPVSGL (PMEL_HUMAN)
  misc_feature (2)..(2): Xaa can be Thr, Ala, Ile, Val, Ser, Leu, Met, Gln, Phe, Gly, Glu, Trp, Tyr, Asn, Pro, Cys, Asp, His, Lys, or Arg
  misc_feature (10)..(10): Xaa can be Val, Lys, Arg, Tyr, Leu, Ile, Trp, Met, Phe, Ala, His, Gln, or Thr
QXLGGPVSGX

SEQ ID NO: 143712 - protein, 9 aa, Artificial Sequence
  Description of Artificial Sequence: Synthetic peptide
  Seed: QVPLDCVLY (PMEL_HUMAN)
  misc_feature (2)..(2): Xaa can be Ala, Met, Ser, Thr, Ile, Leu, Val, Gln, Pro, Asn, Phe, Tyr, Glu, Trp, or Gly
  misc_feature (9)..(9): Xaa can be Tyr, Phe, Lys, Met, Arg, or Leu
QXPLDCVLX

SEQ ID NO: 143713 - protein, 10 aa, Artificial Sequence
  Description of Artificial Sequence: Synthetic peptide
  Seed: QVPLDCVLYR (PMEL_HUMAN)
  misc_feature (2)..(2): Xaa can be Met, Val, Thr, Ser, Ile, Leu, Gln, Ala, Gly, Tyr, Trp, Phe, Arg, His, Asn, or Cys
  misc_feature (10)..(10): Xaa can be Arg, Lys, Tyr, or His
QXPLDCVLYX

SEQ ID NO: 143714 - protein, 8 aa, Artificial Sequence
  Description of Artificial Sequence: Synthetic peptide
  Seed: QVPLIVGI (PMEL_HUMAN)
  misc_feature (2)..(2): Xaa can be Gln, Ala, Gly, Met, Ser, Asn, Glu, Leu, Val, Ile, or Thr
  misc_feature (8)..(8): Xaa can be Ile, Val, Leu, or Met
QXPLIVGX

SEQ ID NO: 143715 - protein, 9 aa, Artificial Sequence
  Description of Artificial Sequence: Synthetic peptide
  Seed: QVPLIVGIL (PMEL_HUMAN)
  misc_feature (2)..(2): Xaa can be Thr, Ala, Ser, Ile, Val, Gly, Gln, Met, Leu, Arg, Asn, Glu, Tyr, Phe, Cys, His, or Asp
  misc_feature (9)..(9): Xaa can be Leu, Met, Val, Ile, Tyr, Lys, Arg, Phe, Ala, or His
QXPLIVGIX

SEQ ID NO: 143716 - protein, 10 aa, Artificial Sequence
  Description of Artificial Sequence: Synthetic peptide
  Seed: QVPLIVGILL (PMEL_HUMAN)
  misc_feature (2)..(2): Xaa can be Lys, Leu, Phe, Val, Thr, Gly, Ala, Ser, Trp, Gln, Arg, Asp, Asn, Cys, Met, Tyr, Glu, Ile, Pro, or His
  misc_feature (10)..(10): Xaa can be Leu, or Met
QXPLIVGILX

SEQ ID NO: 143717 - protein, 8 aa, Artificial Sequence
  Description of Artificial Sequence: Synthetic peptide
  Seed: QVPTTEVI (PMEL_HUMAN)
  misc_feature (2)..(2): Xaa can be Ser, Gln, Ala, Leu, Gly, Met, or Val
  misc_feature (8)..(8): Xaa can be Ile, Leu, or Val
QXPTTEVX

SEQ ID NO: 143718 - protein, 9 aa, Artificial Sequence
  Description of Artificial Sequence: Synthetic peptide
  Seed: QVWGGQPVY (PMEL_HUMAN)
  misc_feature (2)..(2): Xaa can be Pro, Ala, Gln, Met, Leu, Ser, Thr, Val, His, Gly, Ile, Lys, Glu, Asn, Phe, Cys, Arg, Tyr, Asp, or Trp
  misc_feature (9)..(9): Xaa can be Tyr, Phe, Trp, Lys, Arg, Met, Leu, His, Ile, Val, Ala, Cys, Gln, or Gly
QXWGGQPVX

SEQ ID NO: 143719 - protein, 9 aa, Artificial Sequence
  Description of Artificial Sequence: Synthetic peptide
  Seed: RALDGGNKH (PMEL_HUMAN)
  misc_feature (2)..(2): Xaa can be Ala, Gln, Met, Val, Ser, Thr, Ile, Tyr, Leu, Gly, Cys, Asn, Phe, Trp, Glu, Pro, Lys, Asp, Arg, or His
  misc_feature (9)..(9): Xaa can be Phe, Tyr, Met, Leu, Trp, Ile, Val, Lys, Arg, His, Ala, Cys, Thr, Pro, Ser, or Gln
RXLDGGNKX

SEQ ID NO: 143720 - protein, 10 aa, Artificial Sequence
  Description of Artificial Sequence: Synthetic peptide
  Seed: RALDGGNKHF (PMEL_HUMAN)
  misc_feature (2)..(2): Xaa can be Arg, Gln, Ala, Met, Leu, Ile, Val, Glu, Tyr, Thr, Ser, Gly, Lys, Phe, Asn, Cys, His, Asp, Trp, or Pro
  misc_feature (10)..(10): Xaa can be Phe, Met, Tyr, Leu, Trp, Ile, Val, Lys, Arg, His, Cys, Ala, Thr, Gln, Gly, Pro, Ser, Glu, or Asn
RXLDGGNKHX

SEQ ID NO: 143721 - protein, 11 aa, Artificial Sequence
  Description of Artificial Sequence: Synthetic peptide
  Seed: RALDGGNKHFL (PMEL_HUMAN)
  misc_feature (2)..(2): Xaa can be Arg, Gln, Leu, Met, Thr, Ile, Val, Glu, Ala, Ser, Tyr, Gly, Asn, Asp, Trp, Cys, Phe, Lys, His, or Pro
  misc_feature (11)..(11): Xaa can be Leu, Tyr, Trp, Phe, Met, Arg, Lys, Ile, Val, His, Cys, Ala, Gln, Thr, Ser, Pro, Gly, Glu, or Asn
RXLDGGNKHFX

SEQ ID NO: 143722 - protein, 9 aa, Artificial Sequence
  Description of Artificial Sequence: Synthetic peptide
  Seed: RALVVTHTY (PMEL_HUMAN)
  misc_feature (2)..(2): Xaa can be Arg, Gln, Thr, Ser, Ala, Met, Ile, Tyr, Glu, Leu, Val, Trp, Pro, Gly, Lys, Asn, His, Phe, Cys, or Asp
  misc_feature (9)..(9): Xaa can be Arg, Lys, Ile, Phe, Val, Leu, Met, Tyr, Trp, His, Ala, Cys, Gly, Thr, Ser, Asn, Gln, Glu, or Pro
RXLVVTHTX

SEQ ID NO: 143723 - protein, 10 aa, Artificial Sequence
  Description of Artificial Sequence: Synthetic peptide
  Seed: RALVVTHTYL (PMEL_HUMAN)
  misc_feature (2)..(2): Xaa can be Met, Phe, Thr, Leu, Val, Trp, Ala, Tyr, Ile, Ser, Gln, Arg, Glu, Asp, Gly, Cys, Lys, His, Pro, or Asn
  misc_feature (10)..(10): Xaa can be Leu, Met, Ile, Phe, Trp, Val, Tyr, Ala, His, Cys, Arg, Gly, Pro, Glu, Asn, Asp, Gln, Ser, Thr, or Lys
RXLVVTHTYX

SEQ ID NO: 143724 - protein, 9 aa, Artificial Sequence
  Description of Artificial Sequence: Synthetic peptide
  Seed: RAMLGTHTM (PMEL_HUMAN)
  misc_feature (2)..(2): Xaa can be Pro, Tyr, Arg, Thr, Gln, Met, Ser, His, Ala, Leu, Val, Ile, Phe, Lys, Trp, Glu, Asn, Gly, Asp, or Cys
  misc_feature (9)..(9): Xaa can be Trp, Lys, Val, Met, Phe, Tyr, Arg, Ile, Leu, Ala, His, Cys, Thr, Ser, Gly, Gln, Pro, Asn, Glu, or Asp
RXMLGTHTX

SEQ ID NO: 143725 - protein, 11 aa, Artificial Sequence
  Description of Artificial Sequence: Synthetic peptide
  Seed: RAMLGTHTMEV (PMEL_HUMAN)
  misc_feature (2)..(2): Xaa can be Gln, Met, Thr, Ala, Leu, Ser, Phe, Tyr, Glu, Val, Gly, Arg, Ile, Lys, Trp, Cys, His, Pro, Asp, or Asn
  misc_feature (11)..(11): Xaa can be Val, Leu, Ile, Met, Phe, Ala, Tyr, Cys, Thr, or Trp
RXMLGTHTMEX

SEQ ID NO: 143726 - protein, 8 aa, Artificial Sequence
  Description of Artificial Sequence: Synthetic peptide
  Seed: RELPIPEP (PMEL_HUMAN)
  misc_feature (2)..(2): Xaa can be Glu, Asp, or Gln
  misc_feature (8)..(8): Xaa can be Val, Ala, Met, Ile, Leu, Phe, Ser, Pro, Gly, Tyr, Thr, Cys, Asp, Trp, Lys, Glu, Arg, or Gl n
RXLPIPEX

SEQ ID NO: 143727 - protein, 9 aa, Artificial Sequence
  Description of Artificial Sequence: Synthetic peptide
  Seed: RELPIPEPE (PMEL_HUMAN)
  misc_feature (2)..(2): Xaa can be Glu, Asp, or Gln
  misc_feature (9)..(9): Xaa can be Ile, Thr, Cys, Ala, Leu, Phe, Val, Met, Pro, Ser, Gly, Tyr, Glu, His, Trp, Gln, Lys, Asp, Asn, or Arg
RXLPIPEPX

SEQ ID NO: 143728 - protein, 10 aa, Artificial Sequence
  Description of Artificial Sequence: Synthetic peptide
  Seed: RELPIPEPEG (PMEL_HUMAN)
  misc_feature (2)..(2): Xaa can be Glu, Asp, or Gln
  misc_feature (10)..(10): Xaa can be Met, Leu, Cys, Val, Phe, Ala, Ile, Thr, Pro, Arg, Gly, Asp, Trp, Tyr, Gln, His, Lys, Ser, Glu, or Asn
RXLPIPEPEX

SEQ ID NO: 143729 - protein, 11 aa, Artificial Sequence
  Description of Artificial Sequence: Synthetic peptide
  Seed: RELPIPEPEGP (PMEL_HUMAN)
  misc_feature (2)..(2): Xaa can be Glu, Asp, or Gln
  misc_feature (11)..(11): Xaa can be Ile, Ala, Leu, Met, Cys, Val, Phe, Gln, Pro, Ser, Glu, Gly, Arg, Asp, Thr, Tyr, Lys, or Tr p
RXLPIPEPEGX

SEQ ID NO: 143730 - protein, 9 aa, Artificial Sequence
  Description of Artificial Sequence: Synthetic peptide
  Seed: RGGQVSLKV (PMEL_HUMAN)
  misc_feature (2)..(2): Xaa can be Gln, Ala, Met, Ser, Leu, Val, Ile, Thr, Glu, Asn, Gly, Cys, or Asp
  misc_feature (9)..(9): Xaa can be Leu, Ile, Val, Met, Phe, Cys, Ala, Tyr, Trp, or Thr
RXGQVSLKX

SEQ ID NO: 143731 - protein, 9 aa, Artificial Sequence
  Description of Artificial Sequence: Synthetic peptide
  Seed: RGSRSYVPL (PMEL_HUMAN)
  misc_feature (2)..(2): Xaa can be Met, Val, Ser, Thr, Ile, Arg, Ala, Gln, Phe, Tyr, Leu, Gly, Trp, Asn, His, Cys, Lys, or Gl u
  misc_feature (9)..(9): Xaa can be Lys, Leu, Ala, Ile, Arg, Met, Val, Ser, Gly, Tyr, Thr, Phe, His, Cys, Gln, Asn, Pro, Glu, or Trp
RXSRSYVPX

SEQ ID NO: 143732 - protein, 10 aa, Artificial Sequence
  Description of Artificial Sequence: Synthetic peptide
  Seed: RGSRSYVPLA (PMEL_HUMAN)
  misc_feature (2)..(2): Xaa can be Met, Val, Tyr, Thr, Trp, Phe, Glu, Ala, His, Asp, Asn, Ile, Arg, Gln, Cys, Ser, Gly, Lys, Pro, or Leu
  misc_feature (10)..(10): Xaa can be Ala, Tyr, Leu, Cys, Lys, Phe, Val, His, Gln, Pro, Met, Ser, Ile, Gly, Asn, Thr, Glu, Arg, Asp, or Trp
RXSRSYVPLX

SEQ ID NO: 143733 - protein, 9 aa, Artificial Sequence
  Description of Artificial Sequence: Synthetic peptide
  Seed: RIFCSCPIG (PMEL_HUMAN)
  misc_feature (2)..(2): Xaa can be Thr, Ser, Val, Met, Tyr, Ala, Ile, Phe, Leu, Gln, Trp, Gly, Asn, Lys, Cys, Arg, or His
  misc_feature (9)..(9): Xaa can be Lys, Ala, Val, Met, Ile, Arg, Tyr, Leu, Gly, Ser, Thr, His, Phe, Gln, Pro, Cys, Asn, or Gl u
RXFCSCPIX

SEQ ID NO: 143734 - protein, 10 aa, Artificial Sequence
  Description of Artificial Sequence: Synthetic peptide
  Seed: RLDCWRGGQV (PMEL_HUMAN)
  misc_feature (2)..(2): Xaa can be Met, or Leu
  misc_feature (10)..(10): Xaa can be Leu, Val, or Ile
RXDCWRGGQX

SEQ ID NO: 143735 - protein, 9 aa, Artificial Sequence
  Description of Artificial Sequence: Synthetic peptide
  Seed: RLMKQDFSV (PMEL_HUMAN)
  misc_feature (2)..(2): Xaa can be Arg, Gln, Met, Leu, Ile, Val, Thr, Ala, Phe, Glu, Ser, Tyr, Asn, Gly, Trp, Asp, Lys, Cys, His, or Pro
  misc_feature (9)..(9): Xaa can be Phe, Tyr, Leu, Ile, Met, Val, Arg, Trp, Lys, His, Ala, Cys, Thr, Ser, Gly, Pro, Glu, Asn, or Gln
RXMKQDFSX

SEQ ID NO: 143736 - protein, 10 aa, Artificial Sequence
  Description of Artificial Sequence: Synthetic peptide
  Seed: RLMKQDFSVP (PMEL_HUMAN)
  misc_feature (2)..(2): Xaa can be Leu, Met, Ile, Phe, Thr, Tyr, Val, or Gln
  misc_feature (10)..(10): Xaa can be Val, Leu, Ile, Thr, His, Gly, Glu, Met, Cys, Tyr, Arg, Pro, Gln, Lys, Asp, Phe, Ala, Ser, Asn, or Trp
RXMKQDFSVX

SEQ ID NO: 143737 - protein, 9 aa, Artificial Sequence
  Description of Artificial Sequence: Synthetic peptide
  Seed: RLPRIFCSC (PMEL_HUMAN)
  misc_feature (2)..(2): Xaa can be Leu, Gln, Met, Val, Ile, Glu, Ala, Thr, Ser, Gly, Asn, or Asp
  misc_feature (9)..(9): Xaa can be Val, Ile, Leu, Met, Ala, Thr, Cys, or Phe
RXPRIFCSX

SEQ ID NO: 143738 - protein, 11 aa, Artificial Sequence
  Description of Artificial Sequence: Synthetic peptide
  Seed: RLPRIFCSCPI (PMEL_HUMAN)
  misc_feature (2)..(2): Xaa can be Glu, Met, Gln, Leu, Arg, Tyr, Gly, Ile, Phe, Cys, His, Thr, Ser, Trp, Lys, Asp, Val, Ala, Pro, or Asn
  misc_feature (11)..(11): Xaa can be Val, Met, Ile, Lys, Arg, Phe, Tyr, Leu, or Ala
RXPRIFCSCPX

SEQ ID NO: 143739 - protein, 9 aa, Artificial Sequence
  Description of Artificial Sequence: Synthetic peptide
  Seed: RLVKRQVPL (PMEL_HUMAN)
  misc_feature (2)..(2): Xaa can be Arg, Pro, Gln, Met, Leu, Thr, Ala, Ser, Glu, Val, Lys, Ile, Tyr, Asn, Phe, Gly, His, Asp, Trp, or Cys
  misc_feature (9)..(9): Xaa can be Tyr, Met, Leu, Phe, Lys, Ile, Arg, Val, Trp, His, Ala, Thr, Cys, Gly, Ser, Glu, Pro, Asn, or Gln
RXVKRQVPX

SEQ ID NO: 143740 - protein, 10 aa, Artificial Sequence
  Description of Artificial Sequence: Synthetic peptide
  Seed: RNQDWLGVSR (PMEL_HUMAN)
  misc_feature (2)..(2): Xaa can be Met, Leu, Ala, Val, Ile, Thr, Ser, Phe, Trp, Cys, Tyr, Gln, Gly, His, Asn, Asp, Glu, Pro, Lys, or Arg
  misc_feature (10)..(10): Xaa can be Arg, Lys, Leu, Tyr, His, Phe, Met, Val, Ile, Trp, Gln, or Ala
RXQDWLGVSX

SEQ ID NO: 143741 - protein, 9 aa, Artificial Sequence
  Description of Artificial Sequence: Synthetic peptide
  Seed: RNQPLTFAL (PMEL_HUMAN)
  misc_feature (2)..(2): Xaa can be Arg, Gln, Met, His, Ala, Tyr, Leu, Ser, Thr, Ile, Glu, Lys, Trp, Phe, Val, Asn, Gly, Cys, Pro, or Asp
  misc_feature (9)..(9): Xaa can be Met, Leu, Trp, Val, Ile, Tyr, Phe, Lys, His, Arg, Ala, Cys, Thr, Gly, Pro, Asn, Ser, Gln, or Glu
RXQPLTFAX

SEQ ID NO: 143742 - protein, 11 aa, Artificial Sequence
  Description of Artificial Sequence: Synthetic peptide
  Seed: RNQPLTFALQL (PMEL_HUMAN)
  misc_feature (2)..(2): Xaa can be Pro, Val, Ala, Glu, Trp, Ile, Thr, Gly, His, Phe, Cys, Met, Lys, Leu, Arg, Asp, Ser, Gln, Asn, or Tyr
  misc_feature (11)..(11): Xaa can be Leu, Met, Phe, Arg, Thr, His, Asp, Trp, Ile, Tyr, Lys, Val, Pro, Ala, Gly, Glu, Gln, Ser, Asn, or Cys
RXQPLTFALQX

SEQ ID NO: 143743 - protein, 9 aa, Artificial Sequence
  Description of Artificial Sequence: Synthetic peptide
  Seed: RPTAEAPNT (PMEL_HUMAN)
  misc_feature (2)..(2): Xaa can be , or Pro
  misc_feature (9)..(9): Xaa can be Pro, Met, Val, Phe, Ile, Ala, Ser, Tyr, Gly, Thr, Cys, or Leu
RXTAEAPNX

SEQ ID NO: 143744 - protein, 10 aa, Artificial Sequence
  Description of Artificial Sequence: Synthetic peptide
  Seed: RPTAEAPNTT (PMEL_HUMAN)
  misc_feature (2)..(2): Xaa can be , or Pro
  misc_feature (10)..(10): Xaa can be Val, Met, Trp, Leu, Gly, Thr, Cys, Ala, Pro, Phe, Tyr, Ser, or Ile
RXTAEAPNTX

SEQ ID NO: 143745 - protein, 11 aa, Artificial Sequence
  Description of Artificial Sequence: Synthetic peptide
  Seed: RPTAEAPNTTA (PMEL_HUMAN)
  misc_feature (2)..(2): Xaa can be Pro, Ala, or Val
  misc_feature (11)..(11): Xaa can be Leu, Ala, Met, Pro, Cys, Val, Phe, Gly, Trp, Arg, Thr, Ser, His, Tyr, Lys, Ile, or Gln
RXTAEAPNTTX

SEQ ID NO: 143746 - protein, 8 aa, Artificial Sequence
  Description of Artificial Sequence: Synthetic peptide
  Seed: RQLRTKAW (PMEL_HUMAN)
  misc_feature (2)..(2): Xaa can be Gln, Glu, Asp, Lys, Asn, Arg, Ala, Ser, His, or Met
  misc_feature (8)..(8): Xaa can be Tyr, Phe, Trp, Ile, Met, or Leu
RXLRTKAX

SEQ ID NO: 143747 - protein, 10 aa, Artificial Sequence
  Description of Artificial Sequence: Synthetic peptide
  Seed: RQLRTKAWNR (PMEL_HUMAN)
  misc_feature (2)..(2): Xaa can be Arg, Gln, Phe, Met, Leu, Val, Trp, Thr, Tyr, Ile, Lys, Glu, Gly, Ser, Pro, Asn, Ala, Cys, Asp, or His
  misc_feature (10)..(10): Xaa can be Lys, Arg, His, Tyr, Phe, Ile, Leu, Met, Trp, Glu, Ala, Asn, Ser, Val, Pro, Gln, Cys, Thr, or Gly
RXLRTKAWNX

SEQ ID NO: 143748 - protein, 11 aa, Artificial Sequence
  Description of Artificial Sequence: Synthetic peptide
  Seed: RQLRTKAWNRQ (PMEL_HUMAN)
  misc_feature (2)..(2): Xaa can be Ser, Val, Thr, Ala, Gln, Met, Trp, Ile, Tyr, Phe, Leu, Gly, Asn, Lys, Arg, His, or Cys
  misc_feature (11)..(11): Xaa can be Arg, His, Ser, Gly, Glu, Ala, Met, Asp, Thr, Tyr, Gln, Pro, Val, Leu, Trp, Ile, Cys, Phe, Asn, or Lys
RXLRTKAWNRX

SEQ ID NO: 143749 - protein, 10 aa, Artificial Sequence
  Description of Artificial Sequence: Synthetic peptide
  Seed: RQLYPEWTEA (PMEL_HUMAN)
  misc_feature (2)..(2): Xaa can be Met, Gln, Glu, Arg, Ser, Gly, Ala, Leu, Ile, Pro, Phe, Lys, Thr, Val, Tyr, Asn, Cys, Trp, His, or Asp
  misc_feature (10)..(10): Xaa can be Val, Met, Leu, Cys, Phe, Thr, Tyr, Ile, Ala, Trp, or His
RXLYPEWTEX

SEQ ID NO: 143750 - protein, 8 aa, Artificial Sequence
  Description of Artificial Sequence: Synthetic peptide
  Seed: RQVPLDCV (PMEL_HUMAN)
  misc_feature (2)..(2): Xaa can be Gln, or Ala
  misc_feature (8)..(8): Xaa can be Ile, Val, or Leu
RXVPLDCX

SEQ ID NO: 143751 - protein, 9 aa, Artificial Sequence
  Description of Artificial Sequence: Synthetic peptide
  Seed: RQVPLDCVL (PMEL_HUMAN)
  misc_feature (2)..(2): Xaa can be Glu, Arg, Gln, His, Asp, Ala, Met, Lys, Leu, Ser, Ile, Thr, Val, Gly, Asn, Tyr, Cys, Phe, Pro, or Trp
  misc_feature (9)..(9): Xaa can be Tyr, Leu, Phe, Met, Ile, Val, Trp, Ala, His, Cys, Lys, Thr, Ser, Arg, Pro, Gly, Asn, Glu, Gln, or Asp
RXVPLDCVX

SEQ ID NO: 143752 - protein, 10 aa, Artificial Sequence
  Description of Artificial Sequence: Synthetic peptide
  Seed: RQVPLDCVLY (PMEL_HUMAN)
  misc_feature (2)..(2): Xaa can be Arg, Gln, Met, Glu, Leu, Thr, Ser, Ala, Ile, Val, Lys, Tyr, Gly, Phe, Asn, Trp, Asp, His, Cys, or Pro
  misc_feature (10)..(10): Xaa can be Tyr, Trp, Phe, Arg, Lys, Met, Leu, Ile, Val, His, Cys, Ala, Gly, Thr, Glu, Gln, Pro, Ser, or Asn
RXVPLDCVLX

SEQ ID NO: 143753 - protein, 11 aa, Artificial Sequence
  Description of Artificial Sequence: Synthetic peptide
  Seed: RQVPLDCVLYR (PMEL_HUMAN)
  misc_feature (2)..(2): Xaa can be Gln, Arg, Met, Val, Leu, Thr, Ile, Lys, Glu, Ser, Ala, His, Phe, Tyr, Asn, Asp, Gly, Pro, Cys, or Trp
  misc_feature (11)..(11): Xaa can be Arg, Lys, Tyr, Phe, His, Met, Leu, Gln, Trp, Glu, Ser, Gly, Asn, Val, Ile, Thr, Cys, Pro, Ala, or Asp
RXVPLDCVLYX

SEQ ID NO: 143754 - protein, 9 aa, Artificial Sequence
  Description of Artificial Sequence: Synthetic peptide
  Seed: RRGSRSYVP (PMEL_HUMAN)
  misc_feature (2)..(2): Xaa can be Arg, Gln, Lys, His, Gly, Glu, Asn, Ala, or Met
  misc_feature (9)..(9): Xaa can be Leu, Lys, Phe, Met, Ile, Val, Tyr, Arg, Thr, Asn, Gln, Trp, His, Ala, Pro, Cys, or Glu
RXGSRSYVX

SEQ ID NO: 143755 - protein, 10 aa, Artificial Sequence
  Description of Artificial Sequence: Synthetic peptide
  Seed: RRGSRSYVPL (PMEL_HUMAN)
  misc_feature (2)..(2): Xaa can be Arg, or Gln
  misc_feature (10)..(10): Xaa can be Leu, Arg, Lys, Ile, His, Phe, Ala, Cys, Tyr, Met, Gln, Val, or Trp
RXGSRSYVPX

SEQ ID NO: 143756 - protein, 11 aa, Artificial Sequence
  Description of Artificial Sequence: Synthetic peptide
  Seed: RRGSRSYVPLA (PMEL_HUMAN)
  misc_feature (2)..(2): Xaa can be Tyr, Phe, Val, Thr, Met, Arg, Ala, Gln, Trp, Leu, Ile, Ser, Asn, His, Glu, Lys, Cys, Asp, Gly, or Pro
  misc_feature (11)..(11): Xaa can be Tyr, Met, Ile, His, Ser, Phe, Gly, Arg, Ala, Val, Glu, Lys, Thr, Gln, Pro, Leu, Cys, Asn, or Trp
RXGSRSYVPLX

SEQ ID NO: 143757 - protein, 8 aa, Artificial Sequence
  Description of Artificial Sequence: Synthetic peptide
  Seed: RRLMKQDF (PMEL_HUMAN)
  misc_feature (2)..(2): Xaa can be , or Arg
  misc_feature (8)..(8): Xaa can be Trp, Ile, Lys, Met, Val, Tyr, Leu, or Phe
RXLMKQDX

SEQ ID NO: 143758 - protein, 10 aa, Artificial Sequence
  Description of Artificial Sequence: Synthetic peptide
  Seed: RRLMKQDFSV (PMEL_HUMAN)
  misc_feature (2)..(2): Xaa can be Arg, Gln, Lys, Glu, Tyr, Asn, Gly, Phe, Met, Asp, Trp, Leu, Ala, Ile, His, Cys, Pro, Val, Ser, or Thr
  misc_feature (10)..(10): Xaa can be Met, Leu, Ile, Ala, Val, Lys, Thr, Phe, Tyr, Arg, Pro, Asn, Gly, Glu, Ser, Gln, His, Cys, or Trp
RXLMKQDFSX

SEQ ID NO: 143759 - protein, 11 aa, Artificial Sequence
  Description of Artificial Sequence: Synthetic peptide
  Seed: RRLMKQDFSVP (PMEL_HUMAN)
  misc_feature (2)..(2): Xaa can be Glu, Ile, Asp, Pro, Met, Arg, Gln, Gly, His, Ala, Phe, Asn, Cys, Leu, Thr, Tyr, Ser, Trp, Val, or Lys
  misc_feature (11)..(11): Xaa can be Cys, Trp, Lys, Gly, Ile, Asn, Pro, His, Ala, Arg, Phe, Met, Ser, Glu, Asp, Leu, Val, Gln, Tyr, or Thr
RXLMKQDFSVX

SEQ ID NO: 143760 - protein, 9 aa, Artificial Sequence
  Description of Artificial Sequence: Synthetic peptide
  Seed: RRRLMKQDF (PMEL_HUMAN)
  misc_feature (2)..(2): Xaa can be Arg, Gln, His, Ala, Tyr, Asn, Glu, Lys, Met, Gly, Ile, Asp, Leu, Thr, Val, or Ser
  misc_feature (9)..(9): Xaa can be Leu, Phe, Tyr, Lys, Met, Arg, Val, Ile, His, Cys, Trp, or Ala
RXRLMKQDX

SEQ ID NO: 143761 - protein, 11 aa, Artificial Sequence
  Description of Artificial Sequence: Synthetic peptide
  Seed: RRRLMKQDFSV (PMEL_HUMAN)
  misc_feature (2)..(2): Xaa can be Arg, Gln, Leu, Val, Asp, His, Phe, Tyr, Gly, Cys, Glu, Ser, Ile, Lys, Asn, Ala, Thr, Met, Pro, or Trp
  misc_feature (11)..(11): Xaa can be Leu, Ala, Met, Val, Ile, Lys, Phe, His, Arg, Cys, Gly, Trp, Tyr, Thr, or Gln
RXRLMKQDFSX

SEQ ID NO: 143762 - protein, 8 aa, Artificial Sequence
  Description of Artificial Sequence: Synthetic peptide
  Seed: RSFVYVWK (PMEL_HUMAN)
  misc_feature (2)..(2): Xaa can be Leu, Met, Ala, Tyr, Asn, Gln, Arg, Ser, Trp, Gly, Phe, Thr, Ile, Val, His, Cys, or Lys
  misc_feature (8)..(8): Xaa can be Arg, or Lys
RXFVYVWX

SEQ ID NO: 143763 - protein, 9 aa, Artificial Sequence
  Description of Artificial Sequence: Synthetic peptide
  Seed: RSFVYVWKT (PMEL_HUMAN)
  misc_feature (2)..(2): Xaa can be Thr, Ser, Val, Tyr, Ala, Ile, Trp, Met, Gly, Asn, Leu, Gln, or Phe
  misc_feature (9)..(9): Xaa can be Lys, Ala, Val, Arg, Ile, Thr, Gly, Leu, Ser, or Met
RXFVYVWKX

SEQ ID NO: 143764 - protein, 10 aa, Artificial Sequence
  Description of Artificial Sequence: Synthetic peptide
  Seed: RSFVYVWKTW (PMEL_HUMAN)
  misc_feature (2)..(2): Xaa can be Ser, Tyr, Thr, Trp, Met, Val, Ile, Leu, Gln, Ala, Phe, His, Asp, Gly, Cys, Glu, Lys, Asn, Pro, or Arg
  misc_feature (10)..(10): Xaa can be Leu, Phe, Ile, Trp, Met, Tyr, Val, Gly, Ala, or Asn
RXFVYVWKTX

SEQ ID NO: 143765 - protein, 11 aa, Artificial Sequence
  Description of Artificial Sequence: Synthetic peptide
  Seed: RSFVYVWKTWG (PMEL_HUMAN)
  misc_feature (2)..(2): Xaa can be Ser, Ala, Thr, Val, Gly, or Met
  misc_feature (11)..(11): Xaa can be Trp, Asp, Pro, Thr, Ile, His, Leu, Gln, Gly, Lys, Arg, Met, Asn, Tyr, Phe, Ser, Cys, Glu, Val, or Ala
RXFVYVWKTWX

SEQ ID NO: 143766 - protein, 8 aa, Artificial Sequence
  Description of Artificial Sequence: Synthetic peptide
  Seed: RSYVPLAH (PMEL_HUMAN)
  misc_feature (2)..(2): Xaa can be Ala, Ser, Thr, Val, Gly, Ile, Gln, Glu, Cys, Asn, Met, Leu, or Pro
  misc_feature (8)..(8): Xaa can be Tyr, Leu, Phe, Met, His, Ile, Val, Ala, or Trp
RXYVPLAX

SEQ ID NO: 143767 - protein, 9 aa, Artificial Sequence
  Description of Artificial Sequence: Synthetic peptide
  Seed: RSYVPLAHS (PMEL_HUMAN)
  misc_feature (2)..(2): Xaa can be Thr, Ser, Val, Met, Ala, Ile, Tyr, Phe, Trp, Leu, Gly, Gln, Asn, Cys, His, or Lys
  misc_feature (9)..(9): Xaa can be Lys, Val, Ala, Arg, Ile, Gly, Leu, Met, Ser, Thr, Tyr, His, Asn, Phe, Cys, Pro, Gln, or Gl u
RXYVPLAHX

SEQ ID NO: 143768 - protein, 10 aa, Artificial Sequence
  Description of Artificial Sequence: Synthetic peptide
  Seed: RSYVPLAHSS (PMEL_HUMAN)
  misc_feature (2)..(2): Xaa can be Thr, Ser, Val, Tyr, Met, Ala, Ile, Phe, Trp, Gln, Leu, Asn, Gly, His, Cys, Lys, Asp, Glu, Arg, or Pro
  misc_feature (10)..(10): Xaa can be Lys, Ala, Ile, Val, Arg, Leu, Met, Tyr, Ser, Gly, Thr, Pro, Cys, Phe, or His
RXYVPLAHSX

SEQ ID NO: 143769 - protein, 11 aa, Artificial Sequence
  Description of Artificial Sequence: Synthetic peptide
  Seed: RSYVPLAHSSS (PMEL_HUMAN)
  misc_feature (2)..(2): Xaa can be Thr, Ser, Val, Met, Tyr, Ala, Ile, Phe, Leu, His, Trp, Gly, Gln, Asn, or Cys
  misc_feature (11)..(11): Xaa can be Lys, Ala, Arg, Ile, Leu, Val, Met, Ser, Gly, Thr, or Tyr
RXYVPLAHSSX

SEQ ID NO: 143770 - protein, 9 aa, Artificial Sequence
  Description of Artificial Sequence: Synthetic peptide
  Seed: RTKAWNRQL (PMEL_HUMAN)
  misc_feature (2)..(2): Xaa can be Val, Thr, Ala, Phe, Tyr, Ile, Ser, Met, Trp, Leu, Gln, Gly, Arg, Asn, Glu, Asp, His, Cys, Lys, or Pro
  misc_feature (9)..(9): Xaa can be Phe, Lys, Tyr, Met, Trp, Leu, Arg, Ile, Val, Ala, Ser, Thr, Gly, Cys, Asn, Pro, His, Gln, Glu, or Asp
RXKAWNRQX

SEQ ID NO: 143771 - protein, 10 aa, Artificial Sequence
  Description of Artificial Sequence: Synthetic peptide
  Seed: RTKAWNRQLY (PMEL_HUMAN)
  misc_feature (2)..(2): Xaa can be Thr, Val, Tyr, Ser, Met, Ala, Phe, Ile, Leu, Gln, Trp, Gly, Asn, Cys, Arg, Glu, His, Asp, Pro, or Lys
  misc_feature (10)..(10): Xaa can be Tyr, Met, Phe, Lys, Trp, Ala, Val, Arg, Leu, Ile, Ser, Gly, Thr, Pro, Gln, Cys, His, Asn, Glu, or Asp
RXKAWNRQLX

SEQ ID NO: 143772 - protein, 11 aa, Artificial Sequence
  Description of Artificial Sequence: Synthetic peptide
  Seed: RTKAWNRQLYP (PMEL_HUMAN)
  misc_feature (2)..(2): Xaa can be Thr, Ser, Val, Met, Phe, Tyr, Ile, Ala, Leu, Gln, Trp, Gly, Asn, Cys, Glu, Asp, Pro, Arg, His, or Lys
  misc_feature (11)..(11): Xaa can be Lys, Ala, Val, Ile, Ser, Met, Leu, Tyr, Gly, Arg, Thr, Phe, Pro, Cys, His, Asn, Glu, or Gl n
RXKAWNRQLYX

SEQ ID NO: 143773 - protein, 9 aa, Artificial Sequence
  Description of Artificial Sequence: Synthetic peptide
  Seed: RYGSFSVTL (PMEL_HUMAN)
  misc_feature (2)..(2): Xaa can be Arg, Tyr, Gln, Met, Val, Thr, Leu, Ala, Ile, Trp, Ser, Phe, His, Gly, Lys, Glu, Asn, Asp, Pro, or Cys
  misc_feature (9)..(9): Xaa can be Leu, Tyr, Met, Phe, Ile, Val, Trp, His, Lys, Arg, Cys, Ala, Gly, Thr, or Gln
RXGSFSVTX

SEQ ID NO: 143774 - protein, 10 aa, Artificial Sequence
  Description of Artificial Sequence: Synthetic peptide
  Seed: RYGSFSVTLD (PMEL_HUMAN)
  misc_feature (2)..(2): Xaa can be Tyr, Trp, Phe, Met, Val, Gln, Thr, His, or Leu
  misc_feature (10)..(10): Xaa can be Phe, Trp, Met, Leu, Ile, Tyr, Gly, Pro, Lys, Ala, Val, Ser, Gln, Asn, Asp, Arg, Cys, His, Thr, or Glu
RXGSFSVTLX

SEQ ID NO: 143775 - protein, 11 aa, Artificial Sequence
  Description of Artificial Sequence: Synthetic peptide
  Seed: RYGSFSVTLDI (PMEL_HUMAN)
  misc_feature (2)..(2): Xaa can be Tyr, Trp, Val, Asp, Leu, Asn, Phe, Ala, Arg, Ser, Gly, Thr, Glu, Ile, Cys, Lys, His, Gln, Pro, or Met
  misc_feature (11)..(11): Xaa can be Met, Tyr, Leu, Ile, Phe, Trp, or Val
RXGSFSVTLDX

SEQ ID NO: 143776 - protein, 8 aa, Artificial Sequence
  Description of Artificial Sequence: Synthetic peptide
  Seed: SAEILQAV (PMEL_HUMAN)
  misc_feature (2)..(2): Xaa can be Ala, Ser, Thr, Gln, Glu, Pro, Met, Gly, Ile, Phe, Val, Leu, or Cys
  misc_feature (8)..(8): Xaa can be Leu, Ile, Val, Met, Tyr, Phe, or Lys
SXEILQAX

SEQ ID NO: 143777 - protein, 10 aa, Artificial Sequence
  Description of Artificial Sequence: Synthetic peptide
  Seed: SAEILQAVPS (PMEL_HUMAN)
  misc_feature (2)..(2): Xaa can be Glu, Met, Leu, Gly, Pro, Asp, Ile, His, Ser, Arg, Ala, Thr, Gln, Cys, Trp, Val, Tyr, Phe, Lys, or Asn
  misc_feature (10)..(10): Xaa can be Ser, Pro, Thr, Val, Ala, or Ile
SXEILQAVPX

SEQ ID NO: 143778 - protein, 9 aa, Artificial Sequence
  Description of Artificial Sequence: Synthetic peptide
  Seed: SAFTITDQV (PMEL_HUMAN)
  misc_feature (2)..(2): Xaa can be Met, Leu, Gln, Val, Ala, Ile, Thr, Arg, Ser, Pro, Gly, Cys, Glu, Asn, Phe, Asp, Tyr, His, Lys, or Trp
  misc_feature (9)..(9): Xaa can be Leu, Met, Phe, Trp, Ile, Tyr, Val, Lys, Arg, Ala, His, Cys, Thr, Ser, Gly, or Pro
SXFTITDQX

SEQ ID NO: 143779 - protein, 11 aa, Artificial Sequence
  Description of Artificial Sequence: Synthetic peptide
  Seed: SAFTITDQVPF (PMEL_HUMAN)
  misc_feature (2)..(2): Xaa can be Gln, Ala, Met, Thr, Ser, Leu, Val, Ile, Gly, Lys, Glu, Pro, Asp, Asn, Cys, Arg, His, Phe, Trp, or Tyr
  misc_feature (11)..(11): Xaa can be Trp, Phe, Lys, Tyr, Arg, Met, His, Leu, or Ile
SXFTITDQVPX

SEQ ID NO: 143780 - protein, 10 aa, Artificial Sequence
  Description of Artificial Sequence: Synthetic peptide
  Seed: SCPIGENSPL (PMEL_HUMAN)
  misc_feature (2)..(2): Xaa can be Ala, Gln, Asn, Cys, Pro, Val, Leu, Met, Ser, Glu, Phe, Trp, Asp, Tyr, His, Gly, Thr, Ile, Lys, or Arg
  misc_feature (10)..(10): Xaa can be Met, Val, Ala, Phe, Leu, Ile, or Tyr
SXPIGENSPX

SEQ ID NO: 143781 - protein, 11 aa, Artificial Sequence
  Description of Artificial Sequence: Synthetic peptide
  Seed: SCPIGENSPLL (PMEL_HUMAN)
  misc_feature (2)..(2): Xaa can be Ala, Ser, Ile, Met, Gly, Val, Leu, Cys, or Thr
  misc_feature (11)..(11): Xaa can be Leu, Met, Phe, or Ile
SXPIGENSPLX

SEQ ID NO: 143782 - protein, 8 aa, Artificial Sequence
  Description of Artificial Sequence: Synthetic peptide
  Seed: SEVMGTTL (PMEL_HUMAN)
  misc_feature (2)..(2): Xaa can be Glu, Asp, His, Gln, Ala, Leu, Thr, Gly, Val, Ile, Arg, Pro, Met, Ser, Phe, Asn, Lys, or Ty r
  misc_feature (8)..(8): Xaa can be Leu, Val, Ile, Tyr, Phe, Met, Cys, Ala, Trp, His, Gly, Thr, Pro, or Ser
SXVMGTTX

SEQ ID NO: 143783 - protein, 9 aa, Artificial Sequence
  Description of Artificial Sequence: Synthetic peptide
  Seed: SEVMGTTLA (PMEL_HUMAN)
  misc_feature (2)..(2): Xaa can be Glu, His, Gln, Asp, Arg, Pro, Lys, Ala, Asn, or Ser
  misc_feature (9)..(9): Xaa can be Ala, Val, Leu, Ile, Trp, Thr, Cys, Pro, Met, Phe, Gly, Tyr, Ser, Glu, Gln, Arg, Lys, His, or Asp
SXVMGTTLX

SEQ ID NO: 143784 - protein, 11 aa, Artificial Sequence
  Description of Artificial Sequence: Synthetic peptide
  Seed: SEVMGTTLAEM (PMEL_HUMAN)
  misc_feature (2)..(2): Xaa can be Glu, Asp, or Gln
  misc_feature (11)..(11): Xaa can be Trp, Leu, Phe, Met, Tyr, Ala, Thr, Cys, Val, Ile, Gly, Ser, His, or Pro
SXVMGTTLAEX

SEQ ID NO: 143785 - protein, 8 aa, Artificial Sequence
  Description of Artificial Sequence: Synthetic peptide
  Seed: SFSIALNF (PMEL_HUMAN)
  misc_feature (2)..(2): Xaa can be Tyr, Phe, or Trp
  misc_feature (8)..(8): Xaa can be Phe, Leu, Tyr, Met, Ile, Trp, or Val
SXSIALNX

SEQ ID NO: 143786 - protein, 9 aa, Artificial Sequence
  Description of Artificial Sequence: Synthetic peptide
  Seed: SFVYVWKTW (PMEL_HUMAN)
  misc_feature (2)..(2): Xaa can be Tyr, Thr, Ala, Ser, Phe, Trp, Gly, Met, Val, Gln, Cys, Leu, His, Pro, Asn, Glu, Asp, Lys, or Ile
  misc_feature (9)..(9): Xaa can be Trp, Phe, Val, Leu, Ile, Met, Tyr, or Cys
SXVYVWKTX

SEQ ID NO: 143787 - protein, 9 aa, Artificial Sequence
  Description of Artificial Sequence: Synthetic peptide
  Seed: SGEGDAFEL (PMEL_HUMAN)
  misc_feature (2)..(2): Xaa can be Phe, Ala, Tyr, Gly, Thr, Trp, Val, Met, Ser, Gln, Arg, Ile, Cys, Leu, His, Asn, Glu, Lys, Pro, or Asp
  misc_feature (9)..(9): Xaa can be Leu, Met, Ile, Phe, Val, Tyr, Cys, Ala, or Trp
SXEGDAFEX

SEQ ID NO: 143788 - protein, 9 aa, Artificial Sequence
  Description of Artificial Sequence: Synthetic peptide
  Seed: SGLSIGTGR (PMEL_HUMAN)
  misc_feature (2)..(2): Xaa can be Arg, Ala, Ser, Thr, Leu, Val, Met, Ile, Gly, Gln, Cys, Tyr, Phe, Asn, Glu, Asp, Pro, Lys, His, or Trp
  misc_feature (9)..(9): Xaa can be Lys, Arg, Tyr, Phe, Leu, Met, His, Val, Ile, Ala, Trp, Gln, Cys, Asn, Pro, Thr, Gly, or Gl u
SXLSIGTGX

SEQ ID NO: 143789 - protein, 11 aa, Artificial Sequence
  Description of Artificial Sequence: Synthetic peptide
  Seed: SGLSIGTGRAM (PMEL_HUMAN)
  misc_feature (2)..(2): Xaa can be Ala, Ser, Thr, Val, Ile, Gly, Gln, Arg, Leu, Glu, Met, Cys, Asn, His, Pro, Asp, Tyr, or Ly s
  misc_feature (11)..(11): Xaa can be Leu, Tyr, Phe, Met, His, Lys, Trp, Ile, Arg, Val, Cys, Gln, or Ala
SXLSIGTGRAX

SEQ ID NO: 143790 - protein, 10 aa, Artificial Sequence
  Description of Artificial Sequence: Synthetic peptide
  Seed: SGSWSQKRSF (PMEL_HUMAN)
  misc_feature (2)..(2): Xaa can be Thr, Ser, Tyr, Asn, Trp, Arg, Ala, Val, Leu, Gly, Asp, Ile, Met, Lys, Glu, His, Phe, Cys, Gln, or Pro
  misc_feature (10)..(10): Xaa can be Trp, Phe, Tyr, or Met
SXSWSQKRSX

SEQ ID NO: 143791 - protein, 9 aa, Artificial Sequence
  Description of Artificial Sequence: Synthetic peptide
  Seed: SGTLISRAL (PMEL_HUMAN)
  misc_feature (2)..(2): Xaa can be Ala, Ser, Val, Gln, Ile, Gly, Thr, Arg, Asp, Leu, Met, Asn, Tyr, Glu, His, Cys, Phe, Pro, or Lys
  misc_feature (9)..(9): Xaa can be Leu, Phe, Met, Tyr, Ile, Val, His, Lys, Trp, Ala, Cys, or Arg
SXTLISRAX

SEQ ID NO: 143792 - protein, 10 aa, Artificial Sequence
  Description of Artificial Sequence: Synthetic peptide
  Seed: SGTLISRALV (PMEL_HUMAN)
  misc_feature (2)..(2): Xaa can be Thr, Val, Ala, Ser, Ile, Pro, Phe, Gln, Gly, Met, Tyr, Leu, Glu, or Asn
  misc_feature (10)..(10): Xaa can be Val, Ile, Leu, Ala, or Met
SXTLISRALX

SEQ ID NO: 143793 - protein, 11 aa, Artificial Sequence
  Description of Artificial Sequence: Synthetic peptide
  Seed: SGTLISRALVV (PMEL_HUMAN)
  misc_feature (2)..(2): Xaa can be Met, Ser, Trp, Tyr, Arg, Ala, Val, Phe, Gln, His, Cys, Leu, Lys, Thr, Glu, Asn, Pro, Asp, Ile, or Gly
  misc_feature (11)..(11): Xaa can be Val, or Ala
SXTLISRALVX

SEQ ID NO: 143794 - protein, 10 aa, Artificial Sequence
  Description of Artificial Sequence: Synthetic peptide
  Seed: SGTYCLNVSL (PMEL_HUMAN)
  misc_feature (2)..(2): Xaa can be Cys, Glu, Gly, Ala, Met, Ser, Tyr, Pro, Trp, Gln, Ile, Lys, Thr, Asn, Phe, Leu, Arg, Val, Asp, or His
  misc_feature (10)..(10): Xaa can be Tyr, Trp, Ile, Ala, Phe, Leu, Met, or Val
SXTYCLNVSX

SEQ ID NO: 143795 - protein, 9 aa, Artificial Sequence
  Description of Artificial Sequence: Synthetic peptide
  Seed: SGYLAEADL (PMEL_HUMAN)
  misc_feature (2)..(2): Xaa can be Arg, Gln, Ala, His, Asn, Phe, Tyr, Glu, Ser, Gly, or Asp
  misc_feature (9)..(9): Xaa can be Leu, Met, Phe, Val, or Ile
SXYLAEADX

SEQ ID NO: 143796 - protein, 11 aa, Artificial Sequence
  Description of Artificial Sequence: Synthetic peptide
  Seed: SGYLAEADLSY (PMEL_HUMAN)
  misc_feature (2)..(2): Xaa can be Ala, Gln, Val, Met, Ile, Ser, Leu, Gly, Lys, Thr, Glu, His, Asp, Arg, Asn, Phe, Tyr, Trp, Pro, or Cys
  misc_feature (11)..(11): Xaa can be Tyr, Phe, Met, Lys, His, Arg, Leu, Trp, or Ile
SXYLAEADLSX

SEQ ID NO: 143797 - protein, 8 aa, Artificial Sequence
  Description of Artificial Sequence: Synthetic peptide
  Seed: SHWLRLPR (PMEL_HUMAN)
  misc_feature (2)..(2): Xaa can be Ile, Tyr, Gln, Ala, Ser, Met, Leu, Phe, Thr, Trp, Val, Asn, His, Gly, Arg, or Cys
  misc_feature (8)..(8): Xaa can be Arg, or Lys
SXWLRLPX

SEQ ID NO: 143798 - protein, 9 aa, Artificial Sequence
  Description of Artificial Sequence: Synthetic peptide
  Seed: SHWLRLPRI (PMEL_HUMAN)
  misc_feature (2)..(2): Xaa can be His, Arg, Gln, Glu, Asp, Asn, Pro, Ser, Ala, Gly, Met, Val, Ile, Leu, Thr, or Lys
  misc_feature (9)..(9): Xaa can be Leu, Val, Ile, Met, Phe, Ala, Thr, Cys, Pro, Trp, Gly, Ser, or Tyr
SXWLRLPRX

SEQ ID NO: 143799 - protein, 10 aa, Artificial Sequence
  Description of Artificial Sequence: Synthetic peptide
  Seed: SHWLRLPRIF (PMEL_HUMAN)
  misc_feature (2)..(2): Xaa can be Tyr, Trp, Gln, Lys, His, Met, Leu, Glu, Ala, Ser, Phe, Arg, Asn, Gly, Val, Ile, Pro, Asp, Thr, or Cys
  misc_feature (10)..(10): Xaa can be Phe, Tyr, Trp, Met, Leu, Ile, or Val
SXWLRLPRIX

SEQ ID NO: 143800 - protein, 11 aa, Artificial Sequence
  Description of Artificial Sequence: Synthetic peptide
  Seed: SIALNFPGSQK (PMEL_HUMAN)
  misc_feature (2)..(2): Xaa can be Ala, Ser, Val, Thr, Ile, Gln, Gly, Met, Leu, Glu, Asp, Asn, Phe, Lys, His, Trp, Pro, Tyr, Cys, or Arg
  misc_feature (11)..(11): Xaa can be Lys, Arg, Tyr, Phe, His, Met, Leu, or Trp
SXALNFPGSQX

SEQ ID NO: 143801 - protein, 8 aa, Artificial Sequence
  Description of Artificial Sequence: Synthetic peptide
  Seed: SIGTGRAM (PMEL_HUMAN)
  misc_feature (2)..(2): Xaa can be Ala, Ser, Thr, Ile, Val, Gln, Arg, Leu, Glu, Asn, Tyr, Phe, Gly, Met, His, Asp, Cys, Pro, Trp, or Lys
  misc_feature (8)..(8): Xaa can be Leu, Phe, Met, Ile, Tyr, Val, His, Trp, Ala, or Lys
SXGTGRAX

SEQ ID NO: 143802 - protein, 9 aa, Artificial Sequence
  Description of Artificial Sequence: Synthetic peptide
  Seed: SIGTGRAML (PMEL_HUMAN)
  misc_feature (2)..(2): Xaa can be Ala, Ser, Val, Ile, Thr, Arg, Tyr, Phe, Leu, Gln, Gly, Met, Glu, Cys, His, Asn, Asp, or Pr o
  misc_feature (9)..(9): Xaa can be Leu, Tyr, Met, Phe, Val, Ile, His, Trp, Lys, or Ala
SXGTGRAMX

SEQ ID NO: 143803 - protein, 8 aa, Artificial Sequence
  Description of Artificial Sequence: Synthetic peptide
  Seed: SIMSTESI (PMEL_HUMAN)
  misc_feature (2)..(2): Xaa can be Gln, Ala, Met, Glu, Ser, Leu, Val, or Ile
  misc_feature (8)..(8): Xaa can be Ile, Val, Leu, Phe, or Met
SXMSTESX

SEQ ID NO: 143804 - protein, 9 aa, Artificial Sequence
  Description of Artificial Sequence: Synthetic peptide
  Seed: SITGSLGPL (PMEL_HUMAN)
  misc_feature (2)..(2): Xaa can be Leu, Ala, Met, Ser, Gln, Val, Thr, Ile, Gly, Phe, Arg, Cys, Pro, Tyr, Glu, Asn, Asp, His, Lys, or Trp
  misc_feature (9)..(9): Xaa can be Tyr, Phe, Lys, Leu, Arg, Met, Ile, His, Val, Ala, Trp, Cys, Thr, Ser, or Gln
SXTGSLGPX

SEQ ID NO: 143805 - protein, 10 aa, Artificial Sequence
  Description of Artificial Sequence: Synthetic peptide
  Seed: SITGSLGPLL (PMEL_HUMAN)
  misc_feature (2)..(2): Xaa can be Met, Leu, Ala, Val, Ile, Thr, Gln, or Ser
  misc_feature (10)..(10): Xaa can be Leu, Val, Ile, Met, Ala, Thr, or Phe
SXTGSLGPLX

SEQ ID NO: 143806 - protein, 10 aa, Artificial Sequence
  Description of Artificial Sequence: Synthetic peptide
  Seed: SIVVLSGTTA (PMEL_HUMAN)
  misc_feature (2)..(2): Xaa can be Leu, Met, Thr, Ile, Val, Gln, Ala, or Ser
  misc_feature (10)..(10): Xaa can be Val, Leu, Ile, Ala, Met, or Thr
SXVVLSGTTX

SEQ ID NO: 143807 - protein, 8 aa, Artificial Sequence
  Description of Artificial Sequence: Synthetic peptide
  Seed: SLADTNSL (PMEL_HUMAN)
  misc_feature (2)..(2): Xaa can be Met, Leu, Val, Ala, Thr, Ile, or Ser
  misc_feature (8)..(8): Xaa can be Leu, or Val
SXADTNSX

SEQ ID NO: 143808 - protein, 9 aa, Artificial Sequence
  Description of Artificial Sequence: Synthetic peptide
  Seed: SLADTNSLA (PMEL_HUMAN)
  misc_feature (2)..(2): Xaa can be Met, Leu, Thr, Val, Gln, Ile, Ala, Ser, Gly, Phe, Asn, Glu, Pro, or Cys
  misc_feature (9)..(9): Xaa can be Val, Leu, Ile, Ala, Met, Thr, Phe, Cys, Ser, or Gly
SXADTNSLX

SEQ ID NO: 143809 - protein, 10 aa, Artificial Sequence
  Description of Artificial Sequence: Synthetic peptide
  Seed: SLADTNSLAV (PMEL_HUMAN)
  misc_feature (2)..(2): Xaa can be Met, Gln, Leu, Ala, Ile, Val, Thr, Ser, Phe, Asn, Gly, Trp, Glu, Tyr, Lys, Arg, Cys, His, Asp, or Pro
  misc_feature (10)..(10): Xaa can be Met, Ile, Val, Phe, Leu, Arg, Trp, Lys, Tyr, Ala, Thr, Cys, or Ser
SXADTNSLAX

SEQ ID NO: 143810 - protein, 11 aa, Artificial Sequence
  Description of Artificial Sequence: Synthetic peptide
  Seed: SLADTNSLAVV (PMEL_HUMAN)
  misc_feature (2)..(2): Xaa can be Leu, Met, Ile, Gln, Val, Ala, Thr, or Ser
  misc_feature (11)..(11): Xaa can be Leu, Val, Met, Ala, Ile, Thr, Cys, Trp, Phe, Gln, Lys, Ser, Asn, Glu, Tyr, His, Pro, Gly, Asp, or Arg
SXADTNSLAVX

SEQ ID NO: 143811 - protein, 9 aa, Artificial Sequence
  Description of Artificial Sequence: Synthetic peptide
  Seed: SLAVVSTQL (PMEL_HUMAN)
  misc_feature (2)..(2): Xaa can be Ala, Gln, Thr, Met, Leu, Val, Ile, Arg, Ser, Pro, Gly, Asn, Glu, Phe, Asp, Tyr, His, Cys, Lys, or Trp
  misc_feature (9)..(9): Xaa can be Tyr, Leu, Met, Phe, Lys, Val, Ile, Arg, Trp, His, Ala, Thr, Cys, Gln, or Ser
SXAVVSTQX

SEQ ID NO: 143812 - protein, 10 aa, Artificial Sequence
  Description of Artificial Sequence: Synthetic peptide
  Seed: SLAVVSTQLI (PMEL_HUMAN)
  misc_feature (2)..(2): Xaa can be Met, Leu, Gln, Val, Ile, Thr, or Ala
  misc_feature (10)..(10): Xaa can be Val, Ile, Leu, Ala, Phe, Trp, Met, Arg, Tyr, Glu, Cys, Asp, Pro, Gln, His, Lys, Ser, Gly, Thr, or Asn
SXAVVSTQLX

SEQ ID NO: 143813 - protein, 9 aa, Artificial Sequence
  Description of Artificial Sequence: Synthetic peptide
  Seed: SLGPLLDGT (PMEL_HUMAN)
  misc_feature (2)..(2): Xaa can be Met, Leu, Gln, Val, Ile, Thr, Ala, Ser, Phe, Asn, Glu, Cys, or Gly
  misc_feature (9)..(9): Xaa can be Val, Leu, Ile, Ala, Met, Thr, Ser, Phe, or Cys
SXGPLLDGX

SEQ ID NO: 143814 - protein, 10 aa, Artificial Sequence
  Description of Artificial Sequence: Synthetic peptide
  Seed: SLGPLLDGTA (PMEL_HUMAN)
  misc_feature (2)..(2): Xaa can be Leu, Met, Val, Ile, Thr, Gln, or Ala
  misc_feature (10)..(10): Xaa can be Val, Leu, Ile, Ala, or Met
SXGPLLDGTX

SEQ ID NO: 143815 - protein, 8 aa, Artificial Sequence
  Description of Artificial Sequence: Synthetic peptide
  Seed: SLIYRRRL (PMEL_HUMAN)
  misc_feature (2)..(2): Xaa can be Met, Pro, Leu, Ile, or Ala
  misc_feature (8)..(8): Xaa can be Leu, Met, Val, Ile, or Phe
SXIYRRRX

SEQ ID NO: 143816 - protein, 9 aa, Artificial Sequence
  Description of Artificial Sequence: Synthetic peptide
  Seed: SLIYRRRLM (PMEL_HUMAN)
  misc_feature (2)..(2): Xaa can be Tyr, Met, Phe, Pro, Leu, Trp, Ala, Ile, Val, Gln, His, Arg, Asn, Gly, Ser, Lys, Thr, or As p
  misc_feature (9)..(9): Xaa can be Leu, Met, Ile, Phe, Val, Tyr, Ala, Trp, Cys, or His
SXIYRRRLX

SEQ ID NO: 143817 - protein, 10 aa, Artificial Sequence
  Description of Artificial Sequence: Synthetic peptide
  Seed: SLIYRRRLMK (PMEL_HUMAN)
  misc_feature (2)..(2): Xaa can be Thr, Ser, Met, Val, Tyr, Trp, Arg, Ala, Phe, Leu, Asn, Gln, Ile, Gly, His, Lys, Asp, Pro, Cys, or Glu
  misc_feature (10)..(10): Xaa can be Arg, Tyr, Lys, Ala, Val, Ile, Ser, Met, His, Leu, or Gly
SXIYRRRLMX

SEQ ID NO: 143818 - protein, 11 aa, Artificial Sequence
  Description of Artificial Sequence: Synthetic peptide
  Seed: SLKVSNDGPTL (PMEL_HUMAN)
  misc_feature (2)..(2): Xaa can be Ala, Gln, Val, Thr, Ile, Met, Ser, Gly, Leu, Cys, Pro, Asn, Glu, Phe, Trp, Lys, Tyr, Asp, His, or Arg
  misc_feature (11)..(11): Xaa can be Tyr, Phe, Leu, Met, Lys, Trp, His, Arg, Ile, Val, Ala, Cys, or Gln
SXKVSNDGPTX

SEQ ID NO: 143819 - protein, 8 aa, Artificial Sequence
  Description of Artificial Sequence: Synthetic peptide
  Seed: SNDGPTLI (PMEL_HUMAN)
  misc_feature (2)..(2): Xaa can be Ala, Ser, Tyr, Phe, Thr, Val, Ile, Trp, Leu, Met, Gly, Asp, Asn, Cys, Gln, Pro, Glu, His, Arg, or Lys
  misc_feature (8)..(8): Xaa can be Leu, Ile, Phe, Met, Val, Tyr, Cys, Trp, Ala, or Thr
SXDGPTLX

SEQ ID NO: 143820 - protein, 8 aa, Artificial Sequence
  Description of Artificial Sequence: Synthetic peptide
  Seed: SPACQLVL (PMEL_HUMAN)
  misc_feature (2)..(2): Xaa can be , or Pro
  misc_feature (8)..(8): Xaa can be Ile, Met, Val, Leu, Ala, or Phe
SXACQLVX

SEQ ID NO: 143821 - protein, 9 aa, Artificial Sequence
  Description of Artificial Sequence: Synthetic peptide
  Seed: SPACQLVLH (PMEL_HUMAN)
  misc_feature (2)..(2): Xaa can be Pro, Ala, Val, Gly, or Ser
  misc_feature (9)..(9): Xaa can be Tyr, Phe, Met, Leu, His, Ile, Trp, or Val
SXACQLVLX

SEQ ID NO: 143822 - protein, 11 aa, Artificial Sequence
  Description of Artificial Sequence: Synthetic peptide
  Seed: SPACQLVLHQI (PMEL_HUMAN)
  misc_feature (2)..(2): Xaa can be , or Pro
  misc_feature (11)..(11): Xaa can be Ile, Ala, Leu, Phe, Val, Thr, Met, or Cys
SXACQLVLHQX

SEQ ID NO: 143823 - protein, 8 aa, Artificial Sequence
  Description of Artificial Sequence: Synthetic peptide
  Seed: SPGCQPPA (PMEL_HUMAN)
  misc_feature (2)..(2): Xaa can be , or Pro
  misc_feature (8)..(8): Xaa can be Met, Ala, Leu, Ile, or Val
SXGCQPPX

SEQ ID NO: 143824 - protein, 9 aa, Artificial Sequence
  Description of Artificial Sequence: Synthetic peptide
  Seed: SPGCQPPAQ (PMEL_HUMAN)
  misc_feature (2)..(2): Xaa can be Pro, Ala, Val, Gly, Ser, or Ile
  misc_feature (9)..(9): Xaa can be Ala, Val, Met, Ile, Cys, Leu, Thr, Tyr, Gly, Arg, His, Pro, Lys, Gln, Phe, or Ser
SXGCQPPAX

SEQ ID NO: 143825 - protein, 10 aa, Artificial Sequence
  Description of Artificial Sequence: Synthetic peptide
  Seed: SPGCQPPAQR (PMEL_HUMAN)
  misc_feature (2)..(2): Xaa can be Thr, Val, Ala, Ile, Ser, Pro, Glu, Met, Leu, Gly, Asp, or Gln
  misc_feature (10)..(10): Xaa can be Arg, or Lys
SXGCQPPAQX

SEQ ID NO: 143826 - protein, 11 aa, Artificial Sequence
  Description of Artificial Sequence: Synthetic peptide
  Seed: SPGCQPPAQRL (PMEL_HUMAN)
  misc_feature (2)..(2): Xaa can be Pro, or Ala
  misc_feature (11)..(11): Xaa can be Tyr, Phe, Val, Cys, Pro, Thr, Ala, Ile, Leu, Met, or Trp
SXGCQPPAQRX

SEQ ID NO: 143827 - protein, 9 aa, Artificial Sequence
  Description of Artificial Sequence: Synthetic peptide
  Seed: SPLLSGQQV (PMEL_HUMAN)
  misc_feature (2)..(2): Xaa can be Pro, His, Ala, Arg, Val, Gln, Ser, Glu, Ile, Met, Cys, Lys, Gly, Thr, Asn, or Asp
  misc_feature (9)..(9): Xaa can be Val, Ile, Ala, Tyr, Trp, Leu, Met, Phe, Cys, Thr, Pro, Ser, Gly, His, or Arg
SXLLSGQQX

SEQ ID NO: 143828 - protein, 9 aa, Artificial Sequence
  Description of Artificial Sequence: Synthetic peptide
  Seed: SPVPGTTDG (PMEL_HUMAN)
  misc_feature (2)..(2): Xaa can be Pro, Ala, Val, Ile, Ser, or Gly
  misc_feature (9)..(9): Xaa can be Ala, Leu, Met, Val, Cys, Ile, Phe, Lys, Glu, Gly, Gln, Thr, Arg, His, Ser, Tyr, Pro, or Tr p
SXVPGTTDX

SEQ ID NO: 143829 - protein, 10 aa, Artificial Sequence
  Description of Artificial Sequence: Synthetic peptide
  Seed: SPVPGTTDGH (PMEL_HUMAN)
  misc_feature (2)..(2): Xaa can be Pro, Ala, Thr, Val, Ser, Gly, Met, or Ile
  misc_feature (10)..(10): Xaa can be Tyr, Phe, Trp, Met, Leu, or His
SXVPGTTDGX

SEQ ID NO: 143830 - protein, 11 aa, Artificial Sequence
  Description of Artificial Sequence: Synthetic peptide
  Seed: SPVPGTTDGHR (PMEL_HUMAN)
  misc_feature (2)..(2): Xaa can be Ala, Val, Thr, Ile, Ser, Gly, His, Leu, Gln, Trp, Pro, Asp, Asn, Met, Glu, Tyr, Lys, Cys, or Phe
  misc_feature (11)..(11): Xaa can be Arg, Lys, Met, Leu, Tyr, Phe, Gln, His, Ile, Val, or Trp
SXVPGTTDGHX

SEQ ID NO: 143831 - protein, 8 aa, Artificial Sequence
  Description of Artificial Sequence: Synthetic peptide
  Seed: SQKRSFVY (PMEL_HUMAN)
  misc_feature (2)..(2): Xaa can be Gln, His, Met, Glu, Lys, Leu, Ala, Ile, Pro, Ser, Val, or Arg
  misc_feature (8)..(8): Xaa can be Tyr, Phe, Met, or Leu
SXKRSFVX

SEQ ID NO: 143832 - protein, 9 aa, Artificial Sequence
  Description of Artificial Sequence: Synthetic peptide
  Seed: SQKRSFVYV (PMEL_HUMAN)
  misc_feature (2)..(2): Xaa can be Met, Thr, Val, Gln, Ser, Leu, Phe, Trp, Ile, Ala, Tyr, Gly, Asn, His, Cys, Glu, Arg, Lys, Asp, or Pro
  misc_feature (9)..(9): Xaa can be Lys, Tyr, Phe, Leu, Met, Val, Ile, Ala, Arg, Ser, Thr, Gly, Cys, His, Gln, Pro, Asn, Glu, Trp, or Asp
SXKRSFVYX

SEQ ID NO: 143833 - protein, 10 aa, Artificial Sequence
  Description of Artificial Sequence: Synthetic peptide
  Seed: SQKRSFVYVW (PMEL_HUMAN)
  misc_feature (2)..(2): Xaa can be Gln, Met, Ala, Ser, Leu, Cys, Thr, Asp, Val, Gly, Ile, Glu, Asn, Trp, Arg, Lys, His, Pro, Phe, or Tyr
  misc_feature (10)..(10): Xaa can be Leu, Met, Tyr, Phe, Trp, His, Ile, Val, or Ala
SXKRSFVYVX

SEQ ID NO: 143834 - protein, 11 aa, Artificial Sequence
  Description of Artificial Sequence: Synthetic peptide
  Seed: SQKRSFVYVWK (PMEL_HUMAN)
  misc_feature (2)..(2): Xaa can be Thr, Ser, Val, Tyr, Ala, Met, Ile, Gly, Trp, Leu, Phe, Gln, Asn, Cys, or His
  misc_feature (11)..(11): Xaa can be Arg, Lys, Ala, Leu, Ile, Val, Ser, or Met
SXKRSFVYVWX

SEQ ID NO: 143835 - protein, 11 aa, Artificial Sequence
  Description of Artificial Sequence: Synthetic peptide
  Seed: SQKVLPDGQVI (PMEL_HUMAN)
  misc_feature (2)..(2): Xaa can be Gln, Leu, Met, Ile, Glu, or Val
  misc_feature (11)..(11): Xaa can be Trp, Phe, Leu, Val, Ile, Met, or Tyr
SXKVLPDGQVX

SEQ ID NO: 143836 - protein, 11 aa, Artificial Sequence
  Description of Artificial Sequence: Synthetic peptide
  Seed: SQLRALDGGNK (PMEL_HUMAN)
  misc_feature (2)..(2): Xaa can be Arg, Gly, Gln, Ala, Ile, Thr, Val, Ser, Asn, Asp, Glu, or Leu
  misc_feature (11)..(11): Xaa can be Lys, Arg, Phe, Tyr, Leu, Met, His, Glu, Trp, Ile, Val, Ala, Gln, or Asn
SXLRALDGGNX

SEQ ID NO: 143837 - protein, 9 aa, Artificial Sequence
  Description of Artificial Sequence: Synthetic peptide
  Seed: SQVWGGQPV (PMEL_HUMAN)
  misc_feature (2)..(2): Xaa can be Glu, Gln, Asp, His, Arg, Met, Leu, Val, Ile, Ala, Pro, Thr, Lys, Ser, Gly, Tyr, Phe, Asn, Cys, or Trp
  misc_feature (9)..(9): Xaa can be Tyr, Leu, Phe, Met, Ile, Val, Ala, Trp, His, Thr, Cys, Ser, Pro, Gly, Gln, Arg, Asn, Lys, Glu, or Asp
SXVWGGQPX

SEQ ID NO: 143838 - protein, 10 aa, Artificial Sequence
  Description of Artificial Sequence: Synthetic peptide
  Seed: SQVWGGQPVY (PMEL_HUMAN)
  misc_feature (2)..(2): Xaa can be Gln, Glu, Ala, Thr, Met, Ser, Lys, Val, Arg, Leu, His, Ile, Pro, Gly, Tyr, Asn, Trp, Phe, Cys, or Asp
  misc_feature (10)..(10): Xaa can be Trp, Tyr, Phe, Met, Leu, Ile, His, Lys, Val, Arg, Ala, or Cys
SXVWGGQPVX

SEQ ID NO: 143839 - protein, 11 aa, Artificial Sequence
  Description of Artificial Sequence: Synthetic peptide
  Seed: SQVWGGQPVYP (PMEL_HUMAN)
  misc_feature (2)..(2): Xaa can be Gln, Met, His, Leu, Lys, Ile, Val, Ala, Thr, Glu, Ser, or Arg
  misc_feature (11)..(11): Xaa can be Tyr, Phe, Met, Glu, His, Ser, Ala, Arg, Gly, Leu, Gln, Pro, Asn, Trp, Ile, Asp, Thr, Val, Cys, or Lys
SXVWGGQPVYX

SEQ ID NO: 143840 - protein, 9 aa, Artificial Sequence
  Description of Artificial Sequence: Synthetic peptide
  Seed: SRALVVTHT (PMEL_HUMAN)
  misc_feature (2)..(2): Xaa can be Arg, His, Gln, Lys, Pro, or Glu
  misc_feature (9)..(9): Xaa can be Ile, Ala, Leu, Val, Phe, Cys, Thr, Met, Ser, Gly, Pro, Arg, Tyr, Lys, or Trp
SXALVVTHX

SEQ ID NO: 143841 - protein, 10 aa, Artificial Sequence
  Description of Artificial Sequence: Synthetic peptide
  Seed: SRALVVTHTY (PMEL_HUMAN)
  misc_feature (2)..(2): Xaa can be Arg, Met, Glu, Gln, Ser, Thr, Ala, Lys, Phe, Tyr, His, Cys, Pro, Trp, Ile, Asp, Val, Asn, Leu, or Gly
  misc_feature (10)..(10): Xaa can be Trp, Phe, Tyr, Met, Leu, Ile, Lys, His, Arg, Cys, Val, or Ala
SXALVVTHTX

SEQ ID NO: 143842 - protein, 11 aa, Artificial Sequence
  Description of Artificial Sequence: Synthetic peptide
  Seed: SRALVVTHTYL (PMEL_HUMAN)
  misc_feature (2)..(2): Xaa can be , or Arg
  misc_feature (11)..(11): Xaa can be Arg, Trp, Ile, Met, Lys, Leu, Tyr, Val, or Phe
SXALVVTHTYX

SEQ ID NO: 143843 - protein, 9 aa, Artificial Sequence
  Description of Artificial Sequence: Synthetic peptide
  Seed: SRQLRTKAW (PMEL_HUMAN)
  misc_feature (2)..(2): Xaa can be Arg, Gln, Ala, Tyr, Phe, Ser, Lys, His, Glu, Met, Gly, Trp, Asn, Leu, Val, Thr, or Ile
  misc_feature (9)..(9): Xaa can be Met, Phe, Leu, Tyr, Ile, Val, Lys, Trp, Ala, His, Cys, or Arg
SXQLRTKAX

SEQ ID NO: 143844 - protein, 11 aa, Artificial Sequence
  Description of Artificial Sequence: Synthetic peptide
  Seed: SRQLRTKAWNR (PMEL_HUMAN)
  misc_feature (2)..(2): Xaa can be Arg, Phe, Leu, Tyr, Met, Trp, Ile, Thr, Ser, Val, Gln, Glu, Pro, Lys, Gly, His, Asp, Cys, Ala, or Asn
  misc_feature (11)..(11): Xaa can be Arg, Lys, Met, Leu, Trp, Tyr, or Phe
SXQLRTKAWNX

SEQ ID NO: 143845 - protein, 8 aa, Artificial Sequence
  Description of Artificial Sequence: Synthetic peptide
  Seed: SRSYVPLA (PMEL_HUMAN)
  misc_feature (2)..(2): Xaa can be His, or Arg
  misc_feature (8)..(8): Xaa can be Ala, Val, Phe, Leu, Cys, Met, Ile, or Thr
SXSYVPLX

SEQ ID NO: 143846 - protein, 9 aa, Artificial Sequence
  Description of Artificial Sequence: Synthetic peptide
  Seed: SRSYVPLAH (PMEL_HUMAN)
  misc_feature (2)..(2): Xaa can be Arg, Gln, Tyr, His, Ala, Phe, Lys, Trp, Thr, Val, Pro, Ser, Met, Gly, Asn, Leu, Ile, Glu, or Cys
  misc_feature (9)..(9): Xaa can be Leu, Phe, Tyr, Met, Ile, Val, Lys, Trp, Arg, Thr, Pro, Asn, Ala, Gln, Gly, Ser, Glu, Cys, or His
SXSYVPLAX

SEQ ID NO: 143847 - protein, 10 aa, Artificial Sequence
  Description of Artificial Sequence: Synthetic peptide
  Seed: SSAFTITDQV (PMEL_HUMAN)
  misc_feature (2)..(2): Xaa can be Met, Leu, Thr, Val, Gln, Ile, Ser, Ala, Phe, Tyr, Asn, Pro, Glu, Asp, Arg, His, Lys, Cys, Trp, or Gly
  misc_feature (10)..(10): Xaa can be Val, Ile, Ala, Leu, Met, Thr, or Cys
SXAFTITDQX

SEQ ID NO: 143848 - protein, 8 aa, Artificial Sequence
  Description of Artificial Sequence: Synthetic peptide
  Seed: SSGTLISR (PMEL_HUMAN)
  misc_feature (2)..(2): Xaa can be Ala, Thr, Ser, Gly, Val, Ile, Leu, Asp, Met, Gln, Phe, Asn, or Glu
  misc_feature (8)..(8): Xaa can be Lys, Leu, Arg, Tyr, Phe, Met, Val, Ile, or Trp
SXGTLISX

SEQ ID NO: 143849 - protein, 10 aa, Artificial Sequence
  Description of Artificial Sequence: Synthetic peptide
  Seed: SSGTLISRAL (PMEL_HUMAN)
  misc_feature (2)..(2): Xaa can be Ala, Thr, Ser, or Val
  misc_feature (10)..(10): Xaa can be Tyr, Phe, Met, Leu, or Trp
SXGTLISRAX

SEQ ID NO: 143850 - protein, 9 aa, Artificial Sequence
  Description of Artificial Sequence: Synthetic peptide
  Seed: SSHWLRLPR (PMEL_HUMAN)
  misc_feature (2)..(2): Xaa can be Ser, Thr, Met, Val, Ala, Tyr, Phe, Ile, Leu, Gln, Trp, Gly, Asn, Asp, Arg, Lys, Cys, His, Glu, or Pro
  misc_feature (9)..(9): Xaa can be Lys, Arg, Val, Ala, Ile, Tyr, His, Met, Ser, Leu, Gly, Thr, Asn, Pro, Gln, Phe, Glu, or Cy s
SXHWLRLPX

SEQ ID NO: 143851 - protein, 10 aa, Artificial Sequence
  Description of Artificial Sequence: Synthetic peptide
  Seed: SSHWLRLPRI (PMEL_HUMAN)
  misc_feature (2)..(2): Xaa can be Leu, Ser, Gln, Ala, Met, Phe, Val, Ile, Trp, Tyr, Thr, His, Asn, Gly, Cys, Pro, Lys, Arg, Asp, or Glu
  misc_feature (10)..(10): Xaa can be Arg, Lys, Trp, Phe, Val, Gly, Pro, Met, Ile, Asn, Ser, Tyr, Thr, Gln, Ala, Cys, Glu, Asp, His, or Leu
SXHWLRLPRX

SEQ ID NO: 143852 - protein, 11 aa, Artificial Sequence
  Description of Artificial Sequence: Synthetic peptide
  Seed: SSHWLRLPRIF (PMEL_HUMAN)
  misc_feature (2)..(2): Xaa can be Tyr, Thr, Ser, Trp, Phe, Val, Asn, Lys, Ile, Leu, Pro, Cys, Met, Asp, Ala, Gln, Arg, Gly, Glu, or His
  misc_feature (11)..(11): Xaa can be Phe, Trp, Tyr, Ile, Leu, or Met
SXHWLRLPRIX

SEQ ID NO: 143853 - protein, 9 aa, Artificial Sequence
  Description of Artificial Sequence: Synthetic peptide
  Seed: SSIMSTESI (PMEL_HUMAN)
  misc_feature (2)..(2): Xaa can be Gln, Met, Ala, Thr, Leu, Ser, Val, Ile, Asn, Gly, Glu, Pro, Lys, Arg, Asp, Phe, His, Tyr, Cys, or Trp
  misc_feature (9)..(9): Xaa can be Phe, Trp, Tyr, Met, Leu, Ile, Val, Lys, Arg, His, Ala, Cys, Thr, Gly, or Ser
SXIMSTESX

SEQ ID NO: 143854 - protein, 9 aa, Artificial Sequence
  Description of Artificial Sequence: Synthetic peptide
  Seed: SSPGCQPPA (PMEL_HUMAN)
  misc_feature (2)..(2): Xaa can be Ala, Pro, Thr, Ile, Leu, Ser, Met, Val, Gly, Gln, Asn, Phe, Trp, Cys, Tyr, Glu, Asp, Lys, His, or Arg
  misc_feature (9)..(9): Xaa can be Leu, Met, Tyr, Phe, Ile, Val, Arg, Lys, Ala, His, Cys, Thr, Trp, Pro, Gln, Ser, Gly, or Gl u
SXPGCQPPX

SEQ ID NO: 143855 - protein, 11 aa, Artificial Sequence
  Description of Artificial Sequence: Synthetic peptide
  Seed: SSPGCQPPAQR (PMEL_HUMAN)
  misc_feature (2)..(2): Xaa can be Ala, Val, Thr, Met, Gly, Ile, Ser, Leu, Phe, Cys, Gln, Glu, Asp, Pro, Asn, Tyr, or Trp
  misc_feature (11)..(11): Xaa can be Arg, Lys, Tyr, Phe, Leu, Met, His, Trp, Val, or Ile
SXPGCQPPAQX

SEQ ID NO: 143856 - protein, 11 aa, Artificial Sequence
  Description of Artificial Sequence: Synthetic peptide
  Seed: SSPVPGTTDGH (PMEL_HUMAN)
  misc_feature (2)..(2): Xaa can be Ala, Val, Thr, Ser, Ile, Gly, Met, Gln, Leu, Asn, or Glu
  misc_feature (11)..(11): Xaa can be Lys, Tyr, Phe, Met, Arg, Leu, His, Trp, or Ile
SXPVPGTTDGX

SEQ ID NO: 143857 - protein, 11 aa, Artificial Sequence
  Description of Artificial Sequence: Synthetic peptide
  Seed: SSSAFTITDQV (PMEL_HUMAN)
  misc_feature (2)..(2): Xaa can be Thr, Val, Met, Phe, Ile, Ser, or Ala
  misc_feature (11)..(11): Xaa can be Val, or Ile
SXSAFTITDQX

SEQ ID NO: 143858 - protein, 8 aa, Artificial Sequence
  Description of Artificial Sequence: Synthetic peptide
  Seed: SSSHWLRL (PMEL_HUMAN)
  misc_feature (2)..(2): Xaa can be Ala, Ser, or Thr
  misc_feature (8)..(8): Xaa can be Phe, Leu, Tyr, Met, or Ile
SXSHWLRX

SEQ ID NO: 143859 - protein, 10 aa, Artificial Sequence
  Description of Artificial Sequence: Synthetic peptide
  Seed: SSSHWLRLPR (PMEL_HUMAN)
  misc_feature (2)..(2): Xaa can be Thr, Val, Met, Tyr, Trp, Arg, Phe, Ser, Lys, Ile, Leu, Gly, Ala, Glu, Asn, Gln, Pro, His, Cys, or Asp
  misc_feature (10)..(10): Xaa can be Val, Ala, Ser, Tyr, Arg, Ile, Lys, Leu, Met, His, Thr, or Gly
SXSHWLRLPX

SEQ ID NO: 143860 - protein, 11 aa, Artificial Sequence
  Description of Artificial Sequence: Synthetic peptide
  Seed: SSSHWLRLPRI (PMEL_HUMAN)
  misc_feature (2)..(2): Xaa can be Tyr, Met, Thr, Ile, Ser, Phe, Val, Leu, Trp, Ala, Gln, Asn, Gly, Arg, Lys, His, Pro, Glu, Asp, or Cys
  misc_feature (11)..(11): Xaa can be Arg, Lys, Thr, Ser, Ile, Pro, Glu, Gln, Met, Asp, Leu, Ala, Cys, Asn, Phe, Trp, His, Val, Gly, or Tyr
SXSHWLRLPRX

SEQ ID NO: 143861 - protein, 9 aa, Artificial Sequence
  Description of Artificial Sequence: Synthetic peptide
  Seed: STAPVQMPT (PMEL_HUMAN)
  misc_feature (2)..(2): Xaa can be Thr, Leu, Met, Val, Gln, Ile, Ser, Ala, Asn, Cys, Pro, Phe, Gly, Glu, Tyr, or Asp
  misc_feature (9)..(9): Xaa can be Val, Ile, Leu, Ala, Thr, Met, Cys, Phe, Ser, or Gly
SXAPVQMPX

SEQ ID NO: 143862 - protein, 10 aa, Artificial Sequence
  Description of Artificial Sequence: Synthetic peptide
  Seed: STAPVQMPTA (PMEL_HUMAN)
  misc_feature (2)..(2): Xaa can be Met, Leu, Gln, Val, Thr, Ile, Ala, Ser, Phe, Cys, Gly, Tyr, or Asn
  misc_feature (10)..(10): Xaa can be Val, Lys, Leu, Ala, Ile, Thr, Met, Phe, Pro, Gly, Ser, or Cys
SXAPVQMPTX

SEQ ID NO: 143863 - protein, 9 aa, Artificial Sequence
  Description of Artificial Sequence: Synthetic peptide
  Seed: STESITGSL (PMEL_HUMAN)
  misc_feature (2)..(2): Xaa can be Thr, Ala, Leu, Met, Ile, Gln, Gly, Ser, Phe, Tyr, Val, Cys, Trp, Asn, Glu, Pro, His, Arg, Asp, or Lys
  misc_feature (9)..(9): Xaa can be Leu, Met, Lys, Tyr, Phe, Trp, Arg, Ile, Val, His, Ala, or Cys
SXESITGSX

SEQ ID NO: 143864 - protein, 9 aa, Artificial Sequence
  Description of Artificial Sequence: Synthetic peptide
  Seed: STGMTPEKV (PMEL_HUMAN)
  misc_feature (2)..(2): Xaa can be Thr, Ala, Ser, Ile, Val, Leu, Gly, Met, Phe, Gln, or Tyr
  misc_feature (9)..(9): Xaa can be Tyr, Leu, Phe, Met, Val, Ile, Arg, Lys, or Trp
SXGMTPEKX

SEQ ID NO: 143865 - protein, 8 aa, Artificial Sequence
  Description of Artificial Sequence: Synthetic peptide
  Seed: STPEATGM (PMEL_HUMAN)
  misc_feature (2)..(2): Xaa can be Ala, Val, Ile, Gly, Ser, Thr, Phe, Leu, Met, Gln, Cys, Asn, Pro, Trp, or Tyr
  misc_feature (8)..(8): Xaa can be Leu, Tyr, Met, Ile, Phe, Val, Lys, Arg, Trp, or His
SXPEATGX

SEQ ID NO: 143866 - protein, 11 aa, Artificial Sequence
  Description of Artificial Sequence: Synthetic peptide
  Seed: STPEATGMTPA (PMEL_HUMAN)
  misc_feature (2)..(2): Xaa can be Gly, His, Asn, Val, Cys, Lys, Glu, Asp, Ala, Tyr, Ile, Ser, Trp, Phe, Leu, Pro, Thr, Gln, Arg, or Met
  misc_feature (11)..(11): Xaa can be , or Ala
SXPEATGMTPX

SEQ ID NO: 143867 - protein, 9 aa, Artificial Sequence
  Description of Artificial Sequence: Synthetic peptide
  Seed: SVPQLPHSS (PMEL_HUMAN)
  misc_feature (2)..(2): Xaa can be Ala, Ile, Ser, Val, Leu, Met, Thr, Phe, Cys, Gly, Tyr, Gln, Pro, Trp, Asn, Arg, His, Asp, Glu, or Lys
  misc_feature (9)..(9): Xaa can be Leu, Met, Ile, Phe, Val, Tyr, Cys, Ala, Thr, Trp, Ser, Lys, Gln, Pro, His, Gly, or Arg
SXPQLPHSX

SEQ ID NO: 143868 - protein, 10 aa, Artificial Sequence
  Description of Artificial Sequence: Synthetic peptide
  Seed: SVPQLPHSSS (PMEL_HUMAN)
  misc_feature (2)..(2): Xaa can be Arg, Pro, Met, Phe, Val, Gln, Tyr, His, Gly, Ser, Trp, Thr, Asn, Asp, Cys, Lys, Glu, Ala, Leu, or Ile
  misc_feature (10)..(10): Xaa can be Thr, Ser, Leu, Met, Cys, Ile, Ala, Val, Phe, Gly, or Tyr
SXPQLPHSSX

SEQ ID NO: 143869 - protein, 11 aa, Artificial Sequence
  Description of Artificial Sequence: Synthetic peptide
  Seed: SVPQLPHSSSH (PMEL_HUMAN)
  misc_feature (2)..(2): Xaa can be Ala, Val, Ile, Thr, Ser, Met, Gly, Gln, Leu, Cys, or Glu
  misc_feature (11)..(11): Xaa can be Tyr, Phe, Met, His, Leu, Trp, Lys, or Ile
SXPQLPHSSSX

SEQ ID NO: 143870 - protein, 9 aa, Artificial Sequence
  Description of Artificial Sequence: Synthetic peptide
  Seed: SVQVPTTEV (PMEL_HUMAN)
  misc_feature (2)..(2): Xaa can be Pro, Ala, Ser, Val, Gln, Thr, Leu, Ile, Phe, Met, Tyr, Gly, Cys, Glu, Arg, Asn, Asp, His, Trp, or Lys
  misc_feature (9)..(9): Xaa can be Met, Val, Ile, Tyr, Phe, Leu, Lys, Arg, Trp, His, Ala, Cys, Thr, Gln, Gly, Pro, Ser, Asn, or Glu
SXQVPTTEX

SEQ ID NO: 143871 - protein, 8 aa, Artificial Sequence
  Description of Artificial Sequence: Synthetic peptide
  Seed: SVSQLRAL (PMEL_HUMAN)
  misc_feature (2)..(2): Xaa can be Ala, Ser, Thr, Val, Ile, Gly, Gln, Met, Leu, or Phe
  misc_feature (8)..(8): Xaa can be Tyr, Leu, Phe, Met, Ile, Val, or His
SXSQLRAX

SEQ ID NO: 143872 - protein, 8 aa, Artificial Sequence
  Description of Artificial Sequence: Synthetic peptide
  Seed: SVSVSQLR (PMEL_HUMAN)
  misc_feature (2)..(2): Xaa can be Ala, Thr, Ser, Ile, Val, Gly, or Leu
  misc_feature (8)..(8): Xaa can be Lys, Arg, Leu, or Met
SXSVSQLX

SEQ ID NO: 143873 - protein, 10 aa, Artificial Sequence
  Description of Artificial Sequence: Synthetic peptide
  Seed: SVSVSQLRAL (PMEL_HUMAN)
  misc_feature (2)..(2): Xaa can be Ala, Val, Ser, Ile, Thr, Met, Leu, Gln, Glu, or Gly
  misc_feature (10)..(10): Xaa can be Tyr, Phe, Leu, Met, or His
SXSVSQLRAX

SEQ ID NO: 143874 - protein, 10 aa, Artificial Sequence
  Description of Artificial Sequence: Synthetic peptide
  Seed: SVTLDIVQGI (PMEL_HUMAN)
  misc_feature (2)..(2): Xaa can be Met, Leu, Thr, Gln, Val, Ala, Arg, Ile, Gly, Tyr, Cys, His, Trp, Asp, Lys, Glu, Asn, Ser, Phe, or Pro
  misc_feature (10)..(10): Xaa can be Leu, Ala, Ile, Val, Met, Thr, or Cys
SXTLDIVQGX

SEQ ID NO: 143875 - protein, 8 aa, Artificial Sequence
  Description of Artificial Sequence: Synthetic peptide
  Seed: SWSQKRSF (PMEL_HUMAN)
  misc_feature (2)..(2): Xaa can be Tyr, Phe, or Trp
  misc_feature (8)..(8): Xaa can be Phe, Tyr, Leu, Met, Ile, or Val
SXSQKRSX

SEQ ID NO: 143876 - protein, 10 aa, Artificial Sequence
  Description of Artificial Sequence: Synthetic peptide
  Seed: SWSQKRSFVY (PMEL_HUMAN)
  misc_feature (2)..(2): Xaa can be Thr, Ser, Gln, Val, Gly, Lys, Phe, Asn, Arg, His, Trp, Cys, Asp, Met, Leu, Tyr, Ile, Pro, Ala, or Glu
  misc_feature (10)..(10): Xaa can be Phe, Tyr, Trp, or Met
SXSQKRSFVX

SEQ ID NO: 143877 - protein, 9 aa, Artificial Sequence
  Description of Artificial Sequence: Synthetic peptide
  Seed: SYVPLAHSS (PMEL_HUMAN)
  misc_feature (2)..(2): Xaa can be Tyr, Phe, Trp, Met, Ala, Leu, His, Ile, Arg, Gln, Ser, Gly, Val, Thr, Asn, Pro, or Cys
  misc_feature (9)..(9): Xaa can be Phe, Met, Leu, Tyr, Ile, Val, Cys, His, Ala, Trp, Arg, Thr, Gln, Ser, or Lys
SXVPLAHSX

SEQ ID NO: 143878 - protein, 11 aa, Artificial Sequence
  Description of Artificial Sequence: Synthetic peptide
  Seed: SYVPLAHSSSA (PMEL_HUMAN)
  misc_feature (2)..(2): Xaa can be Pro, Thr, Ala, Val, Gln, Cys, Arg, Glu, Lys, Ser, Asn, Ile, His, Tyr, Phe, Leu, Gly, Asp, Trp, or Met
  misc_feature (11)..(11): Xaa can be Val, Leu, Ile, Phe, Ala, Met, Thr, or Cys
SXVPLAHSSSX

SEQ ID NO: 143879 - protein, 10 aa, Artificial Sequence
  Description of Artificial Sequence: Synthetic peptide
  Seed: TAAQVTTTEW (PMEL_HUMAN)
  misc_feature (2)..(2): Xaa can be Ala, Leu, Met, Gln, Thr, Ile, Ser, Val, Gly, Pro, Asn, Glu, Tyr, Phe, Cys, Asp, Lys, Arg, His, or Trp
  misc_feature (10)..(10): Xaa can be Trp, Tyr, Phe, Lys, Leu, Met, Arg, His, Ile, Val, or Ala
TXAQVTTTEX

SEQ ID NO: 143880 - protein, 9 aa, Artificial Sequence
  Description of Artificial Sequence: Synthetic peptide
  Seed: TAEAPNTTA (PMEL_HUMAN)
  misc_feature (2)..(2): Xaa can be Pro, Ala, Ser, Val, Ile, Thr, Leu, Phe, Gln, Met, Gly, Asn, Asp, Cys, Tyr, Trp, or Glu
  misc_feature (9)..(9): Xaa can be Tyr, Phe, Lys, Leu, Met, Val, Ile, Arg, His, Cys, Trp, Ala, Thr, Gly, Ser, or Pro
TXEAPNTTX

SEQ ID NO: 143881 - protein, 10 aa, Artificial Sequence
  Description of Artificial Sequence: Synthetic peptide
  Seed: TAEPSGTTSV (PMEL_HUMAN)
  misc_feature (2)..(2): Xaa can be Ala, Thr, Ser, Val, Ile, Met, Leu, Phe, Gln, Tyr, Gly, Cys, Asn, Trp, Pro, Glu, Arg, Lys, Asp, or His
  misc_feature (10)..(10): Xaa can be Leu, Met, Phe, Tyr, Lys, Ile, Val, Arg, Trp, His, Cys, or Ala
TXEPSGTTSX

SEQ ID NO: 143882 - protein, 11 aa, Artificial Sequence
  Description of Artificial Sequence: Synthetic peptide
  Seed: TAESTGMTPEK (PMEL_HUMAN)
  misc_feature (2)..(2): Xaa can be Thr, Val, Ala, or Ile
  misc_feature (11)..(11): Xaa can be Lys, or Arg
TXESTGMTPEX

SEQ ID NO: 143883 - protein, 10 aa, Artificial Sequence
  Description of Artificial Sequence: Synthetic peptide
  Seed: TAGQVPTTEV (PMEL_HUMAN)
  misc_feature (2)..(2): Xaa can be Ala, Val, Ser, Ile, Met, Thr, Gln, Leu, Gly, Glu, Cys, Asn, or Phe
  misc_feature (10)..(10): Xaa can be Tyr, Phe, Lys, Met, Leu, His, Arg, Ile, Val, or Trp
TXGQVPTTEX

SEQ ID NO: 143884 - protein, 9 aa, Artificial Sequence
  Description of Artificial Sequence: Synthetic peptide
  Seed: TAPVQMPTA (PMEL_HUMAN)
  misc_feature (2)..(2): Xaa can be Ala, Pro, Val, Ser, Thr, Ile, Gln, Tyr, Arg, Met, Glu, Gly, Cys, Asn, Leu, Phe, Trp, Asp, His, or Lys
  misc_feature (9)..(9): Xaa can be Ile, Leu, Met, Val, Phe, Tyr, Cys, Ala, His, Trp, Thr, Pro, Gly, Arg, Lys, or Ser
TXPVQMPTX

SEQ ID NO: 143885 - protein, 9 aa, Artificial Sequence
  Description of Artificial Sequence: Synthetic peptide
  Seed: TAQVVLQAA (PMEL_HUMAN)
  misc_feature (2)..(2): Xaa can be Pro, Gln, Ala, His, Ser, Gly, Ile, Arg, Val, Thr, Asn, Glu, Leu, Met, Lys, Cys, Phe, Asp, or Tyr
  misc_feature (9)..(9): Xaa can be Tyr, Leu, Phe, Met, Lys, Val, Ile, Ala, Arg, His, Cys, Thr, Pro, Trp, Gly, Ser, or Gln
TXQVVLQAX

SEQ ID NO: 143886 - protein, 9 aa, Artificial Sequence
  Description of Artificial Sequence: Synthetic peptide
  Seed: TATLRLVKR (PMEL_HUMAN)
  misc_feature (2)..(2): Xaa can be Ala, Val, Thr, Met, Leu, Gly, Phe, Asn, Asp, Glu, Gln, Pro, Ile, Tyr, Ser, Cys, His, or Tr p
  misc_feature (9)..(9): Xaa can be Arg, Lys, Tyr, His, or Leu
TXTLRLVKX

SEQ ID NO: 143887 - protein, 8 aa, Artificial Sequence
  Description of Artificial Sequence: Synthetic peptide
  Seed: TDQVPFSV (PMEL_HUMAN)
  misc_feature (2)..(2): Xaa can be Glu, Asp, or Gln
  misc_feature (8)..(8): Xaa can be Phe, Leu, Met, Ile, Ala, Val, Tyr, Pro, Trp, Cys, Thr, Ser, or Gly
TXQVPFSX

SEQ ID NO: 143888 - protein, 9 aa, Artificial Sequence
  Description of Artificial Sequence: Synthetic peptide
  Seed: TDQVPFSVS (PMEL_HUMAN)
  misc_feature (2)..(2): Xaa can be Glu, Asp, or Gln
  misc_feature (9)..(9): Xaa can be Cys, Pro, Val, Ala, Ile, Leu, Met, Phe, Ser, Thr, Lys, Asp, Gln, Arg, Trp, Glu, Tyr, Gly, or Asn
TXQVPFSVX

SEQ ID NO: 143889 - protein, 10 aa, Artificial Sequence
  Description of Artificial Sequence: Synthetic peptide
  Seed: TDQVPFSVSV (PMEL_HUMAN)
  misc_feature (2)..(2): Xaa can be Leu, Met, Tyr, Phe, Trp, Arg, Val, Ile, Pro, His, Gly, Cys, Thr, Asp, Ser, Glu, Ala, Asn, Gln, or Lys
  misc_feature (10)..(10): Xaa can be Ile, Leu, Val, Ala, Met, or Thr
TXQVPFSVSX

SEQ ID NO: 143890 - protein, 9 aa, Artificial Sequence
  Description of Artificial Sequence: Synthetic peptide
  Seed: TEAQRLDCW (PMEL_HUMAN)
  misc_feature (2)..(2): Xaa can be Glu, Gln, Asp, Ser, Thr, Ala, Gly, Leu, Trp, Pro, Cys, Phe, Met, Ile, Val, or Asn
  misc_feature (9)..(9): Xaa can be Trp, Phe, Met, Leu, Ile, Tyr, Val, Pro, Ala, Thr, or Cys
TXAQRLDCX

SEQ ID NO: 143891 - protein, 8 aa, Artificial Sequence
  Description of Artificial Sequence: Synthetic peptide
  Seed: TESITGSL (PMEL_HUMAN)
  misc_feature (2)..(2): Xaa can be Glu, or Asp
  misc_feature (8)..(8): Xaa can be Leu, Met, Ile, Phe, Ala, Tyr, Cys, or Val
TXSITGSX

SEQ ID NO: 143892 - protein, 9 aa, Artificial Sequence
  Description of Artificial Sequence: Synthetic peptide
  Seed: TESITGSLG (PMEL_HUMAN)
  misc_feature (2)..(2): Xaa can be Glu, Asp, or Gln
  misc_feature (9)..(9): Xaa can be Ala, Val, Pro, Leu, Cys, Ile, Met, Thr, Tyr, Phe, Gly, or Ser
TXSITGSLX

SEQ ID NO: 143893 - protein, 10 aa, Artificial Sequence
  Description of Artificial Sequence: Synthetic peptide
  Seed: TESITGSLGP (PMEL_HUMAN)
  misc_feature (2)..(2): Xaa can be , or Glu
  misc_feature (10)..(10): Xaa can be Cys, Gly, Ser, Leu, Ala, Met, Phe, Ile, Pro, Val, or Thr
TXSITGSLGX

SEQ ID NO: 143894 - protein, 11 aa, Artificial Sequence
  Description of Artificial Sequence: Synthetic peptide
  Seed: TESITGSLGPL (PMEL_HUMAN)
  misc_feature (2)..(2): Xaa can be , or Glu
  misc_feature (11)..(11): Xaa can be Phe, Thr, Ile, Met, Pro, Val, Trp, Ala, Leu, or Cys
TXSITGSLGPX

SEQ ID NO: 143895 - protein, 8 aa, Artificial Sequence
  Description of Artificial Sequence: Synthetic peptide
  Seed: TEVISTAP (PMEL_HUMAN)
  misc_feature (2)..(2): Xaa can be Glu, or Asp
  misc_feature (8)..(8): Xaa can be Val, Ala, Leu, Ile, Thr, Ser, Met, Pro, Cys, Phe, Tyr, or Gly
TXVISTAX

SEQ ID NO: 143896 - protein, 9 aa, Artificial Sequence
  Description of Artificial Sequence: Synthetic peptide
  Seed: TEVISTAPV (PMEL_HUMAN)
  misc_feature (2)..(2): Xaa can be Glu, Asp, Gln, Ala, Ser, Met, or Leu
  misc_feature (9)..(9): Xaa can be Ile, Val, Leu, Tyr, Phe, Ala, Met, Cys, Pro, Gly, His, Thr, Trp, or Ser
TXVISTAPX

SEQ ID NO: 143897 - protein, 11 aa, Artificial Sequence
  Description of Artificial Sequence: Synthetic peptide
  Seed: TEVISTAPVQM (PMEL_HUMAN)
  misc_feature (2)..(2): Xaa can be Glu, Asp, or Gln
  misc_feature (11)..(11): Xaa can be Trp, Leu, Tyr, Phe, Ser, Gly, Ala, Thr, Val, Cys, Pro, Met, or Ile
TXVISTAPVQX

SEQ ID NO: 143898 - protein, 8 aa, Artificial Sequence
  Description of Artificial Sequence: Synthetic peptide
  Seed: TEVVGTTP (PMEL_HUMAN)
  misc_feature (2)..(2): Xaa can be Glu, Asp, or Gln
  misc_feature (8)..(8): Xaa can be Ile, Val, Leu, Phe, Ala, Met, Cys, Pro, Tyr, Thr, Gly, Trp, or Ser
TXVVGTTX

SEQ ID NO: 143899 - protein, 9 aa, Artificial Sequence
  Description of Artificial Sequence: Synthetic peptide
  Seed: TEVVGTTPG (PMEL_HUMAN)
  misc_feature (2)..(2): Xaa can be Glu, Asp, or Gln
  misc_feature (9)..(9): Xaa can be Val, Met, Leu, Cys, Ala, Ile, Pro, Phe, Thr, Tyr, Trp, Asp, Gln, Glu, Ser, or Gly
TXVVGTTPX

SEQ ID NO: 143900 - protein, 11 aa, Artificial Sequence
  Description of Artificial Sequence: Synthetic peptide
  Seed: TEVVGTTPGQA (PMEL_HUMAN)
  misc_feature (2)..(2): Xaa can be , or Glu
  misc_feature (11)..(11): Xaa can be Cys, Ala, Leu, Val, Thr, Met, Ile, Phe, or Pro
TXVVGTTPGQX

SEQ ID NO: 143901 - protein, 8 aa, Artificial Sequence
  Description of Artificial Sequence: Synthetic peptide
  Seed: TEWVETTA (PMEL_HUMAN)
  misc_feature (2)..(2): Xaa can be Glu, Asp, or Gln
  misc_feature (8)..(8): Xaa can be Leu, Tyr, Phe, Ala, Ile, Val, Met, Gly, His, Cys, Pro, Trp, Ser, or Thr
TXWVETTX

SEQ ID NO: 143902 - protein, 9 aa, Artificial Sequence
  Description of Artificial Sequence: Synthetic peptide
  Seed: TEWVETTAR (PMEL_HUMAN)
  misc_feature (2)..(2): Xaa can be Glu, Asp, Gln, Ala, Val, Thr, Ser, Ile, Tyr, Phe, His, Arg, Met, Cys, Gly, Trp, Asn, Pro, or Leu
  misc_feature (9)..(9): Xaa can be Arg, Lys, Tyr, Phe, Leu, Pro, Trp, Ala, Ile, Val, Cys, Met, Thr, Ser, Gln, His, Glu, Asn, Gly, or Asp
TXWVETTAX

SEQ ID NO: 143903 - protein, 11 aa, Artificial Sequence
  Description of Artificial Sequence: Synthetic peptide
  Seed: TEWVETTAREL (PMEL_HUMAN)
  misc_feature (2)..(2): Xaa can be Glu, Asp, or Gln
  misc_feature (11)..(11): Xaa can be Tyr, Phe, Trp, Leu, Met, Val, Ile, Ser, Ala, Thr, Cys, Pro, or His
TXWVETTAREX

SEQ ID NO: 143904 - protein, 8 aa, Artificial Sequence
  Description of Artificial Sequence: Synthetic peptide
  Seed: TGMTPAEV (PMEL_HUMAN)
  misc_feature (2)..(2): Xaa can be Gln, Met, Glu, Ala, Gly, Leu, Ser, Ile, Val, Thr, or Asn
  misc_feature (8)..(8): Xaa can be Ile, Val, Leu, Met, or Phe
TXMTPAEX

SEQ ID NO: 143905 - protein, 10 aa, Artificial Sequence
  Description of Artificial Sequence: Synthetic peptide
  Seed: TGMTPAEVSI (PMEL_HUMAN)
  misc_feature (2)..(2): Xaa can be Met, Phe, Leu, Tyr, Cys, Ser, Asp, Gly, Lys, His, Trp, Asn, Ala, Glu, Ile, Arg, Val, Gln, Thr, or Pro
  misc_feature (10)..(10): Xaa can be Val, Leu, Ile, Met, or Ala
TXMTPAEVSX

SEQ ID NO: 143906 - protein, 8 aa, Artificial Sequence
  Description of Artificial Sequence: Synthetic peptide
  Seed: TGMTPEKV (PMEL_HUMAN)
  misc_feature (2)..(2): Xaa can be Gln, Leu, Met, Glu, Ala, Ser, Gly, Val, Ile, Asn, or Thr
  misc_feature (8)..(8): Xaa can be Ile, Val, Leu, Phe, or Met
TXMTPEKX

SEQ ID NO: 143907 - protein, 9 aa, Artificial Sequence
  Description of Artificial Sequence: Synthetic peptide
  Seed: TGRAMLGTH (PMEL_HUMAN)
  misc_feature (2)..(2): Xaa can be Ala, Val, Ser, Leu, Ile, Thr, Met, Gly, Gln, Glu, Asn, Cys, Phe, or Asp
  misc_feature (9)..(9): Xaa can be Tyr, Phe, Leu, His, Met, Val, Ile, Trp, or Ala
TXRAMLGTX

SEQ ID NO: 143908 - protein, 8 aa, Artificial Sequence
  Description of Artificial Sequence: Synthetic peptide
  Seed: TGSLGPLL (PMEL_HUMAN)
  misc_feature (2)..(2): Xaa can be Ala, Ile, Val, Ser, Thr, Gly, Gln, Phe, Arg, Asn, Glu, Met, Leu, His, Asp, Cys, Tyr, or Pr o
  misc_feature (8)..(8): Xaa can be Leu, Ile, Val, Met, Tyr, Phe, Trp, or His
TXSLGPLX

SEQ ID NO: 143909 - protein, 8 aa, Artificial Sequence
  Description of Artificial Sequence: Synthetic peptide
  Seed: THTMEVTV (PMEL_HUMAN)
  misc_feature (2)..(2): Xaa can be His, or Arg
  misc_feature (8)..(8): Xaa can be Leu, Phe, Met, Ile, Ala, or Val
TXTMEVTX

SEQ ID NO: 143910 - protein, 9 aa, Artificial Sequence
  Description of Artificial Sequence: Synthetic peptide
  Seed: THTMEVTVY (PMEL_HUMAN)
  misc_feature (2)..(2): Xaa can be Arg, His, Gln, Tyr, Met, Lys, Glu, Phe, Trp, Val, Ala, Leu, Thr, Gly, Ser, Ile, Pro, Asn, Asp, or Cys
  misc_feature (9)..(9): Xaa can be Tyr, Phe, Met, Leu, Ile, Trp, Val, His, Lys, Ala, Arg, or Cys
TXTMEVTVX

SEQ ID NO: 143911 - protein, 10 aa, Artificial Sequence
  Description of Artificial Sequence: Synthetic peptide
  Seed: THTMEVTVYH (PMEL_HUMAN)
  misc_feature (2)..(2): Xaa can be Met, Leu, Cys, Pro, Ala, Phe, Gln, Ile, Trp, Arg, Asn, Ser, Thr, Tyr, Val, Gly, Lys, Asp, Glu, or His
  misc_feature (10)..(10): Xaa can be Ser, Tyr, Ala, His, Lys, Arg, Glu, Gln, Met, Phe, or Val
TXTMEVTVYX

SEQ ID NO: 143912 - protein, 11 aa, Artificial Sequence
  Description of Artificial Sequence: Synthetic peptide
  Seed: THTMEVTVYHR (PMEL_HUMAN)
  misc_feature (2)..(2): Xaa can be Met, Asp, Glu, His, Trp, Tyr, Ser, Arg, Gln, Cys, Lys, Leu, Ile, Asn, Thr, Phe, Val, Gly, or Ala
  misc_feature (11)..(11): Xaa can be Arg, Lys, or Tyr
TXTMEVTVYHX

SEQ ID NO: 143913 - protein, 9 aa, Artificial Sequence
  Description of Artificial Sequence: Synthetic peptide
  Seed: THTYLEPGP (PMEL_HUMAN)
  misc_feature (2)..(2): Xaa can be His, Arg, or Gln
  misc_feature (9)..(9): Xaa can be Val, Ala, Cys, Ile, Leu, Thr, Met, or Pro
TXTYLEPGX

SEQ ID NO: 143914 - protein, 10 aa, Artificial Sequence
  Description of Artificial Sequence: Synthetic peptide
  Seed: THTYLEPGPV (PMEL_HUMAN)
  misc_feature (2)..(2): Xaa can be Thr, Val, Asp, Gln, Lys, Phe, Tyr, Gly, Asn, Met, Ser, His, Ile, Glu, Ala, Leu, Trp, Arg, Pro, or Cys
  misc_feature (10)..(10): Xaa can be Val, Ile, Ala, or Leu
TXTYLEPGPX

SEQ ID NO: 143915 - protein, 9 aa, Artificial Sequence
  Description of Artificial Sequence: Synthetic peptide
  Seed: TIINGSQVW (PMEL_HUMAN)
  misc_feature (2)..(2): Xaa can be Ala, Thr, Ser, Ile, Val, Gly, Leu, Gln, Met, Phe, Asn, Glu, Pro, Tyr, Asp, Cys, Trp, Lys, His, or Arg
  misc_feature (9)..(9): Xaa can be Phe, Tyr, Trp, Lys, Met, Leu, Arg, Ile, Val, His, Ala, Ser, Cys, Thr, or Gln
TXINGSQVX

SEQ ID NO: 143916 - protein, 10 aa, Artificial Sequence
  Description of Artificial Sequence: Synthetic peptide
  Seed: TITDQVPFSV (PMEL_HUMAN)
  misc_feature (2)..(2): Xaa can be Leu, Met, Ile, Val, Thr, Gln, Ser, Tyr, Phe, or Ala
  misc_feature (10)..(10): Xaa can be Val, Leu, Ile, Ala, Met, Thr, or Phe
TXTDQVPFSX

SEQ ID NO: 143917 - protein, 9 aa, Artificial Sequence
  Description of Artificial Sequence: Synthetic peptide
  Seed: TKAWNRQLY (PMEL_HUMAN)
  misc_feature (2)..(2): Xaa can be Gln, Met, His, Lys, Arg, Ala, Val, Leu, Thr, Ile, Glu, Ser, Phe, Asn, Pro, Gly, or Tyr
  misc_feature (9)..(9): Xaa can be Tyr, Phe, Met, Leu, Ile, Trp, or His
TXAWNRQLX

SEQ ID NO: 143918 - protein, 10 aa, Artificial Sequence
  Description of Artificial Sequence: Synthetic peptide
  Seed: TLAEMSTPEA (PMEL_HUMAN)
  misc_feature (2)..(2): Xaa can be Met, Leu, Ile, Val, Gln, Thr, Ala, or Ser
  misc_feature (10)..(10): Xaa can be Val, Ile, Leu, Ala, Met, Phe, Cys, or Thr
TXAEMSTPEX

SEQ ID NO: 143919 - protein, 8 aa, Artificial Sequence
  Description of Artificial Sequence: Synthetic peptide
  Seed: TLDIVQGI (PMEL_HUMAN)
  misc_feature (2)..(2): Xaa can be Tyr, Ala, Phe, Val, Trp, Ile, Ser, Thr, Leu, Cys, Gly, Gln, Asn, Met, Pro, His, Arg, Asp, or Glu
  misc_feature (8)..(8): Xaa can be Leu, Met, Phe, Ile, Val, Tyr, or Trp
TXDIVQGX

SEQ ID NO: 143920 - protein, 11 aa, Artificial Sequence
  Description of Artificial Sequence: Synthetic peptide
  Seed: TLDIVQGIESA (PMEL_HUMAN)
  misc_feature (2)..(2): Xaa can be Leu, Met, Ile, Val, or Gln
  misc_feature (11)..(11): Xaa can be Leu, Ile, Met, Val, Phe, or Ala
TXDIVQGIESX

SEQ ID NO: 143921 - protein, 9 aa, Artificial Sequence
  Description of Artificial Sequence: Synthetic peptide
  Seed: TLIGANASF (PMEL_HUMAN)
  misc_feature (2)..(2): Xaa can be Ala, Gln, Met, Tyr, Pro, Phe, Arg, Ser, Leu, His, Val, Thr, Ile, Trp, Gly, Cys, Asn, Glu, Lys, or Asp
  misc_feature (9)..(9): Xaa can be Met, Tyr, Phe, Leu, Trp, Val, Arg, Lys, Ile, His, Ala, Cys, Thr, Pro, Gly, Ser, or Gln
TXIGANASX

SEQ ID NO: 143922 - protein, 11 aa, Artificial Sequence
  Description of Artificial Sequence: Synthetic peptide
  Seed: TLIGANASFSI (PMEL_HUMAN)
  misc_feature (2)..(2): Xaa can be Gln, Leu, Met, Val, Ile, Glu, Thr, Phe, Ala, or Tyr
  misc_feature (11)..(11): Xaa can be Trp, Val, Leu, Phe, Ile, Met, Ala, or Tyr
TXIGANASFSX

SEQ ID NO: 143923 - protein, 9 aa, Artificial Sequence
  Description of Artificial Sequence: Synthetic peptide
  Seed: TLISRALVV (PMEL_HUMAN)
  misc_feature (2)..(2): Xaa can be Leu, Met, Ala, Gln, Ser, Thr, Ile, Val, Phe, Arg, Gly, Pro, Glu, Tyr, Asn, Asp, Trp, Lys, Cys, or His
  misc_feature (9)..(9): Xaa can be Val, Leu, Met, Tyr, Ile, Phe, Trp, Lys, Arg, Ala, Cys, His, or Thr
TXISRALVX

SEQ ID NO: 143924 - protein, 10 aa, Artificial Sequence
  Description of Artificial Sequence: Synthetic peptide
  Seed: TLISRALVVT (PMEL_HUMAN)
  misc_feature (2)..(2): Xaa can be Met, Leu, Val, Ile, Thr, Gln, Tyr, Phe, Lys, Gly, His, Ala, Arg, Asp, Pro, Glu, Ser, Cys, Asn, or Trp
  misc_feature (10)..(10): Xaa can be Val, Leu, Ala, Ile, Met, Phe, Ser, Gly, Thr, Pro, or Cys
TXISRALVVX

SEQ ID NO: 143925 - protein, 9 aa, Artificial Sequence
  Description of Artificial Sequence: Synthetic peptide
  Seed: TLRLVKRQV (PMEL_HUMAN)
  misc_feature (2)..(2): Xaa can be Pro, Leu, Met, Ala, Ile, Gln, Val, Thr, Asn, Gly, Phe, Asp, Glu, or Ser
  misc_feature (9)..(9): Xaa can be Leu, Met, Ile, Val, or Phe
TXRLVKRQX

SEQ ID NO: 143926 - protein, 11 aa, Artificial Sequence
  Description of Artificial Sequence: Synthetic peptide
  Seed: TLRLVKRQVPL (PMEL_HUMAN)
  misc_feature (2)..(2): Xaa can be Met, Pro, Leu, or Ile
  misc_feature (11)..(11): Xaa can be Leu, Met, Ile, Val, or Phe
TXRLVKRQVPX

SEQ ID NO: 143927 - protein, 9 aa, Artificial Sequence
  Description of Artificial Sequence: Synthetic peptide
  Seed: TMEVTVYHR (PMEL_HUMAN)
  misc_feature (2)..(2): Xaa can be Thr, Ser, Val, Ala, Ile, Gly, Met, Asn, Asp, Gln, Tyr, Trp, Leu, Phe, Glu, Cys, His, or Pr o
  misc_feature (9)..(9): Xaa can be Arg, Tyr, Lys, Phe, Met, His, Leu, or Trp
TXEVTVYHX

SEQ ID NO: 143928 - protein, 10 aa, Artificial Sequence
  Description of Artificial Sequence: Synthetic peptide
  Seed: TMEVTVYHRR (PMEL_HUMAN)
  misc_feature (2)..(2): Xaa can be Ile, Phe, Val, Ser, Ala, Leu, Met, Thr, Tyr, Gln, Trp, Gly, or Asn
  misc_feature (10)..(10): Xaa can be Arg, or Lys
TXEVTVYHRX

SEQ ID NO: 143929 - protein, 11 aa, Artificial Sequence
  Description of Artificial Sequence: Synthetic peptide
  Seed: TNSLAVVSTQL (PMEL_HUMAN)
  misc_feature (2)..(2): Xaa can be Phe, Tyr, Met, Asn, Gln, Thr, Glu, Ile, Asp, Cys, His, Pro, Trp, Arg, Ala, Val, Lys, Ser, Leu, or Gly
  misc_feature (11)..(11): Xaa can be Leu, Val, or Ile
TXSLAVVSTQX

SEQ ID NO: 143930 - protein, 8 aa, Artificial Sequence
  Description of Artificial Sequence: Synthetic peptide
  Seed: TPAEVSIV (PMEL_HUMAN)
  misc_feature (2)..(2): Xaa can be Pro, Glu, Ala, Gln, or Ser
  misc_feature (8)..(8): Xaa can be Ile, Val, Leu, Ala, Pro, Thr, Phe, or Met
TXAEVSIX

SEQ ID NO: 143931 - protein, 9 aa, Artificial Sequence
  Description of Artificial Sequence: Synthetic peptide
  Seed: TPAEVSIVV (PMEL_HUMAN)
  misc_feature (2)..(2): Xaa can be Pro, His, Ala, Val, Gln, Arg, Ser, Thr, Ile, Met, Gly, Lys, Leu, Glu, Cys, Phe, Asn, Asp, Tyr, or Trp
  misc_feature (9)..(9): Xaa can be Tyr, Leu, Val, Ile, Met, Trp, Phe, Ala, Thr, Cys, Ser, Pro, His, Gly, Gln, Arg, Asn, Lys, or Glu
TXAEVSIVX

SEQ ID NO: 143932 - protein, 10 aa, Artificial Sequence
  Description of Artificial Sequence: Synthetic peptide
  Seed: TPAEVSIVVL (PMEL_HUMAN)
  misc_feature (2)..(2): Xaa can be Pro, Ala, Ser, Met, Val, Thr, Ile, Gly, Leu, Cys, Gln, Phe, or Tyr
  misc_feature (10)..(10): Xaa can be Tyr, Trp, Leu, Met, Phe, Val, Ile, Ala, Ser, Pro, Gln, Lys, His, Cys, Thr, Arg, or Gly
TXAEVSIVVX

SEQ ID NO: 143933 - protein, 11 aa, Artificial Sequence
  Description of Artificial Sequence: Synthetic peptide
  Seed: TPAEVSIVVLS (PMEL_HUMAN)
  misc_feature (2)..(2): Xaa can be , or Pro
  misc_feature (11)..(11): Xaa can be Met, Ser, Cys, Phe, Val, Ala, Leu, Thr, Tyr, Pro, Ile, or Gly
TXAEVSIVVLX

SEQ ID NO: 143934 - protein, 9 aa, Artificial Sequence
  Description of Artificial Sequence: Synthetic peptide
  Seed: TPEATGMTP (PMEL_HUMAN)
  misc_feature (2)..(2): Xaa can be Pro, Ala, or Val
  misc_feature (9)..(9): Xaa can be Leu, Ile, Phe, Met, Ala, Tyr, Gly, Pro, Trp, Val, Thr, Ser, or Cys
TXEATGMTX

SEQ ID NO: 143935 - protein, 10 aa, Artificial Sequence
  Description of Artificial Sequence: Synthetic peptide
  Seed: TPEATGMTPA (PMEL_HUMAN)
  misc_feature (2)..(2): Xaa can be Pro, Glu, Trp, Gly, Asn, Gln, His, Met, Ile, Lys, Val, Ala, Arg, Cys, Ser, Asp, Thr, Leu, Tyr, or Phe
  misc_feature (10)..(10): Xaa can be Val, Ala, Leu, Ile, Pro, Ser, Met, Cys, Thr, Tyr, or Phe
TXEATGMTPX

SEQ ID NO: 143936 - protein, 10 aa, Artificial Sequence
  Description of Artificial Sequence: Synthetic peptide
  Seed: TPEKVPVSEV (PMEL_HUMAN)
  misc_feature (2)..(2): Xaa can be , or Pro
  misc_feature (10)..(10): Xaa can be Thr, Tyr, Val, Cys, Ala, Ile, Leu, Phe, or Met
TXEKVPVSEX

SEQ ID NO: 143937 - protein, 11 aa, Artificial Sequence
  Description of Artificial Sequence: Synthetic peptide
  Seed: TPEKVPVSEVM (PMEL_HUMAN)
  misc_feature (2)..(2): Xaa can be Pro, or Ala
  misc_feature (11)..(11): Xaa can be Tyr, Phe, Ala, Val, Met, Trp, Leu, or Ile
TXEKVPVSEVX

SEQ ID NO: 143938 - protein, 8 aa, Artificial Sequence
  Description of Artificial Sequence: Synthetic peptide
  Seed: TPGQAPTA (PMEL_HUMAN)
  misc_feature (2)..(2): Xaa can be , or Pro
  misc_feature (8)..(8): Xaa can be Met, Cys, Val, Leu, Ala, Thr, Pro, Ile, or Phe
TXGQAPTX

SEQ ID NO: 143939 - protein, 10 aa, Artificial Sequence
  Description of Artificial Sequence: Synthetic peptide
  Seed: TPGQAPTAEP (PMEL_HUMAN)
  misc_feature (2)..(2): Xaa can be Pro, or Ala
  misc_feature (10)..(10): Xaa can be Ala, Gly, Leu, Cys, Pro, Thr, Met, Ser, Phe, Ile, Tyr, or Val
TXGQAPTAEX

SEQ ID NO: 143940 - protein, 11 aa, Artificial Sequence
  Description of Artificial Sequence: Synthetic peptide
  Seed: TPGQAPTAEPS (PMEL_HUMAN)
  misc_feature (2)..(2): Xaa can be , or Pro
  misc_feature (11)..(11): Xaa can be Pro, Phe, Gly, Cys, Leu, Ile, Met, Ser, Tyr, Ala, Thr, Lys, or Val
TXGQAPTAEPX

SEQ ID NO: 143941 - protein, 10 aa, Artificial Sequence
  Description of Artificial Sequence: Synthetic peptide
  Seed: TQLIMPGQEA (PMEL_HUMAN)
  misc_feature (2)..(2): Xaa can be His, Arg, or Gln
  misc_feature (10)..(10): Xaa can be Ala, Val, Cys, Ile, Thr, Met, or Leu
TXLIMPGQEX

SEQ ID NO: 143942 - protein, 10 aa, Artificial Sequence
  Description of Artificial Sequence: Synthetic peptide
  Seed: TSVQVPTTEV (PMEL_HUMAN)
  misc_feature (2)..(2): Xaa can be Thr, Ala, Val, Ser, Ile, or Met
  misc_feature (10)..(10): Xaa can be Val, Leu, Ile, Met, Ala, or Phe
TXVQVPTTEX

SEQ ID NO: 143943 - protein, 9 aa, Artificial Sequence
  Description of Artificial Sequence: Synthetic peptide
  Seed: TTAAQVTTT (PMEL_HUMAN)
  misc_feature (2)..(2): Xaa can be Thr, Ala, Val, Ser, Ile, Asn, Gly, Met, or Leu
  misc_feature (9)..(9): Xaa can be Val, Ala, Leu, Ile, Met, or Thr
TXAAQVTTX

SEQ ID NO: 143944 - protein, 11 aa, Artificial Sequence
  Description of Artificial Sequence: Synthetic peptide
  Seed: TTAAQVTTTEW (PMEL_HUMAN)
  misc_feature (2)..(2): Xaa can be Thr, Ser, Gly, Cys, Ala, Val, Ile, Asp, Glu, Leu, Lys, Pro, Asn, Phe, Gln, Trp, Arg, Tyr, Met, or His
  misc_feature (11)..(11): Xaa can be Trp, Phe, Leu, or Tyr
TXAAQVTTTEX

SEQ ID NO: 143945 - protein, 9 aa, Artificial Sequence
  Description of Artificial Sequence: Synthetic peptide
  Seed: TTAGQVPTT (PMEL_HUMAN)
  misc_feature (2)..(2): Xaa can be Thr, Val, Ala, Ser, Ile, Leu, Gly, Met, or Pro
  misc_feature (9)..(9): Xaa can be Val, Ile, Ala, Leu, Met, Thr, or Cys
TXAGQVPTX

SEQ ID NO: 143946 - protein, 11 aa, Artificial Sequence
  Description of Artificial Sequence: Synthetic peptide
  Seed: TTAGQVPTTEV (PMEL_HUMAN)
  misc_feature (2)..(2): Xaa can be Ser, Thr, Ala, Ile, Val, or Gly
  misc_feature (11)..(11): Xaa can be Leu, Val, Met, Ile, or Phe
TXAGQVPTTEX

SEQ ID NO: 143947 - protein, 9 aa, Artificial Sequence
  Description of Artificial Sequence: Synthetic peptide
  Seed: TTDGHRPTA (PMEL_HUMAN)
  misc_feature (2)..(2): Xaa can be Ala, Ser, Tyr, Thr, Val, Ile, Leu, Phe, Met, Gly, Gln, Arg, Asn, Trp, Cys, His, Glu, Asp, Pro, or Lys
  misc_feature (9)..(9): Xaa can be Ile, Tyr, Leu, Met, Cys, Phe, Val, Ala, Trp, Lys, Thr, Arg, Ser, His, Pro, Gln, Gly, or Gl u
TXDGHRPTX

SEQ ID NO: 143948 - protein, 10 aa, Artificial Sequence
  Description of Artificial Sequence: Synthetic peptide
  Seed: TTEVISTAPV (PMEL_HUMAN)
  misc_feature (2)..(2): Xaa can be Thr, Val, Ile, Ser, Ala, Gln, Leu, or Met
  misc_feature (10)..(10): Xaa can be Val, Ile, Leu, Ala, Met, or Thr
TXEVISTAPX

SEQ ID NO: 143949 - protein, 10 aa, Artificial Sequence
  Description of Artificial Sequence: Synthetic peptide
  Seed: TTEWVETTAR (PMEL_HUMAN)
  misc_feature (2)..(2): Xaa can be Thr, Leu, Ile, Met, Val, Ser, Gln, Ala, Phe, Asn, Tyr, Gly, Trp, Glu, Asp, or Cys
  misc_feature (10)..(10): Xaa can be Tyr, Lys, Arg, His, or Phe
TXEWVETTAX

SEQ ID NO: 143950 - protein, 9 aa, Artificial Sequence
  Description of Artificial Sequence: Synthetic peptide
  Seed: TTPGQAPTA (PMEL_HUMAN)
  misc_feature (2)..(2): Xaa can be Ala, Val, Ile, Ser, Leu, Thr, Met, Gln, Gly, Phe, Arg, Pro, Asp, Cys, His, Tyr, Asn, Trp, Glu, or Lys
  misc_feature (9)..(9): Xaa can be Val, Met, Tyr, Phe, Leu, Ile, Cys, Ala, Lys, Arg, Trp, His, Thr, Pro, Ser, or Gln
TXPGQAPTX

SEQ ID NO: 143951 - protein, 9 aa, Artificial Sequence
  Description of Artificial Sequence: Synthetic peptide
  Seed: TTTEWVETT (PMEL_HUMAN)
  misc_feature (2)..(2): Xaa can be Val, Thr, Ala, Ile, Ser, Met, Leu, Asn, Gln, Pro, or Gly
  misc_feature (9)..(9): Xaa can be Val, Ile, Ala, Leu, Met, or Thr
TXTEWVETX

SEQ ID NO: 143952 - protein, 10 aa, Artificial Sequence
  Description of Artificial Sequence: Synthetic peptide
  Seed: TTTEWVETTA (PMEL_HUMAN)
  misc_feature (2)..(2): Xaa can be Val, Thr, Met, Ser, Ile, or Ala
  misc_feature (10)..(10): Xaa can be Val, Ile, Ala, Met, or Leu
TXTEWVETTX

SEQ ID NO: 143953 - protein, 11 aa, Artificial Sequence
  Description of Artificial Sequence: Synthetic peptide
  Seed: TTTEWVETTAR (PMEL_HUMAN)
  misc_feature (2)..(2): Xaa can be Ala, Thr, Ser, Val, Ile, Met, Leu, Gly, Phe, Asn, Gln, Lys, Arg, Trp, Cys, Asp, Glu, or Ty r
  misc_feature (11)..(11): Xaa can be Arg, Lys, Tyr, Phe, Leu, or Met
TXTEWVETTAX

SEQ ID NO: 143954 - protein, 10 aa, Artificial Sequence
  Description of Artificial Sequence: Synthetic peptide
  Seed: TVSCQGGLPK (PMEL_HUMAN)
  misc_feature (2)..(2): Xaa can be Ala, Val, Ser, Thr, Ile, Met, Phe, Asn, Glu, Gln, Gly, Leu, Trp, Asp, Cys, Pro, Tyr, Arg, Lys, or His
  misc_feature (10)..(10): Xaa can be Lys, Arg, Tyr, Phe, Met, Leu, or His
TXSCQGGLPX

SEQ ID NO: 143955 - protein, 9 aa, Artificial Sequence
  Description of Artificial Sequence: Synthetic peptide
  Seed: TVYHRRGSR (PMEL_HUMAN)
  misc_feature (2)..(2): Xaa can be Val, Thr, Ala, Ile, Leu, Met, Ser, Trp, Gln, Asn, Asp, Phe, Tyr, Gly, His, Cys, Glu, or Pr o
  misc_feature (9)..(9): Xaa can be Arg, Lys, Tyr, His, Met, Leu, or Phe
TXYHRRGSX

SEQ ID NO: 143956 - protein, 11 aa, Artificial Sequence
  Description of Artificial Sequence: Synthetic peptide
  Seed: TVYHRRGSRSY (PMEL_HUMAN)
  misc_feature (2)..(2): Xaa can be Gln, Thr, Ser, Ala, Met, Leu, Ile, Val, Lys, His, Arg, Glu, Gly, Asn, Tyr, Trp, or Phe
  misc_feature (11)..(11): Xaa can be Tyr, Phe, Trp, Met, Leu, His, or Ile
TXYHRRGSRSX

SEQ ID NO: 143957 - protein, 11 aa, Artificial Sequence
  Description of Artificial Sequence: Synthetic peptide
  Seed: TWDFGDSSGTL (PMEL_HUMAN)
  misc_feature (2)..(2): Xaa can be Gly, Ala, Ile, Thr, Phe, Tyr, Trp, Arg, Val, Ser, Gln, Leu, Met, Asn, Pro, Cys, His, Asp, Glu, or Lys
  misc_feature (11)..(11): Xaa can be Trp, Phe, Lys, Met, Leu, Ile, Tyr, Val, Arg, Cys, Glu, Ala, Asn, His, Gln, Asp, Thr, or Gl y
TXDFGDSSGTX

SEQ ID NO: 143958 - protein, 9 aa, Artificial Sequence
  Description of Artificial Sequence: Synthetic peptide
  Seed: TWGQYWQVL (PMEL_HUMAN)
  misc_feature (2)..(2): Xaa can be Tyr, Arg, Phe, Trp, Ala, Met, Gln, His, Leu, Ile, Val, or Thr
  misc_feature (9)..(9): Xaa can be Phe, Tyr, Met, Leu, Trp, Ile, Val, Ala, His, or Cys
TXGQYWQVX

SEQ ID NO: 143959 - protein, 8 aa, Artificial Sequence
  Description of Artificial Sequence: Synthetic peptide
  Seed: TYCLNVSL (PMEL_HUMAN)
  misc_feature (2)..(2): Xaa can be Tyr, Phe, Trp, Arg, Glu, Asn, His, Ala, Gly, Asp, Gln, or Ser
  misc_feature (8)..(8): Xaa can be Leu, Met, Tyr, Phe, Ile, or Val
TXCLNVSX

SEQ ID NO: 143960 - protein, 8 aa, Artificial Sequence
  Description of Artificial Sequence: Synthetic peptide
  Seed: TYLEPGPV (PMEL_HUMAN)
  misc_feature (2)..(2): Xaa can be Tyr, Phe, or Trp
  misc_feature (8)..(8): Xaa can be Leu, Phe, Met, Tyr, Ile, or Val
TXLEPGPX

SEQ ID NO: 143961 - protein, 9 aa, Artificial Sequence
  Description of Artificial Sequence: Synthetic peptide
  Seed: TYLEPGPVT (PMEL_HUMAN)
  misc_feature (2)..(2): Xaa can be Tyr, Phe, Trp, Met, Ala, Val, Leu, Ile, Gln, Ser, Gly, Thr, His, Cys, or Pro
  misc_feature (9)..(9): Xaa can be Met, Leu, Phe, Tyr, Ile, His, Trp, Val, Arg, Cys, Ala, Lys, Gln, Thr, or Ser
TXLEPGPVX

SEQ ID NO: 143962 - protein, 10 aa, Artificial Sequence
  Description of Artificial Sequence: Synthetic peptide
  Seed: TYLEPGPVTA (PMEL_HUMAN)
  misc_feature (2)..(2): Xaa can be Arg, His, Tyr, Gln, Phe, Lys, Trp, Pro, Glu, Ala, Gly, Met, Asn, Leu, Ser, Ile, Thr, Val, or Cys
  misc_feature (10)..(10): Xaa can be Met, Phe, Leu, Tyr, Ile, Ala, Val, Cys, Trp, Lys, Arg, Thr, His, Pro, Ser, Gly, or Gln
TXLEPGPVTX

SEQ ID NO: 143963 - protein, 11 aa, Artificial Sequence
  Description of Artificial Sequence: Synthetic peptide
  Seed: TYLEPGPVTAQ (PMEL_HUMAN)
  misc_feature (2)..(2): Xaa can be Tyr, Phe, Trp, Met, Gly, Val, Ala, Leu, Ile, His, Ser, Gln, Thr, or Cys
  misc_feature (11)..(11): Xaa can be Phe, Met, Tyr, Leu, Trp, His, Cys, Arg, Val, Ile, Lys, Ala, Thr, or Gln
TXLEPGPVTAX

SEQ ID NO: 143964 - protein, 8 aa, Artificial Sequence
  Description of Artificial Sequence: Synthetic peptide
  Seed: VETTAREL (PMEL_HUMAN)
  misc_feature (2)..(2): Xaa can be Glu, Asp, Gln, Ser, Ala, Ile, Gly, Leu, Asn, Met, Val, Thr, Arg, Tyr, Phe, or His
  misc_feature (8)..(8): Xaa can be Leu, Val, Ile, Met, Phe, Trp, Tyr, Ala, Cys, Pro, or Thr
VXTTAREX

SEQ ID NO: 143965 - protein, 9 aa, Artificial Sequence
  Description of Artificial Sequence: Synthetic peptide
  Seed: VETTARELP (PMEL_HUMAN)
  misc_feature (2)..(2): Xaa can be Glu, Asp, or Gln
  misc_feature (9)..(9): Xaa can be Leu, Ile, Met, Phe, Ala, Val, Thr, Tyr, Ser, Cys, Gly, Pro, or Trp
VXTTARELX

SEQ ID NO: 143966 - protein, 10 aa, Artificial Sequence
  Description of Artificial Sequence: Synthetic peptide
  Seed: VETTARELPI (PMEL_HUMAN)
  misc_feature (2)..(2): Xaa can be , or Glu
  misc_feature (10)..(10): Xaa can be Val, Cys, Ile, Pro, Thr, Leu, Ala, Met, or Phe
VXTTARELPX

SEQ ID NO: 143967 - protein, 10 aa, Artificial Sequence
  Description of Artificial Sequence: Synthetic peptide
  Seed: VGILLVLMAV (PMEL_HUMAN)
  misc_feature (2)..(2): Xaa can be Gln, Leu, Met, Thr, Ile, Pro, Val, Cys, Asn, Lys, Glu, Asp, Tyr, Phe, Ser, Gly, Ala, His, Trp, or Arg
  misc_feature (10)..(10): Xaa can be Val, Ala, Leu, Ile, or Thr
VXILLVLMAX

SEQ ID NO: 143968 - protein, 9 aa, Artificial Sequence
  Description of Artificial Sequence: Synthetic peptide
  Seed: VISTAPVQM (PMEL_HUMAN)
  misc_feature (2)..(2): Xaa can be Ala, Tyr, Met, Arg, Phe, Gln, Ser, Leu, Thr, Val, Ile, Trp, Pro, Gly, Glu, Asn, Cys, Asp, His, or Lys
  misc_feature (9)..(9): Xaa can be Met, Ile, Val, Phe, Leu, Tyr, Lys, Arg, Trp, His, Ala, Cys, Thr, Gln, Ser, or Pro
VXSTAPVQX

SEQ ID NO: 143969 - protein, 8 aa, Artificial Sequence
  Description of Artificial Sequence: Synthetic peptide
  Seed: VIWVNNTI (PMEL_HUMAN)
  misc_feature (2)..(2): Xaa can be Gln, Glu, Ser, Gly, Ala, Ile, Thr, Val, His, Met, Leu, Asn, Asp, Pro, or Phe
  misc_feature (8)..(8): Xaa can be Val, Ile, Leu, Met, Phe, Ala, or Cys
VXWVNNTX

SEQ ID NO: 143970 - protein, 9 aa, Artificial Sequence
  Description of Artificial Sequence: Synthetic peptide
  Seed: VIWVNNTII (PMEL_HUMAN)
  misc_feature (2)..(2): Xaa can be Gln, Val, Leu, Ala, Thr, Ser, Met, Ile, Asn, Glu, Gly, Asp, or Cys
  misc_feature (9)..(9): Xaa can be Leu, Val, Met, Ile, Phe, Ala, Cys, or Trp
VXWVNNTIX

SEQ ID NO: 143971 - protein, 8 aa, Artificial Sequence
  Description of Artificial Sequence: Synthetic peptide
  Seed: VLASLIYR (PMEL_HUMAN)
  misc_feature (2)..(2): Xaa can be Trp, Tyr, Phe, Met, Gly, Ala, Leu, Thr, His, Ser, Gln, Cys, Lys, Asn, Ile, Val, or Arg
  misc_feature (8)..(8): Xaa can be Arg, or Lys
VXASLIYX

SEQ ID NO: 143972 - protein, 9 aa, Artificial Sequence
  Description of Artificial Sequence: Synthetic peptide
  Seed: VLASLIYRR (PMEL_HUMAN)
  misc_feature (2)..(2): Xaa can be Leu, Met, Thr, Ile, Val, Gln, Ala, Ser, Trp, Phe, Gly, Asn, Asp, Cys, Tyr, Pro, Glu, His, Arg, or Lys
  misc_feature (9)..(9): Xaa can be Arg, Lys, Tyr, Leu, His, Val, Ile, Met, Phe, or Ala
VXASLIYRX

SEQ ID NO: 143973 - protein, 10 aa, Artificial Sequence
  Description of Artificial Sequence: Synthetic peptide
  Seed: VLASLIYRRR (PMEL_HUMAN)
  misc_feature (2)..(2): Xaa can be Tyr, Val, Thr, Ile, Leu, Met, Phe, Gln, Ala, Trp, Ser, Glu, Cys, Asp, Pro, His, Asn, Arg, Gly, or Lys
  misc_feature (10)..(10): Xaa can be Arg, Lys, Gln, Phe, Asn, Val, Pro, Thr, Cys, Trp, Ile, Ser, Asp, Tyr, Gly, Met, Glu, Ala, Leu, or His
VXASLIYRRX

SEQ ID NO: 143974 - protein, 11 aa, Artificial Sequence
  Description of Artificial Sequence: Synthetic peptide
  Seed: VLASLIYRRRL (PMEL_HUMAN)
  misc_feature (2)..(2): Xaa can be Met, Leu, or Ile
  misc_feature (11)..(11): Xaa can be Val, Leu, Ala, or Ile
VXASLIYRRRX

SEQ ID NO: 143975 - protein, 9 aa, Artificial Sequence
  Description of Artificial Sequence: Synthetic peptide
  Seed: VLGGPVSGL (PMEL_HUMAN)
  misc_feature (2)..(2): Xaa can be Ala, Met, Leu, Val, Arg, Ile, Thr, Ser, Gln, Gly, Asn, Pro, Tyr, His, Cys, Phe, Glu, Asp, Trp, or Lys
  misc_feature (9)..(9): Xaa can be Phe, Arg, Lys, Tyr, Leu, Met, Ile, Val, His, Ala, Trp, Gln, Cys, Thr, Ser, or Pro
VXGGPVSGX

SEQ ID NO: 143976 - protein, 11 aa, Artificial Sequence
  Description of Artificial Sequence: Synthetic peptide
  Seed: VLGGPVSGLSI (PMEL_HUMAN)
  misc_feature (2)..(2): Xaa can be Gln, Ala, Leu, Met, Ile, Gly, Ser, Thr, Glu, Val, Asn, Cys, or Pro
  misc_feature (11)..(11): Xaa can be Leu, Met, Trp, Val, Phe, Ile, Ala, Cys, or Tyr
VXGGPVSGLSX

SEQ ID NO: 143977 - protein, 9 aa, Artificial Sequence
  Description of Artificial Sequence: Synthetic peptide
  Seed: VLKRCLLHL (PMEL_HUMAN)
  misc_feature (2)..(2): Xaa can be Met, Leu, Ile, Ala, Val, Thr, Gln, Ser, Gly, Arg, Tyr, Glu, Asn, Phe, Pro, Asp, Cys, Lys, Trp, or His
  misc_feature (9)..(9): Xaa can be Tyr, Leu, Phe, Ile, Arg, Lys, Met, Val, Trp, Ala, Thr, or His
VXKRCLLHX

SEQ ID NO: 143978 - protein, 10 aa, Artificial Sequence
  Description of Artificial Sequence: Synthetic peptide
  Seed: VLKRCLLHLA (PMEL_HUMAN)
  misc_feature (2)..(2): Xaa can be Met, Leu, Gln, Ile, or Val
  misc_feature (10)..(10): Xaa can be Val, Leu, Ile, Ala, or Met
VXKRCLLHLX

SEQ ID NO: 143979 - protein, 11 aa, Artificial Sequence
  Description of Artificial Sequence: Synthetic peptide
  Seed: VLKRCLLHLAV (PMEL_HUMAN)
  misc_feature (2)..(2): Xaa can be Leu, or Met
  misc_feature (11)..(11): Xaa can be , or Val
VXKRCLLHLAX

SEQ ID NO: 143980 - protein, 8 aa, Artificial Sequence
  Description of Artificial Sequence: Synthetic peptide
  Seed: VLMAVVLA (PMEL_HUMAN)
  misc_feature (2)..(2): Xaa can be Leu, Met, Gln, Ile, or Val
  misc_feature (8)..(8): Xaa can be Val, Leu, Ala, Ile, or Met
VXMAVVLX

SEQ ID NO: 143981 - protein, 9 aa, Artificial Sequence
  Description of Artificial Sequence: Synthetic peptide
  Seed: VLMAVVLAS (PMEL_HUMAN)
  misc_feature (2)..(2): Xaa can be Met, Leu, Gln, Ile, Val, Thr, Ser, Ala, Cys, Gly, Phe, Glu, Asn, Tyr, Trp, or Asp
  misc_feature (9)..(9): Xaa can be Leu, Val, Ile, Met, Ala, Thr, Cys, Phe, Ser, Pro, Gly, Lys, or Arg
VXMAVVLAX

SEQ ID NO: 143982 - protein, 10 aa, Artificial Sequence
  Description of Artificial Sequence: Synthetic peptide
  Seed: VLMAVVLASL (PMEL_HUMAN)
  misc_feature (2)..(2): Xaa can be Met, Leu, Gln, Tyr, Phe, Trp, Thr, Asn, Ser, Val, Ala, Ile, Gly, Cys, Pro, Asp, His, Arg, Lys, or Glu
  misc_feature (10)..(10): Xaa can be Phe, Tyr, Val, Leu, Ser, Met, Ile, Thr, Ala, Lys, Arg, Pro, Cys, Gly, Trp, or His
VXMAVVLASX

SEQ ID NO: 143983 - protein, 11 aa, Artificial Sequence
  Description of Artificial Sequence: Synthetic peptide
  Seed: VLMAVVLASLI (PMEL_HUMAN)
  misc_feature (2)..(2): Xaa can be Leu, Met, Tyr, Ser, Phe, Ile, Gln, Ala, Lys, Thr, Arg, His, Val, or Gly
  misc_feature (11)..(11): Xaa can be Val, Leu, Ile, Ala, Cys, Arg, Asn, Asp, Gly, Lys, Trp, Phe, Glu, Tyr, Thr, His, Gln, Ser, Pro, or Met
VXMAVVLASLX

SEQ ID NO: 143984 - protein, 8 aa, Artificial Sequence
  Description of Artificial Sequence: Synthetic peptide
  Seed: VLPDGQVI (PMEL_HUMAN)
  misc_feature (2)..(2): Xaa can be Ala, Thr, Ser, Gly, Val, Ile, Gln, Asn, Met, Leu, Phe, Tyr, Cys, Pro, His, Arg, Glu, Trp, Asp, or Lys
  misc_feature (8)..(8): Xaa can be Leu, Met, Ile, Val, Phe, Tyr, Lys, Arg, Trp, Cys, or Ala
VXPDGQVX

SEQ ID NO: 143985 - protein, 9 aa, Artificial Sequence
  Description of Artificial Sequence: Synthetic peptide
  Seed: VLPDGQVIW (PMEL_HUMAN)
  misc_feature (2)..(2): Xaa can be Ala, Met, Ser, Val, Ile, Thr, Leu, Gly, Phe, Cys, Tyr, Gln, Trp, Asn, Pro, His, Glu, Asp, Arg, or Lys
  misc_feature (9)..(9): Xaa can be Lys, Leu, Phe, Tyr, Met, Trp, Arg, Ile, Val, Cys, Ala, Thr, His, Ser, Gln, Pro, or Gly
VXPDGQVIX

SEQ ID NO: 143986 - protein, 10 aa, Artificial Sequence
  Description of Artificial Sequence: Synthetic peptide
  Seed: VLPDGQVIWV (PMEL_HUMAN)
  misc_feature (2)..(2): Xaa can be Leu, Met, Ile, Ala, Gln, Val, Thr, Ser, Gly, Phe, Tyr, Cys, Asn, Trp, Pro, or Glu
  misc_feature (10)..(10): Xaa can be Leu, Met, Phe, Ile, Val, Ala, Thr, Cys, or Tyr
VXPDGQVIWX

SEQ ID NO: 143987 - protein, 9 aa, Artificial Sequence
  Description of Artificial Sequence: Synthetic peptide
  Seed: VLPSPACQL (PMEL_HUMAN)
  misc_feature (2)..(2): Xaa can be Ala, Tyr, Met, Val, Ser, Leu, Ile, Gln, Thr, Arg, Gly, Phe, Pro, Trp, Asp, Asn, Cys, Glu, His, or Lys
  misc_feature (9)..(9): Xaa can be Val, Tyr, Met, Leu, Ile, Phe, Trp, Arg, Lys, His, Cys, Ala, Thr, Gln, Ser, or Pro
VXPSPACQX

SEQ ID NO: 143988 - protein, 10 aa, Artificial Sequence
  Description of Artificial Sequence: Synthetic peptide
  Seed: VLPSPACQLV (PMEL_HUMAN)
  misc_feature (2)..(2): Xaa can be Ala, Leu, Val, Ile, Met, Gly, Ser, Thr, Cys, Gln, Phe, Tyr, Pro, Asn, or Trp
  misc_feature (10)..(10): Xaa can be Met, Leu, Phe, Ile, Val, Ala, Tyr, or Cys
VXPSPACQLX

SEQ ID NO: 143989 - protein, 11 aa, Artificial Sequence
  Description of Artificial Sequence: Synthetic peptide
  Seed: VLPSPACQLVL (PMEL_HUMAN)
  misc_feature (2)..(2): Xaa can be Val, Met, Ile, Leu, Ala, Gly, Thr, Ser, Cys, Phe, or Pro
  misc_feature (11)..(11): Xaa can be Leu, Met, Val, Ile, Phe, or Ala
VXPSPACQLVX

SEQ ID NO: 143990 - protein, 8 aa, Artificial Sequence
  Description of Artificial Sequence: Synthetic peptide
  Seed: VLQAAIPL (PMEL_HUMAN)
  misc_feature (2)..(2): Xaa can be Leu, or Met
  misc_feature (8)..(8): Xaa can be Val, or Leu
VXQAAIPX

SEQ ID NO: 143991 - protein, 9 aa, Artificial Sequence
  Description of Artificial Sequence: Synthetic peptide
  Seed: VLQAAIPLT (PMEL_HUMAN)
  misc_feature (2)..(2): Xaa can be Met, Leu, Ile, Ala, Val, Thr, Gln, Ser, Asn, Gly, Cys, Phe, or Trp
  misc_feature (9)..(9): Xaa can be Val, Leu, Ile, Met, Ala, Thr, Ser, Phe, or Cys
VXQAAIPLX

SEQ ID NO: 143992 - protein, 10 aa, Artificial Sequence
  Description of Artificial Sequence: Synthetic peptide
  Seed: VLSGTTAAQV (PMEL_HUMAN)
  misc_feature (2)..(2): Xaa can be Gln, Met, Leu, Ile, Val, Thr, Ala, or Ser
  misc_feature (10)..(10): Xaa can be Val, Leu, Ile, Ala, Met, Phe, Thr, or Trp
VXSGTTAAQX

SEQ ID NO: 143993 - protein, 8 aa, Artificial Sequence
  Description of Artificial Sequence: Synthetic peptide
  Seed: VLYRYGSF (PMEL_HUMAN)
  misc_feature (2)..(2): Xaa can be Gln, Met, Glu, Lys, His, Ile, Ser, Ala, Leu, Val, Thr, Gly, or Arg
  misc_feature (8)..(8): Xaa can be Tyr, Phe, Met, Leu, Pro, Trp, Ala, His, Val, or Ile
VXYRYGSX

SEQ ID NO: 143994 - protein, 9 aa, Artificial Sequence
  Description of Artificial Sequence: Synthetic peptide
  Seed: VLYRYGSFS (PMEL_HUMAN)
  misc_feature (2)..(2): Xaa can be Met, Leu, Val, Gln, Ile, Thr, Ser, or Ala
  misc_feature (9)..(9): Xaa can be Val, Ile, Ala, Leu, Cys, Met, Thr, Ser, or Phe
VXYRYGSFX

SEQ ID NO: 143995 - protein, 10 aa, Artificial Sequence
  Description of Artificial Sequence: Synthetic peptide
  Seed: VLYRYGSFSV (PMEL_HUMAN)
  misc_feature (2)..(2): Xaa can be Met, Thr, Leu, Ser, Arg, Val, Lys, Trp, Ala, Gln, Ile, His, Gly, Asn, Tyr, Phe, Pro, Asp, Cys, or Glu
  misc_feature (10)..(10): Xaa can be Ala, Val, Lys, Ile, Leu, Met, Ser, Tyr, Arg, Thr, Phe, Cys, or Gly
VXYRYGSFSX

SEQ ID NO: 143996 - protein, 11 aa, Artificial Sequence
  Description of Artificial Sequence: Synthetic peptide
  Seed: VLYRYGSFSVT (PMEL_HUMAN)
  misc_feature (2)..(2): Xaa can be Leu, Met, Ile, or Val
  misc_feature (11)..(11): Xaa can be Val, Cys, Lys, His, Gln, Ser, Leu, Trp, Glu, Arg, Thr, Met, Gly, Pro, Ile, Asp, Tyr, Asn, Phe, or Ala
VXYRYGSFSVX

SEQ ID NO: 143997 - protein, 9 aa, Artificial Sequence
  Description of Artificial Sequence: Synthetic peptide
  Seed: VMGTTLAEM (PMEL_HUMAN)
  misc_feature (2)..(2): Xaa can be Ala, Met, Tyr, Leu, Val, Gln, Thr, Ser, Phe, Ile, Gly, Trp, Asp, Asn, Glu, Arg, Pro, Cys, His, or Lys
  misc_feature (9)..(9): Xaa can be Met, Phe, Tyr, Leu, Arg, Lys, Val, Ile, His, Trp, Ala, Cys, or Thr
VXGTTLAEX

SEQ ID NO: 143998 - protein, 8 aa, Artificial Sequence
  Description of Artificial Sequence: Synthetic peptide
  Seed: VPFSVSVS (PMEL_HUMAN)
  misc_feature (2)..(2): Xaa can be , or Pro
  misc_feature (8)..(8): Xaa can be Phe, Ala, Thr, Cys, Pro, Ile, Leu, Ser, Val, or Met
VXFSVSVX

SEQ ID NO: 143999 - protein, 9 aa, Artificial Sequence
  Description of Artificial Sequence: Synthetic peptide
  Seed: VPFSVSVSQ (PMEL_HUMAN)
  misc_feature (2)..(2): Xaa can be Pro, Ala, Val, Ser, Ile, Gly, Thr, Phe, Cys, Met, Gln, Leu, Tyr, Asp, His, or Asn
  misc_feature (9)..(9): Xaa can be Tyr, Phe, Met, Ala, Leu, Val, Ile, Trp, Cys, His, Ser, Arg, Pro, Gln, Thr, Glu, Asn, Lys, Asp, or Gly
VXFSVSVSX

SEQ ID NO: 144000 - protein, 10 aa, Artificial Sequence
  Description of Artificial Sequence: Synthetic peptide
  Seed: VPFSVSVSQL (PMEL_HUMAN)
  misc_feature (2)..(2): Xaa can be Pro, Ala, Ser, Val, Gln, Glu, Thr, Ile, Gly, or Met
  misc_feature (10)..(10): Xaa can be Leu, Tyr, Trp, Val, Ile, Met, Phe, Pro, Thr, Gly, Ser, Cys, Ala, Arg, or His
VXFSVSVSQX

SEQ ID NO: 144001 - protein, 11 aa, Artificial Sequence
  Description of Artificial Sequence: Synthetic peptide
  Seed: VPFSVSVSQLR (PMEL_HUMAN)
  misc_feature (2)..(2): Xaa can be Ser, Val, Thr, Ala, Ile, Met, Tyr, Cys, Leu, Pro, Trp, Asp, Asn, Glu, Gly, Phe, Gln, or Hi s
  misc_feature (11)..(11): Xaa can be Arg, or Lys
VXFSVSVSQLX

SEQ ID NO: 144002 - protein, 9 aa, Artificial Sequence
  Description of Artificial Sequence: Synthetic peptide
  Seed: VPGTTDGHR (PMEL_HUMAN)
  misc_feature (2)..(2): Xaa can be Val, Thr, Ser, Ile, Ala, Met, Pro, or Leu
  misc_feature (9)..(9): Xaa can be Arg, or Lys
VXGTTDGHX

SEQ ID NO: 144003 - protein, 11 aa, Artificial Sequence
  Description of Artificial Sequence: Synthetic peptide
  Seed: VPGTTDGHRPT (PMEL_HUMAN)
  misc_feature (2)..(2): Xaa can be , or Pro
  misc_feature (11)..(11): Xaa can be Ala, Val, Phe, Cys, Pro, Ile, Leu, Met, or Thr
VXGTTDGHRPX

SEQ ID NO: 144004 - protein, 8 aa, Artificial Sequence
  Description of Artificial Sequence: Synthetic peptide
  Seed: VPLAHSSS (PMEL_HUMAN)
  misc_feature (2)..(2): Xaa can be , or Pro
  misc_feature (8)..(8): Xaa can be Pro, Ser, Ala, Met, Ile, Phe, Cys, Val, Leu, or Thr
VXLAHSSX

SEQ ID NO: 144005 - protein, 9 aa, Artificial Sequence
  Description of Artificial Sequence: Synthetic peptide
  Seed: VPLAHSSSA (PMEL_HUMAN)
  misc_feature (2)..(2): Xaa can be Pro, His, Ala, Arg, Gln, Ser, Val, Thr, Ile, Leu, Met, Gly, Glu, Lys, Cys, or Phe
  misc_feature (9)..(9): Xaa can be Tyr, Leu, Met, Phe, Val, Ala, Ile, Cys, Thr, Pro, Trp, Ser, Gly, His, Arg, Gln, or Lys
VXLAHSSSX

SEQ ID NO: 144006 - protein, 10 aa, Artificial Sequence
  Description of Artificial Sequence: Synthetic peptide
  Seed: VPLAHSSSAF (PMEL_HUMAN)
  misc_feature (2)..(2): Xaa can be Pro, Gln, Met, Lys, Leu, Ala, His, Ser, Glu, Arg, Val, Thr, Ile, Trp, Gly, Tyr, Asp, Cys, Phe, or Asn
  misc_feature (10)..(10): Xaa can be Tyr, Phe, Met, Leu, Trp, Ile, Val, Ala, His, Thr, Cys, Gly, Pro, or Ser
VXLAHSSSAX

SEQ ID NO: 144007 - protein, 11 aa, Artificial Sequence
  Description of Artificial Sequence: Synthetic peptide
  Seed: VPLAHSSSAFT (PMEL_HUMAN)
  misc_feature (2)..(2): Xaa can be , or Pro
  misc_feature (11)..(11): Xaa can be Leu, Ala, Ile, Cys, Phe, Thr, Val, or Met
VXLAHSSSAFX

SEQ ID NO: 144008 - protein, 8 aa, Artificial Sequence
  Description of Artificial Sequence: Synthetic peptide
  Seed: VPLDCVLY (PMEL_HUMAN)
  misc_feature (2)..(2): Xaa can be Gln, Pro, Ala, or Met
  misc_feature (8)..(8): Xaa can be Tyr, or Phe
VXLDCVLX

SEQ ID NO: 144009 - protein, 9 aa, Artificial Sequence
  Description of Artificial Sequence: Synthetic peptide
  Seed: VPLDCVLYR (PMEL_HUMAN)
  misc_feature (2)..(2): Xaa can be Met, Leu, Thr, Ile, Val, Ala, Gln, Ser, Phe, Tyr, Lys, Pro, Arg, Asp, Cys, Asn, His, Trp, Glu, or Gly
  misc_feature (9)..(9): Xaa can be Lys, Arg, Tyr, Leu, Phe, His, Val, Met, Ile, Ala, Gln, Thr, or Trp
VXLDCVLYX

SEQ ID NO: 144010 - protein, 10 aa, Artificial Sequence
  Description of Artificial Sequence: Synthetic peptide
  Seed: VPLDCVLYRY (PMEL_HUMAN)
  misc_feature (2)..(2): Xaa can be Pro, Tyr, Phe, Met, Gln, Ile, Ala, Trp, Thr, Leu, Val, His, Asn, Gly, Lys, Glu, Ser, Cys, Arg, or Asp
  misc_feature (10)..(10): Xaa can be Tyr, Phe, Met, Trp, or Leu
VXLDCVLYRX

SEQ ID NO: 144011 - protein, 8 aa, Artificial Sequence
  Description of Artificial Sequence: Synthetic peptide
  Seed: VPLIVGIL (PMEL_HUMAN)
  misc_feature (2)..(2): Xaa can be Pro, or Ala
  misc_feature (8)..(8): Xaa can be Val, Ile, Leu, Met, or Ala
VXLIVGIX

SEQ ID NO: 144012 - protein, 9 aa, Artificial Sequence
  Description of Artificial Sequence: Synthetic peptide
  Seed: VPLIVGILL (PMEL_HUMAN)
  misc_feature (2)..(2): Xaa can be Pro, Ala, Ser, Gln, Glu, Val, Gly, Asp, or Thr
  misc_feature (9)..(9): Xaa can be Val, Trp, Ile, Tyr, Leu, Phe, Ala, Met, Gly, Pro, Cys, His, Ser, or Thr
VXLIVGILX

SEQ ID NO: 144013 - protein, 10 aa, Artificial Sequence
  Description of Artificial Sequence: Synthetic peptide
  Seed: VPLIVGILLV (PMEL_HUMAN)
  misc_feature (2)..(2): Xaa can be Pro, Phe, Tyr, Met, Glu, Ala, Gln, Gly, Cys, Asp, Leu, Thr, Trp, Ser, His, Asn, Lys, Ile, Arg, or Val
  misc_feature (10)..(10): Xaa can be Ala, Ile, Val, Leu, Met, Phe, Cys, or Thr
VXLIVGILLX

SEQ ID NO: 144014 - protein, 11 aa, Artificial Sequence
  Description of Artificial Sequence: Synthetic peptide
  Seed: VPLIVGILLVL (PMEL_HUMAN)
  misc_feature (2)..(2): Xaa can be , or Pro
  misc_feature (11)..(11): Xaa can be Ile, Met, Phe, Ala, Leu, Cys, or Val
VXLIVGILLVX

SEQ ID NO: 144015 - protein, 8 aa, Artificial Sequence
  Description of Artificial Sequence: Synthetic peptide
  Seed: VPQLPHSS (PMEL_HUMAN)
  misc_feature (2)..(2): Xaa can be Pro, or Ala
  misc_feature (8)..(8): Xaa can be Ala, Phe, Tyr, Gly, Ser, Met, Ile, Leu, Cys, Val, Thr, or Pro
VXQLPHSX

SEQ ID NO: 144016 - protein, 9 aa, Artificial Sequence
  Description of Artificial Sequence: Synthetic peptide
  Seed: VPQLPHSSS (PMEL_HUMAN)
  misc_feature (2)..(2): Xaa can be Pro, Ala, Val, Gly, Ser, Ile, Thr, Met, Leu, or Phe
  misc_feature (9)..(9): Xaa can be Leu, Met, Ala, Ile, Phe, Val, Cys, Trp, Arg, Gly, Glu, Pro, Ser, His, Lys, Asn, Thr, Tyr, or Gln
VXQLPHSSX

SEQ ID NO: 144017 - protein, 10 aa, Artificial Sequence
  Description of Artificial Sequence: Synthetic peptide
  Seed: VPQLPHSSSH (PMEL_HUMAN)
  misc_feature (2)..(2): Xaa can be Tyr, Gln, His, Arg, Trp, Met, Leu, Lys, Thr, Gly, Pro, Ala, Phe, Glu, Ser, Ile, Asp, Asn, Val, or Cys
  misc_feature (10)..(10): Xaa can be His, Phe, Met, Trp, Val, Ile, Leu, Tyr, or Ala
VXQLPHSSSX

SEQ ID NO: 144018 - protein, 11 aa, Artificial Sequence
  Description of Artificial Sequence: Synthetic peptide
  Seed: VPQLPHSSSHW (PMEL_HUMAN)
  misc_feature (2)..(2): Xaa can be Pro, Thr, Ser, Asn, Trp, Gly, Asp, Cys, Met, Leu, Ala, Val, Phe, Ile, or Gln
  misc_feature (11)..(11): Xaa can be Trp, Phe, Met, Tyr, or Leu
VXQLPHSSSHX

SEQ ID NO: 144019 - protein, 8 aa, Artificial Sequence
  Description of Artificial Sequence: Synthetic peptide
  Seed: VPRNQDWL (PMEL_HUMAN)
  misc_feature (2)..(2): Xaa can be , or Pro
  misc_feature (8)..(8): Xaa can be , or Leu
VXRNQDWX

SEQ ID NO: 144020 - protein, 10 aa, Artificial Sequence
  Description of Artificial Sequence: Synthetic peptide
  Seed: VPRNQDWLGV (PMEL_HUMAN)
  misc_feature (2)..(2): Xaa can be , or Pro
  misc_feature (10)..(10): Xaa can be Phe, Met, Leu, Val, Ile, or Ala
VXRNQDWLGX

SEQ ID NO: 144021 - protein, 9 aa, Artificial Sequence
  Description of Artificial Sequence: Synthetic peptide
  Seed: VPSGEGDAF (PMEL_HUMAN)
  misc_feature (2)..(2): Xaa can be Pro, Met, Ala, Gln, Val, Leu, Ile, Ser, Gly, His, Thr, Phe, Glu, Arg, Trp, Asp, Cys, Tyr, Asn, or Lys
  misc_feature (9)..(9): Xaa can be Tyr, Phe, Met, Trp, Leu, Ile, His, Ala, Pro, Gly, Thr, Val, Ser, or Cys
VXSGEGDAX

SEQ ID NO: 144022 - protein, 11 aa, Artificial Sequence
  Description of Artificial Sequence: Synthetic peptide
  Seed: VPSGEGDAFEL (PMEL_HUMAN)
  misc_feature (2)..(2): Xaa can be Pro, Val, Ala, Ser, Thr, Ile, Gln, Met, Gly, Leu, Glu, Asp, Cys, Phe, Tyr, Asn, or His
  misc_feature (11)..(11): Xaa can be Tyr, Phe, Trp, Met, Leu, Ile, Val, Gly, His, Cys, Ser, Ala, Pro, or Thr
VXSGEGDAFEX

SEQ ID NO: 144023 - protein, 9 aa, Artificial Sequence
  Description of Artificial Sequence: Synthetic peptide
  Seed: VPTTEVIST (PMEL_HUMAN)
  misc_feature (2)..(2): Xaa can be Pro, Ala, Gly, Ser, or Val
  misc_feature (9)..(9): Xaa can be Val, Ile, Cys, Ala, Phe, Met, Leu, Thr, Tyr, Gly, Pro, Arg, Trp, or Ser
VXTTEVISX

SEQ ID NO: 144024 - protein, 10 aa, Artificial Sequence
  Description of Artificial Sequence: Synthetic peptide
  Seed: VPTTEVISTA (PMEL_HUMAN)
  misc_feature (2)..(2): Xaa can be , or Pro
  misc_feature (10)..(10): Xaa can be Ala, Phe, Val, Pro, Ser, Ile, Cys, Thr, Met, Leu, or Tyr
VXTTEVISTX

SEQ ID NO: 144025 - protein, 11 aa, Artificial Sequence
  Description of Artificial Sequence: Synthetic peptide
  Seed: VPTTEVISTAP (PMEL_HUMAN)
  misc_feature (2)..(2): Xaa can be , or Pro
  misc_feature (11)..(11): Xaa can be Ser, Ile, Val, Phe, Thr, Gly, Cys, Pro, Met, Ala, Leu, or Tyr
VXTTEVISTAX

SEQ ID NO: 144026 - protein, 9 aa, Artificial Sequence
  Description of Artificial Sequence: Synthetic peptide
  Seed: VPTTEVVGT (PMEL_HUMAN)
  misc_feature (2)..(2): Xaa can be , or Pro
  misc_feature (9)..(9): Xaa can be Pro, Leu, Tyr, Ser, Cys, Gly, Val, Met, Phe, Ile, Thr, or Ala
VXTTEVVGX

SEQ ID NO: 144027 - protein, 10 aa, Artificial Sequence
  Description of Artificial Sequence: Synthetic peptide
  Seed: VPTTEVVGTT (PMEL_HUMAN)
  misc_feature (2)..(2): Xaa can be , or Pro
  misc_feature (10)..(10): Xaa can be Leu, Thr, Val, Pro, Cys, Ile, Ser, Met, Phe, or Ala
VXTTEVVGTX

SEQ ID NO: 144028 - protein, 11 aa, Artificial Sequence
  Description of Artificial Sequence: Synthetic peptide
  Seed: VPTTEVVGTTP (PMEL_HUMAN)
  misc_feature (2)..(2): Xaa can be , or Pro
  misc_feature (11)..(11): Xaa can be Phe, Trp, Met, Ile, Val, Thr, Ala, Cys, Ser, Tyr, Gly, Leu, or Pro
VXTTEVVGTTX

SEQ ID NO: 144029 - protein, 9 aa, Artificial Sequence
  Description of Artificial Sequence: Synthetic peptide
  Seed: VPVSEVMGT (PMEL_HUMAN)
  misc_feature (2)..(2): Xaa can be Pro, or Ala
  misc_feature (9)..(9): Xaa can be Ala, Ser, Met, Thr, Tyr, Gly, Val, Cys, Leu, Pro, Phe, or Ile
VXVSEVMGX

SEQ ID NO: 144030 - protein, 10 aa, Artificial Sequence
  Description of Artificial Sequence: Synthetic peptide
  Seed: VPVSEVMGTT (PMEL_HUMAN)
  misc_feature (2)..(2): Xaa can be , or Pro
  misc_feature (10)..(10): Xaa can be Met, Tyr, Cys, Ile, Gly, Val, Ala, Leu, Ser, Pro, Thr, or Phe
VXVSEVMGTX

SEQ ID NO: 144031 - protein, 11 aa, Artificial Sequence
  Description of Artificial Sequence: Synthetic peptide
  Seed: VPVSEVMGTTL (PMEL_HUMAN)
  misc_feature (2)..(2): Xaa can be Pro, Ala, Thr, Ser, Val, Gly, or Cys
  misc_feature (11)..(11): Xaa can be Trp, Leu, Met, Tyr, Val, Ile, Phe, Thr, Cys, Gly, Ser, Pro, His, or Ala
VXVSEVMGTTX

SEQ ID NO: 144032 - protein, 9 aa, Artificial Sequence
  Description of Artificial Sequence: Synthetic peptide
  Seed: VQGIESAEI (PMEL_HUMAN)
  misc_feature (2)..(2): Xaa can be His, Gln, Met, Leu, Ala, Arg, Ile, or Val
  misc_feature (9)..(9): Xaa can be Trp, Leu, Ile, Val, Phe, or Met
VXGIESAEX

SEQ ID NO: 144033 - protein, 10 aa, Artificial Sequence
  Description of Artificial Sequence: Synthetic peptide
  Seed: VQGIESAEIL (PMEL_HUMAN)
  misc_feature (2)..(2): Xaa can be Gln, Met, Leu, Lys, His, Arg, or Ala
  misc_feature (10)..(10): Xaa can be Tyr, Phe, Trp, Met, or Leu
VXGIESAEIX

SEQ ID NO: 144034 - protein, 9 aa, Artificial Sequence
  Description of Artificial Sequence: Synthetic peptide
  Seed: VQMPTAEST (PMEL_HUMAN)
  misc_feature (2)..(2): Xaa can be Gln, His, Arg, Met, Leu, Ile, Ser, Val, Ala, Lys, Thr, Glu, Pro, Asn, Asp, Gly, Cys, Phe, Tyr, or Trp
  misc_feature (9)..(9): Xaa can be Val, Phe, Tyr, Leu, Met, Ile, Ala, Trp, His, Cys, Thr, Gly, Ser, Pro, Lys, or Arg
VXMPTAESX

SEQ ID NO: 144035 - protein, 11 aa, Artificial Sequence
  Description of Artificial Sequence: Synthetic peptide
  Seed: VQMPTAESTGM (PMEL_HUMAN)
  misc_feature (2)..(2): Xaa can be Ala, Arg, Gln, Val, Ile, Leu, Met, Glu, Ser, Gly, His, Thr, Tyr, Asn, Pro, Lys, Trp, Phe, Asp, or Cys
  misc_feature (11)..(11): Xaa can be Phe, Tyr, Leu, Met, Trp, Lys, Ile, His, Val, Arg, Cys, Ala, or Gln
VXMPTAESTGX

SEQ ID NO: 144036 - protein, 8 aa, Artificial Sequence
  Description of Artificial Sequence: Synthetic peptide
  Seed: VQVPTTEV (PMEL_HUMAN)
  misc_feature (2)..(2): Xaa can be Gln, Glu, Leu, Ala, Met, Ser, Gly, Val, Ile, Thr, Asn, His, Pro, Phe, Lys, Asp, Tyr, Trp, or Arg
  misc_feature (8)..(8): Xaa can be Tyr, Ile, Val, Leu, Phe, Met, Ala, Trp, His, or Cys
VXVPTTEX

SEQ ID NO: 144037 - protein, 9 aa, Artificial Sequence
  Description of Artificial Sequence: Synthetic peptide
  Seed: VQVPTTEVI (PMEL_HUMAN)
  misc_feature (2)..(2): Xaa can be Glu, Ala, His, Arg, Asp, Gln, Ser, Met, Val, Leu, Thr, Tyr, Ile, Gly, Pro, Asn, Cys, Lys, Phe, or Trp
  misc_feature (9)..(9): Xaa can be Tyr, Leu, Ile, Phe, Met, Val, Lys, Trp, Arg, His, Ala, Cys, Thr, Pro, Gly, Ser, Gln, Asn, Asp, or Glu
VXVPTTEVX

SEQ ID NO: 144038 - protein, 9 aa, Artificial Sequence
  Description of Artificial Sequence: Synthetic peptide
  Seed: VSCQGGLPK (PMEL_HUMAN)
  misc_feature (2)..(2): Xaa can be Ala, Thr, Val, Ser, Ile, Gly, Leu, Met, Gln, Asn, Phe, Pro, Cys, Tyr, Trp, Glu, Asp, His, or Lys
  misc_feature (9)..(9): Xaa can be Lys, Tyr, Arg, Phe, Leu, Met, His, Val, Ile, Ala, Trp, Thr, Pro, Gln, Cys, or Ser
VXCQGGLPX

SEQ ID NO: 144039 - protein, 9 aa, Artificial Sequence
  Description of Artificial Sequence: Synthetic peptide
  Seed: VSEVMGTTL (PMEL_HUMAN)
  misc_feature (2)..(2): Xaa can be Glu, Ala, Thr, Ser, Asp, Val, Tyr, Phe, Ile, Gln, Leu, Asn, Met, Gly, Cys, Pro, Trp, Arg, His, or Lys
  misc_feature (9)..(9): Xaa can be Met, Leu, Phe, Ile, Val, Tyr, Trp, Lys, Arg, Cys, His, Ala, Thr, Pro, Gly, or Ser
VXEVMGTTX

SEQ ID NO: 144040 - protein, 10 aa, Artificial Sequence
  Description of Artificial Sequence: Synthetic peptide
  Seed: VSEVMGTTLA (PMEL_HUMAN)
  misc_feature (2)..(2): Xaa can be Glu, Met, Gly, Val, Gln, Tyr, Asp, Phe, Ala, Thr, Ser, Lys, Leu, Ile, Asn, Trp, Arg, Cys, Pro, or His
  misc_feature (10)..(10): Xaa can be Ala, or Val
VXEVMGTTLX

SEQ ID NO: 144041 - protein, 10 aa, Artificial Sequence
  Description of Artificial Sequence: Synthetic peptide
  Seed: VSGLSIGTGR (PMEL_HUMAN)
  misc_feature (2)..(2): Xaa can be Ala, Thr, Val, Ser, Asp, Cys, Ile, Met, Asn, Gly, Leu, Gln, Tyr, Glu, His, Pro, Trp, Phe, Arg, or Lys
  misc_feature (10)..(10): Xaa can be Arg, Lys, Tyr, Phe, Met, His, or Leu
VXGLSIGTGX

SEQ ID NO: 144042 - protein, 9 aa, Artificial Sequence
  Description of Artificial Sequence: Synthetic peptide
  Seed: VSLADTNSL (PMEL_HUMAN)
  misc_feature (2)..(2): Xaa can be Met, Leu, Gln, Thr, Val, Ile, Ala, Arg, Gly, Ser, Asn, Glu, Lys, Tyr, Phe, Asp, Cys, Pro, Trp, or His
  misc_feature (9)..(9): Xaa can be Met, Leu, Tyr, Phe, Trp, Lys, Ile, Arg, Val, His, Ala, or Thr
VXLADTNSX

SEQ ID NO: 144043 - protein, 10 aa, Artificial Sequence
  Description of Artificial Sequence: Synthetic peptide
  Seed: VSLADTNSLA (PMEL_HUMAN)
  misc_feature (2)..(2): Xaa can be Met, Phe, Leu, Trp, Tyr, Gly, His, Asn, Pro, Arg, Ala, Asp, Thr, Ile, Val, Cys, Gln, Glu, Ser, or Lys
  misc_feature (10)..(10): Xaa can be Ala, Leu, Ile, Met, Val, Phe, Thr, or Cys
VXLADTNSLX

SEQ ID NO: 144044 - protein, 11 aa, Artificial Sequence
  Description of Artificial Sequence: Synthetic peptide
  Seed: VSLADTNSLAV (PMEL_HUMAN)
  misc_feature (2)..(2): Xaa can be Thr, Ser, Ala, Met, Phe, Val, Tyr, Cys, Gly, Trp, Leu, Ile, Lys, His, Asn, Pro, Arg, Gln, Glu, or Asp
  misc_feature (11)..(11): Xaa can be Trp, Leu, Val, Phe, Ile, Met, Tyr, Ala, or Cys
VXLADTNSLAX

SEQ ID NO: 144045 - protein, 8 aa, Artificial Sequence
  Description of Artificial Sequence: Synthetic peptide
  Seed: VSNDGPTL (PMEL_HUMAN)
  misc_feature (2)..(2): Xaa can be Ala, Val, Thr, Ser, Met, Leu, Gly, Ile, Phe, Gln, Asn, Tyr, Arg, Glu, Cys, Trp, His, Pro, Lys, or Asp
  misc_feature (8)..(8): Xaa can be Leu, Met, Tyr, Phe, Ile, Val, Trp, Lys, His, Arg, Ala, Cys, Thr, or Gln
VXNDGPTX

SEQ ID NO: 144046 - protein, 9 aa, Artificial Sequence
  Description of Artificial Sequence: Synthetic peptide
  Seed: VSNDGPTLI (PMEL_HUMAN)
  misc_feature (2)..(2): Xaa can be Ala, Val, Ser, Thr, Arg, Ile, Tyr, Pro, Gln, Met, Leu, Phe, Gly, His, Trp, Asn, Glu, Cys, Asp, or Lys
  misc_feature (9)..(9): Xaa can be Lys, Phe, Val, Leu, Met, Trp, Tyr, Ile, Arg, His, Cys, Ala, Thr, Gln, Ser, Gly, Glu, Pro, or Asn
VXNDGPTLX

SEQ ID NO: 144047 - protein, 8 aa, Artificial Sequence
  Description of Artificial Sequence: Synthetic peptide
  Seed: VSRQLRTK (PMEL_HUMAN)
  misc_feature (2)..(2): Xaa can be Thr, Tyr, Val, Ser, or Met
  misc_feature (8)..(8): Xaa can be , or Lys
VXRQLRTX

SEQ ID NO: 144048 - protein, 9 aa, Artificial Sequence
  Description of Artificial Sequence: Synthetic peptide
  Seed: VSRQLRTKA (PMEL_HUMAN)
  misc_feature (2)..(2): Xaa can be Thr, Val, Ser, Ile, Ala, Met, Leu, Gln, Phe, Tyr, Asn, Trp, or Gly
  misc_feature (9)..(9): Xaa can be Lys, Leu, Ala, Arg, Ile, Val, Tyr, Met, Gly, Ser, Thr, or Phe
VXRQLRTKX

SEQ ID NO: 144049 - protein, 10 aa, Artificial Sequence
  Description of Artificial Sequence: Synthetic peptide
  Seed: VSRQLRTKAW (PMEL_HUMAN)
  misc_feature (2)..(2): Xaa can be Thr, Ser, Met, Asn, Gly, Cys, Gln, Ala, Val, Ile, or Leu
  misc_feature (10)..(10): Xaa can be Trp, Tyr, or Phe
VXRQLRTKAX

SEQ ID NO: 144050 - protein, 9 aa, Artificial Sequence
  Description of Artificial Sequence: Synthetic peptide
  Seed: VSVSQLRAL (PMEL_HUMAN)
  misc_feature (2)..(2): Xaa can be Ala, Gln, Arg, Val, Thr, Ile, Leu, Ser, Gly, Asp, Asn, Met, Glu, Tyr, Phe, Cys, His, Lys, Pro, or Trp
  misc_feature (9)..(9): Xaa can be Met, Leu, Tyr, Phe, Trp, Ile, Val, His, Lys, Ala, Arg, Thr, Cys, or Gln
VXVSQLRAX

SEQ ID NO: 144051 - protein, 9 aa, Artificial Sequence
  Description of Artificial Sequence: Synthetic peptide
  Seed: VTAQVVLQA (PMEL_HUMAN)
  misc_feature (2)..(2): Xaa can be Leu, Met, Thr, Ser, Ala, Ile, Val, Gln, Gly, Asn, Phe, Glu, Cys, Tyr, Pro, Trp, Arg, Asp, or His
  misc_feature (9)..(9): Xaa can be Leu, Lys, Tyr, Val, Met, Phe, Ile, Arg, Trp, Thr, Ala, Cys, His, Ser, or Gly
VXAQVVLQX

SEQ ID NO: 144052 - protein, 10 aa, Artificial Sequence
  Description of Artificial Sequence: Synthetic peptide
  Seed: VTAQVVLQAA (PMEL_HUMAN)
  misc_feature (2)..(2): Xaa can be Met, Leu, Ile, Val, Thr, Gln, Ala, or Ser
  misc_feature (10)..(10): Xaa can be Ile, Val, Leu, Ala, Met, Thr, or Cys
VXAQVVLQAX

SEQ ID NO: 144053 - protein, 11 aa, Artificial Sequence
  Description of Artificial Sequence: Synthetic peptide
  Seed: VTAQVVLQAAI (PMEL_HUMAN)
  misc_feature (2)..(2): Xaa can be Thr, Ser, Cys, Val, Gly, Ala, Met, Gln, Ile, Asn, Leu, or Asp
  misc_feature (11)..(11): Xaa can be Trp, Phe, Met, Leu, Tyr, or Ile
VXAQVVLQAAX

SEQ ID NO: 144054 - protein, 9 aa, Artificial Sequence
  Description of Artificial Sequence: Synthetic peptide
  Seed: VTLDIVQGI (PMEL_HUMAN)
  misc_feature (2)..(2): Xaa can be Leu, Met, Val, Ile, Ala, Gln, Ser, Thr, Arg, Gly, Asn, Pro, Phe, Lys, Asp, Tyr, His, Trp, Cys, or Glu
  misc_feature (9)..(9): Xaa can be Met, Tyr, Phe, Lys, Ile, Trp, Leu, Arg, Val, His, Ala, Cys, Thr, Gln, Ser, Pro, Gly, or Gl u
VXLDIVQGX

SEQ ID NO: 144055 - protein, 10 aa, Artificial Sequence
  Description of Artificial Sequence: Synthetic peptide
  Seed: VTVYHRRGSR (PMEL_HUMAN)
  misc_feature (2)..(2): Xaa can be Cys, Ile, Phe, Ala, Asp, Ser, Lys, Arg, Pro, Trp, Glu, Thr, Asn, Gly, Met, Leu, Tyr, Val, His, or Gln
  misc_feature (10)..(10): Xaa can be Lys, or Arg
VXVYHRRGSX

SEQ ID NO: 144056 - protein, 8 aa, Artificial Sequence
  Description of Artificial Sequence: Synthetic peptide
  Seed: VVLASLIY (PMEL_HUMAN)
  misc_feature (2)..(2): Xaa can be Met, Gln, Leu, Ser, Ile, or Val
  misc_feature (8)..(8): Xaa can be Tyr, Phe, or Met
VXLASLIX

SEQ ID NO: 144057 - protein, 9 aa, Artificial Sequence
  Description of Artificial Sequence: Synthetic peptide
  Seed: VVLASLIYR (PMEL_HUMAN)
  misc_feature (2)..(2): Xaa can be Leu, Met, Ile, Thr, Val, Gln, Ser, Ala, Tyr, Phe, Trp, Gly, Asp, Glu, Cys, His, Asn, Pro, Arg, or Lys
  misc_feature (9)..(9): Xaa can be Arg, Lys, His, Tyr, Val, Leu, Met, Ile, Phe, or Ala
VXLASLIYX

SEQ ID NO: 144058 - protein, 10 aa, Artificial Sequence
  Description of Artificial Sequence: Synthetic peptide
  Seed: VVLASLIYRR (PMEL_HUMAN)
  misc_feature (2)..(2): Xaa can be Tyr, Val, Ser, Trp, Leu, Phe, Ile, Gln, Thr, Met, Ala, Gly, His, Pro, Glu, Cys, Asn, Arg, Lys, or Asp
  misc_feature (10)..(10): Xaa can be Lys, Arg, His, Cys, Trp, Gly, Ile, Met, Asn, Thr, Pro, Glu, Gln, Ser, Tyr, Val, Leu, Asp, Phe, or Ala
VXLASLIYRX

SEQ ID NO: 144059 - protein, 11 aa, Artificial Sequence
  Description of Artificial Sequence: Synthetic peptide
  Seed: VVLASLIYRRR (PMEL_HUMAN)
  misc_feature (2)..(2): Xaa can be Val, Met, Phe, Tyr, Thr, Trp, Leu, Ser, Gln, Ala, Ile, Arg, Gly, Asn, Lys, or His
  misc_feature (11)..(11): Xaa can be Arg, Lys, His, Thr, Trp, Val, Phe, Glu, Cys, Leu, Ser, Tyr, Gln, Pro, Gly, Ile, Asp, Ala, Met, or Asn
VXLASLIYRRX

SEQ ID NO: 144060 - protein, 9 aa, Artificial Sequence
  Description of Artificial Sequence: Synthetic peptide
  Seed: VVLQAAIPL (PMEL_HUMAN)
  misc_feature (2)..(2): Xaa can be Pro, Gln, Ala, Met, Ile, Leu, Ser, Val, Thr, Gly, Lys, His, Asn, Glu, Asp, Arg, Cys, Phe, Tyr, or Trp
  misc_feature (9)..(9): Xaa can be Phe, Tyr, Leu, Met, Val, Ile, Trp, His, Lys, Ala, Arg, Thr, Cys, Gly, Ser, or Pro
VXLQAAIPX

SEQ ID NO: 144061 - protein, 9 aa, Artificial Sequence
  Description of Artificial Sequence: Synthetic peptide
  Seed: VVLSGTTAA (PMEL_HUMAN)
  misc_feature (2)..(2): Xaa can be Pro, Ala, Ser, Met, Ile, Val, Leu, Thr, Gln, Gly, Cys, Glu, Asn, Phe, Asp, Tyr, Trp, Lys, or Arg
  misc_feature (9)..(9): Xaa can be Tyr, Phe, Met, Leu, Lys, Arg, His, Val, Ile, Ala, Trp, Cys, Thr, Ser, Gln, Gly, Glu, Pro, Asn, or Asp
VXLSGTTAX

SEQ ID NO: 144062 - protein, 11 aa, Artificial Sequence
  Description of Artificial Sequence: Synthetic peptide
  Seed: VVLSGTTAAQV (PMEL_HUMAN)
  misc_feature (2)..(2): Xaa can be Tyr, Leu, Phe, Met, Val, Lys, Gly, Ser, Trp, Ala, Arg, or Ile
  misc_feature (11)..(11): Xaa can be Val, Leu, Ile, Ala, or Met
VXLSGTTAAQX

SEQ ID NO: 144063 - protein, 8 aa, Artificial Sequence
  Description of Artificial Sequence: Synthetic peptide
  Seed: VWGGQPVY (PMEL_HUMAN)
  misc_feature (2)..(2): Xaa can be Tyr, Phe, or Trp
  misc_feature (8)..(8): Xaa can be Leu, Tyr, Phe, Met, Val, or Ile
VXGGQPVX

SEQ ID NO: 144064 - protein, 9 aa, Artificial Sequence
  Description of Artificial Sequence: Synthetic peptide
  Seed: VWKTWGQYW (PMEL_HUMAN)
  misc_feature (2)..(2): Xaa can be Tyr, Ala, Ser, Thr, Trp, Phe, Met, Gly, Ile, Val, Cys, Leu, His, Pro, Asp, Lys, Gln, Arg, Glu, or Asn
  misc_feature (9)..(9): Xaa can be Trp, Phe, Ile, Met, Leu, Val, Tyr, or Cys
VXKTWGQYX

SEQ ID NO: 144065 - protein, 11 aa, Artificial Sequence
  Description of Artificial Sequence: Synthetic peptide
  Seed: VWKTWGQYWQV (PMEL_HUMAN)
  misc_feature (2)..(2): Xaa can be Met, Leu, Gln, Ile, Val, Asn, Arg, Ala, Pro, Trp, Asp, Lys, Ser, Tyr, Thr, Gly, His, Glu, Cys, or Phe
  misc_feature (11)..(11): Xaa can be Val, Ile, Leu, Ala, Thr, or Met
VXKTWGQYWQX

SEQ ID NO: 144066 - protein, 10 aa, Artificial Sequence
  Description of Artificial Sequence: Synthetic peptide
  Seed: VYHRRGSRSY (PMEL_HUMAN)
  misc_feature (2)..(2): Xaa can be Gln, Tyr, Met, Phe, Trp, His, Glu, Lys, Leu, Val, Cys, Arg, Asp, Thr, Ala, Asn, Pro, Ile, Ser, or Gly
  misc_feature (10)..(10): Xaa can be Tyr, Phe, Met, Leu, His, Trp, or Ile
VXHRRGSRSX

SEQ ID NO: 144067 - protein, 11 aa, Artificial Sequence
  Description of Artificial Sequence: Synthetic peptide
  Seed: VYPQETDDACI (PMEL_HUMAN)
  misc_feature (2)..(2): Xaa can be Tyr, Trp, Phe, or Met
  misc_feature (11)..(11): Xaa can be Phe, Trp, Leu, Met, Ile, or Tyr
VXPQETDDACX

SEQ ID NO: 144068 - protein, 10 aa, Artificial Sequence
  Description of Artificial Sequence: Synthetic peptide
  Seed: VYVWKTWGQY (PMEL_HUMAN)
  misc_feature (2)..(2): Xaa can be Tyr, Trp, Phe, Met, His, Gly, Asp, Glu, Leu, Ile, Arg, Gln, Ser, Thr, Asn, Cys, Pro, Lys, Ala, or Val
  misc_feature (10)..(10): Xaa can be Tyr, Phe, Ile, Trp, Leu, Met, or Val
VXVWKTWGQX

SEQ ID NO: 144069 - protein, 11 aa, Artificial Sequence
  Description of Artificial Sequence: Synthetic peptide
  Seed: VYVWKTWGQYW (PMEL_HUMAN)
  misc_feature (2)..(2): Xaa can be Tyr, Trp, Phe, Arg, Val, Cys, Asp, His, Ala, Pro, Ile, Gly, Leu, Met, Thr, Asn, Gln, Lys, Glu, or Ser
  misc_feature (11)..(11): Xaa can be Phe, Trp, Leu, Ile, Met, or Val
VXVWKTWGQYX

SEQ ID NO: 144070 - protein, 10 aa, Artificial Sequence
  Description of Artificial Sequence: Synthetic peptide
  Seed: WDFGDSSGTL (PMEL_HUMAN)
  misc_feature (2)..(2): Xaa can be Glu, Asp, or Gln
  misc_feature (10)..(10): Xaa can be Phe, Leu, Ala, Ile, Val, Cys, Pro, Met, Thr, Tyr, Trp, Gly, or Ser
WXFGDSSGTX

SEQ ID NO: 144071 - protein, 11 aa, Artificial Sequence
  Description of Artificial Sequence: Synthetic peptide
  Seed: WDFGDSSGTLI (PMEL_HUMAN)
  misc_feature (2)..(2): Xaa can be Glu, Asp, or Gln
  misc_feature (11)..(11): Xaa can be Ala, Cys, Val, Ile, Met, Leu, Tyr, Gln, Asp, Phe, Lys, Glu, Trp, Thr, Pro, Gly, Ser, or Ar g
WXFGDSSGTLX

SEQ ID NO: 144072 - protein, 10 aa, Artificial Sequence
  Description of Artificial Sequence: Synthetic peptide
  Seed: WKTWGQYWQV (PMEL_HUMAN)
  misc_feature (2)..(2): Xaa can be Met, Leu, Gln, Ile, Asn, Phe, His, Glu, Pro, Arg, Lys, Ser, Cys, Ala, Asp, Trp, Thr, Tyr, Val, or Gly
  misc_feature (10)..(10): Xaa can be Val, Ile, Ala, Leu, Met, Thr, Ser, Cys, or Phe
WXTWGQYWQX

SEQ ID NO: 144073 - protein, 9 aa, Artificial Sequence
  Description of Artificial Sequence: Synthetic peptide
  Seed: WLGVSRQLR (PMEL_HUMAN)
  misc_feature (2)..(2): Xaa can be Tyr, Ser, Met, Val, Phe, Ala, Thr, Ile, Leu, Gln, Trp, Pro, Gly, or Asn
  misc_feature (9)..(9): Xaa can be Arg, or Lys
WXGVSRQLX

SEQ ID NO: 144074 - protein, 9 aa, Artificial Sequence
  Description of Artificial Sequence: Synthetic peptide
  Seed: WNRQLYPEW (PMEL_HUMAN)
  misc_feature (2)..(2): Xaa can be Thr, Ser, Ala, Gly, Val, Ile, Cys, Met, Asn, Gln, Pro, Asp, Phe, Glu, or Leu
  misc_feature (9)..(9): Xaa can be Trp, Phe, Leu, Ile, Met, or Tyr
WXRQLYPEX

SEQ ID NO: 144075 - protein, 8 aa, Artificial Sequence
  Description of Artificial Sequence: Synthetic peptide
  Seed: WQVLGGPV (PMEL_HUMAN)
  misc_feature (2)..(2): Xaa can be , or Gln
  misc_feature (8)..(8): Xaa can be Val, or Ile
WXVLGGPX

SEQ ID NO: 144076 - protein, 9 aa, Artificial Sequence
  Description of Artificial Sequence: Synthetic peptide
  Seed: WQVLGGPVS (PMEL_HUMAN)
  misc_feature (2)..(2): Xaa can be Gln, Met, Lys, His, Ala, Leu, Ser, Arg, Glu, Asn, Ile, Val, Thr, Phe, Gly, Tyr, Cys, Trp, or Pro
  misc_feature (9)..(9): Xaa can be Tyr, Phe, Met, Leu, Trp, Ile, His, Val, Ala, Gly, Cys, Asn, Ser, or Thr
WXVLGGPVX

SEQ ID NO: 144077 - protein, 11 aa, Artificial Sequence
  Description of Artificial Sequence: Synthetic peptide
  Seed: WQVLGGPVSGL (PMEL_HUMAN)
  misc_feature (2)..(2): Xaa can be Met, Gln, Leu, Lys, Ala, Val, Ile, Thr, Ser, His, Glu, Tyr, Arg, Asn, Pro, Gly, Cys, Asp, Phe, or Trp
  misc_feature (11)..(11): Xaa can be Val, Leu, Tyr, Phe, Ile, Met, or Trp
WXVLGGPVSGX

SEQ ID NO: 144078 - protein, 8 aa, Artificial Sequence
  Description of Artificial Sequence: Synthetic peptide
  Seed: WRGGQVSL (PMEL_HUMAN)
  misc_feature (2)..(2): Xaa can be Arg, Tyr, or His
  misc_feature (8)..(8): Xaa can be Leu, Tyr, Phe, or Met
WXGGQVSX

SEQ ID NO: 144079 - protein, 9 aa, Artificial Sequence
  Description of Artificial Sequence: Synthetic peptide
  Seed: WRGGQVSLK (PMEL_HUMAN)
  misc_feature (2)..(2): Xaa can be , or Arg
  misc_feature (9)..(9): Xaa can be Met, Ile, Val, Trp, Leu, Phe, His, Tyr, Lys, or Arg
WXGGQVSLX

SEQ ID NO: 144080 - protein, 10 aa, Artificial Sequence
  Description of Artificial Sequence: Synthetic peptide
  Seed: WRGGQVSLKV (PMEL_HUMAN)
  misc_feature (2)..(2): Xaa can be , or Arg
  misc_feature (10)..(10): Xaa can be Trp, Lys, Phe, Tyr, Val, Leu, Ile, Met, His, or Arg
WXGGQVSLKX

SEQ ID NO: 144081 - protein, 9 aa, Artificial Sequence
  Description of Artificial Sequence: Synthetic peptide
  Seed: WSQKRSFVY (PMEL_HUMAN)
  misc_feature (2)..(2): Xaa can be Gln, Pro, Tyr, Ala, Met, Lys, Phe, Thr, Trp, Ser, Leu, Ile, Gly, Val, His, Asn, Arg, Glu, Cys, or Asp
  misc_feature (9)..(9): Xaa can be Tyr, Phe, Met, Trp, Leu, Ile, Val, His, Ala, Thr, Ser, or Gly
WXQKRSFVX

SEQ ID NO: 144082 - protein, 10 aa, Artificial Sequence
  Description of Artificial Sequence: Synthetic peptide
  Seed: WSQKRSFVYV (PMEL_HUMAN)
  misc_feature (2)..(2): Xaa can be Arg, Lys, Gln, Leu, Ser, Met, Val, Thr, Ile, Ala, Phe, Tyr, Cys, Pro, Glu, His, Asp, Trp, Asn, or Gly
  misc_feature (10)..(10): Xaa can be Val, Lys, Leu, Ala, Ile, Met, Arg, or Tyr
WXQKRSFVYX

SEQ ID NO: 144083 - protein, 11 aa, Artificial Sequence
  Description of Artificial Sequence: Synthetic peptide
  Seed: WSQKRSFVYVW (PMEL_HUMAN)
  misc_feature (2)..(2): Xaa can be Ser, Val, Cys, Thr, or Ala
  misc_feature (11)..(11): Xaa can be Trp, or Phe
WXQKRSFVYVX

SEQ ID NO: 144084 - protein, 10 aa, Artificial Sequence
  Description of Artificial Sequence: Synthetic peptide
  Seed: WTEAQRLDCW (PMEL_HUMAN)
  misc_feature (2)..(2): Xaa can be Ser, Met, Asn, Trp, Gln, Asp, Phe, Ala, Ile, Pro, Tyr, Thr, Gly, Lys, His, Val, Arg, Cys, Glu, or Leu
  misc_feature (10)..(10): Xaa can be , or Trp
WXEAQRLDCX

SEQ ID NO: 144085 - protein, 9 aa, Artificial Sequence
  Description of Artificial Sequence: Synthetic peptide
  Seed: WVETTAREL (PMEL_HUMAN)
  misc_feature (2)..(2): Xaa can be Ala, Ile, Leu, Phe, Ser, Thr, Tyr, Val, Arg, Gly, Met, Gln, His, Cys, Glu, Trp, or Asn
  misc_feature (9)..(9): Xaa can be Leu, Met, Phe, Tyr, Val, Ile, Trp, or His
WXETTAREX

SEQ ID NO: 144086 - protein, 8 aa, Artificial Sequence
  Description of Artificial Sequence: Synthetic peptide
  Seed: YGSFSVTL (PMEL_HUMAN)
  misc_feature (2)..(2): Xaa can be Ser, Ala, Thr, Gly, Ile, Val, Met, Arg, Phe, Gln, Leu, Asp, His, Cys, Tyr, Glu, Asn, or Pr o
  misc_feature (8)..(8): Xaa can be Leu, Met, Phe, Tyr, Ile, Val, or Trp
YXSFSVTX

SEQ ID NO: 144087 - protein, 10 aa, Artificial Sequence
  Description of Artificial Sequence: Synthetic peptide
  Seed: YGSFSVTLDI (PMEL_HUMAN)
  misc_feature (2)..(2): Xaa can be Leu, His, Asp, Tyr, Asn, Arg, Val, Glu, Met, Phe, Gln, Thr, Cys, Ala, Pro, Trp, Gly, Ser, Ile, or Lys
  misc_feature (10)..(10): Xaa can be Leu, Ile, Met, Tyr, Trp, Val, or Phe
YXSFSVTLDX

SEQ ID NO: 144088 - protein, 9 aa, Artificial Sequence
  Description of Artificial Sequence: Synthetic peptide
  Seed: YHRRGSRSY (PMEL_HUMAN)
  misc_feature (2)..(2): Xaa can be Tyr, Gln, Phe, Met, Leu, His, Lys, Arg, Val, Trp, Ala, Glu, Ile, Asn, Pro, Thr, Ser, Gly, Asp, or Cys
  misc_feature (9)..(9): Xaa can be Phe, Tyr, Met, Leu, Ile, Trp, Val, His, Ala, Thr, Cys, Ser, Gln, Gly, Lys, Glu, or Arg
YXRRGSRSX

SEQ ID NO: 144089 - protein, 9 aa, Artificial Sequence
  Description of Artificial Sequence: Synthetic peptide
  Seed: YLAEADLSY (PMEL_HUMAN)
  misc_feature (2)..(2): Xaa can be Pro, Ala, Tyr, Gln, Met, Arg, Leu, Ser, Phe, Val, Ile, Thr, Gly, Cys, Asn, Trp, Glu, His, Lys, or Asp
  misc_feature (9)..(9): Xaa can be Trp, Met, Phe, Ile, Tyr, Leu, His, Arg, Lys, Val, Ala, Cys, Thr, Ser, Gln, Gly, Asn, Glu, Pro, or Asp
YXAEADLSX

SEQ ID NO: 144090 - protein, 10 aa, Artificial Sequence
  Description of Artificial Sequence: Synthetic peptide
  Seed: YLAEADLSYT (PMEL_HUMAN)
  misc_feature (2)..(2): Xaa can be Val, Leu, Gln, Met, Ile, Thr, Ser, Ala, Phe, Gly, Glu, Asn, Trp, Lys, Pro, Cys, Tyr, Asp, Arg, or His
  misc_feature (10)..(10): Xaa can be Val, Leu, Tyr, Ile, Phe, Met, Ala, Thr, Ser, Cys, His, Asn, Glu, Trp, Lys, Pro, Gln, Asp, Gly, or Arg
YXAEADLSYX

SEQ ID NO: 144091 - protein, 11 aa, Artificial Sequence
  Description of Artificial Sequence: Synthetic peptide
  Seed: YLAEADLSYTW (PMEL_HUMAN)
  misc_feature (2)..(2): Xaa can be Leu, Met, Gln, Ile, Val, Phe, Tyr, Ala, Trp, Pro, Thr, Ser, Glu, His, Cys, Asn, Gly, Asp, Arg, or Lys
  misc_feature (11)..(11): Xaa can be Trp, Tyr, Phe, Ile, Leu, Met, Val, Ala, Cys, Ser, Lys, Gln, His, Thr, Pro, Arg, Asp, Glu, Asn, or Gly
YXAEADLSYTX

SEQ ID NO: 144092 - protein, 9 aa, Artificial Sequence
  Description of Artificial Sequence: Synthetic peptide
  Seed: YLEPGPVTA (PMEL_HUMAN)
  misc_feature (2)..(2): Xaa can be Pro, Phe, Ser, Tyr, Ala, Trp, Thr, Ile, Val, Leu, Arg, Gly, Met, Gln, Glu, Asn, Cys, His, Asp, or Lys
  misc_feature (9)..(9): Xaa can be Tyr, Leu, Ala, Met, Val, Ile, Phe, Cys, Lys, Trp, Arg, Thr, His, Pro, Ser, Gln, Gly, Glu, Asn, or Asp
YXEPGPVTX

SEQ ID NO: 144093 - protein, 11 aa, Artificial Sequence
  Description of Artificial Sequence: Synthetic peptide
  Seed: YLEPGPVTAQV (PMEL_HUMAN)
  misc_feature (2)..(2): Xaa can be Ala, Ser, Leu, Gly, Val, Met, Thr, Ile, Gln, Asn, Pro, Phe, Cys, Trp, Asp, Tyr, or Glu
  misc_feature (11)..(11): Xaa can be Leu, Met, Val, Phe, Ile, Cys, Trp, Ala, or Tyr
YXEPGPVTAQX

SEQ ID NO: 144094 - protein, 9 aa, Artificial Sequence
  Description of Artificial Sequence: Synthetic peptide
  Seed: YPEWTEAQR (PMEL_HUMAN)
  misc_feature (2)..(2): Xaa can be Ala, Thr, Val, Ile, Met, Leu, Gly, Pro, Ser, or Gln
  misc_feature (9)..(9): Xaa can be Arg, or Lys
YXEWTEAQX

SEQ ID NO: 144095 - protein, 10 aa, Artificial Sequence
  Description of Artificial Sequence: Synthetic peptide
  Seed: YPEWTEAQRL (PMEL_HUMAN)
  misc_feature (2)..(2): Xaa can be Pro, Ala, Glu, Val, Trp, Met, Asn, Phe, Asp, Cys, Gln, Gly, Arg, His, Ser, Thr, Lys, Tyr, Ile, or Leu
  misc_feature (10)..(10): Xaa can be Ile, Leu, Val, Met, Trp, Phe, or Tyr
YXEWTEAQRX

SEQ ID NO: 144096 - protein, 9 aa, Artificial Sequence
  Description of Artificial Sequence: Synthetic peptide
  Seed: YPQETDDAC (PMEL_HUMAN)
  misc_feature (2)..(2): Xaa can be Pro, Ala, Val, Met, Ile, Thr, Leu, Ser, Gln, Phe, Cys, Gly, Tyr, Trp, Asp, or Asn
  misc_feature (9)..(9): Xaa can be Tyr, Phe, Met, Leu, Trp, His, Val, Ala, Ile, Thr, Gly, Pro, Asn, Arg, Ser, Glu, Gln, or Cy s
YXQETDDAX

SEQ ID NO: 144097 - protein, 10 aa, Artificial Sequence
  Description of Artificial Sequence: Synthetic peptide
  Seed: YPQETDDACI (PMEL_HUMAN)
  misc_feature (2)..(2): Xaa can be Pro, Ala, Val, Ser, Thr, Met, Leu, or Ile
  misc_feature (10)..(10): Xaa can be Tyr, Phe, Trp, Met, Leu, Ala, Cys, His, Ile, or Val
YXQETDDACX

SEQ ID NO: 144098 - protein, 11 aa, Artificial Sequence
  Description of Artificial Sequence: Synthetic peptide
  Seed: YPQETDDACIF (PMEL_HUMAN)
  misc_feature (2)..(2): Xaa can be Pro, Ala, Met, Gln, Ser, Ile, Thr, Val, Leu, Gly, Glu, Phe, Cys, Tyr, or Trp
  misc_feature (11)..(11): Xaa can be Tyr, Trp, Phe, Met, Ala, His, Ile, Leu, Val, or Cys
YXQETDDACIX

SEQ ID NO: 144099 - protein, 10 aa, Artificial Sequence
  Description of Artificial Sequence: Synthetic peptide
  Seed: YRRRLMKQDF (PMEL_HUMAN)
  misc_feature (2)..(2): Xaa can be , or Arg
  misc_feature (10)..(10): Xaa can be Met, Tyr, Trp, Lys, Phe, or Leu
YXRRLMKQDX

SEQ ID NO: 144100 - protein, 8 aa, Artificial Sequence
  Description of Artificial Sequence: Synthetic peptide
  Seed: YRYGSFSV (PMEL_HUMAN)
  misc_feature (2)..(2): Xaa can be His, Arg, Gln, Tyr, Lys, Phe, Ala, Pro, or Met
  misc_feature (8)..(8): Xaa can be Leu, Met, Tyr, Ile, Ala, Phe, Val, Lys, Trp, Cys, Ser, Pro, Arg, or Thr
YXYGSFSX

SEQ ID NO: 144101 - protein, 9 aa, Artificial Sequence
  Description of Artificial Sequence: Synthetic peptide
  Seed: YRYGSFSVT (PMEL_HUMAN)
  misc_feature (2)..(2): Xaa can be Arg, His, Gln, Pro, Tyr, Ala, Lys, Glu, Asn, Met, Gly, Asp, Phe, Trp, Val, Leu, Ile, Cys, Ser, or Thr
  misc_feature (9)..(9): Xaa can be Ile, Leu, Phe, Tyr, Val, Met, Ala, Cys, Trp, Thr, His, Pro, Ser, Lys, Gln, Gly, Asn, Arg, Asp, or Glu
YXYGSFSVX

SEQ ID NO: 144102 - protein, 10 aa, Artificial Sequence
  Description of Artificial Sequence: Synthetic peptide
  Seed: YRYGSFSVTL (PMEL_HUMAN)
  misc_feature (2)..(2): Xaa can be Gln, Arg, Tyr, His, Met, Lys, Phe, Ser, Glu, Ala, Leu, Gly, Pro, Thr, Ile, Val, Trp, Asn, Asp, or Cys
  misc_feature (10)..(10): Xaa can be Leu, Val, Met, Tyr, Phe, Trp, Ile, His, Ala, Thr, Gly, Ser, Cys, Pro, Gln, Lys, Asn, Glu, or Arg
YXYGSFSVTX

SEQ ID NO: 144103 - protein, 11 aa, Artificial Sequence
  Description of Artificial Sequence: Synthetic peptide
  Seed: YRYGSFSVTLD (PMEL_HUMAN)
  misc_feature (2)..(2): Xaa can be Arg, or Gln
  misc_feature (11)..(11): Xaa can be Leu, Asn, Trp, Asp, His, Ile, Ala, Glu, Val, Arg, Gln, Met, Gly, Tyr, Phe, Ser, Thr, Lys, Cys, or Pro
YXYGSFSVTLX

SEQ ID NO: 144104 - protein, 10 aa, Artificial Sequence
  Description of Artificial Sequence: Synthetic peptide
  Seed: YVPLAHSSSA (PMEL_HUMAN)
  misc_feature (2)..(2): Xaa can be Met, Leu, Thr, Asn, His, Lys, Glu, Gly, Arg, Phe, Gln, Tyr, Ile, Cys, Ser, Pro, Trp, Val, Ala, or Asp
  misc_feature (10)..(10): Xaa can be Ala, Tyr, Cys, Val, Trp, Met, Leu, Phe, Ile, Thr, or Ser
YXPLAHSSSX

SEQ ID NO: 144105 - protein, 11 aa, Artificial Sequence
  Description of Artificial Sequence: Synthetic peptide
  Seed: YVPLAHSSSAF (PMEL_HUMAN)
  misc_feature (2)..(2): Xaa can be Ala, Gln, Ser, Gly, Met, Ile, Val, Thr, Phe, Tyr, Lys, Leu, Cys, Asn, Pro, Trp, Arg, Glu, Asp, or His
  misc_feature (11)..(11): Xaa can be Tyr, Phe, Met, Leu, Ile, Trp, His, Lys, or Val
YXPLAHSSSAX

SEQ ID NO: 144106 - protein, 9 aa, Artificial Sequence
  Description of Artificial Sequence: Synthetic peptide
  Seed: YVWKTWGQY (PMEL_HUMAN)
  misc_feature (2)..(2): Xaa can be Gln, Ala, Pro, Met, Thr, Leu, Ser, Ile, Val, Tyr, Gly, Lys, Phe, Asn, Glu, His, Cys, Asp, Trp, or Arg
  misc_feature (9)..(9): Xaa can be Phe, Tyr, Met, Lys, Trp, Leu, Arg, His, Val, Ile, Ala, or Gly
YXWKTWGQX

SEQ ID NO: 144107 - protein, 10 aa, Artificial Sequence
  Description of Artificial Sequence: Synthetic peptide
  Seed: YVWKTWGQYW (PMEL_HUMAN)
  misc_feature (2)..(2): Xaa can be Tyr, Ser, Pro, Trp, Thr, Gln, Ala, Val, Phe, Met, Arg, Leu, Gly, His, Lys, Asp, Glu, Ile, Cys, or Asn
  misc_feature (10)..(10): Xaa can be Ile, Phe, Leu, Trp, Met, Tyr, Val, Gly, or Ala
YXWKTWGQYX

SEQ ID NO: 144108 - protein, 9 aa, Artificial Sequence
  Description of Artificial Sequence: Synthetic peptide
  Seed: YWQVLGGPV (PMEL_HUMAN)
  misc_feature (2)..(2): Xaa can be Tyr, Phe, Trp, Met, Ala, His, Thr, Leu, Ser, Ile, Arg, Val, Pro, Gly, or Gln
  misc_feature (9)..(9): Xaa can be Phe, Met, Leu, Tyr, Ile, Val, Trp, His, Ala, Cys, Arg, Lys, or Thr
YXQVLGGPX

SEQ ID NO: 144109 - protein, 9 aa, Artificial Sequence
  Description of Artificial Sequence: Synthetic peptide
  Seed: EDLEVTCTW (PRAME_HUMAN)
EELEVTCTW

SEQ ID NO: 144110 - protein, 9 aa, Artificial Sequence
  Description of Artificial Sequence: Synthetic peptide
  Seed: ELFSYLIEK (PRAME_HUMAN)
ETFSYLIER

SEQ ID NO: 144111 - protein, 9 aa, Artificial Sequence
  Description of Artificial Sequence: Synthetic peptide
  Seed: FYDPEPILC (PRAME_HUMAN)
FFDPEPILL

SEQ ID NO: 144112 - protein, 9 aa, Artificial Sequence
  Description of Artificial Sequence: Synthetic peptide
  Seed: FYDPEPILC (PRAME_HUMAN)
FFDPEPILM

SEQ ID NO: 144113 - protein, 9 aa, Artificial Sequence
  Description of Artificial Sequence: Synthetic peptide
  Seed: FYDPEPILC (PRAME_HUMAN)
FYDPEPILF

SEQ ID NO: 144114 - protein, 9 aa, Artificial Sequence
  Description of Artificial Sequence: Synthetic peptide
  Seed: FYDPEPILC (PRAME_HUMAN)
FYDPEPILL

SEQ ID NO: 144115 - protein, 9 aa, Artificial Sequence
  Description of Artificial Sequence: Synthetic peptide
  Seed: ITDDQLLAL (PRAME_HUMAN)
IADDQLLAL

SEQ ID NO: 144116 - protein, 9 aa, Artificial Sequence
  Description of Artificial Sequence: Synthetic peptide
  Seed: ITDDQLLAL (PRAME_HUMAN)
IADDQLLAM

SEQ ID NO: 144117 - protein, 9 aa, Artificial Sequence
  Description of Artificial Sequence: Synthetic peptide
  Seed: ITDDQLLAL (PRAME_HUMAN)
ISDDQLLAL

SEQ ID NO: 144118 - protein, 9 aa, Artificial Sequence
  Description of Artificial Sequence: Synthetic peptide
  Seed: ISISALQSL (PRAME_HUMAN)
ISISALQSF

SEQ ID NO: 144119 - protein, 10 aa, Artificial Sequence
  Description of Artificial Sequence: Synthetic peptide
  Seed: ISMSVWTSPR (PRAME_HUMAN)
ISMSVWTSPK

SEQ ID NO: 144120 - protein, 10 aa, Artificial Sequence
  Description of Artificial Sequence: Synthetic peptide
  Seed: ISMSVWTSPR (PRAME_HUMAN)
ITMSVWTSPK

SEQ ID NO: 144121 - protein, 10 aa, Artificial Sequence
  Description of Artificial Sequence: Synthetic peptide
  Seed: ISMSVWTSPR (PRAME_HUMAN)
ITMSVWTSPR

SEQ ID NO: 144122 - protein, 9 aa, Artificial Sequence
  Description of Artificial Sequence: Synthetic peptide
  Seed: KAMVQAWPF (PRAME_HUMAN)
KMMVQAWPF

SEQ ID NO: 144123 - protein, 9 aa, Artificial Sequence
  Description of Artificial Sequence: Synthetic peptide
  Seed: KAMVQAWPF (PRAME_HUMAN)
KWMVQAWPF

SEQ ID NO: 144124 - protein, 9 aa, Artificial Sequence
  Description of Artificial Sequence: Synthetic peptide
  Seed: LPRELFPPL (PRAME_HUMAN)
LPRELFPPM

SEQ ID NO: 144125 - protein, 9 aa, Artificial Sequence
  Description of Artificial Sequence: Synthetic peptide
  Seed: LSNLTHVLY (PRAME_HUMAN)
LTNLTHVLY

SEQ ID NO: 144126 - protein, 10 aa, Artificial Sequence
  Description of Artificial Sequence: Synthetic peptide
  Seed: MPMQDIKMIL (PRAME_HUMAN)
MPMQDIKMIM

SEQ ID NO: 144127 - protein, 9 aa, Artificial Sequence
  Description of Artificial Sequence: Synthetic peptide
  Seed: NLTHVLYPV (PRAME_HUMAN)
NITHVLYPV

SEQ ID NO: 144128 - protein, 9 aa, Artificial Sequence
  Description of Artificial Sequence: Synthetic peptide
  Seed: NLTHVLYPV (PRAME_HUMAN)
NMTHVLYPV

SEQ ID NO: 144129 - protein, 9 aa, Artificial Sequence
  Description of Artificial Sequence: Synthetic peptide
  Seed: QALYVDSLF (PRAME_HUMAN)
QALYVDSLW

SEQ ID NO: 144130 - protein, 9 aa, Artificial Sequence
  Description of Artificial Sequence: Synthetic peptide
  Seed: RLRELLCEL (PRAME_HUMAN)
RMRELLCEV

SEQ ID NO: 144131 - protein, 9 aa, Artificial Sequence
  Description of Artificial Sequence: Synthetic peptide
  Seed: VSPEPLQAL (PRAME_HUMAN)
VAPEPLQAL

SEQ ID NO: 144132 - protein, 9 aa, Artificial Sequence
  Description of Artificial Sequence: Synthetic peptide
  Seed: VSPEPLQAL (PRAME_HUMAN)
VAPEPLQAM

SEQ ID NO: 144133 - protein, 9 aa, Artificial Sequence
  Description of Artificial Sequence: Synthetic peptide
  Seed: VSPEPLQAL (PRAME_HUMAN)
VAPEPLQAV

SEQ ID NO: 144134 - protein, 9 aa, Artificial Sequence
  Description of Artificial Sequence: Synthetic peptide
  Seed: VSPEPLQAL (PRAME_HUMAN)
VLPEPLQAL

SEQ ID NO: 144135 - protein, 9 aa, Artificial Sequence
  Description of Artificial Sequence: Synthetic peptide
  Seed: VSPEPLQAL (PRAME_HUMAN)
VMPEPLQAL

SEQ ID NO: 144136 - protein, 9 aa, Artificial Sequence
  Description of Artificial Sequence: Synthetic peptide
  Seed: YIAQFTSQF (PRAME_HUMAN)
YAAQFTSQM

SEQ ID NO: 144137 - protein, 9 aa, Artificial Sequence
  Description of Artificial Sequence: Synthetic peptide
  Seed: YLHARLREL (PRAME_HUMAN)
YAHARLREF

SEQ ID NO: 144138 - protein, 9 aa, Artificial Sequence
  Description of Artificial Sequence: Synthetic peptide
  Seed: YLHARLREL (PRAME_HUMAN)
YAHARLREM

SEQ ID NO: 144139 - protein, 9 aa, Artificial Sequence
  Description of Artificial Sequence: Synthetic peptide
  Seed: YLHARLREL (PRAME_HUMAN)
YRHARLREM

SEQ ID NO: 144140 - protein, 9 aa, Artificial Sequence
  Description of Artificial Sequence: Synthetic peptide
  Seed: YLHARLREL (PRAME_HUMAN)
YRHARLREY

SEQ ID NO: 144141 - protein, 9 aa, Artificial Sequence
  Description of Artificial Sequence: Synthetic peptide
  Seed: YIAQFTSQF (PRAME_HUMAN)
YTAQFTSQY

SEQ ID NO: 144142 - protein, 9 aa, Artificial Sequence
  Description of Artificial Sequence: Synthetic peptide
  Seed: YLHARLREL (PRAME_HUMAN)
YYHARLREM

SEQ ID NO: 144143 - protein, 11 aa, Homo sapiens
  Native (PRAME_HUMAN)
AAFDGRHSQTL

SEQ ID NO: 144144 - protein, 10 aa, Homo sapiens
  Native (PRAME_HUMAN)
AEQPFIPVEV

SEQ ID NO: 144145 - protein, 10 aa, Homo sapiens
  Native (PRAME_HUMAN)
CELGRPSMVW

SEQ ID NO: 144146 - protein, 10 aa, Homo sapiens
  Native (PRAME_HUMAN)
CTWKLPTLAK

SEQ ID NO: 144147 - protein, 9 aa, Homo sapiens
  Native (PRAME_HUMAN)
DEALAIAAL

SEQ ID NO: 144148 - protein, 9 aa, Homo sapiens
  Native (PRAME_HUMAN)
ELFSYLIEK

SEQ ID NO: 144149 - protein, 9 aa, Homo sapiens
  Native (PRAME_HUMAN)
ETLSITNCR

SEQ ID NO: 144150 - protein, 9 aa, Homo sapiens
  Native (PRAME_HUMAN)
FLRGRLDQL

SEQ ID NO: 144151 - protein, 10 aa, Homo sapiens
  Native (PRAME_HUMAN)
FPEPEAAQPM

SEQ ID NO: 144152 - protein, 8 aa, Homo sapiens
  Native (PRAME_HUMAN)
FYDPEPIL

SEQ ID NO: 144153 - protein, 9 aa, Homo sapiens
  Native (PRAME_HUMAN)
HVMNPLETL

SEQ ID NO: 144154 - protein, 10 aa, Homo sapiens
  Native (PRAME_HUMAN)
IPVEVLVDLF

SEQ ID NO: 144155 - protein, 9 aa, Homo sapiens
  Native (PRAME_HUMAN)
ISISALQSL

SEQ ID NO: 144156 - protein, 9 aa, Homo sapiens
  Native (PRAME_HUMAN)
ITDDQLLAL

SEQ ID NO: 144157 - protein, 9 aa, Homo sapiens
  Native (PRAME_HUMAN)
KAMVQAWPF

SEQ ID NO: 144158 - protein, 9 aa, Homo sapiens
  Native (PRAME_HUMAN)
KEEQYIAQF

SEQ ID NO: 144159 - protein, 11 aa, Homo sapiens
  Native (PRAME_HUMAN)
KIFAMPMQDIK

SEQ ID NO: 144160 - protein, 9 aa, Homo sapiens
  Native (PRAME_HUMAN)
KLKIFAMPM

SEQ ID NO: 144161 - protein, 9 aa, Homo sapiens
  Native (PRAME_HUMAN)
KRKKNVLRL

SEQ ID NO: 144162 - protein, 9 aa, Homo sapiens
  Native (PRAME_HUMAN)
LAIAALELL

SEQ ID NO: 144163 - protein, 9 aa, Homo sapiens
  Native (PRAME_HUMAN)
LEVTCTWKL

SEQ ID NO: 144164 - protein, 9 aa, Homo sapiens
  Native (PRAME_HUMAN)
LPRELFPPL

SEQ ID NO: 144165 - protein, 9 aa, Homo sapiens
  Native (PRAME_HUMAN)
LSHIHASSY

SEQ ID NO: 144166 - protein, 9 aa, Homo sapiens
  Native (PRAME_HUMAN)
LSNLTHVLY

SEQ ID NO: 144167 - protein, 9 aa, Homo sapiens
  Native (PRAME_HUMAN)
LYPVPLESY

SEQ ID NO: 144168 - protein, 9 aa, Homo sapiens
  Native (PRAME_HUMAN)
LYVDSLFFL

SEQ ID NO: 144169 - protein, 10 aa, Homo sapiens
  Native (PRAME_HUMAN)
MPMQDIKMIL

SEQ ID NO: 144170 - protein, 9 aa, Homo sapiens
  Native (PRAME_HUMAN)
NLTHVLYPV

SEQ ID NO: 144171 - protein, 9 aa, Homo sapiens
  Native (PRAME_HUMAN)
NSHQDFWTV

SEQ ID NO: 144172 - protein, 9 aa, Homo sapiens
  Native (PRAME_HUMAN)
QLLALLPSL

SEQ ID NO: 144173 - protein, 10 aa, Homo sapiens
  Native (PRAME_HUMAN)
QTLKAMVQAW

SEQ ID NO: 144174 - protein, 10 aa, Homo sapiens
  Native (PRAME_HUMAN)
QYIAQFTSQF

SEQ ID NO: 144175 - protein, 9 aa, Homo sapiens
  Native (PRAME_HUMAN)
RLRELLCEL

SEQ ID NO: 144176 - protein, 9 aa, Homo sapiens
  Native (PRAME_HUMAN)
RLWGSIQSR

SEQ ID NO: 144177 - protein, 9 aa, Homo sapiens
  Native (PRAME_HUMAN)
SIQSRYISM

SEQ ID NO: 144178 - protein, 9 aa, Homo sapiens
  Native (PRAME_HUMAN)
SLQCLQALY

SEQ ID NO: 144179 - protein, 9 aa, Homo sapiens
  Native (PRAME_HUMAN)
SMSVWTSPR

SEQ ID NO: 144180 - protein, 9 aa, Homo sapiens
  Native (PRAME_HUMAN)
SQLTTLSFY

SEQ ID NO: 144181 - protein, 9 aa, Homo sapiens
  Native (PRAME_HUMAN)
SQSPSVSQL

SEQ ID NO: 144182 - protein, 9 aa, Homo sapiens
  Native (PRAME_HUMAN)
SYEDIHGTL

SEQ ID NO: 144183 - protein, 9 aa, Homo sapiens
  Native (PRAME_HUMAN)
TSPRRLVEL

SEQ ID NO: 144184 - protein, 9 aa, Homo sapiens
  Native (PRAME_HUMAN)
VELAGQSLL

SEQ ID NO: 144185 - protein, 9 aa, Homo sapiens
  Native (PRAME_HUMAN)
VLDGLDVLL

SEQ ID NO: 144186 - protein, 10 aa, Homo sapiens
  Native (PRAME_HUMAN)
VLYPVPLESY

SEQ ID NO: 144187 - protein, 9 aa, Homo sapiens
  Native (PRAME_HUMAN)
VSPEPLQAL

SEQ ID NO: 144188 - protein, 9 aa, Homo sapiens
  Native (PRAME_HUMAN)
YLHARLREL

SEQ ID NO: 144189 - protein, 9 aa, Artificial Sequence
  Description of Artificial Sequence: Synthetic peptide
  Seed: SLLQHLIGL (PRAME_HUMAN)
SLLQHLIGK

SEQ ID NO: 144190 - protein, 10 aa, Artificial Sequence
  Description of Artificial Sequence: Synthetic peptide
  Seed: QAWPFTCLPL (PRAME_HUMAN)
QTWPFTCLPV

SEQ ID NO: 144191 - protein, 9 aa, Artificial Sequence
  Description of Artificial Sequence: Synthetic peptide
  Seed: GLSNLTHVL (PRAME_HUMAN)
GSSNLTHVY

SEQ ID NO: 144192 - protein, 11 aa, Artificial Sequence
  Description of Artificial Sequence: Synthetic peptide
  Seed: QYIAQFTSQFL (PRAME_HUMAN)
QYIAQFTSQFF

SEQ ID NO: 144193 - protein, 9 aa, Artificial Sequence
  Description of Artificial Sequence: Synthetic peptide
  Seed: YSFPEPEAA (PRAME_HUMAN)
YYFPEPEAV

SEQ ID NO: 144194 - protein, 9 aa, Artificial Sequence
  Description of Artificial Sequence: Synthetic peptide
  Seed: WLSANPCPH (PRAME_HUMAN)
WVSANPCPY

SEQ ID NO: 144195 - protein, 9 aa, Artificial Sequence
  Description of Artificial Sequence: Synthetic peptide
  Seed: LLRHVMNPL (PRAME_HUMAN)
LIRHVMNPY

SEQ ID NO: 144196 - protein, 10 aa, Artificial Sequence
  Description of Artificial Sequence: Synthetic peptide
  Seed: SVLSLSGVML (PRAME_HUMAN)
SFLSLSGVMV

SEQ ID NO: 144197 - protein, 9 aa, Artificial Sequence
  Description of Artificial Sequence: Synthetic peptide
  Seed: SLLQHLIGL (PRAME_HUMAN)
SILQHLIGF

SEQ ID NO: 144198 - protein, 9 aa, Artificial Sequence
  Description of Artificial Sequence: Synthetic peptide
  Seed: SRYISMSVW (PRAME_HUMAN)
SAYISMSVL

SEQ ID NO: 144199 - protein, 9 aa, Artificial Sequence
  Description of Artificial Sequence: Synthetic peptide
  Seed: LDQLLRHVM (PRAME_HUMAN)
LEQLLRHVI

SEQ ID NO: 144200 - protein, 9 aa, Artificial Sequence
  Description of Artificial Sequence: Synthetic peptide
  Seed: ALQSLLQHL (PRAME_HUMAN)
AAQSLLQHI

SEQ ID NO: 144201 - protein, 9 aa, Artificial Sequence
  Description of Artificial Sequence: Synthetic peptide
  Seed: ISPEKEEQY (PRAME_HUMAN)
IRPEKEEQL

SEQ ID NO: 144202 - protein, 9 aa, Artificial Sequence
  Description of Artificial Sequence: Synthetic peptide
  Seed: ELFPPLFMA (PRAME_HUMAN)
ETFPPLFMT

SEQ ID NO: 144203 - protein, 9 aa, Artificial Sequence
  Description of Artificial Sequence: Synthetic peptide
  Seed: SFYGNSISI (PRAME_HUMAN)
SCYGNSISY

SEQ ID NO: 144204 - protein, 9 aa, Artificial Sequence
  Description of Artificial Sequence: Synthetic peptide
  Seed: RTFYDPEPI (PRAME_HUMAN)
RIFYDPEPI

SEQ ID NO: 144205 - protein, 9 aa, Artificial Sequence
  Description of Artificial Sequence: Synthetic peptide
  Seed: LALLPSLSH (PRAME_HUMAN)
LILLPSLSF

SEQ ID NO: 144206 - protein, 9 aa, Artificial Sequence
  Description of Artificial Sequence: Synthetic peptide
  Seed: RRWKLQVLD (PRAME_HUMAN)
RKWKLQVLF

SEQ ID NO: 144207 - protein, 10 aa, Artificial Sequence
  Description of Artificial Sequence: Synthetic peptide
  Seed: AQFTSQFLSL (PRAME_HUMAN)
ARFTSQFLSI

SEQ ID NO: 144208 - protein, 9 aa, Artificial Sequence
  Description of Artificial Sequence: Synthetic peptide
  Seed: YSFPEPEAA (PRAME_HUMAN)
YPFPEPEAT

SEQ ID NO: 144209 - protein, 9 aa, Artificial Sequence
  Description of Artificial Sequence: Synthetic peptide
  Seed: LLSHIHASS (PRAME_HUMAN)
LQSHIHASV

SEQ ID NO: 144210 - protein, 9 aa, Artificial Sequence
  Description of Artificial Sequence: Synthetic peptide
  Seed: SFYGNSISI (PRAME_HUMAN)
SHYGNSISL

SEQ ID NO: 144211 - protein, 10 aa, Artificial Sequence
  Description of Artificial Sequence: Synthetic peptide
  Seed: LYVDSLFFLR (PRAME_HUMAN)
LIVDSLFFLR

SEQ ID NO: 144212 - protein, 9 aa, Artificial Sequence
  Description of Artificial Sequence: Synthetic peptide
  Seed: SIEDLEVTC (PRAME_HUMAN)
SGEDLEVTM

SEQ ID NO: 144213 - protein, 9 aa, Artificial Sequence
  Description of Artificial Sequence: Synthetic peptide
  Seed: KLKIFAMPM (PRAME_HUMAN)
KKKIFAMPL

SEQ ID NO: 144214 - protein, 10 aa, Artificial Sequence
  Description of Artificial Sequence: Synthetic peptide
  Seed: SMVWLSANPC (PRAME_HUMAN)
SIVWLSANPV

SEQ ID NO: 144215 - protein, 9 aa, Artificial Sequence
  Description of Artificial Sequence: Synthetic peptide
  Seed: STEAEQPFI (PRAME_HUMAN)
SAEAEQPFL

SEQ ID NO: 144216 - protein, 9 aa, Artificial Sequence
  Description of Artificial Sequence: Synthetic peptide
  Seed: SLLQHLIGL (PRAME_HUMAN)
SVLQHLIGY

SEQ ID NO: 144217 - protein, 9 aa, Artificial Sequence
  Description of Artificial Sequence: Synthetic peptide
  Seed: SLFFLRGRL (PRAME_HUMAN)
SLFFLRGRW

SEQ ID NO: 144218 - protein, 9 aa, Artificial Sequence
  Description of Artificial Sequence: Synthetic peptide
  Seed: SPEPLQALL (PRAME_HUMAN)
SFEPLQALF

SEQ ID NO: 144219 - protein, 9 aa, Artificial Sequence
  Description of Artificial Sequence: Synthetic peptide
  Seed: TFKAVLDGL (PRAME_HUMAN)
TYKAVLDGI

SEQ ID NO: 144220 - protein, 9 aa, Artificial Sequence
  Description of Artificial Sequence: Synthetic peptide
  Seed: SISALQSLL (PRAME_HUMAN)
SMSALQSLK

SEQ ID NO: 144221 - protein, 9 aa, Artificial Sequence
  Description of Artificial Sequence: Synthetic peptide
  Seed: ISPEKEEQY (PRAME_HUMAN)
IAPEKEEQI

SEQ ID NO: 144222 - protein, 9 aa, Artificial Sequence
  Description of Artificial Sequence: Synthetic peptide
  Seed: TDDQLLALL (PRAME_HUMAN)
TWDQLLALM

SEQ ID NO: 144223 - protein, 10 aa, Artificial Sequence
  Description of Artificial Sequence: Synthetic peptide
  Seed: MVQAWPFTCL (PRAME_HUMAN)
MLQAWPFTCA

SEQ ID NO: 144224 - protein, 9 aa, Artificial Sequence
  Description of Artificial Sequence: Synthetic peptide
  Seed: RLRELLCEL (PRAME_HUMAN)
RQRELLCEF

SEQ ID NO: 144225 - protein, 9 aa, Artificial Sequence
  Description of Artificial Sequence: Synthetic peptide
  Seed: GQHLHLETF (PRAME_HUMAN)
GDHLHLETI

SEQ ID NO: 144226 - protein, 9 aa, Artificial Sequence
  Description of Artificial Sequence: Synthetic peptide
  Seed: YISMSVWTS (PRAME_HUMAN)
YMSMSVWTS

SEQ ID NO: 144227 - protein, 9 aa, Artificial Sequence
  Description of Artificial Sequence: Synthetic peptide
  Seed: EAAQPMTKK (PRAME_HUMAN)
EYAQPMTKK

SEQ ID NO: 144228 - protein, 9 aa, Artificial Sequence
  Description of Artificial Sequence: Synthetic peptide
  Seed: LSLQCLQAL (PRAME_HUMAN)
LTLQCLQAY

SEQ ID NO: 144229 - protein, 9 aa, Artificial Sequence
  Description of Artificial Sequence: Synthetic peptide
  Seed: VFDECGITD (PRAME_HUMAN)
VWDECGITI

SEQ ID NO: 144230 - protein, 9 aa, Artificial Sequence
  Description of Artificial Sequence: Synthetic peptide
  Seed: YGNSISISA (PRAME_HUMAN)
YYNSISISL

SEQ ID NO: 144231 - protein, 9 aa, Artificial Sequence
  Description of Artificial Sequence: Synthetic peptide
  Seed: ALAIAALEL (PRAME_HUMAN)
AIAIAALEF

SEQ ID NO: 144232 - protein, 10 aa, Artificial Sequence
  Description of Artificial Sequence: Synthetic peptide
  Seed: ALELLPRELF (PRAME_HUMAN)
ALELLPRELW

SEQ ID NO: 144233 - protein, 9 aa, Artificial Sequence
  Description of Artificial Sequence: Synthetic peptide
  Seed: LSVLSLSGV (PRAME_HUMAN)
LVVLSLSGY

SEQ ID NO: 144234 - protein, 10 aa, Artificial Sequence
  Description of Artificial Sequence: Synthetic peptide
  Seed: LSQSPSVSQL (PRAME_HUMAN)
LTQSPSVSQM

SEQ ID NO: 144235 - protein, 10 aa, Artificial Sequence
  Description of Artificial Sequence: Synthetic peptide
  Seed: AVLDGLDVLL (PRAME_HUMAN)
AVLDGLDVLM

SEQ ID NO: 144236 - protein, 9 aa, Artificial Sequence
  Description of Artificial Sequence: Synthetic peptide
  Seed: SHQDFWTVW (PRAME_HUMAN)
SHQDFWTVI

SEQ ID NO: 144237 - protein, 9 aa, Artificial Sequence
  Description of Artificial Sequence: Synthetic peptide
  Seed: EVLVDLFLK (PRAME_HUMAN)
EALVDLFLR

SEQ ID NO: 144238 - protein, 10 aa, Artificial Sequence
  Description of Artificial Sequence: Synthetic peptide
  Seed: TLAKFSPYLG (PRAME_HUMAN)
TLAKFSPYLL

SEQ ID NO: 144239 - protein, 9 aa, Artificial Sequence
  Description of Artificial Sequence: Synthetic peptide
  Seed: LLLSHIHAS (PRAME_HUMAN)
LTLSHIHAA

SEQ ID NO: 144240 - protein, 8 aa, Artificial Sequence
  Description of Artificial Sequence: Synthetic peptide
  Seed: YEDIHGTL (PRAME_HUMAN)
YGDIHGTM

SEQ ID NO: 144241 - protein, 10 aa, Artificial Sequence
  Description of Artificial Sequence: Synthetic peptide
  Seed: ISISALQSLL (PRAME_HUMAN)
ILISALQSLL

SEQ ID NO: 144242 - protein, 10 aa, Artificial Sequence
  Description of Artificial Sequence: Synthetic peptide
  Seed: RRRLWGSIQS (PRAME_HUMAN)
RKRLWGSIQR

SEQ ID NO: 144243 - protein, 10 aa, Artificial Sequence
  Description of Artificial Sequence: Synthetic peptide
  Seed: RLSEGDVMHL (PRAME_HUMAN)
RTSEGDVMHV

SEQ ID NO: 144244 - protein, 9 aa, Artificial Sequence
  Description of Artificial Sequence: Synthetic peptide
  Seed: RLRELLCEL (PRAME_HUMAN)
RVRELLCEI

SEQ ID NO: 144245 - protein, 9 aa, Artificial Sequence
  Description of Artificial Sequence: Synthetic peptide
  Seed: LLRHVMNPL (PRAME_HUMAN)
LMRHVMNPV

SEQ ID NO: 144246 - protein, 9 aa, Artificial Sequence
  Description of Artificial Sequence: Synthetic peptide
  Seed: SFPEPEAAQ (PRAME_HUMAN)
SFPEPEAAM

SEQ ID NO: 144247 - protein, 9 aa, Artificial Sequence
  Description of Artificial Sequence: Synthetic peptide
  Seed: VSQLSVLSL (PRAME_HUMAN)
VAQLSVLSF

SEQ ID NO: 144248 - protein, 11 aa, Artificial Sequence
  Description of Artificial Sequence: Synthetic peptide
  Seed: AAFDGRHSQTL (PRAME_HUMAN)
AYFDGRHSQTL

SEQ ID NO: 144249 - protein, 9 aa, Artificial Sequence
  Description of Artificial Sequence: Synthetic peptide
  Seed: FYDPEPILC (PRAME_HUMAN)
FDDPEPILL

SEQ ID NO: 144250 - protein, 9 aa, Artificial Sequence
  Description of Artificial Sequence: Synthetic peptide
  Seed: CKKLKIFAM (PRAME_HUMAN)
CIKLKIFAA

SEQ ID NO: 144251 - protein, 10 aa, Artificial Sequence
  Description of Artificial Sequence: Synthetic peptide
  Seed: ARLRELLCEL (PRAME_HUMAN)
AYLRELLCEV

SEQ ID NO: 144252 - protein, 9 aa, Artificial Sequence
  Description of Artificial Sequence: Synthetic peptide
  Seed: NLTHVLYPV (PRAME_HUMAN)
NQTHVLYPL

SEQ ID NO: 144253 - protein, 9 aa, Artificial Sequence
  Description of Artificial Sequence: Synthetic peptide
  Seed: KLKIFAMPM (PRAME_HUMAN)
KFKIFAMPK

SEQ ID NO: 144254 - protein, 9 aa, Artificial Sequence
  Description of Artificial Sequence: Synthetic peptide
  Seed: RLAYLHARL (PRAME_HUMAN)
RVAYLHARV

SEQ ID NO: 144255 - protein, 9 aa, Artificial Sequence
  Description of Artificial Sequence: Synthetic peptide
  Seed: RTFYDPEPI (PRAME_HUMAN)
RVFYDPEPW

SEQ ID NO: 144256 - protein, 10 aa, Artificial Sequence
  Description of Artificial Sequence: Synthetic peptide
  Seed: GACDELFSYL (PRAME_HUMAN)
GQCDELFSYF

SEQ ID NO: 144257 - protein, 11 aa, Artificial Sequence
  Description of Artificial Sequence: Synthetic peptide
  Seed: EQYIAQFTSQF (PRAME_HUMAN)
EMYIAQFTSQF

SEQ ID NO: 144258 - protein, 10 aa, Artificial Sequence
  Description of Artificial Sequence: Synthetic peptide
  Seed: LSFYGNSISI (PRAME_HUMAN)
LIFYGNSISL

SEQ ID NO: 144259 - protein, 10 aa, Artificial Sequence
  Description of Artificial Sequence: Synthetic peptide
  Seed: FAMPMQDIKM (PRAME_HUMAN)
FVMPMQDIKV

SEQ ID NO: 144260 - protein, 9 aa, Artificial Sequence
  Description of Artificial Sequence: Synthetic peptide
  Seed: ALAIAALEL (PRAME_HUMAN)
AAAIAALEF

SEQ ID NO: 144261 - protein, 9 aa, Artificial Sequence
  Description of Artificial Sequence: Synthetic peptide
  Seed: SQLTTLSFY (PRAME_HUMAN)
SLLTTLSFR

SEQ ID NO: 144262 - protein, 10 aa, Artificial Sequence
  Description of Artificial Sequence: Synthetic peptide
  Seed: LLLSHIHASS (PRAME_HUMAN)
LRLSHIHASL

SEQ ID NO: 144263 - protein, 8 aa, Artificial Sequence
  Description of Artificial Sequence: Synthetic peptide
  Seed: FTSQFLSL (PRAME_HUMAN)
FSSQFLSL

SEQ ID NO: 144264 - protein, 9 aa, Artificial Sequence
  Description of Artificial Sequence: Synthetic peptide
  Seed: HVMNPLETL (PRAME_HUMAN)
HYMNPLETI

SEQ ID NO: 144265 - protein, 9 aa, Artificial Sequence
  Description of Artificial Sequence: Synthetic peptide
  Seed: KAMVQAWPF (PRAME_HUMAN)
KTMVQAWPM

SEQ ID NO: 144266 - protein, 9 aa, Artificial Sequence
  Description of Artificial Sequence: Synthetic peptide
  Seed: LLRHVMNPL (PRAME_HUMAN)
LKRHVMNPM

SEQ ID NO: 144267 - protein, 9 aa, Artificial Sequence
  Description of Artificial Sequence: Synthetic peptide
  Seed: SIQSRYISM (PRAME_HUMAN)
SYQSRYISY

SEQ ID NO: 144268 - protein, 10 aa, Artificial Sequence
  Description of Artificial Sequence: Synthetic peptide
  Seed: RHVMNPLETL (PRAME_HUMAN)
RHVMNPLETY

SEQ ID NO: 144269 - protein, 9 aa, Artificial Sequence
  Description of Artificial Sequence: Synthetic peptide
  Seed: SFYGNSISI (PRAME_HUMAN)
SNYGNSISF

SEQ ID NO: 144270 - protein, 9 aa, Artificial Sequence
  Description of Artificial Sequence: Synthetic peptide
  Seed: RASATLQDL (PRAME_HUMAN)
RPSATLQDM

SEQ ID NO: 144271 - protein, 9 aa, Artificial Sequence
  Description of Artificial Sequence: Synthetic peptide
  Seed: GQHLHLETF (PRAME_HUMAN)
GLHLHLETF

SEQ ID NO: 144272 - protein, 9 aa, Artificial Sequence
  Description of Artificial Sequence: Synthetic peptide
  Seed: SHIHASSYI (PRAME_HUMAN)
SFIHASSYM

SEQ ID NO: 144273 - protein, 10 aa, Artificial Sequence
  Description of Artificial Sequence: Synthetic peptide
  Seed: HASSYISPEK (PRAME_HUMAN)
HHSSYISPER

SEQ ID NO: 144274 - protein, 8 aa, Artificial Sequence
  Description of Artificial Sequence: Synthetic peptide
  Seed: TDDQLLAL (PRAME_HUMAN)
TTDQLLAM

SEQ ID NO: 144275 - protein, 9 aa, Artificial Sequence
  Description of Artificial Sequence: Synthetic peptide
  Seed: RASATLQDL (PRAME_HUMAN)
RSSATLQDF

SEQ ID NO: 144276 - protein, 9 aa, Artificial Sequence
  Description of Artificial Sequence: Synthetic peptide
  Seed: HVMNPLETL (PRAME_HUMAN)
HLMNPLETK

SEQ ID NO: 144277 - protein, 9 aa, Artificial Sequence
  Description of Artificial Sequence: Synthetic peptide
  Seed: KLKIFAMPM (PRAME_HUMAN)
KGKIFAMPK

SEQ ID NO: 144278 - protein, 9 aa, Artificial Sequence
  Description of Artificial Sequence: Synthetic peptide
  Seed: FDGRHSQTL (PRAME_HUMAN)
FAGRHSQTM

SEQ ID NO: 144279 - protein, 10 aa, Artificial Sequence
  Description of Artificial Sequence: Synthetic peptide
  Seed: LLSHIHASSY (PRAME_HUMAN)
LHSHIHASSW

SEQ ID NO: 144280 - protein, 10 aa, Artificial Sequence
  Description of Artificial Sequence: Synthetic peptide
  Seed: DELFSYLIEK (PRAME_HUMAN)
DSLFSYLIER

SEQ ID NO: 144281 - protein, 10 aa, Artificial Sequence
  Description of Artificial Sequence: Synthetic peptide
  Seed: VLYPVPLESY (PRAME_HUMAN)
VIYPVPLESF

SEQ ID NO: 144282 - protein, 9 aa, Artificial Sequence
  Description of Artificial Sequence: Synthetic peptide
  Seed: VWSGNRASL (PRAME_HUMAN)
VVSGNRASL

SEQ ID NO: 144283 - protein, 11 aa, Artificial Sequence
  Description of Artificial Sequence: Synthetic peptide
  Seed: RELFPPLFMAA (PRAME_HUMAN)
RLLFPPLFMAL

SEQ ID NO: 144284 - protein, 9 aa, Artificial Sequence
  Description of Artificial Sequence: Synthetic peptide
  Seed: ELAGQSLLK (PRAME_HUMAN)
EWAGQSLLR

SEQ ID NO: 144285 - protein, 9 aa, Artificial Sequence
  Description of Artificial Sequence: Synthetic peptide
  Seed: FMAAFDGRH (PRAME_HUMAN)
FQAAFDGRY

SEQ ID NO: 144286 - protein, 9 aa, Artificial Sequence
  Description of Artificial Sequence: Synthetic peptide
  Seed: ELAGQSLLK (PRAME_HUMAN)
EQAGQSLLR

SEQ ID NO: 144287 - protein, 9 aa, Artificial Sequence
  Description of Artificial Sequence: Synthetic peptide
  Seed: YSFPEPEAA (PRAME_HUMAN)
YPFPEPEAC

SEQ ID NO: 144288 - protein, 9 aa, Artificial Sequence
  Description of Artificial Sequence: Synthetic peptide
  Seed: SYEDIHGTL (PRAME_HUMAN)
STEDIHGTL

SEQ ID NO: 144289 - protein, 9 aa, Artificial Sequence
  Description of Artificial Sequence: Synthetic peptide
  Seed: RLWGSIQSR (PRAME_HUMAN)
RMWGSIQSI

SEQ ID NO: 144290 - protein, 9 aa, Artificial Sequence
  Description of Artificial Sequence: Synthetic peptide
  Seed: KFSPYLGQM (PRAME_HUMAN)
KRSPYLGQI

SEQ ID NO: 144291 - protein, 10 aa, Artificial Sequence
  Description of Artificial Sequence: Synthetic peptide
  Seed: QAWPFTCLPL (PRAME_HUMAN)
QQWPFTCLPI

SEQ ID NO: 144292 - protein, 9 aa, Artificial Sequence
  Description of Artificial Sequence: Synthetic peptide
  Seed: RLRELLCEL (PRAME_HUMAN)
RVRELLCEY

SEQ ID NO: 144293 - protein, 9 aa, Artificial Sequence
  Description of Artificial Sequence: Synthetic peptide
  Seed: IGLSNLTHV (PRAME_HUMAN)
IILSNLTHA

SEQ ID NO: 144294 - protein, 9 aa, Artificial Sequence
  Description of Artificial Sequence: Synthetic peptide
  Seed: LYVDSLFFL (PRAME_HUMAN)
LAVDSLFFI

SEQ ID NO: 144295 - protein, 9 aa, Artificial Sequence
  Description of Artificial Sequence: Synthetic peptide
  Seed: NSISISALQ (PRAME_HUMAN)
NSISISALR

SEQ ID NO: 144296 - protein, 9 aa, Artificial Sequence
  Description of Artificial Sequence: Synthetic peptide
  Seed: RLDQLLRHV (PRAME_HUMAN)
RQDQLLRHM

SEQ ID NO: 144297 - protein, 10 aa, Artificial Sequence
  Description of Artificial Sequence: Synthetic peptide
  Seed: GRPSMVWLSA (PRAME_HUMAN)
GKPSMVWLSL

SEQ ID NO: 144298 - protein, 9 aa, Artificial Sequence
  Description of Artificial Sequence: Synthetic peptide
  Seed: SIQSRYISM (PRAME_HUMAN)
SPQSRYISL

SEQ ID NO: 144299 - protein, 10 aa, Artificial Sequence
  Description of Artificial Sequence: Synthetic peptide
  Seed: AQFTSQFLSL (PRAME_HUMAN)
AEFTSQFLSM

SEQ ID NO: 144300 - protein, 9 aa, Artificial Sequence
  Description of Artificial Sequence: Synthetic peptide
  Seed: QALYVDSLF (PRAME_HUMAN)
QTLYVDSLF

SEQ ID NO: 144301 - protein, 10 aa, Artificial Sequence
  Description of Artificial Sequence: Synthetic peptide
  Seed: RRLWGSIQSR (PRAME_HUMAN)
RVLWGSIQSR

SEQ ID NO: 144302 - protein, 9 aa, Artificial Sequence
  Description of Artificial Sequence: Synthetic peptide
  Seed: SHIHASSYI (PRAME_HUMAN)
SHIHASSYV

SEQ ID NO: 144303 - protein, 9 aa, Artificial Sequence
  Description of Artificial Sequence: Synthetic peptide
  Seed: SRYISMSVW (PRAME_HUMAN)
SRYISMSVM

SEQ ID NO: 144304 - protein, 8 aa, Artificial Sequence
  Description of Artificial Sequence: Synthetic peptide
  Seed: AEQPFIPV (PRAME_HUMAN)
AEQPFIPA

SEQ ID NO: 144305 - protein, 9 aa, Artificial Sequence
  Description of Artificial Sequence: Synthetic peptide
  Seed: QSRYISMSV (PRAME_HUMAN)
QTRYISMSV

SEQ ID NO: 144306 - protein, 9 aa, Artificial Sequence
  Description of Artificial Sequence: Synthetic peptide
  Seed: YSFPEPEAA (PRAME_HUMAN)
YSFPEPEAV

SEQ ID NO: 144307 - protein, 9 aa, Artificial Sequence
  Description of Artificial Sequence: Synthetic peptide
  Seed: ESYEDIHGT (PRAME_HUMAN)
EMYEDIHGI

SEQ ID NO: 144308 - protein, 10 aa, Artificial Sequence
  Description of Artificial Sequence: Synthetic peptide
  Seed: VRPRRWKLQV (PRAME_HUMAN)
VKPRRWKLQL

SEQ ID NO: 144309 - protein, 9 aa, Artificial Sequence
  Description of Artificial Sequence: Synthetic peptide
  Seed: TLAKFSPYL (PRAME_HUMAN)
TFAKFSPYY

SEQ ID NO: 144310 - protein, 9 aa, Artificial Sequence
  Description of Artificial Sequence: Synthetic peptide
  Seed: RHSQTLKAM (PRAME_HUMAN)
RKSQTLKAM

SEQ ID NO: 144311 - protein, 9 aa, Artificial Sequence
  Description of Artificial Sequence: Synthetic peptide
  Seed: HVMNPLETL (PRAME_HUMAN)
HSMNPLETH

SEQ ID NO: 144312 - protein, 9 aa, Artificial Sequence
  Description of Artificial Sequence: Synthetic peptide
  Seed: FYDPEPILC (PRAME_HUMAN)
FVDPEPILY

SEQ ID NO: 144313 - protein, 9 aa, Artificial Sequence
  Description of Artificial Sequence: Synthetic peptide
  Seed: LAIAALELL (PRAME_HUMAN)
LSIAALELL

SEQ ID NO: 144314 - protein, 9 aa, Artificial Sequence
  Description of Artificial Sequence: Synthetic peptide
  Seed: ALAIAALEL (PRAME_HUMAN)
ATAIAALEL

SEQ ID NO: 144315 - protein, 8 aa, Artificial Sequence
  Description of Artificial Sequence: Synthetic peptide
  Seed: QPFIPVEV (PRAME_HUMAN)
QHFIPVEA

SEQ ID NO: 144316 - protein, 10 aa, Artificial Sequence
  Description of Artificial Sequence: Synthetic peptide
  Seed: LSQSPSVSQL (PRAME_HUMAN)
LMQSPSVSQM

SEQ ID NO: 144317 - protein, 11 aa, Artificial Sequence
  Description of Artificial Sequence: Synthetic peptide
  Seed: RLAYLHARLRE (PRAME_HUMAN)
RFAYLHARLRR

SEQ ID NO: 144318 - protein, 11 aa, Artificial Sequence
  Description of Artificial Sequence: Synthetic peptide
  Seed: SNLTHVLYPVP (PRAME_HUMAN)
SLLTHVLYPVN

SEQ ID NO: 144319 - protein, 10 aa, Artificial Sequence
  Description of Artificial Sequence: Synthetic peptide
  Seed: VLYPVPLESY (PRAME_HUMAN)
VIYPVPLESK

SEQ ID NO: 144320 - protein, 10 aa, Artificial Sequence
  Description of Artificial Sequence: Synthetic peptide
  Seed: LQALYVDSLF (PRAME_HUMAN)
LEALYVDSLW

SEQ ID NO: 144321 - protein, 9 aa, Artificial Sequence
  Description of Artificial Sequence: Synthetic peptide
  Seed: ALQSLLQHL (PRAME_HUMAN)
AQQSLLQHF

SEQ ID NO: 144322 - protein, 9 aa, Artificial Sequence
  Description of Artificial Sequence: Synthetic peptide
  Seed: GQHLHLETF (PRAME_HUMAN)
GPHLHLETY

SEQ ID NO: 144323 - protein, 10 aa, Artificial Sequence
  Description of Artificial Sequence: Synthetic peptide
  Seed: LLSHIHASSY (PRAME_HUMAN)
LESHIHASSF

SEQ ID NO: 144324 - protein, 9 aa, Artificial Sequence
  Description of Artificial Sequence: Synthetic peptide
  Seed: YISMSVWTS (PRAME_HUMAN)
YGSMSVWTV

SEQ ID NO: 144325 - protein, 10 aa, Artificial Sequence
  Description of Artificial Sequence: Synthetic peptide
  Seed: SNLTHVLYPV (PRAME_HUMAN)
SELTHVLYPL

SEQ ID NO: 144326 - protein, 10 aa, Artificial Sequence
  Description of Artificial Sequence: Synthetic peptide
  Seed: ETLSITNCRL (PRAME_HUMAN)
EYLSITNCRK

SEQ ID NO: 144327 - protein, 9 aa, Artificial Sequence
  Description of Artificial Sequence: Synthetic peptide
  Seed: KMILKMVQL (PRAME_HUMAN)
KVILKMVQI

SEQ ID NO: 144328 - protein, 10 aa, Artificial Sequence
  Description of Artificial Sequence: Synthetic peptide
  Seed: ISISALQSLL (PRAME_HUMAN)
IGISALQSLW

SEQ ID NO: 144329 - protein, 11 aa, Artificial Sequence
  Description of Artificial Sequence: Synthetic peptide
  Seed: RRWKLQVLDLR (PRAME_HUMAN)
RRWKLQVLDLW

SEQ ID NO: 144330 - protein, 9 aa, Artificial Sequence
  Description of Artificial Sequence: Synthetic peptide
  Seed: SHCSQLTTL (PRAME_HUMAN)
SRCSQLTTV

SEQ ID NO: 144331 - protein, 10 aa, Artificial Sequence
  Description of Artificial Sequence: Synthetic peptide
  Seed: MLTDVSPEPL (PRAME_HUMAN)
MITDVSPEPV

SEQ ID NO: 144332 - protein, 10 aa, Artificial Sequence
  Description of Artificial Sequence: Synthetic peptide
  Seed: RASATLQDLV (PRAME_HUMAN)
RQSATLQDLW

SEQ ID NO: 144333 - protein, 9 aa, Artificial Sequence
  Description of Artificial Sequence: Synthetic peptide
  Seed: SFYGNSISI (PRAME_HUMAN)
SNYGNSISY

SEQ ID NO: 144334 - protein, 9 aa, Artificial Sequence
  Description of Artificial Sequence: Synthetic peptide
  Seed: TCTWKLPTL (PRAME_HUMAN)
TSTWKLPTM

SEQ ID NO: 144335 - protein, 9 aa, Artificial Sequence
  Description of Artificial Sequence: Synthetic peptide
  Seed: HGTLHLERL (PRAME_HUMAN)
HSTLHLERL

SEQ ID NO: 144336 - protein, 10 aa, Artificial Sequence
  Description of Artificial Sequence: Synthetic peptide
  Seed: RGRLDQLLRH (PRAME_HUMAN)
RNRLDQLLRL

SEQ ID NO: 144337 - protein, 9 aa, Artificial Sequence
  Description of Artificial Sequence: Synthetic peptide
  Seed: VSPEPLQAL (PRAME_HUMAN)
VTPEPLQAL

SEQ ID NO: 144338 - protein, 9 aa, Artificial Sequence
  Description of Artificial Sequence: Synthetic peptide
  Seed: YLHARLREL (PRAME_HUMAN)
YSHARLREM

SEQ ID NO: 144339 - protein, 10 aa, Artificial Sequence
  Description of Artificial Sequence: Synthetic peptide
  Seed: LLLSHIHASS (PRAME_HUMAN)
LELSHIHASI

SEQ ID NO: 144340 - protein, 9 aa, Artificial Sequence
  Description of Artificial Sequence: Synthetic peptide
  Seed: SQFLSLQCL (PRAME_HUMAN)
SSFLSLQCY

SEQ ID NO: 144341 - protein, 8 aa, Artificial Sequence
  Description of Artificial Sequence: Synthetic peptide
  Seed: WPFTCLPL (PRAME_HUMAN)
WPFTCLPF

SEQ ID NO: 144342 - protein, 9 aa, Artificial Sequence
  Description of Artificial Sequence: Synthetic peptide
  Seed: KFSPYLGQM (PRAME_HUMAN)
KSSPYLGQM

SEQ ID NO: 144343 - protein, 9 aa, Artificial Sequence
  Description of Artificial Sequence: Synthetic peptide
  Seed: FMAAFDGRH (PRAME_HUMAN)
FMAAFDGRM

SEQ ID NO: 144344 - protein, 9 aa, Artificial Sequence
  Description of Artificial Sequence: Synthetic peptide
  Seed: TDDQLLALL (PRAME_HUMAN)
TNDQLLALM

SEQ ID NO: 144345 - protein, 9 aa, Artificial Sequence
  Description of Artificial Sequence: Synthetic peptide
  Seed: SFYGNSISI (PRAME_HUMAN)
SGYGNSISY

SEQ ID NO: 144346 - protein, 9 aa, Artificial Sequence
  Description of Artificial Sequence: Synthetic peptide
  Seed: NVLRLCCKK (PRAME_HUMAN)
NALRLCCKR

SEQ ID NO: 144347 - protein, 11 aa, Artificial Sequence
  Description of Artificial Sequence: Synthetic peptide
  Seed: RRWKLQVLDLR (PRAME_HUMAN)
RRWKLQVLDLA

SEQ ID NO: 144348 - protein, 10 aa, Artificial Sequence
  Description of Artificial Sequence: Synthetic peptide
  Seed: ITDDQLLALL (PRAME_HUMAN)
IYDDQLLALV

SEQ ID NO: 144349 - protein, 11 aa, Artificial Sequence
  Description of Artificial Sequence: Synthetic peptide
  Seed: QALYVDSLFFL (PRAME_HUMAN)
QMLYVDSLFFF

SEQ ID NO: 144350 - protein, 8 aa, Artificial Sequence
  Description of Artificial Sequence: Synthetic peptide
  Seed: LSFYGNSI (PRAME_HUMAN)
LQFYGNSI

SEQ ID NO: 144351 - protein, 10 aa, Artificial Sequence
  Description of Artificial Sequence: Synthetic peptide
  Seed: KKLKIFAMPM (PRAME_HUMAN)
KTLKIFAMPS

SEQ ID NO: 144352 - protein, 10 aa, Artificial Sequence
  Description of Artificial Sequence: Synthetic peptide
  Seed: LLPRELFPPL (PRAME_HUMAN)
LFPRELFPPF

SEQ ID NO: 144353 - protein, 10 aa, Artificial Sequence
  Description of Artificial Sequence: Synthetic peptide
  Seed: DRTFYDPEPI (PRAME_HUMAN)
DRTFYDPEPV

SEQ ID NO: 144354 - protein, 10 aa, Artificial Sequence
  Description of Artificial Sequence: Synthetic peptide
  Seed: GITDDQLLAL (PRAME_HUMAN)
GLTDDQLLAL

SEQ ID NO: 144355 - protein, 10 aa, Artificial Sequence
  Description of Artificial Sequence: Synthetic peptide
  Seed: MPMQDIKMIL (PRAME_HUMAN)
MPMQDIKMIH

SEQ ID NO: 144356 - protein, 9 aa, Artificial Sequence
  Description of Artificial Sequence: Synthetic peptide
  Seed: SRYISMSVW (PRAME_HUMAN)
SMYISMSVL

SEQ ID NO: 144357 - protein, 9 aa, Artificial Sequence
  Description of Artificial Sequence: Synthetic peptide
  Seed: KAMVQAWPF (PRAME_HUMAN)
KSMVQAWPL

SEQ ID NO: 144358 - protein, 9 aa, Artificial Sequence
  Description of Artificial Sequence: Synthetic peptide
  Seed: FTCLPLGVL (PRAME_HUMAN)
FLCLPLGVF

SEQ ID NO: 144359 - protein, 9 aa, Artificial Sequence
  Description of Artificial Sequence: Synthetic peptide
  Seed: HVMNPLETL (PRAME_HUMAN)
HRMNPLETL

SEQ ID NO: 144360 - protein, 10 aa, Artificial Sequence
  Description of Artificial Sequence: Synthetic peptide
  Seed: SPYLGQMINL (PRAME_HUMAN)
SRYLGQMINW

SEQ ID NO: 144361 - protein, 9 aa, Artificial Sequence
  Description of Artificial Sequence: Synthetic peptide
  Seed: RRLLLSHIH (PRAME_HUMAN)
RRLLLSHIC

SEQ ID NO: 144362 - protein, 9 aa, Artificial Sequence
  Description of Artificial Sequence: Synthetic peptide
  Seed: FPPLFMAAF (PRAME_HUMAN)
FAPLFMAAI

SEQ ID NO: 144363 - protein, 9 aa, Artificial Sequence
  Description of Artificial Sequence: Synthetic peptide
  Seed: LSNLTHVLY (PRAME_HUMAN)
LLNLTHVLY

SEQ ID NO: 144364 - protein, 10 aa, Artificial Sequence
  Description of Artificial Sequence: Synthetic peptide
  Seed: GLSNLTHVLY (PRAME_HUMAN)
GMSNLTHVLY

SEQ ID NO: 144365 - protein, 10 aa, Artificial Sequence
  Description of Artificial Sequence: Synthetic peptide
  Seed: MNPLETLSIT (PRAME_HUMAN)
MPPLETLSIV

SEQ ID NO: 144366 - protein, 10 aa, Artificial Sequence
  Description of Artificial Sequence: Synthetic peptide
  Seed: RYISMSVWTS (PRAME_HUMAN)
RYISMSVWTL

SEQ ID NO: 144367 - protein, 9 aa, Artificial Sequence
  Description of Artificial Sequence: Synthetic peptide
  Seed: VSPEPLQAL (PRAME_HUMAN)
VPPEPLQAL

SEQ ID NO: 144368 - protein, 9 aa, Artificial Sequence
  Description of Artificial Sequence: Synthetic peptide
  Seed: SHIHASSYI (PRAME_HUMAN)
SYIHASSYI

SEQ ID NO: 144369 - protein, 9 aa, Artificial Sequence
  Description of Artificial Sequence: Synthetic peptide
  Seed: RTFYDPEPI (PRAME_HUMAN)
RLFYDPEPA

SEQ ID NO: 144370 - protein, 9 aa, Artificial Sequence
  Description of Artificial Sequence: Synthetic peptide
  Seed: LSVLSLSGV (PRAME_HUMAN)
LSVLSLSGF

SEQ ID NO: 144371 - protein, 9 aa, Artificial Sequence
  Description of Artificial Sequence: Synthetic peptide
  Seed: YLIEKVKRK (PRAME_HUMAN)
YMIEKVKRY

SEQ ID NO: 144372 - protein, 10 aa, Artificial Sequence
  Description of Artificial Sequence: Synthetic peptide
  Seed: LLSHIHASSY (PRAME_HUMAN)
LPSHIHASSF

SEQ ID NO: 144373 - protein, 9 aa, Artificial Sequence
  Description of Artificial Sequence: Synthetic peptide
  Seed: LAIAALELL (PRAME_HUMAN)
LAIAALELW

SEQ ID NO: 144374 - protein, 10 aa, Artificial Sequence
  Description of Artificial Sequence: Synthetic peptide
  Seed: RYISMSVWTS (PRAME_HUMAN)
RWISMSVWTI

SEQ ID NO: 144375 - protein, 9 aa, Artificial Sequence
  Description of Artificial Sequence: Synthetic peptide
  Seed: ITDDQLLAL (PRAME_HUMAN)
IADDQLLAI

SEQ ID NO: 144376 - protein, 9 aa, Artificial Sequence
  Description of Artificial Sequence: Synthetic peptide
  Seed: RLRELLCEL (PRAME_HUMAN)
RSRELLCEL

SEQ ID NO: 144377 - protein, 9 aa, Artificial Sequence
  Description of Artificial Sequence: Synthetic peptide
  Seed: VLYPVPLES (PRAME_HUMAN)
VIYPVPLEA

SEQ ID NO: 144378 - protein, 9 aa, Artificial Sequence
  Description of Artificial Sequence: Synthetic peptide
  Seed: SHQDFWTVW (PRAME_HUMAN)
SFQDFWTVL

SEQ ID NO: 144379 - protein, 9 aa, Artificial Sequence
  Description of Artificial Sequence: Synthetic peptide
  Seed: LSLQCLQAL (PRAME_HUMAN)
LVLQCLQAI

SEQ ID NO: 144380 - protein, 11 aa, Artificial Sequence
  Description of Artificial Sequence: Synthetic peptide
  Seed: RRRLWGSIQSR (PRAME_HUMAN)
RYRLWGSIQSR

SEQ ID NO: 144381 - protein, 9 aa, Artificial Sequence
  Description of Artificial Sequence: Synthetic peptide
  Seed: LALLPSLSH (PRAME_HUMAN)
LKLLPSLSF

SEQ ID NO: 144382 - protein, 9 aa, Artificial Sequence
  Description of Artificial Sequence: Synthetic peptide
  Seed: AAFDGRHSQ (PRAME_HUMAN)
AVFDGRHSV

SEQ ID NO: 144383 - protein, 9 aa, Artificial Sequence
  Description of Artificial Sequence: Synthetic peptide
  Seed: IAALELLPR (PRAME_HUMAN)
IAALELLPL

SEQ ID NO: 144384 - protein, 10 aa, Artificial Sequence
  Description of Artificial Sequence: Synthetic peptide
  Seed: RLAYLHARLR (PRAME_HUMAN)
RVAYLHARLA

SEQ ID NO: 144385 - protein, 10 aa, Artificial Sequence
  Description of Artificial Sequence: Synthetic peptide
  Seed: LIGLSNLTHV (PRAME_HUMAN)
LMGLSNLTHI

SEQ ID NO: 144386 - protein, 9 aa, Artificial Sequence
  Description of Artificial Sequence: Synthetic peptide
  Seed: RLLLSHIHA (PRAME_HUMAN)
RTLLSHIHA

SEQ ID NO: 144387 - protein, 9 aa, Artificial Sequence
  Description of Artificial Sequence: Synthetic peptide
  Seed: LPTLAKFSP (PRAME_HUMAN)
LPTLAKFSL

SEQ ID NO: 144388 - protein, 9 aa, Artificial Sequence
  Description of Artificial Sequence: Synthetic peptide
  Seed: LSVLSLSGV (PRAME_HUMAN)
LTVLSLSGW

SEQ ID NO: 144389 - protein, 9 aa, Artificial Sequence
  Description of Artificial Sequence: Synthetic peptide
  Seed: FYDPEPILC (PRAME_HUMAN)
FCDPEPILV

SEQ ID NO: 144390 - protein, 9 aa, Artificial Sequence
  Description of Artificial Sequence: Synthetic peptide
  Seed: MINLRRLLL (PRAME_HUMAN)
MMNLRRLLA

SEQ ID NO: 144391 - protein, 9 aa, Artificial Sequence
  Description of Artificial Sequence: Synthetic peptide
  Seed: SIQSRYISM (PRAME_HUMAN)
SMQSRYISF

SEQ ID NO: 144392 - protein, 10 aa, Artificial Sequence
  Description of Artificial Sequence: Synthetic peptide
  Seed: DELFSYLIEK (PRAME_HUMAN)
DALFSYLIER

SEQ ID NO: 144393 - protein, 9 aa, Artificial Sequence
  Description of Artificial Sequence: Synthetic peptide
  Seed: FYDPEPILC (PRAME_HUMAN)
FTDPEPILT

SEQ ID NO: 144394 - protein, 9 aa, Artificial Sequence
  Description of Artificial Sequence: Synthetic peptide
  Seed: KLKIFAMPM (PRAME_HUMAN)
KLKIFAMPS

SEQ ID NO: 144395 - protein, 10 aa, Artificial Sequence
  Description of Artificial Sequence: Synthetic peptide
  Seed: GQSLLKDEAL (PRAME_HUMAN)
GESLLKDEAV

SEQ ID NO: 144396 - protein, 9 aa, Artificial Sequence
  Description of Artificial Sequence: Synthetic peptide
  Seed: FYDPEPILC (PRAME_HUMAN)
FWDPEPILI

SEQ ID NO: 144397 - protein, 9 aa, Artificial Sequence
  Description of Artificial Sequence: Synthetic peptide
  Seed: RLDQLLRHV (PRAME_HUMAN)
RVDQLLRHL

SEQ ID NO: 144398 - protein, 9 aa, Artificial Sequence
  Description of Artificial Sequence: Synthetic peptide
  Seed: YGNSISISA (PRAME_HUMAN)
YANSISISF

SEQ ID NO: 144399 - protein, 10 aa, Artificial Sequence
  Description of Artificial Sequence: Synthetic peptide
  Seed: AYLHARLREL (PRAME_HUMAN)
APLHARLREV

SEQ ID NO: 144400 - protein, 10 aa, Artificial Sequence
  Description of Artificial Sequence: Synthetic peptide
  Seed: FAMPMQDIKM (PRAME_HUMAN)
FQMPMQDIKI

SEQ ID NO: 144401 - protein, 9 aa, Artificial Sequence
  Description of Artificial Sequence: Synthetic peptide
  Seed: AFDGRHSQT (PRAME_HUMAN)
ALDGRHSQM

SEQ ID NO: 144402 - protein, 11 aa, Artificial Sequence
  Description of Artificial Sequence: Synthetic peptide
  Seed: AAFDGRHSQTL (PRAME_HUMAN)
AYFDGRHSQTM

SEQ ID NO: 144403 - protein, 11 aa, Artificial Sequence
  Description of Artificial Sequence: Synthetic peptide
  Seed: AAFDGRHSQTL (PRAME_HUMAN)
AFFDGRHSQTL

SEQ ID NO: 144404 - protein, 9 aa, Artificial Sequence
  Description of Artificial Sequence: Synthetic peptide
  Seed: TWKLPTLAK (PRAME_HUMAN)
TIKLPTLAK

SEQ ID NO: 144405 - protein, 8 aa, Artificial Sequence
  Description of Artificial Sequence: Synthetic peptide
  Seed: DQLLRHVM (PRAME_HUMAN)
DHLLRHVL

SEQ ID NO: 144406 - protein, 9 aa, Artificial Sequence
  Description of Artificial Sequence: Synthetic peptide
  Seed: HVMNPLETL (PRAME_HUMAN)
HLMNPLETF

SEQ ID NO: 144407 - protein, 9 aa, Artificial Sequence
  Description of Artificial Sequence: Synthetic peptide
  Seed: KAMVQAWPF (PRAME_HUMAN)
KFMVQAWPY

SEQ ID NO: 144408 - protein, 10 aa, Artificial Sequence
  Description of Artificial Sequence: Synthetic peptide
  Seed: QAWPFTCLPL (PRAME_HUMAN)
QYWPFTCLPI

SEQ ID NO: 144409 - protein, 11 aa, Artificial Sequence
  Description of Artificial Sequence: Synthetic peptide
  Seed: IQSRYISMSVW (PRAME_HUMAN)
IQSRYISMSVM

SEQ ID NO: 144410 - protein, 9 aa, Artificial Sequence
  Description of Artificial Sequence: Synthetic peptide
  Seed: RELFPPLFM (PRAME_HUMAN)
RKLFPPLFF

SEQ ID NO: 144411 - protein, 9 aa, Artificial Sequence
  Description of Artificial Sequence: Synthetic peptide
  Seed: RHSQTLKAM (PRAME_HUMAN)
RMSQTLKAM

SEQ ID NO: 144412 - protein, 9 aa, Artificial Sequence
  Description of Artificial Sequence: Synthetic peptide
  Seed: AAFDGRHSQ (PRAME_HUMAN)
AFFDGRHSY

SEQ ID NO: 144413 - protein, 10 aa, Artificial Sequence
  Description of Artificial Sequence: Synthetic peptide
  Seed: ITDDQLLALL (PRAME_HUMAN)
IADDQLLALL

SEQ ID NO: 144414 - protein, 10 aa, Artificial Sequence
  Description of Artificial Sequence: Synthetic peptide
  Seed: KIFAMPMQDI (PRAME_HUMAN)
KIFAMPMQDW

SEQ ID NO: 144415 - protein, 9 aa, Artificial Sequence
  Description of Artificial Sequence: Synthetic peptide
  Seed: KAMVQAWPF (PRAME_HUMAN)
KHMVQAWPF

SEQ ID NO: 144416 - protein, 9 aa, Artificial Sequence
  Description of Artificial Sequence: Synthetic peptide
  Seed: SFYGNSISI (PRAME_HUMAN)
STYGNSISM

SEQ ID NO: 144417 - protein, 10 aa, Artificial Sequence
  Description of Artificial Sequence: Synthetic peptide
  Seed: VELAGQSLLK (PRAME_HUMAN)
VMLAGQSLLK

SEQ ID NO: 144418 - protein, 9 aa, Artificial Sequence
  Description of Artificial Sequence: Synthetic peptide
  Seed: YSFPEPEAA (PRAME_HUMAN)
YPFPEPEAF

SEQ ID NO: 144419 - protein, 11 aa, Artificial Sequence
  Description of Artificial Sequence: Synthetic peptide
  Seed: FLSLQCLQALY (PRAME_HUMAN)
FPSLQCLQALL

SEQ ID NO: 144420 - protein, 9 aa, Artificial Sequence
  Description of Artificial Sequence: Synthetic peptide
  Seed: ITDDQLLAL (PRAME_HUMAN)
IQDDQLLAY

SEQ ID NO: 144421 - protein, 10 aa, Artificial Sequence
  Description of Artificial Sequence: Synthetic peptide
  Seed: RRLWGSIQSR (PRAME_HUMAN)
RKLWGSIQSR

SEQ ID NO: 144422 - protein, 9 aa, Artificial Sequence
  Description of Artificial Sequence: Synthetic peptide
  Seed: GNRASLYSF (PRAME_HUMAN)
GHRASLYSY

SEQ ID NO: 144423 - protein, 8 aa, Artificial Sequence
  Description of Artificial Sequence: Synthetic peptide
  Seed: SQLSVLSL (PRAME_HUMAN)
SKLSVLSY

SEQ ID NO: 144424 - protein, 10 aa, Artificial Sequence
  Description of Artificial Sequence: Synthetic peptide
  Seed: TLQDLVFDEC (PRAME_HUMAN)
TMQDLVFDEA

SEQ ID NO: 144425 - protein, 10 aa, Artificial Sequence
  Description of Artificial Sequence: Synthetic peptide
  Seed: MPMQDIKMIL (PRAME_HUMAN)
MIMQDIKMII

SEQ ID NO: 144426 - protein, 9 aa, Artificial Sequence
  Description of Artificial Sequence: Synthetic peptide
  Seed: KFSPYLGQM (PRAME_HUMAN)
KASPYLGQF

SEQ ID NO: 144427 - protein, 10 aa, Artificial Sequence
  Description of Artificial Sequence: Synthetic peptide
  Seed: AALELLPREL (PRAME_HUMAN)
ASLELLPREF

SEQ ID NO: 144428 - protein, 9 aa, Artificial Sequence
  Description of Artificial Sequence: Synthetic peptide
  Seed: YIAQFTSQF (PRAME_HUMAN)
YVAQFTSQA

SEQ ID NO: 144429 - protein, 9 aa, Artificial Sequence
  Description of Artificial Sequence: Synthetic peptide
  Seed: TFYDPEPIL (PRAME_HUMAN)
TIYDPEPIY

SEQ ID NO: 144430 - protein, 11 aa, Artificial Sequence
  Description of Artificial Sequence: Synthetic peptide
  Seed: CRLSEGDVMHL (PRAME_HUMAN)
CFLSEGDVMHL

SEQ ID NO: 144431 - protein, 9 aa, Artificial Sequence
  Description of Artificial Sequence: Synthetic peptide
  Seed: VQAWPFTCL (PRAME_HUMAN)
VVAWPFTCV

SEQ ID NO: 144432 - protein, 9 aa, Artificial Sequence
  Description of Artificial Sequence: Synthetic peptide
  Seed: VLDGLDVLL (PRAME_HUMAN)
VMDGLDVLY

SEQ ID NO: 144433 - protein, 9 aa, Artificial Sequence
  Description of Artificial Sequence: Synthetic peptide
  Seed: RGRLDQLLR (PRAME_HUMAN)
RMRLDQLLV

SEQ ID NO: 144434 - protein, 10 aa, Artificial Sequence
  Description of Artificial Sequence: Synthetic peptide
  Seed: DRTFYDPEPI (PRAME_HUMAN)
DMTFYDPEPV

SEQ ID NO: 144435 - protein, 9 aa, Artificial Sequence
  Description of Artificial Sequence: Synthetic peptide
  Seed: VLDGLDVLL (PRAME_HUMAN)
VSDGLDVLF

SEQ ID NO: 144436 - protein, 10 aa, Artificial Sequence
  Description of Artificial Sequence: Synthetic peptide
  Seed: IGLSNLTHVL (PRAME_HUMAN)
ILLSNLTHVW

SEQ ID NO: 144437 - protein, 10 aa, Artificial Sequence
  Description of Artificial Sequence: Synthetic peptide
  Seed: QALYVDSLFF (PRAME_HUMAN)
QSLYVDSLFF

SEQ ID NO: 144438 - protein, 9 aa, Artificial Sequence
  Description of Artificial Sequence: Synthetic peptide
  Seed: LSLQCLQAL (PRAME_HUMAN)
LILQCLQAY

SEQ ID NO: 144439 - protein, 9 aa, Artificial Sequence
  Description of Artificial Sequence: Synthetic peptide
  Seed: RLRELLCEL (PRAME_HUMAN)
RLRELLCEA

SEQ ID NO: 144440 - protein, 11 aa, Artificial Sequence
  Description of Artificial Sequence: Synthetic peptide
  Seed: ALYVDSLFFLR (PRAME_HUMAN)
ALYVDSLFFLK

SEQ ID NO: 144441 - protein, 10 aa, Artificial Sequence
  Description of Artificial Sequence: Synthetic peptide
  Seed: RLAYLHARLR (PRAME_HUMAN)
RGAYLHARLR

SEQ ID NO: 144442 - protein, 9 aa, Artificial Sequence
  Description of Artificial Sequence: Synthetic peptide
  Seed: QLLALLPSL (PRAME_HUMAN)
QILALLPSM

SEQ ID NO: 144443 - protein, 10 aa, Artificial Sequence
  Description of Artificial Sequence: Synthetic peptide
  Seed: YEDIHGTLHL (PRAME_HUMAN)
YADIHGTLHF

SEQ ID NO: 144444 - protein, 11 aa, Artificial Sequence
  Description of Artificial Sequence: Synthetic peptide
  Seed: SHCSQLTTLSF (PRAME_HUMAN)
SHCSQLTTLSM

SEQ ID NO: 144445 - protein, 10 aa, Artificial Sequence
  Description of Artificial Sequence: Synthetic peptide
  Seed: ESYEDIHGTL (PRAME_HUMAN)
ELYEDIHGTV

SEQ ID NO: 144446 - protein, 11 aa, Artificial Sequence
  Description of Artificial Sequence: Synthetic peptide
  Seed: LPTLAKFSPYL (PRAME_HUMAN)
LITLAKFSPYV

SEQ ID NO: 144447 - protein, 9 aa, Artificial Sequence
  Description of Artificial Sequence: Synthetic peptide
  Seed: SMVWLSANP (PRAME_HUMAN)
SLVWLSANI

SEQ ID NO: 144448 - protein, 10 aa, Artificial Sequence
  Description of Artificial Sequence: Synthetic peptide
  Seed: SMVWLSANPC (PRAME_HUMAN)
SQVWLSANPV

SEQ ID NO: 144449 - protein, 11 aa, Artificial Sequence
  Description of Artificial Sequence: Synthetic peptide
  Seed: AAFDGRHSQTL (PRAME_HUMAN)
APFDGRHSQTM

SEQ ID NO: 144450 - protein, 10 aa, Artificial Sequence
  Description of Artificial Sequence: Synthetic peptide
  Seed: KAVLDGLDVL (PRAME_HUMAN)
KMVLDGLDVL

SEQ ID NO: 144451 - protein, 9 aa, Artificial Sequence
  Description of Artificial Sequence: Synthetic peptide
  Seed: KMILKMVQL (PRAME_HUMAN)
KSILKMVQF

SEQ ID NO: 144452 - protein, 9 aa, Artificial Sequence
  Description of Artificial Sequence: Synthetic peptide
  Seed: KLKIFAMPM (PRAME_HUMAN)
KWKIFAMPL

SEQ ID NO: 144453 - protein, 9 aa, Artificial Sequence
  Description of Artificial Sequence: Synthetic peptide
  Seed: SVLSLSGVM (PRAME_HUMAN)
SALSLSGVM

SEQ ID NO: 144454 - protein, 9 aa, Artificial Sequence
  Description of Artificial Sequence: Synthetic peptide
  Seed: TFYDPEPIL (PRAME_HUMAN)
TRYDPEPIY

SEQ ID NO: 144455 - protein, 10 aa, Artificial Sequence
  Description of Artificial Sequence: Synthetic peptide
  Seed: LSFYGNSISI (PRAME_HUMAN)
LHFYGNSISL

SEQ ID NO: 144456 - protein, 10 aa, Artificial Sequence
  Description of Artificial Sequence: Synthetic peptide
  Seed: SPYLGQMINL (PRAME_HUMAN)
SHYLGQMINF

SEQ ID NO: 144457 - protein, 10 aa, Artificial Sequence
  Description of Artificial Sequence: Synthetic peptide
  Seed: ITDDQLLALL (PRAME_HUMAN)
IIDDQLLALI

SEQ ID NO: 144458 - protein, 9 aa, Artificial Sequence
  Description of Artificial Sequence: Synthetic peptide
  Seed: VFDECGITD (PRAME_HUMAN)
VHDECGITM

SEQ ID NO: 144459 - protein, 10 aa, Artificial Sequence
  Description of Artificial Sequence: Synthetic peptide
  Seed: RGRLDQLLRH (PRAME_HUMAN)
RWRLDQLLRF

SEQ ID NO: 144460 - protein, 10 aa, Artificial Sequence
  Description of Artificial Sequence: Synthetic peptide
  Seed: TSQFLSLQCL (PRAME_HUMAN)
TKQFLSLQCY

SEQ ID NO: 144461 - protein, 10 aa, Artificial Sequence
  Description of Artificial Sequence: Synthetic peptide
  Seed: FFLRGRLDQL (PRAME_HUMAN)
FPLRGRLDQL

SEQ ID NO: 144462 - protein, 9 aa, Artificial Sequence
  Description of Artificial Sequence: Synthetic peptide
  Seed: THVLYPVPL (PRAME_HUMAN)
TMVLYPVPF

SEQ ID NO: 144463 - protein, 10 aa, Artificial Sequence
  Description of Artificial Sequence: Synthetic peptide
  Seed: LSQSPSVSQL (PRAME_HUMAN)
LFQSPSVSQM

SEQ ID NO: 144464 - protein, 11 aa, Artificial Sequence
  Description of Artificial Sequence: Synthetic peptide
  Seed: VMLTDVSPEPL (PRAME_HUMAN)
VFLTDVSPEPV

SEQ ID NO: 144465 - protein, 10 aa, Artificial Sequence
  Description of Artificial Sequence: Synthetic peptide
  Seed: VEVLVDLFLK (PRAME_HUMAN)
VYVLVDLFLR

SEQ ID NO: 144466 - protein, 10 aa, Artificial Sequence
  Description of Artificial Sequence: Synthetic peptide
  Seed: CSQLTTLSFY (PRAME_HUMAN)
CHQLTTLSFF

SEQ ID NO: 144467 - protein, 9 aa, Artificial Sequence
  Description of Artificial Sequence: Synthetic peptide
  Seed: SFPEPEAAQ (PRAME_HUMAN)
SLPEPEAAF

SEQ ID NO: 144468 - protein, 10 aa, Artificial Sequence
  Description of Artificial Sequence: Synthetic peptide
  Seed: YVDSLFFLRG (PRAME_HUMAN)
YTDSLFFLRR

SEQ ID NO: 144469 - protein, 11 aa, Artificial Sequence
  Description of Artificial Sequence: Synthetic peptide
  Seed: FYDPEPILCPC (PRAME_HUMAN)
FFDPEPILCPM

SEQ ID NO: 144470 - protein, 10 aa, Artificial Sequence
  Description of Artificial Sequence: Synthetic peptide
  Seed: SVSQLSVLSL (PRAME_HUMAN)
SLSQLSVLSA

SEQ ID NO: 144471 - protein, 10 aa, Artificial Sequence
  Description of Artificial Sequence: Synthetic peptide
  Seed: YISPEKEEQY (PRAME_HUMAN)
YMSPEKEEQY

SEQ ID NO: 144472 - protein, 9 aa, Artificial Sequence
  Description of Artificial Sequence: Synthetic peptide
  Seed: RRWKLQVLD (PRAME_HUMAN)
RRWKLQVLC

SEQ ID NO: 144473 - protein, 9 aa, Artificial Sequence
  Description of Artificial Sequence: Synthetic peptide
  Seed: GLSNLTHVL (PRAME_HUMAN)
GTSNLTHVL

SEQ ID NO: 144474 - protein, 9 aa, Artificial Sequence
  Description of Artificial Sequence: Synthetic peptide
  Seed: LAIAALELL (PRAME_HUMAN)
LQIAALELL

SEQ ID NO: 144475 - protein, 9 aa, Artificial Sequence
  Description of Artificial Sequence: Synthetic peptide
  Seed: YIAQFTSQF (PRAME_HUMAN)
YLAQFTSQT

SEQ ID NO: 144476 - protein, 10 aa, Artificial Sequence
  Description of Artificial Sequence: Synthetic peptide
  Seed: SPSVSQLSVL (PRAME_HUMAN)
STSVSQLSVY

SEQ ID NO: 144477 - protein, 9 aa, Artificial Sequence
  Description of Artificial Sequence: Synthetic peptide
  Seed: ITDDQLLAL (PRAME_HUMAN)
IMDDQLLAM

SEQ ID NO: 144478 - protein, 11 aa, Artificial Sequence
  Description of Artificial Sequence: Synthetic peptide
  Seed: KIFAMPMQDIK (PRAME_HUMAN)
KTFAMPMQDIR

SEQ ID NO: 144479 - protein, 9 aa, Artificial Sequence
  Description of Artificial Sequence: Synthetic peptide
  Seed: LLLSHIHAS (PRAME_HUMAN)
LTLSHIHAI

SEQ ID NO: 144480 - protein, 11 aa, Artificial Sequence
  Description of Artificial Sequence: Synthetic peptide
  Seed: HLSQSPSVSQL (PRAME_HUMAN)
HASQSPSVSQF

SEQ ID NO: 144481 - protein, 10 aa, Artificial Sequence
  Description of Artificial Sequence: Synthetic peptide
  Seed: LLLSHIHASS (PRAME_HUMAN)
LVLSHIHASA

SEQ ID NO: 144482 - protein, 9 aa, Artificial Sequence
  Description of Artificial Sequence: Synthetic peptide
  Seed: LALLPSLSH (PRAME_HUMAN)
LALLPSLSF

SEQ ID NO: 144483 - protein, 10 aa, Artificial Sequence
  Description of Artificial Sequence: Synthetic peptide
  Seed: AALELLPREL (PRAME_HUMAN)
ALLELLPREI

SEQ ID NO: 144484 - protein, 10 aa, Artificial Sequence
  Description of Artificial Sequence: Synthetic peptide
  Seed: VLMKGQHLHL (PRAME_HUMAN)
VMMKGQHLHL

SEQ ID NO: 144485 - protein, 10 aa, Artificial Sequence
  Description of Artificial Sequence: Synthetic peptide
  Seed: CCKKLKIFAM (PRAME_HUMAN)
CLKKLKIFAL

SEQ ID NO: 144486 - protein, 10 aa, Artificial Sequence
  Description of Artificial Sequence: Synthetic peptide
  Seed: LSVLSLSGVM (PRAME_HUMAN)
LLVLSLSGVY

SEQ ID NO: 144487 - protein, 10 aa, Artificial Sequence
  Description of Artificial Sequence: Synthetic peptide
  Seed: RRLWGSIQSR (PRAME_HUMAN)
RKLWGSIQSK

SEQ ID NO: 144488 - protein, 9 aa, Artificial Sequence
  Description of Artificial Sequence: Synthetic peptide
  Seed: KVDGLSTEA (PRAME_HUMAN)
KFDGLSTEM

SEQ ID NO: 144489 - protein, 9 aa, Artificial Sequence
  Description of Artificial Sequence: Synthetic peptide
  Seed: LGRPSMVWL (PRAME_HUMAN)
LARPSMVWF

SEQ ID NO: 144490 - protein, 10 aa, Artificial Sequence
  Description of Artificial Sequence: Synthetic peptide
  Seed: LSFYGNSISI (PRAME_HUMAN)
LMFYGNSISF

SEQ ID NO: 144491 - protein, 10 aa, Artificial Sequence
  Description of Artificial Sequence: Synthetic peptide
  Seed: LLSHIHASSY (PRAME_HUMAN)
LQSHIHASSL

SEQ ID NO: 144492 - protein, 9 aa, Artificial Sequence
  Description of Artificial Sequence: Synthetic peptide
  Seed: MHLSQSPSV (PRAME_HUMAN)
MKLSQSPSF

SEQ ID NO: 144493 - protein, 11 aa, Artificial Sequence
  Description of Artificial Sequence: Synthetic peptide
  Seed: RLWGSIQSRYI (PRAME_HUMAN)
RMWGSIQSRYA

SEQ ID NO: 144494 - protein, 9 aa, Artificial Sequence
  Description of Artificial Sequence: Synthetic peptide
  Seed: CSQLTTLSF (PRAME_HUMAN)
CMQLTTLSM

SEQ ID NO: 144495 - protein, 9 aa, Artificial Sequence
  Description of Artificial Sequence: Synthetic peptide
  Seed: NLTHVLYPV (PRAME_HUMAN)
NVTHVLYPI

SEQ ID NO: 144496 - protein, 9 aa, Artificial Sequence
  Description of Artificial Sequence: Synthetic peptide
  Seed: EPILCPCFM (PRAME_HUMAN)
EPILCPCFW

SEQ ID NO: 144497 - protein, 9 aa, Artificial Sequence
  Description of Artificial Sequence: Synthetic peptide
  Seed: EVLVDLFLK (PRAME_HUMAN)
ESLVDLFLK

SEQ ID NO: 144498 - protein, 9 aa, Artificial Sequence
  Description of Artificial Sequence: Synthetic peptide
  Seed: RASATLQDL (PRAME_HUMAN)
RQSATLQDL

SEQ ID NO: 144499 - protein, 10 aa, Artificial Sequence
  Description of Artificial Sequence: Synthetic peptide
  Seed: LLLSHIHASS (PRAME_HUMAN)
LKLSHIHASI

SEQ ID NO: 144500 - protein, 9 aa, Artificial Sequence
  Description of Artificial Sequence: Synthetic peptide
  Seed: SMSVWTSPR (PRAME_HUMAN)
SYSVWTSPK

SEQ ID NO: 144501 - protein, 9 aa, Artificial Sequence
  Description of Artificial Sequence: Synthetic peptide
  Seed: AVLDGLDVL (PRAME_HUMAN)
AALDGLDVY

SEQ ID NO: 144502 - protein, 9 aa, Artificial Sequence
  Description of Artificial Sequence: Synthetic peptide
  Seed: NSHQDFWTV (PRAME_HUMAN)
NLHQDFWTL

SEQ ID NO: 144503 - protein, 9 aa, Artificial Sequence
  Description of Artificial Sequence: Synthetic peptide
  Seed: SRYISMSVW (PRAME_HUMAN)
STYISMSVM

SEQ ID NO: 144504 - protein, 9 aa, Artificial Sequence
  Description of Artificial Sequence: Synthetic peptide
  Seed: QLLALLPSL (PRAME_HUMAN)
QILALLPSY

SEQ ID NO: 144505 - protein, 11 aa, Artificial Sequence
  Description of Artificial Sequence: Synthetic peptide
  Seed: ALYVDSLFFLR (PRAME_HUMAN)
ALYVDSLFFLN

SEQ ID NO: 144506 - protein, 10 aa, Artificial Sequence
  Description of Artificial Sequence: Synthetic peptide
  Seed: MVQAWPFTCL (PRAME_HUMAN)
MVQAWPFTCM

SEQ ID NO: 144507 - protein, 11 aa, Artificial Sequence
  Description of Artificial Sequence: Synthetic peptide
  Seed: RRWKLQVLDLR (PRAME_HUMAN)
RRWKLQVLDLK

SEQ ID NO: 144508 - protein, 9 aa, Artificial Sequence
  Description of Artificial Sequence: Synthetic peptide
  Seed: FLRGRLDQL (PRAME_HUMAN)
FVRGRLDQF

SEQ ID NO: 144509 - protein, 8 aa, Artificial Sequence
  Description of Artificial Sequence: Synthetic peptide
  Seed: LLALLPSL (PRAME_HUMAN)
LQALLPSV

SEQ ID NO: 144510 - protein, 9 aa, Artificial Sequence
  Description of Artificial Sequence: Synthetic peptide
  Seed: AFDGRHSQT (PRAME_HUMAN)
AADGRHSQM

SEQ ID NO: 144511 - protein, 11 aa, Artificial Sequence
  Description of Artificial Sequence: Synthetic peptide
  Seed: KLPTLAKFSPY (PRAME_HUMAN)
KSPTLAKFSPW

SEQ ID NO: 144512 - protein, 10 aa, Artificial Sequence
  Description of Artificial Sequence: Synthetic peptide
  Seed: ISMSVWTSPR (PRAME_HUMAN)
IFMSVWTSPR

SEQ ID NO: 144513 - protein, 10 aa, Artificial Sequence
  Description of Artificial Sequence: Synthetic peptide
  Seed: SLSGVMLTDV (PRAME_HUMAN)
STSGVMLTDV

SEQ ID NO: 144514 - protein, 10 aa, Artificial Sequence
  Description of Artificial Sequence: Synthetic peptide
  Seed: CTWKLPTLAK (PRAME_HUMAN)
CIWKLPTLAK

SEQ ID NO: 144515 - protein, 11 aa, Artificial Sequence
  Description of Artificial Sequence: Synthetic peptide
  Seed: AAFDGRHSQTL (PRAME_HUMAN)
ALFDGRHSQTL

SEQ ID NO: 144516 - protein, 9 aa, Artificial Sequence
  Description of Artificial Sequence: Synthetic peptide
  Seed: FYDPEPILC (PRAME_HUMAN)
FHDPEPILM

SEQ ID NO: 144517 - protein, 10 aa, Artificial Sequence
  Description of Artificial Sequence: Synthetic peptide
  Seed: HCSQLTTLSF (PRAME_HUMAN)
HWSQLTTLSW

SEQ ID NO: 144518 - protein, 9 aa, Artificial Sequence
  Description of Artificial Sequence: Synthetic peptide
  Seed: YSFPEPEAA (PRAME_HUMAN)
YYFPEPEAL

SEQ ID NO: 144519 - protein, 9 aa, Artificial Sequence
  Description of Artificial Sequence: Synthetic peptide
  Seed: LKMVQLDSI (PRAME_HUMAN)
LMMVQLDSY

SEQ ID NO: 144520 - protein, 10 aa, Artificial Sequence
  Description of Artificial Sequence: Synthetic peptide
  Seed: LSVLSLSGVM (PRAME_HUMAN)
LSVLSLSGVW

SEQ ID NO: 144521 - protein, 11 aa, Artificial Sequence
  Description of Artificial Sequence: Synthetic peptide
  Seed: QALYVDSLFFL (PRAME_HUMAN)
QKLYVDSLFFA

SEQ ID NO: 144522 - protein, 9 aa, Artificial Sequence
  Description of Artificial Sequence: Synthetic peptide
  Seed: ISISALQSL (PRAME_HUMAN)
IPISALQSL

SEQ ID NO: 144523 - protein, 9 aa, Artificial Sequence
  Description of Artificial Sequence: Synthetic peptide
  Seed: CSQLTTLSF (PRAME_HUMAN)
CSQLTTLSM

SEQ ID NO: 144524 - protein, 9 aa, Artificial Sequence
  Description of Artificial Sequence: Synthetic peptide
  Seed: ACDELFSYL (PRAME_HUMAN)
AADELFSYF

SEQ ID NO: 144525 - protein, 9 aa, Artificial Sequence
  Description of Artificial Sequence: Synthetic peptide
  Seed: ACDELFSYL (PRAME_HUMAN)
ALDELFSYY

SEQ ID NO: 144526 - protein, 10 aa, Artificial Sequence
  Description of Artificial Sequence: Synthetic peptide
  Seed: AAFDGRHSQT (PRAME_HUMAN)
AMFDGRHSQL

SEQ ID NO: 144527 - protein, 9 aa, Artificial Sequence
  Description of Artificial Sequence: Synthetic peptide
  Seed: GQMINLRRL (PRAME_HUMAN)
GRMINLRRL

SEQ ID NO: 144528 - protein, 9 aa, Artificial Sequence
  Description of Artificial Sequence: Synthetic peptide
  Seed: SLQCLQALY (PRAME_HUMAN)
SKQCLQALY

SEQ ID NO: 144529 - protein, 9 aa, Artificial Sequence
  Description of Artificial Sequence: Synthetic peptide
  Seed: SLLQHLIGL (PRAME_HUMAN)
SLLQHLIGR

SEQ ID NO: 144530 - protein, 9 aa, Artificial Sequence
  Description of Artificial Sequence: Synthetic peptide
  Seed: LLRHVMNPL (PRAME_HUMAN)
LQRHVMNPF

SEQ ID NO: 144531 - protein, 10 aa, Artificial Sequence
  Description of Artificial Sequence: Synthetic peptide
  Seed: SPYLGQMINL (PRAME_HUMAN)
SHYLGQMINW

SEQ ID NO: 144532 - protein, 9 aa, Artificial Sequence
  Description of Artificial Sequence: Synthetic peptide
  Seed: RLWGSIQSR (PRAME_HUMAN)
RSWGSIQSY

SEQ ID NO: 144533 - protein, 11 aa, Artificial Sequence
  Description of Artificial Sequence: Synthetic peptide
  Seed: KIFAMPMQDIK (PRAME_HUMAN)
KMFAMPMQDIY

SEQ ID NO: 144534 - protein, 10 aa, Artificial Sequence
  Description of Artificial Sequence: Synthetic peptide
  Seed: LKAMVQAWPF (PRAME_HUMAN)
LQAMVQAWPF

SEQ ID NO: 144535 - protein, 10 aa, Artificial Sequence
  Description of Artificial Sequence: Synthetic peptide
  Seed: ETFKAVLDGL (PRAME_HUMAN)
EAFKAVLDGW

SEQ ID NO: 144536 - protein, 9 aa, Artificial Sequence
  Description of Artificial Sequence: Synthetic peptide
  Seed: MVQAWPFTC (PRAME_HUMAN)
MQQAWPFTL

SEQ ID NO: 144537 - protein, 11 aa, Artificial Sequence
  Description of Artificial Sequence: Synthetic peptide
  Seed: LSNLTHVLYPV (PRAME_HUMAN)
LLNLTHVLYPI

SEQ ID NO: 144538 - protein, 10 aa, Artificial Sequence
  Description of Artificial Sequence: Synthetic peptide
  Seed: RTFYDPEPIL (PRAME_HUMAN)
RVFYDPEPIF

SEQ ID NO: 144539 - protein, 9 aa, Artificial Sequence
  Description of Artificial Sequence: Synthetic peptide
  Seed: WSGNRASLY (PRAME_HUMAN)
WSGNRASLW

SEQ ID NO: 144540 - protein, 10 aa, Artificial Sequence
  Description of Artificial Sequence: Synthetic peptide
  Seed: ISMSVWTSPR (PRAME_HUMAN)
IDMSVWTSPK

SEQ ID NO: 144541 - protein, 9 aa, Artificial Sequence
  Description of Artificial Sequence: Synthetic peptide
  Seed: KVDGLSTEA (PRAME_HUMAN)
KSDGLSTEI

SEQ ID NO: 144542 - protein, 11 aa, Artificial Sequence
  Description of Artificial Sequence: Synthetic peptide
  Seed: LPTLAKFSPYL (PRAME_HUMAN)
LQTLAKFSPYV

SEQ ID NO: 144543 - protein, 9 aa, Artificial Sequence
  Description of Artificial Sequence: Synthetic peptide
  Seed: LGRPSMVWL (PRAME_HUMAN)
LTRPSMVWA

SEQ ID NO: 144544 - protein, 9 aa, Artificial Sequence
  Description of Artificial Sequence: Synthetic peptide
  Seed: RLWGSIQSR (PRAME_HUMAN)
RWWGSIQSY

SEQ ID NO: 144545 - protein, 11 aa, Artificial Sequence
  Description of Artificial Sequence: Synthetic peptide
  Seed: RPRRWKLQVLD (PRAME_HUMAN)
RPRRWKLQVLL

SEQ ID NO: 144546 - protein, 8 aa, Artificial Sequence
  Description of Artificial Sequence: Synthetic peptide
  Seed: FYGNSISI (PRAME_HUMAN)
FFGNSISF

SEQ ID NO: 144547 - protein, 9 aa, Artificial Sequence
  Description of Artificial Sequence: Synthetic peptide
  Seed: LLKDEALAI (PRAME_HUMAN)
LLKDEALAY

SEQ ID NO: 144548 - protein, 10 aa, Artificial Sequence
  Description of Artificial Sequence: Synthetic peptide
  Seed: LSFYGNSISI (PRAME_HUMAN)
LWFYGNSISF

SEQ ID NO: 144549 - protein, 10 aa, Artificial Sequence
  Description of Artificial Sequence: Synthetic peptide
  Seed: MPMQDIKMIL (PRAME_HUMAN)
MMMQDIKMIY

SEQ ID NO: 144550 - protein, 9 aa, Artificial Sequence
  Description of Artificial Sequence: Synthetic peptide
  Seed: KLKIFAMPM (PRAME_HUMAN)
KHKIFAMPF

SEQ ID NO: 144551 - protein, 10 aa, Artificial Sequence
  Description of Artificial Sequence: Synthetic peptide
  Seed: SVSQLSVLSL (PRAME_HUMAN)
STSQLSVLSY

SEQ ID NO: 144552 - protein, 10 aa, Artificial Sequence
  Description of Artificial Sequence: Synthetic peptide
  Seed: ESYEDIHGTL (PRAME_HUMAN)
EIYEDIHGTR

SEQ ID NO: 144553 - protein, 9 aa, Artificial Sequence
  Description of Artificial Sequence: Synthetic peptide
  Seed: ISPEKEEQY (PRAME_HUMAN)
IYPEKEEQL

SEQ ID NO: 144554 - protein, 9 aa, Artificial Sequence
  Description of Artificial Sequence: Synthetic peptide
  Seed: LQDLVFDEC (PRAME_HUMAN)
LGDLVFDEM

SEQ ID NO: 144555 - protein, 10 aa, Artificial Sequence
  Description of Artificial Sequence: Synthetic peptide
  Seed: SALQSLLQHL (PRAME_HUMAN)
STLQSLLQHL

SEQ ID NO: 144556 - protein, 9 aa, Artificial Sequence
  Description of Artificial Sequence: Synthetic peptide
  Seed: FLRGRLDQL (PRAME_HUMAN)
FARGRLDQI

SEQ ID NO: 144557 - protein, 10 aa, Artificial Sequence
  Description of Artificial Sequence: Synthetic peptide
  Seed: VSPEPLQALL (PRAME_HUMAN)
VSPEPLQALF

SEQ ID NO: 144558 - protein, 9 aa, Artificial Sequence
  Description of Artificial Sequence: Synthetic peptide
  Seed: LLRHVMNPL (PRAME_HUMAN)
LLRHVMNPY

SEQ ID NO: 144559 - protein, 11 aa, Artificial Sequence
  Description of Artificial Sequence: Synthetic peptide
  Seed: YISPEKEEQYI (PRAME_HUMAN)
YQSPEKEEQYL

SEQ ID NO: 144560 - protein, 9 aa, Artificial Sequence
  Description of Artificial Sequence: Synthetic peptide
  Seed: TDDQLLALL (PRAME_HUMAN)
TYDQLLALL

SEQ ID NO: 144561 - protein, 9 aa, Artificial Sequence
  Description of Artificial Sequence: Synthetic peptide
  Seed: ALAIAALEL (PRAME_HUMAN)
AQAIAALEY

SEQ ID NO: 144562 - protein, 9 aa, Artificial Sequence
  Description of Artificial Sequence: Synthetic peptide
  Seed: YGNSISISA (PRAME_HUMAN)
YRNSISISL

SEQ ID NO: 144563 - protein, 10 aa, Artificial Sequence
  Description of Artificial Sequence: Synthetic peptide
  Seed: QAWPFTCLPL (PRAME_HUMAN)
QPWPFTCLPF

SEQ ID NO: 144564 - protein, 10 aa, Artificial Sequence
  Description of Artificial Sequence: Synthetic peptide
  Seed: ASATLQDLVF (PRAME_HUMAN)
AAATLQDLVW

SEQ ID NO: 144565 - protein, 10 aa, Artificial Sequence
  Description of Artificial Sequence: Synthetic peptide
  Seed: DVSPEPLQAL (PRAME_HUMAN)
DMSPEPLQAR

SEQ ID NO: 144566 - protein, 9 aa, Artificial Sequence
  Description of Artificial Sequence: Synthetic peptide
  Seed: ALYVDSLFF (PRAME_HUMAN)
ASYVDSLFI

SEQ ID NO: 144567 - protein, 9 aa, Artificial Sequence
  Description of Artificial Sequence: Synthetic peptide
  Seed: WSGNRASLY (PRAME_HUMAN)
WKGNRASLF

SEQ ID NO: 144568 - protein, 11 aa, Artificial Sequence
  Description of Artificial Sequence: Synthetic peptide
  Seed: SNLTHVLYPVP (PRAME_HUMAN)
SMLTHVLYPVV

SEQ ID NO: 144569 - protein, 9 aa, Artificial Sequence
  Description of Artificial Sequence: Synthetic peptide
  Seed: LSEGDVMHL (PRAME_HUMAN)
LTEGDVMHY

SEQ ID NO: 144570 - protein, 9 aa, Artificial Sequence
  Description of Artificial Sequence: Synthetic peptide
  Seed: QDIKMILKM (PRAME_HUMAN)
QEIKMILKF

SEQ ID NO: 144571 - protein, 10 aa, Artificial Sequence
  Description of Artificial Sequence: Synthetic peptide
  Seed: HCSQLTTLSF (PRAME_HUMAN)
HNSQLTTLSW

SEQ ID NO: 144572 - protein, 9 aa, Artificial Sequence
  Description of Artificial Sequence: Synthetic peptide
  Seed: KAMVQAWPF (PRAME_HUMAN)
KAMVQAWPL

SEQ ID NO: 144573 - protein, 9 aa, Artificial Sequence
  Description of Artificial Sequence: Synthetic peptide
  Seed: LSTEAEQPF (PRAME_HUMAN)
LPTEAEQPL

SEQ ID NO: 144574 - protein, 9 aa, Artificial Sequence
  Description of Artificial Sequence: Synthetic peptide
  Seed: LSTEAEQPF (PRAME_HUMAN)
LQTEAEQPL

SEQ ID NO: 144575 - protein, 10 aa, Artificial Sequence
  Description of Artificial Sequence: Synthetic peptide
  Seed: RRLWGSIQSR (PRAME_HUMAN)
RRLWGSIQSM

SEQ ID NO: 144576 - protein, 10 aa, Artificial Sequence
  Description of Artificial Sequence: Synthetic peptide
  Seed: ISMSVWTSPR (PRAME_HUMAN)
IRMSVWTSPR

SEQ ID NO: 144577 - protein, 8 aa, Artificial Sequence
  Description of Artificial Sequence: Synthetic peptide
  Seed: KKLKIFAM (PRAME_HUMAN)
KQLKIFAY

SEQ ID NO: 144578 - protein, 9 aa, Artificial Sequence
  Description of Artificial Sequence: Synthetic peptide
  Seed: EPLQALLER (PRAME_HUMAN)
EVLQALLEK

SEQ ID NO: 144579 - protein, 10 aa, Artificial Sequence
  Description of Artificial Sequence: Synthetic peptide
  Seed: AVLDGLDVLL (PRAME_HUMAN)
AQLDGLDVLA

SEQ ID NO: 144580 - protein, 9 aa, Artificial Sequence
  Description of Artificial Sequence: Synthetic peptide
  Seed: ITDDQLLAL (PRAME_HUMAN)
IDDDQLLAF

SEQ ID NO: 144581 - protein, 9 aa, Artificial Sequence
  Description of Artificial Sequence: Synthetic peptide
  Seed: TFKAVLDGL (PRAME_HUMAN)
TYKAVLDGW

SEQ ID NO: 144582 - protein, 10 aa, Artificial Sequence
  Description of Artificial Sequence: Synthetic peptide
  Seed: ALYVDSLFFL (PRAME_HUMAN)
AIYVDSLFFW

SEQ ID NO: 144583 - protein, 9 aa, Artificial Sequence
  Description of Artificial Sequence: Synthetic peptide
  Seed: VQLDSIEDL (PRAME_HUMAN)
VILDSIEDL

SEQ ID NO: 144584 - protein, 10 aa, Artificial Sequence
  Description of Artificial Sequence: Synthetic peptide
  Seed: SNLTHVLYPV (PRAME_HUMAN)
SFLTHVLYPV

SEQ ID NO: 144585 - protein, 9 aa, Artificial Sequence
  Description of Artificial Sequence: Synthetic peptide
  Seed: HLIGLSNLT (PRAME_HUMAN)
HVIGLSNLL

SEQ ID NO: 144586 - protein, 9 aa, Artificial Sequence
  Description of Artificial Sequence: Synthetic peptide
  Seed: LPRELFPPL (PRAME_HUMAN)
LLRELFPPL

SEQ ID NO: 144587 - protein, 9 aa, Artificial Sequence
  Description of Artificial Sequence: Synthetic peptide
  Seed: SFYGNSISI (PRAME_HUMAN)
SCYGNSISF

SEQ ID NO: 144588 - protein, 10 aa, Artificial Sequence
  Description of Artificial Sequence: Synthetic peptide
  Seed: CSQLTTLSFY (PRAME_HUMAN)
CQQLTTLSFF

SEQ ID NO: 144589 - protein, 9 aa, Artificial Sequence
  Description of Artificial Sequence: Synthetic peptide
  Seed: TWKLPTLAK (PRAME_HUMAN)
TYKLPTLAR

SEQ ID NO: 144590 - protein, 10 aa, Artificial Sequence
  Description of Artificial Sequence: Synthetic peptide
  Seed: SPSVSQLSVL (PRAME_HUMAN)
SVSVSQLSVW

SEQ ID NO: 144591 - protein, 9 aa, Artificial Sequence
  Description of Artificial Sequence: Synthetic peptide
  Seed: SLQCLQALY (PRAME_HUMAN)
SIQCLQALY

SEQ ID NO: 144592 - protein, 10 aa, Artificial Sequence
  Description of Artificial Sequence: Synthetic peptide
  Seed: QALYVDSLFF (PRAME_HUMAN)
QVLYVDSLFW

SEQ ID NO: 144593 - protein, 10 aa, Artificial Sequence
  Description of Artificial Sequence: Synthetic peptide
  Seed: YEDIHGTLHL (PRAME_HUMAN)
YWDIHGTLHF

SEQ ID NO: 144594 - protein, 10 aa, Artificial Sequence
  Description of Artificial Sequence: Synthetic peptide
  Seed: TDVSPEPLQA (PRAME_HUMAN)
TEVSPEPLQA

SEQ ID NO: 144595 - protein, 10 aa, Artificial Sequence
  Description of Artificial Sequence: Synthetic peptide
  Seed: HCSQLTTLSF (PRAME_HUMAN)
HLSQLTTLSY

SEQ ID NO: 144596 - protein, 9 aa, Artificial Sequence
  Description of Artificial Sequence: Synthetic peptide
  Seed: LPRELFPPL (PRAME_HUMAN)
LPRELFPPV

SEQ ID NO: 144597 - protein, 8 aa, Artificial Sequence
  Description of Artificial Sequence: Synthetic peptide
  Seed: SQLSVLSL (PRAME_HUMAN)
SQLSVLSM

SEQ ID NO: 144598 - protein, 9 aa, Artificial Sequence
  Description of Artificial Sequence: Synthetic peptide
  Seed: SIQSRYISM (PRAME_HUMAN)
SSQSRYISV

SEQ ID NO: 144599 - protein, 10 aa, Artificial Sequence
  Description of Artificial Sequence: Synthetic peptide
  Seed: KKLKIFAMPM (PRAME_HUMAN)
KTLKIFAMPK

SEQ ID NO: 144600 - protein, 10 aa, Artificial Sequence
  Description of Artificial Sequence: Synthetic peptide
  Seed: KGQHLHLETF (PRAME_HUMAN)
KKQHLHLETM

SEQ ID NO: 144601 - protein, 10 aa, Artificial Sequence
  Description of Artificial Sequence: Synthetic peptide
  Seed: RLDQLLRHVM (PRAME_HUMAN)
RLDQLLRHVV

SEQ ID NO: 144602 - protein, 10 aa, Artificial Sequence
  Description of Artificial Sequence: Synthetic peptide
  Seed: SISISALQSL (PRAME_HUMAN)
SWSISALQSF

SEQ ID NO: 144603 - protein, 10 aa, Artificial Sequence
  Description of Artificial Sequence: Synthetic peptide
  Seed: SNLTHVLYPV (PRAME_HUMAN)
SALTHVLYPL

SEQ ID NO: 144604 - protein, 10 aa, Artificial Sequence
  Description of Artificial Sequence: Synthetic peptide
  Seed: TLQDLVFDEC (PRAME_HUMAN)
TMQDLVFDEV

SEQ ID NO: 144605 - protein, 10 aa, Artificial Sequence
  Description of Artificial Sequence: Synthetic peptide
  Seed: LSFYGNSISI (PRAME_HUMAN)
LSFYGNSISM

SEQ ID NO: 144606 - protein, 9 aa, Artificial Sequence
  Description of Artificial Sequence: Synthetic peptide
  Seed: VLYPVPLES (PRAME_HUMAN)
VIYPVPLEV

SEQ ID NO: 144607 - protein, 10 aa, Artificial Sequence
  Description of Artificial Sequence: Synthetic peptide
  Seed: SPSVSQLSVL (PRAME_HUMAN)
SLSVSQLSVW

SEQ ID NO: 144608 - protein, 10 aa, Artificial Sequence
  Description of Artificial Sequence: Synthetic peptide
  Seed: SPYLGQMINL (PRAME_HUMAN)
STYLGQMINW

SEQ ID NO: 144609 - protein, 9 aa, Artificial Sequence
  Description of Artificial Sequence: Synthetic peptide
  Seed: QDIKMILKM (PRAME_HUMAN)
QQIKMILKF

SEQ ID NO: 144610 - protein, 9 aa, Artificial Sequence
  Description of Artificial Sequence: Synthetic peptide
  Seed: RELLCELGR (PRAME_HUMAN)
RTLLCELGR

SEQ ID NO: 144611 - protein, 10 aa, Artificial Sequence
  Description of Artificial Sequence: Synthetic peptide
  Seed: RASATLQDLV (PRAME_HUMAN)
RSSATLQDLF

SEQ ID NO: 144612 - protein, 10 aa, Artificial Sequence
  Description of Artificial Sequence: Synthetic peptide
  Seed: LSQSPSVSQL (PRAME_HUMAN)
LSQSPSVSQF

SEQ ID NO: 144613 - protein, 10 aa, Artificial Sequence
  Description of Artificial Sequence: Synthetic peptide
  Seed: RLVELAGQSL (PRAME_HUMAN)
RIVELAGQSY

SEQ ID NO: 144614 - protein, 10 aa, Artificial Sequence
  Description of Artificial Sequence: Synthetic peptide
  Seed: KIFAMPMQDI (PRAME_HUMAN)
KLFAMPMQDL

SEQ ID NO: 144615 - protein, 11 aa, Artificial Sequence
  Description of Artificial Sequence: Synthetic peptide
  Seed: SIQSRYISMSV (PRAME_HUMAN)
SGQSRYISMSK

SEQ ID NO: 144616 - protein, 9 aa, Artificial Sequence
  Description of Artificial Sequence: Synthetic peptide
  Seed: EDLEVTCTW (PRAME_HUMAN)
EALEVTCTI

SEQ ID NO: 144617 - protein, 10 aa, Artificial Sequence
  Description of Artificial Sequence: Synthetic peptide
  Seed: MPMQDIKMIL (PRAME_HUMAN)
MVMQDIKMIY

SEQ ID NO: 144618 - protein, 10 aa, Artificial Sequence
  Description of Artificial Sequence: Synthetic peptide
  Seed: RRLWGSIQSR (PRAME_HUMAN)
RNLWGSIQSK

SEQ ID NO: 144619 - protein, 9 aa, Artificial Sequence
  Description of Artificial Sequence: Synthetic peptide
  Seed: YIAQFTSQF (PRAME_HUMAN)
YSAQFTSQF

SEQ ID NO: 144620 - protein, 9 aa, Artificial Sequence
  Description of Artificial Sequence: Synthetic peptide
  Seed: VLMKGQHLH (PRAME_HUMAN)
VYMKGQHLF

SEQ ID NO: 144621 - protein, 9 aa, Artificial Sequence
  Description of Artificial Sequence: Synthetic peptide
  Seed: YIAQFTSQF (PRAME_HUMAN)
YLAQFTSQK

SEQ ID NO: 144622 - protein, 9 aa, Artificial Sequence
  Description of Artificial Sequence: Synthetic peptide
  Seed: ASATLQDLV (PRAME_HUMAN)
ATATLQDLW

SEQ ID NO: 144623 - protein, 11 aa, Artificial Sequence
  Description of Artificial Sequence: Synthetic peptide
  Seed: EAAQPMTKKRK (PRAME_HUMAN)
ETAQPMTKKRR

SEQ ID NO: 144624 - protein, 9 aa, Artificial Sequence
  Description of Artificial Sequence: Synthetic peptide
  Seed: KNVLRLCCK (PRAME_HUMAN)
KMVLRLCCK

SEQ ID NO: 144625 - protein, 11 aa, Artificial Sequence
  Description of Artificial Sequence: Synthetic peptide
  Seed: KAVLDGLDVLL (PRAME_HUMAN)
KVVLDGLDVLW

SEQ ID NO: 144626 - protein, 9 aa, Artificial Sequence
  Description of Artificial Sequence: Synthetic peptide
  Seed: MINLRRLLL (PRAME_HUMAN)
MQNLRRLLF

SEQ ID NO: 144627 - protein, 10 aa, Artificial Sequence
  Description of Artificial Sequence: Synthetic peptide
  Seed: MLTDVSPEPL (PRAME_HUMAN)
MVTDVSPEPA

SEQ ID NO: 144628 - protein, 9 aa, Artificial Sequence
  Description of Artificial Sequence: Synthetic peptide
  Seed: ELFSYLIEK (PRAME_HUMAN)
EPFSYLIER

SEQ ID NO: 144629 - protein, 8 aa, Artificial Sequence
  Description of Artificial Sequence: Synthetic peptide
  Seed: IQSRYISM (PRAME_HUMAN)
IQSRYISF

SEQ ID NO: 144630 - protein, 9 aa, Artificial Sequence
  Description of Artificial Sequence: Synthetic peptide
  Seed: LSNLTHVLY (PRAME_HUMAN)
LMNLTHVLF

SEQ ID NO: 144631 - protein, 10 aa, Artificial Sequence
  Description of Artificial Sequence: Synthetic peptide
  Seed: GACDELFSYL (PRAME_HUMAN)
GACDELFSYV

SEQ ID NO: 144632 - protein, 9 aa, Artificial Sequence
  Description of Artificial Sequence: Synthetic peptide
  Seed: QMINLRRLL (PRAME_HUMAN)
QKINLRRLF

SEQ ID NO: 144633 - protein, 9 aa, Artificial Sequence
  Description of Artificial Sequence: Synthetic peptide
  Seed: YSFPEPEAA (PRAME_HUMAN)
YVFPEPEAT

SEQ ID NO: 144634 - protein, 10 aa, Artificial Sequence
  Description of Artificial Sequence: Synthetic peptide
  Seed: MNPLETLSIT (PRAME_HUMAN)
MAPLETLSIV

SEQ ID NO: 144635 - protein, 8 aa, Artificial Sequence
  Description of Artificial Sequence: Synthetic peptide
  Seed: VELAGQSL (PRAME_HUMAN)
VELAGQSV

SEQ ID NO: 144636 - protein, 9 aa, Artificial Sequence
  Description of Artificial Sequence: Synthetic peptide
  Seed: SHIHASSYI (PRAME_HUMAN)
SIIHASSYY

SEQ ID NO: 144637 - protein, 9 aa, Artificial Sequence
  Description of Artificial Sequence: Synthetic peptide
  Seed: EPILCPCFM (PRAME_HUMAN)
EAILCPCFY

SEQ ID NO: 144638 - protein, 10 aa, Artificial Sequence
  Description of Artificial Sequence: Synthetic peptide
  Seed: GLSNLTHVLY (PRAME_HUMAN)
GMSNLTHVLF

SEQ ID NO: 144639 - protein, 10 aa, Artificial Sequence
  Description of Artificial Sequence: Synthetic peptide
  Seed: MERRRLWGSI (PRAME_HUMAN)
MARRRLWGSV

SEQ ID NO: 144640 - protein, 10 aa, Artificial Sequence
  Description of Artificial Sequence: Synthetic peptide
  Seed: LKAMVQAWPF (PRAME_HUMAN)
LKAMVQAWPM

SEQ ID NO: 144641 - protein, 10 aa, Artificial Sequence
  Description of Artificial Sequence: Synthetic peptide
  Seed: MLTDVSPEPL (PRAME_HUMAN)
MSTDVSPEPI

SEQ ID NO: 144642 - protein, 10 aa, Artificial Sequence
  Description of Artificial Sequence: Synthetic peptide
  Seed: NLTHVLYPVP (PRAME_HUMAN)
NLTHVLYPVL

SEQ ID NO: 144643 - protein, 9 aa, Artificial Sequence
  Description of Artificial Sequence: Synthetic peptide
  Seed: GQHLHLETF (PRAME_HUMAN)
GYHLHLETM

SEQ ID NO: 144644 - protein, 9 aa, Artificial Sequence
  Description of Artificial Sequence: Synthetic peptide
  Seed: LSEGDVMHL (PRAME_HUMAN)
LMEGDVMHI

SEQ ID NO: 144645 - protein, 10 aa, Artificial Sequence
  Description of Artificial Sequence: Synthetic peptide
  Seed: SPSVSQLSVL (PRAME_HUMAN)
SHSVSQLSVY

SEQ ID NO: 144646 - protein, 9 aa, Artificial Sequence
  Description of Artificial Sequence: Synthetic peptide
  Seed: LHLERLAYL (PRAME_HUMAN)
LRLERLAYY

SEQ ID NO: 144647 - protein, 8 aa, Artificial Sequence
  Description of Artificial Sequence: Synthetic peptide
  Seed: VMNPLETL (PRAME_HUMAN)
VQNPLETI

SEQ ID NO: 144648 - protein, 9 aa, Artificial Sequence
  Description of Artificial Sequence: Synthetic peptide
  Seed: FLRGRLDQL (PRAME_HUMAN)
FQRGRLDQI

SEQ ID NO: 144649 - protein, 10 aa, Artificial Sequence
  Description of Artificial Sequence: Synthetic peptide
  Seed: LLPRELFPPL (PRAME_HUMAN)
LVPRELFPPF

SEQ ID NO: 144650 - protein, 9 aa, Artificial Sequence
  Description of Artificial Sequence: Synthetic peptide
  Seed: ITDDQLLAL (PRAME_HUMAN)
ISDDQLLAI

SEQ ID NO: 144651 - protein, 9 aa, Artificial Sequence
  Description of Artificial Sequence: Synthetic peptide
  Seed: RGRLDQLLR (PRAME_HUMAN)
RTRLDQLLA

SEQ ID NO: 144652 - protein, 9 aa, Artificial Sequence
  Description of Artificial Sequence: Synthetic peptide
  Seed: ITDDQLLAL (PRAME_HUMAN)
IVDDQLLAM

SEQ ID NO: 144653 - protein, 10 aa, Artificial Sequence
  Description of Artificial Sequence: Synthetic peptide
  Seed: FIPVEVLVDL (PRAME_HUMAN)
FIPVEVLVDV

SEQ ID NO: 144654 - protein, 10 aa, Artificial Sequence
  Description of Artificial Sequence: Synthetic peptide
  Seed: QSLLQHLIGL (PRAME_HUMAN)
QHLLQHLIGI

SEQ ID NO: 144655 - protein, 9 aa, Artificial Sequence
  Description of Artificial Sequence: Synthetic peptide
  Seed: LAIAALELL (PRAME_HUMAN)
LAIAALELI

SEQ ID NO: 144656 - protein, 9 aa, Artificial Sequence
  Description of Artificial Sequence: Synthetic peptide
  Seed: RRLWGSIQS (PRAME_HUMAN)
RRLWGSIQA

SEQ ID NO: 144657 - protein, 9 aa, Artificial Sequence
  Description of Artificial Sequence: Synthetic peptide
  Seed: SQSPSVSQL (PRAME_HUMAN)
SYSPSVSQF

SEQ ID NO: 144658 - protein, 9 aa, Artificial Sequence
  Description of Artificial Sequence: Synthetic peptide
  Seed: RELLCELGR (PRAME_HUMAN)
RELLCELGW

SEQ ID NO: 144659 - protein, 9 aa, Artificial Sequence
  Description of Artificial Sequence: Synthetic peptide
  Seed: HLIGLSNLT (PRAME_HUMAN)
HIIGLSNLI

SEQ ID NO: 144660 - protein, 9 aa, Artificial Sequence
  Description of Artificial Sequence: Synthetic peptide
  Seed: LQDLVFDEC (PRAME_HUMAN)
LNDLVFDEL

SEQ ID NO: 144661 - protein, 9 aa, Artificial Sequence
  Description of Artificial Sequence: Synthetic peptide
  Seed: LSLQCLQAL (PRAME_HUMAN)
LQLQCLQAM

SEQ ID NO: 144662 - protein, 10 aa, Artificial Sequence
  Description of Artificial Sequence: Synthetic peptide
  Seed: FAMPMQDIKM (PRAME_HUMAN)
FPMPMQDIKF

SEQ ID NO: 144663 - protein, 10 aa, Artificial Sequence
  Description of Artificial Sequence: Synthetic peptide
  Seed: HCSQLTTLSF (PRAME_HUMAN)
HQSQLTTLSM

SEQ ID NO: 144664 - protein, 9 aa, Artificial Sequence
  Description of Artificial Sequence: Synthetic peptide
  Seed: LSEGDVMHL (PRAME_HUMAN)
LTEGDVMHW

SEQ ID NO: 144665 - protein, 9 aa, Artificial Sequence
  Description of Artificial Sequence: Synthetic peptide
  Seed: LYVDSLFFL (PRAME_HUMAN)
LTVDSLFFL

SEQ ID NO: 144666 - protein, 9 aa, Artificial Sequence
  Description of Artificial Sequence: Synthetic peptide
  Seed: EAAQPMTKK (PRAME_HUMAN)
EQAQPMTKK

SEQ ID NO: 144667 - protein, 9 aa, Artificial Sequence
  Description of Artificial Sequence: Synthetic peptide
  Seed: LQALYVDSL (PRAME_HUMAN)
LVALYVDSI

SEQ ID NO: 144668 - protein, 9 aa, Artificial Sequence
  Description of Artificial Sequence: Synthetic peptide
  Seed: ITDDQLLAL (PRAME_HUMAN)
IMDDQLLAI

SEQ ID NO: 144669 - protein, 9 aa, Artificial Sequence
  Description of Artificial Sequence: Synthetic peptide
  Seed: KLKIFAMPM (PRAME_HUMAN)
KLKIFAMPG

SEQ ID NO: 144670 - protein, 9 aa, Artificial Sequence
  Description of Artificial Sequence: Synthetic peptide
  Seed: LTDVSPEPL (PRAME_HUMAN)
LADVSPEPV

SEQ ID NO: 144671 - protein, 8 aa, Artificial Sequence
  Description of Artificial Sequence: Synthetic peptide
  Seed: LKIFAMPM (PRAME_HUMAN)
LKIFAMPF

SEQ ID NO: 144672 - protein, 9 aa, Artificial Sequence
  Description of Artificial Sequence: Synthetic peptide
  Seed: TLKAMVQAW (PRAME_HUMAN)
TSKAMVQAF

SEQ ID NO: 144673 - protein, 9 aa, Artificial Sequence
  Description of Artificial Sequence: Synthetic peptide
  Seed: SRYISMSVW (PRAME_HUMAN)
SEYISMSVY

SEQ ID NO: 144674 - protein, 9 aa, Artificial Sequence
  Description of Artificial Sequence: Synthetic peptide
  Seed: NLTHVLYPV (PRAME_HUMAN)
NLTHVLYPM

SEQ ID NO: 144675 - protein, 10 aa, Artificial Sequence
  Description of Artificial Sequence: Synthetic peptide
  Seed: VLMKGQHLHL (PRAME_HUMAN)
VIMKGQHLHV

SEQ ID NO: 144676 - protein, 10 aa, Artificial Sequence
  Description of Artificial Sequence: Synthetic peptide
  Seed: QLLRHVMNPL (PRAME_HUMAN)
QWLRHVMNPV

SEQ ID NO: 144677 - protein, 9 aa, Artificial Sequence
  Description of Artificial Sequence: Synthetic peptide
  Seed: SQSPSVSQL (PRAME_HUMAN)
SDSPSVSQM

SEQ ID NO: 144678 - protein, 9 aa, Artificial Sequence
  Description of Artificial Sequence: Synthetic peptide
  Seed: YIAQFTSQF (PRAME_HUMAN)
YIAQFTSQV

SEQ ID NO: 144679 - protein, 9 aa, Artificial Sequence
  Description of Artificial Sequence: Synthetic peptide
  Seed: SHQDFWTVW (PRAME_HUMAN)
SWQDFWTVL

SEQ ID NO: 144680 - protein, 9 aa, Artificial Sequence
  Description of Artificial Sequence: Synthetic peptide
  Seed: RLRELLCEL (PRAME_HUMAN)
RIRELLCER

SEQ ID NO: 144681 - protein, 9 aa, Artificial Sequence
  Description of Artificial Sequence: Synthetic peptide
  Seed: RLWGSIQSR (PRAME_HUMAN)
RLWGSIQSV

SEQ ID NO: 144682 - protein, 10 aa, Artificial Sequence
  Description of Artificial Sequence: Synthetic peptide
  Seed: RELFPPLFMA (PRAME_HUMAN)
RILFPPLFMA

SEQ ID NO: 144683 - protein, 11 aa, Artificial Sequence
  Description of Artificial Sequence: Synthetic peptide
  Seed: RASATLQDLVF (PRAME_HUMAN)
RPSATLQDLVW

SEQ ID NO: 144684 - protein, 9 aa, Artificial Sequence
  Description of Artificial Sequence: Synthetic peptide
  Seed: NSISISALQ (PRAME_HUMAN)
NVISISALR

SEQ ID NO: 144685 - protein, 9 aa, Artificial Sequence
  Description of Artificial Sequence: Synthetic peptide
  Seed: ESYEDIHGT (PRAME_HUMAN)
ELYEDIHGL

SEQ ID NO: 144686 - protein, 9 aa, Artificial Sequence
  Description of Artificial Sequence: Synthetic peptide
  Seed: EDLEVTCTW (PRAME_HUMAN)
ESLEVTCTF

SEQ ID NO: 144687 - protein, 9 aa, Artificial Sequence
  Description of Artificial Sequence: Synthetic peptide
  Seed: LSNLTHVLY (PRAME_HUMAN)
LANLTHVLL

SEQ ID NO: 144688 - protein, 9 aa, Artificial Sequence
  Description of Artificial Sequence: Synthetic peptide
  Seed: KLKIFAMPM (PRAME_HUMAN)
KLKIFAMPF

SEQ ID NO: 144689 - protein, 9 aa, Artificial Sequence
  Description of Artificial Sequence: Synthetic peptide
  Seed: KAMVQAWPF (PRAME_HUMAN)
KQMVQAWPF

SEQ ID NO: 144690 - protein, 9 aa, Artificial Sequence
  Description of Artificial Sequence: Synthetic peptide
  Seed: YSFPEPEAA (PRAME_HUMAN)
YRFPEPEAF

SEQ ID NO: 144691 - protein, 9 aa, Artificial Sequence
  Description of Artificial Sequence: Synthetic peptide
  Seed: SVWTSPRRL (PRAME_HUMAN)
STWTSPRRL

SEQ ID NO: 144692 - protein, 9 aa, Artificial Sequence
  Description of Artificial Sequence: Synthetic peptide
  Seed: LQALYVDSL (PRAME_HUMAN)
LMALYVDSI

SEQ ID NO: 144693 - protein, 9 aa, Artificial Sequence
  Description of Artificial Sequence: Synthetic peptide
  Seed: VQAWPFTCL (PRAME_HUMAN)
VMAWPFTCV

SEQ ID NO: 144694 - protein, 11 aa, Artificial Sequence
  Description of Artificial Sequence: Synthetic peptide
  Seed: QALYVDSLFFL (PRAME_HUMAN)
QHLYVDSLFFV

SEQ ID NO: 144695 - protein, 9 aa, Artificial Sequence
  Description of Artificial Sequence: Synthetic peptide
  Seed: HVMNPLETL (PRAME_HUMAN)
HHMNPLETC

SEQ ID NO: 144696 - protein, 9 aa, Artificial Sequence
  Description of Artificial Sequence: Synthetic peptide
  Seed: LLSHIHASS (PRAME_HUMAN)
LVSHIHASI

SEQ ID NO: 144697 - protein, 10 aa, Artificial Sequence
  Description of Artificial Sequence: Synthetic peptide
  Seed: LYVDSLFFLR (PRAME_HUMAN)
LNVDSLFFLR

SEQ ID NO: 144698 - protein, 10 aa, Artificial Sequence
  Description of Artificial Sequence: Synthetic peptide
  Seed: RGRLDQLLRH (PRAME_HUMAN)
RLRLDQLLRL

SEQ ID NO: 144699 - protein, 9 aa, Artificial Sequence
  Description of Artificial Sequence: Synthetic peptide
  Seed: LQHLIGLSN (PRAME_HUMAN)
LLHLIGLSF

SEQ ID NO: 144700 - protein, 11 aa, Artificial Sequence
  Description of Artificial Sequence: Synthetic peptide
  Seed: MLTDVSPEPLQ (PRAME_HUMAN)
MMTDVSPEPLV

SEQ ID NO: 144701 - protein, 11 aa, Artificial Sequence
  Description of Artificial Sequence: Synthetic peptide
  Seed: ESYEDIHGTLH (PRAME_HUMAN)
EMYEDIHGTLR

SEQ ID NO: 144702 - protein, 9 aa, Artificial Sequence
  Description of Artificial Sequence: Synthetic peptide
  Seed: LMKGQHLHL (PRAME_HUMAN)
LQKGQHLHM

SEQ ID NO: 144703 - protein, 10 aa, Artificial Sequence
  Description of Artificial Sequence: Synthetic peptide
  Seed: LSQSPSVSQL (PRAME_HUMAN)
LGQSPSVSQF

SEQ ID NO: 144704 - protein, 10 aa, Artificial Sequence
  Description of Artificial Sequence: Synthetic peptide
  Seed: RLSEGDVMHL (PRAME_HUMAN)
RMSEGDVMHV

SEQ ID NO: 144705 - protein, 9 aa, Artificial Sequence
  Description of Artificial Sequence: Synthetic peptide
  Seed: FTCLPLGVL (PRAME_HUMAN)
FQCLPLGVV

SEQ ID NO: 144706 - protein, 10 aa, Artificial Sequence
  Description of Artificial Sequence: Synthetic peptide
  Seed: AQFTSQFLSL (PRAME_HUMAN)
ALFTSQFLSI

SEQ ID NO: 144707 - protein, 8 aa, Artificial Sequence
  Description of Artificial Sequence: Synthetic peptide
  Seed: LSNLTHVL (PRAME_HUMAN)
LANLTHVM

SEQ ID NO: 144708 - protein, 9 aa, Artificial Sequence
  Description of Artificial Sequence: Synthetic peptide
  Seed: LSVLSLSGV (PRAME_HUMAN)
LLVLSLSGT

SEQ ID NO: 144709 - protein, 9 aa, Artificial Sequence
  Description of Artificial Sequence: Synthetic peptide
  Seed: LLKDEALAI (PRAME_HUMAN)
LQKDEALAM

SEQ ID NO: 144710 - protein, 9 aa, Artificial Sequence
  Description of Artificial Sequence: Synthetic peptide
  Seed: RLRELLCEL (PRAME_HUMAN)
RRRELLCEY

SEQ ID NO: 144711 - protein, 9 aa, Artificial Sequence
  Description of Artificial Sequence: Synthetic peptide
  Seed: AVLDGLDVL (PRAME_HUMAN)
AMLDGLDVA

SEQ ID NO: 144712 - protein, 9 aa, Artificial Sequence
  Description of Artificial Sequence: Synthetic peptide
  Seed: SIEDLEVTC (PRAME_HUMAN)
SVEDLEVTM

SEQ ID NO: 144713 - protein, 9 aa, Artificial Sequence
  Description of Artificial Sequence: Synthetic peptide
  Seed: ASATLQDLV (PRAME_HUMAN)
AMATLQDLL

SEQ ID NO: 144714 - protein, 10 aa, Artificial Sequence
  Description of Artificial Sequence: Synthetic peptide
  Seed: LLPRELFPPL (PRAME_HUMAN)
LSPRELFPPL

SEQ ID NO: 144715 - protein, 10 aa, Artificial Sequence
  Description of Artificial Sequence: Synthetic peptide
  Seed: ITDDQLLALL (PRAME_HUMAN)
IMDDQLLALV

SEQ ID NO: 144716 - protein, 9 aa, Artificial Sequence
  Description of Artificial Sequence: Synthetic peptide
  Seed: AMVQAWPFT (PRAME_HUMAN)
AQVQAWPFV

SEQ ID NO: 144717 - protein, 10 aa, Artificial Sequence
  Description of Artificial Sequence: Synthetic peptide
  Seed: QSRYISMSVW (PRAME_HUMAN)
QSRYISMSVF

SEQ ID NO: 144718 - protein, 9 aa, Artificial Sequence
  Description of Artificial Sequence: Synthetic peptide
  Seed: KLKIFAMPM (PRAME_HUMAN)
KIKIFAMPS

SEQ ID NO: 144719 - protein, 10 aa, Artificial Sequence
  Description of Artificial Sequence: Synthetic peptide
  Seed: LSLQCLQALY (PRAME_HUMAN)
LVLQCLQALY

SEQ ID NO: 144720 - protein, 10 aa, Artificial Sequence
  Description of Artificial Sequence: Synthetic peptide
  Seed: KAVLDGLDVL (PRAME_HUMAN)
KLVLDGLDVF

SEQ ID NO: 144721 - protein, 10 aa, Artificial Sequence
  Description of Artificial Sequence: Synthetic peptide
  Seed: SLYSFPEPEA (PRAME_HUMAN)
SIYSFPEPEL

SEQ ID NO: 144722 - protein, 9 aa, Artificial Sequence
  Description of Artificial Sequence: Synthetic peptide
  Seed: SATLQDLVF (PRAME_HUMAN)
SSTLQDLVW

SEQ ID NO: 144723 - protein, 9 aa, Artificial Sequence
  Description of Artificial Sequence: Synthetic peptide
  Seed: LAIAALELL (PRAME_HUMAN)
LQIAALELA

SEQ ID NO: 144724 - protein, 11 aa, Artificial Sequence
  Description of Artificial Sequence: Synthetic peptide
  Seed: RLWGSIQSRYI (PRAME_HUMAN)
RLWGSIQSRYW

SEQ ID NO: 144725 - protein, 10 aa, Artificial Sequence
  Description of Artificial Sequence: Synthetic peptide
  Seed: QAWPFTCLPL (PRAME_HUMAN)
QQWPFTCLPV

SEQ ID NO: 144726 - protein, 9 aa, Artificial Sequence
  Description of Artificial Sequence: Synthetic peptide
  Seed: SMSVWTSPR (PRAME_HUMAN)
SASVWTSPY

SEQ ID NO: 144727 - protein, 9 aa, Artificial Sequence
  Description of Artificial Sequence: Synthetic peptide
  Seed: LSNLTHVLY (PRAME_HUMAN)
LYNLTHVLY

SEQ ID NO: 144728 - protein, 10 aa, Artificial Sequence
  Description of Artificial Sequence: Synthetic peptide
  Seed: MERRRLWGSI (PRAME_HUMAN)
MVRRRLWGSM

SEQ ID NO: 144729 - protein, 9 aa, Artificial Sequence
  Description of Artificial Sequence: Synthetic peptide
  Seed: ELFPPLFMA (PRAME_HUMAN)
ETFPPLFMV

SEQ ID NO: 144730 - protein, 10 aa, Artificial Sequence
  Description of Artificial Sequence: Synthetic peptide
  Seed: LYVDSLFFLR (PRAME_HUMAN)
LWVDSLFFLR

SEQ ID NO: 144731 - protein, 9 aa, Artificial Sequence
  Description of Artificial Sequence: Synthetic peptide
  Seed: RRWKLQVLD (PRAME_HUMAN)
RRWKLQVLR

SEQ ID NO: 144732 - protein, 9 aa, Artificial Sequence
  Description of Artificial Sequence: Synthetic peptide
  Seed: FDGRHSQTL (PRAME_HUMAN)
FEGRHSQTF

SEQ ID NO: 144733 - protein, 9 aa, Artificial Sequence
  Description of Artificial Sequence: Synthetic peptide
  Seed: MNPLETLSI (PRAME_HUMAN)
MQPLETLSV

SEQ ID NO: 144734 - protein, 9 aa, Artificial Sequence
  Description of Artificial Sequence: Synthetic peptide
  Seed: ACDELFSYL (PRAME_HUMAN)
ACDELFSYI

SEQ ID NO: 144735 - protein, 9 aa, Artificial Sequence
  Description of Artificial Sequence: Synthetic peptide
  Seed: SHQDFWTVW (PRAME_HUMAN)
SMQDFWTVF

SEQ ID NO: 144736 - protein, 9 aa, Artificial Sequence
  Description of Artificial Sequence: Synthetic peptide
  Seed: LPLGVLMKG (PRAME_HUMAN)
LPLGVLMKV

SEQ ID NO: 144737 - protein, 9 aa, Artificial Sequence
  Description of Artificial Sequence: Synthetic peptide
  Seed: SQSPSVSQL (PRAME_HUMAN)
SMSPSVSQL

SEQ ID NO: 144738 - protein, 10 aa, Artificial Sequence
  Description of Artificial Sequence: Synthetic peptide
  Seed: ISISALQSLL (PRAME_HUMAN)
IVISALQSLL

SEQ ID NO: 144739 - protein, 9 aa, Artificial Sequence
  Description of Artificial Sequence: Synthetic peptide
  Seed: HVMNPLETL (PRAME_HUMAN)
HDMNPLETV

SEQ ID NO: 144740 - protein, 11 aa, Artificial Sequence
  Description of Artificial Sequence: Synthetic peptide
  Seed: AEQPFIPVEVL (PRAME_HUMAN)
AEQPFIPVEVV

SEQ ID NO: 144741 - protein, 10 aa, Artificial Sequence
  Description of Artificial Sequence: Synthetic peptide
  Seed: AYLHARLREL (PRAME_HUMAN)
AYLHARLREV

SEQ ID NO: 144742 - protein, 10 aa, Artificial Sequence
  Description of Artificial Sequence: Synthetic peptide
  Seed: IGLSNLTHVL (PRAME_HUMAN)
IELSNLTHVI

SEQ ID NO: 144743 - protein, 9 aa, Artificial Sequence
  Description of Artificial Sequence: Synthetic peptide
  Seed: CKKLKIFAM (PRAME_HUMAN)
CPKLKIFAL

SEQ ID NO: 144744 - protein, 9 aa, Artificial Sequence
  Description of Artificial Sequence: Synthetic peptide
  Seed: SALQSLLQH (PRAME_HUMAN)
SVLQSLLQF

SEQ ID NO: 144745 - protein, 10 aa, Artificial Sequence
  Description of Artificial Sequence: Synthetic peptide
  Seed: RELFPPLFMA (PRAME_HUMAN)
RNLFPPLFMV

SEQ ID NO: 144746 - protein, 9 aa, Artificial Sequence
  Description of Artificial Sequence: Synthetic peptide
  Seed: EPLQALLER (PRAME_HUMAN)
EVLQALLEY

SEQ ID NO: 144747 - protein, 10 aa, Artificial Sequence
  Description of Artificial Sequence: Synthetic peptide
  Seed: RLAYLHARLR (PRAME_HUMAN)
RMAYLHARLR

SEQ ID NO: 144748 - protein, 8 aa, Artificial Sequence
  Description of Artificial Sequence: Synthetic peptide
  Seed: FYDPEPIL (PRAME_HUMAN)
FADPEPIL

SEQ ID NO: 144749 - protein, 9 aa, Artificial Sequence
  Description of Artificial Sequence: Synthetic peptide
  Seed: YIAQFTSQF (PRAME_HUMAN)
YNAQFTSQF

SEQ ID NO: 144750 - protein, 9 aa, Artificial Sequence
  Description of Artificial Sequence: Synthetic peptide
  Seed: QLLALLPSL (PRAME_HUMAN)
QILALLPSL

SEQ ID NO: 144751 - protein, 9 aa, Artificial Sequence
  Description of Artificial Sequence: Synthetic peptide
  Seed: SATLQDLVF (PRAME_HUMAN)
SATLQDLVW

SEQ ID NO: 144752 - protein, 9 aa, Artificial Sequence
  Description of Artificial Sequence: Synthetic peptide
  Seed: QPFIPVEVL (PRAME_HUMAN)
QRFIPVEVL

SEQ ID NO: 144753 - protein, 9 aa, Artificial Sequence
  Description of Artificial Sequence: Synthetic peptide
  Seed: VSPEPLQAL (PRAME_HUMAN)
VRPEPLQAV

SEQ ID NO: 144754 - protein, 9 aa, Artificial Sequence
  Description of Artificial Sequence: Synthetic peptide
  Seed: EDLEVTCTW (PRAME_HUMAN)
EILEVTCTW

SEQ ID NO: 144755 - protein, 9 aa, Artificial Sequence
  Description of Artificial Sequence: Synthetic peptide
  Seed: ESYEDIHGT (PRAME_HUMAN)
ECYEDIHGV

SEQ ID NO: 144756 - protein, 10 aa, Artificial Sequence
  Description of Artificial Sequence: Synthetic peptide
  Seed: LKAMVQAWPF (PRAME_HUMAN)
LFAMVQAWPY

SEQ ID NO: 144757 - protein, 10 aa, Artificial Sequence
  Description of Artificial Sequence: Synthetic peptide
  Seed: RRLWGSIQSR (PRAME_HUMAN)
RILWGSIQSK

SEQ ID NO: 144758 - protein, 9 aa, Artificial Sequence
  Description of Artificial Sequence: Synthetic peptide
  Seed: LYPVPLESY (PRAME_HUMAN)
LWPVPLESL

SEQ ID NO: 144759 - protein, 9 aa, Artificial Sequence
  Description of Artificial Sequence: Synthetic peptide
  Seed: RRLLLSHIH (PRAME_HUMAN)
RQLLLSHIV

SEQ ID NO: 144760 - protein, 10 aa, Artificial Sequence
  Description of Artificial Sequence: Synthetic peptide
  Seed: SNLTHVLYPV (PRAME_HUMAN)
SRLTHVLYPA

SEQ ID NO: 144761 - protein, 10 aa, Artificial Sequence
  Description of Artificial Sequence: Synthetic peptide
  Seed: LSFYGNSISI (PRAME_HUMAN)
LYFYGNSISY

SEQ ID NO: 144762 - protein, 10 aa, Artificial Sequence
  Description of Artificial Sequence: Synthetic peptide
  Seed: LSQSPSVSQL (PRAME_HUMAN)
LQQSPSVSQF

SEQ ID NO: 144763 - protein, 11 aa, Artificial Sequence
  Description of Artificial Sequence: Synthetic peptide
  Seed: RLRELLCELGR (PRAME_HUMAN)
RSRELLCELGR

SEQ ID NO: 144764 - protein, 11 aa, Artificial Sequence
  Description of Artificial Sequence: Synthetic peptide
  Seed: RRLWGSIQSRY (PRAME_HUMAN)
RSLWGSIQSRY

SEQ ID NO: 144765 - protein, 10 aa, Artificial Sequence
  Description of Artificial Sequence: Synthetic peptide
  Seed: FFLRGRLDQL (PRAME_HUMAN)
FQLRGRLDQI

SEQ ID NO: 144766 - protein, 10 aa, Artificial Sequence
  Description of Artificial Sequence: Synthetic peptide
  Seed: YIAQFTSQFL (PRAME_HUMAN)
YPAQFTSQFF

SEQ ID NO: 144767 - protein, 9 aa, Artificial Sequence
  Description of Artificial Sequence: Synthetic peptide
  Seed: AAFDGRHSQ (PRAME_HUMAN)
AAFDGRHSY

SEQ ID NO: 144768 - protein, 11 aa, Artificial Sequence
  Description of Artificial Sequence: Synthetic peptide
  Seed: AAFDGRHSQTL (PRAME_HUMAN)
AHFDGRHSQTY

SEQ ID NO: 144769 - protein, 9 aa, Artificial Sequence
  Description of Artificial Sequence: Synthetic peptide
  Seed: ALELLPREL (PRAME_HUMAN)
ATELLPREL

SEQ ID NO: 144770 - protein, 9 aa, Artificial Sequence
  Description of Artificial Sequence: Synthetic peptide
  Seed: ALAIAALEL (PRAME_HUMAN)
AVAIAALEL

SEQ ID NO: 144771 - protein, 9 aa, Artificial Sequence
  Description of Artificial Sequence: Synthetic peptide
  Seed: ALLERASAT (PRAME_HUMAN)
AVLERASAA

SEQ ID NO: 144772 - protein, 10 aa, Artificial Sequence
  Description of Artificial Sequence: Synthetic peptide
  Seed: FIPVEVLVDL (PRAME_HUMAN)
FGPVEVLVDM

SEQ ID NO: 144773 - protein, 9 aa, Artificial Sequence
  Description of Artificial Sequence: Synthetic peptide
  Seed: ELFPPLFMA (PRAME_HUMAN)
ESFPPLFMA

SEQ ID NO: 144774 - protein, 10 aa, Artificial Sequence
  Description of Artificial Sequence: Synthetic peptide
  Seed: FIPVEVLVDL (PRAME_HUMAN)
FHPVEVLVDW

SEQ ID NO: 144775 - protein, 9 aa, Artificial Sequence
  Description of Artificial Sequence: Synthetic peptide
  Seed: HVMNPLETL (PRAME_HUMAN)
HWMNPLETM

SEQ ID NO: 144776 - protein, 9 aa, Artificial Sequence
  Description of Artificial Sequence: Synthetic peptide
  Seed: ALLPSLSHC (PRAME_HUMAN)
AMLPSLSHI

SEQ ID NO: 144777 - protein, 10 aa, Artificial Sequence
  Description of Artificial Sequence: Synthetic peptide
  Seed: LPTLAKFSPY (PRAME_HUMAN)
LHTLAKFSPY

SEQ ID NO: 144778 - protein, 9 aa, Artificial Sequence
  Description of Artificial Sequence: Synthetic peptide
  Seed: LQSLLQHLI (PRAME_HUMAN)
LMSLLQHLV

SEQ ID NO: 144779 - protein, 9 aa, Artificial Sequence
  Description of Artificial Sequence: Synthetic peptide
  Seed: LSHIHASSY (PRAME_HUMAN)
LTHIHASSW

SEQ ID NO: 144780 - protein, 9 aa, Artificial Sequence
  Description of Artificial Sequence: Synthetic peptide
  Seed: SVLSLSGVM (PRAME_HUMAN)
STLSLSGVY

SEQ ID NO: 144781 - protein, 10 aa, Artificial Sequence
  Description of Artificial Sequence: Synthetic peptide
  Seed: GLSNLTHVLY (PRAME_HUMAN)
GTSNLTHVLR

SEQ ID NO: 144782 - protein, 9 aa, Artificial Sequence
  Description of Artificial Sequence: Synthetic peptide
  Seed: KMILKMVQL (PRAME_HUMAN)
KAILKMVQV

SEQ ID NO: 144783 - protein, 9 aa, Artificial Sequence
  Description of Artificial Sequence: Synthetic peptide
  Seed: ITDDQLLAL (PRAME_HUMAN)
IRDDQLLAY

SEQ ID NO: 144784 - protein, 10 aa, Artificial Sequence
  Description of Artificial Sequence: Synthetic peptide
  Seed: RHVMNPLETL (PRAME_HUMAN)
RRVMNPLETI

SEQ ID NO: 144785 - protein, 10 aa, Artificial Sequence
  Description of Artificial Sequence: Synthetic peptide
  Seed: ARLRELLCEL (PRAME_HUMAN)
AALRELLCEI

SEQ ID NO: 144786 - protein, 9 aa, Artificial Sequence
  Description of Artificial Sequence: Synthetic peptide
  Seed: RLRELLCEL (PRAME_HUMAN)
RSRELLCEW

SEQ ID NO: 144787 - protein, 10 aa, Artificial Sequence
  Description of Artificial Sequence: Synthetic peptide
  Seed: FFLRGRLDQL (PRAME_HUMAN)
FPLRGRLDQV

SEQ ID NO: 144788 - protein, 9 aa, Artificial Sequence
  Description of Artificial Sequence: Synthetic peptide
  Seed: FTCLPLGVL (PRAME_HUMAN)
FLCLPLGVV

SEQ ID NO: 144789 - protein, 9 aa, Artificial Sequence
  Description of Artificial Sequence: Synthetic peptide
  Seed: AWPFTCLPL (PRAME_HUMAN)
AYPFTCLPF

SEQ ID NO: 144790 - protein, 10 aa, Artificial Sequence
  Description of Artificial Sequence: Synthetic peptide
  Seed: RLAYLHARLR (PRAME_HUMAN)
RRAYLHARLR

SEQ ID NO: 144791 - protein, 9 aa, Artificial Sequence
  Description of Artificial Sequence: Synthetic peptide
  Seed: EPLQALLER (PRAME_HUMAN)
EILQALLER

SEQ ID NO: 144792 - protein, 9 aa, Artificial Sequence
  Description of Artificial Sequence: Synthetic peptide
  Seed: SVLSLSGVM (PRAME_HUMAN)
SVLSLSGVR

SEQ ID NO: 144793 - protein, 9 aa, Artificial Sequence
  Description of Artificial Sequence: Synthetic peptide
  Seed: YIAQFTSQF (PRAME_HUMAN)
YFAQFTSQH

SEQ ID NO: 144794 - protein, 10 aa, Artificial Sequence
  Description of Artificial Sequence: Synthetic peptide
  Seed: SLLKDEALAI (PRAME_HUMAN)
SALKDEALAV

SEQ ID NO: 144795 - protein, 10 aa, Artificial Sequence
  Description of Artificial Sequence: Synthetic peptide
  Seed: LSFYGNSISI (PRAME_HUMAN)
LGFYGNSISF

SEQ ID NO: 144796 - protein, 9 aa, Artificial Sequence
  Description of Artificial Sequence: Synthetic peptide
  Seed: TCLPLGVLM (PRAME_HUMAN)
TTLPLGVLI

SEQ ID NO: 144797 - protein, 11 aa, Artificial Sequence
  Description of Artificial Sequence: Synthetic peptide
  Seed: RLAYLHARLRE (PRAME_HUMAN)
RQAYLHARLRR

SEQ ID NO: 144798 - protein, 9 aa, Artificial Sequence
  Description of Artificial Sequence: Synthetic peptide
  Seed: YSFPEPEAA (PRAME_HUMAN)
YSFPEPEAI

SEQ ID NO: 144799 - protein, 9 aa, Artificial Sequence
  Description of Artificial Sequence: Synthetic peptide
  Seed: LGRPSMVWL (PRAME_HUMAN)
LVRPSMVWK

SEQ ID NO: 144800 - protein, 9 aa, Artificial Sequence
  Description of Artificial Sequence: Synthetic peptide
  Seed: VSPEPLQAL (PRAME_HUMAN)
VWPEPLQAV

SEQ ID NO: 144801 - protein, 9 aa, Artificial Sequence
  Description of Artificial Sequence: Synthetic peptide
  Seed: SLLQHLIGL (PRAME_HUMAN)
SGLQHLIGY

SEQ ID NO: 144802 - protein, 10 aa, Artificial Sequence
  Description of Artificial Sequence: Synthetic peptide
  Seed: RGRLDQLLRH (PRAME_HUMAN)
RKRLDQLLRI

SEQ ID NO: 144803 - protein, 9 aa, Artificial Sequence
  Description of Artificial Sequence: Synthetic peptide
  Seed: ITDDQLLAL (PRAME_HUMAN)
IIDDQLLAM

SEQ ID NO: 144804 - protein, 10 aa, Artificial Sequence
  Description of Artificial Sequence: Synthetic peptide
  Seed: VMNPLETLSI (PRAME_HUMAN)
VLNPLETLSV

SEQ ID NO: 144805 - protein, 10 aa, Artificial Sequence
  Description of Artificial Sequence: Synthetic peptide
  Seed: RHVMNPLETL (PRAME_HUMAN)
RQVMNPLETY

SEQ ID NO: 144806 - protein, 10 aa, Artificial Sequence
  Description of Artificial Sequence: Synthetic peptide
  Seed: QAWPFTCLPL (PRAME_HUMAN)
QTWPFTCLPW

SEQ ID NO: 144807 - protein, 9 aa, Artificial Sequence
  Description of Artificial Sequence: Synthetic peptide
  Seed: ELAGQSLLK (PRAME_HUMAN)
EFAGQSLLR

SEQ ID NO: 144808 - protein, 9 aa, Artificial Sequence
  Description of Artificial Sequence: Synthetic peptide
  Seed: AVLDGLDVL (PRAME_HUMAN)
ALLDGLDVV

SEQ ID NO: 144809 - protein, 11 aa, Artificial Sequence
  Description of Artificial Sequence: Synthetic peptide
  Seed: RASATLQDLVF (PRAME_HUMAN)
RFSATLQDLVW

SEQ ID NO: 144810 - protein, 10 aa, Artificial Sequence
  Description of Artificial Sequence: Synthetic peptide
  Seed: ARLRELLCEL (PRAME_HUMAN)
AFLRELLCEA

SEQ ID NO: 144811 - protein, 10 aa, Artificial Sequence
  Description of Artificial Sequence: Synthetic peptide
  Seed: CSQLTTLSFY (PRAME_HUMAN)
CMQLTTLSFF

SEQ ID NO: 144812 - protein, 9 aa, Artificial Sequence
  Description of Artificial Sequence: Synthetic peptide
  Seed: FYDPEPILC (PRAME_HUMAN)
FLDPEPILF

SEQ ID NO: 144813 - protein, 10 aa, Artificial Sequence
  Description of Artificial Sequence: Synthetic peptide
  Seed: DVSPEPLQAL (PRAME_HUMAN)
DTSPEPLQAW

SEQ ID NO: 144814 - protein, 9 aa, Artificial Sequence
  Description of Artificial Sequence: Synthetic peptide
  Seed: ITDDQLLAL (PRAME_HUMAN)
IDDDQLLAM

SEQ ID NO: 144815 - protein, 10 aa, Artificial Sequence
  Description of Artificial Sequence: Synthetic peptide
  Seed: FLKEGACDEL (PRAME_HUMAN)
FAKEGACDEY

SEQ ID NO: 144816 - protein, 11 aa, Artificial Sequence
  Description of Artificial Sequence: Synthetic peptide
  Seed: QALYVDSLFFL (PRAME_HUMAN)
QFLYVDSLFFI

SEQ ID NO: 144817 - protein, 10 aa, Artificial Sequence
  Description of Artificial Sequence: Synthetic peptide
  Seed: KKLKIFAMPM (PRAME_HUMAN)
KTLKIFAMPL

SEQ ID NO: 144818 - protein, 11 aa, Artificial Sequence
  Description of Artificial Sequence: Synthetic peptide
  Seed: SIQSRYISMSV (PRAME_HUMAN)
SLQSRYISMSK

SEQ ID NO: 144819 - protein, 9 aa, Artificial Sequence
  Description of Artificial Sequence: Synthetic peptide
  Seed: SPYLGQMIN (PRAME_HUMAN)
SPYLGQMIA

SEQ ID NO: 144820 - protein, 11 aa, Artificial Sequence
  Description of Artificial Sequence: Synthetic peptide
  Seed: RELFPPLFMAA (PRAME_HUMAN)
RYLFPPLFMAI

SEQ ID NO: 144821 - protein, 10 aa, Artificial Sequence
  Description of Artificial Sequence: Synthetic peptide
  Seed: LSFYGNSISI (PRAME_HUMAN)
LCFYGNSISL

SEQ ID NO: 144822 - protein, 11 aa, Artificial Sequence
  Description of Artificial Sequence: Synthetic peptide
  Seed: RLAYLHARLRE (PRAME_HUMAN)
RTAYLHARLRR

SEQ ID NO: 144823 - protein, 9 aa, Artificial Sequence
  Description of Artificial Sequence: Synthetic peptide
  Seed: SQLTTLSFY (PRAME_HUMAN)
SHLTTLSFF

SEQ ID NO: 144824 - protein, 9 aa, Artificial Sequence
  Description of Artificial Sequence: Synthetic peptide
  Seed: CKKLKIFAM (PRAME_HUMAN)
CLKLKIFAA

SEQ ID NO: 144825 - protein, 9 aa, Artificial Sequence
  Description of Artificial Sequence: Synthetic peptide
  Seed: SRYISMSVW (PRAME_HUMAN)
SNYISMSVF

SEQ ID NO: 144826 - protein, 9 aa, Artificial Sequence
  Description of Artificial Sequence: Synthetic peptide
  Seed: LETLSITNC (PRAME_HUMAN)
LETLSITNV

SEQ ID NO: 144827 - protein, 9 aa, Artificial Sequence
  Description of Artificial Sequence: Synthetic peptide
  Seed: KVKRKKNVL (PRAME_HUMAN)
KVKRKKNVA

SEQ ID NO: 144828 - protein, 11 aa, Artificial Sequence
  Description of Artificial Sequence: Synthetic peptide
  Seed: LSNLTHVLYPV (PRAME_HUMAN)
LWNLTHVLYPV

SEQ ID NO: 144829 - protein, 10 aa, Artificial Sequence
  Description of Artificial Sequence: Synthetic peptide
  Seed: RTFYDPEPIL (PRAME_HUMAN)
RQFYDPEPIF

SEQ ID NO: 144830 - protein, 10 aa, Artificial Sequence
  Description of Artificial Sequence: Synthetic peptide
  Seed: FFLRGRLDQL (PRAME_HUMAN)
FHLRGRLDQV

SEQ ID NO: 144831 - protein, 10 aa, Artificial Sequence
  Description of Artificial Sequence: Synthetic peptide
  Seed: LLSHIHASSY (PRAME_HUMAN)
LISHIHASSY

SEQ ID NO: 144832 - protein, 9 aa, Artificial Sequence
  Description of Artificial Sequence: Synthetic peptide
  Seed: SYEDIHGTL (PRAME_HUMAN)
SAEDIHGTI

SEQ ID NO: 144833 - protein, 11 aa, Artificial Sequence
  Description of Artificial Sequence: Synthetic peptide
  Seed: TDVSPEPLQAL (PRAME_HUMAN)
TEVSPEPLQAM

SEQ ID NO: 144834 - protein, 9 aa, Artificial Sequence
  Description of Artificial Sequence: Synthetic peptide
  Seed: ERLAYLHAR (PRAME_HUMAN)
EFLAYLHAK

SEQ ID NO: 144835 - protein, 10 aa, Artificial Sequence
  Description of Artificial Sequence: Synthetic peptide
  Seed: LERLAYLHAR (PRAME_HUMAN)
LFRLAYLHAK

SEQ ID NO: 144836 - protein, 9 aa, Artificial Sequence
  Description of Artificial Sequence: Synthetic peptide
  Seed: ISPEKEEQY (PRAME_HUMAN)
ILPEKEEQL

SEQ ID NO: 144837 - protein, 10 aa, Artificial Sequence
  Description of Artificial Sequence: Synthetic peptide
  Seed: RLSEGDVMHL (PRAME_HUMAN)
RASEGDVMHR

SEQ ID NO: 144838 - protein, 11 aa, Artificial Sequence
  Description of Artificial Sequence: Synthetic peptide
  Seed: SNLTHVLYPVP (PRAME_HUMAN)
SLLTHVLYPVF

SEQ ID NO: 144839 - protein, 10 aa, Artificial Sequence
  Description of Artificial Sequence: Synthetic peptide
  Seed: ARLRELLCEL (PRAME_HUMAN)
AELRELLCEA

SEQ ID NO: 144840 - protein, 11 aa, Artificial Sequence
  Description of Artificial Sequence: Synthetic peptide
  Seed: CRLSEGDVMHL (PRAME_HUMAN)
CYLSEGDVMHV

SEQ ID NO: 144841 - protein, 8 aa, Artificial Sequence
  Description of Artificial Sequence: Synthetic peptide
  Seed: TDDQLLAL (PRAME_HUMAN)
TTDQLLAL

SEQ ID NO: 144842 - protein, 11 aa, Artificial Sequence
  Description of Artificial Sequence: Synthetic peptide
  Seed: RELFPPLFMAA (PRAME_HUMAN)
RFLFPPLFMAV

SEQ ID NO: 144843 - protein, 9 aa, Artificial Sequence
  Description of Artificial Sequence: Synthetic peptide
  Seed: TDDQLLALL (PRAME_HUMAN)
TIDQLLALL

SEQ ID NO: 144844 - protein, 9 aa, Artificial Sequence
  Description of Artificial Sequence: Synthetic peptide
  Seed: LGRPSMVWL (PRAME_HUMAN)
LARPSMVWK

SEQ ID NO: 144845 - protein, 10 aa, Artificial Sequence
  Description of Artificial Sequence: Synthetic peptide
  Seed: ESYEDIHGTL (PRAME_HUMAN)
ETYEDIHGTM

SEQ ID NO: 144846 - protein, 9 aa, Artificial Sequence
  Description of Artificial Sequence: Synthetic peptide
  Seed: RLRELLCEL (PRAME_HUMAN)
RTRELLCEG

SEQ ID NO: 144847 - protein, 9 aa, Artificial Sequence
  Description of Artificial Sequence: Synthetic peptide
  Seed: VQAWPFTCL (PRAME_HUMAN)
VMAWPFTCA

SEQ ID NO: 144848 - protein, 9 aa, Artificial Sequence
  Description of Artificial Sequence: Synthetic peptide
  Seed: KEEQYIAQF (PRAME_HUMAN)
KEEQYIAQC

SEQ ID NO: 144849 - protein, 8 aa, Artificial Sequence
  Description of Artificial Sequence: Synthetic peptide
  Seed: DQLLRHVM (PRAME_HUMAN)
DELLRHVL

SEQ ID NO: 144850 - protein, 10 aa, Artificial Sequence
  Description of Artificial Sequence: Synthetic peptide
  Seed: RLWGSIQSRY (PRAME_HUMAN)
RYWGSIQSRY

SEQ ID NO: 144851 - protein, 10 aa, Artificial Sequence
  Description of Artificial Sequence: Synthetic peptide
  Seed: AMVQAWPFTC (PRAME_HUMAN)
AMVQAWPFTI

SEQ ID NO: 144852 - protein, 10 aa, Artificial Sequence
  Description of Artificial Sequence: Synthetic peptide
  Seed: FIPVEVLVDL (PRAME_HUMAN)
FRPVEVLVDF

SEQ ID NO: 144853 - protein, 10 aa, Artificial Sequence
  Description of Artificial Sequence: Synthetic peptide
  Seed: AYLHARLREL (PRAME_HUMAN)
AWLHARLREV

SEQ ID NO: 144854 - protein, 10 aa, Artificial Sequence
  Description of Artificial Sequence: Synthetic peptide
  Seed: RPRRWKLQVL (PRAME_HUMAN)
RPRRWKLQVA

SEQ ID NO: 144855 - protein, 10 aa, Artificial Sequence
  Description of Artificial Sequence: Synthetic peptide
  Seed: RLWGSIQSRY (PRAME_HUMAN)
RTWGSIQSRY

SEQ ID NO: 144856 - protein, 10 aa, Artificial Sequence
  Description of Artificial Sequence: Synthetic peptide
  Seed: LKAMVQAWPF (PRAME_HUMAN)
LTAMVQAWPF

SEQ ID NO: 144857 - protein, 9 aa, Artificial Sequence
  Description of Artificial Sequence: Synthetic peptide
  Seed: EVLVDLFLK (PRAME_HUMAN)
EILVDLFLR

SEQ ID NO: 144858 - protein, 9 aa, Artificial Sequence
  Description of Artificial Sequence: Synthetic peptide
  Seed: KLKIFAMPM (PRAME_HUMAN)
KKKIFAMPY

SEQ ID NO: 144859 - protein, 10 aa, Artificial Sequence
  Description of Artificial Sequence: Synthetic peptide
  Seed: ALQSLLQHLI (PRAME_HUMAN)
AQQSLLQHLW

SEQ ID NO: 144860 - protein, 9 aa, Artificial Sequence
  Description of Artificial Sequence: Synthetic peptide
  Seed: TCLPLGVLM (PRAME_HUMAN)
TALPLGVLM

SEQ ID NO: 144861 - protein, 10 aa, Artificial Sequence
  Description of Artificial Sequence: Synthetic peptide
  Seed: ETFKAVLDGL (PRAME_HUMAN)
ETFKAVLDGV

SEQ ID NO: 144862 - protein, 9 aa, Artificial Sequence
  Description of Artificial Sequence: Synthetic peptide
  Seed: RLAYLHARL (PRAME_HUMAN)
REAYLHARY

SEQ ID NO: 144863 - protein, 10 aa, Artificial Sequence
  Description of Artificial Sequence: Synthetic peptide
  Seed: RTFYDPEPIL (PRAME_HUMAN)
RMFYDPEPIW

SEQ ID NO: 144864 - protein, 10 aa, Artificial Sequence
  Description of Artificial Sequence: Synthetic peptide
  Seed: VLYPVPLESY (PRAME_HUMAN)
VQYPVPLESL

SEQ ID NO: 144865 - protein, 10 aa, Artificial Sequence
  Description of Artificial Sequence: Synthetic peptide
  Seed: SPYLGQMINL (PRAME_HUMAN)
SWYLGQMINF

SEQ ID NO: 144866 - protein, 10 aa, Artificial Sequence
  Description of Artificial Sequence: Synthetic peptide
  Seed: HCSQLTTLSF (PRAME_HUMAN)
HQSQLTTLSF

SEQ ID NO: 144867 - protein, 10 aa, Artificial Sequence
  Description of Artificial Sequence: Synthetic peptide
  Seed: LPTLAKFSPY (PRAME_HUMAN)
LMTLAKFSPM

SEQ ID NO: 144868 - protein, 9 aa, Artificial Sequence
  Description of Artificial Sequence: Synthetic peptide
  Seed: RLRELLCEL (PRAME_HUMAN)
RYRELLCEK

SEQ ID NO: 144869 - protein, 9 aa, Artificial Sequence
  Description of Artificial Sequence: Synthetic peptide
  Seed: MERRRLWGS (PRAME_HUMAN)
MERRRLWGV

SEQ ID NO: 144870 - protein, 10 aa, Artificial Sequence
  Description of Artificial Sequence: Synthetic peptide
  Seed: FIPVEVLVDL (PRAME_HUMAN)
FVPVEVLVDM

SEQ ID NO: 144871 - protein, 9 aa, Artificial Sequence
  Description of Artificial Sequence: Synthetic peptide
  Seed: TLHLERLAY (PRAME_HUMAN)
TVHLERLAY

SEQ ID NO: 144872 - protein, 10 aa, Artificial Sequence
  Description of Artificial Sequence: Synthetic peptide
  Seed: AAFDGRHSQT (PRAME_HUMAN)
ALFDGRHSQY

SEQ ID NO: 144873 - protein, 9 aa, Artificial Sequence
  Description of Artificial Sequence: Synthetic peptide
  Seed: MINLRRLLL (PRAME_HUMAN)
MPNLRRLLL

SEQ ID NO: 144874 - protein, 11 aa, Artificial Sequence
  Description of Artificial Sequence: Synthetic peptide
  Seed: AEQPFIPVEVL (PRAME_HUMAN)
AEQPFIPVEVY

SEQ ID NO: 144875 - protein, 10 aa, Artificial Sequence
  Description of Artificial Sequence: Synthetic peptide
  Seed: HCSQLTTLSF (PRAME_HUMAN)
HVSQLTTLSY

SEQ ID NO: 144876 - protein, 10 aa, Artificial Sequence
  Description of Artificial Sequence: Synthetic peptide
  Seed: ELFPPLFMAA (PRAME_HUMAN)
ESFPPLFMAV

SEQ ID NO: 144877 - protein, 9 aa, Artificial Sequence
  Description of Artificial Sequence: Synthetic peptide
  Seed: SLSHCSQLT (PRAME_HUMAN)
SMSHCSQLI

SEQ ID NO: 144878 - protein, 9 aa, Artificial Sequence
  Description of Artificial Sequence: Synthetic peptide
  Seed: VSPEPLQAL (PRAME_HUMAN)
VFPEPLQAM

SEQ ID NO: 144879 - protein, 9 aa, Artificial Sequence
  Description of Artificial Sequence: Synthetic peptide
  Seed: DGRHSQTLK (PRAME_HUMAN)
DVRHSQTLK

SEQ ID NO: 144880 - protein, 11 aa, Artificial Sequence
  Description of Artificial Sequence: Synthetic peptide
  Seed: RELFPPLFMAA (PRAME_HUMAN)
RSLFPPLFMAL

SEQ ID NO: 144881 - protein, 10 aa, Artificial Sequence
  Description of Artificial Sequence: Synthetic peptide
  Seed: ETFKAVLDGL (PRAME_HUMAN)
EIFKAVLDGW

SEQ ID NO: 144882 - protein, 9 aa, Artificial Sequence
  Description of Artificial Sequence: Synthetic peptide
  Seed: YGNSISISA (PRAME_HUMAN)
YSNSISISV

SEQ ID NO: 144883 - protein, 9 aa, Artificial Sequence
  Description of Artificial Sequence: Synthetic peptide
  Seed: LYPVPLESY (PRAME_HUMAN)
LFPVPLESW

SEQ ID NO: 144884 - protein, 9 aa, Artificial Sequence
  Description of Artificial Sequence: Synthetic peptide
  Seed: KVDGLSTEA (PRAME_HUMAN)
KMDGLSTEV

SEQ ID NO: 144885 - protein, 9 aa, Artificial Sequence
  Description of Artificial Sequence: Synthetic peptide
  Seed: LAIAALELL (PRAME_HUMAN)
LPIAALELV

SEQ ID NO: 144886 - protein, 9 aa, Artificial Sequence
  Description of Artificial Sequence: Synthetic peptide
  Seed: RLAYLHARL (PRAME_HUMAN)
RTAYLHARW

SEQ ID NO: 144887 - protein, 11 aa, Artificial Sequence
  Description of Artificial Sequence: Synthetic peptide
  Seed: SQLSVLSLSGV (PRAME_HUMAN)
SYLSVLSLSGV

SEQ ID NO: 144888 - protein, 10 aa, Artificial Sequence
  Description of Artificial Sequence: Synthetic peptide
  Seed: LLLSHIHASS (PRAME_HUMAN)
LALSHIHASA

SEQ ID NO: 144889 - protein, 9 aa, Artificial Sequence
  Description of Artificial Sequence: Synthetic peptide
  Seed: MVQAWPFTC (PRAME_HUMAN)
MLQAWPFTC

SEQ ID NO: 144890 - protein, 9 aa, Artificial Sequence
  Description of Artificial Sequence: Synthetic peptide
  Seed: FLSLQCLQA (PRAME_HUMAN)
FQSLQCLQI

SEQ ID NO: 144891 - protein, 10 aa, Artificial Sequence
  Description of Artificial Sequence: Synthetic peptide
  Seed: YISPEKEEQY (PRAME_HUMAN)
YTSPEKEEQY

SEQ ID NO: 144892 - protein, 9 aa, Artificial Sequence
  Description of Artificial Sequence: Synthetic peptide
  Seed: SLLQHLIGL (PRAME_HUMAN)
SYLQHLIGY

SEQ ID NO: 144893 - protein, 9 aa, Artificial Sequence
  Description of Artificial Sequence: Synthetic peptide
  Seed: TFYDPEPIL (PRAME_HUMAN)
TTYDPEPIF

SEQ ID NO: 144894 - protein, 9 aa, Artificial Sequence
  Description of Artificial Sequence: Synthetic peptide
  Seed: QALYVDSLF (PRAME_HUMAN)
QQLYVDSLM

SEQ ID NO: 144895 - protein, 10 aa, Artificial Sequence
  Description of Artificial Sequence: Synthetic peptide
  Seed: AVLDGLDVLL (PRAME_HUMAN)
AALDGLDVLF

SEQ ID NO: 144896 - protein, 9 aa, Artificial Sequence
  Description of Artificial Sequence: Synthetic peptide
  Seed: RLWGSIQSR (PRAME_HUMAN)
RTWGSIQSK

SEQ ID NO: 144897 - protein, 10 aa, Artificial Sequence
  Description of Artificial Sequence: Synthetic peptide
  Seed: FSYLIEKVKR (PRAME_HUMAN)
FVYLIEKVKK

SEQ ID NO: 144898 - protein, 9 aa, Artificial Sequence
  Description of Artificial Sequence: Synthetic peptide
  Seed: IGLSNLTHV (PRAME_HUMAN)
ILLSNLTHV

SEQ ID NO: 144899 - protein, 9 aa, Artificial Sequence
  Description of Artificial Sequence: Synthetic peptide
  Seed: RLLLSHIHA (PRAME_HUMAN)
RILLSHIHK

SEQ ID NO: 144900 - protein, 10 aa, Artificial Sequence
  Description of Artificial Sequence: Synthetic peptide
  Seed: RRLWGSIQSR (PRAME_HUMAN)
RMLWGSIQSR

SEQ ID NO: 144901 - protein, 9 aa, Artificial Sequence
  Description of Artificial Sequence: Synthetic peptide
  Seed: SFPEPEAAQ (PRAME_HUMAN)
SWPEPEAAL

SEQ ID NO: 144902 - protein, 10 aa, Artificial Sequence
  Description of Artificial Sequence: Synthetic peptide
  Seed: KDEALAIAAL (PRAME_HUMAN)
KLEALAIAAL

SEQ ID NO: 144903 - protein, 10 aa, Artificial Sequence
  Description of Artificial Sequence: Synthetic peptide
  Seed: RGRLDQLLRH (PRAME_HUMAN)
RIRLDQLLRF

SEQ ID NO: 144904 - protein, 9 aa, Artificial Sequence
  Description of Artificial Sequence: Synthetic peptide
  Seed: LLLSHIHAS (PRAME_HUMAN)
LMLSHIHAF

SEQ ID NO: 144905 - protein, 10 aa, Artificial Sequence
  Description of Artificial Sequence: Synthetic peptide
  Seed: KGQHLHLETF (PRAME_HUMAN)
KAQHLHLETF

SEQ ID NO: 144906 - protein, 10 aa, Artificial Sequence
  Description of Artificial Sequence: Synthetic peptide
  Seed: KKLKIFAMPM (PRAME_HUMAN)
KGLKIFAMPK

SEQ ID NO: 144907 - protein, 11 aa, Artificial Sequence
  Description of Artificial Sequence: Synthetic peptide
  Seed: RRLWGSIQSRY (PRAME_HUMAN)
RMLWGSIQSRY

SEQ ID NO: 144908 - protein, 10 aa, Artificial Sequence
  Description of Artificial Sequence: Synthetic peptide
  Seed: SPYLGQMINL (PRAME_HUMAN)
SKYLGQMINW

SEQ ID NO: 144909 - protein, 8 aa, Artificial Sequence
  Description of Artificial Sequence: Synthetic peptide
  Seed: YVDSLFFL (PRAME_HUMAN)
YLDSLFFT

SEQ ID NO: 144910 - protein, 10 aa, Artificial Sequence
  Description of Artificial Sequence: Synthetic peptide
  Seed: AVLDGLDVLL (PRAME_HUMAN)
AVLDGLDVLA

SEQ ID NO: 144911 - protein, 10 aa, Artificial Sequence
  Description of Artificial Sequence: Synthetic peptide
  Seed: ALYVDSLFFL (PRAME_HUMAN)
AGYVDSLFFI

SEQ ID NO: 144912 - protein, 10 aa, Artificial Sequence
  Description of Artificial Sequence: Synthetic peptide
  Seed: IKMILKMVQL (PRAME_HUMAN)
IEMILKMVQV

SEQ ID NO: 144913 - protein, 9 aa, Artificial Sequence
  Description of Artificial Sequence: Synthetic peptide
  Seed: SYEDIHGTL (PRAME_HUMAN)
SMEDIHGTL

SEQ ID NO: 144914 - protein, 9 aa, Artificial Sequence
  Description of Artificial Sequence: Synthetic peptide
  Seed: RRLLLSHIH (PRAME_HUMAN)
RQLLLSHIM

SEQ ID NO: 144915 - protein, 9 aa, Artificial Sequence
  Description of Artificial Sequence: Synthetic peptide
  Seed: TLAKFSPYL (PRAME_HUMAN)
TVAKFSPYM

SEQ ID NO: 144916 - protein, 9 aa, Artificial Sequence
  Description of Artificial Sequence: Synthetic peptide
  Seed: KMILKMVQL (PRAME_HUMAN)
KYILKMVQF

SEQ ID NO: 144917 - protein, 10 aa, Artificial Sequence
  Description of Artificial Sequence: Synthetic peptide
  Seed: FYDPEPILCP (PRAME_HUMAN)
FVDPEPILCL

SEQ ID NO: 144918 - protein, 9 aa, Artificial Sequence
  Description of Artificial Sequence: Synthetic peptide
  Seed: KLKIFAMPM (PRAME_HUMAN)
KSKIFAMPA

SEQ ID NO: 144919 - protein, 9 aa, Artificial Sequence
  Description of Artificial Sequence: Synthetic peptide
  Seed: MQDIKMILK (PRAME_HUMAN)
MIDIKMILK

SEQ ID NO: 144920 - protein, 9 aa, Artificial Sequence
  Description of Artificial Sequence: Synthetic peptide
  Seed: IAQFTSQFL (PRAME_HUMAN)
IAQFTSQFY

SEQ ID NO: 144921 - protein, 10 aa, Artificial Sequence
  Description of Artificial Sequence: Synthetic peptide
  Seed: DRTFYDPEPI (PRAME_HUMAN)
DTTFYDPEPV

SEQ ID NO: 144922 - protein, 10 aa, Artificial Sequence
  Description of Artificial Sequence: Synthetic peptide
  Seed: LSFYGNSISI (PRAME_HUMAN)
LLFYGNSISV

SEQ ID NO: 144923 - protein, 9 aa, Artificial Sequence
  Description of Artificial Sequence: Synthetic peptide
  Seed: YEDIHGTLH (PRAME_HUMAN)
YEDIHGTLW

SEQ ID NO: 144924 - protein, 10 aa, Artificial Sequence
  Description of Artificial Sequence: Synthetic peptide
  Seed: LSQSPSVSQL (PRAME_HUMAN)
LTQSPSVSQW

SEQ ID NO: 144925 - protein, 9 aa, Artificial Sequence
  Description of Artificial Sequence: Synthetic peptide
  Seed: WPFTCLPLG (PRAME_HUMAN)
WPFTCLPLA

SEQ ID NO: 144926 - protein, 9 aa, Artificial Sequence
  Description of Artificial Sequence: Synthetic peptide
  Seed: HVMNPLETL (PRAME_HUMAN)
HAMNPLETK

SEQ ID NO: 144927 - protein, 10 aa, Artificial Sequence
  Description of Artificial Sequence: Synthetic peptide
  Seed: LKAMVQAWPF (PRAME_HUMAN)
LRAMVQAWPW

SEQ ID NO: 144928 - protein, 10 aa, Artificial Sequence
  Description of Artificial Sequence: Synthetic peptide
  Seed: AVLDGLDVLL (PRAME_HUMAN)
AMLDGLDVLV

SEQ ID NO: 144929 - protein, 9 aa, Artificial Sequence
  Description of Artificial Sequence: Synthetic peptide
  Seed: LTDVSPEPL (PRAME_HUMAN)
LVDVSPEPL

SEQ ID NO: 144930 - protein, 10 aa, Artificial Sequence
  Description of Artificial Sequence: Synthetic peptide
  Seed: AMVQAWPFTC (PRAME_HUMAN)
AAVQAWPFTV

SEQ ID NO: 144931 - protein, 10 aa, Artificial Sequence
  Description of Artificial Sequence: Synthetic peptide
  Seed: LLSHIHASSY (PRAME_HUMAN)
LRSHIHASSW

SEQ ID NO: 144932 - protein, 10 aa, Artificial Sequence
  Description of Artificial Sequence: Synthetic peptide
  Seed: FYDPEPILCP (PRAME_HUMAN)
FYDPEPILCF

SEQ ID NO: 144933 - protein, 10 aa, Artificial Sequence
  Description of Artificial Sequence: Synthetic peptide
  Seed: TSQFLSLQCL (PRAME_HUMAN)
TIQFLSLQCY

SEQ ID NO: 144934 - protein, 9 aa, Artificial Sequence
  Description of Artificial Sequence: Synthetic peptide
  Seed: GNRASLYSF (PRAME_HUMAN)
GHRASLYSF

SEQ ID NO: 144935 - protein, 9 aa, Artificial Sequence
  Description of Artificial Sequence: Synthetic peptide
  Seed: VSQLSVLSL (PRAME_HUMAN)
VAQLSVLSM

SEQ ID NO: 144936 - protein, 9 aa, Artificial Sequence
  Description of Artificial Sequence: Synthetic peptide
  Seed: LMKGQHLHL (PRAME_HUMAN)
LYKGQHLHL

SEQ ID NO: 144937 - protein, 9 aa, Artificial Sequence
  Description of Artificial Sequence: Synthetic peptide
  Seed: LQDLVFDEC (PRAME_HUMAN)
LFDLVFDEV

SEQ ID NO: 144938 - protein, 10 aa, Artificial Sequence
  Description of Artificial Sequence: Synthetic peptide
  Seed: SISISALQSL (PRAME_HUMAN)
SKSISALQSW

SEQ ID NO: 144939 - protein, 10 aa, Artificial Sequence
  Description of Artificial Sequence: Synthetic peptide
  Seed: RLSEGDVMHL (PRAME_HUMAN)
RISEGDVMHI

SEQ ID NO: 144940 - protein, 9 aa, Artificial Sequence
  Description of Artificial Sequence: Synthetic peptide
  Seed: EPILCPCFM (PRAME_HUMAN)
EPILCPCFY

SEQ ID NO: 144941 - protein, 11 aa, Artificial Sequence
  Description of Artificial Sequence: Synthetic peptide
  Seed: LQSLLQHLIGL (PRAME_HUMAN)
LNSLLQHLIGV

SEQ ID NO: 144942 - protein, 10 aa, Artificial Sequence
  Description of Artificial Sequence: Synthetic peptide
  Seed: DVSPEPLQAL (PRAME_HUMAN)
DTSPEPLQAK

SEQ ID NO: 144943 - protein, 11 aa, Artificial Sequence
  Description of Artificial Sequence: Synthetic peptide
  Seed: YISPEKEEQYI (PRAME_HUMAN)
YQSPEKEEQYI

SEQ ID NO: 144944 - protein, 10 aa, Artificial Sequence
  Description of Artificial Sequence: Synthetic peptide
  Seed: ISISALQSLL (PRAME_HUMAN)
ILISALQSLV

SEQ ID NO: 144945 - protein, 9 aa, Artificial Sequence
  Description of Artificial Sequence: Synthetic peptide
  Seed: RWKLQVLDL (PRAME_HUMAN)
RYKLQVLDI

SEQ ID NO: 144946 - protein, 9 aa, Artificial Sequence
  Description of Artificial Sequence: Synthetic peptide
  Seed: YIAQFTSQF (PRAME_HUMAN)
YLAQFTSQI

SEQ ID NO: 144947 - protein, 9 aa, Artificial Sequence
  Description of Artificial Sequence: Synthetic peptide
  Seed: SALQSLLQH (PRAME_HUMAN)
STLQSLLQM

SEQ ID NO: 144948 - protein, 9 aa, Artificial Sequence
  Description of Artificial Sequence: Synthetic peptide
  Seed: LTDVSPEPL (PRAME_HUMAN)
LWDVSPEPL

SEQ ID NO: 144949 - protein, 9 aa, Artificial Sequence
  Description of Artificial Sequence: Synthetic peptide
  Seed: KVDGLSTEA (PRAME_HUMAN)
KQDGLSTEI

SEQ ID NO: 144950 - protein, 10 aa, Artificial Sequence
  Description of Artificial Sequence: Synthetic peptide
  Seed: MSVWTSPRRL (PRAME_HUMAN)
MGVWTSPRRW

SEQ ID NO: 144951 - protein, 8 aa, Artificial Sequence
  Description of Artificial Sequence: Synthetic peptide
  Seed: VLMKGQHL (PRAME_HUMAN)
VQMKGQHL

SEQ ID NO: 144952 - protein, 9 aa, Artificial Sequence
  Description of Artificial Sequence: Synthetic peptide
  Seed: IAQFTSQFL (PRAME_HUMAN)
IMQFTSQFL

SEQ ID NO: 144953 - protein, 9 aa, Artificial Sequence
  Description of Artificial Sequence: Synthetic peptide
  Seed: YIAQFTSQF (PRAME_HUMAN)
YYAQFTSQF

SEQ ID NO: 144954 - protein, 9 aa, Artificial Sequence
  Description of Artificial Sequence: Synthetic peptide
  Seed: YVDSLFFLR (PRAME_HUMAN)
YADSLFFLR

SEQ ID NO: 144955 - protein, 9 aa, Artificial Sequence
  Description of Artificial Sequence: Synthetic peptide
  Seed: SFYGNSISI (PRAME_HUMAN)
SSYGNSISF

SEQ ID NO: 144956 - protein, 10 aa, Artificial Sequence
  Description of Artificial Sequence: Synthetic peptide
  Seed: YIAQFTSQFL (PRAME_HUMAN)
YWAQFTSQFF

SEQ ID NO: 144957 - protein, 9 aa, Artificial Sequence
  Description of Artificial Sequence: Synthetic peptide
  Seed: SISALQSLL (PRAME_HUMAN)
SLSALQSLF

SEQ ID NO: 144958 - protein, 10 aa, Artificial Sequence
  Description of Artificial Sequence: Synthetic peptide
  Seed: IQSRYISMSV (PRAME_HUMAN)
IHSRYISMSF

SEQ ID NO: 144959 - protein, 9 aa, Artificial Sequence
  Description of Artificial Sequence: Synthetic peptide
  Seed: ITDDQLLAL (PRAME_HUMAN)
ITDDQLLAI

SEQ ID NO: 144960 - protein, 10 aa, Artificial Sequence
  Description of Artificial Sequence: Synthetic peptide
  Seed: IGLSNLTHVL (PRAME_HUMAN)
ILLSNLTHVV

SEQ ID NO: 144961 - protein, 9 aa, Artificial Sequence
  Description of Artificial Sequence: Synthetic peptide
  Seed: YPVPLESYE (PRAME_HUMAN)
YSVPLESYY

SEQ ID NO: 144962 - protein, 10 aa, Artificial Sequence
  Description of Artificial Sequence: Synthetic peptide
  Seed: RRLWGSIQSR (PRAME_HUMAN)
RFLWGSIQSR

SEQ ID NO: 144963 - protein, 9 aa, Artificial Sequence
  Description of Artificial Sequence: Synthetic peptide
  Seed: AFDGRHSQT (PRAME_HUMAN)
AYDGRHSQF

SEQ ID NO: 144964 - protein, 9 aa, Artificial Sequence
  Description of Artificial Sequence: Synthetic peptide
  Seed: VLDGLDVLL (PRAME_HUMAN)
VYDGLDVLY

SEQ ID NO: 144965 - protein, 10 aa, Artificial Sequence
  Description of Artificial Sequence: Synthetic peptide
  Seed: SGNRASLYSF (PRAME_HUMAN)
STNRASLYSF

SEQ ID NO: 144966 - protein, 9 aa, Artificial Sequence
  Description of Artificial Sequence: Synthetic peptide
  Seed: KMILKMVQL (PRAME_HUMAN)
KSILKMVQM

SEQ ID NO: 144967 - protein, 9 aa, Artificial Sequence
  Description of Artificial Sequence: Synthetic peptide
  Seed: GNRASLYSF (PRAME_HUMAN)
GIRASLYSY

SEQ ID NO: 144968 - protein, 10 aa, Artificial Sequence
  Description of Artificial Sequence: Synthetic peptide
  Seed: LLSHIHASSY (PRAME_HUMAN)
LWSHIHASSF

SEQ ID NO: 144969 - protein, 9 aa, Artificial Sequence
  Description of Artificial Sequence: Synthetic peptide
  Seed: FPPLFMAAF (PRAME_HUMAN)
FSPLFMAAL

SEQ ID NO: 144970 - protein, 10 aa, Artificial Sequence
  Description of Artificial Sequence: Synthetic peptide
  Seed: FIPVEVLVDL (PRAME_HUMAN)
FQPVEVLVDW

SEQ ID NO: 144971 - protein, 11 aa, Artificial Sequence
  Description of Artificial Sequence: Synthetic peptide
  Seed: MKGQHLHLETF (PRAME_HUMAN)
MDGQHLHLETF

SEQ ID NO: 144972 - protein, 11 aa, Artificial Sequence
  Description of Artificial Sequence: Synthetic peptide
  Seed: ALYVDSLFFLR (PRAME_HUMAN)
AMYVDSLFFLG

SEQ ID NO: 144973 - protein, 10 aa, Artificial Sequence
  Description of Artificial Sequence: Synthetic peptide
  Seed: SPSVSQLSVL (PRAME_HUMAN)
SPSVSQLSVW

SEQ ID NO: 144974 - protein, 9 aa, Artificial Sequence
  Description of Artificial Sequence: Synthetic peptide
  Seed: SHIHASSYI (PRAME_HUMAN)
SYIHASSYY

SEQ ID NO: 144975 - protein, 9 aa, Artificial Sequence
  Description of Artificial Sequence: Synthetic peptide
  Seed: YSFPEPEAA (PRAME_HUMAN)
YCFPEPEAL

SEQ ID NO: 144976 - protein, 9 aa, Artificial Sequence
  Description of Artificial Sequence: Synthetic peptide
  Seed: YLHARLREL (PRAME_HUMAN)
YPHARLREA

SEQ ID NO: 144977 - protein, 9 aa, Artificial Sequence
  Description of Artificial Sequence: Synthetic peptide
  Seed: SIEDLEVTC (PRAME_HUMAN)
STEDLEVTF

SEQ ID NO: 144978 - protein, 11 aa, Artificial Sequence
  Description of Artificial Sequence: Synthetic peptide
  Seed: IAQFTSQFLSL (PRAME_HUMAN)
IQQFTSQFLSY

SEQ ID NO: 144979 - protein, 11 aa, Artificial Sequence
  Description of Artificial Sequence: Synthetic peptide
  Seed: LLAQEVRPRRW (PRAME_HUMAN)
LSAQEVRPRRW

SEQ ID NO: 144980 - protein, 9 aa, Artificial Sequence
  Description of Artificial Sequence: Synthetic peptide
  Seed: VELAGQSLL (PRAME_HUMAN)
VELAGQSLW

SEQ ID NO: 144981 - protein, 9 aa, Artificial Sequence
  Description of Artificial Sequence: Synthetic peptide
  Seed: VLMKGQHLH (PRAME_HUMAN)
VTMKGQHLF

SEQ ID NO: 144982 - protein, 10 aa, Artificial Sequence
  Description of Artificial Sequence: Synthetic peptide
  Seed: RASATLQDLV (PRAME_HUMAN)
RTSATLQDLW

SEQ ID NO: 144983 - protein, 10 aa, Artificial Sequence
  Description of Artificial Sequence: Synthetic peptide
  Seed: LQALYVDSLF (PRAME_HUMAN)
LSALYVDSLM

SEQ ID NO: 144984 - protein, 11 aa, Artificial Sequence
  Description of Artificial Sequence: Synthetic peptide
  Seed: VQLDSIEDLEV (PRAME_HUMAN)
VMLDSIEDLEV

SEQ ID NO: 144985 - protein, 10 aa, Artificial Sequence
  Description of Artificial Sequence: Synthetic peptide
  Seed: CTWKLPTLAK (PRAME_HUMAN)
CSWKLPTLAK

SEQ ID NO: 144986 - protein, 9 aa, Artificial Sequence
  Description of Artificial Sequence: Synthetic peptide
  Seed: FSPYLGQMI (PRAME_HUMAN)
FLPYLGQMV

SEQ ID NO: 144987 - protein, 10 aa, Artificial Sequence
  Description of Artificial Sequence: Synthetic peptide
  Seed: IGLSNLTHVL (PRAME_HUMAN)
IDLSNLTHVV

SEQ ID NO: 144988 - protein, 10 aa, Artificial Sequence
  Description of Artificial Sequence: Synthetic peptide
  Seed: KGQHLHLETF (PRAME_HUMAN)
KGQHLHLETY

SEQ ID NO: 144989 - protein, 11 aa, Artificial Sequence
  Description of Artificial Sequence: Synthetic peptide
  Seed: LLAQEVRPRRW (PRAME_HUMAN)
LTAQEVRPRRW

SEQ ID NO: 144990 - protein, 10 aa, Artificial Sequence
  Description of Artificial Sequence: Synthetic peptide
  Seed: AFDGRHSQTL (PRAME_HUMAN)
AADGRHSQTI

SEQ ID NO: 144991 - protein, 9 aa, Artificial Sequence
  Description of Artificial Sequence: Synthetic peptide
  Seed: RLRELLCEL (PRAME_HUMAN)
RLRELLCEM

SEQ ID NO: 144992 - protein, 9 aa, Artificial Sequence
  Description of Artificial Sequence: Synthetic peptide
  Seed: TSPRRLVEL (PRAME_HUMAN)
TTPRRLVEM

SEQ ID NO: 144993 - protein, 10 aa, Artificial Sequence
  Description of Artificial Sequence: Synthetic peptide
  Seed: SNLTHVLYPV (PRAME_HUMAN)
SKLTHVLYPL

SEQ ID NO: 144994 - protein, 9 aa, Artificial Sequence
  Description of Artificial Sequence: Synthetic peptide
  Seed: RRWKLQVLD (PRAME_HUMAN)
RQWKLQVLI

SEQ ID NO: 144995 - protein, 9 aa, Artificial Sequence
  Description of Artificial Sequence: Synthetic peptide
  Seed: GQHLHLETF (PRAME_HUMAN)
GKHLHLETM

SEQ ID NO: 144996 - protein, 9 aa, Artificial Sequence
  Description of Artificial Sequence: Synthetic peptide
  Seed: QLLALLPSL (PRAME_HUMAN)
QQLALLPSY

SEQ ID NO: 144997 - protein, 9 aa, Artificial Sequence
  Description of Artificial Sequence: Synthetic peptide
  Seed: GLSNLTHVL (PRAME_HUMAN)
GISNLTHVY

SEQ ID NO: 144998 - protein, 10 aa, Artificial Sequence
  Description of Artificial Sequence: Synthetic peptide
  Seed: RLSEGDVMHL (PRAME_HUMAN)
RVSEGDVMHR

SEQ ID NO: 144999 - protein, 10 aa, Artificial Sequence
  Description of Artificial Sequence: Synthetic peptide
  Seed: RYISMSVWTS (PRAME_HUMAN)
RVISMSVWTF

SEQ ID NO: 145000 - protein, 10 aa, Artificial Sequence
  Description of Artificial Sequence: Synthetic peptide
  Seed: ETFKAVLDGL (PRAME_HUMAN)
ESFKAVLDGV

SEQ ID NO: 145001 - protein, 11 aa, Artificial Sequence
  Description of Artificial Sequence: Synthetic peptide
  Seed: RRLLLSHIHAS (PRAME_HUMAN)
RRLLLSHIHAM

SEQ ID NO: 145002 - protein, 9 aa, Artificial Sequence
  Description of Artificial Sequence: Synthetic peptide
  Seed: MVQAWPFTC (PRAME_HUMAN)
MVQAWPFTL

SEQ ID NO: 145003 - protein, 9 aa, Artificial Sequence
  Description of Artificial Sequence: Synthetic peptide
  Seed: GNRASLYSF (PRAME_HUMAN)
GQRASLYSL

SEQ ID NO: 145004 - protein, 9 aa, Artificial Sequence
  Description of Artificial Sequence: Synthetic peptide
  Seed: RELFPPLFM (PRAME_HUMAN)
RHLFPPLFF

SEQ ID NO: 145005 - protein, 9 aa, Artificial Sequence
  Description of Artificial Sequence: Synthetic peptide
  Seed: RLRELLCEL (PRAME_HUMAN)
RQRELLCEV

SEQ ID NO: 145006 - protein, 11 aa, Artificial Sequence
  Description of Artificial Sequence: Synthetic peptide
  Seed: LPTLAKFSPYL (PRAME_HUMAN)
LPTLAKFSPYI

SEQ ID NO: 145007 - protein, 9 aa, Artificial Sequence
  Description of Artificial Sequence: Synthetic peptide
  Seed: LFMAAFDGR (PRAME_HUMAN)
LVMAAFDGK

SEQ ID NO: 145008 - protein, 9 aa, Artificial Sequence
  Description of Artificial Sequence: Synthetic peptide
  Seed: QMINLRRLL (PRAME_HUMAN)
QKINLRRLY

SEQ ID NO: 145009 - protein, 11 aa, Artificial Sequence
  Description of Artificial Sequence: Synthetic peptide
  Seed: ALYVDSLFFLR (PRAME_HUMAN)
ATYVDSLFFLK

SEQ ID NO: 145010 - protein, 9 aa, Artificial Sequence
  Description of Artificial Sequence: Synthetic peptide
  Seed: EPLQALLER (PRAME_HUMAN)
EALQALLER

SEQ ID NO: 145011 - protein, 9 aa, Artificial Sequence
  Description of Artificial Sequence: Synthetic peptide
  Seed: YIAQFTSQF (PRAME_HUMAN)
YMAQFTSQK

SEQ ID NO: 145012 - protein, 10 aa, Artificial Sequence
  Description of Artificial Sequence: Synthetic peptide
  Seed: RELFPPLFMA (PRAME_HUMAN)
RDLFPPLFMI

SEQ ID NO: 145013 - protein, 9 aa, Artificial Sequence
  Description of Artificial Sequence: Synthetic peptide
  Seed: LAIAALELL (PRAME_HUMAN)
LPIAALELF

SEQ ID NO: 145014 - protein, 9 aa, Artificial Sequence
  Description of Artificial Sequence: Synthetic peptide
  Seed: GQHLHLETF (PRAME_HUMAN)
GRHLHLETL

SEQ ID NO: 145015 - protein, 9 aa, Artificial Sequence
  Description of Artificial Sequence: Synthetic peptide
  Seed: VSQLSVLSL (PRAME_HUMAN)
VLQLSVLSV

SEQ ID NO: 145016 - protein, 10 aa, Artificial Sequence
  Description of Artificial Sequence: Synthetic peptide
  Seed: AMPMQDIKMI (PRAME_HUMAN)
AMPMQDIKMV

SEQ ID NO: 145017 - protein, 9 aa, Artificial Sequence
  Description of Artificial Sequence: Synthetic peptide
  Seed: FTCLPLGVL (PRAME_HUMAN)
FACLPLGVL

SEQ ID NO: 145018 - protein, 9 aa, Artificial Sequence
  Description of Artificial Sequence: Synthetic peptide
  Seed: VSQLSVLSL (PRAME_HUMAN)
VSQLSVLSV

SEQ ID NO: 145019 - protein, 10 aa, Artificial Sequence
  Description of Artificial Sequence: Synthetic peptide
  Seed: SNLTHVLYPV (PRAME_HUMAN)
SFLTHVLYPI

SEQ ID NO: 145020 - protein, 11 aa, Artificial Sequence
  Description of Artificial Sequence: Synthetic peptide
  Seed: AEQPFIPVEVL (PRAME_HUMAN)
AEQPFIPVEVF

SEQ ID NO: 145021 - protein, 9 aa, Artificial Sequence
  Description of Artificial Sequence: Synthetic peptide
  Seed: AWPFTCLPL (PRAME_HUMAN)
AAPFTCLPI

SEQ ID NO: 145022 - protein, 10 aa, Artificial Sequence
  Description of Artificial Sequence: Synthetic peptide
  Seed: LLPRELFPPL (PRAME_HUMAN)
LTPRELFPPL

SEQ ID NO: 145023 - protein, 11 aa, Artificial Sequence
  Description of Artificial Sequence: Synthetic peptide
  Seed: ISALQSLLQHL (PRAME_HUMAN)
ILALQSLLQHV

SEQ ID NO: 145024 - protein, 9 aa, Artificial Sequence
  Description of Artificial Sequence: Synthetic peptide
  Seed: FLRGRLDQL (PRAME_HUMAN)
FSRGRLDQV

SEQ ID NO: 145025 - protein, 9 aa, Artificial Sequence
  Description of Artificial Sequence: Synthetic peptide
  Seed: MVQAWPFTC (PRAME_HUMAN)
MQQAWPFTF

SEQ ID NO: 145026 - protein, 10 aa, Artificial Sequence
  Description of Artificial Sequence: Synthetic peptide
  Seed: EDLEVTCTWK (PRAME_HUMAN)
ESLEVTCTWK

SEQ ID NO: 145027 - protein, 10 aa, Artificial Sequence
  Description of Artificial Sequence: Synthetic peptide
  Seed: FLRGRLDQLL (PRAME_HUMAN)
FMRGRLDQLI

SEQ ID NO: 145028 - protein, 10 aa, Artificial Sequence
  Description of Artificial Sequence: Synthetic peptide
  Seed: LLLSHIHASS (PRAME_HUMAN)
LMLSHIHASV

SEQ ID NO: 145029 - protein, 11 aa, Artificial Sequence
  Description of Artificial Sequence: Synthetic peptide
  Seed: RLWGSIQSRYI (PRAME_HUMAN)
RMWGSIQSRYL

SEQ ID NO: 145030 - protein, 10 aa, Artificial Sequence
  Description of Artificial Sequence: Synthetic peptide
  Seed: SPYLGQMINL (PRAME_HUMAN)
SCYLGQMINF

SEQ ID NO: 145031 - protein, 9 aa, Artificial Sequence
  Description of Artificial Sequence: Synthetic peptide
  Seed: IPVEVLVDL (PRAME_HUMAN)
IPVEVLVDY

SEQ ID NO: 145032 - protein, 10 aa, Artificial Sequence
  Description of Artificial Sequence: Synthetic peptide
  Seed: ESYEDIHGTL (PRAME_HUMAN)
ELYEDIHGTK

SEQ ID NO: 145033 - protein, 10 aa, Artificial Sequence
  Description of Artificial Sequence: Synthetic peptide
  Seed: ALLERASATL (PRAME_HUMAN)
AQLERASATI

SEQ ID NO: 145034 - protein, 9 aa, Artificial Sequence
  Description of Artificial Sequence: Synthetic peptide
  Seed: RLRELLCEL (PRAME_HUMAN)
RQRELLCEH

SEQ ID NO: 145035 - protein, 9 aa, Artificial Sequence
  Description of Artificial Sequence: Synthetic peptide
  Seed: VSPEPLQAL (PRAME_HUMAN)
VCPEPLQAF

SEQ ID NO: 145036 - protein, 9 aa, Artificial Sequence
  Description of Artificial Sequence: Synthetic peptide
  Seed: GNRASLYSF (PRAME_HUMAN)
GVRASLYSY

SEQ ID NO: 145037 - protein, 10 aa, Artificial Sequence
  Description of Artificial Sequence: Synthetic peptide
  Seed: RELFPPLFMA (PRAME_HUMAN)
RALFPPLFML

SEQ ID NO: 145038 - protein, 9 aa, Artificial Sequence
  Description of Artificial Sequence: Synthetic peptide
  Seed: SALQSLLQH (PRAME_HUMAN)
SVLQSLLQY

SEQ ID NO: 145039 - protein, 9 aa, Artificial Sequence
  Description of Artificial Sequence: Synthetic peptide
  Seed: QALYVDSLF (PRAME_HUMAN)
QPLYVDSLY

SEQ ID NO: 145040 - protein, 9 aa, Artificial Sequence
  Description of Artificial Sequence: Synthetic peptide
  Seed: ACDELFSYL (PRAME_HUMAN)
AVDELFSYM

SEQ ID NO: 145041 - protein, 9 aa, Artificial Sequence
  Description of Artificial Sequence: Synthetic peptide
  Seed: LSHIHASSY (PRAME_HUMAN)
LSHIHASSM

SEQ ID NO: 145042 - protein, 10 aa, Artificial Sequence
  Description of Artificial Sequence: Synthetic peptide
  Seed: RRLWGSIQSR (PRAME_HUMAN)
RPLWGSIQSK

SEQ ID NO: 145043 - protein, 10 aa, Artificial Sequence
  Description of Artificial Sequence: Synthetic peptide
  Seed: SPSVSQLSVL (PRAME_HUMAN)
SMSVSQLSVF

SEQ ID NO: 145044 - protein, 10 aa, Artificial Sequence
  Description of Artificial Sequence: Synthetic peptide
  Seed: VLYPVPLESY (PRAME_HUMAN)
VMYPVPLESW

SEQ ID NO: 145045 - protein, 9 aa, Artificial Sequence
  Description of Artificial Sequence: Synthetic peptide
  Seed: VFDECGITD (PRAME_HUMAN)
VMDECGITF

SEQ ID NO: 145046 - protein, 10 aa, Artificial Sequence
  Description of Artificial Sequence: Synthetic peptide
  Seed: LPTLAKFSPY (PRAME_HUMAN)
LPTLAKFSPL

SEQ ID NO: 145047 - protein, 9 aa, Artificial Sequence
  Description of Artificial Sequence: Synthetic peptide
  Seed: NLTHVLYPV (PRAME_HUMAN)
NQTHVLYPA

SEQ ID NO: 145048 - protein, 9 aa, Artificial Sequence
  Description of Artificial Sequence: Synthetic peptide
  Seed: KLKIFAMPM (PRAME_HUMAN)
KSKIFAMPL

SEQ ID NO: 145049 - protein, 10 aa, Artificial Sequence
  Description of Artificial Sequence: Synthetic peptide
  Seed: KFSPYLGQMI (PRAME_HUMAN)
KFSPYLGQMW

SEQ ID NO: 145050 - protein, 9 aa, Artificial Sequence
  Description of Artificial Sequence: Synthetic peptide
  Seed: SFYGNSISI (PRAME_HUMAN)
SNYGNSISV

SEQ ID NO: 145051 - protein, 9 aa, Artificial Sequence
  Description of Artificial Sequence: Synthetic peptide
  Seed: YVDSLFFLR (PRAME_HUMAN)
YADSLFFLM

SEQ ID NO: 145052 - protein, 9 aa, Artificial Sequence
  Description of Artificial Sequence: Synthetic peptide
  Seed: LSEGDVMHL (PRAME_HUMAN)
LAEGDVMHY

SEQ ID NO: 145053 - protein, 9 aa, Artificial Sequence
  Description of Artificial Sequence: Synthetic peptide
  Seed: CSQLTTLSF (PRAME_HUMAN)
CVQLTTLSY

SEQ ID NO: 145054 - protein, 10 aa, Artificial Sequence
  Description of Artificial Sequence: Synthetic peptide
  Seed: LLPRELFPPL (PRAME_HUMAN)
LCPRELFPPV

SEQ ID NO: 145055 - protein, 11 aa, Artificial Sequence
  Description of Artificial Sequence: Synthetic peptide
  Seed: LLLSHIHASSY (PRAME_HUMAN)
LSLSHIHASSF

SEQ ID NO: 145056 - protein, 10 aa, Artificial Sequence
  Description of Artificial Sequence: Synthetic peptide
  Seed: RLVELAGQSL (PRAME_HUMAN)
RAVELAGQSY

SEQ ID NO: 145057 - protein, 9 aa, Artificial Sequence
  Description of Artificial Sequence: Synthetic peptide
  Seed: AAQPMTKKR (PRAME_HUMAN)
ATQPMTKKR

SEQ ID NO: 145058 - protein, 9 aa, Artificial Sequence
  Description of Artificial Sequence: Synthetic peptide
  Seed: VFDECGITD (PRAME_HUMAN)
VYDECGITF

SEQ ID NO: 145059 - protein, 10 aa, Artificial Sequence
  Description of Artificial Sequence: Synthetic peptide
  Seed: RRLWGSIQSR (PRAME_HUMAN)
RLLWGSIQSR

SEQ ID NO: 145060 - protein, 8 aa, Artificial Sequence
  Description of Artificial Sequence: Synthetic peptide
  Seed: SQLTTLSF (PRAME_HUMAN)
SQLTTLSV

SEQ ID NO: 145061 - protein, 10 aa, Artificial Sequence
  Description of Artificial Sequence: Synthetic peptide
  Seed: KGQHLHLETF (PRAME_HUMAN)
KSQHLHLETY

SEQ ID NO: 145062 - protein, 10 aa, Artificial Sequence
  Description of Artificial Sequence: Synthetic peptide
  Seed: IQSRYISMSV (PRAME_HUMAN)
IISRYISMSV

SEQ ID NO: 145063 - protein, 9 aa, Artificial Sequence
  Description of Artificial Sequence: Synthetic peptide
  Seed: ACDELFSYL (PRAME_HUMAN)
AIDELFSYF

SEQ ID NO: 145064 - protein, 9 aa, Artificial Sequence
  Description of Artificial Sequence: Synthetic peptide
  Seed: AAFDGRHSQ (PRAME_HUMAN)
ALFDGRHSF

SEQ ID NO: 145065 - protein, 10 aa, Artificial Sequence
  Description of Artificial Sequence: Synthetic peptide
  Seed: FAMPMQDIKM (PRAME_HUMAN)
FQMPMQDIKV

SEQ ID NO: 145066 - protein, 10 aa, Artificial Sequence
  Description of Artificial Sequence: Synthetic peptide
  Seed: RLVELAGQSL (PRAME_HUMAN)
RLVELAGQSI

SEQ ID NO: 145067 - protein, 10 aa, Artificial Sequence
  Description of Artificial Sequence: Synthetic peptide
  Seed: RLSEGDVMHL (PRAME_HUMAN)
RRSEGDVMHF

SEQ ID NO: 145068 - protein, 9 aa, Artificial Sequence
  Description of Artificial Sequence: Synthetic peptide
  Seed: ALYVDSLFF (PRAME_HUMAN)
AKYVDSLFF

SEQ ID NO: 145069 - protein, 10 aa, Artificial Sequence
  Description of Artificial Sequence: Synthetic peptide
  Seed: IQSRYISMSV (PRAME_HUMAN)
ITSRYISMSK

SEQ ID NO: 145070 - protein, 10 aa, Artificial Sequence
  Description of Artificial Sequence: Synthetic peptide
  Seed: RYISMSVWTS (PRAME_HUMAN)
RWISMSVWTL

SEQ ID NO: 145071 - protein, 9 aa, Artificial Sequence
  Description of Artificial Sequence: Synthetic peptide
  Seed: LQSLLQHLI (PRAME_HUMAN)
LMSLLQHLY

SEQ ID NO: 145072 - protein, 10 aa, Artificial Sequence
  Description of Artificial Sequence: Synthetic peptide
  Seed: QSLLQHLIGL (PRAME_HUMAN)
QVLLQHLIGV

SEQ ID NO: 145073 - protein, 9 aa, Artificial Sequence
  Description of Artificial Sequence: Synthetic peptide
  Seed: EQPFIPVEV (PRAME_HUMAN)
EVPFIPVEI

SEQ ID NO: 145074 - protein, 10 aa, Artificial Sequence
  Description of Artificial Sequence: Synthetic peptide
  Seed: ISISALQSLL (PRAME_HUMAN)
ITISALQSLM

SEQ ID NO: 145075 - protein, 10 aa, Artificial Sequence
  Description of Artificial Sequence: Synthetic peptide
  Seed: RGRLDQLLRH (PRAME_HUMAN)
RGRLDQLLRK

SEQ ID NO: 145076 - protein, 10 aa, Artificial Sequence
  Description of Artificial Sequence: Synthetic peptide
  Seed: LLSHIHASSY (PRAME_HUMAN)
LCSHIHASSW

SEQ ID NO: 145077 - protein, 9 aa, Artificial Sequence
  Description of Artificial Sequence: Synthetic peptide
  Seed: IGLSNLTHV (PRAME_HUMAN)
IQLSNLTHA

SEQ ID NO: 145078 - protein, 10 aa, Artificial Sequence
  Description of Artificial Sequence: Synthetic peptide
  Seed: AVLDGLDVLL (PRAME_HUMAN)
AQLDGLDVLV

SEQ ID NO: 145079 - protein, 8 aa, Artificial Sequence
  Description of Artificial Sequence: Synthetic peptide
  Seed: HLERLAYL (PRAME_HUMAN)
HLERLAYV

SEQ ID NO: 145080 - protein, 10 aa, Artificial Sequence
  Description of Artificial Sequence: Synthetic peptide
  Seed: QAWPFTCLPL (PRAME_HUMAN)
QQWPFTCLPL

SEQ ID NO: 145081 - protein, 9 aa, Artificial Sequence
  Description of Artificial Sequence: Synthetic peptide
  Seed: SFYGNSISI (PRAME_HUMAN)
SIYGNSISL

SEQ ID NO: 145082 - protein, 9 aa, Artificial Sequence
  Description of Artificial Sequence: Synthetic peptide
  Seed: ALLERASAT (PRAME_HUMAN)
AQLERASAV

SEQ ID NO: 145083 - protein, 9 aa, Artificial Sequence
  Description of Artificial Sequence: Synthetic peptide
  Seed: VLMKGQHLH (PRAME_HUMAN)
VNMKGQHLY

SEQ ID NO: 145084 - protein, 9 aa, Artificial Sequence
  Description of Artificial Sequence: Synthetic peptide
  Seed: YSFPEPEAA (PRAME_HUMAN)
YFFPEPEAL

SEQ ID NO: 145085 - protein, 9 aa, Artificial Sequence
  Description of Artificial Sequence: Synthetic peptide
  Seed: LLKDEALAI (PRAME_HUMAN)
LLKDEALAV

SEQ ID NO: 145086 - protein, 10 aa, Artificial Sequence
  Description of Artificial Sequence: Synthetic peptide
  Seed: SNLTHVLYPV (PRAME_HUMAN)
SALTHVLYPI

SEQ ID NO: 145087 - protein, 10 aa, Artificial Sequence
  Description of Artificial Sequence: Synthetic peptide
  Seed: YIAQFTSQFL (PRAME_HUMAN)
YTAQFTSQFA

SEQ ID NO: 145088 - protein, 10 aa, Artificial Sequence
  Description of Artificial Sequence: Synthetic peptide
  Seed: RYISMSVWTS (PRAME_HUMAN)
RWISMSVWTW

SEQ ID NO: 145089 - protein, 11 aa, Artificial Sequence
  Description of Artificial Sequence: Synthetic peptide
  Seed: RTFYDPEPILC (PRAME_HUMAN)
RSFYDPEPILF

SEQ ID NO: 145090 - protein, 10 aa, Artificial Sequence
  Description of Artificial Sequence: Synthetic peptide
  Seed: DELFSYLIEK (PRAME_HUMAN)
DILFSYLIEK

SEQ ID NO: 145091 - protein, 9 aa, Artificial Sequence
  Description of Artificial Sequence: Synthetic peptide
  Seed: HVMNPLETL (PRAME_HUMAN)
HEMNPLETY

SEQ ID NO: 145092 - protein, 9 aa, Artificial Sequence
  Description of Artificial Sequence: Synthetic peptide
  Seed: IGLSNLTHV (PRAME_HUMAN)
IVLSNLTHI

SEQ ID NO: 145093 - protein, 9 aa, Artificial Sequence
  Description of Artificial Sequence: Synthetic peptide
  Seed: GQHLHLETF (PRAME_HUMAN)
GHHLHLETI

SEQ ID NO: 145094 - protein, 10 aa, Artificial Sequence
  Description of Artificial Sequence: Synthetic peptide
  Seed: SLLQHLIGLS (PRAME_HUMAN)
SQLQHLIGLI

SEQ ID NO: 145095 - protein, 10 aa, Artificial Sequence
  Description of Artificial Sequence: Synthetic peptide
  Seed: RTFYDPEPIL (PRAME_HUMAN)
RTFYDPEPIW

SEQ ID NO: 145096 - protein, 10 aa, Artificial Sequence
  Description of Artificial Sequence: Synthetic peptide
  Seed: YIAQFTSQFL (PRAME_HUMAN)
YGAQFTSQFY

SEQ ID NO: 145097 - protein, 9 aa, Artificial Sequence
  Description of Artificial Sequence: Synthetic peptide
  Seed: TDDQLLALL (PRAME_HUMAN)
TTDQLLALM

SEQ ID NO: 145098 - protein, 9 aa, Artificial Sequence
  Description of Artificial Sequence: Synthetic peptide
  Seed: SQFLSLQCL (PRAME_HUMAN)
SIFLSLQCF

SEQ ID NO: 145099 - protein, 9 aa, Artificial Sequence
  Description of Artificial Sequence: Synthetic peptide
  Seed: SFYGNSISI (PRAME_HUMAN)
SSYGNSISM

SEQ ID NO: 145100 - protein, 9 aa, Artificial Sequence
  Description of Artificial Sequence: Synthetic peptide
  Seed: YSFPEPEAA (PRAME_HUMAN)
YAFPEPEAI

SEQ ID NO: 145101 - protein, 9 aa, Artificial Sequence
  Description of Artificial Sequence: Synthetic peptide
  Seed: RHSQTLKAM (PRAME_HUMAN)
RFSQTLKAY

SEQ ID NO: 145102 - protein, 10 aa, Artificial Sequence
  Description of Artificial Sequence: Synthetic peptide
  Seed: RHVMNPLETL (PRAME_HUMAN)
RDVMNPLETW

SEQ ID NO: 145103 - protein, 10 aa, Artificial Sequence
  Description of Artificial Sequence: Synthetic peptide
  Seed: MSVWTSPRRL (PRAME_HUMAN)
MAVWTSPRRW

SEQ ID NO: 145104 - protein, 10 aa, Artificial Sequence
  Description of Artificial Sequence: Synthetic peptide
  Seed: RGRLDQLLRH (PRAME_HUMAN)
RCRLDQLLRK

SEQ ID NO: 145105 - protein, 9 aa, Artificial Sequence
  Description of Artificial Sequence: Synthetic peptide
  Seed: RWKLQVLDL (PRAME_HUMAN)
RIKLQVLDK

SEQ ID NO: 145106 - protein, 9 aa, Artificial Sequence
  Description of Artificial Sequence: Synthetic peptide
  Seed: SLLQHLIGL (PRAME_HUMAN)
SPLQHLIGY

SEQ ID NO: 145107 - protein, 10 aa, Artificial Sequence
  Description of Artificial Sequence: Synthetic peptide
  Seed: DQLLALLPSL (PRAME_HUMAN)
DMLLALLPSL

SEQ ID NO: 145108 - protein, 10 aa, Artificial Sequence
  Description of Artificial Sequence: Synthetic peptide
  Seed: SPYLGQMINL (PRAME_HUMAN)
SSYLGQMINL

SEQ ID NO: 145109 - protein, 8 aa, Artificial Sequence
  Description of Artificial Sequence: Synthetic peptide
  Seed: VLDGLDVL (PRAME_HUMAN)
VTDGLDVL

SEQ ID NO: 145110 - protein, 9 aa, Artificial Sequence
  Description of Artificial Sequence: Synthetic peptide
  Seed: TDDQLLALL (PRAME_HUMAN)
TVDQLLALM

SEQ ID NO: 145111 - protein, 10 aa, Artificial Sequence
  Description of Artificial Sequence: Synthetic peptide
  Seed: VLYPVPLESY (PRAME_HUMAN)
VSYPVPLESI

SEQ ID NO: 145112 - protein, 10 aa, Artificial Sequence
  Description of Artificial Sequence: Synthetic peptide
  Seed: AIAALELLPR (PRAME_HUMAN)
AQAALELLPK

SEQ ID NO: 145113 - protein, 10 aa, Artificial Sequence
  Description of Artificial Sequence: Synthetic peptide
  Seed: LERLAYLHAR (PRAME_HUMAN)
LERLAYLHAK

SEQ ID NO: 145114 - protein, 9 aa, Artificial Sequence
  Description of Artificial Sequence: Synthetic peptide
  Seed: LSNLTHVLY (PRAME_HUMAN)
LMNLTHVLL

SEQ ID NO: 145115 - protein, 9 aa, Artificial Sequence
  Description of Artificial Sequence: Synthetic peptide
  Seed: SFYGNSISI (PRAME_HUMAN)
SHYGNSISY

SEQ ID NO: 145116 - protein, 10 aa, Artificial Sequence
  Description of Artificial Sequence: Synthetic peptide
  Seed: DELFSYLIEK (PRAME_HUMAN)
DTLFSYLIEK

SEQ ID NO: 145117 - protein, 8 aa, Artificial Sequence
  Description of Artificial Sequence: Synthetic peptide
  Seed: LTHVLYPV (PRAME_HUMAN)
LWHVLYPV

SEQ ID NO: 145118 - protein, 11 aa, Artificial Sequence
  Description of Artificial Sequence: Synthetic peptide
  Seed: LLLSHIHASSY (PRAME_HUMAN)
LLLSHIHASSW

SEQ ID NO: 145119 - protein, 10 aa, Artificial Sequence
  Description of Artificial Sequence: Synthetic peptide
  Seed: RLVELAGQSL (PRAME_HUMAN)
RLVELAGQSF

SEQ ID NO: 145120 - protein, 9 aa, Artificial Sequence
  Description of Artificial Sequence: Synthetic peptide
  Seed: VSPEPLQAL (PRAME_HUMAN)
VIPEPLQAI

SEQ ID NO: 145121 - protein, 9 aa, Artificial Sequence
  Description of Artificial Sequence: Synthetic peptide
  Seed: ITDDQLLAL (PRAME_HUMAN)
IFDDQLLAT

SEQ ID NO: 145122 - protein, 10 aa, Artificial Sequence
  Description of Artificial Sequence: Synthetic peptide
  Seed: MVQAWPFTCL (PRAME_HUMAN)
MEQAWPFTCF

SEQ ID NO: 145123 - protein, 10 aa, Artificial Sequence
  Description of Artificial Sequence: Synthetic peptide
  Seed: QSLLQHLIGL (PRAME_HUMAN)
QFLLQHLIGI

SEQ ID NO: 145124 - protein, 9 aa, Artificial Sequence
  Description of Artificial Sequence: Synthetic peptide
  Seed: TCTWKLPTL (PRAME_HUMAN)
TSTWKLPTF

SEQ ID NO: 145125 - protein, 9 aa, Artificial Sequence
  Description of Artificial Sequence: Synthetic peptide
  Seed: ALYVDSLFF (PRAME_HUMAN)
AKYVDSLFY

SEQ ID NO: 145126 - protein, 10 aa, Artificial Sequence
  Description of Artificial Sequence: Synthetic peptide
  Seed: IGLSNLTHVL (PRAME_HUMAN)
ISLSNLTHVL

SEQ ID NO: 145127 - protein, 9 aa, Artificial Sequence
  Description of Artificial Sequence: Synthetic peptide
  Seed: VQAWPFTCL (PRAME_HUMAN)
VLAWPFTCV

SEQ ID NO: 145128 - protein, 9 aa, Artificial Sequence
  Description of Artificial Sequence: Synthetic peptide
  Seed: LWGSIQSRY (PRAME_HUMAN)
LVGSIQSRY

SEQ ID NO: 145129 - protein, 10 aa, Artificial Sequence
  Description of Artificial Sequence: Synthetic peptide
  Seed: SALQSLLQHL (PRAME_HUMAN)
STLQSLLQHV

SEQ ID NO: 145130 - protein, 9 aa, Artificial Sequence
  Description of Artificial Sequence: Synthetic peptide
  Seed: LALLPSLSH (PRAME_HUMAN)
LALLPSLSL

SEQ ID NO: 145131 - protein, 9 aa, Artificial Sequence
  Description of Artificial Sequence: Synthetic peptide
  Seed: YLHARLREL (PRAME_HUMAN)
YMHARLREV

SEQ ID NO: 145132 - protein, 10 aa, Artificial Sequence
  Description of Artificial Sequence: Synthetic peptide
  Seed: FPEPEAAQPM (PRAME_HUMAN)
FPEPEAAQPF

SEQ ID NO: 145133 - protein, 9 aa, Artificial Sequence
  Description of Artificial Sequence: Synthetic peptide
  Seed: RGRLDQLLR (PRAME_HUMAN)
RLRLDQLLK

SEQ ID NO: 145134 - protein, 11 aa, Artificial Sequence
  Description of Artificial Sequence: Synthetic peptide
  Seed: EDIHGTLHLER (PRAME_HUMAN)
EVIHGTLHLER

SEQ ID NO: 145135 - protein, 10 aa, Artificial Sequence
  Description of Artificial Sequence: Synthetic peptide
  Seed: FIPVEVLVDL (PRAME_HUMAN)
FLPVEVLVDV

SEQ ID NO: 145136 - protein, 11 aa, Artificial Sequence
  Description of Artificial Sequence: Synthetic peptide
  Seed: SIEDLEVTCTW (PRAME_HUMAN)
SMEDLEVTCTY

SEQ ID NO: 145137 - protein, 10 aa, Artificial Sequence
  Description of Artificial Sequence: Synthetic peptide
  Seed: RGRLDQLLRH (PRAME_HUMAN)
RQRLDQLLRL

SEQ ID NO: 145138 - protein, 9 aa, Artificial Sequence
  Description of Artificial Sequence: Synthetic peptide
  Seed: VFDECGITD (PRAME_HUMAN)
VMDECGITV

SEQ ID NO: 145139 - protein, 9 aa, Artificial Sequence
  Description of Artificial Sequence: Synthetic peptide
  Seed: RGRLDQLLR (PRAME_HUMAN)
RTRLDQLLT

SEQ ID NO: 145140 - protein, 9 aa, Artificial Sequence
  Description of Artificial Sequence: Synthetic peptide
  Seed: ALLERASAT (PRAME_HUMAN)
AVLERASAV

SEQ ID NO: 145141 - protein, 9 aa, Artificial Sequence
  Description of Artificial Sequence: Synthetic peptide
  Seed: QALYVDSLF (PRAME_HUMAN)
QSLYVDSLL

SEQ ID NO: 145142 - protein, 9 aa, Artificial Sequence
  Description of Artificial Sequence: Synthetic peptide
  Seed: SLLQHLIGL (PRAME_HUMAN)
SALQHLIGW

SEQ ID NO: 145143 - protein, 10 aa, Artificial Sequence
  Description of Artificial Sequence: Synthetic peptide
  Seed: HCSQLTTLSF (PRAME_HUMAN)
HMSQLTTLSF

SEQ ID NO: 145144 - protein, 9 aa, Artificial Sequence
  Description of Artificial Sequence: Synthetic peptide
  Seed: KLKIFAMPM (PRAME_HUMAN)
KMKIFAMPP

SEQ ID NO: 145145 - protein, 9 aa, Artificial Sequence
  Description of Artificial Sequence: Synthetic peptide
  Seed: TLAKFSPYL (PRAME_HUMAN)
TMAKFSPYR

SEQ ID NO: 145146 - protein, 9 aa, Artificial Sequence
  Description of Artificial Sequence: Synthetic peptide
  Seed: LTDVSPEPL (PRAME_HUMAN)
LYDVSPEPL

SEQ ID NO: 145147 - protein, 9 aa, Artificial Sequence
  Description of Artificial Sequence: Synthetic peptide
  Seed: FDGRHSQTL (PRAME_HUMAN)
FHGRHSQTF

SEQ ID NO: 145148 - protein, 9 aa, Artificial Sequence
  Description of Artificial Sequence: Synthetic peptide
  Seed: ISISALQSL (PRAME_HUMAN)
ILISALQSL

SEQ ID NO: 145149 - protein, 9 aa, Artificial Sequence
  Description of Artificial Sequence: Synthetic peptide
  Seed: LQHLIGLSN (PRAME_HUMAN)
LEHLIGLSF

SEQ ID NO: 145150 - protein, 9 aa, Artificial Sequence
  Description of Artificial Sequence: Synthetic peptide
  Seed: TSPRRLVEL (PRAME_HUMAN)
TIPRRLVEF

SEQ ID NO: 145151 - protein, 10 aa, Artificial Sequence
  Description of Artificial Sequence: Synthetic peptide
  Seed: AYLHARLREL (PRAME_HUMAN)
AFLHARLREV

SEQ ID NO: 145152 - protein, 9 aa, Artificial Sequence
  Description of Artificial Sequence: Synthetic peptide
  Seed: SATLQDLVF (PRAME_HUMAN)
SMTLQDLVY

SEQ ID NO: 145153 - protein, 9 aa, Artificial Sequence
  Description of Artificial Sequence: Synthetic peptide
  Seed: SFYGNSISI (PRAME_HUMAN)
SMYGNSISM

SEQ ID NO: 145154 - protein, 10 aa, Artificial Sequence
  Description of Artificial Sequence: Synthetic peptide
  Seed: LLPRELFPPL (PRAME_HUMAN)
LAPRELFPPI

SEQ ID NO: 145155 - protein, 9 aa, Artificial Sequence
  Description of Artificial Sequence: Synthetic peptide
  Seed: MINLRRLLL (PRAME_HUMAN)
MSNLRRLLI

SEQ ID NO: 145156 - protein, 9 aa, Artificial Sequence
  Description of Artificial Sequence: Synthetic peptide
  Seed: LSVLSLSGV (PRAME_HUMAN)
LTVLSLSGI

SEQ ID NO: 145157 - protein, 10 aa, Artificial Sequence
  Description of Artificial Sequence: Synthetic peptide
  Seed: LLSHIHASSY (PRAME_HUMAN)
LNSHIHASSF

SEQ ID NO: 145158 - protein, 9 aa, Artificial Sequence
  Description of Artificial Sequence: Synthetic peptide
  Seed: SQLTTLSFY (PRAME_HUMAN)
SMLTTLSFK

SEQ ID NO: 145159 - protein, 10 aa, Artificial Sequence
  Description of Artificial Sequence: Synthetic peptide
  Seed: LSLQCLQALY (PRAME_HUMAN)
LMLQCLQALW

SEQ ID NO: 145160 - protein, 9 aa, Artificial Sequence
  Description of Artificial Sequence: Synthetic peptide
  Seed: SFYGNSISI (PRAME_HUMAN)
SAYGNSISF

SEQ ID NO: 145161 - protein, 8 aa, Artificial Sequence
  Description of Artificial Sequence: Synthetic peptide
  Seed: YSFPEPEA (PRAME_HUMAN)
YSFPEPEY

SEQ ID NO: 145162 - protein, 8 aa, Artificial Sequence
  Description of Artificial Sequence: Synthetic peptide
  Seed: TLAKFSPY (PRAME_HUMAN)
TQAKFSPF

SEQ ID NO: 145163 - protein, 10 aa, Artificial Sequence
  Description of Artificial Sequence: Synthetic peptide
  Seed: ITDDQLLALL (PRAME_HUMAN)
ISDDQLLALV

SEQ ID NO: 145164 - protein, 10 aa, Artificial Sequence
  Description of Artificial Sequence: Synthetic peptide
  Seed: AAFDGRHSQT (PRAME_HUMAN)
ATFDGRHSQV

SEQ ID NO: 145165 - protein, 9 aa, Artificial Sequence
  Description of Artificial Sequence: Synthetic peptide
  Seed: THVLYPVPL (PRAME_HUMAN)
TAVLYPVPF

SEQ ID NO: 145166 - protein, 9 aa, Artificial Sequence
  Description of Artificial Sequence: Synthetic peptide
  Seed: VWSGNRASL (PRAME_HUMAN)
VFSGNRASV

SEQ ID NO: 145167 - protein, 9 aa, Artificial Sequence
  Description of Artificial Sequence: Synthetic peptide
  Seed: SQSPSVSQL (PRAME_HUMAN)
SMSPSVSQY

SEQ ID NO: 145168 - protein, 9 aa, Artificial Sequence
  Description of Artificial Sequence: Synthetic peptide
  Seed: YIAQFTSQF (PRAME_HUMAN)
YQAQFTSQV

SEQ ID NO: 145169 - protein, 9 aa, Artificial Sequence
  Description of Artificial Sequence: Synthetic peptide
  Seed: TDDQLLALL (PRAME_HUMAN)
TQDQLLALM

SEQ ID NO: 145170 - protein, 9 aa, Artificial Sequence
  Description of Artificial Sequence: Synthetic peptide
  Seed: SQSPSVSQL (PRAME_HUMAN)
SASPSVSQI

SEQ ID NO: 145171 - protein, 9 aa, Artificial Sequence
  Description of Artificial Sequence: Synthetic peptide
  Seed: AFDGRHSQT (PRAME_HUMAN)
AYDGRHSQI

SEQ ID NO: 145172 - protein, 9 aa, Artificial Sequence
  Description of Artificial Sequence: Synthetic peptide
  Seed: ISISALQSL (PRAME_HUMAN)
IYISALQSY

SEQ ID NO: 145173 - protein, 9 aa, Artificial Sequence
  Description of Artificial Sequence: Synthetic peptide
  Seed: VSPEPLQAL (PRAME_HUMAN)
VRPEPLQAI

SEQ ID NO: 145174 - protein, 11 aa, Artificial Sequence
  Description of Artificial Sequence: Synthetic peptide
  Seed: IGLSNLTHVLY (PRAME_HUMAN)
ISLSNLTHVLF

SEQ ID NO: 145175 - protein, 10 aa, Artificial Sequence
  Description of Artificial Sequence: Synthetic peptide
  Seed: SLSGVMLTDV (PRAME_HUMAN)
SLSGVMLTDI

SEQ ID NO: 145176 - protein, 9 aa, Artificial Sequence
  Description of Artificial Sequence: Synthetic peptide
  Seed: QMINLRRLL (PRAME_HUMAN)
QTINLRRLF

SEQ ID NO: 145177 - protein, 9 aa, Artificial Sequence
  Description of Artificial Sequence: Synthetic peptide
  Seed: HLIGLSNLT (PRAME_HUMAN)
HAIGLSNLV

SEQ ID NO: 145178 - protein, 10 aa, Artificial Sequence
  Description of Artificial Sequence: Synthetic peptide
  Seed: RLVELAGQSL (PRAME_HUMAN)
RQVELAGQSM

SEQ ID NO: 145179 - protein, 10 aa, Artificial Sequence
  Description of Artificial Sequence: Synthetic peptide
  Seed: RRLWGSIQSR (PRAME_HUMAN)
RMLWGSIQSK

SEQ ID NO: 145180 - protein, 9 aa, Artificial Sequence
  Description of Artificial Sequence: Synthetic peptide
  Seed: FYDPEPILC (PRAME_HUMAN)
FIDPEPILW

SEQ ID NO: 145181 - protein, 8 aa, Artificial Sequence
  Description of Artificial Sequence: Synthetic peptide
  Seed: ITDDQLLA (PRAME_HUMAN)
IADDQLLM

SEQ ID NO: 145182 - protein, 9 aa, Artificial Sequence
  Description of Artificial Sequence: Synthetic peptide
  Seed: SLFFLRGRL (PRAME_HUMAN)
STFFLRGRW

SEQ ID NO: 145183 - protein, 10 aa, Artificial Sequence
  Description of Artificial Sequence: Synthetic peptide
  Seed: RLDQLLRHVM (PRAME_HUMAN)
RMDQLLRHVF

SEQ ID NO: 145184 - protein, 9 aa, Artificial Sequence
  Description of Artificial Sequence: Synthetic peptide
  Seed: LDQLLRHVM (PRAME_HUMAN)
LEQLLRHVV

SEQ ID NO: 145185 - protein, 9 aa, Artificial Sequence
  Description of Artificial Sequence: Synthetic peptide
  Seed: SLLQHLIGL (PRAME_HUMAN)
SRLQHLIGI

SEQ ID NO: 145186 - protein, 10 aa, Artificial Sequence
  Description of Artificial Sequence: Synthetic peptide
  Seed: MNPLETLSIT (PRAME_HUMAN)
MNPLETLSIA

SEQ ID NO: 145187 - protein, 10 aa, Artificial Sequence
  Description of Artificial Sequence: Synthetic peptide
  Seed: TVWSGNRASL (PRAME_HUMAN)
TPWSGNRASI

SEQ ID NO: 145188 - protein, 11 aa, Artificial Sequence
  Description of Artificial Sequence: Synthetic peptide
  Seed: SIQSRYISMSV (PRAME_HUMAN)
SMQSRYISMSV

SEQ ID NO: 145189 - protein, 10 aa, Artificial Sequence
  Description of Artificial Sequence: Synthetic peptide
  Seed: QALYVDSLFF (PRAME_HUMAN)
QTLYVDSLFY

SEQ ID NO: 145190 - protein, 10 aa, Artificial Sequence
  Description of Artificial Sequence: Synthetic peptide
  Seed: RLVELAGQSL (PRAME_HUMAN)
RMVELAGQSI

SEQ ID NO: 145191 - protein, 11 aa, Artificial Sequence
  Description of Artificial Sequence: Synthetic peptide
  Seed: RASATLQDLVF (PRAME_HUMAN)
RSSATLQDLVM

SEQ ID NO: 145192 - protein, 11 aa, Artificial Sequence
  Description of Artificial Sequence: Synthetic peptide
  Seed: ALYVDSLFFLR (PRAME_HUMAN)
AMYVDSLFFLI

SEQ ID NO: 145193 - protein, 10 aa, Artificial Sequence
  Description of Artificial Sequence: Synthetic peptide
  Seed: DQLLALLPSL (PRAME_HUMAN)
DILLALLPSI

SEQ ID NO: 145194 - protein, 9 aa, Artificial Sequence
  Description of Artificial Sequence: Synthetic peptide
  Seed: YSFPEPEAA (PRAME_HUMAN)
YMFPEPEAV

SEQ ID NO: 145195 - protein, 9 aa, Artificial Sequence
  Description of Artificial Sequence: Synthetic peptide
  Seed: GQHLHLETF (PRAME_HUMAN)
GSHLHLETL

SEQ ID NO: 145196 - protein, 10 aa, Artificial Sequence
  Description of Artificial Sequence: Synthetic peptide
  Seed: ARLRELLCEL (PRAME_HUMAN)
ANLRELLCEI

SEQ ID NO: 145197 - protein, 9 aa, Artificial Sequence
  Description of Artificial Sequence: Synthetic peptide
  Seed: RHSQTLKAM (PRAME_HUMAN)
RQSQTLKAI

SEQ ID NO: 145198 - protein, 10 aa, Artificial Sequence
  Description of Artificial Sequence: Synthetic peptide
  Seed: AEQPFIPVEV (PRAME_HUMAN)
AEQPFIPVEP

SEQ ID NO: 145199 - protein, 10 aa, Artificial Sequence
  Description of Artificial Sequence: Synthetic peptide
  Seed: DQLLALLPSL (PRAME_HUMAN)
DRLLALLPSV

SEQ ID NO: 145200 - protein, 10 aa, Artificial Sequence
  Description of Artificial Sequence: Synthetic peptide
  Seed: LLSHIHASSY (PRAME_HUMAN)
LCSHIHASSY

SEQ ID NO: 145201 - protein, 9 aa, Artificial Sequence
  Description of Artificial Sequence: Synthetic peptide
  Seed: KDEALAIAA (PRAME_HUMAN)
KEEALAIAA

SEQ ID NO: 145202 - protein, 9 aa, Artificial Sequence
  Description of Artificial Sequence: Synthetic peptide
  Seed: YLHARLREL (PRAME_HUMAN)
YAHARLREW

SEQ ID NO: 145203 - protein, 10 aa, Artificial Sequence
  Description of Artificial Sequence: Synthetic peptide
  Seed: MPMQDIKMIL (PRAME_HUMAN)
MYMQDIKMIL

SEQ ID NO: 145204 - protein, 9 aa, Artificial Sequence
  Description of Artificial Sequence: Synthetic peptide
  Seed: KVDGLSTEA (PRAME_HUMAN)
KTDGLSTEF

SEQ ID NO: 145205 - protein, 9 aa, Artificial Sequence
  Description of Artificial Sequence: Synthetic peptide
  Seed: RTFYDPEPI (PRAME_HUMAN)
RLFYDPEPM

SEQ ID NO: 145206 - protein, 9 aa, Artificial Sequence
  Description of Artificial Sequence: Synthetic peptide
  Seed: YLHARLREL (PRAME_HUMAN)
YFHARLREF

SEQ ID NO: 145207 - protein, 9 aa, Artificial Sequence
  Description of Artificial Sequence: Synthetic peptide
  Seed: SLLQHLIGL (PRAME_HUMAN)
SVLQHLIGR

SEQ ID NO: 145208 - protein, 9 aa, Artificial Sequence
  Description of Artificial Sequence: Synthetic peptide
  Seed: LSHIHASSY (PRAME_HUMAN)
LAHIHASSI

SEQ ID NO: 145209 - protein, 10 aa, Artificial Sequence
  Description of Artificial Sequence: Synthetic peptide
  Seed: SVSQLSVLSL (PRAME_HUMAN)
SLSQLSVLSW

SEQ ID NO: 145210 - protein, 9 aa, Artificial Sequence
  Description of Artificial Sequence: Synthetic peptide
  Seed: SIQSRYISM (PRAME_HUMAN)
SWQSRYISL

SEQ ID NO: 145211 - protein, 9 aa, Artificial Sequence
  Description of Artificial Sequence: Synthetic peptide
  Seed: LQALYVDSL (PRAME_HUMAN)
LQALYVDSM

SEQ ID NO: 145212 - protein, 10 aa, Artificial Sequence
  Description of Artificial Sequence: Synthetic peptide
  Seed: FMAAFDGRHS (PRAME_HUMAN)
FLAAFDGRHA

SEQ ID NO: 145213 - protein, 9 aa, Artificial Sequence
  Description of Artificial Sequence: Synthetic peptide
  Seed: QALYVDSLF (PRAME_HUMAN)
QSLYVDSLY

SEQ ID NO: 145214 - protein, 9 aa, Artificial Sequence
  Description of Artificial Sequence: Synthetic peptide
  Seed: SVLSLSGVM (PRAME_HUMAN)
STLSLSGVR

SEQ ID NO: 145215 - protein, 10 aa, Artificial Sequence
  Description of Artificial Sequence: Synthetic peptide
  Seed: IGLSNLTHVL (PRAME_HUMAN)
IQLSNLTHVV

SEQ ID NO: 145216 - protein, 9 aa, Artificial Sequence
  Description of Artificial Sequence: Synthetic peptide
  Seed: ALAIAALEL (PRAME_HUMAN)
ALAIAALEV

SEQ ID NO: 145217 - protein, 9 aa, Artificial Sequence
  Description of Artificial Sequence: Synthetic peptide
  Seed: LYVDSLFFL (PRAME_HUMAN)
LWVDSLFFW

SEQ ID NO: 145218 - protein, 9 aa, Artificial Sequence
  Description of Artificial Sequence: Synthetic peptide
  Seed: YGNSISISA (PRAME_HUMAN)
YPNSISISI

SEQ ID NO: 145219 - protein, 10 aa, Artificial Sequence
  Description of Artificial Sequence: Synthetic peptide
  Seed: ASATLQDLVF (PRAME_HUMAN)
AVATLQDLVW

SEQ ID NO: 145220 - protein, 9 aa, Artificial Sequence
  Description of Artificial Sequence: Synthetic peptide
  Seed: SHCSQLTTL (PRAME_HUMAN)
SQCSQLTTY

SEQ ID NO: 145221 - protein, 9 aa, Artificial Sequence
  Description of Artificial Sequence: Synthetic peptide
  Seed: SFPEPEAAQ (PRAME_HUMAN)
SFPEPEAAV

SEQ ID NO: 145222 - protein, 9 aa, Artificial Sequence
  Description of Artificial Sequence: Synthetic peptide
  Seed: YLHARLREL (PRAME_HUMAN)
YYHARLREW

SEQ ID NO: 145223 - protein, 8 aa, Artificial Sequence
  Description of Artificial Sequence: Synthetic peptide
  Seed: FYDPEPIL (PRAME_HUMAN)
FMDPEPII

SEQ ID NO: 145224 - protein, 10 aa, Artificial Sequence
  Description of Artificial Sequence: Synthetic peptide
  Seed: TVWSGNRASL (PRAME_HUMAN)
TTWSGNRASR

SEQ ID NO: 145225 - protein, 9 aa, Artificial Sequence
  Description of Artificial Sequence: Synthetic peptide
  Seed: FYDPEPILC (PRAME_HUMAN)
FVDPEPILT

SEQ ID NO: 145226 - protein, 10 aa, Artificial Sequence
  Description of Artificial Sequence: Synthetic peptide
  Seed: RLVELAGQSL (PRAME_HUMAN)
RIVELAGQSI

SEQ ID NO: 145227 - protein, 9 aa, Artificial Sequence
  Description of Artificial Sequence: Synthetic peptide
  Seed: KEEQYIAQF (PRAME_HUMAN)
KQEQYIAQY

SEQ ID NO: 145228 - protein, 10 aa, Artificial Sequence
  Description of Artificial Sequence: Synthetic peptide
  Seed: RLDQLLRHVM (PRAME_HUMAN)
RQDQLLRHVI

SEQ ID NO: 145229 - protein, 9 aa, Artificial Sequence
  Description of Artificial Sequence: Synthetic peptide
  Seed: HVMNPLETL (PRAME_HUMAN)
HYMNPLETF

SEQ ID NO: 145230 - protein, 10 aa, Artificial Sequence
  Description of Artificial Sequence: Synthetic peptide
  Seed: ERLAYLHARL (PRAME_HUMAN)
EVLAYLHARV

SEQ ID NO: 145231 - protein, 9 aa, Artificial Sequence
  Description of Artificial Sequence: Synthetic peptide
  Seed: LLRHVMNPL (PRAME_HUMAN)
LSRHVMNPF

SEQ ID NO: 145232 - protein, 9 aa, Artificial Sequence
  Description of Artificial Sequence: Synthetic peptide
  Seed: YSFPEPEAA (PRAME_HUMAN)
YAFPEPEAT

SEQ ID NO: 145233 - protein, 8 aa, Artificial Sequence
  Description of Artificial Sequence: Synthetic peptide
  Seed: RYISMSVW (PRAME_HUMAN)
RWISMSVF

SEQ ID NO: 145234 - protein, 9 aa, Artificial Sequence
  Description of Artificial Sequence: Synthetic peptide
  Seed: IPVEVLVDL (PRAME_HUMAN)
IAVEVLVDM

SEQ ID NO: 145235 - protein, 10 aa, Artificial Sequence
  Description of Artificial Sequence: Synthetic peptide
  Seed: CCKKLKIFAM (PRAME_HUMAN)
CMKKLKIFAL

SEQ ID NO: 145236 - protein, 10 aa, Artificial Sequence
  Description of Artificial Sequence: Synthetic peptide
  Seed: ISPEKEEQYI (PRAME_HUMAN)
IMPEKEEQYL

SEQ ID NO: 145237 - protein, 9 aa, Artificial Sequence
  Description of Artificial Sequence: Synthetic peptide
  Seed: RRWKLQVLD (PRAME_HUMAN)
RQWKLQVLL

SEQ ID NO: 145238 - protein, 9 aa, Artificial Sequence
  Description of Artificial Sequence: Synthetic peptide
  Seed: KLKIFAMPM (PRAME_HUMAN)
KTKIFAMPS

SEQ ID NO: 145239 - protein, 10 aa, Artificial Sequence
  Description of Artificial Sequence: Synthetic peptide
  Seed: ARLRELLCEL (PRAME_HUMAN)
ATLRELLCEI

SEQ ID NO: 145240 - protein, 9 aa, Artificial Sequence
  Description of Artificial Sequence: Synthetic peptide
  Seed: HVMNPLETL (PRAME_HUMAN)
HPMNPLETL

SEQ ID NO: 145241 - protein, 10 aa, Artificial Sequence
  Description of Artificial Sequence: Synthetic peptide
  Seed: GLSNLTHVLY (PRAME_HUMAN)
GVSNLTHVLK

SEQ ID NO: 145242 - protein, 9 aa, Artificial Sequence
  Description of Artificial Sequence: Synthetic peptide
  Seed: EAAQPMTKK (PRAME_HUMAN)
EVAQPMTKV

SEQ ID NO: 145243 - protein, 10 aa, Artificial Sequence
  Description of Artificial Sequence: Synthetic peptide
  Seed: LPTLAKFSPY (PRAME_HUMAN)
LPTLAKFSPA

SEQ ID NO: 145244 - protein, 9 aa, Artificial Sequence
  Description of Artificial Sequence: Synthetic peptide
  Seed: LYPVPLESY (PRAME_HUMAN)
LAPVPLESL

SEQ ID NO: 145245 - protein, 9 aa, Artificial Sequence
  Description of Artificial Sequence: Synthetic peptide
  Seed: RRWKLQVLD (PRAME_HUMAN)
RQWKLQVLF

SEQ ID NO: 145246 - protein, 11 aa, Artificial Sequence
  Description of Artificial Sequence: Synthetic peptide
  Seed: LLLSHIHASSY (PRAME_HUMAN)
LMLSHIHASSW

SEQ ID NO: 145247 - protein, 9 aa, Artificial Sequence
  Description of Artificial Sequence: Synthetic peptide
  Seed: RWKLQVLDL (PRAME_HUMAN)
RYKLQVLDW

SEQ ID NO: 145248 - protein, 10 aa, Artificial Sequence
  Description of Artificial Sequence: Synthetic peptide
  Seed: YISPEKEEQY (PRAME_HUMAN)
YQSPEKEEQV

SEQ ID NO: 145249 - protein, 9 aa, Artificial Sequence
  Description of Artificial Sequence: Synthetic peptide
  Seed: ACDELFSYL (PRAME_HUMAN)
AGDELFSYF

SEQ ID NO: 145250 - protein, 10 aa, Artificial Sequence
  Description of Artificial Sequence: Synthetic peptide
  Seed: GLSNLTHVLY (PRAME_HUMAN)
GLSNLTHVLV

SEQ ID NO: 145251 - protein, 9 aa, Artificial Sequence
  Description of Artificial Sequence: Synthetic peptide
  Seed: SPEPLQALL (PRAME_HUMAN)
SMEPLQALL

SEQ ID NO: 145252 - protein, 9 aa, Artificial Sequence
  Description of Artificial Sequence: Synthetic peptide
  Seed: KMILKMVQL (PRAME_HUMAN)
KLILKMVQW

SEQ ID NO: 145253 - protein, 10 aa, Artificial Sequence
  Description of Artificial Sequence: Synthetic peptide
  Seed: TTLSFYGNSI (PRAME_HUMAN)
TILSFYGNSV

SEQ ID NO: 145254 - protein, 11 aa, Artificial Sequence
  Description of Artificial Sequence: Synthetic peptide
  Seed: ALYVDSLFFLR (PRAME_HUMAN)
ALYVDSLFFLI

SEQ ID NO: 145255 - protein, 10 aa, Artificial Sequence
  Description of Artificial Sequence: Synthetic peptide
  Seed: GRPSMVWLSA (PRAME_HUMAN)
GLPSMVWLSL

SEQ ID NO: 145256 - protein, 9 aa, Artificial Sequence
  Description of Artificial Sequence: Synthetic peptide
  Seed: ALLPSLSHC (PRAME_HUMAN)
AMLPSLSHA

SEQ ID NO: 145257 - protein, 9 aa, Artificial Sequence
  Description of Artificial Sequence: Synthetic peptide
  Seed: IFAMPMQDI (PRAME_HUMAN)
IFAMPMQDY

SEQ ID NO: 145258 - protein, 9 aa, Artificial Sequence
  Description of Artificial Sequence: Synthetic peptide
  Seed: LELLPRELF (PRAME_HUMAN)
LALLPRELY

SEQ ID NO: 145259 - protein, 9 aa, Artificial Sequence
  Description of Artificial Sequence: Synthetic peptide
  Seed: LVELAGQSL (PRAME_HUMAN)
LMELAGQSY

SEQ ID NO: 145260 - protein, 9 aa, Artificial Sequence
  Description of Artificial Sequence: Synthetic peptide
  Seed: SATLQDLVF (PRAME_HUMAN)
SKTLQDLVM

SEQ ID NO: 145261 - protein, 9 aa, Artificial Sequence
  Description of Artificial Sequence: Synthetic peptide
  Seed: RLAYLHARL (PRAME_HUMAN)
RSAYLHARF

SEQ ID NO: 145262 - protein, 9 aa, Artificial Sequence
  Description of Artificial Sequence: Synthetic peptide
  Seed: FDGRHSQTL (PRAME_HUMAN)
FHGRHSQTL

SEQ ID NO: 145263 - protein, 9 aa, Artificial Sequence
  Description of Artificial Sequence: Synthetic peptide
  Seed: KLKIFAMPM (PRAME_HUMAN)
KHKIFAMPM

SEQ ID NO: 145264 - protein, 10 aa, Artificial Sequence
  Description of Artificial Sequence: Synthetic peptide
  Seed: LLLSHIHASS (PRAME_HUMAN)
LWLSHIHASV

SEQ ID NO: 145265 - protein, 10 aa, Artificial Sequence
  Description of Artificial Sequence: Synthetic peptide
  Seed: IGLSNLTHVL (PRAME_HUMAN)
ILLSNLTHVN

SEQ ID NO: 145266 - protein, 10 aa, Artificial Sequence
  Description of Artificial Sequence: Synthetic peptide
  Seed: QYIAQFTSQF (PRAME_HUMAN)
QMIAQFTSQY

SEQ ID NO: 145267 - protein, 9 aa, Artificial Sequence
  Description of Artificial Sequence: Synthetic peptide
  Seed: LKMVQLDSI (PRAME_HUMAN)
LHMVQLDSY

SEQ ID NO: 145268 - protein, 10 aa, Artificial Sequence
  Description of Artificial Sequence: Synthetic peptide
  Seed: FIPVEVLVDL (PRAME_HUMAN)
FSPVEVLVDM

SEQ ID NO: 145269 - protein, 9 aa, Artificial Sequence
  Description of Artificial Sequence: Synthetic peptide
  Seed: LQALYVDSL (PRAME_HUMAN)
LMALYVDSF

SEQ ID NO: 145270 - protein, 9 aa, Artificial Sequence
  Description of Artificial Sequence: Synthetic peptide
  Seed: RGRLDQLLR (PRAME_HUMAN)
RTRLDQLLL

SEQ ID NO: 145271 - protein, 9 aa, Artificial Sequence
  Description of Artificial Sequence: Synthetic peptide
  Seed: HVMNPLETL (PRAME_HUMAN)
HHMNPLETI

SEQ ID NO: 145272 - protein, 9 aa, Artificial Sequence
  Description of Artificial Sequence: Synthetic peptide
  Seed: ACDELFSYL (PRAME_HUMAN)
AIDELFSYI

SEQ ID NO: 145273 - protein, 9 aa, Artificial Sequence
  Description of Artificial Sequence: Synthetic peptide
  Seed: IGLSNLTHV (PRAME_HUMAN)
IMLSNLTHA

SEQ ID NO: 145274 - protein, 9 aa, Artificial Sequence
  Description of Artificial Sequence: Synthetic peptide
  Seed: TFYDPEPIL (PRAME_HUMAN)
TSYDPEPIM

SEQ ID NO: 145275 - protein, 9 aa, Artificial Sequence
  Description of Artificial Sequence: Synthetic peptide
  Seed: MHLSQSPSV (PRAME_HUMAN)
MMLSQSPSW

SEQ ID NO: 145276 - protein, 9 aa, Artificial Sequence
  Description of Artificial Sequence: Synthetic peptide
  Seed: RLLLSHIHA (PRAME_HUMAN)
RQLLSHIHV

SEQ ID NO: 145277 - protein, 9 aa, Artificial Sequence
  Description of Artificial Sequence: Synthetic peptide
  Seed: VSPEPLQAL (PRAME_HUMAN)
VSPEPLQAI

SEQ ID NO: 145278 - protein, 11 aa, Artificial Sequence
  Description of Artificial Sequence: Synthetic peptide
  Seed: AVLDGLDVLLA (PRAME_HUMAN)
ALLDGLDVLLV

SEQ ID NO: 145279 - protein, 10 aa, Artificial Sequence
  Description of Artificial Sequence: Synthetic peptide
  Seed: VTCTWKLPTL (PRAME_HUMAN)
VACTWKLPTW

SEQ ID NO: 145280 - protein, 9 aa, Artificial Sequence
  Description of Artificial Sequence: Synthetic peptide
  Seed: VQAWPFTCL (PRAME_HUMAN)
VHAWPFTCY

SEQ ID NO: 145281 - protein, 10 aa, Artificial Sequence
  Description of Artificial Sequence: Synthetic peptide
  Seed: SPSVSQLSVL (PRAME_HUMAN)
SNSVSQLSVW

SEQ ID NO: 145282 - protein, 10 aa, Artificial Sequence
  Description of Artificial Sequence: Synthetic peptide
  Seed: LPRELFPPLF (PRAME_HUMAN)
LPRELFPPLV

SEQ ID NO: 145283 - protein, 9 aa, Artificial Sequence
  Description of Artificial Sequence: Synthetic peptide
  Seed: SFYGNSISI (PRAME_HUMAN)
SAYGNSISI

SEQ ID NO: 145284 - protein, 10 aa, Artificial Sequence
  Description of Artificial Sequence: Synthetic peptide
  Seed: KKLKIFAMPM (PRAME_HUMAN)
KSLKIFAMPK

SEQ ID NO: 145285 - protein, 9 aa, Artificial Sequence
  Description of Artificial Sequence: Synthetic peptide
  Seed: LQHLIGLSN (PRAME_HUMAN)
LKHLIGLSF

SEQ ID NO: 145286 - protein, 11 aa, Artificial Sequence
  Description of Artificial Sequence: Synthetic peptide
  Seed: SNLTHVLYPVP (PRAME_HUMAN)
SMLTHVLYPVC

SEQ ID NO: 145287 - protein, 11 aa, Artificial Sequence
  Description of Artificial Sequence: Synthetic peptide
  Seed: GTLHLERLAYL (PRAME_HUMAN)
GLLHLERLAYA

SEQ ID NO: 145288 - protein, 9 aa, Artificial Sequence
  Description of Artificial Sequence: Synthetic peptide
  Seed: VLDGLDVLL (PRAME_HUMAN)
VTDGLDVLM

SEQ ID NO: 145289 - protein, 10 aa, Artificial Sequence
  Description of Artificial Sequence: Synthetic peptide
  Seed: FAMPMQDIKM (PRAME_HUMAN)
FVMPMQDIKY

SEQ ID NO: 145290 - protein, 10 aa, Artificial Sequence
  Description of Artificial Sequence: Synthetic peptide
  Seed: SALQSLLQHL (PRAME_HUMAN)
SNLQSLLQHV

SEQ ID NO: 145291 - protein, 9 aa, Artificial Sequence
  Description of Artificial Sequence: Synthetic peptide
  Seed: VSPEPLQAL (PRAME_HUMAN)
VAPEPLQAF

SEQ ID NO: 145292 - protein, 11 aa, Artificial Sequence
  Description of Artificial Sequence: Synthetic peptide
  Seed: HLSQSPSVSQL (PRAME_HUMAN)
HQSQSPSVSQF

SEQ ID NO: 145293 - protein, 10 aa, Artificial Sequence
  Description of Artificial Sequence: Synthetic peptide
  Seed: RGRLDQLLRH (PRAME_HUMAN)
RTRLDQLLRI

SEQ ID NO: 145294 - protein, 9 aa, Artificial Sequence
  Description of Artificial Sequence: Synthetic peptide
  Seed: SHIHASSYI (PRAME_HUMAN)
SNIHASSYF

SEQ ID NO: 145295 - protein, 10 aa, Artificial Sequence
  Description of Artificial Sequence: Synthetic peptide
  Seed: ASATLQDLVF (PRAME_HUMAN)
ASATLQDLVW

SEQ ID NO: 145296 - protein, 9 aa, Artificial Sequence
  Description of Artificial Sequence: Synthetic peptide
  Seed: ACDELFSYL (PRAME_HUMAN)
AMDELFSYT

SEQ ID NO: 145297 - protein, 10 aa, Artificial Sequence
  Description of Artificial Sequence: Synthetic peptide
  Seed: SNLTHVLYPV (PRAME_HUMAN)
SPLTHVLYPL

SEQ ID NO: 145298 - protein, 10 aa, Artificial Sequence
  Description of Artificial Sequence: Synthetic peptide
  Seed: AQFTSQFLSL (PRAME_HUMAN)
AIFTSQFLSV

SEQ ID NO: 145299 - protein, 9 aa, Artificial Sequence
  Description of Artificial Sequence: Synthetic peptide
  Seed: ALQSLLQHL (PRAME_HUMAN)
AVQSLLQHF

SEQ ID NO: 145300 - protein, 10 aa, Artificial Sequence
  Description of Artificial Sequence: Synthetic peptide
  Seed: ARLRELLCEL (PRAME_HUMAN)
AQLRELLCEL

SEQ ID NO: 145301 - protein, 9 aa, Artificial Sequence
  Description of Artificial Sequence: Synthetic peptide
  Seed: ACDELFSYL (PRAME_HUMAN)
ACDELFSYM

SEQ ID NO: 145302 - protein, 9 aa, Artificial Sequence
  Description of Artificial Sequence: Synthetic peptide
  Seed: ACDELFSYL (PRAME_HUMAN)
AQDELFSYM

SEQ ID NO: 145303 - protein, 10 aa, Artificial Sequence
  Description of Artificial Sequence: Synthetic peptide
  Seed: ISISALQSLL (PRAME_HUMAN)
IMISALQSLW

SEQ ID NO: 145304 - protein, 9 aa, Artificial Sequence
  Description of Artificial Sequence: Synthetic peptide
  Seed: EQPFIPVEV (PRAME_HUMAN)
EMPFIPVEI

SEQ ID NO: 145305 - protein, 9 aa, Artificial Sequence
  Description of Artificial Sequence: Synthetic peptide
  Seed: ITDDQLLAL (PRAME_HUMAN)
IQDDQLLAV

SEQ ID NO: 145306 - protein, 9 aa, Artificial Sequence
  Description of Artificial Sequence: Synthetic peptide
  Seed: AAFDGRHSQ (PRAME_HUMAN)
AMFDGRHSF

SEQ ID NO: 145307 - protein, 9 aa, Artificial Sequence
  Description of Artificial Sequence: Synthetic peptide
  Seed: YLHARLREL (PRAME_HUMAN)
YMHARLREM

SEQ ID NO: 145308 - protein, 9 aa, Artificial Sequence
  Description of Artificial Sequence: Synthetic peptide
  Seed: RHSQTLKAM (PRAME_HUMAN)
RRSQTLKAM

SEQ ID NO: 145309 - protein, 10 aa, Artificial Sequence
  Description of Artificial Sequence: Synthetic peptide
  Seed: SGNRASLYSF (PRAME_HUMAN)
SHNRASLYSF

SEQ ID NO: 145310 - protein, 9 aa, Artificial Sequence
  Description of Artificial Sequence: Synthetic peptide
  Seed: LLALLPSLS (PRAME_HUMAN)
LLALLPSLV

SEQ ID NO: 145311 - protein, 11 aa, Artificial Sequence
  Description of Artificial Sequence: Synthetic peptide
  Seed: FLSLQCLQALY (PRAME_HUMAN)
FVSLQCLQALL

SEQ ID NO: 145312 - protein, 9 aa, Artificial Sequence
  Description of Artificial Sequence: Synthetic peptide
  Seed: ETLSITNCR (PRAME_HUMAN)
EALSITNCR

SEQ ID NO: 145313 - protein, 9 aa, Artificial Sequence
  Description of Artificial Sequence: Synthetic peptide
  Seed: KVDGLSTEA (PRAME_HUMAN)
KSDGLSTEV

SEQ ID NO: 145314 - protein, 9 aa, Artificial Sequence
  Description of Artificial Sequence: Synthetic peptide
  Seed: GQHLHLETF (PRAME_HUMAN)
GYHLHLETL

SEQ ID NO: 145315 - protein, 10 aa, Artificial Sequence
  Description of Artificial Sequence: Synthetic peptide
  Seed: RLVELAGQSL (PRAME_HUMAN)
RLVELAGQSV

SEQ ID NO: 145316 - protein, 9 aa, Artificial Sequence
  Description of Artificial Sequence: Synthetic peptide
  Seed: LMKGQHLHL (PRAME_HUMAN)
LMKGQHLHV

SEQ ID NO: 145317 - protein, 10 aa, Artificial Sequence
  Description of Artificial Sequence: Synthetic peptide
  Seed: RRRLWGSIQS (PRAME_HUMAN)
RERLWGSIQK

SEQ ID NO: 145318 - protein, 10 aa, Artificial Sequence
  Description of Artificial Sequence: Synthetic peptide
  Seed: RGRLDQLLRH (PRAME_HUMAN)
RIRLDQLLRR

SEQ ID NO: 145319 - protein, 9 aa, Artificial Sequence
  Description of Artificial Sequence: Synthetic peptide
  Seed: MINLRRLLL (PRAME_HUMAN)
MQNLRRLLM

SEQ ID NO: 145320 - protein, 9 aa, Artificial Sequence
  Description of Artificial Sequence: Synthetic peptide
  Seed: LTDVSPEPL (PRAME_HUMAN)
LTDVSPEPF

SEQ ID NO: 145321 - protein, 10 aa, Artificial Sequence
  Description of Artificial Sequence: Synthetic peptide
  Seed: FYDPEPILCP (PRAME_HUMAN)
FWDPEPILCV

SEQ ID NO: 145322 - protein, 9 aa, Artificial Sequence
  Description of Artificial Sequence: Synthetic peptide
  Seed: YPVPLESYE (PRAME_HUMAN)
YMVPLESYF

SEQ ID NO: 145323 - protein, 9 aa, Artificial Sequence
  Description of Artificial Sequence: Synthetic peptide
  Seed: MNPLETLSI (PRAME_HUMAN)
MAPLETLSL

SEQ ID NO: 145324 - protein, 10 aa, Artificial Sequence
  Description of Artificial Sequence: Synthetic peptide
  Seed: FLKEGACDEL (PRAME_HUMAN)
FAKEGACDEF

SEQ ID NO: 145325 - protein, 9 aa, Artificial Sequence
  Description of Artificial Sequence: Synthetic peptide
  Seed: KNVLRLCCK (PRAME_HUMAN)
KMVLRLCCR

SEQ ID NO: 145326 - protein, 10 aa, Artificial Sequence
  Description of Artificial Sequence: Synthetic peptide
  Seed: FTCLPLGVLM (PRAME_HUMAN)
FMCLPLGVLL

SEQ ID NO: 145327 - protein, 9 aa, Artificial Sequence
  Description of Artificial Sequence: Synthetic peptide
  Seed: MNPLETLSI (PRAME_HUMAN)
MFPLETLSL

SEQ ID NO: 145328 - protein, 9 aa, Artificial Sequence
  Description of Artificial Sequence: Synthetic peptide
  Seed: GLSNLTHVL (PRAME_HUMAN)
GQSNLTHVW

SEQ ID NO: 145329 - protein, 10 aa, Artificial Sequence
  Description of Artificial Sequence: Synthetic peptide
  Seed: LSVLSLSGVM (PRAME_HUMAN)
LRVLSLSGVF

SEQ ID NO: 145330 - protein, 9 aa, Artificial Sequence
  Description of Artificial Sequence: Synthetic peptide
  Seed: QMINLRRLL (PRAME_HUMAN)
QQINLRRLY

SEQ ID NO: 145331 - protein, 9 aa, Artificial Sequence
  Description of Artificial Sequence: Synthetic peptide
  Seed: HVMNPLETL (PRAME_HUMAN)
HEMNPLETI

SEQ ID NO: 145332 - protein, 9 aa, Artificial Sequence
  Description of Artificial Sequence: Synthetic peptide
  Seed: LSNLTHVLY (PRAME_HUMAN)
LTNLTHVLI

SEQ ID NO: 145333 - protein, 10 aa, Artificial Sequence
  Description of Artificial Sequence: Synthetic peptide
  Seed: ITDDQLLALL (PRAME_HUMAN)
IVDDQLLALL

SEQ ID NO: 145334 - protein, 9 aa, Artificial Sequence
  Description of Artificial Sequence: Synthetic peptide
  Seed: FAMPMQDIK (PRAME_HUMAN)
FTMPMQDIR

SEQ ID NO: 145335 - protein, 10 aa, Artificial Sequence
  Description of Artificial Sequence: Synthetic peptide
  Seed: LLPRELFPPL (PRAME_HUMAN)
LDPRELFPPL

SEQ ID NO: 145336 - protein, 10 aa, Artificial Sequence
  Description of Artificial Sequence: Synthetic peptide
  Seed: SLLQHLIGLS (PRAME_HUMAN)
SLLQHLIGLA

SEQ ID NO: 145337 - protein, 11 aa, Artificial Sequence
  Description of Artificial Sequence: Synthetic peptide
  Seed: HLSQSPSVSQL (PRAME_HUMAN)
HMSQSPSVSQF

SEQ ID NO: 145338 - protein, 9 aa, Artificial Sequence
  Description of Artificial Sequence: Synthetic peptide
  Seed: QFTSQFLSL (PRAME_HUMAN)
QATSQFLSM

SEQ ID NO: 145339 - protein, 10 aa, Artificial Sequence
  Description of Artificial Sequence: Synthetic peptide
  Seed: DQLLALLPSL (PRAME_HUMAN)
DSLLALLPSV

SEQ ID NO: 145340 - protein, 9 aa, Artificial Sequence
  Description of Artificial Sequence: Synthetic peptide
  Seed: SISALQSLL (PRAME_HUMAN)
STSALQSLR

SEQ ID NO: 145341 - protein, 10 aa, Artificial Sequence
  Description of Artificial Sequence: Synthetic peptide
  Seed: RLWGSIQSRY (PRAME_HUMAN)
RQWGSIQSRF

SEQ ID NO: 145342 - protein, 11 aa, Artificial Sequence
  Description of Artificial Sequence: Synthetic peptide
  Seed: VQLDSIEDLEV (PRAME_HUMAN)
VQLDSIEDLEW

SEQ ID NO: 145343 - protein, 9 aa, Artificial Sequence
  Description of Artificial Sequence: Synthetic peptide
  Seed: LFPPLFMAA (PRAME_HUMAN)
LYPPLFMAV

SEQ ID NO: 145344 - protein, 9 aa, Artificial Sequence
  Description of Artificial Sequence: Synthetic peptide
  Seed: LEVTCTWKL (PRAME_HUMAN)
LEVTCTWKW

SEQ ID NO: 145345 - protein, 9 aa, Artificial Sequence
  Description of Artificial Sequence: Synthetic peptide
  Seed: YIAQFTSQF (PRAME_HUMAN)
YAAQFTSQW

SEQ ID NO: 145346 - protein, 10 aa, Artificial Sequence
  Description of Artificial Sequence: Synthetic peptide
  Seed: LQALYVDSLF (PRAME_HUMAN)
LQALYVDSLY

SEQ ID NO: 145347 - protein, 10 aa, Artificial Sequence
  Description of Artificial Sequence: Synthetic peptide
  Seed: ALAIAALELL (PRAME_HUMAN)
AQAIAALELF

SEQ ID NO: 145348 - protein, 9 aa, Artificial Sequence
  Description of Artificial Sequence: Synthetic peptide
  Seed: TLAKFSPYL (PRAME_HUMAN)
TMAKFSPYC

SEQ ID NO: 145349 - protein, 10 aa, Artificial Sequence
  Description of Artificial Sequence: Synthetic peptide
  Seed: RLSEGDVMHL (PRAME_HUMAN)
RQSEGDVMHL

SEQ ID NO: 145350 - protein, 11 aa, Artificial Sequence
  Description of Artificial Sequence: Synthetic peptide
  Seed: RRLWGSIQSRY (PRAME_HUMAN)
RRLWGSIQSRM

SEQ ID NO: 145351 - protein, 10 aa, Artificial Sequence
  Description of Artificial Sequence: Synthetic peptide
  Seed: FLRGRLDQLL (PRAME_HUMAN)
FMRGRLDQLL

SEQ ID NO: 145352 - protein, 9 aa, Artificial Sequence
  Description of Artificial Sequence: Synthetic peptide
  Seed: WLSANPCPH (PRAME_HUMAN)
WMSANPCPM

SEQ ID NO: 145353 - protein, 9 aa, Artificial Sequence
  Description of Artificial Sequence: Synthetic peptide
  Seed: SVLSLSGVM (PRAME_HUMAN)
SRLSLSGVF

SEQ ID NO: 145354 - protein, 9 aa, Artificial Sequence
  Description of Artificial Sequence: Synthetic peptide
  Seed: YIAQFTSQF (PRAME_HUMAN)
YFAQFTSQL

SEQ ID NO: 145355 - protein, 9 aa, Artificial Sequence
  Description of Artificial Sequence: Synthetic peptide
  Seed: KVDGLSTEA (PRAME_HUMAN)
KTDGLSTEM

SEQ ID NO: 145356 - protein, 11 aa, Artificial Sequence
  Description of Artificial Sequence: Synthetic peptide
  Seed: MLTDVSPEPLQ (PRAME_HUMAN)
MLTDVSPEPLL

SEQ ID NO: 145357 - protein, 9 aa, Artificial Sequence
  Description of Artificial Sequence: Synthetic peptide
  Seed: EAAQPMTKK (PRAME_HUMAN)
ETAQPMTKF

SEQ ID NO: 145358 - protein, 10 aa, Artificial Sequence
  Description of Artificial Sequence: Synthetic peptide
  Seed: QSLLQHLIGL (PRAME_HUMAN)
QRLLQHLIGI

SEQ ID NO: 145359 - protein, 9 aa, Artificial Sequence
  Description of Artificial Sequence: Synthetic peptide
  Seed: RLCCKKLKI (PRAME_HUMAN)
RICCKKLKY

SEQ ID NO: 145360 - protein, 10 aa, Artificial Sequence
  Description of Artificial Sequence: Synthetic peptide
  Seed: VLYPVPLESY (PRAME_HUMAN)
VKYPVPLESF

SEQ ID NO: 145361 - protein, 9 aa, Artificial Sequence
  Description of Artificial Sequence: Synthetic peptide
  Seed: LDSIEDLEV (PRAME_HUMAN)
LESIEDLEL

SEQ ID NO: 145362 - protein, 9 aa, Artificial Sequence
  Description of Artificial Sequence: Synthetic peptide
  Seed: ALQSLLQHL (PRAME_HUMAN)
ALQSLLQHR

SEQ ID NO: 145363 - protein, 10 aa, Artificial Sequence
  Description of Artificial Sequence: Synthetic peptide
  Seed: IGLSNLTHVL (PRAME_HUMAN)
ILLSNLTHVD

SEQ ID NO: 145364 - protein, 9 aa, Artificial Sequence
  Description of Artificial Sequence: Synthetic peptide
  Seed: FLRGRLDQL (PRAME_HUMAN)
FARGRLDQV

SEQ ID NO: 145365 - protein, 9 aa, Artificial Sequence
  Description of Artificial Sequence: Synthetic peptide
  Seed: ITDDQLLAL (PRAME_HUMAN)
IWDDQLLAL

SEQ ID NO: 145366 - protein, 8 aa, Artificial Sequence
  Description of Artificial Sequence: Synthetic peptide
  Seed: VSPEPLQA (PRAME_HUMAN)
VMPEPLQL

SEQ ID NO: 145367 - protein, 10 aa, Artificial Sequence
  Description of Artificial Sequence: Synthetic peptide
  Seed: ESYEDIHGTL (PRAME_HUMAN)
ESYEDIHGTI

SEQ ID NO: 145368 - protein, 9 aa, Artificial Sequence
  Description of Artificial Sequence: Synthetic peptide
  Seed: HLETFKAVL (PRAME_HUMAN)
HAETFKAVY

SEQ ID NO: 145369 - protein, 9 aa, Artificial Sequence
  Description of Artificial Sequence: Synthetic peptide
  Seed: SRYISMSVW (PRAME_HUMAN)
SHYISMSVF

SEQ ID NO: 145370 - protein, 10 aa, Artificial Sequence
  Description of Artificial Sequence: Synthetic peptide
  Seed: SPSVSQLSVL (PRAME_HUMAN)
SFSVSQLSVY

SEQ ID NO: 145371 - protein, 11 aa, Artificial Sequence
  Description of Artificial Sequence: Synthetic peptide
  Seed: FYDPEPILCPC (PRAME_HUMAN)
FYDPEPILCPM

SEQ ID NO: 145372 - protein, 9 aa, Artificial Sequence
  Description of Artificial Sequence: Synthetic peptide
  Seed: RRLLLSHIH (PRAME_HUMAN)
RRLLLSHIR

SEQ ID NO: 145373 - protein, 10 aa, Artificial Sequence
  Description of Artificial Sequence: Synthetic peptide
  Seed: RASATLQDLV (PRAME_HUMAN)
RYSATLQDLF

SEQ ID NO: 145374 - protein, 9 aa, Artificial Sequence
  Description of Artificial Sequence: Synthetic peptide
  Seed: YISMSVWTS (PRAME_HUMAN)
YTSMSVWTL

SEQ ID NO: 145375 - protein, 10 aa, Artificial Sequence
  Description of Artificial Sequence: Synthetic peptide
  Seed: ISMSVWTSPR (PRAME_HUMAN)
IIMSVWTSPR

SEQ ID NO: 145376 - protein, 10 aa, Artificial Sequence
  Description of Artificial Sequence: Synthetic peptide
  Seed: YIAQFTSQFL (PRAME_HUMAN)
YVAQFTSQFI

SEQ ID NO: 145377 - protein, 9 aa, Artificial Sequence
  Description of Artificial Sequence: Synthetic peptide
  Seed: KFSPYLGQM (PRAME_HUMAN)
KASPYLGQM

SEQ ID NO: 145378 - protein, 9 aa, Artificial Sequence
  Description of Artificial Sequence: Synthetic peptide
  Seed: LTDVSPEPL (PRAME_HUMAN)
LWDVSPEPM

SEQ ID NO: 145379 - protein, 9 aa, Artificial Sequence
  Description of Artificial Sequence: Synthetic peptide
  Seed: NSHQDFWTV (PRAME_HUMAN)
NTHQDFWTY

SEQ ID NO: 145380 - protein, 9 aa, Artificial Sequence
  Description of Artificial Sequence: Synthetic peptide
  Seed: QSRYISMSV (PRAME_HUMAN)
QARYISMSV

SEQ ID NO: 145381 - protein, 10 aa, Artificial Sequence
  Description of Artificial Sequence: Synthetic peptide
  Seed: DQLLALLPSL (PRAME_HUMAN)
DFLLALLPSA

SEQ ID NO: 145382 - protein, 9 aa, Artificial Sequence
  Description of Artificial Sequence: Synthetic peptide
  Seed: AMVQAWPFT (PRAME_HUMAN)
AMVQAWPFL

SEQ ID NO: 145383 - protein, 11 aa, Artificial Sequence
  Description of Artificial Sequence: Synthetic peptide
  Seed: LQSLLQHLIGL (PRAME_HUMAN)
LYSLLQHLIGV

SEQ ID NO: 145384 - protein, 9 aa, Artificial Sequence
  Description of Artificial Sequence: Synthetic peptide
  Seed: YPVPLESYE (PRAME_HUMAN)
YPVPLESYF

SEQ ID NO: 145385 - protein, 10 aa, Artificial Sequence
  Description of Artificial Sequence: Synthetic peptide
  Seed: MERRRLWGSI (PRAME_HUMAN)
MQRRRLWGSM

SEQ ID NO: 145386 - protein, 10 aa, Artificial Sequence
  Description of Artificial Sequence: Synthetic peptide
  Seed: SPSVSQLSVL (PRAME_HUMAN)
SHSVSQLSVW

SEQ ID NO: 145387 - protein, 10 aa, Artificial Sequence
  Description of Artificial Sequence: Synthetic peptide
  Seed: ALYVDSLFFL (PRAME_HUMAN)
AYYVDSLFFW

SEQ ID NO: 145388 - protein, 10 aa, Artificial Sequence
  Description of Artificial Sequence: Synthetic peptide
  Seed: ITDDQLLALL (PRAME_HUMAN)
ITDDQLLALY

SEQ ID NO: 145389 - protein, 9 aa, Artificial Sequence
  Description of Artificial Sequence: Synthetic peptide
  Seed: FLSLQCLQA (PRAME_HUMAN)
FMSLQCLQL

SEQ ID NO: 145390 - protein, 9 aa, Artificial Sequence
  Description of Artificial Sequence: Synthetic peptide
  Seed: LQCLQALYV (PRAME_HUMAN)
LMCLQALYI

SEQ ID NO: 145391 - protein, 11 aa, Artificial Sequence
  Description of Artificial Sequence: Synthetic peptide
  Seed: CRLSEGDVMHL (PRAME_HUMAN)
CFLSEGDVMHV

SEQ ID NO: 145392 - protein, 10 aa, Artificial Sequence
  Description of Artificial Sequence: Synthetic peptide
  Seed: VTCTWKLPTL (PRAME_HUMAN)
VICTWKLPTL

SEQ ID NO: 145393 - protein, 8 aa, Artificial Sequence
  Description of Artificial Sequence: Synthetic peptide
  Seed: LAYLHARL (PRAME_HUMAN)
LQYLHARV

SEQ ID NO: 145394 - protein, 9 aa, Artificial Sequence
  Description of Artificial Sequence: Synthetic peptide
  Seed: KAMVQAWPF (PRAME_HUMAN)
KQMVQAWPH

SEQ ID NO: 145395 - protein, 9 aa, Artificial Sequence
  Description of Artificial Sequence: Synthetic peptide
  Seed: THVLYPVPL (PRAME_HUMAN)
THVLYPVPI

SEQ ID NO: 145396 - protein, 9 aa, Artificial Sequence
  Description of Artificial Sequence: Synthetic peptide
  Seed: EPLQALLER (PRAME_HUMAN)
ETLQALLEY

SEQ ID NO: 145397 - protein, 9 aa, Artificial Sequence
  Description of Artificial Sequence: Synthetic peptide
  Seed: RASATLQDL (PRAME_HUMAN)
RISATLQDY

SEQ ID NO: 145398 - protein, 9 aa, Artificial Sequence
  Description of Artificial Sequence: Synthetic peptide
  Seed: SFYGNSISI (PRAME_HUMAN)
SEYGNSISF

SEQ ID NO: 145399 - protein, 10 aa, Artificial Sequence
  Description of Artificial Sequence: Synthetic peptide
  Seed: GSIQSRYISM (PRAME_HUMAN)
GTIQSRYISF

SEQ ID NO: 145400 - protein, 9 aa, Artificial Sequence
  Description of Artificial Sequence: Synthetic peptide
  Seed: YLHARLREL (PRAME_HUMAN)
YMHARLREY

SEQ ID NO: 145401 - protein, 9 aa, Artificial Sequence
  Description of Artificial Sequence: Synthetic peptide
  Seed: LMKGQHLHL (PRAME_HUMAN)
LSKGQHLHK

SEQ ID NO: 145402 - protein, 9 aa, Artificial Sequence
  Description of Artificial Sequence: Synthetic peptide
  Seed: CKKLKIFAM (PRAME_HUMAN)
CSKLKIFAL

SEQ ID NO: 145403 - protein, 9 aa, Artificial Sequence
  Description of Artificial Sequence: Synthetic peptide
  Seed: VSPEPLQAL (PRAME_HUMAN)
VCPEPLQAV

SEQ ID NO: 145404 - protein, 10 aa, Artificial Sequence
  Description of Artificial Sequence: Synthetic peptide
  Seed: GLSNLTHVLY (PRAME_HUMAN)
GASNLTHVLY

SEQ ID NO: 145405 - protein, 9 aa, Artificial Sequence
  Description of Artificial Sequence: Synthetic peptide
  Seed: FLRGRLDQL (PRAME_HUMAN)
FTRGRLDQY

SEQ ID NO: 145406 - protein, 10 aa, Artificial Sequence
  Description of Artificial Sequence: Synthetic peptide
  Seed: LSVLSLSGVM (PRAME_HUMAN)
LHVLSLSGVY

SEQ ID NO: 145407 - protein, 10 aa, Artificial Sequence
  Description of Artificial Sequence: Synthetic peptide
  Seed: YIAQFTSQFL (PRAME_HUMAN)
YYAQFTSQFY

SEQ ID NO: 145408 - protein, 10 aa, Artificial Sequence
  Description of Artificial Sequence: Synthetic peptide
  Seed: ESYEDIHGTL (PRAME_HUMAN)
EMYEDIHGTW

SEQ ID NO: 145409 - protein, 9 aa, Artificial Sequence
  Description of Artificial Sequence: Synthetic peptide
  Seed: TLKAMVQAW (PRAME_HUMAN)
TLKAMVQAY

SEQ ID NO: 145410 - protein, 9 aa, Artificial Sequence
  Description of Artificial Sequence: Synthetic peptide
  Seed: VLDGLDVLL (PRAME_HUMAN)
VTDGLDVLW

SEQ ID NO: 145411 - protein, 11 aa, Artificial Sequence
  Description of Artificial Sequence: Synthetic peptide
  Seed: IQSRYISMSVW (PRAME_HUMAN)
ISSRYISMSVW

SEQ ID NO: 145412 - protein, 9 aa, Artificial Sequence
  Description of Artificial Sequence: Synthetic peptide
  Seed: LALLPSLSH (PRAME_HUMAN)
LRLLPSLSM

SEQ ID NO: 145413 - protein, 9 aa, Artificial Sequence
  Description of Artificial Sequence: Synthetic peptide
  Seed: TDDQLLALL (PRAME_HUMAN)
TGDQLLALF

SEQ ID NO: 145414 - protein, 9 aa, Artificial Sequence
  Description of Artificial Sequence: Synthetic peptide
  Seed: RLRELLCEL (PRAME_HUMAN)
RYRELLCEV

SEQ ID NO: 145415 - protein, 9 aa, Artificial Sequence
  Description of Artificial Sequence: Synthetic peptide
  Seed: SATLQDLVF (PRAME_HUMAN)
SQTLQDLVM

SEQ ID NO: 145416 - protein, 10 aa, Artificial Sequence
  Description of Artificial Sequence: Synthetic peptide
  Seed: LKAMVQAWPF (PRAME_HUMAN)
LRAMVQAWPY

SEQ ID NO: 145417 - protein, 9 aa, Artificial Sequence
  Description of Artificial Sequence: Synthetic peptide
  Seed: GNRASLYSF (PRAME_HUMAN)
GVRASLYSF

SEQ ID NO: 145418 - protein, 10 aa, Artificial Sequence
  Description of Artificial Sequence: Synthetic peptide
  Seed: SISISALQSL (PRAME_HUMAN)
SCSISALQSY

SEQ ID NO: 145419 - protein, 9 aa, Artificial Sequence
  Description of Artificial Sequence: Synthetic peptide
  Seed: YIAQFTSQF (PRAME_HUMAN)
YMAQFTSQY

SEQ ID NO: 145420 - protein, 9 aa, Artificial Sequence
  Description of Artificial Sequence: Synthetic peptide
  Seed: RLWGSIQSR (PRAME_HUMAN)
RAWGSIQSY

SEQ ID NO: 145421 - protein, 9 aa, Artificial Sequence
  Description of Artificial Sequence: Synthetic peptide
  Seed: ITDDQLLAL (PRAME_HUMAN)
ISDDQLLAV

SEQ ID NO: 145422 - protein, 10 aa, Artificial Sequence
  Description of Artificial Sequence: Synthetic peptide
  Seed: RGRLDQLLRH (PRAME_HUMAN)
RMRLDQLLRK

SEQ ID NO: 145423 - protein, 10 aa, Artificial Sequence
  Description of Artificial Sequence: Synthetic peptide
  Seed: IGLSNLTHVL (PRAME_HUMAN)
IDLSNLTHVI

SEQ ID NO: 145424 - protein, 9 aa, Artificial Sequence
  Description of Artificial Sequence: Synthetic peptide
  Seed: LAIAALELL (PRAME_HUMAN)
LMIAALELW

SEQ ID NO: 145425 - protein, 10 aa, Artificial Sequence
  Description of Artificial Sequence: Synthetic peptide
  Seed: KKLKIFAMPM (PRAME_HUMAN)
KALKIFAMPF

SEQ ID NO: 145426 - protein, 10 aa, Artificial Sequence
  Description of Artificial Sequence: Synthetic peptide
  Seed: RHVMNPLETL (PRAME_HUMAN)
RQVMNPLETF

SEQ ID NO: 145427 - protein, 9 aa, Artificial Sequence
  Description of Artificial Sequence: Synthetic peptide
  Seed: CKKLKIFAM (PRAME_HUMAN)
CKKLKIFAL

SEQ ID NO: 145428 - protein, 9 aa, Artificial Sequence
  Description of Artificial Sequence: Synthetic peptide
  Seed: KLKIFAMPM (PRAME_HUMAN)
KNKIFAMPF

SEQ ID NO: 145429 - protein, 9 aa, Artificial Sequence
  Description of Artificial Sequence: Synthetic peptide
  Seed: TLAKFSPYL (PRAME_HUMAN)
TAAKFSPYV

SEQ ID NO: 145430 - protein, 10 aa, Artificial Sequence
  Description of Artificial Sequence: Synthetic peptide
  Seed: ARLRELLCEL (PRAME_HUMAN)
ATLRELLCEL

SEQ ID NO: 145431 - protein, 9 aa, Artificial Sequence
  Description of Artificial Sequence: Synthetic peptide
  Seed: TLSFYGNSI (PRAME_HUMAN)
TLSFYGNSV

SEQ ID NO: 145432 - protein, 10 aa, Artificial Sequence
  Description of Artificial Sequence: Synthetic peptide
  Seed: SGNRASLYSF (PRAME_HUMAN)
SQNRASLYSF

SEQ ID NO: 145433 - protein, 9 aa, Artificial Sequence
  Description of Artificial Sequence: Synthetic peptide
  Seed: VSQLSVLSL (PRAME_HUMAN)
VHQLSVLSF

SEQ ID NO: 145434 - protein, 10 aa, Artificial Sequence
  Description of Artificial Sequence: Synthetic peptide
  Seed: TSQFLSLQCL (PRAME_HUMAN)
TQQFLSLQCY

SEQ ID NO: 145435 - protein, 10 aa, Artificial Sequence
  Description of Artificial Sequence: Synthetic peptide
  Seed: ISMSVWTSPR (PRAME_HUMAN)
IFMSVWTSPK

SEQ ID NO: 145436 - protein, 11 aa, Artificial Sequence
  Description of Artificial Sequence: Synthetic peptide
  Seed: IAQFTSQFLSL (PRAME_HUMAN)
ISQFTSQFLSF

SEQ ID NO: 145437 - protein, 10 aa, Artificial Sequence
  Description of Artificial Sequence: Synthetic peptide
  Seed: LSFYGNSISI (PRAME_HUMAN)
LQFYGNSISM

SEQ ID NO: 145438 - protein, 8 aa, Artificial Sequence
  Description of Artificial Sequence: Synthetic peptide
  Seed: YVDSLFFL (PRAME_HUMAN)
YIDSLFFL

SEQ ID NO: 145439 - protein, 9 aa, Artificial Sequence
  Description of Artificial Sequence: Synthetic peptide
  Seed: ESYEDIHGT (PRAME_HUMAN)
ETYEDIHGV

SEQ ID NO: 145440 - protein, 9 aa, Artificial Sequence
  Description of Artificial Sequence: Synthetic peptide
  Seed: SQSPSVSQL (PRAME_HUMAN)
SCSPSVSQL

SEQ ID NO: 145441 - protein, 9 aa, Artificial Sequence
  Description of Artificial Sequence: Synthetic peptide
  Seed: NSISISALQ (PRAME_HUMAN)
NQISISALR

SEQ ID NO: 145442 - protein, 9 aa, Artificial Sequence
  Description of Artificial Sequence: Synthetic peptide
  Seed: SQSPSVSQL (PRAME_HUMAN)
SFSPSVSQM

SEQ ID NO: 145443 - protein, 9 aa, Artificial Sequence
  Description of Artificial Sequence: Synthetic peptide
  Seed: VSPEPLQAL (PRAME_HUMAN)
VCPEPLQAL

SEQ ID NO: 145444 - protein, 9 aa, Artificial Sequence
  Description of Artificial Sequence: Synthetic peptide
  Seed: CKKLKIFAM (PRAME_HUMAN)
CMKLKIFAA

SEQ ID NO: 145445 - protein, 8 aa, Artificial Sequence
  Description of Artificial Sequence: Synthetic peptide
  Seed: YVDSLFFL (PRAME_HUMAN)
YIDSLFFI

SEQ ID NO: 145446 - protein, 9 aa, Artificial Sequence
  Description of Artificial Sequence: Synthetic peptide
  Seed: HVMNPLETL (PRAME_HUMAN)
HEMNPLETT

SEQ ID NO: 145447 - protein, 10 aa, Artificial Sequence
  Description of Artificial Sequence: Synthetic peptide
  Seed: ALYVDSLFFL (PRAME_HUMAN)
AVYVDSLFFM

SEQ ID NO: 145448 - protein, 10 aa, Artificial Sequence
  Description of Artificial Sequence: Synthetic peptide
  Seed: AQFTSQFLSL (PRAME_HUMAN)
AAFTSQFLSF

SEQ ID NO: 145449 - protein, 10 aa, Artificial Sequence
  Description of Artificial Sequence: Synthetic peptide
  Seed: YSFPEPEAAQ (PRAME_HUMAN)
YIFPEPEAAL

SEQ ID NO: 145450 - protein, 11 aa, Artificial Sequence
  Description of Artificial Sequence: Synthetic peptide
  Seed: IQSRYISMSVW (PRAME_HUMAN)
ITSRYISMSVY

SEQ ID NO: 145451 - protein, 9 aa, Artificial Sequence
  Description of Artificial Sequence: Synthetic peptide
  Seed: ALQSLLQHL (PRAME_HUMAN)
AMQSLLQHI

SEQ ID NO: 145452 - protein, 8 aa, Artificial Sequence
  Description of Artificial Sequence: Synthetic peptide
  Seed: FTSQFLSL (PRAME_HUMAN)
FSSQFLSF

SEQ ID NO: 145453 - protein, 9 aa, Artificial Sequence
  Description of Artificial Sequence: Synthetic peptide
  Seed: GRHSQTLKA (PRAME_HUMAN)
GHHSQTLKA

SEQ ID NO: 145454 - protein, 10 aa, Artificial Sequence
  Description of Artificial Sequence: Synthetic peptide
  Seed: TCLPLGVLMK (PRAME_HUMAN)
TTLPLGVLMK

SEQ ID NO: 145455 - protein, 10 aa, Artificial Sequence
  Description of Artificial Sequence: Synthetic peptide
  Seed: IQSRYISMSV (PRAME_HUMAN)
IVSRYISMSV

SEQ ID NO: 145456 - protein, 9 aa, Artificial Sequence
  Description of Artificial Sequence: Synthetic peptide
  Seed: LRKNSHQDF (PRAME_HUMAN)
LKKNSHQDF

SEQ ID NO: 145457 - protein, 10 aa, Artificial Sequence
  Description of Artificial Sequence: Synthetic peptide
  Seed: AVLDGLDVLL (PRAME_HUMAN)
AQLDGLDVLL

SEQ ID NO: 145458 - protein, 9 aa, Artificial Sequence
  Description of Artificial Sequence: Synthetic peptide
  Seed: KMILKMVQL (PRAME_HUMAN)
KRILKMVQL

SEQ ID NO: 145459 - protein, 9 aa, Artificial Sequence
  Description of Artificial Sequence: Synthetic peptide
  Seed: FYDPEPILC (PRAME_HUMAN)
FLDPEPILL

SEQ ID NO: 145460 - protein, 9 aa, Artificial Sequence
  Description of Artificial Sequence: Synthetic peptide
  Seed: KNVLRLCCK (PRAME_HUMAN)
KTVLRLCCR

SEQ ID NO: 145461 - protein, 9 aa, Artificial Sequence
  Description of Artificial Sequence: Synthetic peptide
  Seed: QSLLKDEAL (PRAME_HUMAN)
QVLLKDEAY

SEQ ID NO: 145462 - protein, 9 aa, Artificial Sequence
  Description of Artificial Sequence: Synthetic peptide
  Seed: SQSPSVSQL (PRAME_HUMAN)
SHSPSVSQF

SEQ ID NO: 145463 - protein, 9 aa, Artificial Sequence
  Description of Artificial Sequence: Synthetic peptide
  Seed: HVMNPLETL (PRAME_HUMAN)
HPMNPLETW

SEQ ID NO: 145464 - protein, 11 aa, Artificial Sequence
  Description of Artificial Sequence: Synthetic peptide
  Seed: RRLWGSIQSRY (PRAME_HUMAN)
RRLWGSIQSRR

SEQ ID NO: 145465 - protein, 9 aa, Artificial Sequence
  Description of Artificial Sequence: Synthetic peptide
  Seed: SMVWLSANP (PRAME_HUMAN)
SLVWLSANL

SEQ ID NO: 145466 - protein, 10 aa, Artificial Sequence
  Description of Artificial Sequence: Synthetic peptide
  Seed: ARLRELLCEL (PRAME_HUMAN)
AMLRELLCEV

SEQ ID NO: 145467 - protein, 9 aa, Artificial Sequence
  Description of Artificial Sequence: Synthetic peptide
  Seed: GQHLHLETF (PRAME_HUMAN)
GEHLHLETL

SEQ ID NO: 145468 - protein, 9 aa, Artificial Sequence
  Description of Artificial Sequence: Synthetic peptide
  Seed: YISMSVWTS (PRAME_HUMAN)
YASMSVWTI

SEQ ID NO: 145469 - protein, 9 aa, Artificial Sequence
  Description of Artificial Sequence: Synthetic peptide
  Seed: KEEQYIAQF (PRAME_HUMAN)
KEEQYIAQM

SEQ ID NO: 145470 - protein, 9 aa, Artificial Sequence
  Description of Artificial Sequence: Synthetic peptide
  Seed: QSRYISMSV (PRAME_HUMAN)
QSRYISMSL

SEQ ID NO: 145471 - protein, 10 aa, Artificial Sequence
  Description of Artificial Sequence: Synthetic peptide
  Seed: ARLRELLCEL (PRAME_HUMAN)
ACLRELLCEV

SEQ ID NO: 145472 - protein, 10 aa, Artificial Sequence
  Description of Artificial Sequence: Synthetic peptide
  Seed: KKLKIFAMPM (PRAME_HUMAN)
KRLKIFAMPM

SEQ ID NO: 145473 - protein, 10 aa, Artificial Sequence
  Description of Artificial Sequence: Synthetic peptide
  Seed: LSVLSLSGVM (PRAME_HUMAN)
LSVLSLSGVF

SEQ ID NO: 145474 - protein, 9 aa, Artificial Sequence
  Description of Artificial Sequence: Synthetic peptide
  Seed: ITDDQLLAL (PRAME_HUMAN)
IMDDQLLAY

SEQ ID NO: 145475 - protein, 9 aa, Artificial Sequence
  Description of Artificial Sequence: Synthetic peptide
  Seed: VPLESYEDI (PRAME_HUMAN)
VPLESYEDW

SEQ ID NO: 145476 - protein, 9 aa, Artificial Sequence
  Description of Artificial Sequence: Synthetic peptide
  Seed: LSNLTHVLY (PRAME_HUMAN)
LPNLTHVLY

SEQ ID NO: 145477 - protein, 10 aa, Artificial Sequence
  Description of Artificial Sequence: Synthetic peptide
  Seed: ARLRELLCEL (PRAME_HUMAN)
AMLRELLCEI

SEQ ID NO: 145478 - protein, 11 aa, Artificial Sequence
  Description of Artificial Sequence: Synthetic peptide
  Seed: MKGQHLHLETF (PRAME_HUMAN)
MSGQHLHLETY

SEQ ID NO: 145479 - protein, 11 aa, Artificial Sequence
  Description of Artificial Sequence: Synthetic peptide
  Seed: TDVSPEPLQAL (PRAME_HUMAN)
TEVSPEPLQAA

SEQ ID NO: 145480 - protein, 9 aa, Artificial Sequence
  Description of Artificial Sequence: Synthetic peptide
  Seed: YSFPEPEAA (PRAME_HUMAN)
YPFPEPEAM

SEQ ID NO: 145481 - protein, 10 aa, Artificial Sequence
  Description of Artificial Sequence: Synthetic peptide
  Seed: RLWGSIQSRY (PRAME_HUMAN)
RHWGSIQSRF

SEQ ID NO: 145482 - protein, 10 aa, Artificial Sequence
  Description of Artificial Sequence: Synthetic peptide
  Seed: RRWKLQVLDL (PRAME_HUMAN)
RRWKLQVLDI

SEQ ID NO: 145483 - protein, 9 aa, Artificial Sequence
  Description of Artificial Sequence: Synthetic peptide
  Seed: YISMSVWTS (PRAME_HUMAN)
YQSMSVWTI

SEQ ID NO: 145484 - protein, 9 aa, Artificial Sequence
  Description of Artificial Sequence: Synthetic peptide
  Seed: SLLQHLIGL (PRAME_HUMAN)
SQLQHLIGY

SEQ ID NO: 145485 - protein, 10 aa, Artificial Sequence
  Description of Artificial Sequence: Synthetic peptide
  Seed: YSFPEPEAAQ (PRAME_HUMAN)
YMFPEPEAAF

SEQ ID NO: 145486 - protein, 11 aa, Artificial Sequence
  Description of Artificial Sequence: Synthetic peptide
  Seed: AEQPFIPVEVL (PRAME_HUMAN)
AEQPFIPVEVM

SEQ ID NO: 145487 - protein, 10 aa, Artificial Sequence
  Description of Artificial Sequence: Synthetic peptide
  Seed: RTFYDPEPIL (PRAME_HUMAN)
RSFYDPEPIF

SEQ ID NO: 145488 - protein, 10 aa, Artificial Sequence
  Description of Artificial Sequence: Synthetic peptide
  Seed: MNPLETLSIT (PRAME_HUMAN)
MWPLETLSIA

SEQ ID NO: 145489 - protein, 9 aa, Artificial Sequence
  Description of Artificial Sequence: Synthetic peptide
  Seed: DEALAIAAL (PRAME_HUMAN)
DAALAIAAF

SEQ ID NO: 145490 - protein, 9 aa, Artificial Sequence
  Description of Artificial Sequence: Synthetic peptide
  Seed: SHCSQLTTL (PRAME_HUMAN)
SVCSQLTTL

SEQ ID NO: 145491 - protein, 9 aa, Artificial Sequence
  Description of Artificial Sequence: Synthetic peptide
  Seed: SIQSRYISM (PRAME_HUMAN)
SYQSRYISL

SEQ ID NO: 145492 - protein, 10 aa, Artificial Sequence
  Description of Artificial Sequence: Synthetic peptide
  Seed: RLWGSIQSRY (PRAME_HUMAN)
RMWGSIQSRF

SEQ ID NO: 145493 - protein, 9 aa, Artificial Sequence
  Description of Artificial Sequence: Synthetic peptide
  Seed: FAMPMQDIK (PRAME_HUMAN)
FAMPMQDIM

SEQ ID NO: 145494 - protein, 9 aa, Artificial Sequence
  Description of Artificial Sequence: Synthetic peptide
  Seed: MINLRRLLL (PRAME_HUMAN)
MLNLRRLLY

SEQ ID NO: 145495 - protein, 10 aa, Artificial Sequence
  Description of Artificial Sequence: Synthetic peptide
  Seed: QMINLRRLLL (PRAME_HUMAN)
QMINLRRLLV

SEQ ID NO: 145496 - protein, 9 aa, Artificial Sequence
  Description of Artificial Sequence: Synthetic peptide
  Seed: FYDPEPILC (PRAME_HUMAN)
FIDPEPILL

SEQ ID NO: 145497 - protein, 10 aa, Artificial Sequence
  Description of Artificial Sequence: Synthetic peptide
  Seed: YSFPEPEAAQ (PRAME_HUMAN)
YTFPEPEAAL

SEQ ID NO: 145498 - protein, 11 aa, Artificial Sequence
  Description of Artificial Sequence: Synthetic peptide
  Seed: HLSQSPSVSQL (PRAME_HUMAN)
HASQSPSVSQL

SEQ ID NO: 145499 - protein, 9 aa, Artificial Sequence
  Description of Artificial Sequence: Synthetic peptide
  Seed: RLAYLHARL (PRAME_HUMAN)
RAAYLHARF

SEQ ID NO: 145500 - protein, 10 aa, Artificial Sequence
  Description of Artificial Sequence: Synthetic peptide
  Seed: GLSNLTHVLY (PRAME_HUMAN)
GQSNLTHVLF

SEQ ID NO: 145501 - protein, 9 aa, Artificial Sequence
  Description of Artificial Sequence: Synthetic peptide
  Seed: VQLDSIEDL (PRAME_HUMAN)
VLLDSIEDM

SEQ ID NO: 145502 - protein, 9 aa, Artificial Sequence
  Description of Artificial Sequence: Synthetic peptide
  Seed: AVLDGLDVL (PRAME_HUMAN)
AVLDGLDVI

SEQ ID NO: 145503 - protein, 10 aa, Artificial Sequence
  Description of Artificial Sequence: Synthetic peptide
  Seed: GACDELFSYL (PRAME_HUMAN)
GQCDELFSYW

SEQ ID NO: 145504 - protein, 9 aa, Artificial Sequence
  Description of Artificial Sequence: Synthetic peptide
  Seed: VLSLSGVML (PRAME_HUMAN)
VQSLSGVMY

SEQ ID NO: 145505 - protein, 10 aa, Artificial Sequence
  Description of Artificial Sequence: Synthetic peptide
  Seed: RRRLWGSIQS (PRAME_HUMAN)
RNRLWGSIQR

SEQ ID NO: 145506 - protein, 11 aa, Artificial Sequence
  Description of Artificial Sequence: Synthetic peptide
  Seed: FAMPMQDIKMI (PRAME_HUMAN)
FTMPMQDIKMF

SEQ ID NO: 145507 - protein, 9 aa, Artificial Sequence
  Description of Artificial Sequence: Synthetic peptide
  Seed: GACDELFSY (PRAME_HUMAN)
GSCDELFSY

SEQ ID NO: 145508 - protein, 10 aa, Artificial Sequence
  Description of Artificial Sequence: Synthetic peptide
  Seed: CSQLTTLSFY (PRAME_HUMAN)
CHQLTTLSFY

SEQ ID NO: 145509 - protein, 9 aa, Artificial Sequence
  Description of Artificial Sequence: Synthetic peptide
  Seed: LSLQCLQAL (PRAME_HUMAN)
LKLQCLQAF

SEQ ID NO: 145510 - protein, 9 aa, Artificial Sequence
  Description of Artificial Sequence: Synthetic peptide
  Seed: MNPLETLSI (PRAME_HUMAN)
MIPLETLSL

SEQ ID NO: 145511 - protein, 9 aa, Artificial Sequence
  Description of Artificial Sequence: Synthetic peptide
  Seed: VSQLSVLSL (PRAME_HUMAN)
VQQLSVLSL

SEQ ID NO: 145512 - protein, 9 aa, Artificial Sequence
  Description of Artificial Sequence: Synthetic peptide
  Seed: IPVEVLVDL (PRAME_HUMAN)
IPVEVLVDV

SEQ ID NO: 145513 - protein, 9 aa, Artificial Sequence
  Description of Artificial Sequence: Synthetic peptide
  Seed: YIAQFTSQF (PRAME_HUMAN)
YFAQFTSQM

SEQ ID NO: 145514 - protein, 9 aa, Artificial Sequence
  Description of Artificial Sequence: Synthetic peptide
  Seed: MINLRRLLL (PRAME_HUMAN)
MKNLRRLLL

SEQ ID NO: 145515 - protein, 9 aa, Artificial Sequence
  Description of Artificial Sequence: Synthetic peptide
  Seed: SLFFLRGRL (PRAME_HUMAN)
SLFFLRGRV

SEQ ID NO: 145516 - protein, 10 aa, Artificial Sequence
  Description of Artificial Sequence: Synthetic peptide
  Seed: SPYLGQMINL (PRAME_HUMAN)
SVYLGQMINW

SEQ ID NO: 145517 - protein, 9 aa, Artificial Sequence
  Description of Artificial Sequence: Synthetic peptide
  Seed: MHLSQSPSV (PRAME_HUMAN)
MRLSQSPSL

SEQ ID NO: 145518 - protein, 10 aa, Artificial Sequence
  Description of Artificial Sequence: Synthetic peptide
  Seed: SISISALQSL (PRAME_HUMAN)
SESISALQSF

SEQ ID NO: 145519 - protein, 9 aa, Artificial Sequence
  Description of Artificial Sequence: Synthetic peptide
  Seed: MINLRRLLL (PRAME_HUMAN)
MSNLRRLLA

SEQ ID NO: 145520 - protein, 11 aa, Artificial Sequence
  Description of Artificial Sequence: Synthetic peptide
  Seed: AAFDGRHSQTL (PRAME_HUMAN)
ATFDGRHSQTF

SEQ ID NO: 145521 - protein, 9 aa, Artificial Sequence
  Description of Artificial Sequence: Synthetic peptide
  Seed: GACDELFSY (PRAME_HUMAN)
GVCDELFSW

SEQ ID NO: 145522 - protein, 9 aa, Artificial Sequence
  Description of Artificial Sequence: Synthetic peptide
  Seed: VQLDSIEDL (PRAME_HUMAN)
VMLDSIEDY

SEQ ID NO: 145523 - protein, 9 aa, Artificial Sequence
  Description of Artificial Sequence: Synthetic peptide
  Seed: TDDQLLALL (PRAME_HUMAN)
TLDQLLALF

SEQ ID NO: 145524 - protein, 9 aa, Artificial Sequence
  Description of Artificial Sequence: Synthetic peptide
  Seed: VLDGLDVLL (PRAME_HUMAN)
VMDGLDVLW

SEQ ID NO: 145525 - protein, 9 aa, Artificial Sequence
  Description of Artificial Sequence: Synthetic peptide
  Seed: RLCCKKLKI (PRAME_HUMAN)
RTCCKKLKY

SEQ ID NO: 145526 - protein, 11 aa, Artificial Sequence
  Description of Artificial Sequence: Synthetic peptide
  Seed: DVSPEPLQALL (PRAME_HUMAN)
DVSPEPLQALW

SEQ ID NO: 145527 - protein, 9 aa, Artificial Sequence
  Description of Artificial Sequence: Synthetic peptide
  Seed: EDLEVTCTW (PRAME_HUMAN)
EQLEVTCTW

SEQ ID NO: 145528 - protein, 10 aa, Artificial Sequence
  Description of Artificial Sequence: Synthetic peptide
  Seed: VMNPLETLSI (PRAME_HUMAN)
VMNPLETLSY

SEQ ID NO: 145529 - protein, 9 aa, Artificial Sequence
  Description of Artificial Sequence: Synthetic peptide
  Seed: ELFSYLIEK (PRAME_HUMAN)
ETFSYLIEK

SEQ ID NO: 145530 - protein, 10 aa, Artificial Sequence
  Description of Artificial Sequence: Synthetic peptide
  Seed: DQLLALLPSL (PRAME_HUMAN)
DKLLALLPSV

SEQ ID NO: 145531 - protein, 10 aa, Artificial Sequence
  Description of Artificial Sequence: Synthetic peptide
  Seed: FIPVEVLVDL (PRAME_HUMAN)
FWPVEVLVDW

SEQ ID NO: 145532 - protein, 9 aa, Artificial Sequence
  Description of Artificial Sequence: Synthetic peptide
  Seed: ACDELFSYL (PRAME_HUMAN)
AYDELFSYF

SEQ ID NO: 145533 - protein, 9 aa, Artificial Sequence
  Description of Artificial Sequence: Synthetic peptide
  Seed: KLKIFAMPM (PRAME_HUMAN)
KNKIFAMPY

SEQ ID NO: 145534 - protein, 9 aa, Artificial Sequence
  Description of Artificial Sequence: Synthetic peptide
  Seed: RHSQTLKAM (PRAME_HUMAN)
RFSQTLKAM

SEQ ID NO: 145535 - protein, 10 aa, Artificial Sequence
  Description of Artificial Sequence: Synthetic peptide
  Seed: YIAQFTSQFL (PRAME_HUMAN)
YSAQFTSQFI

SEQ ID NO: 145536 - protein, 9 aa, Artificial Sequence
  Description of Artificial Sequence: Synthetic peptide
  Seed: RLDQLLRHV (PRAME_HUMAN)
RQDQLLRHI

SEQ ID NO: 145537 - protein, 10 aa, Artificial Sequence
  Description of Artificial Sequence: Synthetic peptide
  Seed: LPTLAKFSPY (PRAME_HUMAN)
LITLAKFSPF

SEQ ID NO: 145538 - protein, 9 aa, Artificial Sequence
  Description of Artificial Sequence: Synthetic peptide
  Seed: FYDPEPILC (PRAME_HUMAN)
FYDPEPILS

SEQ ID NO: 145539 - protein, 9 aa, Artificial Sequence
  Description of Artificial Sequence: Synthetic peptide
  Seed: LSEGDVMHL (PRAME_HUMAN)
LQEGDVMHW

SEQ ID NO: 145540 - protein, 8 aa, Artificial Sequence
  Description of Artificial Sequence: Synthetic peptide
  Seed: YEDIHGTL (PRAME_HUMAN)
YADIHGTF

SEQ ID NO: 145541 - protein, 9 aa, Artificial Sequence
  Description of Artificial Sequence: Synthetic peptide
  Seed: SYEDIHGTL (PRAME_HUMAN)
SLEDIHGTY

SEQ ID NO: 145542 - protein, 10 aa, Artificial Sequence
  Description of Artificial Sequence: Synthetic peptide
  Seed: RLWGSIQSRY (PRAME_HUMAN)
RQWGSIQSRW

SEQ ID NO: 145543 - protein, 10 aa, Artificial Sequence
  Description of Artificial Sequence: Synthetic peptide
  Seed: ASATLQDLVF (PRAME_HUMAN)
ASATLQDLVY

SEQ ID NO: 145544 - protein, 10 aa, Artificial Sequence
  Description of Artificial Sequence: Synthetic peptide
  Seed: RLVELAGQSL (PRAME_HUMAN)
RMVELAGQSY

SEQ ID NO: 145545 - protein, 10 aa, Artificial Sequence
  Description of Artificial Sequence: Synthetic peptide
  Seed: YIAQFTSQFL (PRAME_HUMAN)
YSAQFTSQFF

SEQ ID NO: 145546 - protein, 10 aa, Artificial Sequence
  Description of Artificial Sequence: Synthetic peptide
  Seed: AMVQAWPFTC (PRAME_HUMAN)
ALVQAWPFTM

SEQ ID NO: 145547 - protein, 9 aa, Artificial Sequence
  Description of Artificial Sequence: Synthetic peptide
  Seed: IFAMPMQDI (PRAME_HUMAN)
IWAMPMQDF

SEQ ID NO: 145548 - protein, 9 aa, Artificial Sequence
  Description of Artificial Sequence: Synthetic peptide
  Seed: STEAEQPFI (PRAME_HUMAN)
SSEAEQPFL

SEQ ID NO: 145549 - protein, 10 aa, Artificial Sequence
  Description of Artificial Sequence: Synthetic peptide
  Seed: VELAGQSLLK (PRAME_HUMAN)
VWLAGQSLLK

SEQ ID NO: 145550 - protein, 10 aa, Artificial Sequence
  Description of Artificial Sequence: Synthetic peptide
  Seed: SALQSLLQHL (PRAME_HUMAN)
SLLQSLLQHI

SEQ ID NO: 145551 - protein, 9 aa, Artificial Sequence
  Description of Artificial Sequence: Synthetic peptide
  Seed: GQHLHLETF (PRAME_HUMAN)
GTHLHLETW

SEQ ID NO: 145552 - protein, 10 aa, Artificial Sequence
  Description of Artificial Sequence: Synthetic peptide
  Seed: QYIAQFTSQF (PRAME_HUMAN)
QAIAQFTSQY

SEQ ID NO: 145553 - protein, 9 aa, Artificial Sequence
  Description of Artificial Sequence: Synthetic peptide
  Seed: TFKAVLDGL (PRAME_HUMAN)
TYKAVLDGL

SEQ ID NO: 145554 - protein, 9 aa, Artificial Sequence
  Description of Artificial Sequence: Synthetic peptide
  Seed: LETLSITNC (PRAME_HUMAN)
LETLSITNI

SEQ ID NO: 145555 - protein, 10 aa, Artificial Sequence
  Description of Artificial Sequence: Synthetic peptide
  Seed: RHVMNPLETL (PRAME_HUMAN)
RMVMNPLETL

SEQ ID NO: 145556 - protein, 11 aa, Artificial Sequence
  Description of Artificial Sequence: Synthetic peptide
  Seed: ALYVDSLFFLR (PRAME_HUMAN)
ALYVDSLFFLV

SEQ ID NO: 145557 - protein, 9 aa, Artificial Sequence
  Description of Artificial Sequence: Synthetic peptide
  Seed: KLKIFAMPM (PRAME_HUMAN)
KMKIFAMPV

SEQ ID NO: 145558 - protein, 8 aa, Artificial Sequence
  Description of Artificial Sequence: Synthetic peptide
  Seed: TLAKFSPY (PRAME_HUMAN)
TQAKFSPY

SEQ ID NO: 145559 - protein, 9 aa, Artificial Sequence
  Description of Artificial Sequence: Synthetic peptide
  Seed: GLSNLTHVL (PRAME_HUMAN)
GQSNLTHVL

SEQ ID NO: 145560 - protein, 10 aa, Artificial Sequence
  Description of Artificial Sequence: Synthetic peptide
  Seed: MERRRLWGSI (PRAME_HUMAN)
MIRRRLWGSM

SEQ ID NO: 145561 - protein, 9 aa, Artificial Sequence
  Description of Artificial Sequence: Synthetic peptide
  Seed: KAMVQAWPF (PRAME_HUMAN)
KRMVQAWPY

SEQ ID NO: 145562 - protein, 9 aa, Artificial Sequence
  Description of Artificial Sequence: Synthetic peptide
  Seed: SIEDLEVTC (PRAME_HUMAN)
SLEDLEVTV

SEQ ID NO: 145563 - protein, 9 aa, Artificial Sequence
  Description of Artificial Sequence: Synthetic peptide
  Seed: ITDDQLLAL (PRAME_HUMAN)
ISDDQLLAA

SEQ ID NO: 145564 - protein, 10 aa, Artificial Sequence
  Description of Artificial Sequence: Synthetic peptide
  Seed: FMAAFDGRHS (PRAME_HUMAN)
FMAAFDGRHM

SEQ ID NO: 145565 - protein, 8 aa, Artificial Sequence
  Description of Artificial Sequence: Synthetic peptide
  Seed: DQLLRHVM (PRAME_HUMAN)
DRLLRHVL

SEQ ID NO: 145566 - protein, 9 aa, Artificial Sequence
  Description of Artificial Sequence: Synthetic peptide
  Seed: VLYPVPLES (PRAME_HUMAN)
VQYPVPLEA

SEQ ID NO: 145567 - protein, 11 aa, Artificial Sequence
  Description of Artificial Sequence: Synthetic peptide
  Seed: KAVLDGLDVLL (PRAME_HUMAN)
KAVLDGLDVLW

SEQ ID NO: 145568 - protein, 10 aa, Artificial Sequence
  Description of Artificial Sequence: Synthetic peptide
  Seed: ARLRELLCEL (PRAME_HUMAN)
ALLRELLCEI

SEQ ID NO: 145569 - protein, 9 aa, Artificial Sequence
  Description of Artificial Sequence: Synthetic peptide
  Seed: TDDQLLALL (PRAME_HUMAN)
TEDQLLALL

SEQ ID NO: 145570 - protein, 9 aa, Artificial Sequence
  Description of Artificial Sequence: Synthetic peptide
  Seed: LRKNSHQDF (PRAME_HUMAN)
LMKNSHQDM

SEQ ID NO: 145571 - protein, 9 aa, Artificial Sequence
  Description of Artificial Sequence: Synthetic peptide
  Seed: KLKIFAMPM (PRAME_HUMAN)
KGKIFAMPA

SEQ ID NO: 145572 - protein, 10 aa, Artificial Sequence
  Description of Artificial Sequence: Synthetic peptide
  Seed: LLLSHIHASS (PRAME_HUMAN)
LWLSHIHASA

SEQ ID NO: 145573 - protein, 9 aa, Artificial Sequence
  Description of Artificial Sequence: Synthetic peptide
  Seed: YSFPEPEAA (PRAME_HUMAN)
YWFPEPEAL

SEQ ID NO: 145574 - protein, 9 aa, Artificial Sequence
  Description of Artificial Sequence: Synthetic peptide
  Seed: ASSYISPEK (PRAME_HUMAN)
AMSYISPEK

SEQ ID NO: 145575 - protein, 9 aa, Artificial Sequence
  Description of Artificial Sequence: Synthetic peptide
  Seed: QALYVDSLF (PRAME_HUMAN)
QMLYVDSLF

SEQ ID NO: 145576 - protein, 11 aa, Artificial Sequence
  Description of Artificial Sequence: Synthetic peptide
  Seed: FLSLQCLQALY (PRAME_HUMAN)
FLSLQCLQALI

SEQ ID NO: 145577 - protein, 9 aa, Artificial Sequence
  Description of Artificial Sequence: Synthetic peptide
  Seed: SHIHASSYI (PRAME_HUMAN)
SQIHASSYV

SEQ ID NO: 145578 - protein, 10 aa, Artificial Sequence
  Description of Artificial Sequence: Synthetic peptide
  Seed: TSQFLSLQCL (PRAME_HUMAN)
TDQFLSLQCF

SEQ ID NO: 145579 - protein, 9 aa, Artificial Sequence
  Description of Artificial Sequence: Synthetic peptide
  Seed: ISPEKEEQY (PRAME_HUMAN)
IWPEKEEQF

SEQ ID NO: 145580 - protein, 10 aa, Artificial Sequence
  Description of Artificial Sequence: Synthetic peptide
  Seed: RHVMNPLETL (PRAME_HUMAN)
RLVMNPLETI

SEQ ID NO: 145581 - protein, 10 aa, Artificial Sequence
  Description of Artificial Sequence: Synthetic peptide
  Seed: GRPSMVWLSA (PRAME_HUMAN)
GMPSMVWLSL

SEQ ID NO: 145582 - protein, 9 aa, Artificial Sequence
  Description of Artificial Sequence: Synthetic peptide
  Seed: YIAQFTSQF (PRAME_HUMAN)
YMAQFTSQT

SEQ ID NO: 145583 - protein, 11 aa, Artificial Sequence
  Description of Artificial Sequence: Synthetic peptide
  Seed: LIGLSNLTHVL (PRAME_HUMAN)
LYGLSNLTHVL

SEQ ID NO: 145584 - protein, 10 aa, Artificial Sequence
  Description of Artificial Sequence: Synthetic peptide
  Seed: LQALYVDSLF (PRAME_HUMAN)
LCALYVDSLW

SEQ ID NO: 145585 - protein, 10 aa, Artificial Sequence
  Description of Artificial Sequence: Synthetic peptide
  Seed: AFDGRHSQTL (PRAME_HUMAN)
AMDGRHSQTL

SEQ ID NO: 145586 - protein, 9 aa, Artificial Sequence
  Description of Artificial Sequence: Synthetic peptide
  Seed: RLRELLCEL (PRAME_HUMAN)
RMRELLCEY

SEQ ID NO: 145587 - protein, 9 aa, Artificial Sequence
  Description of Artificial Sequence: Synthetic peptide
  Seed: YSFPEPEAA (PRAME_HUMAN)
YHFPEPEAM

SEQ ID NO: 145588 - protein, 10 aa, Artificial Sequence
  Description of Artificial Sequence: Synthetic peptide
  Seed: LSQSPSVSQL (PRAME_HUMAN)
LCQSPSVSQY

SEQ ID NO: 145589 - protein, 10 aa, Artificial Sequence
  Description of Artificial Sequence: Synthetic peptide
  Seed: GACDELFSYL (PRAME_HUMAN)
GICDELFSYL

SEQ ID NO: 145590 - protein, 10 aa, Artificial Sequence
  Description of Artificial Sequence: Synthetic peptide
  Seed: SQLTTLSFYG (PRAME_HUMAN)
SYLTTLSFYY

SEQ ID NO: 145591 - protein, 9 aa, Artificial Sequence
  Description of Artificial Sequence: Synthetic peptide
  Seed: GQMINLRRL (PRAME_HUMAN)
GEMINLRRL

SEQ ID NO: 145592 - protein, 9 aa, Artificial Sequence
  Description of Artificial Sequence: Synthetic peptide
  Seed: YEDIHGTLH (PRAME_HUMAN)
YEDIHGTLA

SEQ ID NO: 145593 - protein, 9 aa, Artificial Sequence
  Description of Artificial Sequence: Synthetic peptide
  Seed: RLDQLLRHV (PRAME_HUMAN)
RADQLLRHM

SEQ ID NO: 145594 - protein, 10 aa, Artificial Sequence
  Description of Artificial Sequence: Synthetic peptide
  Seed: EAAQPMTKKR (PRAME_HUMAN)
EYAQPMTKKR

SEQ ID NO: 145595 - protein, 9 aa, Artificial Sequence
  Description of Artificial Sequence: Synthetic peptide
  Seed: MINLRRLLL (PRAME_HUMAN)
MFNLRRLLL

SEQ ID NO: 145596 - protein, 9 aa, Artificial Sequence
  Description of Artificial Sequence: Synthetic peptide
  Seed: SQLSVLSLS (PRAME_HUMAN)
SQLSVLSLV

SEQ ID NO: 145597 - protein, 9 aa, Artificial Sequence
  Description of Artificial Sequence: Synthetic peptide
  Seed: FYDPEPILC (PRAME_HUMAN)
FEDPEPILM

SEQ ID NO: 145598 - protein, 9 aa, Artificial Sequence
  Description of Artificial Sequence: Synthetic peptide
  Seed: CKKLKIFAM (PRAME_HUMAN)
CPKLKIFAA

SEQ ID NO: 145599 - protein, 9 aa, Artificial Sequence
  Description of Artificial Sequence: Synthetic peptide
  Seed: GACDELFSY (PRAME_HUMAN)
GMCDELFSF

SEQ ID NO: 145600 - protein, 9 aa, Artificial Sequence
  Description of Artificial Sequence: Synthetic peptide
  Seed: VSPEPLQAL (PRAME_HUMAN)
VFPEPLQAL

SEQ ID NO: 145601 - protein, 10 aa, Artificial Sequence
  Description of Artificial Sequence: Synthetic peptide
  Seed: YSFPEPEAAQ (PRAME_HUMAN)
YVFPEPEAAL

SEQ ID NO: 145602 - protein, 9 aa, Artificial Sequence
  Description of Artificial Sequence: Synthetic peptide
  Seed: SRYISMSVW (PRAME_HUMAN)
SQYISMSVG

SEQ ID NO: 145603 - protein, 10 aa, Artificial Sequence
  Description of Artificial Sequence: Synthetic peptide
  Seed: SISISALQSL (PRAME_HUMAN)
SMSISALQSI

SEQ ID NO: 145604 - protein, 10 aa, Artificial Sequence
  Description of Artificial Sequence: Synthetic peptide
  Seed: FIPVEVLVDL (PRAME_HUMAN)
FMPVEVLVDV

SEQ ID NO: 145605 - protein, 11 aa, Artificial Sequence
  Description of Artificial Sequence: Synthetic peptide
  Seed: ELFSYLIEKVK (PRAME_HUMAN)
EAFSYLIEKVR

SEQ ID NO: 145606 - protein, 9 aa, Artificial Sequence
  Description of Artificial Sequence: Synthetic peptide
  Seed: VQLDSIEDL (PRAME_HUMAN)
VQLDSIEDI

SEQ ID NO: 145607 - protein, 10 aa, Artificial Sequence
  Description of Artificial Sequence: Synthetic peptide
  Seed: IQSRYISMSV (PRAME_HUMAN)
ILSRYISMSF

SEQ ID NO: 145608 - protein, 9 aa, Artificial Sequence
  Description of Artificial Sequence: Synthetic peptide
  Seed: AMVQAWPFT (PRAME_HUMAN)
AMVQAWPFI

SEQ ID NO: 145609 - protein, 10 aa, Artificial Sequence
  Description of Artificial Sequence: Synthetic peptide
  Seed: QALYVDSLFF (PRAME_HUMAN)
QMLYVDSLFY

SEQ ID NO: 145610 - protein, 11 aa, Artificial Sequence
  Description of Artificial Sequence: Synthetic peptide
  Seed: ESYEDIHGTLH (PRAME_HUMAN)
EVYEDIHGTLR

SEQ ID NO: 145611 - protein, 10 aa, Artificial Sequence
  Description of Artificial Sequence: Synthetic peptide
  Seed: VELAGQSLLK (PRAME_HUMAN)
VTLAGQSLLY

SEQ ID NO: 145612 - protein, 10 aa, Artificial Sequence
  Description of Artificial Sequence: Synthetic peptide
  Seed: QSLLQHLIGL (PRAME_HUMAN)
QFLLQHLIGV

SEQ ID NO: 145613 - protein, 9 aa, Artificial Sequence
  Description of Artificial Sequence: Synthetic peptide
  Seed: SQLSVLSLS (PRAME_HUMAN)
SLLSVLSLV

SEQ ID NO: 145614 - protein, 9 aa, Artificial Sequence
  Description of Artificial Sequence: Synthetic peptide
  Seed: KLKIFAMPM (PRAME_HUMAN)
KVKIFAMPN

SEQ ID NO: 145615 - protein, 10 aa, Artificial Sequence
  Description of Artificial Sequence: Synthetic peptide
  Seed: TLHLERLAYL (PRAME_HUMAN)
TLHLERLAYV

SEQ ID NO: 145616 - protein, 11 aa, Artificial Sequence
  Description of Artificial Sequence: Synthetic peptide
  Seed: RTFYDPEPILC (PRAME_HUMAN)
RGFYDPEPILW

SEQ ID NO: 145617 - protein, 10 aa, Artificial Sequence
  Description of Artificial Sequence: Synthetic peptide
  Seed: SALQSLLQHL (PRAME_HUMAN)
SFLQSLLQHI

SEQ ID NO: 145618 - protein, 11 aa, Artificial Sequence
  Description of Artificial Sequence: Synthetic peptide
  Seed: ELLPRELFPPL (PRAME_HUMAN)
EYLPRELFPPV

SEQ ID NO: 145619 - protein, 10 aa, Artificial Sequence
  Description of Artificial Sequence: Synthetic peptide
  Seed: RLWGSIQSRY (PRAME_HUMAN)
RVWGSIQSRY

SEQ ID NO: 145620 - protein, 10 aa, Artificial Sequence
  Description of Artificial Sequence: Synthetic peptide
  Seed: QYIAQFTSQF (PRAME_HUMAN)
QYIAQFTSQW

SEQ ID NO: 145621 - protein, 10 aa, Artificial Sequence
  Description of Artificial Sequence: Synthetic peptide
  Seed: LLLSHIHASS (PRAME_HUMAN)
LWLSHIHASI

SEQ ID NO: 145622 - protein, 9 aa, Artificial Sequence
  Description of Artificial Sequence: Synthetic peptide
  Seed: TDDQLLALL (PRAME_HUMAN)
TWDQLLALL

SEQ ID NO: 145623 - protein, 9 aa, Artificial Sequence
  Description of Artificial Sequence: Synthetic peptide
  Seed: YLHARLREL (PRAME_HUMAN)
YMHARLREL

SEQ ID NO: 145624 - protein, 10 aa, Artificial Sequence
  Description of Artificial Sequence: Synthetic peptide
  Seed: LLPRELFPPL (PRAME_HUMAN)
LEPRELFPPM

SEQ ID NO: 145625 - protein, 9 aa, Artificial Sequence
  Description of Artificial Sequence: Synthetic peptide
  Seed: ALAIAALEL (PRAME_HUMAN)
AQAIAALEL

SEQ ID NO: 145626 - protein, 8 aa, Artificial Sequence
  Description of Artificial Sequence: Synthetic peptide
  Seed: ITDDQLLA (PRAME_HUMAN)
IIDDQLLV

SEQ ID NO: 145627 - protein, 9 aa, Artificial Sequence
  Description of Artificial Sequence: Synthetic peptide
  Seed: LYVDSLFFL (PRAME_HUMAN)
LMVDSLFFT

SEQ ID NO: 145628 - protein, 9 aa, Artificial Sequence
  Description of Artificial Sequence: Synthetic peptide
  Seed: THVLYPVPL (PRAME_HUMAN)
TSVLYPVPY

SEQ ID NO: 145629 - protein, 10 aa, Artificial Sequence
  Description of Artificial Sequence: Synthetic peptide
  Seed: ETFKAVLDGL (PRAME_HUMAN)
EMFKAVLDGK

SEQ ID NO: 145630 - protein, 9 aa, Artificial Sequence
  Description of Artificial Sequence: Synthetic peptide
  Seed: VLDGLDVLL (PRAME_HUMAN)
VWDGLDVLM

SEQ ID NO: 145631 - protein, 10 aa, Artificial Sequence
  Description of Artificial Sequence: Synthetic peptide
  Seed: ITDDQLLALL (PRAME_HUMAN)
ITDDQLLALW

SEQ ID NO: 145632 - protein, 9 aa, Artificial Sequence
  Description of Artificial Sequence: Synthetic peptide
  Seed: QSRYISMSV (PRAME_HUMAN)
QMRYISMSA

SEQ ID NO: 145633 - protein, 9 aa, Artificial Sequence
  Description of Artificial Sequence: Synthetic peptide
  Seed: ALLPSLSHC (PRAME_HUMAN)
ATLPSLSHI

SEQ ID NO: 145634 - protein, 9 aa, Artificial Sequence
  Description of Artificial Sequence: Synthetic peptide
  Seed: ALLPSLSHC (PRAME_HUMAN)
ATLPSLSHL

SEQ ID NO: 145635 - protein, 9 aa, Artificial Sequence
  Description of Artificial Sequence: Synthetic peptide
  Seed: KVDGLSTEA (PRAME_HUMAN)
KADGLSTEC

SEQ ID NO: 145636 - protein, 9 aa, Artificial Sequence
  Description of Artificial Sequence: Synthetic peptide
  Seed: DGRHSQTLK (PRAME_HUMAN)
DIRHSQTLR

SEQ ID NO: 145637 - protein, 9 aa, Artificial Sequence
  Description of Artificial Sequence: Synthetic peptide
  Seed: LSHIHASSY (PRAME_HUMAN)
LTHIHASSY

SEQ ID NO: 145638 - protein, 11 aa, Artificial Sequence
  Description of Artificial Sequence: Synthetic peptide
  Seed: RASATLQDLVF (PRAME_HUMAN)
RQSATLQDLVF

SEQ ID NO: 145639 - protein, 9 aa, Artificial Sequence
  Description of Artificial Sequence: Synthetic peptide
  Seed: KNVLRLCCK (PRAME_HUMAN)
KSVLRLCCR

SEQ ID NO: 145640 - protein, 9 aa, Artificial Sequence
  Description of Artificial Sequence: Synthetic peptide
  Seed: ELAGQSLLK (PRAME_HUMAN)
EYAGQSLLR

SEQ ID NO: 145641 - protein, 9 aa, Artificial Sequence
  Description of Artificial Sequence: Synthetic peptide
  Seed: KEEQYIAQF (PRAME_HUMAN)
KREQYIAQF

SEQ ID NO: 145642 - protein, 9 aa, Artificial Sequence
  Description of Artificial Sequence: Synthetic peptide
  Seed: KLKIFAMPM (PRAME_HUMAN)
KSKIFAMPM

SEQ ID NO: 145643 - protein, 11 aa, Artificial Sequence
  Description of Artificial Sequence: Synthetic peptide
  Seed: LLSHIHASSYI (PRAME_HUMAN)
LLSHIHASSYL

SEQ ID NO: 145644 - protein, 11 aa, Artificial Sequence
  Description of Artificial Sequence: Synthetic peptide
  Seed: MKGQHLHLETF (PRAME_HUMAN)
MPGQHLHLETF

SEQ ID NO: 145645 - protein, 10 aa, Artificial Sequence
  Description of Artificial Sequence: Synthetic peptide
  Seed: AEQPFIPVEV (PRAME_HUMAN)
AEQPFIPVEI

SEQ ID NO: 145646 - protein, 9 aa, Artificial Sequence
  Description of Artificial Sequence: Synthetic peptide
  Seed: RLWGSIQSR (PRAME_HUMAN)
RVWGSIQSY

SEQ ID NO: 145647 - protein, 8 aa, Artificial Sequence
  Description of Artificial Sequence: Synthetic peptide
  Seed: AMVQAWPF (PRAME_HUMAN)
AMVQAWPY

SEQ ID NO: 145648 - protein, 9 aa, Artificial Sequence
  Description of Artificial Sequence: Synthetic peptide
  Seed: NSHQDFWTV (PRAME_HUMAN)
NVHQDFWTV

SEQ ID NO: 145649 - protein, 9 aa, Artificial Sequence
  Description of Artificial Sequence: Synthetic peptide
  Seed: MINLRRLLL (PRAME_HUMAN)
MVNLRRLLK

SEQ ID NO: 145650 - protein, 8 aa, Artificial Sequence
  Description of Artificial Sequence: Synthetic peptide
  Seed: FYDPEPIL (PRAME_HUMAN)
FSDPEPII

SEQ ID NO: 145651 - protein, 9 aa, Artificial Sequence
  Description of Artificial Sequence: Synthetic peptide
  Seed: LQSLLQHLI (PRAME_HUMAN)
LISLLQHLL

SEQ ID NO: 145652 - protein, 9 aa, Artificial Sequence
  Description of Artificial Sequence: Synthetic peptide
  Seed: LYVDSLFFL (PRAME_HUMAN)
LVVDSLFFA

SEQ ID NO: 145653 - protein, 10 aa, Artificial Sequence
  Description of Artificial Sequence: Synthetic peptide
  Seed: SPYLGQMINL (PRAME_HUMAN)
SEYLGQMINL

SEQ ID NO: 145654 - protein, 9 aa, Artificial Sequence
  Description of Artificial Sequence: Synthetic peptide
  Seed: EDLEVTCTW (PRAME_HUMAN)
EILEVTCTI

SEQ ID NO: 145655 - protein, 9 aa, Artificial Sequence
  Description of Artificial Sequence: Synthetic peptide
  Seed: SPEPLQALL (PRAME_HUMAN)
SSEPLQALM

SEQ ID NO: 145656 - protein, 10 aa, Artificial Sequence
  Description of Artificial Sequence: Synthetic peptide
  Seed: YSFPEPEAAQ (PRAME_HUMAN)
YSFPEPEAAH

SEQ ID NO: 145657 - protein, 10 aa, Artificial Sequence
  Description of Artificial Sequence: Synthetic peptide
  Seed: LLLSHIHASS (PRAME_HUMAN)
LELSHIHASV

SEQ ID NO: 145658 - protein, 10 aa, Artificial Sequence
  Description of Artificial Sequence: Synthetic peptide
  Seed: RRRLWGSIQS (PRAME_HUMAN)
RVRLWGSIQK

SEQ ID NO: 145659 - protein, 9 aa, Artificial Sequence
  Description of Artificial Sequence: Synthetic peptide
  Seed: GITDDQLLA (PRAME_HUMAN)
GMTDDQLLL

SEQ ID NO: 145660 - protein, 10 aa, Artificial Sequence
  Description of Artificial Sequence: Synthetic peptide
  Seed: ITDDQLLALL (PRAME_HUMAN)
ISDDQLLALW

SEQ ID NO: 145661 - protein, 10 aa, Artificial Sequence
  Description of Artificial Sequence: Synthetic peptide
  Seed: ASATLQDLVF (PRAME_HUMAN)
AQATLQDLVM

SEQ ID NO: 145662 - protein, 9 aa, Artificial Sequence
  Description of Artificial Sequence: Synthetic peptide
  Seed: SQSPSVSQL (PRAME_HUMAN)
SESPSVSQV

SEQ ID NO: 145663 - protein, 9 aa, Artificial Sequence
  Description of Artificial Sequence: Synthetic peptide
  Seed: ACDELFSYL (PRAME_HUMAN)
ACDELFSYF

SEQ ID NO: 145664 - protein, 10 aa, Artificial Sequence
  Description of Artificial Sequence: Synthetic peptide
  Seed: SLLKDEALAI (PRAME_HUMAN)
SPLKDEALAV

SEQ ID NO: 145665 - protein, 9 aa, Artificial Sequence
  Description of Artificial Sequence: Synthetic peptide
  Seed: KLKIFAMPM (PRAME_HUMAN)
KNKIFAMPA

SEQ ID NO: 145666 - protein, 10 aa, Artificial Sequence
  Description of Artificial Sequence: Synthetic peptide
  Seed: RLSEGDVMHL (PRAME_HUMAN)
RSSEGDVMHL

SEQ ID NO: 145667 - protein, 9 aa, Artificial Sequence
  Description of Artificial Sequence: Synthetic peptide
  Seed: GQHLHLETF (PRAME_HUMAN)
GMHLHLETY

SEQ ID NO: 145668 - protein, 9 aa, Artificial Sequence
  Description of Artificial Sequence: Synthetic peptide
  Seed: LSEGDVMHL (PRAME_HUMAN)
LWEGDVMHM

SEQ ID NO: 145669 - protein, 8 aa, Artificial Sequence
  Description of Artificial Sequence: Synthetic peptide
  Seed: AMVQAWPF (PRAME_HUMAN)
AQVQAWPF

SEQ ID NO: 145670 - protein, 10 aa, Artificial Sequence
  Description of Artificial Sequence: Synthetic peptide
  Seed: QEVRPRRWKL (PRAME_HUMAN)
QEVRPRRWKY

SEQ ID NO: 145671 - protein, 9 aa, Artificial Sequence
  Description of Artificial Sequence: Synthetic peptide
  Seed: VLYPVPLES (PRAME_HUMAN)
VTYPVPLEI

SEQ ID NO: 145672 - protein, 10 aa, Artificial Sequence
  Description of Artificial Sequence: Synthetic peptide
  Seed: LLPRELFPPL (PRAME_HUMAN)
LYPRELFPPM

SEQ ID NO: 145673 - protein, 10 aa, Artificial Sequence
  Description of Artificial Sequence: Synthetic peptide
  Seed: ELFSYLIEKV (PRAME_HUMAN)
EAFSYLIEKV

SEQ ID NO: 145674 - protein, 9 aa, Artificial Sequence
  Description of Artificial Sequence: Synthetic peptide
  Seed: ALQSLLQHL (PRAME_HUMAN)
ARQSLLQHV

SEQ ID NO: 145675 - protein, 9 aa, Artificial Sequence
  Description of Artificial Sequence: Synthetic peptide
  Seed: YIAQFTSQF (PRAME_HUMAN)
YLAQFTSQW

SEQ ID NO: 145676 - protein, 9 aa, Artificial Sequence
  Description of Artificial Sequence: Synthetic peptide
  Seed: SQFLSLQCL (PRAME_HUMAN)
SMFLSLQCA

SEQ ID NO: 145677 - protein, 10 aa, Artificial Sequence
  Description of Artificial Sequence: Synthetic peptide
  Seed: ISISALQSLL (PRAME_HUMAN)
ITISALQSLL

SEQ ID NO: 145678 - protein, 9 aa, Artificial Sequence
  Description of Artificial Sequence: Synthetic peptide
  Seed: LQHLIGLSN (PRAME_HUMAN)
LEHLIGLSM

SEQ ID NO: 145679 - protein, 10 aa, Artificial Sequence
  Description of Artificial Sequence: Synthetic peptide
  Seed: LKAMVQAWPF (PRAME_HUMAN)
LQAMVQAWPY

SEQ ID NO: 145680 - protein, 10 aa, Artificial Sequence
  Description of Artificial Sequence: Synthetic peptide
  Seed: RHVMNPLETL (PRAME_HUMAN)
RLVMNPLETF

SEQ ID NO: 145681 - protein, 10 aa, Artificial Sequence
  Description of Artificial Sequence: Synthetic peptide
  Seed: RRLWGSIQSR (PRAME_HUMAN)
RRLWGSIQSV

SEQ ID NO: 145682 - protein, 9 aa, Artificial Sequence
  Description of Artificial Sequence: Synthetic peptide
  Seed: ACDELFSYL (PRAME_HUMAN)
AFDELFSYI

SEQ ID NO: 145683 - protein, 9 aa, Artificial Sequence
  Description of Artificial Sequence: Synthetic peptide
  Seed: ISPEKEEQY (PRAME_HUMAN)
IIPEKEEQM

SEQ ID NO: 145684 - protein, 10 aa, Artificial Sequence
  Description of Artificial Sequence: Synthetic peptide
  Seed: QYIAQFTSQF (PRAME_HUMAN)
QYIAQFTSQL

SEQ ID NO: 145685 - protein, 10 aa, Artificial Sequence
  Description of Artificial Sequence: Synthetic peptide
  Seed: ETLSITNCRL (PRAME_HUMAN)
ETLSITNCRY

SEQ ID NO: 145686 - protein, 9 aa, Artificial Sequence
  Description of Artificial Sequence: Synthetic peptide
  Seed: SQFLSLQCL (PRAME_HUMAN)
SKFLSLQCF

SEQ ID NO: 145687 - protein, 9 aa, Artificial Sequence
  Description of Artificial Sequence: Synthetic peptide
  Seed: RLRELLCEL (PRAME_HUMAN)
RKRELLCEF

SEQ ID NO: 145688 - protein, 9 aa, Artificial Sequence
  Description of Artificial Sequence: Synthetic peptide
  Seed: DEALAIAAL (PRAME_HUMAN)
DQALAIAAL

SEQ ID NO: 145689 - protein, 9 aa, Artificial Sequence
  Description of Artificial Sequence: Synthetic peptide
  Seed: SHQDFWTVW (PRAME_HUMAN)
SHQDFWTVL

SEQ ID NO: 145690 - protein, 9 aa, Artificial Sequence
  Description of Artificial Sequence: Synthetic peptide
  Seed: TCLPLGVLM (PRAME_HUMAN)
TALPLGVLI

SEQ ID NO: 145691 - protein, 10 aa, Artificial Sequence
  Description of Artificial Sequence: Synthetic peptide
  Seed: LSFYGNSISI (PRAME_HUMAN)
LVFYGNSISM

SEQ ID NO: 145692 - protein, 9 aa, Artificial Sequence
  Description of Artificial Sequence: Synthetic peptide
  Seed: SYEDIHGTL (PRAME_HUMAN)
SAEDIHGTY

SEQ ID NO: 145693 - protein, 9 aa, Artificial Sequence
  Description of Artificial Sequence: Synthetic peptide
  Seed: SQFLSLQCL (PRAME_HUMAN)
SRFLSLQCV

SEQ ID NO: 145694 - protein, 9 aa, Artificial Sequence
  Description of Artificial Sequence: Synthetic peptide
  Seed: CSQLTTLSF (PRAME_HUMAN)
CQQLTTLSI

SEQ ID NO: 145695 - protein, 9 aa, Artificial Sequence
  Description of Artificial Sequence: Synthetic peptide
  Seed: FYDPEPILC (PRAME_HUMAN)
FMDPEPILL

SEQ ID NO: 145696 - protein, 9 aa, Artificial Sequence
  Description of Artificial Sequence: Synthetic peptide
  Seed: KFSPYLGQM (PRAME_HUMAN)
KQSPYLGQF

SEQ ID NO: 145697 - protein, 9 aa, Artificial Sequence
  Description of Artificial Sequence: Synthetic peptide
  Seed: TLHLERLAY (PRAME_HUMAN)
THHLERLAF

SEQ ID NO: 145698 - protein, 9 aa, Artificial Sequence
  Description of Artificial Sequence: Synthetic peptide
  Seed: RLSEGDVMH (PRAME_HUMAN)
RISEGDVMF

SEQ ID NO: 145699 - protein, 9 aa, Artificial Sequence
  Description of Artificial Sequence: Synthetic peptide
  Seed: SIQSRYISM (PRAME_HUMAN)
SVQSRYISR

SEQ ID NO: 145700 - protein, 9 aa, Artificial Sequence
  Description of Artificial Sequence: Synthetic peptide
  Seed: RASATLQDL (PRAME_HUMAN)
RSSATLQDY

SEQ ID NO: 145701 - protein, 10 aa, Artificial Sequence
  Description of Artificial Sequence: Synthetic peptide
  Seed: RHVMNPLETL (PRAME_HUMAN)
RLVMNPLETL

SEQ ID NO: 145702 - protein, 11 aa, Artificial Sequence
  Description of Artificial Sequence: Synthetic peptide
  Seed: PRELFPPLFMA (PRAME_HUMAN)
PYELFPPLFMI

SEQ ID NO: 145703 - protein, 9 aa, Artificial Sequence
  Description of Artificial Sequence: Synthetic peptide
  Seed: SISALQSLL (PRAME_HUMAN)
SLSALQSLM

SEQ ID NO: 145704 - protein, 9 aa, Artificial Sequence
  Description of Artificial Sequence: Synthetic peptide
  Seed: HVMNPLETL (PRAME_HUMAN)
HHMNPLETY

SEQ ID NO: 145705 - protein, 9 aa, Artificial Sequence
  Description of Artificial Sequence: Synthetic peptide
  Seed: WKLPTLAKF (PRAME_HUMAN)
WKLPTLAKM

SEQ ID NO: 145706 - protein, 10 aa, Artificial Sequence
  Description of Artificial Sequence: Synthetic peptide
  Seed: KDEALAIAAL (PRAME_HUMAN)
KEEALAIAAV

SEQ ID NO: 145707 - protein, 9 aa, Artificial Sequence
  Description of Artificial Sequence: Synthetic peptide
  Seed: LSEGDVMHL (PRAME_HUMAN)
LMEGDVMHY

SEQ ID NO: 145708 - protein, 9 aa, Artificial Sequence
  Description of Artificial Sequence: Synthetic peptide
  Seed: ISPEKEEQY (PRAME_HUMAN)
ITPEKEEQV

SEQ ID NO: 145709 - protein, 10 aa, Artificial Sequence
  Description of Artificial Sequence: Synthetic peptide
  Seed: QYIAQFTSQF (PRAME_HUMAN)
QWIAQFTSQY

SEQ ID NO: 145710 - protein, 9 aa, Artificial Sequence
  Description of Artificial Sequence: Synthetic peptide
  Seed: KEEQYIAQF (PRAME_HUMAN)
KMEQYIAQF

SEQ ID NO: 145711 - protein, 9 aa, Artificial Sequence
  Description of Artificial Sequence: Synthetic peptide
  Seed: SQLTTLSFY (PRAME_HUMAN)
SGLTTLSFY

SEQ ID NO: 145712 - protein, 9 aa, Artificial Sequence
  Description of Artificial Sequence: Synthetic peptide
  Seed: SQFLSLQCL (PRAME_HUMAN)
SAFLSLQCV

SEQ ID NO: 145713 - protein, 10 aa, Artificial Sequence
  Description of Artificial Sequence: Synthetic peptide
  Seed: VLYPVPLESY (PRAME_HUMAN)
VIYPVPLESR

SEQ ID NO: 145714 - protein, 10 aa, Artificial Sequence
  Description of Artificial Sequence: Synthetic peptide
  Seed: SNLTHVLYPV (PRAME_HUMAN)
SYLTHVLYPL

SEQ ID NO: 145715 - protein, 10 aa, Artificial Sequence
  Description of Artificial Sequence: Synthetic peptide
  Seed: ISISALQSLL (PRAME_HUMAN)
ITISALQSLY

SEQ ID NO: 145716 - protein, 9 aa, Artificial Sequence
  Description of Artificial Sequence: Synthetic peptide
  Seed: VFDECGITD (PRAME_HUMAN)
VNDECGITM

SEQ ID NO: 145717 - protein, 10 aa, Artificial Sequence
  Description of Artificial Sequence: Synthetic peptide
  Seed: RLWGSIQSRY (PRAME_HUMAN)
RKWGSIQSRF

SEQ ID NO: 145718 - protein, 9 aa, Artificial Sequence
  Description of Artificial Sequence: Synthetic peptide
  Seed: GACDELFSY (PRAME_HUMAN)
GSCDELFSW

SEQ ID NO: 145719 - protein, 10 aa, Artificial Sequence
  Description of Artificial Sequence: Synthetic peptide
  Seed: KDEALAIAAL (PRAME_HUMAN)
KGEALAIAAL

SEQ ID NO: 145720 - protein, 9 aa, Artificial Sequence
  Description of Artificial Sequence: Synthetic peptide
  Seed: QSRYISMSV (PRAME_HUMAN)
QYRYISMSV

SEQ ID NO: 145721 - protein, 9 aa, Artificial Sequence
  Description of Artificial Sequence: Synthetic peptide
  Seed: LYVDSLFFL (PRAME_HUMAN)
LLVDSLFFC

SEQ ID NO: 145722 - protein, 9 aa, Artificial Sequence
  Description of Artificial Sequence: Synthetic peptide
  Seed: VLMKGQHLH (PRAME_HUMAN)
VQMKGQHLF

SEQ ID NO: 145723 - protein, 10 aa, Artificial Sequence
  Description of Artificial Sequence: Synthetic peptide
  Seed: AMPMQDIKMI (PRAME_HUMAN)
ALPMQDIKMV

SEQ ID NO: 145724 - protein, 9 aa, Artificial Sequence
  Description of Artificial Sequence: Synthetic peptide
  Seed: GQHLHLETF (PRAME_HUMAN)
GQHLHLETM

SEQ ID NO: 145725 - protein, 11 aa, Artificial Sequence
  Description of Artificial Sequence: Synthetic peptide
  Seed: LQSLLQHLIGL (PRAME_HUMAN)
LKSLLQHLIGV

SEQ ID NO: 145726 - protein, 10 aa, Artificial Sequence
  Description of Artificial Sequence: Synthetic peptide
  Seed: RRRLWGSIQS (PRAME_HUMAN)
RFRLWGSIQR

SEQ ID NO: 145727 - protein, 10 aa, Artificial Sequence
  Description of Artificial Sequence: Synthetic peptide
  Seed: QLSVLSLSGV (PRAME_HUMAN)
QMSVLSLSGL

SEQ ID NO: 145728 - protein, 9 aa, Artificial Sequence
  Description of Artificial Sequence: Synthetic peptide
  Seed: RLRELLCEL (PRAME_HUMAN)
RRRELLCEI

SEQ ID NO: 145729 - protein, 9 aa, Artificial Sequence
  Description of Artificial Sequence: Synthetic peptide
  Seed: MINLRRLLL (PRAME_HUMAN)
MMNLRRLLF

SEQ ID NO: 145730 - protein, 9 aa, Artificial Sequence
  Description of Artificial Sequence: Synthetic peptide
  Seed: SISALQSLL (PRAME_HUMAN)
SMSALQSLF

SEQ ID NO: 145731 - protein, 9 aa, Artificial Sequence
  Description of Artificial Sequence: Synthetic peptide
  Seed: FLSLQCLQA (PRAME_HUMAN)
FMSLQCLQA

SEQ ID NO: 145732 - protein, 9 aa, Artificial Sequence
  Description of Artificial Sequence: Synthetic peptide
  Seed: EVRPRRWKL (PRAME_HUMAN)
EIRPRRWKL

SEQ ID NO: 145733 - protein, 9 aa, Artificial Sequence
  Description of Artificial Sequence: Synthetic peptide
  Seed: AFDGRHSQT (PRAME_HUMAN)
AFDGRHSQF

SEQ ID NO: 145734 - protein, 9 aa, Artificial Sequence
  Description of Artificial Sequence: Synthetic peptide
  Seed: YIAQFTSQF (PRAME_HUMAN)
YTAQFTSQR

SEQ ID NO: 145735 - protein, 9 aa, Artificial Sequence
  Description of Artificial Sequence: Synthetic peptide
  Seed: ELFSYLIEK (PRAME_HUMAN)
EAFSYLIEL

SEQ ID NO: 145736 - protein, 9 aa, Artificial Sequence
  Description of Artificial Sequence: Synthetic peptide
  Seed: SLLQHLIGL (PRAME_HUMAN)
SMLQHLIGW

SEQ ID NO: 145737 - protein, 9 aa, Artificial Sequence
  Description of Artificial Sequence: Synthetic peptide
  Seed: LPRELFPPL (PRAME_HUMAN)
LARELFPPM

SEQ ID NO: 145738 - protein, 9 aa, Artificial Sequence
  Description of Artificial Sequence: Synthetic peptide
  Seed: GQHLHLETF (PRAME_HUMAN)
GAHLHLETF

SEQ ID NO: 145739 - protein, 10 aa, Artificial Sequence
  Description of Artificial Sequence: Synthetic peptide
  Seed: RASATLQDLV (PRAME_HUMAN)
RKSATLQDLF

SEQ ID NO: 145740 - protein, 9 aa, Artificial Sequence
  Description of Artificial Sequence: Synthetic peptide
  Seed: ALLERASAT (PRAME_HUMAN)
ALLERASAV

SEQ ID NO: 145741 - protein, 10 aa, Artificial Sequence
  Description of Artificial Sequence: Synthetic peptide
  Seed: VLDGLDVLLA (PRAME_HUMAN)
VLDGLDVLLL

SEQ ID NO: 145742 - protein, 9 aa, Artificial Sequence
  Description of Artificial Sequence: Synthetic peptide
  Seed: LHLERLAYL (PRAME_HUMAN)
LFLERLAYY

SEQ ID NO: 145743 - protein, 11 aa, Artificial Sequence
  Description of Artificial Sequence: Synthetic peptide
  Seed: ALYVDSLFFLR (PRAME_HUMAN)
ALYVDSLFFLP

SEQ ID NO: 145744 - protein, 9 aa, Artificial Sequence
  Description of Artificial Sequence: Synthetic peptide
  Seed: SIEDLEVTC (PRAME_HUMAN)
SAEDLEVTM

SEQ ID NO: 145745 - protein, 9 aa, Artificial Sequence
  Description of Artificial Sequence: Synthetic peptide
  Seed: SQSPSVSQL (PRAME_HUMAN)
SDSPSVSQF

SEQ ID NO: 145746 - protein, 9 aa, Artificial Sequence
  Description of Artificial Sequence: Synthetic peptide
  Seed: ETLSITNCR (PRAME_HUMAN)
ELLSITNCK

SEQ ID NO: 145747 - protein, 10 aa, Artificial Sequence
  Description of Artificial Sequence: Synthetic peptide
  Seed: FIPVEVLVDL (PRAME_HUMAN)
FAPVEVLVDW

SEQ ID NO: 145748 - protein, 9 aa, Artificial Sequence
  Description of Artificial Sequence: Synthetic peptide
  Seed: KMILKMVQL (PRAME_HUMAN)
KIILKMVQR

SEQ ID NO: 145749 - protein, 10 aa, Artificial Sequence
  Description of Artificial Sequence: Synthetic peptide
  Seed: LSVLSLSGVM (PRAME_HUMAN)
LKVLSLSGVF

SEQ ID NO: 145750 - protein, 9 aa, Artificial Sequence
  Description of Artificial Sequence: Synthetic peptide
  Seed: RLWGSIQSR (PRAME_HUMAN)
RLWGSIQSL

SEQ ID NO: 145751 - protein, 9 aa, Artificial Sequence
  Description of Artificial Sequence: Synthetic peptide
  Seed: YSFPEPEAA (PRAME_HUMAN)
YHFPEPEAY

SEQ ID NO: 145752 - protein, 9 aa, Artificial Sequence
  Description of Artificial Sequence: Synthetic peptide
  Seed: TDDQLLALL (PRAME_HUMAN)
TFDQLLALI

SEQ ID NO: 145753 - protein, 9 aa, Artificial Sequence
  Description of Artificial Sequence: Synthetic peptide
  Seed: ISPEKEEQY (PRAME_HUMAN)
IRPEKEEQY

SEQ ID NO: 145754 - protein, 11 aa, Artificial Sequence
  Description of Artificial Sequence: Synthetic peptide
  Seed: HLSQSPSVSQL (PRAME_HUMAN)
HQSQSPSVSQL

SEQ ID NO: 145755 - protein, 9 aa, Artificial Sequence
  Description of Artificial Sequence: Synthetic peptide
  Seed: VLYPVPLES (PRAME_HUMAN)
VVYPVPLEL

SEQ ID NO: 145756 - protein, 9 aa, Artificial Sequence
  Description of Artificial Sequence: Synthetic peptide
  Seed: FYDPEPILC (PRAME_HUMAN)
FHDPEPILL

SEQ ID NO: 145757 - protein, 9 aa, Artificial Sequence
  Description of Artificial Sequence: Synthetic peptide
  Seed: CRLSEGDVM (PRAME_HUMAN)
CMLSEGDVM

SEQ ID NO: 145758 - protein, 8 aa, Artificial Sequence
  Description of Artificial Sequence: Synthetic peptide
  Seed: YEDIHGTL (PRAME_HUMAN)
YVDIHGTF

SEQ ID NO: 145759 - protein, 11 aa, Artificial Sequence
  Description of Artificial Sequence: Synthetic peptide
  Seed: KAVLDGLDVLL (PRAME_HUMAN)
KTVLDGLDVLF

SEQ ID NO: 145760 - protein, 9 aa, Artificial Sequence
  Description of Artificial Sequence: Synthetic peptide
  Seed: ELFSYLIEK (PRAME_HUMAN)
EVFSYLIEY

SEQ ID NO: 145761 - protein, 9 aa, Artificial Sequence
  Description of Artificial Sequence: Synthetic peptide
  Seed: IPVEVLVDL (PRAME_HUMAN)
IAVEVLVDY

SEQ ID NO: 145762 - protein, 9 aa, Artificial Sequence
  Description of Artificial Sequence: Synthetic peptide
  Seed: SVLSLSGVM (PRAME_HUMAN)
SSLSLSGVI

SEQ ID NO: 145763 - protein, 9 aa, Artificial Sequence
  Description of Artificial Sequence: Synthetic peptide
  Seed: WLSANPCPH (PRAME_HUMAN)
WQSANPCPM

SEQ ID NO: 145764 - protein, 10 aa, Artificial Sequence
  Description of Artificial Sequence: Synthetic peptide
  Seed: LFPPLFMAAF (PRAME_HUMAN)
LFPPLFMAAM

SEQ ID NO: 145765 - protein, 11 aa, Artificial Sequence
  Description of Artificial Sequence: Synthetic peptide
  Seed: ALYVDSLFFLR (PRAME_HUMAN)
AMYVDSLFFLY

SEQ ID NO: 145766 - protein, 9 aa, Artificial Sequence
  Description of Artificial Sequence: Synthetic peptide
  Seed: RLLLSHIHA (PRAME_HUMAN)
RVLLSHIHV

SEQ ID NO: 145767 - protein, 10 aa, Artificial Sequence
  Description of Artificial Sequence: Synthetic peptide
  Seed: ESYEDIHGTL (PRAME_HUMAN)
EIYEDIHGTI

SEQ ID NO: 145768 - protein, 9 aa, Artificial Sequence
  Description of Artificial Sequence: Synthetic peptide
  Seed: SMSVWTSPR (PRAME_HUMAN)
SGSVWTSPR

SEQ ID NO: 145769 - protein, 9 aa, Artificial Sequence
  Description of Artificial Sequence: Synthetic peptide
  Seed: SPEPLQALL (PRAME_HUMAN)
SYEPLQALL

SEQ ID NO: 145770 - protein, 10 aa, Artificial Sequence
  Description of Artificial Sequence: Synthetic peptide
  Seed: KGQHLHLETF (PRAME_HUMAN)
KHQHLHLETF

SEQ ID NO: 145771 - protein, 10 aa, Artificial Sequence
  Description of Artificial Sequence: Synthetic peptide
  Seed: SNLTHVLYPV (PRAME_HUMAN)
SELTHVLYPV

SEQ ID NO: 145772 - protein, 10 aa, Artificial Sequence
  Description of Artificial Sequence: Synthetic peptide
  Seed: LSFYGNSISI (PRAME_HUMAN)
LWFYGNSISL

SEQ ID NO: 145773 - protein, 9 aa, Artificial Sequence
  Description of Artificial Sequence: Synthetic peptide
  Seed: LAIAALELL (PRAME_HUMAN)
LIIAALELI

SEQ ID NO: 145774 - protein, 10 aa, Artificial Sequence
  Description of Artificial Sequence: Synthetic peptide
  Seed: ARLRELLCEL (PRAME_HUMAN)
AVLRELLCEI

SEQ ID NO: 145775 - protein, 10 aa, Artificial Sequence
  Description of Artificial Sequence: Synthetic peptide
  Seed: LLCELGRPSM (PRAME_HUMAN)
LMCELGRPSF

SEQ ID NO: 145776 - protein, 11 aa, Artificial Sequence
  Description of Artificial Sequence: Synthetic peptide
  Seed: KLPTLAKFSPY (PRAME_HUMAN)
KAPTLAKFSPW

SEQ ID NO: 145777 - protein, 9 aa, Artificial Sequence
  Description of Artificial Sequence: Synthetic peptide
  Seed: FYDPEPILC (PRAME_HUMAN)
FTDPEPILY

SEQ ID NO: 145778 - protein, 9 aa, Artificial Sequence
  Description of Artificial Sequence: Synthetic peptide
  Seed: KEEQYIAQF (PRAME_HUMAN)
KEEQYIAQP

SEQ ID NO: 145779 - protein, 9 aa, Artificial Sequence
  Description of Artificial Sequence: Synthetic peptide
  Seed: NSHQDFWTV (PRAME_HUMAN)
NVHQDFWTA

SEQ ID NO: 145780 - protein, 9 aa, Artificial Sequence
  Description of Artificial Sequence: Synthetic peptide
  Seed: RELLCELGR (PRAME_HUMAN)
RLLLCELGR

SEQ ID NO: 145781 - protein, 8 aa, Artificial Sequence
  Description of Artificial Sequence: Synthetic peptide
  Seed: TDDQLLAL (PRAME_HUMAN)
TYDQLLAF

SEQ ID NO: 145782 - protein, 10 aa, Artificial Sequence
  Description of Artificial Sequence: Synthetic peptide
  Seed: ELFPPLFMAA (PRAME_HUMAN)
EIFPPLFMAL

SEQ ID NO: 145783 - protein, 9 aa, Artificial Sequence
  Description of Artificial Sequence: Synthetic peptide
  Seed: ERLAYLHAR (PRAME_HUMAN)
EILAYLHAR

SEQ ID NO: 145784 - protein, 9 aa, Artificial Sequence
  Description of Artificial Sequence: Synthetic peptide
  Seed: LLRHVMNPL (PRAME_HUMAN)
LARHVMNPF

SEQ ID NO: 145785 - protein, 9 aa, Artificial Sequence
  Description of Artificial Sequence: Synthetic peptide
  Seed: ALYVDSLFF (PRAME_HUMAN)
AIYVDSLFF

SEQ ID NO: 145786 - protein, 9 aa, Artificial Sequence
  Description of Artificial Sequence: Synthetic peptide
  Seed: YLHARLREL (PRAME_HUMAN)
YSHARLREL

SEQ ID NO: 145787 - protein, 9 aa, Artificial Sequence
  Description of Artificial Sequence: Synthetic peptide
  Seed: LAIAALELL (PRAME_HUMAN)
LAIAALELF

SEQ ID NO: 145788 - protein, 10 aa, Artificial Sequence
  Description of Artificial Sequence: Synthetic peptide
  Seed: AAFDGRHSQT (PRAME_HUMAN)
AAFDGRHSQV

SEQ ID NO: 145789 - protein, 11 aa, Artificial Sequence
  Description of Artificial Sequence: Synthetic peptide
  Seed: FLSLQCLQALY (PRAME_HUMAN)
FYSLQCLQALL

SEQ ID NO: 145790 - protein, 10 aa, Artificial Sequence
  Description of Artificial Sequence: Synthetic peptide
  Seed: LLPRELFPPL (PRAME_HUMAN)
LIPRELFPPF

SEQ ID NO: 145791 - protein, 10 aa, Artificial Sequence
  Description of Artificial Sequence: Synthetic peptide
  Seed: ISMSVWTSPR (PRAME_HUMAN)
ICMSVWTSPR

SEQ ID NO: 145792 - protein, 10 aa, Artificial Sequence
  Description of Artificial Sequence: Synthetic peptide
  Seed: KNVLRLCCKK (PRAME_HUMAN)
KYVLRLCCKR

SEQ ID NO: 145793 - protein, 9 aa, Artificial Sequence
  Description of Artificial Sequence: Synthetic peptide
  Seed: RELFPPLFM (PRAME_HUMAN)
RQLFPPLFM

SEQ ID NO: 145794 - protein, 9 aa, Artificial Sequence
  Description of Artificial Sequence: Synthetic peptide
  Seed: RRRLWGSIQ (PRAME_HUMAN)
RRRLWGSIL

SEQ ID NO: 145795 - protein, 9 aa, Artificial Sequence
  Description of Artificial Sequence: Synthetic peptide
  Seed: ETLSITNCR (PRAME_HUMAN)
EMLSITNCR

SEQ ID NO: 145796 - protein, 10 aa, Artificial Sequence
  Description of Artificial Sequence: Synthetic peptide
  Seed: AFDGRHSQTL (PRAME_HUMAN)
AADGRHSQTF

SEQ ID NO: 145797 - protein, 10 aa, Artificial Sequence
  Description of Artificial Sequence: Synthetic peptide
  Seed: LTDVSPEPLQ (PRAME_HUMAN)
LIDVSPEPLY

SEQ ID NO: 145798 - protein, 9 aa, Artificial Sequence
  Description of Artificial Sequence: Synthetic peptide
  Seed: QPFIPVEVL (PRAME_HUMAN)
QMFIPVEVF

SEQ ID NO: 145799 - protein, 9 aa, Artificial Sequence
  Description of Artificial Sequence: Synthetic peptide
  Seed: ISISALQSL (PRAME_HUMAN)
IMISALQSW

SEQ ID NO: 145800 - protein, 10 aa, Artificial Sequence
  Description of Artificial Sequence: Synthetic peptide
  Seed: RASATLQDLV (PRAME_HUMAN)
RPSATLQDLF

SEQ ID NO: 145801 - protein, 9 aa, Artificial Sequence
  Description of Artificial Sequence: Synthetic peptide
  Seed: VLDGLDVLL (PRAME_HUMAN)
VQDGLDVLV

SEQ ID NO: 145802 - protein, 8 aa, Artificial Sequence
  Description of Artificial Sequence: Synthetic peptide
  Seed: RRWKLQVL (PRAME_HUMAN)
RRWKLQVK

SEQ ID NO: 145803 - protein, 10 aa, Artificial Sequence
  Description of Artificial Sequence: Synthetic peptide
  Seed: ETFKAVLDGL (PRAME_HUMAN)
ETFKAVLDGW

SEQ ID NO: 145804 - protein, 10 aa, Artificial Sequence
  Description of Artificial Sequence: Synthetic peptide
  Seed: HCSQLTTLSF (PRAME_HUMAN)
HMSQLTTLSM

SEQ ID NO: 145805 - protein, 10 aa, Artificial Sequence
  Description of Artificial Sequence: Synthetic peptide
  Seed: FFLRGRLDQL (PRAME_HUMAN)
FKLRGRLDQV

SEQ ID NO: 145806 - protein, 11 aa, Artificial Sequence
  Description of Artificial Sequence: Synthetic peptide
  Seed: ALYVDSLFFLR (PRAME_HUMAN)
AAYVDSLFFLK

SEQ ID NO: 145807 - protein, 11 aa, Artificial Sequence
  Description of Artificial Sequence: Synthetic peptide
  Seed: LSNLTHVLYPV (PRAME_HUMAN)
LLNLTHVLYPL

SEQ ID NO: 145808 - protein, 9 aa, Artificial Sequence
  Description of Artificial Sequence: Synthetic peptide
  Seed: YSFPEPEAA (PRAME_HUMAN)
YKFPEPEAL

SEQ ID NO: 145809 - protein, 9 aa, Artificial Sequence
  Description of Artificial Sequence: Synthetic peptide
  Seed: TLSITNCRL (PRAME_HUMAN)
TMSITNCRV

SEQ ID NO: 145810 - protein, 9 aa, Artificial Sequence
  Description of Artificial Sequence: Synthetic peptide
  Seed: VLDGLDVLL (PRAME_HUMAN)
VFDGLDVLI

SEQ ID NO: 145811 - protein, 9 aa, Artificial Sequence
  Description of Artificial Sequence: Synthetic peptide
  Seed: LQALYVDSL (PRAME_HUMAN)
LAALYVDSV

SEQ ID NO: 145812 - protein, 10 aa, Artificial Sequence
  Description of Artificial Sequence: Synthetic peptide
  Seed: LKAMVQAWPF (PRAME_HUMAN)
LGAMVQAWPY

SEQ ID NO: 145813 - protein, 10 aa, Artificial Sequence
  Description of Artificial Sequence: Synthetic peptide
  Seed: KGQHLHLETF (PRAME_HUMAN)
KSQHLHLETF

SEQ ID NO: 145814 - protein, 10 aa, Artificial Sequence
  Description of Artificial Sequence: Synthetic peptide
  Seed: LTHVLYPVPL (PRAME_HUMAN)
LSHVLYPVPF

SEQ ID NO: 145815 - protein, 10 aa, Artificial Sequence
  Description of Artificial Sequence: Synthetic peptide
  Seed: KKLKIFAMPM (PRAME_HUMAN)
KALKIFAMPA

SEQ ID NO: 145816 - protein, 11 aa, Artificial Sequence
  Description of Artificial Sequence: Synthetic peptide
  Seed: FKAVLDGLDVL (PRAME_HUMAN)
FKAVLDGLDVV

SEQ ID NO: 145817 - protein, 9 aa, Artificial Sequence
  Description of Artificial Sequence: Synthetic peptide
  Seed: SQSPSVSQL (PRAME_HUMAN)
SKSPSVSQM

SEQ ID NO: 145818 - protein, 11 aa, Artificial Sequence
  Description of Artificial Sequence: Synthetic peptide
  Seed: GTLHLERLAYL (PRAME_HUMAN)
GWLHLERLAYV

SEQ ID NO: 145819 - protein, 9 aa, Artificial Sequence
  Description of Artificial Sequence: Synthetic peptide
  Seed: IAQFTSQFL (PRAME_HUMAN)
ILQFTSQFL

SEQ ID NO: 145820 - protein, 9 aa, Artificial Sequence
  Description of Artificial Sequence: Synthetic peptide
  Seed: MSVWTSPRR (PRAME_HUMAN)
MTVWTSPRR

SEQ ID NO: 145821 - protein, 10 aa, Artificial Sequence
  Description of Artificial Sequence: Synthetic peptide
  Seed: RRLWGSIQSR (PRAME_HUMAN)
RTLWGSIQSK

SEQ ID NO: 145822 - protein, 10 aa, Artificial Sequence
  Description of Artificial Sequence: Synthetic peptide
  Seed: PTLAKFSPYL (PRAME_HUMAN)
PWLAKFSPYL

SEQ ID NO: 145823 - protein, 11 aa, Artificial Sequence
  Description of Artificial Sequence: Synthetic peptide
  Seed: KAVLDGLDVLL (PRAME_HUMAN)
KMVLDGLDVLV

SEQ ID NO: 145824 - protein, 9 aa, Artificial Sequence
  Description of Artificial Sequence: Synthetic peptide
  Seed: LLKDEALAI (PRAME_HUMAN)
LVKDEALAV

SEQ ID NO: 145825 - protein, 9 aa, Artificial Sequence
  Description of Artificial Sequence: Synthetic peptide
  Seed: SQFLSLQCL (PRAME_HUMAN)
SQFLSLQCF

SEQ ID NO: 145826 - protein, 9 aa, Artificial Sequence
  Description of Artificial Sequence: Synthetic peptide
  Seed: WPFTCLPLG (PRAME_HUMAN)
WPFTCLPLI

SEQ ID NO: 145827 - protein, 10 aa, Artificial Sequence
  Description of Artificial Sequence: Synthetic peptide
  Seed: RHVMNPLETL (PRAME_HUMAN)
RSVMNPLETW

SEQ ID NO: 145828 - protein, 9 aa, Artificial Sequence
  Description of Artificial Sequence: Synthetic peptide
  Seed: LSTEAEQPF (PRAME_HUMAN)
LLTEAEQPY

SEQ ID NO: 145829 - protein, 10 aa, Artificial Sequence
  Description of Artificial Sequence: Synthetic peptide
  Seed: RRRLWGSIQS (PRAME_HUMAN)
RLRLWGSIQR

SEQ ID NO: 145830 - protein, 9 aa, Artificial Sequence
  Description of Artificial Sequence: Synthetic peptide
  Seed: EVRPRRWKL (PRAME_HUMAN)
ELRPRRWKM

SEQ ID NO: 145831 - protein, 10 aa, Artificial Sequence
  Description of Artificial Sequence: Synthetic peptide
  Seed: GLSNLTHVLY (PRAME_HUMAN)
GSSNLTHVLY

SEQ ID NO: 145832 - protein, 9 aa, Artificial Sequence
  Description of Artificial Sequence: Synthetic peptide
  Seed: RLRELLCEL (PRAME_HUMAN)
RSRELLCEY

SEQ ID NO: 145833 - protein, 9 aa, Artificial Sequence
  Description of Artificial Sequence: Synthetic peptide
  Seed: SVWTSPRRL (PRAME_HUMAN)
STWTSPRRW

SEQ ID NO: 145834 - protein, 10 aa, Artificial Sequence
  Description of Artificial Sequence: Synthetic peptide
  Seed: LSHCSQLTTL (PRAME_HUMAN)
LSHCSQLTTF

SEQ ID NO: 145835 - protein, 10 aa, Artificial Sequence
  Description of Artificial Sequence: Synthetic peptide
  Seed: SLLQHLIGLS (PRAME_HUMAN)
SALQHLIGLV

SEQ ID NO: 145836 - protein, 9 aa, Artificial Sequence
  Description of Artificial Sequence: Synthetic peptide
  Seed: LELLPRELF (PRAME_HUMAN)
LELLPRELA

SEQ ID NO: 145837 - protein, 10 aa, Artificial Sequence
  Description of Artificial Sequence: Synthetic peptide
  Seed: HASSYISPEK (PRAME_HUMAN)
HYSSYISPER

SEQ ID NO: 145838 - protein, 11 aa, Artificial Sequence
  Description of Artificial Sequence: Synthetic peptide
  Seed: QALLERASATL (PRAME_HUMAN)
QFLLERASATL

SEQ ID NO: 145839 - protein, 10 aa, Artificial Sequence
  Description of Artificial Sequence: Synthetic peptide
  Seed: RGRLDQLLRH (PRAME_HUMAN)
RCRLDQLLRF

SEQ ID NO: 145840 - protein, 8 aa, Artificial Sequence
  Description of Artificial Sequence: Synthetic peptide
  Seed: CLPLGVLM (PRAME_HUMAN)
CAPLGVLL

SEQ ID NO: 145841 - protein, 10 aa, Artificial Sequence
  Description of Artificial Sequence: Synthetic peptide
  Seed: ETFKAVLDGL (PRAME_HUMAN)
EVFKAVLDGL

SEQ ID NO: 145842 - protein, 11 aa, Artificial Sequence
  Description of Artificial Sequence: Synthetic peptide
  Seed: QALYVDSLFFL (PRAME_HUMAN)
QRLYVDSLFFV

SEQ ID NO: 145843 - protein, 9 aa, Artificial Sequence
  Description of Artificial Sequence: Synthetic peptide
  Seed: SQSPSVSQL (PRAME_HUMAN)
SESPSVSQA

SEQ ID NO: 145844 - protein, 9 aa, Artificial Sequence
  Description of Artificial Sequence: Synthetic peptide
  Seed: RRWKLQVLD (PRAME_HUMAN)
RRWKLQVLA

SEQ ID NO: 145845 - protein, 9 aa, Artificial Sequence
  Description of Artificial Sequence: Synthetic peptide
  Seed: DELFSYLIE (PRAME_HUMAN)
DELFSYLIH

SEQ ID NO: 145846 - protein, 9 aa, Artificial Sequence
  Description of Artificial Sequence: Synthetic peptide
  Seed: GQHLHLETF (PRAME_HUMAN)
GRHLHLETM

SEQ ID NO: 145847 - protein, 9 aa, Artificial Sequence
  Description of Artificial Sequence: Synthetic peptide
  Seed: FSPYLGQMI (PRAME_HUMAN)
FLPYLGQML

SEQ ID NO: 145848 - protein, 9 aa, Artificial Sequence
  Description of Artificial Sequence: Synthetic peptide
  Seed: VLMKGQHLH (PRAME_HUMAN)
VAMKGQHLR

SEQ ID NO: 145849 - protein, 10 aa, Artificial Sequence
  Description of Artificial Sequence: Synthetic peptide
  Seed: QYIAQFTSQF (PRAME_HUMAN)
QFIAQFTSQF

SEQ ID NO: 145850 - protein, 10 aa, Artificial Sequence
  Description of Artificial Sequence: Synthetic peptide
  Seed: QSLLQHLIGL (PRAME_HUMAN)
QWLLQHLIGV

SEQ ID NO: 145851 - protein, 10 aa, Artificial Sequence
  Description of Artificial Sequence: Synthetic peptide
  Seed: RELFPPLFMA (PRAME_HUMAN)
RILFPPLFMT

SEQ ID NO: 145852 - protein, 9 aa, Artificial Sequence
  Description of Artificial Sequence: Synthetic peptide
  Seed: ALYVDSLFF (PRAME_HUMAN)
AAYVDSLFM

SEQ ID NO: 145853 - protein, 9 aa, Artificial Sequence
  Description of Artificial Sequence: Synthetic peptide
  Seed: GACDELFSY (PRAME_HUMAN)
GLCDELFSY

SEQ ID NO: 145854 - protein, 10 aa, Artificial Sequence
  Description of Artificial Sequence: Synthetic peptide
  Seed: RLWGSIQSRY (PRAME_HUMAN)
RIWGSIQSRY

SEQ ID NO: 145855 - protein, 9 aa, Artificial Sequence
  Description of Artificial Sequence: Synthetic peptide
  Seed: GITDDQLLA (PRAME_HUMAN)
GLTDDQLLL

SEQ ID NO: 145856 - protein, 9 aa, Artificial Sequence
  Description of Artificial Sequence: Synthetic peptide
  Seed: ITDDQLLAL (PRAME_HUMAN)
IVDDQLLAI

SEQ ID NO: 145857 - protein, 9 aa, Artificial Sequence
  Description of Artificial Sequence: Synthetic peptide
  Seed: KMILKMVQL (PRAME_HUMAN)
KLILKMVQR

SEQ ID NO: 145858 - protein, 11 aa, Artificial Sequence
  Description of Artificial Sequence: Synthetic peptide
  Seed: LTDVSPEPLQA (PRAME_HUMAN)
LVDVSPEPLQL

SEQ ID NO: 145859 - protein, 10 aa, Artificial Sequence
  Description of Artificial Sequence: Synthetic peptide
  Seed: YGNSISISAL (PRAME_HUMAN)
YSNSISISAL

SEQ ID NO: 145860 - protein, 9 aa, Artificial Sequence
  Description of Artificial Sequence: Synthetic peptide
  Seed: IFAMPMQDI (PRAME_HUMAN)
IYAMPMQDI

SEQ ID NO: 145861 - protein, 10 aa, Artificial Sequence
  Description of Artificial Sequence: Synthetic peptide
  Seed: FFLRGRLDQL (PRAME_HUMAN)
FHLRGRLDQA

SEQ ID NO: 145862 - protein, 10 aa, Artificial Sequence
  Description of Artificial Sequence: Synthetic peptide
  Seed: HLERLAYLHA (PRAME_HUMAN)
HSERLAYLHA

SEQ ID NO: 145863 - protein, 10 aa, Artificial Sequence
  Description of Artificial Sequence: Synthetic peptide
  Seed: LSHIHASSYI (PRAME_HUMAN)
LTHIHASSYM

SEQ ID NO: 145864 - protein, 10 aa, Artificial Sequence
  Description of Artificial Sequence: Synthetic peptide
  Seed: LFPPLFMAAF (PRAME_HUMAN)
LYPPLFMAAM

SEQ ID NO: 145865 - protein, 10 aa, Artificial Sequence
  Description of Artificial Sequence: Synthetic peptide
  Seed: AKFSPYLGQM (PRAME_HUMAN)
AMFSPYLGQY

SEQ ID NO: 145866 - protein, 9 aa, Artificial Sequence
  Description of Artificial Sequence: Synthetic peptide
  Seed: AAFDGRHSQ (PRAME_HUMAN)
ASFDGRHSY

SEQ ID NO: 145867 - protein, 9 aa, Artificial Sequence
  Description of Artificial Sequence: Synthetic peptide
  Seed: RTFYDPEPI (PRAME_HUMAN)
RAFYDPEPW

SEQ ID NO: 145868 - protein, 10 aa, Artificial Sequence
  Description of Artificial Sequence: Synthetic peptide
  Seed: RGRLDQLLRH (PRAME_HUMAN)
RERLDQLLRK

SEQ ID NO: 145869 - protein, 9 aa, Artificial Sequence
  Description of Artificial Sequence: Synthetic peptide
  Seed: LLSHIHASS (PRAME_HUMAN)
LTSHIHASV

SEQ ID NO: 145870 - protein, 10 aa, Artificial Sequence
  Description of Artificial Sequence: Synthetic peptide
  Seed: GACDELFSYL (PRAME_HUMAN)
GICDELFSYA

SEQ ID NO: 145871 - protein, 10 aa, Artificial Sequence
  Description of Artificial Sequence: Synthetic peptide
  Seed: MLTDVSPEPL (PRAME_HUMAN)
MMTDVSPEPV

SEQ ID NO: 145872 - protein, 9 aa, Artificial Sequence
  Description of Artificial Sequence: Synthetic peptide
  Seed: ALLERASAT (PRAME_HUMAN)
AMLERASAA

SEQ ID NO: 145873 - protein, 8 aa, Artificial Sequence
  Description of Artificial Sequence: Synthetic peptide
  Seed: ITDDQLLA (PRAME_HUMAN)
IADDQLLL

SEQ ID NO: 145874 - protein, 10 aa, Artificial Sequence
  Description of Artificial Sequence: Synthetic peptide
  Seed: TFYDPEPILC (PRAME_HUMAN)
TYYDPEPILL

SEQ ID NO: 145875 - protein, 10 aa, Artificial Sequence
  Description of Artificial Sequence: Synthetic peptide
  Seed: SPYLGQMINL (PRAME_HUMAN)
SLYLGQMINF

SEQ ID NO: 145876 - protein, 10 aa, Artificial Sequence
  Description of Artificial Sequence: Synthetic peptide
  Seed: RLDQLLRHVM (PRAME_HUMAN)
RMDQLLRHVY

SEQ ID NO: 145877 - protein, 8 aa, Artificial Sequence
  Description of Artificial Sequence: Synthetic peptide
  Seed: AMVQAWPF (PRAME_HUMAN)
AQVQAWPY

SEQ ID NO: 145878 - protein, 9 aa, Artificial Sequence
  Description of Artificial Sequence: Synthetic peptide
  Seed: GQHLHLETF (PRAME_HUMAN)
GMHLHLETL

SEQ ID NO: 145879 - protein, 9 aa, Artificial Sequence
  Description of Artificial Sequence: Synthetic peptide
  Seed: ALYVDSLFF (PRAME_HUMAN)
AAYVDSLFW

SEQ ID NO: 145880 - protein, 9 aa, Artificial Sequence
  Description of Artificial Sequence: Synthetic peptide
  Seed: ITDDQLLAL (PRAME_HUMAN)
IFDDQLLAW

SEQ ID NO: 145881 - protein, 10 aa, Artificial Sequence
  Description of Artificial Sequence: Synthetic peptide
  Seed: LSQSPSVSQL (PRAME_HUMAN)
LYQSPSVSQF

SEQ ID NO: 145882 - protein, 9 aa, Artificial Sequence
  Description of Artificial Sequence: Synthetic peptide
  Seed: WLSANPCPH (PRAME_HUMAN)
WLSANPCPM

SEQ ID NO: 145883 - protein, 9 aa, Artificial Sequence
  Description of Artificial Sequence: Synthetic peptide
  Seed: RTFYDPEPI (PRAME_HUMAN)
RSFYDPEPK

SEQ ID NO: 145884 - protein, 9 aa, Artificial Sequence
  Description of Artificial Sequence: Synthetic peptide
  Seed: LAIAALELL (PRAME_HUMAN)
LLIAALELI

SEQ ID NO: 145885 - protein, 9 aa, Artificial Sequence
  Description of Artificial Sequence: Synthetic peptide
  Seed: RLAYLHARL (PRAME_HUMAN)
RIAYLHARI

SEQ ID NO: 145886 - protein, 8 aa, Artificial Sequence
  Description of Artificial Sequence: Synthetic peptide
  Seed: QHLHLETF (PRAME_HUMAN)
QHLHLETA

SEQ ID NO: 145887 - protein, 9 aa, Artificial Sequence
  Description of Artificial Sequence: Synthetic peptide
  Seed: CKKLKIFAM (PRAME_HUMAN)
CFKLKIFAL

SEQ ID NO: 145888 - protein, 10 aa, Artificial Sequence
  Description of Artificial Sequence: Synthetic peptide
  Seed: LLPRELFPPL (PRAME_HUMAN)
LMPRELFPPV

SEQ ID NO: 145889 - protein, 11 aa, Artificial Sequence
  Description of Artificial Sequence: Synthetic peptide
  Seed: LPTLAKFSPYL (PRAME_HUMAN)
LTTLAKFSPYL

SEQ ID NO: 145890 - protein, 9 aa, Artificial Sequence
  Description of Artificial Sequence: Synthetic peptide
  Seed: VLDGLDVLL (PRAME_HUMAN)
VFDGLDVLM

SEQ ID NO: 145891 - protein, 10 aa, Artificial Sequence
  Description of Artificial Sequence: Synthetic peptide
  Seed: FIPVEVLVDL (PRAME_HUMAN)
FQPVEVLVDL

SEQ ID NO: 145892 - protein, 9 aa, Artificial Sequence
  Description of Artificial Sequence: Synthetic peptide
  Seed: LLKDEALAI (PRAME_HUMAN)
LSKDEALAF

SEQ ID NO: 145893 - protein, 10 aa, Artificial Sequence
  Description of Artificial Sequence: Synthetic peptide
  Seed: AQFTSQFLSL (PRAME_HUMAN)
ARFTSQFLSF

SEQ ID NO: 145894 - protein, 9 aa, Artificial Sequence
  Description of Artificial Sequence: Synthetic peptide
  Seed: SQLSVLSLS (PRAME_HUMAN)
SILSVLSLV

SEQ ID NO: 145895 - protein, 9 aa, Artificial Sequence
  Description of Artificial Sequence: Synthetic peptide
  Seed: SQSPSVSQL (PRAME_HUMAN)
SYSPSVSQM

SEQ ID NO: 145896 - protein, 9 aa, Artificial Sequence
  Description of Artificial Sequence: Synthetic peptide
  Seed: TCLPLGVLM (PRAME_HUMAN)
TILPLGVLW

SEQ ID NO: 145897 - protein, 9 aa, Artificial Sequence
  Description of Artificial Sequence: Synthetic peptide
  Seed: MINLRRLLL (PRAME_HUMAN)
MGNLRRLLL

SEQ ID NO: 145898 - protein, 9 aa, Artificial Sequence
  Description of Artificial Sequence: Synthetic peptide
  Seed: ALYVDSLFF (PRAME_HUMAN)
AFYVDSLFY

SEQ ID NO: 145899 - protein, 9 aa, Artificial Sequence
  Description of Artificial Sequence: Synthetic peptide
  Seed: SQFLSLQCL (PRAME_HUMAN)
SRFLSLQCL

SEQ ID NO: 145900 - protein, 9 aa, Artificial Sequence
  Description of Artificial Sequence: Synthetic peptide
  Seed: YSFPEPEAA (PRAME_HUMAN)
YCFPEPEAY

SEQ ID NO: 145901 - protein, 11 aa, Artificial Sequence
  Description of Artificial Sequence: Synthetic peptide
  Seed: DVSPEPLQALL (PRAME_HUMAN)
DASPEPLQALR

SEQ ID NO: 145902 - protein, 9 aa, Artificial Sequence
  Description of Artificial Sequence: Synthetic peptide
  Seed: KFSPYLGQM (PRAME_HUMAN)
KTSPYLGQL

SEQ ID NO: 145903 - protein, 10 aa, Artificial Sequence
  Description of Artificial Sequence: Synthetic peptide
  Seed: SPYLGQMINL (PRAME_HUMAN)
SVYLGQMINL

SEQ ID NO: 145904 - protein, 8 aa, Artificial Sequence
  Description of Artificial Sequence: Synthetic peptide
  Seed: AEQPFIPV (PRAME_HUMAN)
AEQPFIPL

SEQ ID NO: 145905 - protein, 9 aa, Artificial Sequence
  Description of Artificial Sequence: Synthetic peptide
  Seed: YIAQFTSQF (PRAME_HUMAN)
YFAQFTSQF

SEQ ID NO: 145906 - protein, 10 aa, Artificial Sequence
  Description of Artificial Sequence: Synthetic peptide
  Seed: ALELLPRELF (PRAME_HUMAN)
ACELLPRELW

SEQ ID NO: 145907 - protein, 10 aa, Artificial Sequence
  Description of Artificial Sequence: Synthetic peptide
  Seed: KVKRKKNVLR (PRAME_HUMAN)
KTKRKKNVLA

SEQ ID NO: 145908 - protein, 10 aa, Artificial Sequence
  Description of Artificial Sequence: Synthetic peptide
  Seed: TTLSFYGNSI (PRAME_HUMAN)
TLLSFYGNSI

SEQ ID NO: 145909 - protein, 10 aa, Artificial Sequence
  Description of Artificial Sequence: Synthetic peptide
  Seed: LSHIHASSYI (PRAME_HUMAN)
LGHIHASSYW

SEQ ID NO: 145910 - protein, 9 aa, Artificial Sequence
  Description of Artificial Sequence: Synthetic peptide
  Seed: YSFPEPEAA (PRAME_HUMAN)
YEFPEPEAL

SEQ ID NO: 145911 - protein, 9 aa, Artificial Sequence
  Description of Artificial Sequence: Synthetic peptide
  Seed: LQHLIGLSN (PRAME_HUMAN)
LQHLIGLSV

SEQ ID NO: 145912 - protein, 9 aa, Artificial Sequence
  Description of Artificial Sequence: Synthetic peptide
  Seed: YGNSISISA (PRAME_HUMAN)
YRNSISISM

SEQ ID NO: 145913 - protein, 10 aa, Artificial Sequence
  Description of Artificial Sequence: Synthetic peptide
  Seed: FFLRGRLDQL (PRAME_HUMAN)
FELRGRLDQV

SEQ ID NO: 145914 - protein, 9 aa, Artificial Sequence
  Description of Artificial Sequence: Synthetic peptide
  Seed: ITDDQLLAL (PRAME_HUMAN)
IPDDQLLAV

SEQ ID NO: 145915 - protein, 10 aa, Artificial Sequence
  Description of Artificial Sequence: Synthetic peptide
  Seed: ALYVDSLFFL (PRAME_HUMAN)
AQYVDSLFFI

SEQ ID NO: 145916 - protein, 10 aa, Artificial Sequence
  Description of Artificial Sequence: Synthetic peptide
  Seed: ISISALQSLL (PRAME_HUMAN)
IVISALQSLV

SEQ ID NO: 145917 - protein, 9 aa, Artificial Sequence
  Description of Artificial Sequence: Synthetic peptide
  Seed: YIAQFTSQF (PRAME_HUMAN)
YPAQFTSQI

SEQ ID NO: 145918 - protein, 9 aa, Artificial Sequence
  Description of Artificial Sequence: Synthetic peptide
  Seed: MVQAWPFTC (PRAME_HUMAN)
MMQAWPFTF

SEQ ID NO: 145919 - protein, 10 aa, Artificial Sequence
  Description of Artificial Sequence: Synthetic peptide
  Seed: RLSEGDVMHL (PRAME_HUMAN)
RISEGDVMHM

SEQ ID NO: 145920 - protein, 9 aa, Artificial Sequence
  Description of Artificial Sequence: Synthetic peptide
  Seed: LSNLTHVLY (PRAME_HUMAN)
LQNLTHVLF

SEQ ID NO: 145921 - protein, 9 aa, Artificial Sequence
  Description of Artificial Sequence: Synthetic peptide
  Seed: MNPLETLSI (PRAME_HUMAN)
MSPLETLSI

SEQ ID NO: 145922 - protein, 10 aa, Artificial Sequence
  Description of Artificial Sequence: Synthetic peptide
  Seed: KKLKIFAMPM (PRAME_HUMAN)
KQLKIFAMPF

SEQ ID NO: 145923 - protein, 9 aa, Artificial Sequence
  Description of Artificial Sequence: Synthetic peptide
  Seed: YEDIHGTLH (PRAME_HUMAN)
YDDIHGTLL

SEQ ID NO: 145924 - protein, 9 aa, Artificial Sequence
  Description of Artificial Sequence: Synthetic peptide
  Seed: STEAEQPFI (PRAME_HUMAN)
SAEAEQPFM

SEQ ID NO: 145925 - protein, 9 aa, Artificial Sequence
  Description of Artificial Sequence: Synthetic peptide
  Seed: HVMNPLETL (PRAME_HUMAN)
HMMNPLETW

SEQ ID NO: 145926 - protein, 9 aa, Artificial Sequence
  Description of Artificial Sequence: Synthetic peptide
  Seed: KLKIFAMPM (PRAME_HUMAN)
KTKIFAMPQ

SEQ ID NO: 145927 - protein, 9 aa, Artificial Sequence
  Description of Artificial Sequence: Synthetic peptide
  Seed: GQHLHLETF (PRAME_HUMAN)
GKHLHLETF

SEQ ID NO: 145928 - protein, 10 aa, Artificial Sequence
  Description of Artificial Sequence: Synthetic peptide
  Seed: SPYLGQMINL (PRAME_HUMAN)
SLYLGQMINW

SEQ ID NO: 145929 - protein, 10 aa, Artificial Sequence
  Description of Artificial Sequence: Synthetic peptide
  Seed: ELFPPLFMAA (PRAME_HUMAN)
ELFPPLFMAV

SEQ ID NO: 145930 - protein, 9 aa, Artificial Sequence
  Description of Artificial Sequence: Synthetic peptide
  Seed: PYLGQMINL (PRAME_HUMAN)
PYLGQMINI

SEQ ID NO: 145931 - protein, 9 aa, Artificial Sequence
  Description of Artificial Sequence: Synthetic peptide
  Seed: MINLRRLLL (PRAME_HUMAN)
MTNLRRLLM

SEQ ID NO: 145932 - protein, 9 aa, Artificial Sequence
  Description of Artificial Sequence: Synthetic peptide
  Seed: RLRELLCEL (PRAME_HUMAN)
RPRELLCEM

SEQ ID NO: 145933 - protein, 10 aa, Artificial Sequence
  Description of Artificial Sequence: Synthetic peptide
  Seed: VLSLSGVMLT (PRAME_HUMAN)
VLSLSGVMLV

SEQ ID NO: 145934 - protein, 9 aa, Artificial Sequence
  Description of Artificial Sequence: Synthetic peptide
  Seed: SIEDLEVTC (PRAME_HUMAN)
SVEDLEVTI

SEQ ID NO: 145935 - protein, 9 aa, Artificial Sequence
  Description of Artificial Sequence: Synthetic peptide
  Seed: AAFDGRHSQ (PRAME_HUMAN)
ASFDGRHSH

SEQ ID NO: 145936 - protein, 9 aa, Artificial Sequence
  Description of Artificial Sequence: Synthetic peptide
  Seed: GLSNLTHVL (PRAME_HUMAN)
GQSNLTHVM

SEQ ID NO: 145937 - protein, 9 aa, Artificial Sequence
  Description of Artificial Sequence: Synthetic peptide
  Seed: SPSVSQLSV (PRAME_HUMAN)
SASVSQLSW

SEQ ID NO: 145938 - protein, 9 aa, Artificial Sequence
  Description of Artificial Sequence: Synthetic peptide
  Seed: KVDGLSTEA (PRAME_HUMAN)
KVDGLSTEV

SEQ ID NO: 145939 - protein, 9 aa, Artificial Sequence
  Description of Artificial Sequence: Synthetic peptide
  Seed: ALQSLLQHL (PRAME_HUMAN)
AAQSLLQHV

SEQ ID NO: 145940 - protein, 10 aa, Artificial Sequence
  Description of Artificial Sequence: Synthetic peptide
  Seed: ALYVDSLFFL (PRAME_HUMAN)
ARYVDSLFFI

SEQ ID NO: 145941 - protein, 9 aa, Artificial Sequence
  Description of Artificial Sequence: Synthetic peptide
  Seed: WKLPTLAKF (PRAME_HUMAN)
WILPTLAKY

SEQ ID NO: 145942 - protein, 9 aa, Artificial Sequence
  Description of Artificial Sequence: Synthetic peptide
  Seed: YSFPEPEAA (PRAME_HUMAN)
YQFPEPEAH

SEQ ID NO: 145943 - protein, 11 aa, Artificial Sequence
  Description of Artificial Sequence: Synthetic peptide
  Seed: SNLTHVLYPVP (PRAME_HUMAN)
SMLTHVLYPVN

SEQ ID NO: 145944 - protein, 9 aa, Artificial Sequence
  Description of Artificial Sequence: Synthetic peptide
  Seed: TLHLERLAY (PRAME_HUMAN)
TKHLERLAM

SEQ ID NO: 145945 - protein, 10 aa, Artificial Sequence
  Description of Artificial Sequence: Synthetic peptide
  Seed: MVQAWPFTCL (PRAME_HUMAN)
MRQAWPFTCM

SEQ ID NO: 145946 - protein, 10 aa, Artificial Sequence
  Description of Artificial Sequence: Synthetic peptide
  Seed: QAWPFTCLPL (PRAME_HUMAN)
QFWPFTCLPW

SEQ ID NO: 145947 - protein, 9 aa, Artificial Sequence
  Description of Artificial Sequence: Synthetic peptide
  Seed: LSNLTHVLY (PRAME_HUMAN)
LGNLTHVLW

SEQ ID NO: 145948 - protein, 9 aa, Artificial Sequence
  Description of Artificial Sequence: Synthetic peptide
  Seed: LFMAAFDGR (PRAME_HUMAN)
LTMAAFDGK

SEQ ID NO: 145949 - protein, 9 aa, Artificial Sequence
  Description of Artificial Sequence: Synthetic peptide
  Seed: KFSPYLGQM (PRAME_HUMAN)
KTSPYLGQF

SEQ ID NO: 145950 - protein, 9 aa, Artificial Sequence
  Description of Artificial Sequence: Synthetic peptide
  Seed: LQSLLQHLI (PRAME_HUMAN)
LMSLLQHLM

SEQ ID NO: 145951 - protein, 9 aa, Artificial Sequence
  Description of Artificial Sequence: Synthetic peptide
  Seed: ESYEDIHGT (PRAME_HUMAN)
ETYEDIHGS

SEQ ID NO: 145952 - protein, 9 aa, Artificial Sequence
  Description of Artificial Sequence: Synthetic peptide
  Seed: EVLVDLFLK (PRAME_HUMAN)
ETLVDLFLK

SEQ ID NO: 145953 - protein, 9 aa, Artificial Sequence
  Description of Artificial Sequence: Synthetic peptide
  Seed: LLRHVMNPL (PRAME_HUMAN)
LRRHVMNPF

SEQ ID NO: 145954 - protein, 9 aa, Artificial Sequence
  Description of Artificial Sequence: Synthetic peptide
  Seed: QPFIPVEVL (PRAME_HUMAN)
QRFIPVEVA

SEQ ID NO: 145955 - protein, 10 aa, Artificial Sequence
  Description of Artificial Sequence: Synthetic peptide
  Seed: KNVLRLCCKK (PRAME_HUMAN)
KTVLRLCCKR

SEQ ID NO: 145956 - protein, 10 aa, Artificial Sequence
  Description of Artificial Sequence: Synthetic peptide
  Seed: AVLDGLDVLL (PRAME_HUMAN)
AVLDGLDVLW

SEQ ID NO: 145957 - protein, 9 aa, Artificial Sequence
  Description of Artificial Sequence: Synthetic peptide
  Seed: YVDSLFFLR (PRAME_HUMAN)
YQDSLFFLR

SEQ ID NO: 145958 - protein, 10 aa, Artificial Sequence
  Description of Artificial Sequence: Synthetic peptide
  Seed: RLAYLHARLR (PRAME_HUMAN)
RQAYLHARLR

SEQ ID NO: 145959 - protein, 11 aa, Artificial Sequence
  Description of Artificial Sequence: Synthetic peptide
  Seed: ALYVDSLFFLR (PRAME_HUMAN)
AMYVDSLFFLH

SEQ ID NO: 145960 - protein, 9 aa, Artificial Sequence
  Description of Artificial Sequence: Synthetic peptide
  Seed: CKKLKIFAM (PRAME_HUMAN)
CTKLKIFAL

SEQ ID NO: 145961 - protein, 9 aa, Artificial Sequence
  Description of Artificial Sequence: Synthetic peptide
  Seed: ELFPPLFMA (PRAME_HUMAN)
EIFPPLFML

SEQ ID NO: 145962 - protein, 9 aa, Artificial Sequence
  Description of Artificial Sequence: Synthetic peptide
  Seed: ESYEDIHGT (PRAME_HUMAN)
EIYEDIHGV

SEQ ID NO: 145963 - protein, 10 aa, Artificial Sequence
  Description of Artificial Sequence: Synthetic peptide
  Seed: SMVWLSANPC (PRAME_HUMAN)
SVVWLSANPV

SEQ ID NO: 145964 - protein, 9 aa, Artificial Sequence
  Description of Artificial Sequence: Synthetic peptide
  Seed: YVDSLFFLR (PRAME_HUMAN)
YLDSLFFLY

SEQ ID NO: 145965 - protein, 11 aa, Artificial Sequence
  Description of Artificial Sequence: Synthetic peptide
  Seed: ALYVDSLFFLR (PRAME_HUMAN)
AIYVDSLFFLK

SEQ ID NO: 145966 - protein, 9 aa, Artificial Sequence
  Description of Artificial Sequence: Synthetic peptide
  Seed: CKKLKIFAM (PRAME_HUMAN)
CNKLKIFAM

SEQ ID NO: 145967 - protein, 8 aa, Artificial Sequence
  Description of Artificial Sequence: Synthetic peptide
  Seed: TLAKFSPY (PRAME_HUMAN)
TMAKFSPF

SEQ ID NO: 145968 - protein, 8 aa, Artificial Sequence
  Description of Artificial Sequence: Synthetic peptide
  Seed: FYDPEPIL (PRAME_HUMAN)
FIDPEPIF

SEQ ID NO: 145969 - protein, 8 aa, Artificial Sequence
  Description of Artificial Sequence: Synthetic peptide
  Seed: LAKFSPYL (PRAME_HUMAN)
LLKFSPYV

SEQ ID NO: 145970 - protein, 10 aa, Artificial Sequence
  Description of Artificial Sequence: Synthetic peptide
  Seed: MVQAWPFTCL (PRAME_HUMAN)
MFQAWPFTCF

SEQ ID NO: 145971 - protein, 9 aa, Artificial Sequence
  Description of Artificial Sequence: Synthetic peptide
  Seed: NSHQDFWTV (PRAME_HUMAN)
NVHQDFWTL

SEQ ID NO: 145972 - protein, 9 aa, Artificial Sequence
  Description of Artificial Sequence: Synthetic peptide
  Seed: SQLSVLSLS (PRAME_HUMAN)
SMLSVLSLL

SEQ ID NO: 145973 - protein, 9 aa, Artificial Sequence
  Description of Artificial Sequence: Synthetic peptide
  Seed: ITDDQLLAL (PRAME_HUMAN)
ILDDQLLAV

SEQ ID NO: 145974 - protein, 9 aa, Artificial Sequence
  Description of Artificial Sequence: Synthetic peptide
  Seed: SMVWLSANP (PRAME_HUMAN)
SMVWLSANV

SEQ ID NO: 145975 - protein, 11 aa, Artificial Sequence
  Description of Artificial Sequence: Synthetic peptide
  Seed: RRWKLQVLDLR (PRAME_HUMAN)
RYWKLQVLDLR

SEQ ID NO: 145976 - protein, 9 aa, Artificial Sequence
  Description of Artificial Sequence: Synthetic peptide
  Seed: RRLLLSHIH (PRAME_HUMAN)
RRLLLSHIY

SEQ ID NO: 145977 - protein, 9 aa, Artificial Sequence
  Description of Artificial Sequence: Synthetic peptide
  Seed: VSPEPLQAL (PRAME_HUMAN)
VSPEPLQAW

SEQ ID NO: 145978 - protein, 9 aa, Artificial Sequence
  Description of Artificial Sequence: Synthetic peptide
  Seed: LDQLLRHVM (PRAME_HUMAN)
LEQLLRHVL

SEQ ID NO: 145979 - protein, 9 aa, Artificial Sequence
  Description of Artificial Sequence: Synthetic peptide
  Seed: RTFYDPEPI (PRAME_HUMAN)
RKFYDPEPI

SEQ ID NO: 145980 - protein, 10 aa, Artificial Sequence
  Description of Artificial Sequence: Synthetic peptide
  Seed: YISPEKEEQY (PRAME_HUMAN)
YMSPEKEEQW

SEQ ID NO: 145981 - protein, 10 aa, Artificial Sequence
  Description of Artificial Sequence: Synthetic peptide
  Seed: IGLSNLTHVL (PRAME_HUMAN)
ILLSNLTHVF

SEQ ID NO: 145982 - protein, 9 aa, Artificial Sequence
  Description of Artificial Sequence: Synthetic peptide
  Seed: YPVPLESYE (PRAME_HUMAN)
YAVPLESYY

SEQ ID NO: 145983 - protein, 9 aa, Artificial Sequence
  Description of Artificial Sequence: Synthetic peptide
  Seed: RHSQTLKAM (PRAME_HUMAN)
RFSQTLKAF

SEQ ID NO: 145984 - protein, 9 aa, Artificial Sequence
  Description of Artificial Sequence: Synthetic peptide
  Seed: SFYGNSISI (PRAME_HUMAN)
SYYGNSISM

SEQ ID NO: 145985 - protein, 10 aa, Artificial Sequence
  Description of Artificial Sequence: Synthetic peptide
  Seed: VLDGLDVLLA (PRAME_HUMAN)
VLDGLDVLLM

SEQ ID NO: 145986 - protein, 9 aa, Artificial Sequence
  Description of Artificial Sequence: Synthetic peptide
  Seed: ITDDQLLAL (PRAME_HUMAN)
IEDDQLLAL

SEQ ID NO: 145987 - protein, 11 aa, Artificial Sequence
  Description of Artificial Sequence: Synthetic peptide
  Seed: LPTLAKFSPYL (PRAME_HUMAN)
LVTLAKFSPYV

SEQ ID NO: 145988 - protein, 10 aa, Artificial Sequence
  Description of Artificial Sequence: Synthetic peptide
  Seed: IGLSNLTHVL (PRAME_HUMAN)
IWLSNLTHVI

SEQ ID NO: 145989 - protein, 11 aa, Artificial Sequence
  Description of Artificial Sequence: Synthetic peptide
  Seed: RLWGSIQSRYI (PRAME_HUMAN)
RIWGSIQSRYI

SEQ ID NO: 145990 - protein, 10 aa, Artificial Sequence
  Description of Artificial Sequence: Synthetic peptide
  Seed: KFSPYLGQMI (PRAME_HUMAN)
KWSPYLGQMI

SEQ ID NO: 145991 - protein, 9 aa, Artificial Sequence
  Description of Artificial Sequence: Synthetic peptide
  Seed: RELLCELGR (PRAME_HUMAN)
RYLLCELGR

SEQ ID NO: 145992 - protein, 9 aa, Artificial Sequence
  Description of Artificial Sequence: Synthetic peptide
  Seed: ALQSLLQHL (PRAME_HUMAN)
AIQSLLQHF

SEQ ID NO: 145993 - protein, 10 aa, Artificial Sequence
  Description of Artificial Sequence: Synthetic peptide
  Seed: RGRLDQLLRH (PRAME_HUMAN)
RKRLDQLLRL

SEQ ID NO: 145994 - protein, 8 aa, Artificial Sequence
  Description of Artificial Sequence: Synthetic peptide
  Seed: VLMKGQHL (PRAME_HUMAN)
VAMKGQHL

SEQ ID NO: 145995 - protein, 9 aa, Artificial Sequence
  Description of Artificial Sequence: Synthetic peptide
  Seed: WSGNRASLY (PRAME_HUMAN)
WMGNRASLY

SEQ ID NO: 145996 - protein, 9 aa, Artificial Sequence
  Description of Artificial Sequence: Synthetic peptide
  Seed: YLHARLREL (PRAME_HUMAN)
YHHARLREF

SEQ ID NO: 145997 - protein, 10 aa, Artificial Sequence
  Description of Artificial Sequence: Synthetic peptide
  Seed: TLQDLVFDEC (PRAME_HUMAN)
TMQDLVFDEM

SEQ ID NO: 145998 - protein, 10 aa, Artificial Sequence
  Description of Artificial Sequence: Synthetic peptide
  Seed: RLSEGDVMHL (PRAME_HUMAN)
RSSEGDVMHF

SEQ ID NO: 145999 - protein, 9 aa, Artificial Sequence
  Description of Artificial Sequence: Synthetic peptide
  Seed: ACDELFSYL (PRAME_HUMAN)
AQDELFSYI

SEQ ID NO: 146000 - protein, 10 aa, Artificial Sequence
  Description of Artificial Sequence: Synthetic peptide
  Seed: HCSQLTTLSF (PRAME_HUMAN)
HGSQLTTLSW

SEQ ID NO: 146001 - protein, 8 aa, Artificial Sequence
  Description of Artificial Sequence: Synthetic peptide
  Seed: TDDQLLAL (PRAME_HUMAN)
TYDQLLAL

SEQ ID NO: 146002 - protein, 9 aa, Artificial Sequence
  Description of Artificial Sequence: Synthetic peptide
  Seed: VFDECGITD (PRAME_HUMAN)
VLDECGITL

SEQ ID NO: 146003 - protein, 9 aa, Artificial Sequence
  Description of Artificial Sequence: Synthetic peptide
  Seed: ELFPPLFMA (PRAME_HUMAN)
EMFPPLFMA

SEQ ID NO: 146004 - protein, 10 aa, Artificial Sequence
  Description of Artificial Sequence: Synthetic peptide
  Seed: TVWSGNRASL (PRAME_HUMAN)
TAWSGNRASR

SEQ ID NO: 146005 - protein, 10 aa, Artificial Sequence
  Description of Artificial Sequence: Synthetic peptide
  Seed: AQFTSQFLSL (PRAME_HUMAN)
AIFTSQFLSL

SEQ ID NO: 146006 - protein, 10 aa, Artificial Sequence
  Description of Artificial Sequence: Synthetic peptide
  Seed: VRPRRWKLQV (PRAME_HUMAN)
VFPRRWKLQL

SEQ ID NO: 146007 - protein, 10 aa, Artificial Sequence
  Description of Artificial Sequence: Synthetic peptide
  Seed: TFYDPEPILC (PRAME_HUMAN)
TRYDPEPILY

SEQ ID NO: 146008 - protein, 10 aa, Artificial Sequence
  Description of Artificial Sequence: Synthetic peptide
  Seed: GRPSMVWLSA (PRAME_HUMAN)
GSPSMVWLSL

SEQ ID NO: 146009 - protein, 9 aa, Artificial Sequence
  Description of Artificial Sequence: Synthetic peptide
  Seed: VSPEPLQAL (PRAME_HUMAN)
VPPEPLQAI

SEQ ID NO: 146010 - protein, 10 aa, Artificial Sequence
  Description of Artificial Sequence: Synthetic peptide
  Seed: FFLRGRLDQL (PRAME_HUMAN)
FCLRGRLDQL

SEQ ID NO: 146011 - protein, 9 aa, Artificial Sequence
  Description of Artificial Sequence: Synthetic peptide
  Seed: MVQAWPFTC (PRAME_HUMAN)
MMQAWPFTA

SEQ ID NO: 146012 - protein, 9 aa, Artificial Sequence
  Description of Artificial Sequence: Synthetic peptide
  Seed: KLKIFAMPM (PRAME_HUMAN)
KLKIFAMPY

SEQ ID NO: 146013 - protein, 10 aa, Artificial Sequence
  Description of Artificial Sequence: Synthetic peptide
  Seed: RRLWGSIQSR (PRAME_HUMAN)
RGLWGSIQSK

SEQ ID NO: 146014 - protein, 9 aa, Artificial Sequence
  Description of Artificial Sequence: Synthetic peptide
  Seed: RTFYDPEPI (PRAME_HUMAN)
RQFYDPEPM

SEQ ID NO: 146015 - protein, 9 aa, Artificial Sequence
  Description of Artificial Sequence: Synthetic peptide
  Seed: RLAYLHARL (PRAME_HUMAN)
RHAYLHARF

SEQ ID NO: 146016 - protein, 9 aa, Artificial Sequence
  Description of Artificial Sequence: Synthetic peptide
  Seed: RGRLDQLLR (PRAME_HUMAN)
RMRLDQLLL

SEQ ID NO: 146017 - protein, 9 aa, Artificial Sequence
  Description of Artificial Sequence: Synthetic peptide
  Seed: SVLSLSGVM (PRAME_HUMAN)
SELSLSGVY

SEQ ID NO: 146018 - protein, 10 aa, Artificial Sequence
  Description of Artificial Sequence: Synthetic peptide
  Seed: ALAIAALELL (PRAME_HUMAN)
AQAIAALELV

SEQ ID NO: 146019 - protein, 9 aa, Artificial Sequence
  Description of Artificial Sequence: Synthetic peptide
  Seed: SFYGNSISI (PRAME_HUMAN)
SLYGNSISV

SEQ ID NO: 146020 - protein, 9 aa, Artificial Sequence
  Description of Artificial Sequence: Synthetic peptide
  Seed: YSFPEPEAA (PRAME_HUMAN)
YWFPEPEAF

SEQ ID NO: 146021 - protein, 9 aa, Artificial Sequence
  Description of Artificial Sequence: Synthetic peptide
  Seed: AVLDGLDVL (PRAME_HUMAN)
AILDGLDVY

SEQ ID NO: 146022 - protein, 9 aa, Artificial Sequence
  Description of Artificial Sequence: Synthetic peptide
  Seed: YIAQFTSQF (PRAME_HUMAN)
YFAQFTSQV

SEQ ID NO: 146023 - protein, 11 aa, Artificial Sequence
  Description of Artificial Sequence: Synthetic peptide
  Seed: EALAIAALELL (PRAME_HUMAN)
EYLAIAALELL

SEQ ID NO: 146024 - protein, 8 aa, Artificial Sequence
  Description of Artificial Sequence: Synthetic peptide
  Seed: VLDGLDVL (PRAME_HUMAN)
VFDGLDVM

SEQ ID NO: 146025 - protein, 10 aa, Artificial Sequence
  Description of Artificial Sequence: Synthetic peptide
  Seed: MNPLETLSIT (PRAME_HUMAN)
MYPLETLSIA

SEQ ID NO: 146026 - protein, 11 aa, Artificial Sequence
  Description of Artificial Sequence: Synthetic peptide
  Seed: SNLTHVLYPVP (PRAME_HUMAN)
SMLTHVLYPVR

SEQ ID NO: 146027 - protein, 9 aa, Artificial Sequence
  Description of Artificial Sequence: Synthetic peptide
  Seed: LYPVPLESY (PRAME_HUMAN)
LAPVPLESM

SEQ ID NO: 146028 - protein, 9 aa, Artificial Sequence
  Description of Artificial Sequence: Synthetic peptide
  Seed: AAFDGRHSQ (PRAME_HUMAN)
ASFDGRHSL

SEQ ID NO: 146029 - protein, 9 aa, Artificial Sequence
  Description of Artificial Sequence: Synthetic peptide
  Seed: LALLPSLSH (PRAME_HUMAN)
LSLLPSLSF

SEQ ID NO: 146030 - protein, 10 aa, Artificial Sequence
  Description of Artificial Sequence: Synthetic peptide
  Seed: IGLSNLTHVL (PRAME_HUMAN)
ILLSNLTHVR

SEQ ID NO: 146031 - protein, 9 aa, Artificial Sequence
  Description of Artificial Sequence: Synthetic peptide
  Seed: VLMKGQHLH (PRAME_HUMAN)
VSMKGQHLF

SEQ ID NO: 146032 - protein, 9 aa, Artificial Sequence
  Description of Artificial Sequence: Synthetic peptide
  Seed: IPVEVLVDL (PRAME_HUMAN)
IAVEVLVDL

SEQ ID NO: 146033 - protein, 10 aa, Artificial Sequence
  Description of Artificial Sequence: Synthetic peptide
  Seed: TSQFLSLQCL (PRAME_HUMAN)
TWQFLSLQCF

SEQ ID NO: 146034 - protein, 11 aa, Artificial Sequence
  Description of Artificial Sequence: Synthetic peptide
  Seed: RLVELAGQSLL (PRAME_HUMAN)
RQVELAGQSLI

SEQ ID NO: 146035 - protein, 9 aa, Artificial Sequence
  Description of Artificial Sequence: Synthetic peptide
  Seed: TSPRRLVEL (PRAME_HUMAN)
TTPRRLVEF

SEQ ID NO: 146036 - protein, 9 aa, Artificial Sequence
  Description of Artificial Sequence: Synthetic peptide
  Seed: SQFLSLQCL (PRAME_HUMAN)
SAFLSLQCM

SEQ ID NO: 146037 - protein, 9 aa, Artificial Sequence
  Description of Artificial Sequence: Synthetic peptide
  Seed: LSEGDVMHL (PRAME_HUMAN)
LSEGDVMHY

SEQ ID NO: 146038 - protein, 9 aa, Artificial Sequence
  Description of Artificial Sequence: Synthetic peptide
  Seed: YIAQFTSQF (PRAME_HUMAN)
YMAQFTSQI

SEQ ID NO: 146039 - protein, 9 aa, Artificial Sequence
  Description of Artificial Sequence: Synthetic peptide
  Seed: VSQLSVLSL (PRAME_HUMAN)
VYQLSVLSM

SEQ ID NO: 146040 - protein, 9 aa, Artificial Sequence
  Description of Artificial Sequence: Synthetic peptide
  Seed: YIAQFTSQF (PRAME_HUMAN)
YPAQFTSQA

SEQ ID NO: 146041 - protein, 9 aa, Artificial Sequence
  Description of Artificial Sequence: Synthetic peptide
  Seed: SHIHASSYI (PRAME_HUMAN)
SWIHASSYL

SEQ ID NO: 146042 - protein, 10 aa, Artificial Sequence
  Description of Artificial Sequence: Synthetic peptide
  Seed: KKLKIFAMPM (PRAME_HUMAN)
KWLKIFAMPK

SEQ ID NO: 146043 - protein, 10 aa, Artificial Sequence
  Description of Artificial Sequence: Synthetic peptide
  Seed: LLLSHIHASS (PRAME_HUMAN)
LNLSHIHASA

SEQ ID NO: 146044 - protein, 9 aa, Artificial Sequence
  Description of Artificial Sequence: Synthetic peptide
  Seed: LYPVPLESY (PRAME_HUMAN)
LTPVPLESY

SEQ ID NO: 146045 - protein, 9 aa, Artificial Sequence
  Description of Artificial Sequence: Synthetic peptide
  Seed: LTDVSPEPL (PRAME_HUMAN)
LIDVSPEPY

SEQ ID NO: 146046 - protein, 9 aa, Artificial Sequence
  Description of Artificial Sequence: Synthetic peptide
  Seed: IAALELLPR (PRAME_HUMAN)
IFALELLPR

SEQ ID NO: 146047 - protein, 9 aa, Artificial Sequence
  Description of Artificial Sequence: Synthetic peptide
  Seed: EAEQPFIPV (PRAME_HUMAN)
ETEQPFIPV

SEQ ID NO: 146048 - protein, 10 aa, Artificial Sequence
  Description of Artificial Sequence: Synthetic peptide
  Seed: KVKRKKNVLR (PRAME_HUMAN)
KTKRKKNVLR

SEQ ID NO: 146049 - protein, 11 aa, Artificial Sequence
  Description of Artificial Sequence: Synthetic peptide
  Seed: KMVQLDSIEDL (PRAME_HUMAN)
KQVQLDSIEDL

SEQ ID NO: 146050 - protein, 9 aa, Artificial Sequence
  Description of Artificial Sequence: Synthetic peptide
  Seed: IFAMPMQDI (PRAME_HUMAN)
IYAMPMQDY

SEQ ID NO: 146051 - protein, 10 aa, Artificial Sequence
  Description of Artificial Sequence: Synthetic peptide
  Seed: SMSVWTSPRR (PRAME_HUMAN)
SLSVWTSPRK

SEQ ID NO: 146052 - protein, 9 aa, Artificial Sequence
  Description of Artificial Sequence: Synthetic peptide
  Seed: CRLSEGDVM (PRAME_HUMAN)
CQLSEGDVY

SEQ ID NO: 146053 - protein, 9 aa, Artificial Sequence
  Description of Artificial Sequence: Synthetic peptide
  Seed: AEQPFIPVE (PRAME_HUMAN)
ADQPFIPVF

SEQ ID NO: 146054 - protein, 9 aa, Artificial Sequence
  Description of Artificial Sequence: Synthetic peptide
  Seed: LQSLLQHLI (PRAME_HUMAN)
LESLLQHLM

SEQ ID NO: 146055 - protein, 10 aa, Artificial Sequence
  Description of Artificial Sequence: Synthetic peptide
  Seed: LLSHIHASSY (PRAME_HUMAN)
LVSHIHASSY

SEQ ID NO: 146056 - protein, 9 aa, Artificial Sequence
  Description of Artificial Sequence: Synthetic peptide
  Seed: SHQDFWTVW (PRAME_HUMAN)
SHQDFWTVM

SEQ ID NO: 146057 - protein, 10 aa, Artificial Sequence
  Description of Artificial Sequence: Synthetic peptide
  Seed: YSFPEPEAAQ (PRAME_HUMAN)
YAFPEPEAAI

SEQ ID NO: 146058 - protein, 9 aa, Artificial Sequence
  Description of Artificial Sequence: Synthetic peptide
  Seed: RTFYDPEPI (PRAME_HUMAN)
RQFYDPEPY

SEQ ID NO: 146059 - protein, 11 aa, Artificial Sequence
  Description of Artificial Sequence: Synthetic peptide
  Seed: RTFYDPEPILC (PRAME_HUMAN)
RTFYDPEPILL

SEQ ID NO: 146060 - protein, 11 aa, Artificial Sequence
  Description of Artificial Sequence: Synthetic peptide
  Seed: ALYVDSLFFLR (PRAME_HUMAN)
ALYVDSLFFLA

SEQ ID NO: 146061 - protein, 9 aa, Artificial Sequence
  Description of Artificial Sequence: Synthetic peptide
  Seed: ETLSITNCR (PRAME_HUMAN)
EMLSITNCK

SEQ ID NO: 146062 - protein, 10 aa, Artificial Sequence
  Description of Artificial Sequence: Synthetic peptide
  Seed: MVQAWPFTCL (PRAME_HUMAN)
MTQAWPFTCA

SEQ ID NO: 146063 - protein, 9 aa, Artificial Sequence
  Description of Artificial Sequence: Synthetic peptide
  Seed: AFDGRHSQT (PRAME_HUMAN)
AFDGRHSQI

SEQ ID NO: 146064 - protein, 10 aa, Artificial Sequence
  Description of Artificial Sequence: Synthetic peptide
  Seed: VLYPVPLESY (PRAME_HUMAN)
VGYPVPLESY

SEQ ID NO: 146065 - protein, 9 aa, Artificial Sequence
  Description of Artificial Sequence: Synthetic peptide
  Seed: AVLDGLDVL (PRAME_HUMAN)
AVLDGLDVF

SEQ ID NO: 146066 - protein, 9 aa, Artificial Sequence
  Description of Artificial Sequence: Synthetic peptide
  Seed: LSLQCLQAL (PRAME_HUMAN)
LMLQCLQAY

SEQ ID NO: 146067 - protein, 9 aa, Artificial Sequence
  Description of Artificial Sequence: Synthetic peptide
  Seed: LLAQEVRPR (PRAME_HUMAN)
LYAQEVRPR

SEQ ID NO: 146068 - protein, 9 aa, Artificial Sequence
  Description of Artificial Sequence: Synthetic peptide
  Seed: LLRHVMNPL (PRAME_HUMAN)
LVRHVMNPF

SEQ ID NO: 146069 - protein, 10 aa, Artificial Sequence
  Description of Artificial Sequence: Synthetic peptide
  Seed: MLTDVSPEPL (PRAME_HUMAN)
MATDVSPEPI

SEQ ID NO: 146070 - protein, 9 aa, Artificial Sequence
  Description of Artificial Sequence: Synthetic peptide
  Seed: YSFPEPEAA (PRAME_HUMAN)
YYFPEPEAY

SEQ ID NO: 146071 - protein, 10 aa, Artificial Sequence
  Description of Artificial Sequence: Synthetic peptide
  Seed: ESYEDIHGTL (PRAME_HUMAN)
ETYEDIHGTF

SEQ ID NO: 146072 - protein, 10 aa, Artificial Sequence
  Description of Artificial Sequence: Synthetic peptide
  Seed: ASATLQDLVF (PRAME_HUMAN)
AYATLQDLVW

SEQ ID NO: 146073 - protein, 11 aa, Artificial Sequence
  Description of Artificial Sequence: Synthetic peptide
  Seed: GTLHLERLAYL (PRAME_HUMAN)
GYLHLERLAYA

SEQ ID NO: 146074 - protein, 10 aa, Artificial Sequence
  Description of Artificial Sequence: Synthetic peptide
  Seed: SQLTTLSFYG (PRAME_HUMAN)
SKLTTLSFYF

SEQ ID NO: 146075 - protein, 8 aa, Artificial Sequence
  Description of Artificial Sequence: Synthetic peptide
  Seed: FYDPEPIL (PRAME_HUMAN)
FVDPEPII

SEQ ID NO: 146076 - protein, 10 aa, Artificial Sequence
  Description of Artificial Sequence: Synthetic peptide
  Seed: SPYLGQMINL (PRAME_HUMAN)
SEYLGQMINI

SEQ ID NO: 146077 - protein, 11 aa, Artificial Sequence
  Description of Artificial Sequence: Synthetic peptide
  Seed: RELFPPLFMAA (PRAME_HUMAN)
RELFPPLFMAV

SEQ ID NO: 146078 - protein, 9 aa, Artificial Sequence
  Description of Artificial Sequence: Synthetic peptide
  Seed: ACDELFSYL (PRAME_HUMAN)
ATDELFSYW

SEQ ID NO: 146079 - protein, 9 aa, Artificial Sequence
  Description of Artificial Sequence: Synthetic peptide
  Seed: LLLSHIHAS (PRAME_HUMAN)
LTLSHIHAV

SEQ ID NO: 146080 - protein, 9 aa, Artificial Sequence
  Description of Artificial Sequence: Synthetic peptide
  Seed: SFYGNSISI (PRAME_HUMAN)
SRYGNSISY

SEQ ID NO: 146081 - protein, 9 aa, Artificial Sequence
  Description of Artificial Sequence: Synthetic peptide
  Seed: LSNLTHVLY (PRAME_HUMAN)
LHNLTHVLY

SEQ ID NO: 146082 - protein, 9 aa, Artificial Sequence
  Description of Artificial Sequence: Synthetic peptide
  Seed: SPEPLQALL (PRAME_HUMAN)
SIEPLQALM

SEQ ID NO: 146083 - protein, 9 aa, Artificial Sequence
  Description of Artificial Sequence: Synthetic peptide
  Seed: LQHLIGLSN (PRAME_HUMAN)
LAHLIGLSM

SEQ ID NO: 146084 - protein, 9 aa, Artificial Sequence
  Description of Artificial Sequence: Synthetic peptide
  Seed: SVLSLSGVM (PRAME_HUMAN)
SLLSLSGVM

SEQ ID NO: 146085 - protein, 10 aa, Artificial Sequence
  Description of Artificial Sequence: Synthetic peptide
  Seed: TLQDLVFDEC (PRAME_HUMAN)
TLQDLVFDEV

SEQ ID NO: 146086 - protein, 9 aa, Artificial Sequence
  Description of Artificial Sequence: Synthetic peptide
  Seed: KVDGLSTEA (PRAME_HUMAN)
KQDGLSTEV

SEQ ID NO: 146087 - protein, 8 aa, Artificial Sequence
  Description of Artificial Sequence: Synthetic peptide
  Seed: YSFPEPEA (PRAME_HUMAN)
YTFPEPEF

SEQ ID NO: 146088 - protein, 9 aa, Artificial Sequence
  Description of Artificial Sequence: Synthetic peptide
  Seed: YIAQFTSQF (PRAME_HUMAN)
YKAQFTSQF

SEQ ID NO: 146089 - protein, 10 aa, Artificial Sequence
  Description of Artificial Sequence: Synthetic peptide
  Seed: SVSQLSVLSL (PRAME_HUMAN)
SMSQLSVLSA

SEQ ID NO: 146090 - protein, 10 aa, Artificial Sequence
  Description of Artificial Sequence: Synthetic peptide
  Seed: GITDDQLLAL (PRAME_HUMAN)
GQTDDQLLAF

SEQ ID NO: 146091 - protein, 9 aa, Artificial Sequence
  Description of Artificial Sequence: Synthetic peptide
  Seed: ISPEKEEQY (PRAME_HUMAN)
IIPEKEEQL

SEQ ID NO: 146092 - protein, 10 aa, Artificial Sequence
  Description of Artificial Sequence: Synthetic peptide
  Seed: IGLSNLTHVL (PRAME_HUMAN)
IFLSNLTHVI

SEQ ID NO: 146093 - protein, 10 aa, Artificial Sequence
  Description of Artificial Sequence: Synthetic peptide
  Seed: ETLSITNCRL (PRAME_HUMAN)
EALSITNCRK

SEQ ID NO: 146094 - protein, 9 aa, Artificial Sequence
  Description of Artificial Sequence: Synthetic peptide
  Seed: LSNLTHVLY (PRAME_HUMAN)
LRNLTHVLM

SEQ ID NO: 146095 - protein, 9 aa, Artificial Sequence
  Description of Artificial Sequence: Synthetic peptide
  Seed: LSNLTHVLY (PRAME_HUMAN)
LSNLTHVLW

SEQ ID NO: 146096 - protein, 9 aa, Artificial Sequence
  Description of Artificial Sequence: Synthetic peptide
  Seed: SQFLSLQCL (PRAME_HUMAN)
SQFLSLQCI

SEQ ID NO: 146097 - protein, 9 aa, Artificial Sequence
  Description of Artificial Sequence: Synthetic peptide
  Seed: SYEDIHGTL (PRAME_HUMAN)
SWEDIHGTW

SEQ ID NO: 146098 - protein, 9 aa, Artificial Sequence
  Description of Artificial Sequence: Synthetic peptide
  Seed: KMILKMVQL (PRAME_HUMAN)
KEILKMVQY

SEQ ID NO: 146099 - protein, 9 aa, Artificial Sequence
  Description of Artificial Sequence: Synthetic peptide
  Seed: RLAYLHARL (PRAME_HUMAN)
RLAYLHARR

SEQ ID NO: 146100 - protein, 9 aa, Artificial Sequence
  Description of Artificial Sequence: Synthetic peptide
  Seed: SATLQDLVF (PRAME_HUMAN)
SPTLQDLVW

SEQ ID NO: 146101 - protein, 9 aa, Artificial Sequence
  Description of Artificial Sequence: Synthetic peptide
  Seed: ALQSLLQHL (PRAME_HUMAN)
ASQSLLQHV

SEQ ID NO: 146102 - protein, 11 aa, Artificial Sequence
  Description of Artificial Sequence: Synthetic peptide
  Seed: FYDPEPILCPC (PRAME_HUMAN)
FWDPEPILCPL

SEQ ID NO: 146103 - protein, 9 aa, Artificial Sequence
  Description of Artificial Sequence: Synthetic peptide
  Seed: LALLPSLSH (PRAME_HUMAN)
LTLLPSLSF

SEQ ID NO: 146104 - protein, 9 aa, Artificial Sequence
  Description of Artificial Sequence: Synthetic peptide
  Seed: CKKLKIFAM (PRAME_HUMAN)
CIKLKIFAF

SEQ ID NO: 146105 - protein, 9 aa, Artificial Sequence
  Description of Artificial Sequence: Synthetic peptide
  Seed: RLWGSIQSR (PRAME_HUMAN)
RVWGSIQSM

SEQ ID NO: 146106 - protein, 9 aa, Artificial Sequence
  Description of Artificial Sequence: Synthetic peptide
  Seed: RWKLQVLDL (PRAME_HUMAN)
RVKLQVLDV

SEQ ID NO: 146107 - protein, 9 aa, Artificial Sequence
  Description of Artificial Sequence: Synthetic peptide
  Seed: SQFLSLQCL (PRAME_HUMAN)
STFLSLQCY

SEQ ID NO: 146108 - protein, 9 aa, Artificial Sequence
  Description of Artificial Sequence: Synthetic peptide
  Seed: SLLQHLIGL (PRAME_HUMAN)
SVLQHLIGM

SEQ ID NO: 146109 - protein, 8 aa, Artificial Sequence
  Description of Artificial Sequence: Synthetic peptide
  Seed: LSFYGNSI (PRAME_HUMAN)
LTFYGNSF

SEQ ID NO: 146110 - protein, 11 aa, Artificial Sequence
  Description of Artificial Sequence: Synthetic peptide
  Seed: SQTLKAMVQAW (PRAME_HUMAN)
SMTLKAMVQAW

SEQ ID NO: 146111 - protein, 11 aa, Artificial Sequence
  Description of Artificial Sequence: Synthetic peptide
  Seed: KAVLDGLDVLL (PRAME_HUMAN)
KMVLDGLDVLL

SEQ ID NO: 146112 - protein, 11 aa, Artificial Sequence
  Description of Artificial Sequence: Synthetic peptide
  Seed: FKAVLDGLDVL (PRAME_HUMAN)
FDAVLDGLDVV

SEQ ID NO: 146113 - protein, 9 aa, Artificial Sequence
  Description of Artificial Sequence: Synthetic peptide
  Seed: VSQLSVLSL (PRAME_HUMAN)
VYQLSVLSL

SEQ ID NO: 146114 - protein, 9 aa, Artificial Sequence
  Description of Artificial Sequence: Synthetic peptide
  Seed: RGRLDQLLR (PRAME_HUMAN)
RVRLDQLLV

SEQ ID NO: 146115 - protein, 9 aa, Artificial Sequence
  Description of Artificial Sequence: Synthetic peptide
  Seed: LSEGDVMHL (PRAME_HUMAN)
LFEGDVMHL

SEQ ID NO: 146116 - protein, 10 aa, Artificial Sequence
  Description of Artificial Sequence: Synthetic peptide
  Seed: KVKRKKNVLR (PRAME_HUMAN)
KSKRKKNVLR

SEQ ID NO: 146117 - protein, 9 aa, Artificial Sequence
  Description of Artificial Sequence: Synthetic peptide
  Seed: RASATLQDL (PRAME_HUMAN)
RQSATLQDF

SEQ ID NO: 146118 - protein, 8 aa, Artificial Sequence
  Description of Artificial Sequence: Synthetic peptide
  Seed: VLDGLDVL (PRAME_HUMAN)
VMDGLDVL

SEQ ID NO: 146119 - protein, 10 aa, Artificial Sequence
  Description of Artificial Sequence: Synthetic peptide
  Seed: ALYVDSLFFL (PRAME_HUMAN)
AKYVDSLFFW

SEQ ID NO: 146120 - protein, 10 aa, Artificial Sequence
  Description of Artificial Sequence: Synthetic peptide
  Seed: QTLKAMVQAW (PRAME_HUMAN)
QSLKAMVQAF

SEQ ID NO: 146121 - protein, 9 aa, Artificial Sequence
  Description of Artificial Sequence: Synthetic peptide
  Seed: ITDDQLLAL (PRAME_HUMAN)
IFDDQLLAF

SEQ ID NO: 146122 - protein, 10 aa, Artificial Sequence
  Description of Artificial Sequence: Synthetic peptide
  Seed: SGNRASLYSF (PRAME_HUMAN)
SANRASLYSW

SEQ ID NO: 146123 - protein, 10 aa, Artificial Sequence
  Description of Artificial Sequence: Synthetic peptide
  Seed: LPTLAKFSPY (PRAME_HUMAN)
LTTLAKFSPY

SEQ ID NO: 146124 - protein, 10 aa, Artificial Sequence
  Description of Artificial Sequence: Synthetic peptide
  Seed: VEVLVDLFLK (PRAME_HUMAN)
VWVLVDLFLR

SEQ ID NO: 146125 - protein, 11 aa, Artificial Sequence
  Description of Artificial Sequence: Synthetic peptide
  Seed: RELFPPLFMAA (PRAME_HUMAN)
RMLFPPLFMAA

SEQ ID NO: 146126 - protein, 9 aa, Artificial Sequence
  Description of Artificial Sequence: Synthetic peptide
  Seed: SYEDIHGTL (PRAME_HUMAN)
SYEDIHGTF

SEQ ID NO: 146127 - protein, 9 aa, Artificial Sequence
  Description of Artificial Sequence: Synthetic peptide
  Seed: RLSEGDVMH (PRAME_HUMAN)
RMSEGDVMF

SEQ ID NO: 146128 - protein, 11 aa, Artificial Sequence
  Description of Artificial Sequence: Synthetic peptide
  Seed: LPTLAKFSPYL (PRAME_HUMAN)
LKTLAKFSPYV

SEQ ID NO: 146129 - protein, 9 aa, Artificial Sequence
  Description of Artificial Sequence: Synthetic peptide
  Seed: YSFPEPEAA (PRAME_HUMAN)
YMFPEPEAA

SEQ ID NO: 146130 - protein, 9 aa, Artificial Sequence
  Description of Artificial Sequence: Synthetic peptide
  Seed: QPFIPVEVL (PRAME_HUMAN)
QQFIPVEVV

SEQ ID NO: 146131 - protein, 9 aa, Artificial Sequence
  Description of Artificial Sequence: Synthetic peptide
  Seed: DGRHSQTLK (PRAME_HUMAN)
DYRHSQTLR

SEQ ID NO: 146132 - protein, 8 aa, Artificial Sequence
  Description of Artificial Sequence: Synthetic peptide
  Seed: LTHVLYPV (PRAME_HUMAN)
LMHVLYPA

SEQ ID NO: 146133 - protein, 9 aa, Artificial Sequence
  Description of Artificial Sequence: Synthetic peptide
  Seed: LSEGDVMHL (PRAME_HUMAN)
LFEGDVMHV

SEQ ID NO: 146134 - protein, 9 aa, Artificial Sequence
  Description of Artificial Sequence: Synthetic peptide
  Seed: SIQSRYISM (PRAME_HUMAN)
SRQSRYISM

SEQ ID NO: 146135 - protein, 10 aa, Artificial Sequence
  Description of Artificial Sequence: Synthetic peptide
  Seed: LSVLSLSGVM (PRAME_HUMAN)
LTVLSLSGVY

SEQ ID NO: 146136 - protein, 9 aa, Artificial Sequence
  Description of Artificial Sequence: Synthetic peptide
  Seed: FYDPEPILC (PRAME_HUMAN)
FMDPEPILY

SEQ ID NO: 146137 - protein, 9 aa, Artificial Sequence
  Description of Artificial Sequence: Synthetic peptide
  Seed: YLHARLREL (PRAME_HUMAN)
YQHARLREL

SEQ ID NO: 146138 - protein, 10 aa, Artificial Sequence
  Description of Artificial Sequence: Synthetic peptide
  Seed: CTWKLPTLAK (PRAME_HUMAN)
CLWKLPTLAR

SEQ ID NO: 146139 - protein, 9 aa, Artificial Sequence
  Description of Artificial Sequence: Synthetic peptide
  Seed: TFYDPEPIL (PRAME_HUMAN)
TSYDPEPIL

SEQ ID NO: 146140 - protein, 9 aa, Artificial Sequence
  Description of Artificial Sequence: Synthetic peptide
  Seed: SVLSLSGVM (PRAME_HUMAN)
SQLSLSGVH

SEQ ID NO: 146141 - protein, 11 aa, Artificial Sequence
  Description of Artificial Sequence: Synthetic peptide
  Seed: HVMNPLETLSI (PRAME_HUMAN)
HQMNPLETLSW

SEQ ID NO: 146142 - protein, 9 aa, Artificial Sequence
  Description of Artificial Sequence: Synthetic peptide
  Seed: LSTEAEQPF (PRAME_HUMAN)
LITEAEQPF

SEQ ID NO: 146143 - protein, 9 aa, Artificial Sequence
  Description of Artificial Sequence: Synthetic peptide
  Seed: GQSLLKDEA (PRAME_HUMAN)
GESLLKDEP

SEQ ID NO: 146144 - protein, 9 aa, Artificial Sequence
  Description of Artificial Sequence: Synthetic peptide
  Seed: RTFYDPEPI (PRAME_HUMAN)
RVFYDPEPL

SEQ ID NO: 146145 - protein, 9 aa, Artificial Sequence
  Description of Artificial Sequence: Synthetic peptide
  Seed: YSFPEPEAA (PRAME_HUMAN)
YSFPEPEAM

SEQ ID NO: 146146 - protein, 9 aa, Artificial Sequence
  Description of Artificial Sequence: Synthetic peptide
  Seed: LFPPLFMAA (PRAME_HUMAN)
LYPPLFMAF

SEQ ID NO: 146147 - protein, 9 aa, Artificial Sequence
  Description of Artificial Sequence: Synthetic peptide
  Seed: CSQLTTLSF (PRAME_HUMAN)
CLQLTTLSM

SEQ ID NO: 146148 - protein, 9 aa, Artificial Sequence
  Description of Artificial Sequence: Synthetic peptide
  Seed: CSQLTTLSF (PRAME_HUMAN)
CMQLTTLSY

SEQ ID NO: 146149 - protein, 10 aa, Artificial Sequence
  Description of Artificial Sequence: Synthetic peptide
  Seed: ALYVDSLFFL (PRAME_HUMAN)
AYYVDSLFFL

SEQ ID NO: 146150 - protein, 11 aa, Artificial Sequence
  Description of Artificial Sequence: Synthetic peptide
  Seed: PRELFPPLFMA (PRAME_HUMAN)
PYELFPPLFMV

SEQ ID NO: 146151 - protein, 10 aa, Artificial Sequence
  Description of Artificial Sequence: Synthetic peptide
  Seed: ETFKAVLDGL (PRAME_HUMAN)
ELFKAVLDGV

SEQ ID NO: 146152 - protein, 9 aa, Artificial Sequence
  Description of Artificial Sequence: Synthetic peptide
  Seed: FLRGRLDQL (PRAME_HUMAN)
FFRGRLDQL

SEQ ID NO: 146153 - protein, 9 aa, Artificial Sequence
  Description of Artificial Sequence: Synthetic peptide
  Seed: ITDDQLLAL (PRAME_HUMAN)
IPDDQLLAY

SEQ ID NO: 146154 - protein, 10 aa, Artificial Sequence
  Description of Artificial Sequence: Synthetic peptide
  Seed: RLVELAGQSL (PRAME_HUMAN)
RIVELAGQSR

SEQ ID NO: 146155 - protein, 9 aa, Artificial Sequence
  Description of Artificial Sequence: Synthetic peptide
  Seed: CKKLKIFAM (PRAME_HUMAN)
CMKLKIFAV

SEQ ID NO: 146156 - protein, 9 aa, Artificial Sequence
  Description of Artificial Sequence: Synthetic peptide
  Seed: VLMKGQHLH (PRAME_HUMAN)
VQMKGQHLR

SEQ ID NO: 146157 - protein, 9 aa, Artificial Sequence
  Description of Artificial Sequence: Synthetic peptide
  Seed: RASATLQDL (PRAME_HUMAN)
RLSATLQDV

SEQ ID NO: 146158 - protein, 9 aa, Artificial Sequence
  Description of Artificial Sequence: Synthetic peptide
  Seed: MINLRRLLL (PRAME_HUMAN)
MSNLRRLLK

SEQ ID NO: 146159 - protein, 9 aa, Artificial Sequence
  Description of Artificial Sequence: Synthetic peptide
  Seed: RHSQTLKAM (PRAME_HUMAN)
RVSQTLKAY

SEQ ID NO: 146160 - protein, 9 aa, Artificial Sequence
  Description of Artificial Sequence: Synthetic peptide
  Seed: ERLAYLHAR (PRAME_HUMAN)
ECLAYLHAR

SEQ ID NO: 146161 - protein, 9 aa, Artificial Sequence
  Description of Artificial Sequence: Synthetic peptide
  Seed: TFYDPEPIL (PRAME_HUMAN)
TVYDPEPIY

SEQ ID NO: 146162 - protein, 9 aa, Artificial Sequence
  Description of Artificial Sequence: Synthetic peptide
  Seed: YIAQFTSQF (PRAME_HUMAN)
YVAQFTSQR

SEQ ID NO: 146163 - protein, 9 aa, Artificial Sequence
  Description of Artificial Sequence: Synthetic peptide
  Seed: ELAGQSLLK (PRAME_HUMAN)
EVAGQSLLM

SEQ ID NO: 146164 - protein, 10 aa, Artificial Sequence
  Description of Artificial Sequence: Synthetic peptide
  Seed: ALYVDSLFFL (PRAME_HUMAN)
ANYVDSLFFW

SEQ ID NO: 146165 - protein, 9 aa, Artificial Sequence
  Description of Artificial Sequence: Synthetic peptide
  Seed: LFMAAFDGR (PRAME_HUMAN)
LTMAAFDGR

SEQ ID NO: 146166 - protein, 11 aa, Artificial Sequence
  Description of Artificial Sequence: Synthetic peptide
  Seed: FTSQFLSLQCL (PRAME_HUMAN)
FTSQFLSLQCW

SEQ ID NO: 146167 - protein, 9 aa, Artificial Sequence
  Description of Artificial Sequence: Synthetic peptide
  Seed: LSLQCLQAL (PRAME_HUMAN)
LKLQCLQAY

SEQ ID NO: 146168 - protein, 9 aa, Artificial Sequence
  Description of Artificial Sequence: Synthetic peptide
  Seed: YVDSLFFLR (PRAME_HUMAN)
YNDSLFFLY

SEQ ID NO: 146169 - protein, 10 aa, Artificial Sequence
  Description of Artificial Sequence: Synthetic peptide
  Seed: QYIAQFTSQF (PRAME_HUMAN)
QMIAQFTSQF

SEQ ID NO: 146170 - protein, 9 aa, Artificial Sequence
  Description of Artificial Sequence: Synthetic peptide
  Seed: YLHARLREL (PRAME_HUMAN)
YPHARLREM

SEQ ID NO: 146171 - protein, 9 aa, Artificial Sequence
  Description of Artificial Sequence: Synthetic peptide
  Seed: FAMPMQDIK (PRAME_HUMAN)
FTMPMQDIL

SEQ ID NO: 146172 - protein, 10 aa, Artificial Sequence
  Description of Artificial Sequence: Synthetic peptide
  Seed: ASATLQDLVF (PRAME_HUMAN)
ARATLQDLVW

SEQ ID NO: 146173 - protein, 11 aa, Artificial Sequence
  Description of Artificial Sequence: Synthetic peptide
  Seed: LPTLAKFSPYL (PRAME_HUMAN)
LHTLAKFSPYV

SEQ ID NO: 146174 - protein, 8 aa, Artificial Sequence
  Description of Artificial Sequence: Synthetic peptide
  Seed: FYDPEPIL (PRAME_HUMAN)
FFDPEPII

SEQ ID NO: 146175 - protein, 9 aa, Artificial Sequence
  Description of Artificial Sequence: Synthetic peptide
  Seed: RLWGSIQSR (PRAME_HUMAN)
RTWGSIQSI

SEQ ID NO: 146176 - protein, 10 aa, Artificial Sequence
  Description of Artificial Sequence: Synthetic peptide
  Seed: ETFKAVLDGL (PRAME_HUMAN)
EVFKAVLDGY

SEQ ID NO: 146177 - protein, 9 aa, Artificial Sequence
  Description of Artificial Sequence: Synthetic peptide
  Seed: LHLERLAYL (PRAME_HUMAN)
LYLERLAYY

SEQ ID NO: 146178 - protein, 9 aa, Artificial Sequence
  Description of Artificial Sequence: Synthetic peptide
  Seed: ELFSYLIEK (PRAME_HUMAN)
ELFSYLIER

SEQ ID NO: 146179 - protein, 8 aa, Artificial Sequence
  Description of Artificial Sequence: Synthetic peptide
  Seed: VSPEPLQA (PRAME_HUMAN)
VTPEPLQL

SEQ ID NO: 146180 - protein, 8 aa, Artificial Sequence
  Description of Artificial Sequence: Synthetic peptide
  Seed: DQLLRHVM (PRAME_HUMAN)
DELLRHVY

SEQ ID NO: 146181 - protein, 9 aa, Artificial Sequence
  Description of Artificial Sequence: Synthetic peptide
  Seed: MHLSQSPSV (PRAME_HUMAN)
MLLSQSPSF

SEQ ID NO: 146182 - protein, 9 aa, Artificial Sequence
  Description of Artificial Sequence: Synthetic peptide
  Seed: KLKIFAMPM (PRAME_HUMAN)
KTKIFAMPI

SEQ ID NO: 146183 - protein, 9 aa, Artificial Sequence
  Description of Artificial Sequence: Synthetic peptide
  Seed: LALLPSLSH (PRAME_HUMAN)
LELLPSLSM

SEQ ID NO: 146184 - protein, 9 aa, Artificial Sequence
  Description of Artificial Sequence: Synthetic peptide
  Seed: ISPEKEEQY (PRAME_HUMAN)
ISPEKEEQM

SEQ ID NO: 146185 - protein, 9 aa, Artificial Sequence
  Description of Artificial Sequence: Synthetic peptide
  Seed: SLQCLQALY (PRAME_HUMAN)
STQCLQALY

SEQ ID NO: 146186 - protein, 9 aa, Artificial Sequence
  Description of Artificial Sequence: Synthetic peptide
  Seed: AEQPFIPVE (PRAME_HUMAN)
AEQPFIPVC

SEQ ID NO: 146187 - protein, 9 aa, Artificial Sequence
  Description of Artificial Sequence: Synthetic peptide
  Seed: FYDPEPILC (PRAME_HUMAN)
FLDPEPILA

SEQ ID NO: 146188 - protein, 9 aa, Artificial Sequence
  Description of Artificial Sequence: Synthetic peptide
  Seed: SEGDVMHLS (PRAME_HUMAN)
SEGDVMHLF

SEQ ID NO: 146189 - protein, 10 aa, Artificial Sequence
  Description of Artificial Sequence: Synthetic peptide
  Seed: MLTDVSPEPL (PRAME_HUMAN)
MLTDVSPEPI

SEQ ID NO: 146190 - protein, 9 aa, Artificial Sequence
  Description of Artificial Sequence: Synthetic peptide
  Seed: SQSPSVSQL (PRAME_HUMAN)
SMSPSVSQT

SEQ ID NO: 146191 - protein, 10 aa, Artificial Sequence
  Description of Artificial Sequence: Synthetic peptide
  Seed: KDEALAIAAL (PRAME_HUMAN)
KEEALAIAAC

SEQ ID NO: 146192 - protein, 9 aa, Artificial Sequence
  Description of Artificial Sequence: Synthetic peptide
  Seed: QALYVDSLF (PRAME_HUMAN)
QLLYVDSLY

SEQ ID NO: 146193 - protein, 9 aa, Artificial Sequence
  Description of Artificial Sequence: Synthetic peptide
  Seed: DGRHSQTLK (PRAME_HUMAN)
DTRHSQTLK

SEQ ID NO: 146194 - protein, 10 aa, Artificial Sequence
  Description of Artificial Sequence: Synthetic peptide
  Seed: ALYVDSLFFL (PRAME_HUMAN)
ADYVDSLFFL

SEQ ID NO: 146195 - protein, 9 aa, Artificial Sequence
  Description of Artificial Sequence: Synthetic peptide
  Seed: LQCLQALYV (PRAME_HUMAN)
LQCLQALYL

SEQ ID NO: 146196 - protein, 9 aa, Artificial Sequence
  Description of Artificial Sequence: Synthetic peptide
  Seed: RWKLQVLDL (PRAME_HUMAN)
RFKLQVLDF

SEQ ID NO: 146197 - protein, 9 aa, Artificial Sequence
  Description of Artificial Sequence: Synthetic peptide
  Seed: RLLLSHIHA (PRAME_HUMAN)
RTLLSHIHI

SEQ ID NO: 146198 - protein, 10 aa, Artificial Sequence
  Description of Artificial Sequence: Synthetic peptide
  Seed: TFYDPEPILC (PRAME_HUMAN)
TYYDPEPILF

SEQ ID NO: 146199 - protein, 9 aa, Artificial Sequence
  Description of Artificial Sequence: Synthetic peptide
  Seed: RGRLDQLLR (PRAME_HUMAN)
RARLDQLLV

SEQ ID NO: 146200 - protein, 9 aa, Artificial Sequence
  Description of Artificial Sequence: Synthetic peptide
  Seed: IAQFTSQFL (PRAME_HUMAN)
ISQFTSQFW

SEQ ID NO: 146201 - protein, 11 aa, Artificial Sequence
  Description of Artificial Sequence: Synthetic peptide
  Seed: LQSLLQHLIGL (PRAME_HUMAN)
LGSLLQHLIGV

SEQ ID NO: 146202 - protein, 9 aa, Artificial Sequence
  Description of Artificial Sequence: Synthetic peptide
  Seed: HLHLETFKA (PRAME_HUMAN)
HMHLETFKL

SEQ ID NO: 146203 - protein, 9 aa, Artificial Sequence
  Description of Artificial Sequence: Synthetic peptide
  Seed: TLHLERLAY (PRAME_HUMAN)
TPHLERLAY

SEQ ID NO: 146204 - protein, 10 aa, Artificial Sequence
  Description of Artificial Sequence: Synthetic peptide
  Seed: MNPLETLSIT (PRAME_HUMAN)
MRPLETLSIV

SEQ ID NO: 146205 - protein, 11 aa, Artificial Sequence
  Description of Artificial Sequence: Synthetic peptide
  Seed: IAQFTSQFLSL (PRAME_HUMAN)
IKQFTSQFLSY

SEQ ID NO: 146206 - protein, 10 aa, Artificial Sequence
  Description of Artificial Sequence: Synthetic peptide
  Seed: KKLKIFAMPM (PRAME_HUMAN)
KVLKIFAMPA

SEQ ID NO: 146207 - protein, 11 aa, Artificial Sequence
  Description of Artificial Sequence: Synthetic peptide
  Seed: KIFAMPMQDIK (PRAME_HUMAN)
KSFAMPMQDIR

SEQ ID NO: 146208 - protein, 11 aa, Artificial Sequence
  Description of Artificial Sequence: Synthetic peptide
  Seed: EQYIAQFTSQF (PRAME_HUMAN)
EFYIAQFTSQF

SEQ ID NO: 146209 - protein, 9 aa, Artificial Sequence
  Description of Artificial Sequence: Synthetic peptide
  Seed: LQALYVDSL (PRAME_HUMAN)
LMALYVDST

SEQ ID NO: 146210 - protein, 9 aa, Artificial Sequence
  Description of Artificial Sequence: Synthetic peptide
  Seed: AWPFTCLPL (PRAME_HUMAN)
AAPFTCLPM

SEQ ID NO: 146211 - protein, 9 aa, Artificial Sequence
  Description of Artificial Sequence: Synthetic peptide
  Seed: YGNSISISA (PRAME_HUMAN)
YFNSISISL

SEQ ID NO: 146212 - protein, 10 aa, Artificial Sequence
  Description of Artificial Sequence: Synthetic peptide
  Seed: FFLRGRLDQL (PRAME_HUMAN)
FQLRGRLDQV

SEQ ID NO: 146213 - protein, 10 aa, Artificial Sequence
  Description of Artificial Sequence: Synthetic peptide
  Seed: AVLDGLDVLL (PRAME_HUMAN)
AQLDGLDVLY

SEQ ID NO: 146214 - protein, 9 aa, Artificial Sequence
  Description of Artificial Sequence: Synthetic peptide
  Seed: QTLKAMVQA (PRAME_HUMAN)
QLLKAMVQA

SEQ ID NO: 146215 - protein, 10 aa, Artificial Sequence
  Description of Artificial Sequence: Synthetic peptide
  Seed: SLLKDEALAI (PRAME_HUMAN)
SQLKDEALAF

SEQ ID NO: 146216 - protein, 9 aa, Artificial Sequence
  Description of Artificial Sequence: Synthetic peptide
  Seed: EAAQPMTKK (PRAME_HUMAN)
ELAQPMTKR

SEQ ID NO: 146217 - protein, 10 aa, Artificial Sequence
  Description of Artificial Sequence: Synthetic peptide
  Seed: LSFYGNSISI (PRAME_HUMAN)
LDFYGNSISL

SEQ ID NO: 146218 - protein, 11 aa, Artificial Sequence
  Description of Artificial Sequence: Synthetic peptide
  Seed: RASATLQDLVF (PRAME_HUMAN)
RKSATLQDLVW

SEQ ID NO: 146219 - protein, 8 aa, Artificial Sequence
  Description of Artificial Sequence: Synthetic peptide
  Seed: LKIFAMPM (PRAME_HUMAN)
LKIFAMPY

SEQ ID NO: 146220 - protein, 9 aa, Artificial Sequence
  Description of Artificial Sequence: Synthetic peptide
  Seed: GQHLHLETF (PRAME_HUMAN)
GHHLHLETF

SEQ ID NO: 146221 - protein, 9 aa, Artificial Sequence
  Description of Artificial Sequence: Synthetic peptide
  Seed: HVMNPLETL (PRAME_HUMAN)
HPMNPLETT

SEQ ID NO: 146222 - protein, 9 aa, Artificial Sequence
  Description of Artificial Sequence: Synthetic peptide
  Seed: KEGACDELF (PRAME_HUMAN)
KQGACDELW

SEQ ID NO: 146223 - protein, 10 aa, Artificial Sequence
  Description of Artificial Sequence: Synthetic peptide
  Seed: IGLSNLTHVL (PRAME_HUMAN)
IELSNLTHVL

SEQ ID NO: 146224 - protein, 10 aa, Artificial Sequence
  Description of Artificial Sequence: Synthetic peptide
  Seed: FIPVEVLVDL (PRAME_HUMAN)
FWPVEVLVDY

SEQ ID NO: 146225 - protein, 10 aa, Artificial Sequence
  Description of Artificial Sequence: Synthetic peptide
  Seed: LSQSPSVSQL (PRAME_HUMAN)
LNQSPSVSQF

SEQ ID NO: 146226 - protein, 9 aa, Artificial Sequence
  Description of Artificial Sequence: Synthetic peptide
  Seed: THVLYPVPL (PRAME_HUMAN)
TMVLYPVPL

SEQ ID NO: 146227 - protein, 9 aa, Artificial Sequence
  Description of Artificial Sequence: Synthetic peptide
  Seed: YIAQFTSQF (PRAME_HUMAN)
YVAQFTSQF

SEQ ID NO: 146228 - protein, 11 aa, Artificial Sequence
  Description of Artificial Sequence: Synthetic peptide
  Seed: AAFDGRHSQTL (PRAME_HUMAN)
AEFDGRHSQTY

SEQ ID NO: 146229 - protein, 10 aa, Artificial Sequence
  Description of Artificial Sequence: Synthetic peptide
  Seed: SPYLGQMINL (PRAME_HUMAN)
SCYLGQMINI

SEQ ID NO: 146230 - protein, 9 aa, Artificial Sequence
  Description of Artificial Sequence: Synthetic peptide
  Seed: VQLDSIEDL (PRAME_HUMAN)
VHLDSIEDV

SEQ ID NO: 146231 - protein, 10 aa, Artificial Sequence
  Description of Artificial Sequence: Synthetic peptide
  Seed: FAMPMQDIKM (PRAME_HUMAN)
FAMPMQDIKL

SEQ ID NO: 146232 - protein, 10 aa, Artificial Sequence
  Description of Artificial Sequence: Synthetic peptide
  Seed: SALQSLLQHL (PRAME_HUMAN)
SSLQSLLQHW

SEQ ID NO: 146233 - protein, 10 aa, Artificial Sequence
  Description of Artificial Sequence: Synthetic peptide
  Seed: TLAKFSPYLG (PRAME_HUMAN)
TMAKFSPYLA

SEQ ID NO: 146234 - protein, 9 aa, Artificial Sequence
  Description of Artificial Sequence: Synthetic peptide
  Seed: KVDGLSTEA (PRAME_HUMAN)
KNDGLSTEV

SEQ ID NO: 146235 - protein, 9 aa, Artificial Sequence
  Description of Artificial Sequence: Synthetic peptide
  Seed: LSLQCLQAL (PRAME_HUMAN)
LMLQCLQAF

SEQ ID NO: 146236 - protein, 10 aa, Artificial Sequence
  Description of Artificial Sequence: Synthetic peptide
  Seed: LPTLAKFSPY (PRAME_HUMAN)
LLTLAKFSPY

SEQ ID NO: 146237 - protein, 9 aa, Artificial Sequence
  Description of Artificial Sequence: Synthetic peptide
  Seed: YSFPEPEAA (PRAME_HUMAN)
YTFPEPEAH

SEQ ID NO: 146238 - protein, 10 aa, Artificial Sequence
  Description of Artificial Sequence: Synthetic peptide
  Seed: AQFTSQFLSL (PRAME_HUMAN)
ARFTSQFLSY

SEQ ID NO: 146239 - protein, 10 aa, Artificial Sequence
  Description of Artificial Sequence: Synthetic peptide
  Seed: AIAALELLPR (PRAME_HUMAN)
ASAALELLPR

SEQ ID NO: 146240 - protein, 9 aa, Artificial Sequence
  Description of Artificial Sequence: Synthetic peptide
  Seed: ELFPPLFMA (PRAME_HUMAN)
ESFPPLFMI

SEQ ID NO: 146241 - protein, 10 aa, Artificial Sequence
  Description of Artificial Sequence: Synthetic peptide
  Seed: SALQSLLQHL (PRAME_HUMAN)
SSLQSLLQHV

SEQ ID NO: 146242 - protein, 9 aa, Artificial Sequence
  Description of Artificial Sequence: Synthetic peptide
  Seed: ALQSLLQHL (PRAME_HUMAN)
ATQSLLQHW

SEQ ID NO: 146243 - protein, 11 aa, Artificial Sequence
  Description of Artificial Sequence: Synthetic peptide
  Seed: QALYVDSLFFL (PRAME_HUMAN)
QYLYVDSLFFF

SEQ ID NO: 146244 - protein, 9 aa, Artificial Sequence
  Description of Artificial Sequence: Synthetic peptide
  Seed: LYVDSLFFL (PRAME_HUMAN)
LLVDSLFFI

SEQ ID NO: 146245 - protein, 11 aa, Artificial Sequence
  Description of Artificial Sequence: Synthetic peptide
  Seed: RLWGSIQSRYI (PRAME_HUMAN)
RVWGSIQSRYF

SEQ ID NO: 146246 - protein, 10 aa, Artificial Sequence
  Description of Artificial Sequence: Synthetic peptide
  Seed: RRLWGSIQSR (PRAME_HUMAN)
RCLWGSIQSR

SEQ ID NO: 146247 - protein, 9 aa, Artificial Sequence
  Description of Artificial Sequence: Synthetic peptide
  Seed: SIQSRYISM (PRAME_HUMAN)
STQSRYISL

SEQ ID NO: 146248 - protein, 9 aa, Artificial Sequence
  Description of Artificial Sequence: Synthetic peptide
  Seed: VQAWPFTCL (PRAME_HUMAN)
VAAWPFTCY

SEQ ID NO: 146249 - protein, 9 aa, Artificial Sequence
  Description of Artificial Sequence: Synthetic peptide
  Seed: CSQLTTLSF (PRAME_HUMAN)
CKQLTTLSM

SEQ ID NO: 146250 - protein, 9 aa, Artificial Sequence
  Description of Artificial Sequence: Synthetic peptide
  Seed: LQHLIGLSN (PRAME_HUMAN)
LTHLIGLSY

SEQ ID NO: 146251 - protein, 9 aa, Artificial Sequence
  Description of Artificial Sequence: Synthetic peptide
  Seed: SRYISMSVW (PRAME_HUMAN)
SVYISMSVM

SEQ ID NO: 146252 - protein, 9 aa, Artificial Sequence
  Description of Artificial Sequence: Synthetic peptide
  Seed: LALLPSLSH (PRAME_HUMAN)
LVLLPSLSF

SEQ ID NO: 146253 - protein, 10 aa, Artificial Sequence
  Description of Artificial Sequence: Synthetic peptide
  Seed: SLLQHLIGLS (PRAME_HUMAN)
SLLQHLIGLV

SEQ ID NO: 146254 - protein, 11 aa, Artificial Sequence
  Description of Artificial Sequence: Synthetic peptide
  Seed: FSPYLGQMINL (PRAME_HUMAN)
FRPYLGQMINF

SEQ ID NO: 146255 - protein, 10 aa, Artificial Sequence
  Description of Artificial Sequence: Synthetic peptide
  Seed: SPSVSQLSVL (PRAME_HUMAN)
SNSVSQLSVF

SEQ ID NO: 146256 - protein, 9 aa, Artificial Sequence
  Description of Artificial Sequence: Synthetic peptide
  Seed: AAQPMTKKR (PRAME_HUMAN)
ALQPMTKKR

SEQ ID NO: 146257 - protein, 9 aa, Artificial Sequence
  Description of Artificial Sequence: Synthetic peptide
  Seed: HVMNPLETL (PRAME_HUMAN)
HMMNPLETK

SEQ ID NO: 146258 - protein, 9 aa, Artificial Sequence
  Description of Artificial Sequence: Synthetic peptide
  Seed: HVMNPLETL (PRAME_HUMAN)
HSMNPLETL

SEQ ID NO: 146259 - protein, 10 aa, Artificial Sequence
  Description of Artificial Sequence: Synthetic peptide
  Seed: IQSRYISMSV (PRAME_HUMAN)
IISRYISMSY

SEQ ID NO: 146260 - protein, 8 aa, Artificial Sequence
  Description of Artificial Sequence: Synthetic peptide
  Seed: SQLTTLSF (PRAME_HUMAN)
SKLTTLSY

SEQ ID NO: 146261 - protein, 9 aa, Artificial Sequence
  Description of Artificial Sequence: Synthetic peptide
  Seed: SQLTTLSFY (PRAME_HUMAN)
SLLTTLSFK

SEQ ID NO: 146262 - protein, 9 aa, Artificial Sequence
  Description of Artificial Sequence: Synthetic peptide
  Seed: SIEDLEVTC (PRAME_HUMAN)
SSEDLEVTM

SEQ ID NO: 146263 - protein, 9 aa, Artificial Sequence
  Description of Artificial Sequence: Synthetic peptide
  Seed: SALQSLLQH (PRAME_HUMAN)
SSLQSLLQL

SEQ ID NO: 146264 - protein, 9 aa, Artificial Sequence
  Description of Artificial Sequence: Synthetic peptide
  Seed: ITDDQLLAL (PRAME_HUMAN)
IMDDQLLAA

SEQ ID NO: 146265 - protein, 9 aa, Artificial Sequence
  Description of Artificial Sequence: Synthetic peptide
  Seed: TLAKFSPYL (PRAME_HUMAN)
TIAKFSPYW

SEQ ID NO: 146266 - protein, 9 aa, Artificial Sequence
  Description of Artificial Sequence: Synthetic peptide
  Seed: MINLRRLLL (PRAME_HUMAN)
MTNLRRLLA

SEQ ID NO: 146267 - protein, 9 aa, Artificial Sequence
  Description of Artificial Sequence: Synthetic peptide
  Seed: SLLQHLIGL (PRAME_HUMAN)
STLQHLIGI

SEQ ID NO: 146268 - protein, 9 aa, Artificial Sequence
  Description of Artificial Sequence: Synthetic peptide
  Seed: ITDDQLLAL (PRAME_HUMAN)
IIDDQLLAA

SEQ ID NO: 146269 - protein, 10 aa, Artificial Sequence
  Description of Artificial Sequence: Synthetic peptide
  Seed: HCSQLTTLSF (PRAME_HUMAN)
HKSQLTTLSM

SEQ ID NO: 146270 - protein, 9 aa, Artificial Sequence
  Description of Artificial Sequence: Synthetic peptide
  Seed: CSQLTTLSF (PRAME_HUMAN)
CPQLTTLSY

SEQ ID NO: 146271 - protein, 9 aa, Artificial Sequence
  Description of Artificial Sequence: Synthetic peptide
  Seed: RGRLDQLLR (PRAME_HUMAN)
RYRLDQLLV

SEQ ID NO: 146272 - protein, 10 aa, Artificial Sequence
  Description of Artificial Sequence: Synthetic peptide
  Seed: LPTLAKFSPY (PRAME_HUMAN)
LQTLAKFSPM

SEQ ID NO: 146273 - protein, 9 aa, Artificial Sequence
  Description of Artificial Sequence: Synthetic peptide
  Seed: QALYVDSLF (PRAME_HUMAN)
QQLYVDSLW

SEQ ID NO: 146274 - protein, 10 aa, Artificial Sequence
  Description of Artificial Sequence: Synthetic peptide
  Seed: LLPRELFPPL (PRAME_HUMAN)
LKPRELFPPV

SEQ ID NO: 146275 - protein, 9 aa, Artificial Sequence
  Description of Artificial Sequence: Synthetic peptide
  Seed: LLLSHIHAS (PRAME_HUMAN)
LMLSHIHAT

SEQ ID NO: 146276 - protein, 10 aa, Artificial Sequence
  Description of Artificial Sequence: Synthetic peptide
  Seed: TFYDPEPILC (PRAME_HUMAN)
TWYDPEPILW

SEQ ID NO: 146277 - protein, 10 aa, Artificial Sequence
  Description of Artificial Sequence: Synthetic peptide
  Seed: KDEALAIAAL (PRAME_HUMAN)
KFEALAIAAL

SEQ ID NO: 146278 - protein, 9 aa, Artificial Sequence
  Description of Artificial Sequence: Synthetic peptide
  Seed: VQAWPFTCL (PRAME_HUMAN)
VQAWPFTCF

SEQ ID NO: 146279 - protein, 10 aa, Artificial Sequence
  Description of Artificial Sequence: Synthetic peptide
  Seed: SPRRLVELAG (PRAME_HUMAN)
SPRRLVELAV

SEQ ID NO: 146280 - protein, 9 aa, Artificial Sequence
  Description of Artificial Sequence: Synthetic peptide
  Seed: YSFPEPEAA (PRAME_HUMAN)
YLFPEPEAY

SEQ ID NO: 146281 - protein, 10 aa, Artificial Sequence
  Description of Artificial Sequence: Synthetic peptide
  Seed: MPMQDIKMIL (PRAME_HUMAN)
MWMQDIKMIV

SEQ ID NO: 146282 - protein, 10 aa, Artificial Sequence
  Description of Artificial Sequence: Synthetic peptide
  Seed: ALYVDSLFFL (PRAME_HUMAN)
AAYVDSLFFW

SEQ ID NO: 146283 - protein, 8 aa, Artificial Sequence
  Description of Artificial Sequence: Synthetic peptide
  Seed: QMINLRRL (PRAME_HUMAN)
QQINLRRV

SEQ ID NO: 146284 - protein, 10 aa, Artificial Sequence
  Description of Artificial Sequence: Synthetic peptide
  Seed: SLSHCSQLTT (PRAME_HUMAN)
SMSHCSQLTL

SEQ ID NO: 146285 - protein, 9 aa, Artificial Sequence
  Description of Artificial Sequence: Synthetic peptide
  Seed: RELFPPLFM (PRAME_HUMAN)
RKLFPPLFM

SEQ ID NO: 146286 - protein, 10 aa, Artificial Sequence
  Description of Artificial Sequence: Synthetic peptide
  Seed: GITDDQLLAL (PRAME_HUMAN)
GMTDDQLLAF

SEQ ID NO: 146287 - protein, 9 aa, Artificial Sequence
  Description of Artificial Sequence: Synthetic peptide
  Seed: VQLDSIEDL (PRAME_HUMAN)
VELDSIEDI

SEQ ID NO: 146288 - protein, 9 aa, Artificial Sequence
  Description of Artificial Sequence: Synthetic peptide
  Seed: RHSQTLKAM (PRAME_HUMAN)
RLSQTLKAF

SEQ ID NO: 146289 - protein, 9 aa, Artificial Sequence
  Description of Artificial Sequence: Synthetic peptide
  Seed: KLKIFAMPM (PRAME_HUMAN)
KYKIFAMPG

SEQ ID NO: 146290 - protein, 9 aa, Artificial Sequence
  Description of Artificial Sequence: Synthetic peptide
  Seed: GACDELFSY (PRAME_HUMAN)
GICDELFSY

SEQ ID NO: 146291 - protein, 11 aa, Artificial Sequence
  Description of Artificial Sequence: Synthetic peptide
  Seed: IQSRYISMSVW (PRAME_HUMAN)
IASRYISMSVW

SEQ ID NO: 146292 - protein, 9 aa, Artificial Sequence
  Description of Artificial Sequence: Synthetic peptide
  Seed: KVDGLSTEA (PRAME_HUMAN)
KIDGLSTEI

SEQ ID NO: 146293 - protein, 10 aa, Artificial Sequence
  Description of Artificial Sequence: Synthetic peptide
  Seed: VMNPLETLSI (PRAME_HUMAN)
VMNPLETLSM

SEQ ID NO: 146294 - protein, 10 aa, Artificial Sequence
  Description of Artificial Sequence: Synthetic peptide
  Seed: ISISALQSLL (PRAME_HUMAN)
IVISALQSLW

SEQ ID NO: 146295 - protein, 9 aa, Artificial Sequence
  Description of Artificial Sequence: Synthetic peptide
  Seed: RRLLLSHIH (PRAME_HUMAN)
RRLLLSHIT

SEQ ID NO: 146296 - protein, 9 aa, Artificial Sequence
  Description of Artificial Sequence: Synthetic peptide
  Seed: LAIAALELL (PRAME_HUMAN)
LMIAALELI

SEQ ID NO: 146297 - protein, 9 aa, Artificial Sequence
  Description of Artificial Sequence: Synthetic peptide
  Seed: RLCCKKLKI (PRAME_HUMAN)
RQCCKKLKV

SEQ ID NO: 146298 - protein, 10 aa, Artificial Sequence
  Description of Artificial Sequence: Synthetic peptide
  Seed: RASATLQDLV (PRAME_HUMAN)
RNSATLQDLW

SEQ ID NO: 146299 - protein, 9 aa, Artificial Sequence
  Description of Artificial Sequence: Synthetic peptide
  Seed: MHLSQSPSV (PRAME_HUMAN)
MTLSQSPSY

SEQ ID NO: 146300 - protein, 8 aa, Artificial Sequence
  Description of Artificial Sequence: Synthetic peptide
  Seed: LFPPLFMA (PRAME_HUMAN)
LMPPLFMV

SEQ ID NO: 146301 - protein, 8 aa, Artificial Sequence
  Description of Artificial Sequence: Synthetic peptide
  Seed: MSVWTSPR (PRAME_HUMAN)
MTVWTSPR

SEQ ID NO: 146302 - protein, 9 aa, Artificial Sequence
  Description of Artificial Sequence: Synthetic peptide
  Seed: KLKIFAMPM (PRAME_HUMAN)
KMKIFAMPL

SEQ ID NO: 146303 - protein, 9 aa, Artificial Sequence
  Description of Artificial Sequence: Synthetic peptide
  Seed: QLLALLPSL (PRAME_HUMAN)
QALALLPSY

SEQ ID NO: 146304 - protein, 11 aa, Artificial Sequence
  Description of Artificial Sequence: Synthetic peptide
  Seed: LSNLTHVLYPV (PRAME_HUMAN)
LMNLTHVLYPI

SEQ ID NO: 146305 - protein, 9 aa, Artificial Sequence
  Description of Artificial Sequence: Synthetic peptide
  Seed: HVMNPLETL (PRAME_HUMAN)
HEMNPLETL

SEQ ID NO: 146306 - protein, 9 aa, Artificial Sequence
  Description of Artificial Sequence: Synthetic peptide
  Seed: VQLDSIEDL (PRAME_HUMAN)
VILDSIEDI

SEQ ID NO: 146307 - protein, 9 aa, Artificial Sequence
  Description of Artificial Sequence: Synthetic peptide
  Seed: SPSVSQLSV (PRAME_HUMAN)
SPSVSQLSF

SEQ ID NO: 146308 - protein, 9 aa, Artificial Sequence
  Description of Artificial Sequence: Synthetic peptide
  Seed: ELFPPLFMA (PRAME_HUMAN)
EMFPPLFMM

SEQ ID NO: 146309 - protein, 10 aa, Artificial Sequence
  Description of Artificial Sequence: Synthetic peptide
  Seed: AFDGRHSQTL (PRAME_HUMAN)
AYDGRHSQTM

SEQ ID NO: 146310 - protein, 10 aa, Artificial Sequence
  Description of Artificial Sequence: Synthetic peptide
  Seed: ARLRELLCEL (PRAME_HUMAN)
AALRELLCEV

SEQ ID NO: 146311 - protein, 10 aa, Artificial Sequence
  Description of Artificial Sequence: Synthetic peptide
  Seed: TTLSFYGNSI (PRAME_HUMAN)
TFLSFYGNSV

SEQ ID NO: 146312 - protein, 10 aa, Artificial Sequence
  Description of Artificial Sequence: Synthetic peptide
  Seed: RGRLDQLLRH (PRAME_HUMAN)
RTRLDQLLRL

SEQ ID NO: 146313 - protein, 9 aa, Artificial Sequence
  Description of Artificial Sequence: Synthetic peptide
  Seed: RLRELLCEL (PRAME_HUMAN)
RVRELLCES

SEQ ID NO: 146314 - protein, 10 aa, Artificial Sequence
  Description of Artificial Sequence: Synthetic peptide
  Seed: IKMILKMVQL (PRAME_HUMAN)
IFMILKMVQV

SEQ ID NO: 146315 - protein, 10 aa, Artificial Sequence
  Description of Artificial Sequence: Synthetic peptide
  Seed: DELFSYLIEK (PRAME_HUMAN)
DILFSYLIER

SEQ ID NO: 146316 - protein, 10 aa, Artificial Sequence
  Description of Artificial Sequence: Synthetic peptide
  Seed: MVQAWPFTCL (PRAME_HUMAN)
MIQAWPFTCY

SEQ ID NO: 146317 - protein, 9 aa, Artificial Sequence
  Description of Artificial Sequence: Synthetic peptide
  Seed: NSHQDFWTV (PRAME_HUMAN)
NSHQDFWTY

SEQ ID NO: 146318 - protein, 10 aa, Artificial Sequence
  Description of Artificial Sequence: Synthetic peptide
  Seed: AMVQAWPFTC (PRAME_HUMAN)
ALVQAWPFTV

SEQ ID NO: 146319 - protein, 9 aa, Artificial Sequence
  Description of Artificial Sequence: Synthetic peptide
  Seed: ISISALQSL (PRAME_HUMAN)
IQISALQSW

SEQ ID NO: 146320 - protein, 9 aa, Artificial Sequence
  Description of Artificial Sequence: Synthetic peptide
  Seed: RRLWGSIQS (PRAME_HUMAN)
RQLWGSIQF

SEQ ID NO: 146321 - protein, 9 aa, Artificial Sequence
  Description of Artificial Sequence: Synthetic peptide
  Seed: SQLTTLSFY (PRAME_HUMAN)
SILTTLSFF

SEQ ID NO: 146322 - protein, 9 aa, Artificial Sequence
  Description of Artificial Sequence: Synthetic peptide
  Seed: TSPRRLVEL (PRAME_HUMAN)
TIPRRLVEM

SEQ ID NO: 146323 - protein, 9 aa, Artificial Sequence
  Description of Artificial Sequence: Synthetic peptide
  Seed: ASSYISPEK (PRAME_HUMAN)
AYSYISPER

SEQ ID NO: 146324 - protein, 9 aa, Artificial Sequence
  Description of Artificial Sequence: Synthetic peptide
  Seed: YLHARLREL (PRAME_HUMAN)
YAHARLREI

SEQ ID NO: 146325 - protein, 9 aa, Artificial Sequence
  Description of Artificial Sequence: Synthetic peptide
  Seed: SYEDIHGTL (PRAME_HUMAN)
SFEDIHGTV

SEQ ID NO: 146326 - protein, 10 aa, Artificial Sequence
  Description of Artificial Sequence: Synthetic peptide
  Seed: DRTFYDPEPI (PRAME_HUMAN)
DWTFYDPEPV

SEQ ID NO: 146327 - protein, 10 aa, Artificial Sequence
  Description of Artificial Sequence: Synthetic peptide
  Seed: HASSYISPEK (PRAME_HUMAN)
HNSSYISPER

SEQ ID NO: 146328 - protein, 11 aa, Artificial Sequence
  Description of Artificial Sequence: Synthetic peptide
  Seed: SQLSVLSLSGV (PRAME_HUMAN)
SMLSVLSLSGL

SEQ ID NO: 146329 - protein, 9 aa, Artificial Sequence
  Description of Artificial Sequence: Synthetic peptide
  Seed: ALLPSLSHC (PRAME_HUMAN)
AMLPSLSHC

SEQ ID NO: 146330 - protein, 9 aa, Artificial Sequence
  Description of Artificial Sequence: Synthetic peptide
  Seed: KMILKMVQL (PRAME_HUMAN)
KAILKMVQL

SEQ ID NO: 146331 - protein, 9 aa, Artificial Sequence
  Description of Artificial Sequence: Synthetic peptide
  Seed: YISMSVWTS (PRAME_HUMAN)
YLSMSVWTF

SEQ ID NO: 146332 - protein, 9 aa, Artificial Sequence
  Description of Artificial Sequence: Synthetic peptide
  Seed: FYDPEPILC (PRAME_HUMAN)
FLDPEPILT

SEQ ID NO: 146333 - protein, 9 aa, Artificial Sequence
  Description of Artificial Sequence: Synthetic peptide
  Seed: CKKLKIFAM (PRAME_HUMAN)
CIKLKIFAV

SEQ ID NO: 146334 - protein, 9 aa, Artificial Sequence
  Description of Artificial Sequence: Synthetic peptide
  Seed: YIAQFTSQF (PRAME_HUMAN)
YGAQFTSQY

SEQ ID NO: 146335 - protein, 11 aa, Artificial Sequence
  Description of Artificial Sequence: Synthetic peptide
  Seed: AVLDGLDVLLA (PRAME_HUMAN)
AILDGLDVLLV

SEQ ID NO: 146336 - protein, 10 aa, Artificial Sequence
  Description of Artificial Sequence: Synthetic peptide
  Seed: LLSHIHASSY (PRAME_HUMAN)
LMSHIHASSW

SEQ ID NO: 146337 - protein, 9 aa, Artificial Sequence
  Description of Artificial Sequence: Synthetic peptide
  Seed: YSFPEPEAA (PRAME_HUMAN)
YLFPEPEAV

SEQ ID NO: 146338 - protein, 10 aa, Artificial Sequence
  Description of Artificial Sequence: Synthetic peptide
  Seed: VLYPVPLESY (PRAME_HUMAN)
VRYPVPLESM

SEQ ID NO: 146339 - protein, 9 aa, Artificial Sequence
  Description of Artificial Sequence: Synthetic peptide
  Seed: QSLLKDEAL (PRAME_HUMAN)
QALLKDEAY

SEQ ID NO: 146340 - protein, 9 aa, Artificial Sequence
  Description of Artificial Sequence: Synthetic peptide
  Seed: IAALELLPR (PRAME_HUMAN)
ISALELLPK

SEQ ID NO: 146341 - protein, 10 aa, Artificial Sequence
  Description of Artificial Sequence: Synthetic peptide
  Seed: LSVLSLSGVM (PRAME_HUMAN)
LAVLSLSGVW

SEQ ID NO: 146342 - protein, 10 aa, Artificial Sequence
  Description of Artificial Sequence: Synthetic peptide
  Seed: DQLLALLPSL (PRAME_HUMAN)
DYLLALLPSV

SEQ ID NO: 146343 - protein, 10 aa, Artificial Sequence
  Description of Artificial Sequence: Synthetic peptide
  Seed: KGQHLHLETF (PRAME_HUMAN)
KLQHLHLETY

SEQ ID NO: 146344 - protein, 9 aa, Artificial Sequence
  Description of Artificial Sequence: Synthetic peptide
  Seed: ALAIAALEL (PRAME_HUMAN)
AAAIAALEV

SEQ ID NO: 146345 - protein, 10 aa, Artificial Sequence
  Description of Artificial Sequence: Synthetic peptide
  Seed: LLLSHIHASS (PRAME_HUMAN)
LYLSHIHASA

SEQ ID NO: 146346 - protein, 10 aa, Artificial Sequence
  Description of Artificial Sequence: Synthetic peptide
  Seed: HCSQLTTLSF (PRAME_HUMAN)
HSSQLTTLSM

SEQ ID NO: 146347 - protein, 9 aa, Artificial Sequence
  Description of Artificial Sequence: Synthetic peptide
  Seed: EAAQPMTKK (PRAME_HUMAN)
EVAQPMTKI

SEQ ID NO: 146348 - protein, 9 aa, Artificial Sequence
  Description of Artificial Sequence: Synthetic peptide
  Seed: ISISALQSL (PRAME_HUMAN)
IMISALQSI

SEQ ID NO: 146349 - protein, 9 aa, Artificial Sequence
  Description of Artificial Sequence: Synthetic peptide
  Seed: RLLLSHIHA (PRAME_HUMAN)
RMLLSHIHL

SEQ ID NO: 146350 - protein, 9 aa, Artificial Sequence
  Description of Artificial Sequence: Synthetic peptide
  Seed: SQFLSLQCL (PRAME_HUMAN)
SAFLSLQCF

SEQ ID NO: 146351 - protein, 10 aa, Artificial Sequence
  Description of Artificial Sequence: Synthetic peptide
  Seed: LQALYVDSLF (PRAME_HUMAN)
LTALYVDSLY

SEQ ID NO: 146352 - protein, 8 aa, Artificial Sequence
  Description of Artificial Sequence: Synthetic peptide
  Seed: ACDELFSY (PRAME_HUMAN)
ATDELFSY

SEQ ID NO: 146353 - protein, 8 aa, Artificial Sequence
  Description of Artificial Sequence: Synthetic peptide
  Seed: SPRRLVEL (PRAME_HUMAN)
SPRRLVEM

SEQ ID NO: 146354 - protein, 10 aa, Artificial Sequence
  Description of Artificial Sequence: Synthetic peptide
  Seed: ISMSVWTSPR (PRAME_HUMAN)
IKMSVWTSPK

SEQ ID NO: 146355 - protein, 10 aa, Artificial Sequence
  Description of Artificial Sequence: Synthetic peptide
  Seed: RRLLLSHIHA (PRAME_HUMAN)
RRLLLSHIHI

SEQ ID NO: 146356 - protein, 10 aa, Artificial Sequence
  Description of Artificial Sequence: Synthetic peptide
  Seed: ESYEDIHGTL (PRAME_HUMAN)
ELYEDIHGTY

SEQ ID NO: 146357 - protein, 10 aa, Artificial Sequence
  Description of Artificial Sequence: Synthetic peptide
  Seed: VRPRRWKLQV (PRAME_HUMAN)
VSPRRWKLQL

SEQ ID NO: 146358 - protein, 10 aa, Artificial Sequence
  Description of Artificial Sequence: Synthetic peptide
  Seed: MPMQDIKMIL (PRAME_HUMAN)
MHMQDIKMIM

SEQ ID NO: 146359 - protein, 10 aa, Artificial Sequence
  Description of Artificial Sequence: Synthetic peptide
  Seed: LSLQCLQALY (PRAME_HUMAN)
LYLQCLQALY

SEQ ID NO: 146360 - protein, 9 aa, Artificial Sequence
  Description of Artificial Sequence: Synthetic peptide
  Seed: RHSQTLKAM (PRAME_HUMAN)
RYSQTLKAI

SEQ ID NO: 146361 - protein, 10 aa, Artificial Sequence
  Description of Artificial Sequence: Synthetic peptide
  Seed: RLVELAGQSL (PRAME_HUMAN)
RVVELAGQSI

SEQ ID NO: 146362 - protein, 9 aa, Artificial Sequence
  Description of Artificial Sequence: Synthetic peptide
  Seed: RLAYLHARL (PRAME_HUMAN)
RLAYLHARF

SEQ ID NO: 146363 - protein, 9 aa, Artificial Sequence
  Description of Artificial Sequence: Synthetic peptide
  Seed: YGNSISISA (PRAME_HUMAN)
YTNSISISL

SEQ ID NO: 146364 - protein, 9 aa, Artificial Sequence
  Description of Artificial Sequence: Synthetic peptide
  Seed: NLTHVLYPV (PRAME_HUMAN)
NITHVLYPI

SEQ ID NO: 146365 - protein, 11 aa, Artificial Sequence
  Description of Artificial Sequence: Synthetic peptide
  Seed: SIQSRYISMSV (PRAME_HUMAN)
SPQSRYISMSK

SEQ ID NO: 146366 - protein, 9 aa, Artificial Sequence
  Description of Artificial Sequence: Synthetic peptide
  Seed: TSPRRLVEL (PRAME_HUMAN)
TLPRRLVEF

SEQ ID NO: 146367 - protein, 10 aa, Artificial Sequence
  Description of Artificial Sequence: Synthetic peptide
  Seed: GRLDQLLRHV (PRAME_HUMAN)
GRLDQLLRHM

SEQ ID NO: 146368 - protein, 10 aa, Artificial Sequence
  Description of Artificial Sequence: Synthetic peptide
  Seed: GRPSMVWLSA (PRAME_HUMAN)
GRPSMVWLSK

SEQ ID NO: 146369 - protein, 11 aa, Artificial Sequence
  Description of Artificial Sequence: Synthetic peptide
  Seed: QALYVDSLFFL (PRAME_HUMAN)
QWLYVDSLFFI

SEQ ID NO: 146370 - protein, 9 aa, Artificial Sequence
  Description of Artificial Sequence: Synthetic peptide
  Seed: YLIEKVKRK (PRAME_HUMAN)
YVIEKVKRR

SEQ ID NO: 146371 - protein, 10 aa, Artificial Sequence
  Description of Artificial Sequence: Synthetic peptide
  Seed: YEDIHGTLHL (PRAME_HUMAN)
YTDIHGTLHM

SEQ ID NO: 146372 - protein, 9 aa, Artificial Sequence
  Description of Artificial Sequence: Synthetic peptide
  Seed: ALAIAALEL (PRAME_HUMAN)
AMAIAALEA

SEQ ID NO: 146373 - protein, 9 aa, Artificial Sequence
  Description of Artificial Sequence: Synthetic peptide
  Seed: LSEGDVMHL (PRAME_HUMAN)
LFEGDVMHM

SEQ ID NO: 146374 - protein, 11 aa, Artificial Sequence
  Description of Artificial Sequence: Synthetic peptide
  Seed: FAMPMQDIKMI (PRAME_HUMAN)
FSMPMQDIKMF

SEQ ID NO: 146375 - protein, 9 aa, Artificial Sequence
  Description of Artificial Sequence: Synthetic peptide
  Seed: SVWTSPRRL (PRAME_HUMAN)
SMWTSPRRW

SEQ ID NO: 146376 - protein, 10 aa, Artificial Sequence
  Description of Artificial Sequence: Synthetic peptide
  Seed: QSLLQHLIGL (PRAME_HUMAN)
QTLLQHLIGW

SEQ ID NO: 146377 - protein, 10 aa, Artificial Sequence
  Description of Artificial Sequence: Synthetic peptide
  Seed: RRLWGSIQSR (PRAME_HUMAN)
RQLWGSIQSR

SEQ ID NO: 146378 - protein, 10 aa, Artificial Sequence
  Description of Artificial Sequence: Synthetic peptide
  Seed: SNLTHVLYPV (PRAME_HUMAN)
SDLTHVLYPI

SEQ ID NO: 146379 - protein, 9 aa, Artificial Sequence
  Description of Artificial Sequence: Synthetic peptide
  Seed: FYDPEPILC (PRAME_HUMAN)
FQDPEPILM

SEQ ID NO: 146380 - protein, 9 aa, Artificial Sequence
  Description of Artificial Sequence: Synthetic peptide
  Seed: YGNSISISA (PRAME_HUMAN)
YSNSISISY

SEQ ID NO: 146381 - protein, 8 aa, Artificial Sequence
  Description of Artificial Sequence: Synthetic peptide
  Seed: YEDIHGTL (PRAME_HUMAN)
YYDIHGTL

SEQ ID NO: 146382 - protein, 10 aa, Artificial Sequence
  Description of Artificial Sequence: Synthetic peptide
  Seed: ERASATLQDL (PRAME_HUMAN)
EHASATLQDF

SEQ ID NO: 146383 - protein, 9 aa, Artificial Sequence
  Description of Artificial Sequence: Synthetic peptide
  Seed: VLMKGQHLH (PRAME_HUMAN)
VLMKGQHLF

SEQ ID NO: 146384 - protein, 9 aa, Artificial Sequence
  Description of Artificial Sequence: Synthetic peptide
  Seed: KLKIFAMPM (PRAME_HUMAN)
KYKIFAMPV

SEQ ID NO: 146385 - protein, 10 aa, Artificial Sequence
  Description of Artificial Sequence: Synthetic peptide
  Seed: QSLLQHLIGL (PRAME_HUMAN)
QILLQHLIGI

SEQ ID NO: 146386 - protein, 10 aa, Artificial Sequence
  Description of Artificial Sequence: Synthetic peptide
  Seed: ARLRELLCEL (PRAME_HUMAN)
ANLRELLCEA

SEQ ID NO: 146387 - protein, 10 aa, Artificial Sequence
  Description of Artificial Sequence: Synthetic peptide
  Seed: FFLRGRLDQL (PRAME_HUMAN)
FKLRGRLDQL

SEQ ID NO: 146388 - protein, 10 aa, Artificial Sequence
  Description of Artificial Sequence: Synthetic peptide
  Seed: ARLRELLCEL (PRAME_HUMAN)
AMLRELLCEA

SEQ ID NO: 146389 - protein, 10 aa, Artificial Sequence
  Description of Artificial Sequence: Synthetic peptide
  Seed: ALQSLLQHLI (PRAME_HUMAN)
AMQSLLQHLI

SEQ ID NO: 146390 - protein, 11 aa, Artificial Sequence
  Description of Artificial Sequence: Synthetic peptide
  Seed: ALYVDSLFFLR (PRAME_HUMAN)
AWYVDSLFFLR

SEQ ID NO: 146391 - protein, 10 aa, Artificial Sequence
  Description of Artificial Sequence: Synthetic peptide
  Seed: ISMSVWTSPR (PRAME_HUMAN)
INMSVWTSPR

SEQ ID NO: 146392 - protein, 9 aa, Artificial Sequence
  Description of Artificial Sequence: Synthetic peptide
  Seed: RTFYDPEPI (PRAME_HUMAN)
REFYDPEPF

SEQ ID NO: 146393 - protein, 9 aa, Artificial Sequence
  Description of Artificial Sequence: Synthetic peptide
  Seed: ALQSLLQHL (PRAME_HUMAN)
AMQSLLQHY

SEQ ID NO: 146394 - protein, 10 aa, Artificial Sequence
  Description of Artificial Sequence: Synthetic peptide
  Seed: RELFPPLFMA (PRAME_HUMAN)
RHLFPPLFML

SEQ ID NO: 146395 - protein, 10 aa, Artificial Sequence
  Description of Artificial Sequence: Synthetic peptide
  Seed: HCSQLTTLSF (PRAME_HUMAN)
HISQLTTLSF

SEQ ID NO: 146396 - protein, 10 aa, Artificial Sequence
  Description of Artificial Sequence: Synthetic peptide
  Seed: RELFPPLFMA (PRAME_HUMAN)
RVLFPPLFML

SEQ ID NO: 146397 - protein, 10 aa, Artificial Sequence
  Description of Artificial Sequence: Synthetic peptide
  Seed: SNLTHVLYPV (PRAME_HUMAN)
SYLTHVLYPA

SEQ ID NO: 146398 - protein, 9 aa, Artificial Sequence
  Description of Artificial Sequence: Synthetic peptide
  Seed: FPEPEAAQP (PRAME_HUMAN)
FPEPEAAQY

SEQ ID NO: 146399 - protein, 9 aa, Artificial Sequence
  Description of Artificial Sequence: Synthetic peptide
  Seed: SLLQHLIGL (PRAME_HUMAN)
SILQHLIGI

SEQ ID NO: 146400 - protein, 9 aa, Artificial Sequence
  Description of Artificial Sequence: Synthetic peptide
  Seed: VFDECGITD (PRAME_HUMAN)
VIDECGITV

SEQ ID NO: 146401 - protein, 9 aa, Artificial Sequence
  Description of Artificial Sequence: Synthetic peptide
  Seed: MINLRRLLL (PRAME_HUMAN)
MANLRRLLF

SEQ ID NO: 146402 - protein, 11 aa, Artificial Sequence
  Description of Artificial Sequence: Synthetic peptide
  Seed: LSLSGVMLTDV (PRAME_HUMAN)
LMLSGVMLTDI

SEQ ID NO: 146403 - protein, 10 aa, Artificial Sequence
  Description of Artificial Sequence: Synthetic peptide
  Seed: YIAQFTSQFL (PRAME_HUMAN)
YMAQFTSQFL

SEQ ID NO: 146404 - protein, 10 aa, Artificial Sequence
  Description of Artificial Sequence: Synthetic peptide
  Seed: LLSHIHASSY (PRAME_HUMAN)
LFSHIHASSW

SEQ ID NO: 146405 - protein, 11 aa, Artificial Sequence
  Description of Artificial Sequence: Synthetic peptide
  Seed: GITDDQLLALL (PRAME_HUMAN)
GLTDDQLLALV

SEQ ID NO: 146406 - protein, 11 aa, Artificial Sequence
  Description of Artificial Sequence: Synthetic peptide
  Seed: KIFAMPMQDIK (PRAME_HUMAN)
KLFAMPMQDIR

SEQ ID NO: 146407 - protein, 10 aa, Artificial Sequence
  Description of Artificial Sequence: Synthetic peptide
  Seed: ETLSITNCRL (PRAME_HUMAN)
ETLSITNCRR

SEQ ID NO: 146408 - protein, 9 aa, Artificial Sequence
  Description of Artificial Sequence: Synthetic peptide
  Seed: TDDQLLALL (PRAME_HUMAN)
TSDQLLALV

SEQ ID NO: 146409 - protein, 10 aa, Artificial Sequence
  Description of Artificial Sequence: Synthetic peptide
  Seed: MVQAWPFTCL (PRAME_HUMAN)
MLQAWPFTCY

SEQ ID NO: 146410 - protein, 9 aa, Artificial Sequence
  Description of Artificial Sequence: Synthetic peptide
  Seed: LYPVPLESY (PRAME_HUMAN)
LVPVPLESY

SEQ ID NO: 146411 - protein, 10 aa, Artificial Sequence
  Description of Artificial Sequence: Synthetic peptide
  Seed: YIAQFTSQFL (PRAME_HUMAN)
YVAQFTSQFF

SEQ ID NO: 146412 - protein, 10 aa, Artificial Sequence
  Description of Artificial Sequence: Synthetic peptide
  Seed: SLLKDEALAI (PRAME_HUMAN)
SVLKDEALAV

SEQ ID NO: 146413 - protein, 9 aa, Artificial Sequence
  Description of Artificial Sequence: Synthetic peptide
  Seed: SHQDFWTVW (PRAME_HUMAN)
SFQDFWTVF

SEQ ID NO: 146414 - protein, 9 aa, Artificial Sequence
  Description of Artificial Sequence: Synthetic peptide
  Seed: AEQPFIPVE (PRAME_HUMAN)
AEQPFIPVY

SEQ ID NO: 146415 - protein, 9 aa, Artificial Sequence
  Description of Artificial Sequence: Synthetic peptide
  Seed: DEALAIAAL (PRAME_HUMAN)
DQALAIAAF

SEQ ID NO: 146416 - protein, 10 aa, Artificial Sequence
  Description of Artificial Sequence: Synthetic peptide
  Seed: AQFTSQFLSL (PRAME_HUMAN)
AHFTSQFLSF

SEQ ID NO: 146417 - protein, 8 aa, Artificial Sequence
  Description of Artificial Sequence: Synthetic peptide
  Seed: LLLSHIHA (PRAME_HUMAN)
LMLSHIHV

SEQ ID NO: 146418 - protein, 9 aa, Artificial Sequence
  Description of Artificial Sequence: Synthetic peptide
  Seed: RASATLQDL (PRAME_HUMAN)
RASATLQDY

SEQ ID NO: 146419 - protein, 10 aa, Artificial Sequence
  Description of Artificial Sequence: Synthetic peptide
  Seed: RRRLWGSIQS (PRAME_HUMAN)
RQRLWGSIQK

SEQ ID NO: 146420 - protein, 10 aa, Artificial Sequence
  Description of Artificial Sequence: Synthetic peptide
  Seed: GRPSMVWLSA (PRAME_HUMAN)
GFPSMVWLSL

SEQ ID NO: 146421 - protein, 9 aa, Artificial Sequence
  Description of Artificial Sequence: Synthetic peptide
  Seed: THVLYPVPL (PRAME_HUMAN)
TWVLYPVPL

SEQ ID NO: 146422 - protein, 11 aa, Artificial Sequence
  Description of Artificial Sequence: Synthetic peptide
  Seed: EDIHGTLHLER (PRAME_HUMAN)
EAIHGTLHLER

SEQ ID NO: 146423 - protein, 10 aa, Artificial Sequence
  Description of Artificial Sequence: Synthetic peptide
  Seed: FAMPMQDIKM (PRAME_HUMAN)
FMMPMQDIKL

SEQ ID NO: 146424 - protein, 9 aa, Artificial Sequence
  Description of Artificial Sequence: Synthetic peptide
  Seed: GITDDQLLA (PRAME_HUMAN)
GMTDDQLLI

SEQ ID NO: 146425 - protein, 10 aa, Artificial Sequence
  Description of Artificial Sequence: Synthetic peptide
  Seed: PTLAKFSPYL (PRAME_HUMAN)
PALAKFSPYI

SEQ ID NO: 146426 - protein, 10 aa, Artificial Sequence
  Description of Artificial Sequence: Synthetic peptide
  Seed: VDSLFFLRGR (PRAME_HUMAN)
VQSLFFLRGR

SEQ ID NO: 146427 - protein, 9 aa, Artificial Sequence
  Description of Artificial Sequence: Synthetic peptide
  Seed: SALQSLLQH (PRAME_HUMAN)
STLQSLLQK

SEQ ID NO: 146428 - protein, 9 aa, Artificial Sequence
  Description of Artificial Sequence: Synthetic peptide
  Seed: KFSPYLGQM (PRAME_HUMAN)
KSSPYLGQY

SEQ ID NO: 146429 - protein, 10 aa, Artificial Sequence
  Description of Artificial Sequence: Synthetic peptide
  Seed: AAFDGRHSQT (PRAME_HUMAN)
ALFDGRHSQM

SEQ ID NO: 146430 - protein, 10 aa, Artificial Sequence
  Description of Artificial Sequence: Synthetic peptide
  Seed: IQSRYISMSV (PRAME_HUMAN)
ILSRYISMSL

SEQ ID NO: 146431 - protein, 9 aa, Artificial Sequence
  Description of Artificial Sequence: Synthetic peptide
  Seed: YLHARLREL (PRAME_HUMAN)
YNHARLREL

SEQ ID NO: 146432 - protein, 10 aa, Artificial Sequence
  Description of Artificial Sequence: Synthetic peptide
  Seed: MPMQDIKMIL (PRAME_HUMAN)
MMMQDIKMIA

SEQ ID NO: 146433 - protein, 9 aa, Artificial Sequence
  Description of Artificial Sequence: Synthetic peptide
  Seed: YISMSVWTS (PRAME_HUMAN)
YQSMSVWTL

SEQ ID NO: 146434 - protein, 8 aa, Artificial Sequence
  Description of Artificial Sequence: Synthetic peptide
  Seed: FYDPEPIL (PRAME_HUMAN)
FADPEPIF

SEQ ID NO: 146435 - protein, 9 aa, Artificial Sequence
  Description of Artificial Sequence: Synthetic peptide
  Seed: TLKAMVQAW (PRAME_HUMAN)
TVKAMVQAW

SEQ ID NO: 146436 - protein, 10 aa, Artificial Sequence
  Description of Artificial Sequence: Synthetic peptide
  Seed: RTFYDPEPIL (PRAME_HUMAN)
RSFYDPEPIW

SEQ ID NO: 146437 - protein, 9 aa, Artificial Sequence
  Description of Artificial Sequence: Synthetic peptide
  Seed: LMKGQHLHL (PRAME_HUMAN)
LVKGQHLHW

SEQ ID NO: 146438 - protein, 11 aa, Artificial Sequence
  Description of Artificial Sequence: Synthetic peptide
  Seed: YISMSVWTSPR (PRAME_HUMAN)
YMSMSVWTSPR

SEQ ID NO: 146439 - protein, 9 aa, Artificial Sequence
  Description of Artificial Sequence: Synthetic peptide
  Seed: YSFPEPEAA (PRAME_HUMAN)
YGFPEPEAY

SEQ ID NO: 146440 - protein, 10 aa, Artificial Sequence
  Description of Artificial Sequence: Synthetic peptide
  Seed: ALQSLLQHLI (PRAME_HUMAN)
AMQSLLQHLL

SEQ ID NO: 146441 - protein, 9 aa, Artificial Sequence
  Description of Artificial Sequence: Synthetic peptide
  Seed: SALQSLLQH (PRAME_HUMAN)
SILQSLLQR

SEQ ID NO: 146442 - protein, 10 aa, Artificial Sequence
  Description of Artificial Sequence: Synthetic peptide
  Seed: RHVMNPLETL (PRAME_HUMAN)
RAVMNPLETW

SEQ ID NO: 146443 - protein, 11 aa, Artificial Sequence
  Description of Artificial Sequence: Synthetic peptide
  Seed: RRRLWGSIQSR (PRAME_HUMAN)
RIRLWGSIQSR

SEQ ID NO: 146444 - protein, 9 aa, Artificial Sequence
  Description of Artificial Sequence: Synthetic peptide
  Seed: RRWKLQVLD (PRAME_HUMAN)
RQWKLQVLK

SEQ ID NO: 146445 - protein, 9 aa, Artificial Sequence
  Description of Artificial Sequence: Synthetic peptide
  Seed: LYPVPLESY (PRAME_HUMAN)
LSPVPLESL

SEQ ID NO: 146446 - protein, 9 aa, Artificial Sequence
  Description of Artificial Sequence: Synthetic peptide
  Seed: SVWTSPRRL (PRAME_HUMAN)
SMWTSPRRV

SEQ ID NO: 146447 - protein, 9 aa, Artificial Sequence
  Description of Artificial Sequence: Synthetic peptide
  Seed: ISISALQSL (PRAME_HUMAN)
IVISALQSM

SEQ ID NO: 146448 - protein, 9 aa, Artificial Sequence
  Description of Artificial Sequence: Synthetic peptide
  Seed: ALLPSLSHC (PRAME_HUMAN)
AVLPSLSHV

SEQ ID NO: 146449 - protein, 11 aa, Artificial Sequence
  Description of Artificial Sequence: Synthetic peptide
  Seed: RLWGSIQSRYI (PRAME_HUMAN)
RLWGSIQSRYL

SEQ ID NO: 146450 - protein, 10 aa, Artificial Sequence
  Description of Artificial Sequence: Synthetic peptide
  Seed: ISISALQSLL (PRAME_HUMAN)
IPISALQSLW

SEQ ID NO: 146451 - protein, 9 aa, Artificial Sequence
  Description of Artificial Sequence: Synthetic peptide
  Seed: TLAKFSPYL (PRAME_HUMAN)
TMAKFSPYV

SEQ ID NO: 146452 - protein, 10 aa, Artificial Sequence
  Description of Artificial Sequence: Synthetic peptide
  Seed: MPMQDIKMIL (PRAME_HUMAN)
MEMQDIKMIV

SEQ ID NO: 146453 - protein, 9 aa, Artificial Sequence
  Description of Artificial Sequence: Synthetic peptide
  Seed: QLLALLPSL (PRAME_HUMAN)
QLLALLPSW

SEQ ID NO: 146454 - protein, 9 aa, Artificial Sequence
  Description of Artificial Sequence: Synthetic peptide
  Seed: YSFPEPEAA (PRAME_HUMAN)
YTFPEPEAI

SEQ ID NO: 146455 - protein, 10 aa, Artificial Sequence
  Description of Artificial Sequence: Synthetic peptide
  Seed: SYEDIHGTLH (PRAME_HUMAN)
SYEDIHGTLF

SEQ ID NO: 146456 - protein, 10 aa, Artificial Sequence
  Description of Artificial Sequence: Synthetic peptide
  Seed: KKLKIFAMPM (PRAME_HUMAN)
KLLKIFAMPK

SEQ ID NO: 146457 - protein, 9 aa, Artificial Sequence
  Description of Artificial Sequence: Synthetic peptide
  Seed: RGRLDQLLR (PRAME_HUMAN)
RIRLDQLLM

SEQ ID NO: 146458 - protein, 9 aa, Artificial Sequence
  Description of Artificial Sequence: Synthetic peptide
  Seed: SLLQHLIGL (PRAME_HUMAN)
SWLQHLIGY

SEQ ID NO: 146459 - protein, 9 aa, Artificial Sequence
  Description of Artificial Sequence: Synthetic peptide
  Seed: TWKLPTLAK (PRAME_HUMAN)
TAKLPTLAK

SEQ ID NO: 146460 - protein, 9 aa, Artificial Sequence
  Description of Artificial Sequence: Synthetic peptide
  Seed: MNPLETLSI (PRAME_HUMAN)
MRPLETLSF

SEQ ID NO: 146461 - protein, 10 aa, Artificial Sequence
  Description of Artificial Sequence: Synthetic peptide
  Seed: GSIQSRYISM (PRAME_HUMAN)
GSIQSRYISW

SEQ ID NO: 146462 - protein, 9 aa, Artificial Sequence
  Description of Artificial Sequence: Synthetic peptide
  Seed: LMKGQHLHL (PRAME_HUMAN)
LYKGQHLHM

SEQ ID NO: 146463 - protein, 9 aa, Artificial Sequence
  Description of Artificial Sequence: Synthetic peptide
  Seed: MINLRRLLL (PRAME_HUMAN)
MPNLRRLLM

SEQ ID NO: 146464 - protein, 10 aa, Artificial Sequence
  Description of Artificial Sequence: Synthetic peptide
  Seed: KFSPYLGQMI (PRAME_HUMAN)
KFSPYLGQMF

SEQ ID NO: 146465 - protein, 9 aa, Artificial Sequence
  Description of Artificial Sequence: Synthetic peptide
  Seed: RTFYDPEPI (PRAME_HUMAN)
RLFYDPEPY

SEQ ID NO: 146466 - protein, 9 aa, Artificial Sequence
  Description of Artificial Sequence: Synthetic peptide
  Seed: RWKLQVLDL (PRAME_HUMAN)
RLKLQVLDK

SEQ ID NO: 146467 - protein, 10 aa, Artificial Sequence
  Description of Artificial Sequence: Synthetic peptide
  Seed: FFLRGRLDQL (PRAME_HUMAN)
FVLRGRLDQL

SEQ ID NO: 146468 - protein, 10 aa, Artificial Sequence
  Description of Artificial Sequence: Synthetic peptide
  Seed: RHVMNPLETL (PRAME_HUMAN)
RMVMNPLETF

SEQ ID NO: 146469 - protein, 9 aa, Artificial Sequence
  Description of Artificial Sequence: Synthetic peptide
  Seed: RHSQTLKAM (PRAME_HUMAN)
RNSQTLKAY

SEQ ID NO: 146470 - protein, 9 aa, Artificial Sequence
  Description of Artificial Sequence: Synthetic peptide
  Seed: RHSQTLKAM (PRAME_HUMAN)
RTSQTLKAF

SEQ ID NO: 146471 - protein, 9 aa, Artificial Sequence
  Description of Artificial Sequence: Synthetic peptide
  Seed: QSRYISMSV (PRAME_HUMAN)
QSRYISMSA

SEQ ID NO: 146472 - protein, 9 aa, Artificial Sequence
  Description of Artificial Sequence: Synthetic peptide
  Seed: RLRELLCEL (PRAME_HUMAN)
RFRELLCEY

SEQ ID NO: 146473 - protein, 9 aa, Artificial Sequence
  Description of Artificial Sequence: Synthetic peptide
  Seed: TDDQLLALL (PRAME_HUMAN)
TADQLLALI

SEQ ID NO: 146474 - protein, 9 aa, Artificial Sequence
  Description of Artificial Sequence: Synthetic peptide
  Seed: NLTHVLYPV (PRAME_HUMAN)
NVTHVLYPA

SEQ ID NO: 146475 - protein, 9 aa, Artificial Sequence
  Description of Artificial Sequence: Synthetic peptide
  Seed: KVDGLSTEA (PRAME_HUMAN)
KADGLSTEF

SEQ ID NO: 146476 - protein, 9 aa, Artificial Sequence
  Description of Artificial Sequence: Synthetic peptide
  Seed: GQMINLRRL (PRAME_HUMAN)
GQMINLRRV

SEQ ID NO: 146477 - protein, 10 aa, Artificial Sequence
  Description of Artificial Sequence: Synthetic peptide
  Seed: KGQHLHLETF (PRAME_HUMAN)
KTQHLHLETW

SEQ ID NO: 146478 - protein, 11 aa, Artificial Sequence
  Description of Artificial Sequence: Synthetic peptide
  Seed: LPTLAKFSPYL (PRAME_HUMAN)
LMTLAKFSPYI

SEQ ID NO: 146479 - protein, 10 aa, Artificial Sequence
  Description of Artificial Sequence: Synthetic peptide
  Seed: CSQLTTLSFY (PRAME_HUMAN)
CMQLTTLSFY

SEQ ID NO: 146480 - protein, 11 aa, Artificial Sequence
  Description of Artificial Sequence: Synthetic peptide
  Seed: ESYEDIHGTLH (PRAME_HUMAN)
EIYEDIHGTLR

SEQ ID NO: 146481 - protein, 10 aa, Artificial Sequence
  Description of Artificial Sequence: Synthetic peptide
  Seed: KEEQYIAQFT (PRAME_HUMAN)
KEEQYIAQFL

SEQ ID NO: 146482 - protein, 9 aa, Artificial Sequence
  Description of Artificial Sequence: Synthetic peptide
  Seed: MSVWTSPRR (PRAME_HUMAN)
MIVWTSPRR

SEQ ID NO: 146483 - protein, 9 aa, Artificial Sequence
  Description of Artificial Sequence: Synthetic peptide
  Seed: ESYEDIHGT (PRAME_HUMAN)
EAYEDIHGA

SEQ ID NO: 146484 - protein, 9 aa, Artificial Sequence
  Description of Artificial Sequence: Synthetic peptide
  Seed: SQLTTLSFY (PRAME_HUMAN)
SSLTTLSFK

SEQ ID NO: 146485 - protein, 9 aa, Artificial Sequence
  Description of Artificial Sequence: Synthetic peptide
  Seed: RLSEGDVMH (PRAME_HUMAN)
RTSEGDVMK

SEQ ID NO: 146486 - protein, 9 aa, Artificial Sequence
  Description of Artificial Sequence: Synthetic peptide
  Seed: ALYVDSLFF (PRAME_HUMAN)
AYYVDSLFY

SEQ ID NO: 146487 - protein, 9 aa, Artificial Sequence
  Description of Artificial Sequence: Synthetic peptide
  Seed: KLKIFAMPM (PRAME_HUMAN)
KTKIFAMPE

SEQ ID NO: 146488 - protein, 10 aa, Artificial Sequence
  Description of Artificial Sequence: Synthetic peptide
  Seed: MLTDVSPEPL (PRAME_HUMAN)
MSTDVSPEPV

SEQ ID NO: 146489 - protein, 9 aa, Artificial Sequence
  Description of Artificial Sequence: Synthetic peptide
  Seed: LLKDEALAI (PRAME_HUMAN)
LLKDEALAF

SEQ ID NO: 146490 - protein, 9 aa, Artificial Sequence
  Description of Artificial Sequence: Synthetic peptide
  Seed: KAMVQAWPF (PRAME_HUMAN)
KVMVQAWPW

SEQ ID NO: 146491 - protein, 10 aa, Artificial Sequence
  Description of Artificial Sequence: Synthetic peptide
  Seed: LLSHIHASSY (PRAME_HUMAN)
LNSHIHASSY

SEQ ID NO: 146492 - protein, 11 aa, Artificial Sequence
  Description of Artificial Sequence: Synthetic peptide
  Seed: LLLSHIHASSY (PRAME_HUMAN)
LQLSHIHASSY

SEQ ID NO: 146493 - protein, 10 aa, Artificial Sequence
  Description of Artificial Sequence: Synthetic peptide
  Seed: RLWGSIQSRY (PRAME_HUMAN)
RFWGSIQSRY

SEQ ID NO: 146494 - protein, 9 aa, Artificial Sequence
  Description of Artificial Sequence: Synthetic peptide
  Seed: VLDGLDVLL (PRAME_HUMAN)
VLDGLDVLI

SEQ ID NO: 146495 - protein, 10 aa, Artificial Sequence
  Description of Artificial Sequence: Synthetic peptide
  Seed: DVSPEPLQAL (PRAME_HUMAN)
DTSPEPLQAR

SEQ ID NO: 146496 - protein, 9 aa, Artificial Sequence
  Description of Artificial Sequence: Synthetic peptide
  Seed: LLRHVMNPL (PRAME_HUMAN)
LARHVMNPL

SEQ ID NO: 146497 - protein, 9 aa, Artificial Sequence
  Description of Artificial Sequence: Synthetic peptide
  Seed: GQHLHLETF (PRAME_HUMAN)
GAHLHLETY

SEQ ID NO: 146498 - protein, 11 aa, Artificial Sequence
  Description of Artificial Sequence: Synthetic peptide
  Seed: QALYVDSLFFL (PRAME_HUMAN)
QTLYVDSLFFV

SEQ ID NO: 146499 - protein, 8 aa, Artificial Sequence
  Description of Artificial Sequence: Synthetic peptide
  Seed: MINLRRLL (PRAME_HUMAN)
MLNLRRLL

SEQ ID NO: 146500 - protein, 9 aa, Artificial Sequence
  Description of Artificial Sequence: Synthetic peptide
  Seed: LQALYVDSL (PRAME_HUMAN)
LAALYVDSY

SEQ ID NO: 146501 - protein, 11 aa, Artificial Sequence
  Description of Artificial Sequence: Synthetic peptide
  Seed: RRLVELAGQSL (PRAME_HUMAN)
RRLVELAGQSY

SEQ ID NO: 146502 - protein, 10 aa, Artificial Sequence
  Description of Artificial Sequence: Synthetic peptide
  Seed: IGLSNLTHVL (PRAME_HUMAN)
IYLSNLTHVV

SEQ ID NO: 146503 - protein, 9 aa, Artificial Sequence
  Description of Artificial Sequence: Synthetic peptide
  Seed: ISISALQSL (PRAME_HUMAN)
IHISALQSM

SEQ ID NO: 146504 - protein, 10 aa, Artificial Sequence
  Description of Artificial Sequence: Synthetic peptide
  Seed: AYLHARLREL (PRAME_HUMAN)
ANLHARLREV

SEQ ID NO: 146505 - protein, 10 aa, Artificial Sequence
  Description of Artificial Sequence: Synthetic peptide
  Seed: KKLKIFAMPM (PRAME_HUMAN)
KQLKIFAMPY

SEQ ID NO: 146506 - protein, 10 aa, Artificial Sequence
  Description of Artificial Sequence: Synthetic peptide
  Seed: RRRLWGSIQS (PRAME_HUMAN)
RFRLWGSIQK

SEQ ID NO: 146507 - protein, 8 aa, Artificial Sequence
  Description of Artificial Sequence: Synthetic peptide
  Seed: ITDDQLLA (PRAME_HUMAN)
IVDDQLLL

SEQ ID NO: 146508 - protein, 9 aa, Artificial Sequence
  Description of Artificial Sequence: Synthetic peptide
  Seed: SLLQHLIGL (PRAME_HUMAN)
SSLQHLIGA

SEQ ID NO: 146509 - protein, 10 aa, Artificial Sequence
  Description of Artificial Sequence: Synthetic peptide
  Seed: VELAGQSLLK (PRAME_HUMAN)
VQLAGQSLLK

SEQ ID NO: 146510 - protein, 8 aa, Artificial Sequence
  Description of Artificial Sequence: Synthetic peptide
  Seed: FYDPEPIL (PRAME_HUMAN)
FSDPEPIF

SEQ ID NO: 146511 - protein, 9 aa, Artificial Sequence
  Description of Artificial Sequence: Synthetic peptide
  Seed: KAMVQAWPF (PRAME_HUMAN)
KAMVQAWPY

SEQ ID NO: 146512 - protein, 9 aa, Artificial Sequence
  Description of Artificial Sequence: Synthetic peptide
  Seed: LLALLPSLS (PRAME_HUMAN)
LMALLPSLM

SEQ ID NO: 146513 - protein, 9 aa, Artificial Sequence
  Description of Artificial Sequence: Synthetic peptide
  Seed: YIAQFTSQF (PRAME_HUMAN)
YMAQFTSQL

SEQ ID NO: 146514 - protein, 10 aa, Artificial Sequence
  Description of Artificial Sequence: Synthetic peptide
  Seed: LSHIHASSYI (PRAME_HUMAN)
LSHIHASSYM

SEQ ID NO: 146515 - protein, 10 aa, Artificial Sequence
  Description of Artificial Sequence: Synthetic peptide
  Seed: LKAMVQAWPF (PRAME_HUMAN)
LLAMVQAWPW

SEQ ID NO: 146516 - protein, 10 aa, Artificial Sequence
  Description of Artificial Sequence: Synthetic peptide
  Seed: AKFSPYLGQM (PRAME_HUMAN)
AEFSPYLGQY

SEQ ID NO: 146517 - protein, 8 aa, Artificial Sequence
  Description of Artificial Sequence: Synthetic peptide
  Seed: QPFIPVEV (PRAME_HUMAN)
QQFIPVEV

SEQ ID NO: 146518 - protein, 10 aa, Artificial Sequence
  Description of Artificial Sequence: Synthetic peptide
  Seed: YEDIHGTLHL (PRAME_HUMAN)
YTDIHGTLHF

SEQ ID NO: 146519 - protein, 10 aa, Artificial Sequence
  Description of Artificial Sequence: Synthetic peptide
  Seed: ESYEDIHGTL (PRAME_HUMAN)
EMYEDIHGTK

SEQ ID NO: 146520 - protein, 10 aa, Artificial Sequence
  Description of Artificial Sequence: Synthetic peptide
  Seed: TFYDPEPILC (PRAME_HUMAN)
TFYDPEPILY

SEQ ID NO: 146521 - protein, 9 aa, Artificial Sequence
  Description of Artificial Sequence: Synthetic peptide
  Seed: KVDGLSTEA (PRAME_HUMAN)
KFDGLSTEF

SEQ ID NO: 146522 - protein, 9 aa, Artificial Sequence
  Description of Artificial Sequence: Synthetic peptide
  Seed: FPPLFMAAF (PRAME_HUMAN)
FPPLFMAAI

SEQ ID NO: 146523 - protein, 11 aa, Artificial Sequence
  Description of Artificial Sequence: Synthetic peptide
  Seed: ELFSYLIEKVK (PRAME_HUMAN)
ETFSYLIEKVK

SEQ ID NO: 146524 - protein, 9 aa, Artificial Sequence
  Description of Artificial Sequence: Synthetic peptide
  Seed: LMKGQHLHL (PRAME_HUMAN)
LSKGQHLHW

SEQ ID NO: 146525 - protein, 10 aa, Artificial Sequence
  Description of Artificial Sequence: Synthetic peptide
  Seed: AVLDGLDVLL (PRAME_HUMAN)
AVLDGLDVLF

SEQ ID NO: 146526 - protein, 9 aa, Artificial Sequence
  Description of Artificial Sequence: Synthetic peptide
  Seed: AAFDGRHSQ (PRAME_HUMAN)
ANFDGRHSY

SEQ ID NO: 146527 - protein, 9 aa, Artificial Sequence
  Description of Artificial Sequence: Synthetic peptide
  Seed: DEALAIAAL (PRAME_HUMAN)
DEALAIAAM

SEQ ID NO: 146528 - protein, 9 aa, Artificial Sequence
  Description of Artificial Sequence: Synthetic peptide
  Seed: ALLPSLSHC (PRAME_HUMAN)
AQLPSLSHL

SEQ ID NO: 146529 - protein, 9 aa, Artificial Sequence
  Description of Artificial Sequence: Synthetic peptide
  Seed: RTFYDPEPI (PRAME_HUMAN)
RHFYDPEPF

SEQ ID NO: 146530 - protein, 11 aa, Artificial Sequence
  Description of Artificial Sequence: Synthetic peptide
  Seed: DVSPEPLQALL (PRAME_HUMAN)
DVSPEPLQALK

SEQ ID NO: 146531 - protein, 9 aa, Artificial Sequence
  Description of Artificial Sequence: Synthetic peptide
  Seed: QPFIPVEVL (PRAME_HUMAN)
QAFIPVEVF

SEQ ID NO: 146532 - protein, 9 aa, Artificial Sequence
  Description of Artificial Sequence: Synthetic peptide
  Seed: QSRYISMSV (PRAME_HUMAN)
QTRYISMSG

SEQ ID NO: 146533 - protein, 10 aa, Artificial Sequence
  Description of Artificial Sequence: Synthetic peptide
  Seed: LLPRELFPPL (PRAME_HUMAN)
LWPRELFPPM

SEQ ID NO: 146534 - protein, 9 aa, Artificial Sequence
  Description of Artificial Sequence: Synthetic peptide
  Seed: ACDELFSYL (PRAME_HUMAN)
AQDELFSYY

SEQ ID NO: 146535 - protein, 9 aa, Artificial Sequence
  Description of Artificial Sequence: Synthetic peptide
  Seed: FYDPEPILC (PRAME_HUMAN)
FEDPEPILL

SEQ ID NO: 146536 - protein, 10 aa, Artificial Sequence
  Description of Artificial Sequence: Synthetic peptide
  Seed: KKLKIFAMPM (PRAME_HUMAN)
KRLKIFAMPF

SEQ ID NO: 146537 - protein, 9 aa, Artificial Sequence
  Description of Artificial Sequence: Synthetic peptide
  Seed: KMILKMVQL (PRAME_HUMAN)
KSILKMVQL

SEQ ID NO: 146538 - protein, 9 aa, Artificial Sequence
  Description of Artificial Sequence: Synthetic peptide
  Seed: RLAYLHARL (PRAME_HUMAN)
RGAYLHARY

SEQ ID NO: 146539 - protein, 10 aa, Artificial Sequence
  Description of Artificial Sequence: Synthetic peptide
  Seed: LLPRELFPPL (PRAME_HUMAN)
LWPRELFPPL

SEQ ID NO: 146540 - protein, 10 aa, Artificial Sequence
  Description of Artificial Sequence: Synthetic peptide
  Seed: TFYDPEPILC (PRAME_HUMAN)
TWYDPEPILM

SEQ ID NO: 146541 - protein, 11 aa, Artificial Sequence
  Description of Artificial Sequence: Synthetic peptide
  Seed: GTLHLERLAYL (PRAME_HUMAN)
GLLHLERLAYV

SEQ ID NO: 146542 - protein, 10 aa, Artificial Sequence
  Description of Artificial Sequence: Synthetic peptide
  Seed: LLLSHIHASS (PRAME_HUMAN)
LYLSHIHASI

SEQ ID NO: 146543 - protein, 9 aa, Artificial Sequence
  Description of Artificial Sequence: Synthetic peptide
  Seed: GITDDQLLA (PRAME_HUMAN)
GVTDDQLLV

SEQ ID NO: 146544 - protein, 10 aa, Artificial Sequence
  Description of Artificial Sequence: Synthetic peptide
  Seed: ESYEDIHGTL (PRAME_HUMAN)
ESYEDIHGTK

SEQ ID NO: 146545 - protein, 9 aa, Artificial Sequence
  Description of Artificial Sequence: Synthetic peptide
  Seed: VFDECGITD (PRAME_HUMAN)
VWDECGITC

SEQ ID NO: 146546 - protein, 9 aa, Artificial Sequence
  Description of Artificial Sequence: Synthetic peptide
  Seed: YGNSISISA (PRAME_HUMAN)
YVNSISISL

SEQ ID NO: 146547 - protein, 10 aa, Artificial Sequence
  Description of Artificial Sequence: Synthetic peptide
  Seed: LYVDSLFFLR (PRAME_HUMAN)
LGVDSLFFLR

SEQ ID NO: 146548 - protein, 10 aa, Artificial Sequence
  Description of Artificial Sequence: Synthetic peptide
  Seed: GACDELFSYL (PRAME_HUMAN)
GMCDELFSYT

SEQ ID NO: 146549 - protein, 9 aa, Artificial Sequence
  Description of Artificial Sequence: Synthetic peptide
  Seed: TLHLERLAY (PRAME_HUMAN)
TQHLERLAM

SEQ ID NO: 146550 - protein, 9 aa, Artificial Sequence
  Description of Artificial Sequence: Synthetic peptide
  Seed: DGRHSQTLK (PRAME_HUMAN)
DVRHSQTLR

SEQ ID NO: 146551 - protein, 10 aa, Artificial Sequence
  Description of Artificial Sequence: Synthetic peptide
  Seed: KDEALAIAAL (PRAME_HUMAN)
KLEALAIAAA

SEQ ID NO: 146552 - protein, 10 aa, Artificial Sequence
  Description of Artificial Sequence: Synthetic peptide
  Seed: GACDELFSYL (PRAME_HUMAN)
GICDELFSYI

SEQ ID NO: 146553 - protein, 9 aa, Artificial Sequence
  Description of Artificial Sequence: Synthetic peptide
  Seed: GRHSQTLKA (PRAME_HUMAN)
GRHSQTLKM

SEQ ID NO: 146554 - protein, 9 aa, Artificial Sequence
  Description of Artificial Sequence: Synthetic peptide
  Seed: IPVEVLVDL (PRAME_HUMAN)
IPVEVLVDA

SEQ ID NO: 146555 - protein, 11 aa, Artificial Sequence
  Description of Artificial Sequence: Synthetic peptide
  Seed: MKGQHLHLETF (PRAME_HUMAN)
MIGQHLHLETY

SEQ ID NO: 146556 - protein, 10 aa, Artificial Sequence
  Description of Artificial Sequence: Synthetic peptide
  Seed: YEDIHGTLHL (PRAME_HUMAN)
YFDIHGTLHL

SEQ ID NO: 146557 - protein, 9 aa, Artificial Sequence
  Description of Artificial Sequence: Synthetic peptide
  Seed: RGRLDQLLR (PRAME_HUMAN)
RTRLDQLLM

SEQ ID NO: 146558 - protein, 11 aa, Artificial Sequence
  Description of Artificial Sequence: Synthetic peptide
  Seed: KIFAMPMQDIK (PRAME_HUMAN)
KVFAMPMQDIK

SEQ ID NO: 146559 - protein, 10 aa, Artificial Sequence
  Description of Artificial Sequence: Synthetic peptide
  Seed: VLYPVPLESY (PRAME_HUMAN)
VVYPVPLESW

SEQ ID NO: 146560 - protein, 9 aa, Artificial Sequence
  Description of Artificial Sequence: Synthetic peptide
  Seed: KFSPYLGQM (PRAME_HUMAN)
KMSPYLGQF

SEQ ID NO: 146561 - protein, 9 aa, Artificial Sequence
  Description of Artificial Sequence: Synthetic peptide
  Seed: RTFYDPEPI (PRAME_HUMAN)
RVFYDPEPY

SEQ ID NO: 146562 - protein, 10 aa, Artificial Sequence
  Description of Artificial Sequence: Synthetic peptide
  Seed: ALYVDSLFFL (PRAME_HUMAN)
ASYVDSLFFR

SEQ ID NO: 146563 - protein, 11 aa, Artificial Sequence
  Description of Artificial Sequence: Synthetic peptide
  Seed: ELLPRELFPPL (PRAME_HUMAN)
EFLPRELFPPV

SEQ ID NO: 146564 - protein, 9 aa, Artificial Sequence
  Description of Artificial Sequence: Synthetic peptide
  Seed: KLKIFAMPM (PRAME_HUMAN)
KQKIFAMPA

SEQ ID NO: 146565 - protein, 10 aa, Artificial Sequence
  Description of Artificial Sequence: Synthetic peptide
  Seed: VLYPVPLESY (PRAME_HUMAN)
VAYPVPLESF

SEQ ID NO: 146566 - protein, 9 aa, Artificial Sequence
  Description of Artificial Sequence: Synthetic peptide
  Seed: TLKAMVQAW (PRAME_HUMAN)
TLKAMVQAF

SEQ ID NO: 146567 - protein, 9 aa, Artificial Sequence
  Description of Artificial Sequence: Synthetic peptide
  Seed: VQLDSIEDL (PRAME_HUMAN)
VMLDSIEDF

SEQ ID NO: 146568 - protein, 10 aa, Artificial Sequence
  Description of Artificial Sequence: Synthetic peptide
  Seed: RGRLDQLLRH (PRAME_HUMAN)
RMRLDQLLRI

SEQ ID NO: 146569 - protein, 10 aa, Artificial Sequence
  Description of Artificial Sequence: Synthetic peptide
  Seed: LLPRELFPPL (PRAME_HUMAN)
LSPRELFPPV

SEQ ID NO: 146570 - protein, 9 aa, Artificial Sequence
  Description of Artificial Sequence: Synthetic peptide
  Seed: TLHLERLAY (PRAME_HUMAN)
TAHLERLAY

SEQ ID NO: 146571 - protein, 10 aa, Artificial Sequence
  Description of Artificial Sequence: Synthetic peptide
  Seed: YLHARLRELL (PRAME_HUMAN)
YMHARLRELV

SEQ ID NO: 146572 - protein, 9 aa, Artificial Sequence
  Description of Artificial Sequence: Synthetic peptide
  Seed: LQSLLQHLI (PRAME_HUMAN)
LHSLLQHLL

SEQ ID NO: 146573 - protein, 9 aa, Artificial Sequence
  Description of Artificial Sequence: Synthetic peptide
  Seed: SRYISMSVW (PRAME_HUMAN)
SHYISMSVL

SEQ ID NO: 146574 - protein, 10 aa, Artificial Sequence
  Description of Artificial Sequence: Synthetic peptide
  Seed: TFYDPEPILC (PRAME_HUMAN)
TKYDPEPILF

SEQ ID NO: 146575 - protein, 9 aa, Artificial Sequence
  Description of Artificial Sequence: Synthetic peptide
  Seed: VSQLSVLSL (PRAME_HUMAN)
VEQLSVLSY

SEQ ID NO: 146576 - protein, 8 aa, Artificial Sequence
  Description of Artificial Sequence: Synthetic peptide
  Seed: FYDPEPIL (PRAME_HUMAN)
FSDPEPIL

SEQ ID NO: 146577 - protein, 11 aa, Artificial Sequence
  Description of Artificial Sequence: Synthetic peptide
  Seed: KAVLDGLDVLL (PRAME_HUMAN)
KQVLDGLDVLL

SEQ ID NO: 146578 - protein, 10 aa, Artificial Sequence
  Description of Artificial Sequence: Synthetic peptide
  Seed: FMAAFDGRHS (PRAME_HUMAN)
FIAAFDGRHL

SEQ ID NO: 146579 - protein, 10 aa, Artificial Sequence
  Description of Artificial Sequence: Synthetic peptide
  Seed: YIAQFTSQFL (PRAME_HUMAN)
YNAQFTSQFF

SEQ ID NO: 146580 - protein, 9 aa, Artificial Sequence
  Description of Artificial Sequence: Synthetic peptide
  Seed: GLSNLTHVL (PRAME_HUMAN)
GTSNLTHVW

SEQ ID NO: 146581 - protein, 10 aa, Artificial Sequence
  Description of Artificial Sequence: Synthetic peptide
  Seed: MPMQDIKMIL (PRAME_HUMAN)
MQMQDIKMIL

SEQ ID NO: 146582 - protein, 11 aa, Artificial Sequence
  Description of Artificial Sequence: Synthetic peptide
  Seed: SIQSRYISMSV (PRAME_HUMAN)
SWQSRYISMSK

SEQ ID NO: 146583 - protein, 9 aa, Artificial Sequence
  Description of Artificial Sequence: Synthetic peptide
  Seed: NLTHVLYPV (PRAME_HUMAN)
NTTHVLYPT

SEQ ID NO: 146584 - protein, 10 aa, Artificial Sequence
  Description of Artificial Sequence: Synthetic peptide
  Seed: AQFTSQFLSL (PRAME_HUMAN)
AEFTSQFLSI

SEQ ID NO: 146585 - protein, 10 aa, Artificial Sequence
  Description of Artificial Sequence: Synthetic peptide
  Seed: LSLQCLQALY (PRAME_HUMAN)
LKLQCLQALY

SEQ ID NO: 146586 - protein, 11 aa, Artificial Sequence
  Description of Artificial Sequence: Synthetic peptide
  Seed: WSGNRASLYSF (PRAME_HUMAN)
WTGNRASLYSW

SEQ ID NO: 146587 - protein, 9 aa, Artificial Sequence
  Description of Artificial Sequence: Synthetic peptide
  Seed: RELFPPLFM (PRAME_HUMAN)
RELFPPLFV

SEQ ID NO: 146588 - protein, 9 aa, Artificial Sequence
  Description of Artificial Sequence: Synthetic peptide
  Seed: YSFPEPEAA (PRAME_HUMAN)
YVFPEPEAF

SEQ ID NO: 146589 - protein, 9 aa, Artificial Sequence
  Description of Artificial Sequence: Synthetic peptide
  Seed: YVDSLFFLR (PRAME_HUMAN)
YADSLFFLY

SEQ ID NO: 146590 - protein, 9 aa, Artificial Sequence
  Description of Artificial Sequence: Synthetic peptide
  Seed: YVDSLFFLR (PRAME_HUMAN)
YIDSLFFLK

SEQ ID NO: 146591 - protein, 8 aa, Artificial Sequence
  Description of Artificial Sequence: Synthetic peptide
  Seed: AQFTSQFL (PRAME_HUMAN)
AQFTSQFY

SEQ ID NO: 146592 - protein, 9 aa, Artificial Sequence
  Description of Artificial Sequence: Synthetic peptide
  Seed: SFYGNSISI (PRAME_HUMAN)
SMYGNSISH

SEQ ID NO: 146593 - protein, 9 aa, Artificial Sequence
  Description of Artificial Sequence: Synthetic peptide
  Seed: MINLRRLLL (PRAME_HUMAN)
MTNLRRLLI

SEQ ID NO: 146594 - protein, 9 aa, Artificial Sequence
  Description of Artificial Sequence: Synthetic peptide
  Seed: FTCLPLGVL (PRAME_HUMAN)
FMCLPLGVL

SEQ ID NO: 146595 - protein, 10 aa, Artificial Sequence
  Description of Artificial Sequence: Synthetic peptide
  Seed: MPMQDIKMIL (PRAME_HUMAN)
MEMQDIKMIL

SEQ ID NO: 146596 - protein, 11 aa, Artificial Sequence
  Description of Artificial Sequence: Synthetic peptide
  Seed: RLAYLHARLRE (PRAME_HUMAN)
RSAYLHARLRR

SEQ ID NO: 146597 - protein, 10 aa, Artificial Sequence
  Description of Artificial Sequence: Synthetic peptide
  Seed: LLKDEALAIA (PRAME_HUMAN)
LMKDEALAII

SEQ ID NO: 146598 - protein, 9 aa, Artificial Sequence
  Description of Artificial Sequence: Synthetic peptide
  Seed: LQSLLQHLI (PRAME_HUMAN)
LHSLLQHLF

SEQ ID NO: 146599 - protein, 9 aa, Artificial Sequence
  Description of Artificial Sequence: Synthetic peptide
  Seed: LEVTCTWKL (PRAME_HUMAN)
LHVTCTWKL

SEQ ID NO: 146600 - protein, 10 aa, Artificial Sequence
  Description of Artificial Sequence: Synthetic peptide
  Seed: LPTLAKFSPY (PRAME_HUMAN)
LPTLAKFSPF

SEQ ID NO: 146601 - protein, 9 aa, Artificial Sequence
  Description of Artificial Sequence: Synthetic peptide
  Seed: MQDIKMILK (PRAME_HUMAN)
MLDIKMILY

SEQ ID NO: 146602 - protein, 10 aa, Artificial Sequence
  Description of Artificial Sequence: Synthetic peptide
  Seed: KIFAMPMQDI (PRAME_HUMAN)
KLFAMPMQDM

SEQ ID NO: 146603 - protein, 9 aa, Artificial Sequence
  Description of Artificial Sequence: Synthetic peptide
  Seed: QLLALLPSL (PRAME_HUMAN)
QMLALLPSY

SEQ ID NO: 146604 - protein, 9 aa, Artificial Sequence
  Description of Artificial Sequence: Synthetic peptide
  Seed: YISMSVWTS (PRAME_HUMAN)
YQSMSVWTA

SEQ ID NO: 146605 - protein, 10 aa, Artificial Sequence
  Description of Artificial Sequence: Synthetic peptide
  Seed: ALYVDSLFFL (PRAME_HUMAN)
AMYVDSLFFM

SEQ ID NO: 146606 - protein, 10 aa, Artificial Sequence
  Description of Artificial Sequence: Synthetic peptide
  Seed: QAWPFTCLPL (PRAME_HUMAN)
QGWPFTCLPF

SEQ ID NO: 146607 - protein, 9 aa, Artificial Sequence
  Description of Artificial Sequence: Synthetic peptide
  Seed: FSPYLGQMI (PRAME_HUMAN)
FTPYLGQML

SEQ ID NO: 146608 - protein, 10 aa, Artificial Sequence
  Description of Artificial Sequence: Synthetic peptide
  Seed: GACDELFSYL (PRAME_HUMAN)
GMCDELFSYI

SEQ ID NO: 146609 - protein, 9 aa, Artificial Sequence
  Description of Artificial Sequence: Synthetic peptide
  Seed: ISISALQSL (PRAME_HUMAN)
IPISALQSY

SEQ ID NO: 146610 - protein, 10 aa, Artificial Sequence
  Description of Artificial Sequence: Synthetic peptide
  Seed: VTCTWKLPTL (PRAME_HUMAN)
VTCTWKLPTV

SEQ ID NO: 146611 - protein, 10 aa, Artificial Sequence
  Description of Artificial Sequence: Synthetic peptide
  Seed: RLAYLHARLR (PRAME_HUMAN)
RLAYLHARLY

SEQ ID NO: 146612 - protein, 9 aa, Artificial Sequence
  Description of Artificial Sequence: Synthetic peptide
  Seed: SATLQDLVF (PRAME_HUMAN)
SMTLQDLVM

SEQ ID NO: 146613 - protein, 9 aa, Artificial Sequence
  Description of Artificial Sequence: Synthetic peptide
  Seed: LHLERLAYL (PRAME_HUMAN)
LYLERLAYF

SEQ ID NO: 146614 - protein, 9 aa, Artificial Sequence
  Description of Artificial Sequence: Synthetic peptide
  Seed: SHCSQLTTL (PRAME_HUMAN)
SACSQLTTY

SEQ ID NO: 146615 - protein, 9 aa, Artificial Sequence
  Description of Artificial Sequence: Synthetic peptide
  Seed: LPRELFPPL (PRAME_HUMAN)
LSRELFPPY

SEQ ID NO: 146616 - protein, 10 aa, Artificial Sequence
  Description of Artificial Sequence: Synthetic peptide
  Seed: FFLRGRLDQL (PRAME_HUMAN)
FYLRGRLDQL

SEQ ID NO: 146617 - protein, 9 aa, Artificial Sequence
  Description of Artificial Sequence: Synthetic peptide
  Seed: SALQSLLQH (PRAME_HUMAN)
SILQSLLQK

SEQ ID NO: 146618 - protein, 9 aa, Artificial Sequence
  Description of Artificial Sequence: Synthetic peptide
  Seed: TFYDPEPIL (PRAME_HUMAN)
TQYDPEPII

SEQ ID NO: 146619 - protein, 10 aa, Artificial Sequence
  Description of Artificial Sequence: Synthetic peptide
  Seed: AAFDGRHSQT (PRAME_HUMAN)
AQFDGRHSQM

SEQ ID NO: 146620 - protein, 10 aa, Artificial Sequence
  Description of Artificial Sequence: Synthetic peptide
  Seed: HCSQLTTLSF (PRAME_HUMAN)
HLSQLTTLSW

SEQ ID NO: 146621 - protein, 9 aa, Artificial Sequence
  Description of Artificial Sequence: Synthetic peptide
  Seed: YLGQMINLR (PRAME_HUMAN)
YTGQMINLR

SEQ ID NO: 146622 - protein, 10 aa, Artificial Sequence
  Description of Artificial Sequence: Synthetic peptide
  Seed: ELFSYLIEKV (PRAME_HUMAN)
ETFSYLIEKA

SEQ ID NO: 146623 - protein, 10 aa, Artificial Sequence
  Description of Artificial Sequence: Synthetic peptide
  Seed: VLYPVPLESY (PRAME_HUMAN)
VTYPVPLESY

SEQ ID NO: 146624 - protein, 9 aa, Artificial Sequence
  Description of Artificial Sequence: Synthetic peptide
  Seed: FLSLQCLQA (PRAME_HUMAN)
FISLQCLQL

SEQ ID NO: 146625 - protein, 10 aa, Artificial Sequence
  Description of Artificial Sequence: Synthetic peptide
  Seed: QLLRHVMNPL (PRAME_HUMAN)
QDLRHVMNPV

SEQ ID NO: 146626 - protein, 9 aa, Artificial Sequence
  Description of Artificial Sequence: Synthetic peptide
  Seed: KAMVQAWPF (PRAME_HUMAN)
KTMVQAWPW

SEQ ID NO: 146627 - protein, 9 aa, Artificial Sequence
  Description of Artificial Sequence: Synthetic peptide
  Seed: HVMNPLETL (PRAME_HUMAN)
HMMNPLETT

SEQ ID NO: 146628 - protein, 10 aa, Artificial Sequence
  Description of Artificial Sequence: Synthetic peptide
  Seed: LLPRELFPPL (PRAME_HUMAN)
LNPRELFPPL

SEQ ID NO: 146629 - protein, 9 aa, Artificial Sequence
  Description of Artificial Sequence: Synthetic peptide
  Seed: ISPEKEEQY (PRAME_HUMAN)
IMPEKEEQL

SEQ ID NO: 146630 - protein, 10 aa, Artificial Sequence
  Description of Artificial Sequence: Synthetic peptide
  Seed: ARLRELLCEL (PRAME_HUMAN)
AQLRELLCEI

SEQ ID NO: 146631 - protein, 9 aa, Artificial Sequence
  Description of Artificial Sequence: Synthetic peptide
  Seed: KLKIFAMPM (PRAME_HUMAN)
KVKIFAMPK

SEQ ID NO: 146632 - protein, 9 aa, Artificial Sequence
  Description of Artificial Sequence: Synthetic peptide
  Seed: KEGACDELF (PRAME_HUMAN)
KQGACDELL

SEQ ID NO: 146633 - protein, 9 aa, Artificial Sequence
  Description of Artificial Sequence: Synthetic peptide
  Seed: SYEDIHGTL (PRAME_HUMAN)
SAEDIHGTF

SEQ ID NO: 146634 - protein, 9 aa, Artificial Sequence
  Description of Artificial Sequence: Synthetic peptide
  Seed: SHCSQLTTL (PRAME_HUMAN)
SRCSQLTTY

SEQ ID NO: 146635 - protein, 9 aa, Artificial Sequence
  Description of Artificial Sequence: Synthetic peptide
  Seed: TSPRRLVEL (PRAME_HUMAN)
TAPRRLVEF

SEQ ID NO: 146636 - protein, 10 aa, Artificial Sequence
  Description of Artificial Sequence: Synthetic peptide
  Seed: AQFTSQFLSL (PRAME_HUMAN)
AEFTSQFLSL

SEQ ID NO: 146637 - protein, 9 aa, Artificial Sequence
  Description of Artificial Sequence: Synthetic peptide
  Seed: ISISALQSL (PRAME_HUMAN)
IIISALQSF

SEQ ID NO: 146638 - protein, 10 aa, Artificial Sequence
  Description of Artificial Sequence: Synthetic peptide
  Seed: YISPEKEEQY (PRAME_HUMAN)
YPSPEKEEQF

SEQ ID NO: 146639 - protein, 9 aa, Artificial Sequence
  Description of Artificial Sequence: Synthetic peptide
  Seed: RLRELLCEL (PRAME_HUMAN)
RIRELLCEI

SEQ ID NO: 146640 - protein, 10 aa, Artificial Sequence
  Description of Artificial Sequence: Synthetic peptide
  Seed: GLSNLTHVLY (PRAME_HUMAN)
GLSNLTHVLI

SEQ ID NO: 146641 - protein, 10 aa, Artificial Sequence
  Description of Artificial Sequence: Synthetic peptide
  Seed: SNLTHVLYPV (PRAME_HUMAN)
STLTHVLYPL

SEQ ID NO: 146642 - protein, 10 aa, Artificial Sequence
  Description of Artificial Sequence: Synthetic peptide
  Seed: VEVLVDLFLK (PRAME_HUMAN)
VMVLVDLFLR

SEQ ID NO: 146643 - protein, 9 aa, Artificial Sequence
  Description of Artificial Sequence: Synthetic peptide
  Seed: TSPRRLVEL (PRAME_HUMAN)
TAPRRLVEV

SEQ ID NO: 146644 - protein, 9 aa, Artificial Sequence
  Description of Artificial Sequence: Synthetic peptide
  Seed: LALLPSLSH (PRAME_HUMAN)
LMLLPSLSL

SEQ ID NO: 146645 - protein, 9 aa, Artificial Sequence
  Description of Artificial Sequence: Synthetic peptide
  Seed: AMVQAWPFT (PRAME_HUMAN)
ATVQAWPFV

SEQ ID NO: 146646 - protein, 10 aa, Artificial Sequence
  Description of Artificial Sequence: Synthetic peptide
  Seed: SNLTHVLYPV (PRAME_HUMAN)
SNLTHVLYPL

SEQ ID NO: 146647 - protein, 10 aa, Artificial Sequence
  Description of Artificial Sequence: Synthetic peptide
  Seed: EALAIAALEL (PRAME_HUMAN)
ETLAIAALEI

SEQ ID NO: 146648 - protein, 9 aa, Artificial Sequence
  Description of Artificial Sequence: Synthetic peptide
  Seed: GLSNLTHVL (PRAME_HUMAN)
GMSNLTHVA

SEQ ID NO: 146649 - protein, 9 aa, Artificial Sequence
  Description of Artificial Sequence: Synthetic peptide
  Seed: ISISALQSL (PRAME_HUMAN)
ISISALQSI

SEQ ID NO: 146650 - protein, 10 aa, Artificial Sequence
  Description of Artificial Sequence: Synthetic peptide
  Seed: LSFYGNSISI (PRAME_HUMAN)
LAFYGNSISL

SEQ ID NO: 146651 - protein, 9 aa, Artificial Sequence
  Description of Artificial Sequence: Synthetic peptide
  Seed: LAIAALELL (PRAME_HUMAN)
LLIAALELF

SEQ ID NO: 146652 - protein, 9 aa, Artificial Sequence
  Description of Artificial Sequence: Synthetic peptide
  Seed: AQFTSQFLS (PRAME_HUMAN)
AMFTSQFLL

SEQ ID NO: 146653 - protein, 10 aa, Artificial Sequence
  Description of Artificial Sequence: Synthetic peptide
  Seed: QAWPFTCLPL (PRAME_HUMAN)
QVWPFTCLPF

SEQ ID NO: 146654 - protein, 8 aa, Artificial Sequence
  Description of Artificial Sequence: Synthetic peptide
  Seed: FYGNSISI (PRAME_HUMAN)
FYGNSISY

SEQ ID NO: 146655 - protein, 9 aa, Artificial Sequence
  Description of Artificial Sequence: Synthetic peptide
  Seed: TDDQLLALL (PRAME_HUMAN)
TADQLLALM

SEQ ID NO: 146656 - protein, 10 aa, Artificial Sequence
  Description of Artificial Sequence: Synthetic peptide
  Seed: ETFKAVLDGL (PRAME_HUMAN)
EIFKAVLDGI

SEQ ID NO: 146657 - protein, 9 aa, Artificial Sequence
  Description of Artificial Sequence: Synthetic peptide
  Seed: IGLSNLTHV (PRAME_HUMAN)
ILLSNLTHA

SEQ ID NO: 146658 - protein, 9 aa, Artificial Sequence
  Description of Artificial Sequence: Synthetic peptide
  Seed: LETLSITNC (PRAME_HUMAN)
LETLSITNA

SEQ ID NO: 146659 - protein, 9 aa, Artificial Sequence
  Description of Artificial Sequence: Synthetic peptide
  Seed: LYPVPLESY (PRAME_HUMAN)
LWPVPLESM

SEQ ID NO: 146660 - protein, 11 aa, Artificial Sequence
  Description of Artificial Sequence: Synthetic peptide
  Seed: LIGLSNLTHVL (PRAME_HUMAN)
LFGLSNLTHVL

SEQ ID NO: 146661 - protein, 10 aa, Artificial Sequence
  Description of Artificial Sequence: Synthetic peptide
  Seed: RWKLQVLDLR (PRAME_HUMAN)
RIKLQVLDLR

SEQ ID NO: 146662 - protein, 10 aa, Artificial Sequence
  Description of Artificial Sequence: Synthetic peptide
  Seed: ITDDQLLALL (PRAME_HUMAN)
IIDDQLLALF

SEQ ID NO: 146663 - protein, 10 aa, Artificial Sequence
  Description of Artificial Sequence: Synthetic peptide
  Seed: ISMSVWTSPR (PRAME_HUMAN)
IMMSVWTSPR

SEQ ID NO: 146664 - protein, 9 aa, Artificial Sequence
  Description of Artificial Sequence: Synthetic peptide
  Seed: ALYVDSLFF (PRAME_HUMAN)
ARYVDSLFY

SEQ ID NO: 146665 - protein, 9 aa, Artificial Sequence
  Description of Artificial Sequence: Synthetic peptide
  Seed: SALQSLLQH (PRAME_HUMAN)
SSLQSLLQY

SEQ ID NO: 146666 - protein, 8 aa, Artificial Sequence
  Description of Artificial Sequence: Synthetic peptide
  Seed: MINLRRLL (PRAME_HUMAN)
MVNLRRLL

SEQ ID NO: 146667 - protein, 9 aa, Artificial Sequence
  Description of Artificial Sequence: Synthetic peptide
  Seed: YSFPEPEAA (PRAME_HUMAN)
YYFPEPEAI

SEQ ID NO: 146668 - protein, 9 aa, Artificial Sequence
  Description of Artificial Sequence: Synthetic peptide
  Seed: SVLSLSGVM (PRAME_HUMAN)
SELSLSGVF

SEQ ID NO: 146669 - protein, 9 aa, Artificial Sequence
  Description of Artificial Sequence: Synthetic peptide
  Seed: ITDDQLLAL (PRAME_HUMAN)
ILDDQLLAI

SEQ ID NO: 146670 - protein, 9 aa, Artificial Sequence
  Description of Artificial Sequence: Synthetic peptide
  Seed: VLYPVPLES (PRAME_HUMAN)
VQYPVPLEL

SEQ ID NO: 146671 - protein, 9 aa, Artificial Sequence
  Description of Artificial Sequence: Synthetic peptide
  Seed: HVMNPLETL (PRAME_HUMAN)
HAMNPLETM

SEQ ID NO: 146672 - protein, 10 aa, Artificial Sequence
  Description of Artificial Sequence: Synthetic peptide
  Seed: FFLRGRLDQL (PRAME_HUMAN)
FDLRGRLDQA

SEQ ID NO: 146673 - protein, 10 aa, Artificial Sequence
  Description of Artificial Sequence: Synthetic peptide
  Seed: ISMSVWTSPR (PRAME_HUMAN)
IGMSVWTSPR

SEQ ID NO: 146674 - protein, 9 aa, Artificial Sequence
  Description of Artificial Sequence: Synthetic peptide
  Seed: LGRPSMVWL (PRAME_HUMAN)
LTRPSMVWL

SEQ ID NO: 146675 - protein, 10 aa, Artificial Sequence
  Description of Artificial Sequence: Synthetic peptide
  Seed: RGRLDQLLRH (PRAME_HUMAN)
RARLDQLLRK

SEQ ID NO: 146676 - protein, 9 aa, Artificial Sequence
  Description of Artificial Sequence: Synthetic peptide
  Seed: RLLLSHIHA (PRAME_HUMAN)
RTLLSHIHV

SEQ ID NO: 146677 - protein, 9 aa, Artificial Sequence
  Description of Artificial Sequence: Synthetic peptide
  Seed: TLAKFSPYL (PRAME_HUMAN)
TYAKFSPYL

SEQ ID NO: 146678 - protein, 9 aa, Artificial Sequence
  Description of Artificial Sequence: Synthetic peptide
  Seed: RLDQLLRHV (PRAME_HUMAN)
RTDQLLRHM

SEQ ID NO: 146679 - protein, 9 aa, Artificial Sequence
  Description of Artificial Sequence: Synthetic peptide
  Seed: YIAQFTSQF (PRAME_HUMAN)
YGAQFTSQV

SEQ ID NO: 146680 - protein, 11 aa, Artificial Sequence
  Description of Artificial Sequence: Synthetic peptide
  Seed: LPTLAKFSPYL (PRAME_HUMAN)
LQTLAKFSPYI

SEQ ID NO: 146681 - protein, 9 aa, Artificial Sequence
  Description of Artificial Sequence: Synthetic peptide
  Seed: ACDELFSYL (PRAME_HUMAN)
ARDELFSYL

SEQ ID NO: 146682 - protein, 10 aa, Artificial Sequence
  Description of Artificial Sequence: Synthetic peptide
  Seed: ARLRELLCEL (PRAME_HUMAN)
AHLRELLCEV

SEQ ID NO: 146683 - protein, 10 aa, Artificial Sequence
  Description of Artificial Sequence: Synthetic peptide
  Seed: AQFTSQFLSL (PRAME_HUMAN)
ARFTSQFLSM

SEQ ID NO: 146684 - protein, 9 aa, Artificial Sequence
  Description of Artificial Sequence: Synthetic peptide
  Seed: HVMNPLETL (PRAME_HUMAN)
HSMNPLETF

SEQ ID NO: 146685 - protein, 11 aa, Artificial Sequence
  Description of Artificial Sequence: Synthetic peptide
  Seed: RPRRWKLQVLD (PRAME_HUMAN)
RPRRWKLQVLM

SEQ ID NO: 146686 - protein, 9 aa, Artificial Sequence
  Description of Artificial Sequence: Synthetic peptide
  Seed: SFYGNSISI (PRAME_HUMAN)
SMYGNSISW

SEQ ID NO: 146687 - protein, 10 aa, Artificial Sequence
  Description of Artificial Sequence: Synthetic peptide
  Seed: SALQSLLQHL (PRAME_HUMAN)
STLQSLLQHM

SEQ ID NO: 146688 - protein, 10 aa, Artificial Sequence
  Description of Artificial Sequence: Synthetic peptide
  Seed: AFDGRHSQTL (PRAME_HUMAN)
ATDGRHSQTF

SEQ ID NO: 146689 - protein, 9 aa, Artificial Sequence
  Description of Artificial Sequence: Synthetic peptide
  Seed: EQPFIPVEV (PRAME_HUMAN)
EEPFIPVEA

SEQ ID NO: 146690 - protein, 9 aa, Artificial Sequence
  Description of Artificial Sequence: Synthetic peptide
  Seed: VFDECGITD (PRAME_HUMAN)
VFDECGITI

SEQ ID NO: 146691 - protein, 10 aa, Artificial Sequence
  Description of Artificial Sequence: Synthetic peptide
  Seed: LSFYGNSISI (PRAME_HUMAN)
LDFYGNSISM

SEQ ID NO: 146692 - protein, 11 aa, Artificial Sequence
  Description of Artificial Sequence: Synthetic peptide
  Seed: SNLTHVLYPVP (PRAME_HUMAN)
SMLTHVLYPVK

SEQ ID NO: 146693 - protein, 10 aa, Artificial Sequence
  Description of Artificial Sequence: Synthetic peptide
  Seed: KKLKIFAMPM (PRAME_HUMAN)
KSLKIFAMPY

SEQ ID NO: 146694 - protein, 10 aa, Artificial Sequence
  Description of Artificial Sequence: Synthetic peptide
  Seed: LSVLSLSGVM (PRAME_HUMAN)
LFVLSLSGVY

SEQ ID NO: 146695 - protein, 9 aa, Artificial Sequence
  Description of Artificial Sequence: Synthetic peptide
  Seed: QSRYISMSV (PRAME_HUMAN)
QVRYISMSW

SEQ ID NO: 146696 - protein, 8 aa, Artificial Sequence
  Description of Artificial Sequence: Synthetic peptide
  Seed: YVDSLFFL (PRAME_HUMAN)
YSDSLFFL

SEQ ID NO: 146697 - protein, 10 aa, Artificial Sequence
  Description of Artificial Sequence: Synthetic peptide
  Seed: TFYDPEPILC (PRAME_HUMAN)
TYYDPEPILI

SEQ ID NO: 146698 - protein, 9 aa, Artificial Sequence
  Description of Artificial Sequence: Synthetic peptide
  Seed: TLHLERLAY (PRAME_HUMAN)
TKHLERLAF

SEQ ID NO: 146699 - protein, 9 aa, Artificial Sequence
  Description of Artificial Sequence: Synthetic peptide
  Seed: QMINLRRLL (PRAME_HUMAN)
QQINLRRLF

SEQ ID NO: 146700 - protein, 10 aa, Artificial Sequence
  Description of Artificial Sequence: Synthetic peptide
  Seed: ARLRELLCEL (PRAME_HUMAN)
ARLRELLCEV

SEQ ID NO: 146701 - protein, 11 aa, Artificial Sequence
  Description of Artificial Sequence: Synthetic peptide
  Seed: FLKEGACDELF (PRAME_HUMAN)
FLKEGACDELI

SEQ ID NO: 146702 - protein, 9 aa, Artificial Sequence
  Description of Artificial Sequence: Synthetic peptide
  Seed: VSQLSVLSL (PRAME_HUMAN)
VTQLSVLSM

SEQ ID NO: 146703 - protein, 10 aa, Artificial Sequence
  Description of Artificial Sequence: Synthetic peptide
  Seed: ALELLPRELF (PRAME_HUMAN)
AWELLPRELW

SEQ ID NO: 146704 - protein, 9 aa, Artificial Sequence
  Description of Artificial Sequence: Synthetic peptide
  Seed: EQPFIPVEV (PRAME_HUMAN)
EHPFIPVEM

SEQ ID NO: 146705 - protein, 11 aa, Artificial Sequence
  Description of Artificial Sequence: Synthetic peptide
  Seed: IGLSNLTHVLY (PRAME_HUMAN)
ISLSNLTHVLY

SEQ ID NO: 146706 - protein, 9 aa, Artificial Sequence
  Description of Artificial Sequence: Synthetic peptide
  Seed: ESYEDIHGT (PRAME_HUMAN)
ETYEDIHGT

SEQ ID NO: 146707 - protein, 10 aa, Artificial Sequence
  Description of Artificial Sequence: Synthetic peptide
  Seed: SQLTTLSFYG (PRAME_HUMAN)
SQLTTLSFYY

SEQ ID NO: 146708 - protein, 10 aa, Artificial Sequence
  Description of Artificial Sequence: Synthetic peptide
  Seed: TSQFLSLQCL (PRAME_HUMAN)
TFQFLSLQCY

SEQ ID NO: 146709 - protein, 10 aa, Artificial Sequence
  Description of Artificial Sequence: Synthetic peptide
  Seed: AYLHARLREL (PRAME_HUMAN)
AMLHARLREV

SEQ ID NO: 146710 - protein, 10 aa, Artificial Sequence
  Description of Artificial Sequence: Synthetic peptide
  Seed: SPSVSQLSVL (PRAME_HUMAN)
SASVSQLSVY

SEQ ID NO: 146711 - protein, 9 aa, Artificial Sequence
  Description of Artificial Sequence: Synthetic peptide
  Seed: CKKLKIFAM (PRAME_HUMAN)
CGKLKIFAM

SEQ ID NO: 146712 - protein, 8 aa, Artificial Sequence
  Description of Artificial Sequence: Synthetic peptide
  Seed: MPMQDIKM (PRAME_HUMAN)
MPMQDIKW

SEQ ID NO: 146713 - protein, 11 aa, Artificial Sequence
  Description of Artificial Sequence: Synthetic peptide
  Seed: RASATLQDLVF (PRAME_HUMAN)
RKSATLQDLVF

SEQ ID NO: 146714 - protein, 10 aa, Artificial Sequence
  Description of Artificial Sequence: Synthetic peptide
  Seed: CSQLTTLSFY (PRAME_HUMAN)
CWQLTTLSFF

SEQ ID NO: 146715 - protein, 9 aa, Artificial Sequence
  Description of Artificial Sequence: Synthetic peptide
  Seed: LLKDEALAI (PRAME_HUMAN)
LQKDEALAF

SEQ ID NO: 146716 - protein, 10 aa, Artificial Sequence
  Description of Artificial Sequence: Synthetic peptide
  Seed: KKLKIFAMPM (PRAME_HUMAN)
KVLKIFAMPL

SEQ ID NO: 146717 - protein, 9 aa, Artificial Sequence
  Description of Artificial Sequence: Synthetic peptide
  Seed: MHLSQSPSV (PRAME_HUMAN)
MSLSQSPSM

SEQ ID NO: 146718 - protein, 9 aa, Artificial Sequence
  Description of Artificial Sequence: Synthetic peptide
  Seed: QALYVDSLF (PRAME_HUMAN)
QLLYVDSLW

SEQ ID NO: 146719 - protein, 9 aa, Artificial Sequence
  Description of Artificial Sequence: Synthetic peptide
  Seed: LAIAALELL (PRAME_HUMAN)
LLIAALELL

SEQ ID NO: 146720 - protein, 9 aa, Artificial Sequence
  Description of Artificial Sequence: Synthetic peptide
  Seed: ISISALQSL (PRAME_HUMAN)
ITISALQSI

SEQ ID NO: 146721 - protein, 10 aa, Artificial Sequence
  Description of Artificial Sequence: Synthetic peptide
  Seed: VRPRRWKLQV (PRAME_HUMAN)
VMPRRWKLQL

SEQ ID NO: 146722 - protein, 9 aa, Artificial Sequence
  Description of Artificial Sequence: Synthetic peptide
  Seed: YLHARLREL (PRAME_HUMAN)
YYHARLREL

SEQ ID NO: 146723 - protein, 11 aa, Artificial Sequence
  Description of Artificial Sequence: Synthetic peptide
  Seed: QALYVDSLFFL (PRAME_HUMAN)
QQLYVDSLFFL

SEQ ID NO: 146724 - protein, 9 aa, Artificial Sequence
  Description of Artificial Sequence: Synthetic peptide
  Seed: DEALAIAAL (PRAME_HUMAN)
DMALAIAAF

SEQ ID NO: 146725 - protein, 9 aa, Artificial Sequence
  Description of Artificial Sequence: Synthetic peptide
  Seed: TCTWKLPTL (PRAME_HUMAN)
TATWKLPTY

SEQ ID NO: 146726 - protein, 10 aa, Artificial Sequence
  Description of Artificial Sequence: Synthetic peptide
  Seed: YISPEKEEQY (PRAME_HUMAN)
YVSPEKEEQY

SEQ ID NO: 146727 - protein, 9 aa, Artificial Sequence
  Description of Artificial Sequence: Synthetic peptide
  Seed: TLAKFSPYL (PRAME_HUMAN)
TWAKFSPYL

SEQ ID NO: 146728 - protein, 9 aa, Artificial Sequence
  Description of Artificial Sequence: Synthetic peptide
  Seed: DELFSYLIE (PRAME_HUMAN)
DELFSYLIF

SEQ ID NO: 146729 - protein, 10 aa, Artificial Sequence
  Description of Artificial Sequence: Synthetic peptide
  Seed: HCSQLTTLSF (PRAME_HUMAN)
HISQLTTLSY

SEQ ID NO: 146730 - protein, 10 aa, Artificial Sequence
  Description of Artificial Sequence: Synthetic peptide
  Seed: FTCLPLGVLM (PRAME_HUMAN)
FICLPLGVLV

SEQ ID NO: 146731 - protein, 10 aa, Artificial Sequence
  Description of Artificial Sequence: Synthetic peptide
  Seed: KIFAMPMQDI (PRAME_HUMAN)
KVFAMPMQDV

SEQ ID NO: 146732 - protein, 9 aa, Artificial Sequence
  Description of Artificial Sequence: Synthetic peptide
  Seed: RTFYDPEPI (PRAME_HUMAN)
RLFYDPEPI

SEQ ID NO: 146733 - protein, 10 aa, Artificial Sequence
  Description of Artificial Sequence: Synthetic peptide
  Seed: FLKEGACDEL (PRAME_HUMAN)
FLKEGACDEM

SEQ ID NO: 146734 - protein, 9 aa, Artificial Sequence
  Description of Artificial Sequence: Synthetic peptide
  Seed: LMKGQHLHL (PRAME_HUMAN)
LMKGQHLHY

SEQ ID NO: 146735 - protein, 9 aa, Artificial Sequence
  Description of Artificial Sequence: Synthetic peptide
  Seed: RGRLDQLLR (PRAME_HUMAN)
RVRLDQLLT

SEQ ID NO: 146736 - protein, 11 aa, Artificial Sequence
  Description of Artificial Sequence: Synthetic peptide
  Seed: SNLTHVLYPVP (PRAME_HUMAN)
SMLTHVLYPVW

SEQ ID NO: 146737 - protein, 9 aa, Artificial Sequence
  Description of Artificial Sequence: Synthetic peptide
  Seed: SFYGNSISI (PRAME_HUMAN)
SYYGNSISC

SEQ ID NO: 146738 - protein, 10 aa, Artificial Sequence
  Description of Artificial Sequence: Synthetic peptide
  Seed: TTLSFYGNSI (PRAME_HUMAN)
TWLSFYGNSV

SEQ ID NO: 146739 - protein, 9 aa, Artificial Sequence
  Description of Artificial Sequence: Synthetic peptide
  Seed: YIAQFTSQF (PRAME_HUMAN)
YKAQFTSQL

SEQ ID NO: 146740 - protein, 9 aa, Artificial Sequence
  Description of Artificial Sequence: Synthetic peptide
  Seed: IGLSNLTHV (PRAME_HUMAN)
IMLSNLTHI

SEQ ID NO: 146741 - protein, 8 aa, Artificial Sequence
  Description of Artificial Sequence: Synthetic peptide
  Seed: RELFPPLF (PRAME_HUMAN)
RELFPPLI

SEQ ID NO: 146742 - protein, 9 aa, Artificial Sequence
  Description of Artificial Sequence: Synthetic peptide
  Seed: RLCCKKLKI (PRAME_HUMAN)
RLCCKKLKY

SEQ ID NO: 146743 - protein, 11 aa, Artificial Sequence
  Description of Artificial Sequence: Synthetic peptide
  Seed: SLSGVMLTDVS (PRAME_HUMAN)
SLSGVMLTDVV

SEQ ID NO: 146744 - protein, 9 aa, Artificial Sequence
  Description of Artificial Sequence: Synthetic peptide
  Seed: CSQLTTLSF (PRAME_HUMAN)
CSQLTTLSW

SEQ ID NO: 146745 - protein, 9 aa, Artificial Sequence
  Description of Artificial Sequence: Synthetic peptide
  Seed: AAQPMTKKR (PRAME_HUMAN)
AMQPMTKKR

SEQ ID NO: 146746 - protein, 9 aa, Artificial Sequence
  Description of Artificial Sequence: Synthetic peptide
  Seed: EQPFIPVEV (PRAME_HUMAN)
ESPFIPVEV

SEQ ID NO: 146747 - protein, 10 aa, Artificial Sequence
  Description of Artificial Sequence: Synthetic peptide
  Seed: AVLDGLDVLL (PRAME_HUMAN)
AFLDGLDVLL

SEQ ID NO: 146748 - protein, 10 aa, Artificial Sequence
  Description of Artificial Sequence: Synthetic peptide
  Seed: ITDDQLLALL (PRAME_HUMAN)
IQDDQLLALY

SEQ ID NO: 146749 - protein, 10 aa, Artificial Sequence
  Description of Artificial Sequence: Synthetic peptide
  Seed: KAVLDGLDVL (PRAME_HUMAN)
KQVLDGLDVF

SEQ ID NO: 146750 - protein, 10 aa, Artificial Sequence
  Description of Artificial Sequence: Synthetic peptide
  Seed: ALYVDSLFFL (PRAME_HUMAN)
AMYVDSLFFC

SEQ ID NO: 146751 - protein, 9 aa, Artificial Sequence
  Description of Artificial Sequence: Synthetic peptide
  Seed: LSTEAEQPF (PRAME_HUMAN)
LPTEAEQPF

SEQ ID NO: 146752 - protein, 9 aa, Artificial Sequence
  Description of Artificial Sequence: Synthetic peptide
  Seed: SFPEPEAAQ (PRAME_HUMAN)
SYPEPEAAI

SEQ ID NO: 146753 - protein, 8 aa, Artificial Sequence
  Description of Artificial Sequence: Synthetic peptide
  Seed: YSFPEPEA (PRAME_HUMAN)
YGFPEPEL

SEQ ID NO: 146754 - protein, 9 aa, Artificial Sequence
  Description of Artificial Sequence: Synthetic peptide
  Seed: LTDVSPEPL (PRAME_HUMAN)
LSDVSPEPL

SEQ ID NO: 146755 - protein, 9 aa, Artificial Sequence
  Description of Artificial Sequence: Synthetic peptide
  Seed: CKKLKIFAM (PRAME_HUMAN)
CLKLKIFAL

SEQ ID NO: 146756 - protein, 9 aa, Artificial Sequence
  Description of Artificial Sequence: Synthetic peptide
  Seed: MVQAWPFTC (PRAME_HUMAN)
MLQAWPFTS

SEQ ID NO: 146757 - protein, 9 aa, Artificial Sequence
  Description of Artificial Sequence: Synthetic peptide
  Seed: ETLSITNCR (PRAME_HUMAN)
ETLSITNCY

SEQ ID NO: 146758 - protein, 9 aa, Artificial Sequence
  Description of Artificial Sequence: Synthetic peptide
  Seed: VELAGQSLL (PRAME_HUMAN)
VQLAGQSLV

SEQ ID NO: 146759 - protein, 9 aa, Artificial Sequence
  Description of Artificial Sequence: Synthetic peptide
  Seed: ACDELFSYL (PRAME_HUMAN)
AMDELFSYY

SEQ ID NO: 146760 - protein, 9 aa, Artificial Sequence
  Description of Artificial Sequence: Synthetic peptide
  Seed: YSFPEPEAA (PRAME_HUMAN)
YLFPEPEAF

SEQ ID NO: 146761 - protein, 11 aa, Artificial Sequence
  Description of Artificial Sequence: Synthetic peptide
  Seed: QALYVDSLFFL (PRAME_HUMAN)
QFLYVDSLFFA

SEQ ID NO: 146762 - protein, 10 aa, Artificial Sequence
  Description of Artificial Sequence: Synthetic peptide
  Seed: RGRLDQLLRH (PRAME_HUMAN)
RTRLDQLLRM

SEQ ID NO: 146763 - protein, 9 aa, Artificial Sequence
  Description of Artificial Sequence: Synthetic peptide
  Seed: SQLTTLSFY (PRAME_HUMAN)
SQLTTLSFK

SEQ ID NO: 146764 - protein, 10 aa, Artificial Sequence
  Description of Artificial Sequence: Synthetic peptide
  Seed: GACDELFSYL (PRAME_HUMAN)
GSCDELFSYW

SEQ ID NO: 146765 - protein, 9 aa, Artificial Sequence
  Description of Artificial Sequence: Synthetic peptide
  Seed: ELFSYLIEK (PRAME_HUMAN)
EIFSYLIER

SEQ ID NO: 146766 - protein, 11 aa, Artificial Sequence
  Description of Artificial Sequence: Synthetic peptide
  Seed: RLWGSIQSRYI (PRAME_HUMAN)
RTWGSIQSRYW

SEQ ID NO: 146767 - protein, 10 aa, Artificial Sequence
  Description of Artificial Sequence: Synthetic peptide
  Seed: SPYLGQMINL (PRAME_HUMAN)
SGYLGQMINF

SEQ ID NO: 146768 - protein, 9 aa, Artificial Sequence
  Description of Artificial Sequence: Synthetic peptide
  Seed: SHCSQLTTL (PRAME_HUMAN)
SACSQLTTF

SEQ ID NO: 146769 - protein, 8 aa, Artificial Sequence
  Description of Artificial Sequence: Synthetic peptide
  Seed: YEDIHGTL (PRAME_HUMAN)
YHDIHGTL

SEQ ID NO: 146770 - protein, 11 aa, Artificial Sequence
  Description of Artificial Sequence: Synthetic peptide
  Seed: IQSRYISMSVW (PRAME_HUMAN)
IQSRYISMSVY

SEQ ID NO: 146771 - protein, 9 aa, Artificial Sequence
  Description of Artificial Sequence: Synthetic peptide
  Seed: RLDQLLRHV (PRAME_HUMAN)
RSDQLLRHI

SEQ ID NO: 146772 - protein, 10 aa, Artificial Sequence
  Description of Artificial Sequence: Synthetic peptide
  Seed: ARLRELLCEL (PRAME_HUMAN)
AFLRELLCEV

SEQ ID NO: 146773 - protein, 9 aa, Artificial Sequence
  Description of Artificial Sequence: Synthetic peptide
  Seed: LQALYVDSL (PRAME_HUMAN)
LRALYVDSF

SEQ ID NO: 146774 - protein, 9 aa, Artificial Sequence
  Description of Artificial Sequence: Synthetic peptide
  Seed: YLHARLREL (PRAME_HUMAN)
YIHARLREA

SEQ ID NO: 146775 - protein, 9 aa, Artificial Sequence
  Description of Artificial Sequence: Synthetic peptide
  Seed: DEALAIAAL (PRAME_HUMAN)
DAALAIAAY

SEQ ID NO: 146776 - protein, 10 aa, Artificial Sequence
  Description of Artificial Sequence: Synthetic peptide
  Seed: RLWGSIQSRY (PRAME_HUMAN)
RLWGSIQSRW

SEQ ID NO: 146777 - protein, 9 aa, Artificial Sequence
  Description of Artificial Sequence: Synthetic peptide
  Seed: ITDDQLLAL (PRAME_HUMAN)
IEDDQLLAF

SEQ ID NO: 146778 - protein, 10 aa, Artificial Sequence
  Description of Artificial Sequence: Synthetic peptide
  Seed: RELFPPLFMA (PRAME_HUMAN)
RFLFPPLFMI

SEQ ID NO: 146779 - protein, 11 aa, Artificial Sequence
  Description of Artificial Sequence: Synthetic peptide
  Seed: LPTLAKFSPYL (PRAME_HUMAN)
LHTLAKFSPYI

SEQ ID NO: 146780 - protein, 10 aa, Artificial Sequence
  Description of Artificial Sequence: Synthetic peptide
  Seed: SGNRASLYSF (PRAME_HUMAN)
SKNRASLYSF

SEQ ID NO: 146781 - protein, 10 aa, Artificial Sequence
  Description of Artificial Sequence: Synthetic peptide
  Seed: SPYLGQMINL (PRAME_HUMAN)
SYYLGQMINL

SEQ ID NO: 146782 - protein, 9 aa, Artificial Sequence
  Description of Artificial Sequence: Synthetic peptide
  Seed: LPRELFPPL (PRAME_HUMAN)
LQRELFPPI

SEQ ID NO: 146783 - protein, 10 aa, Artificial Sequence
  Description of Artificial Sequence: Synthetic peptide
  Seed: SVSQLSVLSL (PRAME_HUMAN)
SASQLSVLSW

SEQ ID NO: 146784 - protein, 9 aa, Artificial Sequence
  Description of Artificial Sequence: Synthetic peptide
  Seed: VQAWPFTCL (PRAME_HUMAN)
VVAWPFTCI

SEQ ID NO: 146785 - protein, 9 aa, Artificial Sequence
  Description of Artificial Sequence: Synthetic peptide
  Seed: ITDDQLLAL (PRAME_HUMAN)
ICDDQLLAF

SEQ ID NO: 146786 - protein, 9 aa, Artificial Sequence
  Description of Artificial Sequence: Synthetic peptide
  Seed: KLKIFAMPM (PRAME_HUMAN)
KLKIFAMPA

SEQ ID NO: 146787 - protein, 10 aa, Artificial Sequence
  Description of Artificial Sequence: Synthetic peptide
  Seed: YEDIHGTLHL (PRAME_HUMAN)
YVDIHGTLHV

SEQ ID NO: 146788 - protein, 10 aa, Artificial Sequence
  Description of Artificial Sequence: Synthetic peptide
  Seed: CSQLTTLSFY (PRAME_HUMAN)
CSQLTTLSFW

SEQ ID NO: 146789 - protein, 10 aa, Artificial Sequence
  Description of Artificial Sequence: Synthetic peptide
  Seed: ERASATLQDL (PRAME_HUMAN)
EHASATLQDL

SEQ ID NO: 146790 - protein, 9 aa, Artificial Sequence
  Description of Artificial Sequence: Synthetic peptide
  Seed: SQSPSVSQL (PRAME_HUMAN)
SVSPSVSQM

SEQ ID NO: 146791 - protein, 9 aa, Artificial Sequence
  Description of Artificial Sequence: Synthetic peptide
  Seed: QPMTKKRKV (PRAME_HUMAN)
QMMTKKRKL

SEQ ID NO: 146792 - protein, 9 aa, Artificial Sequence
  Description of Artificial Sequence: Synthetic peptide
  Seed: TWKLPTLAK (PRAME_HUMAN)
TMKLPTLAR

SEQ ID NO: 146793 - protein, 9 aa, Artificial Sequence
  Description of Artificial Sequence: Synthetic peptide
  Seed: EAEQPFIPV (PRAME_HUMAN)
ETEQPFIPI

SEQ ID NO: 146794 - protein, 10 aa, Artificial Sequence
  Description of Artificial Sequence: Synthetic peptide
  Seed: SPRRLVELAG (PRAME_HUMAN)
SPRRLVELAM

SEQ ID NO: 146795 - protein, 9 aa, Artificial Sequence
  Description of Artificial Sequence: Synthetic peptide
  Seed: ITDDQLLAL (PRAME_HUMAN)
ITDDQLLAM

SEQ ID NO: 146796 - protein, 9 aa, Artificial Sequence
  Description of Artificial Sequence: Synthetic peptide
  Seed: KVDGLSTEA (PRAME_HUMAN)
KLDGLSTEV

SEQ ID NO: 146797 - protein, 11 aa, Artificial Sequence
  Description of Artificial Sequence: Synthetic peptide
  Seed: IAQFTSQFLSL (PRAME_HUMAN)
IYQFTSQFLSY

SEQ ID NO: 146798 - protein, 11 aa, Artificial Sequence
  Description of Artificial Sequence: Synthetic peptide
  Seed: SHCSQLTTLSF (PRAME_HUMAN)
STCSQLTTLSW

SEQ ID NO: 146799 - protein, 9 aa, Artificial Sequence
  Description of Artificial Sequence: Synthetic peptide
  Seed: KEEQYIAQF (PRAME_HUMAN)
KMEQYIAQY

SEQ ID NO: 146800 - protein, 9 aa, Artificial Sequence
  Description of Artificial Sequence: Synthetic peptide
  Seed: SVWTSPRRL (PRAME_HUMAN)
STWTSPRRF

SEQ ID NO: 146801 - protein, 8 aa, Artificial Sequence
  Description of Artificial Sequence: Synthetic peptide
  Seed: ITDDQLLA (PRAME_HUMAN)
IIDDQLLI

SEQ ID NO: 146802 - protein, 9 aa, Artificial Sequence
  Description of Artificial Sequence: Synthetic peptide
  Seed: YLHARLREL (PRAME_HUMAN)
YWHARLREI

SEQ ID NO: 146803 - protein, 10 aa, Artificial Sequence
  Description of Artificial Sequence: Synthetic peptide
  Seed: RLSEGDVMHL (PRAME_HUMAN)
RYSEGDVMHY

SEQ ID NO: 146804 - protein, 10 aa, Artificial Sequence
  Description of Artificial Sequence: Synthetic peptide
  Seed: VRPRRWKLQV (PRAME_HUMAN)
VWPRRWKLQL

SEQ ID NO: 146805 - protein, 9 aa, Artificial Sequence
  Description of Artificial Sequence: Synthetic peptide
  Seed: AMVQAWPFT (PRAME_HUMAN)
AIVQAWPFI

SEQ ID NO: 146806 - protein, 9 aa, Artificial Sequence
  Description of Artificial Sequence: Synthetic peptide
  Seed: RGRLDQLLR (PRAME_HUMAN)
RIRLDQLLL

SEQ ID NO: 146807 - protein, 9 aa, Artificial Sequence
  Description of Artificial Sequence: Synthetic peptide
  Seed: YSFPEPEAA (PRAME_HUMAN)
YRFPEPEAL

SEQ ID NO: 146808 - protein, 8 aa, Artificial Sequence
  Description of Artificial Sequence: Synthetic peptide
  Seed: LSFYGNSI (PRAME_HUMAN)
LQFYGNSV

SEQ ID NO: 146809 - protein, 9 aa, Artificial Sequence
  Description of Artificial Sequence: Synthetic peptide
  Seed: KLKIFAMPM (PRAME_HUMAN)
KMKIFAMPS

SEQ ID NO: 146810 - protein, 10 aa, Artificial Sequence
  Description of Artificial Sequence: Synthetic peptide
  Seed: KKLKIFAMPM (PRAME_HUMAN)
KRLKIFAMPA

SEQ ID NO: 146811 - protein, 9 aa, Artificial Sequence
  Description of Artificial Sequence: Synthetic peptide
  Seed: VLDGLDVLL (PRAME_HUMAN)
VCDGLDVLF

SEQ ID NO: 146812 - protein, 11 aa, Artificial Sequence
  Description of Artificial Sequence: Synthetic peptide
  Seed: LSLQCLQALYV (PRAME_HUMAN)
LFLQCLQALYV

SEQ ID NO: 146813 - protein, 8 aa, Artificial Sequence
  Description of Artificial Sequence: Synthetic peptide
  Seed: SQLTTLSF (PRAME_HUMAN)
SQLTTLSI

SEQ ID NO: 146814 - protein, 10 aa, Artificial Sequence
  Description of Artificial Sequence: Synthetic peptide
  Seed: LLSHIHASSY (PRAME_HUMAN)
LESHIHASSW

SEQ ID NO: 146815 - protein, 9 aa, Artificial Sequence
  Description of Artificial Sequence: Synthetic peptide
  Seed: ACDELFSYL (PRAME_HUMAN)
ATDELFSYI

SEQ ID NO: 146816 - protein, 10 aa, Artificial Sequence
  Description of Artificial Sequence: Synthetic peptide
  Seed: CLQALYVDSL (PRAME_HUMAN)
CMQALYVDSV

SEQ ID NO: 146817 - protein, 9 aa, Artificial Sequence
  Description of Artificial Sequence: Synthetic peptide
  Seed: HARLRELLC (PRAME_HUMAN)
HIRLRELLL

SEQ ID NO: 146818 - protein, 9 aa, Artificial Sequence
  Description of Artificial Sequence: Synthetic peptide
  Seed: RHSQTLKAM (PRAME_HUMAN)
RRSQTLKAL

SEQ ID NO: 146819 - protein, 10 aa, Artificial Sequence
  Description of Artificial Sequence: Synthetic peptide
  Seed: GRLDQLLRHV (PRAME_HUMAN)
GRLDQLLRHL

SEQ ID NO: 146820 - protein, 9 aa, Artificial Sequence
  Description of Artificial Sequence: Synthetic peptide
  Seed: ACDELFSYL (PRAME_HUMAN)
ALDELFSYV

SEQ ID NO: 146821 - protein, 9 aa, Artificial Sequence
  Description of Artificial Sequence: Synthetic peptide
  Seed: SATLQDLVF (PRAME_HUMAN)
SQTLQDLVI

SEQ ID NO: 146822 - protein, 9 aa, Artificial Sequence
  Description of Artificial Sequence: Synthetic peptide
  Seed: CSQLTTLSF (PRAME_HUMAN)
CKQLTTLSY

SEQ ID NO: 146823 - protein, 10 aa, Artificial Sequence
  Description of Artificial Sequence: Synthetic peptide
  Seed: GRPSMVWLSA (PRAME_HUMAN)
GRPSMVWLSF

SEQ ID NO: 146824 - protein, 9 aa, Artificial Sequence
  Description of Artificial Sequence: Synthetic peptide
  Seed: RWKLQVLDL (PRAME_HUMAN)
RSKLQVLDK

SEQ ID NO: 146825 - protein, 9 aa, Artificial Sequence
  Description of Artificial Sequence: Synthetic peptide
  Seed: HLETFKAVL (PRAME_HUMAN)
HFETFKAVL

SEQ ID NO: 146826 - protein, 10 aa, Artificial Sequence
  Description of Artificial Sequence: Synthetic peptide
  Seed: FMAAFDGRHS (PRAME_HUMAN)
FLAAFDGRHL

SEQ ID NO: 146827 - protein, 9 aa, Artificial Sequence
  Description of Artificial Sequence: Synthetic peptide
  Seed: LWGSIQSRY (PRAME_HUMAN)
LFGSIQSRY

SEQ ID NO: 146828 - protein, 11 aa, Artificial Sequence
  Description of Artificial Sequence: Synthetic peptide
  Seed: MKGQHLHLETF (PRAME_HUMAN)
MCGQHLHLETY

SEQ ID NO: 146829 - protein, 9 aa, Artificial Sequence
  Description of Artificial Sequence: Synthetic peptide
  Seed: RLWGSIQSR (PRAME_HUMAN)
RWWGSIQSK

SEQ ID NO: 146830 - protein, 9 aa, Artificial Sequence
  Description of Artificial Sequence: Synthetic peptide
  Seed: VLYPVPLES (PRAME_HUMAN)
VMYPVPLEL

SEQ ID NO: 146831 - protein, 9 aa, Artificial Sequence
  Description of Artificial Sequence: Synthetic peptide
  Seed: ELFPPLFMA (PRAME_HUMAN)
EMFPPLFML

SEQ ID NO: 146832 - protein, 10 aa, Artificial Sequence
  Description of Artificial Sequence: Synthetic peptide
  Seed: TFYDPEPILC (PRAME_HUMAN)
THYDPEPILF

SEQ ID NO: 146833 - protein, 9 aa, Artificial Sequence
  Description of Artificial Sequence: Synthetic peptide
  Seed: YGNSISISA (PRAME_HUMAN)
YSNSISISH

SEQ ID NO: 146834 - protein, 9 aa, Artificial Sequence
  Description of Artificial Sequence: Synthetic peptide
  Seed: LAIAALELL (PRAME_HUMAN)
LTIAALELV

SEQ ID NO: 146835 - protein, 11 aa, Artificial Sequence
  Description of Artificial Sequence: Synthetic peptide
  Seed: AAFDGRHSQTL (PRAME_HUMAN)
ARFDGRHSQTV

SEQ ID NO: 146836 - protein, 9 aa, Artificial Sequence
  Description of Artificial Sequence: Synthetic peptide
  Seed: LSLQCLQAL (PRAME_HUMAN)
LALQCLQAV

SEQ ID NO: 146837 - protein, 9 aa, Artificial Sequence
  Description of Artificial Sequence: Synthetic peptide
  Seed: LTDVSPEPL (PRAME_HUMAN)
LGDVSPEPV

SEQ ID NO: 146838 - protein, 9 aa, Artificial Sequence
  Description of Artificial Sequence: Synthetic peptide
  Seed: LPRELFPPL (PRAME_HUMAN)
LIRELFPPY

SEQ ID NO: 146839 - protein, 9 aa, Artificial Sequence
  Description of Artificial Sequence: Synthetic peptide
  Seed: LSLQCLQAL (PRAME_HUMAN)
LALQCLQAW

SEQ ID NO: 146840 - protein, 9 aa, Artificial Sequence
  Description of Artificial Sequence: Synthetic peptide
  Seed: SQSPSVSQL (PRAME_HUMAN)
SRSPSVSQF

SEQ ID NO: 146841 - protein, 11 aa, Artificial Sequence
  Description of Artificial Sequence: Synthetic peptide
  Seed: FSPYLGQMINL (PRAME_HUMAN)
FWPYLGQMINF

SEQ ID NO: 146842 - protein, 10 aa, Artificial Sequence
  Description of Artificial Sequence: Synthetic peptide
  Seed: RYISMSVWTS (PRAME_HUMAN)
RWISMSVWTF

SEQ ID NO: 146843 - protein, 10 aa, Artificial Sequence
  Description of Artificial Sequence: Synthetic peptide
  Seed: GQSLLKDEAL (PRAME_HUMAN)
GESLLKDEAL

SEQ ID NO: 146844 - protein, 9 aa, Artificial Sequence
  Description of Artificial Sequence: Synthetic peptide
  Seed: RELLCELGR (PRAME_HUMAN)
RALLCELGR

SEQ ID NO: 146845 - protein, 9 aa, Artificial Sequence
  Description of Artificial Sequence: Synthetic peptide
  Seed: SIQSRYISM (PRAME_HUMAN)
SHQSRYISM

SEQ ID NO: 146846 - protein, 9 aa, Artificial Sequence
  Description of Artificial Sequence: Synthetic peptide
  Seed: FLRGRLDQL (PRAME_HUMAN)
FIRGRLDQL

SEQ ID NO: 146847 - protein, 9 aa, Artificial Sequence
  Description of Artificial Sequence: Synthetic peptide
  Seed: SIEDLEVTC (PRAME_HUMAN)
STEDLEVTI

SEQ ID NO: 146848 - protein, 9 aa, Artificial Sequence
  Description of Artificial Sequence: Synthetic peptide
  Seed: GLSNLTHVL (PRAME_HUMAN)
GTSNLTHVI

SEQ ID NO: 146849 - protein, 9 aa, Artificial Sequence
  Description of Artificial Sequence: Synthetic peptide
  Seed: KEEQYIAQF (PRAME_HUMAN)
KEEQYIAQT

SEQ ID NO: 146850 - protein, 9 aa, Artificial Sequence
  Description of Artificial Sequence: Synthetic peptide
  Seed: VSPEPLQAL (PRAME_HUMAN)
VHPEPLQAY

SEQ ID NO: 146851 - protein, 9 aa, Artificial Sequence
  Description of Artificial Sequence: Synthetic peptide
  Seed: NSISISALQ (PRAME_HUMAN)
NAISISALR

SEQ ID NO: 146852 - protein, 10 aa, Artificial Sequence
  Description of Artificial Sequence: Synthetic peptide
  Seed: DQLLALLPSL (PRAME_HUMAN)
DTLLALLPSV

SEQ ID NO: 146853 - protein, 9 aa, Artificial Sequence
  Description of Artificial Sequence: Synthetic peptide
  Seed: FYDPEPILC (PRAME_HUMAN)
FMDPEPILC

SEQ ID NO: 146854 - protein, 9 aa, Artificial Sequence
  Description of Artificial Sequence: Synthetic peptide
  Seed: ACDELFSYL (PRAME_HUMAN)
AADELFSYL

SEQ ID NO: 146855 - protein, 9 aa, Artificial Sequence
  Description of Artificial Sequence: Synthetic peptide
  Seed: LSHIHASSY (PRAME_HUMAN)
LQHIHASSF

SEQ ID NO: 146856 - protein, 10 aa, Artificial Sequence
  Description of Artificial Sequence: Synthetic peptide
  Seed: LLPRELFPPL (PRAME_HUMAN)
LGPRELFPPF

SEQ ID NO: 146857 - protein, 9 aa, Artificial Sequence
  Description of Artificial Sequence: Synthetic peptide
  Seed: SQSPSVSQL (PRAME_HUMAN)
SESPSVSQM

SEQ ID NO: 146858 - protein, 11 aa, Artificial Sequence
  Description of Artificial Sequence: Synthetic peptide
  Seed: AAFDGRHSQTL (PRAME_HUMAN)
ASFDGRHSQTL

SEQ ID NO: 146859 - protein, 10 aa, Artificial Sequence
  Description of Artificial Sequence: Synthetic peptide
  Seed: GQHLHLETFK (PRAME_HUMAN)
GIHLHLETFR

SEQ ID NO: 146860 - protein, 10 aa, Artificial Sequence
  Description of Artificial Sequence: Synthetic peptide
  Seed: IQSRYISMSV (PRAME_HUMAN)
IISRYISMSA

SEQ ID NO: 146861 - protein, 9 aa, Artificial Sequence
  Description of Artificial Sequence: Synthetic peptide
  Seed: ELFSYLIEK (PRAME_HUMAN)
EHFSYLIER

SEQ ID NO: 146862 - protein, 9 aa, Artificial Sequence
  Description of Artificial Sequence: Synthetic peptide
  Seed: MPMQDIKMI (PRAME_HUMAN)
MMMQDIKMY

SEQ ID NO: 146863 - protein, 9 aa, Artificial Sequence
  Description of Artificial Sequence: Synthetic peptide
  Seed: FTCLPLGVL (PRAME_HUMAN)
FSCLPLGVL

SEQ ID NO: 146864 - protein, 9 aa, Artificial Sequence
  Description of Artificial Sequence: Synthetic peptide
  Seed: SMSVWTSPR (PRAME_HUMAN)
SSSVWTSPR

SEQ ID NO: 146865 - protein, 10 aa, Artificial Sequence
  Description of Artificial Sequence: Synthetic peptide
  Seed: GACDELFSYL (PRAME_HUMAN)
GLCDELFSYA

SEQ ID NO: 146866 - protein, 10 aa, Artificial Sequence
  Description of Artificial Sequence: Synthetic peptide
  Seed: KVKRKKNVLR (PRAME_HUMAN)
KTKRKKNVLM

SEQ ID NO: 146867 - protein, 10 aa, Artificial Sequence
  Description of Artificial Sequence: Synthetic peptide
  Seed: SPSVSQLSVL (PRAME_HUMAN)
SWSVSQLSVY

SEQ ID NO: 146868 - protein, 9 aa, Artificial Sequence
  Description of Artificial Sequence: Synthetic peptide
  Seed: LQHLIGLSN (PRAME_HUMAN)
LEHLIGLSY

SEQ ID NO: 146869 - protein, 10 aa, Artificial Sequence
  Description of Artificial Sequence: Synthetic peptide
  Seed: MLTDVSPEPL (PRAME_HUMAN)
MITDVSPEPL

SEQ ID NO: 146870 - protein, 10 aa, Artificial Sequence
  Description of Artificial Sequence: Synthetic peptide
  Seed: MVQAWPFTCL (PRAME_HUMAN)
MLQAWPFTCT

SEQ ID NO: 146871 - protein, 10 aa, Artificial Sequence
  Description of Artificial Sequence: Synthetic peptide
  Seed: KDEALAIAAL (PRAME_HUMAN)
KVEALAIAAA

SEQ ID NO: 146872 - protein, 9 aa, Artificial Sequence
  Description of Artificial Sequence: Synthetic peptide
  Seed: GQMINLRRL (PRAME_HUMAN)
GRMINLRRM

SEQ ID NO: 146873 - protein, 9 aa, Artificial Sequence
  Description of Artificial Sequence: Synthetic peptide
  Seed: SQLSVLSLS (PRAME_HUMAN)
STLSVLSLV

SEQ ID NO: 146874 - protein, 10 aa, Artificial Sequence
  Description of Artificial Sequence: Synthetic peptide
  Seed: ISISALQSLL (PRAME_HUMAN)
IFISALQSLL

SEQ ID NO: 146875 - protein, 9 aa, Artificial Sequence
  Description of Artificial Sequence: Synthetic peptide
  Seed: YIAQFTSQF (PRAME_HUMAN)
YQAQFTSQL

SEQ ID NO: 146876 - protein, 11 aa, Artificial Sequence
  Description of Artificial Sequence: Synthetic peptide
  Seed: YISMSVWTSPR (PRAME_HUMAN)
YKSMSVWTSPR

SEQ ID NO: 146877 - protein, 9 aa, Artificial Sequence
  Description of Artificial Sequence: Synthetic peptide
  Seed: ITDDQLLAL (PRAME_HUMAN)
IADDQLLAT

SEQ ID NO: 146878 - protein, 10 aa, Artificial Sequence
  Description of Artificial Sequence: Synthetic peptide
  Seed: RLSEGDVMHL (PRAME_HUMAN)
RMSEGDVMHI

SEQ ID NO: 146879 - protein, 9 aa, Artificial Sequence
  Description of Artificial Sequence: Synthetic peptide
  Seed: RRLLLSHIH (PRAME_HUMAN)
RRLLLSHIL

SEQ ID NO: 146880 - protein, 10 aa, Artificial Sequence
  Description of Artificial Sequence: Synthetic peptide
  Seed: KVKRKKNVLR (PRAME_HUMAN)
KYKRKKNVLK

SEQ ID NO: 146881 - protein, 11 aa, Artificial Sequence
  Description of Artificial Sequence: Synthetic peptide
  Seed: IEDLEVTCTWK (PRAME_HUMAN)
ITDLEVTCTWY

SEQ ID NO: 146882 - protein, 9 aa, Artificial Sequence
  Description of Artificial Sequence: Synthetic peptide
  Seed: LKMVQLDSI (PRAME_HUMAN)
LKMVQLDSF

SEQ ID NO: 146883 - protein, 10 aa, Artificial Sequence
  Description of Artificial Sequence: Synthetic peptide
  Seed: VSPEPLQALL (PRAME_HUMAN)
VMPEPLQALL

SEQ ID NO: 146884 - protein, 8 aa, Artificial Sequence
  Description of Artificial Sequence: Synthetic peptide
  Seed: HARLRELL (PRAME_HUMAN)
HVRLRELL

SEQ ID NO: 146885 - protein, 10 aa, Artificial Sequence
  Description of Artificial Sequence: Synthetic peptide
  Seed: YIAQFTSQFL (PRAME_HUMAN)
YLAQFTSQFT

SEQ ID NO: 146886 - protein, 9 aa, Artificial Sequence
  Description of Artificial Sequence: Synthetic peptide
  Seed: VELAGQSLL (PRAME_HUMAN)
VELAGQSLA

SEQ ID NO: 146887 - protein, 9 aa, Artificial Sequence
  Description of Artificial Sequence: Synthetic peptide
  Seed: TFYDPEPIL (PRAME_HUMAN)
TAYDPEPII

SEQ ID NO: 146888 - protein, 9 aa, Artificial Sequence
  Description of Artificial Sequence: Synthetic peptide
  Seed: TSPRRLVEL (PRAME_HUMAN)
TVPRRLVEY

SEQ ID NO: 146889 - protein, 10 aa, Artificial Sequence
  Description of Artificial Sequence: Synthetic peptide
  Seed: SNLTHVLYPV (PRAME_HUMAN)
SELTHVLYPI

SEQ ID NO: 146890 - protein, 10 aa, Artificial Sequence
  Description of Artificial Sequence: Synthetic peptide
  Seed: MPMQDIKMIL (PRAME_HUMAN)
MVMQDIKMIW

SEQ ID NO: 146891 - protein, 9 aa, Artificial Sequence
  Description of Artificial Sequence: Synthetic peptide
  Seed: VLDGLDVLL (PRAME_HUMAN)
VQDGLDVLF

SEQ ID NO: 146892 - protein, 9 aa, Artificial Sequence
  Description of Artificial Sequence: Synthetic peptide
  Seed: LLLSHIHAS (PRAME_HUMAN)
LQLSHIHAA

SEQ ID NO: 146893 - protein, 10 aa, Artificial Sequence
  Description of Artificial Sequence: Synthetic peptide
  Seed: ESYEDIHGTL (PRAME_HUMAN)
EQYEDIHGTR

SEQ ID NO: 146894 - protein, 10 aa, Artificial Sequence
  Description of Artificial Sequence: Synthetic peptide
  Seed: LLLSHIHASS (PRAME_HUMAN)
LLLSHIHASV

SEQ ID NO: 146895 - protein, 11 aa, Artificial Sequence
  Description of Artificial Sequence: Synthetic peptide
  Seed: LSNLTHVLYPV (PRAME_HUMAN)
LCNLTHVLYPV

SEQ ID NO: 146896 - protein, 9 aa, Artificial Sequence
  Description of Artificial Sequence: Synthetic peptide
  Seed: ITDDQLLAL (PRAME_HUMAN)
IMDDQLLAR

SEQ ID NO: 146897 - protein, 10 aa, Artificial Sequence
  Description of Artificial Sequence: Synthetic peptide
  Seed: VLMKGQHLHL (PRAME_HUMAN)
VVMKGQHLHW

SEQ ID NO: 146898 - protein, 10 aa, Artificial Sequence
  Description of Artificial Sequence: Synthetic peptide
  Seed: FTCLPLGVLM (PRAME_HUMAN)
FTCLPLGVLY

SEQ ID NO: 146899 - protein, 9 aa, Artificial Sequence
  Description of Artificial Sequence: Synthetic peptide
  Seed: LSTEAEQPF (PRAME_HUMAN)
LVTEAEQPW

SEQ ID NO: 146900 - protein, 9 aa, Artificial Sequence
  Description of Artificial Sequence: Synthetic peptide
  Seed: SIQSRYISM (PRAME_HUMAN)
SAQSRYISF

SEQ ID NO: 146901 - protein, 9 aa, Artificial Sequence
  Description of Artificial Sequence: Synthetic peptide
  Seed: FYDPEPILC (PRAME_HUMAN)
FLDPEPILC

SEQ ID NO: 146902 - protein, 9 aa, Artificial Sequence
  Description of Artificial Sequence: Synthetic peptide
  Seed: SYEDIHGTL (PRAME_HUMAN)
SSEDIHGTV

SEQ ID NO: 146903 - protein, 9 aa, Artificial Sequence
  Description of Artificial Sequence: Synthetic peptide
  Seed: SFYGNSISI (PRAME_HUMAN)
SWYGNSISW

SEQ ID NO: 146904 - protein, 9 aa, Artificial Sequence
  Description of Artificial Sequence: Synthetic peptide
  Seed: SYEDIHGTL (PRAME_HUMAN)
SHEDIHGTW

SEQ ID NO: 146905 - protein, 9 aa, Artificial Sequence
  Description of Artificial Sequence: Synthetic peptide
  Seed: VQAWPFTCL (PRAME_HUMAN)
VMAWPFTCF

SEQ ID NO: 146906 - protein, 9 aa, Artificial Sequence
  Description of Artificial Sequence: Synthetic peptide
  Seed: SMSVWTSPR (PRAME_HUMAN)
SFSVWTSPY

SEQ ID NO: 146907 - protein, 11 aa, Artificial Sequence
  Description of Artificial Sequence: Synthetic peptide
  Seed: ALYVDSLFFLR (PRAME_HUMAN)
AMYVDSLFFLF

SEQ ID NO: 146908 - protein, 10 aa, Artificial Sequence
  Description of Artificial Sequence: Synthetic peptide
  Seed: KKLKIFAMPM (PRAME_HUMAN)
KSLKIFAMPV

SEQ ID NO: 146909 - protein, 9 aa, Artificial Sequence
  Description of Artificial Sequence: Synthetic peptide
  Seed: LELLPRELF (PRAME_HUMAN)
LELLPRELL

SEQ ID NO: 146910 - protein, 9 aa, Artificial Sequence
  Description of Artificial Sequence: Synthetic peptide
  Seed: TFYDPEPIL (PRAME_HUMAN)
TYYDPEPIL

SEQ ID NO: 146911 - protein, 10 aa, Artificial Sequence
  Description of Artificial Sequence: Synthetic peptide
  Seed: HLERLAYLHA (PRAME_HUMAN)
HAERLAYLHK

SEQ ID NO: 146912 - protein, 10 aa, Artificial Sequence
  Description of Artificial Sequence: Synthetic peptide
  Seed: ISISALQSLL (PRAME_HUMAN)
ISISALQSLY

SEQ ID NO: 146913 - protein, 9 aa, Artificial Sequence
  Description of Artificial Sequence: Synthetic peptide
  Seed: AAFDGRHSQ (PRAME_HUMAN)
ATFDGRHSL

SEQ ID NO: 146914 - protein, 10 aa, Artificial Sequence
  Description of Artificial Sequence: Synthetic peptide
  Seed: LQALYVDSLF (PRAME_HUMAN)
LRALYVDSLW

SEQ ID NO: 146915 - protein, 9 aa, Artificial Sequence
  Description of Artificial Sequence: Synthetic peptide
  Seed: VSPEPLQAL (PRAME_HUMAN)
VWPEPLQAI

SEQ ID NO: 146916 - protein, 10 aa, Artificial Sequence
  Description of Artificial Sequence: Synthetic peptide
  Seed: SPSVSQLSVL (PRAME_HUMAN)
SPSVSQLSVF

SEQ ID NO: 146917 - protein, 10 aa, Artificial Sequence
  Description of Artificial Sequence: Synthetic peptide
  Seed: MERRRLWGSI (PRAME_HUMAN)
MGRRRLWGSM

SEQ ID NO: 146918 - protein, 9 aa, Artificial Sequence
  Description of Artificial Sequence: Synthetic peptide
  Seed: FDGRHSQTL (PRAME_HUMAN)
FEGRHSQTL

SEQ ID NO: 146919 - protein, 10 aa, Artificial Sequence
  Description of Artificial Sequence: Synthetic peptide
  Seed: MLTDVSPEPL (PRAME_HUMAN)
MQTDVSPEPV

SEQ ID NO: 146920 - protein, 8 aa, Artificial Sequence
  Description of Artificial Sequence: Synthetic peptide
  Seed: RLAYLHAR (PRAME_HUMAN)
RFAYLHAR

SEQ ID NO: 146921 - protein, 8 aa, Artificial Sequence
  Description of Artificial Sequence: Synthetic peptide
  Seed: SQLSVLSL (PRAME_HUMAN)
SQLSVLSI

SEQ ID NO: 146922 - protein, 9 aa, Artificial Sequence
  Description of Artificial Sequence: Synthetic peptide
  Seed: LQALYVDSL (PRAME_HUMAN)
LAALYVDSF

SEQ ID NO: 146923 - protein, 10 aa, Artificial Sequence
  Description of Artificial Sequence: Synthetic peptide
  Seed: MTKKRKVDGL (PRAME_HUMAN)
MMKKRKVDGM

SEQ ID NO: 146924 - protein, 9 aa, Artificial Sequence
  Description of Artificial Sequence: Synthetic peptide
  Seed: LVELAGQSL (PRAME_HUMAN)
LAELAGQSY

SEQ ID NO: 146925 - protein, 11 aa, Artificial Sequence
  Description of Artificial Sequence: Synthetic peptide
  Seed: PRELFPPLFMA (PRAME_HUMAN)
PFELFPPLFMV

SEQ ID NO: 146926 - protein, 10 aa, Artificial Sequence
  Description of Artificial Sequence: Synthetic peptide
  Seed: MVQAWPFTCL (PRAME_HUMAN)
MEQAWPFTCV

SEQ ID NO: 146927 - protein, 9 aa, Artificial Sequence
  Description of Artificial Sequence: Synthetic peptide
  Seed: SIEDLEVTC (PRAME_HUMAN)
SIEDLEVTF

SEQ ID NO: 146928 - protein, 9 aa, Artificial Sequence
  Description of Artificial Sequence: Synthetic peptide
  Seed: RGRLDQLLR (PRAME_HUMAN)
RVRLDQLLK

SEQ ID NO: 146929 - protein, 10 aa, Artificial Sequence
  Description of Artificial Sequence: Synthetic peptide
  Seed: SLLQHLIGLS (PRAME_HUMAN)
SMLQHLIGLA

SEQ ID NO: 146930 - protein, 10 aa, Artificial Sequence
  Description of Artificial Sequence: Synthetic peptide
  Seed: ARLRELLCEL (PRAME_HUMAN)
ADLRELLCEI

SEQ ID NO: 146931 - protein, 10 aa, Artificial Sequence
  Description of Artificial Sequence: Synthetic peptide
  Seed: HLERLAYLHA (PRAME_HUMAN)
HMERLAYLHK

SEQ ID NO: 146932 - protein, 9 aa, Artificial Sequence
  Description of Artificial Sequence: Synthetic peptide
  Seed: SQLTTLSFY (PRAME_HUMAN)
SVLTTLSFF

SEQ ID NO: 146933 - protein, 10 aa, Artificial Sequence
  Description of Artificial Sequence: Synthetic peptide
  Seed: ALYVDSLFFL (PRAME_HUMAN)
AQYVDSLFFL

SEQ ID NO: 146934 - protein, 9 aa, Artificial Sequence
  Description of Artificial Sequence: Synthetic peptide
  Seed: LSEGDVMHL (PRAME_HUMAN)
LVEGDVMHM

SEQ ID NO: 146935 - protein, 9 aa, Artificial Sequence
  Description of Artificial Sequence: Synthetic peptide
  Seed: VLMKGQHLH (PRAME_HUMAN)
VGMKGQHLY

SEQ ID NO: 146936 - protein, 9 aa, Artificial Sequence
  Description of Artificial Sequence: Synthetic peptide
  Seed: VSPEPLQAL (PRAME_HUMAN)
VVPEPLQAV

SEQ ID NO: 146937 - protein, 10 aa, Artificial Sequence
  Description of Artificial Sequence: Synthetic peptide
  Seed: AMVQAWPFTC (PRAME_HUMAN)
ANVQAWPFTV

SEQ ID NO: 146938 - protein, 9 aa, Artificial Sequence
  Description of Artificial Sequence: Synthetic peptide
  Seed: RTFYDPEPI (PRAME_HUMAN)
RIFYDPEPL

SEQ ID NO: 146939 - protein, 10 aa, Artificial Sequence
  Description of Artificial Sequence: Synthetic peptide
  Seed: SISISALQSL (PRAME_HUMAN)
SPSISALQSW

SEQ ID NO: 146940 - protein, 9 aa, Artificial Sequence
  Description of Artificial Sequence: Synthetic peptide
  Seed: KLKIFAMPM (PRAME_HUMAN)
KSKIFAMPH

SEQ ID NO: 146941 - protein, 9 aa, Artificial Sequence
  Description of Artificial Sequence: Synthetic peptide
  Seed: RASATLQDL (PRAME_HUMAN)
RQSATLQDV

SEQ ID NO: 146942 - protein, 10 aa, Artificial Sequence
  Description of Artificial Sequence: Synthetic peptide
  Seed: YEDIHGTLHL (PRAME_HUMAN)
YMDIHGTLHF

SEQ ID NO: 146943 - protein, 9 aa, Artificial Sequence
  Description of Artificial Sequence: Synthetic peptide
  Seed: FYDPEPILC (PRAME_HUMAN)
FSDPEPILI

SEQ ID NO: 146944 - protein, 10 aa, Artificial Sequence
  Description of Artificial Sequence: Synthetic peptide
  Seed: ITDDQLLALL (PRAME_HUMAN)
IVDDQLLALM

SEQ ID NO: 146945 - protein, 9 aa, Artificial Sequence
  Description of Artificial Sequence: Synthetic peptide
  Seed: RASATLQDL (PRAME_HUMAN)
RVSATLQDY

SEQ ID NO: 146946 - protein, 9 aa, Artificial Sequence
  Description of Artificial Sequence: Synthetic peptide
  Seed: YLHARLREL (PRAME_HUMAN)
YVHARLREY

SEQ ID NO: 146947 - protein, 9 aa, Artificial Sequence
  Description of Artificial Sequence: Synthetic peptide
  Seed: SQSPSVSQL (PRAME_HUMAN)
SYSPSVSQV

SEQ ID NO: 146948 - protein, 9 aa, Artificial Sequence
  Description of Artificial Sequence: Synthetic peptide
  Seed: VSPEPLQAL (PRAME_HUMAN)
VRPEPLQAY

SEQ ID NO: 146949 - protein, 10 aa, Artificial Sequence
  Description of Artificial Sequence: Synthetic peptide
  Seed: YVDSLFFLRG (PRAME_HUMAN)
YSDSLFFLRR

SEQ ID NO: 146950 - protein, 10 aa, Artificial Sequence
  Description of Artificial Sequence: Synthetic peptide
  Seed: MLTDVSPEPL (PRAME_HUMAN)
MLTDVSPEPV

SEQ ID NO: 146951 - protein, 9 aa, Artificial Sequence
  Description of Artificial Sequence: Synthetic peptide
  Seed: NSISISALQ (PRAME_HUMAN)
NCISISALK

SEQ ID NO: 146952 - protein, 9 aa, Artificial Sequence
  Description of Artificial Sequence: Synthetic peptide
  Seed: ISPEKEEQY (PRAME_HUMAN)
IQPEKEEQM

SEQ ID NO: 146953 - protein, 11 aa, Artificial Sequence
  Description of Artificial Sequence: Synthetic peptide
  Seed: LQSLLQHLIGL (PRAME_HUMAN)
LQSLLQHLIGV

SEQ ID NO: 146954 - protein, 9 aa, Artificial Sequence
  Description of Artificial Sequence: Synthetic peptide
  Seed: MVQAWPFTC (PRAME_HUMAN)
MMQAWPFTL

SEQ ID NO: 146955 - protein, 10 aa, Artificial Sequence
  Description of Artificial Sequence: Synthetic peptide
  Seed: AYLHARLREL (PRAME_HUMAN)
AILHARLREV

SEQ ID NO: 146956 - protein, 9 aa, Artificial Sequence
  Description of Artificial Sequence: Synthetic peptide
  Seed: ESYEDIHGT (PRAME_HUMAN)
EVYEDIHGL

SEQ ID NO: 146957 - protein, 10 aa, Artificial Sequence
  Description of Artificial Sequence: Synthetic peptide
  Seed: SISISALQSL (PRAME_HUMAN)
SSSISALQSW

SEQ ID NO: 146958 - protein, 10 aa, Artificial Sequence
  Description of Artificial Sequence: Synthetic peptide
  Seed: MSVWTSPRRL (PRAME_HUMAN)
MSVWTSPRRM

SEQ ID NO: 146959 - protein, 9 aa, Artificial Sequence
  Description of Artificial Sequence: Synthetic peptide
  Seed: KFSPYLGQM (PRAME_HUMAN)
KSSPYLGQF

SEQ ID NO: 146960 - protein, 9 aa, Artificial Sequence
  Description of Artificial Sequence: Synthetic peptide
  Seed: TLAKFSPYL (PRAME_HUMAN)
TLAKFSPYY

SEQ ID NO: 146961 - protein, 9 aa, Artificial Sequence
  Description of Artificial Sequence: Synthetic peptide
  Seed: VSPEPLQAL (PRAME_HUMAN)
VIPEPLQAF

SEQ ID NO: 146962 - protein, 9 aa, Artificial Sequence
  Description of Artificial Sequence: Synthetic peptide
  Seed: SHCSQLTTL (PRAME_HUMAN)
SQCSQLTTF

SEQ ID NO: 146963 - protein, 11 aa, Artificial Sequence
  Description of Artificial Sequence: Synthetic peptide
  Seed: ELFSYLIEKVK (PRAME_HUMAN)
EIFSYLIEKVR

SEQ ID NO: 146964 - protein, 9 aa, Artificial Sequence
  Description of Artificial Sequence: Synthetic peptide
  Seed: CKKLKIFAM (PRAME_HUMAN)
CGKLKIFAL

SEQ ID NO: 146965 - protein, 10 aa, Artificial Sequence
  Description of Artificial Sequence: Synthetic peptide
  Seed: SNLTHVLYPV (PRAME_HUMAN)
SCLTHVLYPV

SEQ ID NO: 146966 - protein, 9 aa, Artificial Sequence
  Description of Artificial Sequence: Synthetic peptide
  Seed: SISALQSLL (PRAME_HUMAN)
STSALQSLA

SEQ ID NO: 146967 - protein, 9 aa, Artificial Sequence
  Description of Artificial Sequence: Synthetic peptide
  Seed: QPFIPVEVL (PRAME_HUMAN)
QMFIPVEVY

SEQ ID NO: 146968 - protein, 9 aa, Artificial Sequence
  Description of Artificial Sequence: Synthetic peptide
  Seed: TSPRRLVEL (PRAME_HUMAN)
TRPRRLVEF

SEQ ID NO: 146969 - protein, 10 aa, Artificial Sequence
  Description of Artificial Sequence: Synthetic peptide
  Seed: IQSRYISMSV (PRAME_HUMAN)
IASRYISMSK

SEQ ID NO: 146970 - protein, 9 aa, Artificial Sequence
  Description of Artificial Sequence: Synthetic peptide
  Seed: ALLPSLSHC (PRAME_HUMAN)
AQLPSLSHI

SEQ ID NO: 146971 - protein, 9 aa, Artificial Sequence
  Description of Artificial Sequence: Synthetic peptide
  Seed: VSPEPLQAL (PRAME_HUMAN)
VIPEPLQAK

SEQ ID NO: 146972 - protein, 10 aa, Artificial Sequence
  Description of Artificial Sequence: Synthetic peptide
  Seed: KIFAMPMQDI (PRAME_HUMAN)
KLFAMPMQDF

SEQ ID NO: 146973 - protein, 10 aa, Artificial Sequence
  Description of Artificial Sequence: Synthetic peptide
  Seed: TLAKFSPYLG (PRAME_HUMAN)
TMAKFSPYLV

SEQ ID NO: 146974 - protein, 8 aa, Artificial Sequence
  Description of Artificial Sequence: Synthetic peptide
  Seed: LELLPREL (PRAME_HUMAN)
LELLPREI

SEQ ID NO: 146975 - protein, 9 aa, Artificial Sequence
  Description of Artificial Sequence: Synthetic peptide
  Seed: ALQSLLQHL (PRAME_HUMAN)
ALQSLLQHW

SEQ ID NO: 146976 - protein, 10 aa, Artificial Sequence
  Description of Artificial Sequence: Synthetic peptide
  Seed: ALYVDSLFFL (PRAME_HUMAN)
AGYVDSLFFL

SEQ ID NO: 146977 - protein, 11 aa, Artificial Sequence
  Description of Artificial Sequence: Synthetic peptide
  Seed: TDVSPEPLQAL (PRAME_HUMAN)
TEVSPEPLQAL

SEQ ID NO: 146978 - protein, 10 aa, Artificial Sequence
  Description of Artificial Sequence: Synthetic peptide
  Seed: MLTDVSPEPL (PRAME_HUMAN)
MATDVSPEPY

SEQ ID NO: 146979 - protein, 10 aa, Artificial Sequence
  Description of Artificial Sequence: Synthetic peptide
  Seed: LLLSHIHASS (PRAME_HUMAN)
LILSHIHASI

SEQ ID NO: 146980 - protein, 10 aa, Artificial Sequence
  Description of Artificial Sequence: Synthetic peptide
  Seed: RGRLDQLLRH (PRAME_HUMAN)
RWRLDQLLRL

SEQ ID NO: 146981 - protein, 10 aa, Artificial Sequence
  Description of Artificial Sequence: Synthetic peptide
  Seed: FYDPEPILCP (PRAME_HUMAN)
FFDPEPILCM

SEQ ID NO: 146982 - protein, 9 aa, Artificial Sequence
  Description of Artificial Sequence: Synthetic peptide
  Seed: SLLQHLIGL (PRAME_HUMAN)
SRLQHLIGY

SEQ ID NO: 146983 - protein, 9 aa, Artificial Sequence
  Description of Artificial Sequence: Synthetic peptide
  Seed: RRLWGSIQS (PRAME_HUMAN)
RRLWGSIQK

SEQ ID NO: 146984 - protein, 9 aa, Artificial Sequence
  Description of Artificial Sequence: Synthetic peptide
  Seed: TLAKFSPYL (PRAME_HUMAN)
TSAKFSPYY

SEQ ID NO: 146985 - protein, 8 aa, Artificial Sequence
  Description of Artificial Sequence: Synthetic peptide
  Seed: FSYLIEKV (PRAME_HUMAN)
FQYLIEKI

SEQ ID NO: 146986 - protein, 9 aa, Artificial Sequence
  Description of Artificial Sequence: Synthetic peptide
  Seed: ALQSLLQHL (PRAME_HUMAN)
AIQSLLQHW

SEQ ID NO: 146987 - protein, 9 aa, Artificial Sequence
  Description of Artificial Sequence: Synthetic peptide
  Seed: ELFPPLFMA (PRAME_HUMAN)
EGFPPLFMV

SEQ ID NO: 146988 - protein, 10 aa, Artificial Sequence
  Description of Artificial Sequence: Synthetic peptide
  Seed: ELFPPLFMAA (PRAME_HUMAN)
EMFPPLFMAV

SEQ ID NO: 146989 - protein, 10 aa, Artificial Sequence
  Description of Artificial Sequence: Synthetic peptide
  Seed: QYIAQFTSQF (PRAME_HUMAN)
QQIAQFTSQF

SEQ ID NO: 146990 - protein, 9 aa, Artificial Sequence
  Description of Artificial Sequence: Synthetic peptide
  Seed: SALQSLLQH (PRAME_HUMAN)
SSLQSLLQR

SEQ ID NO: 146991 - protein, 10 aa, Artificial Sequence
  Description of Artificial Sequence: Synthetic peptide
  Seed: WPFTCLPLGV (PRAME_HUMAN)
WPFTCLPLGM

SEQ ID NO: 146992 - protein, 10 aa, Artificial Sequence
  Description of Artificial Sequence: Synthetic peptide
  Seed: LLPRELFPPL (PRAME_HUMAN)
LAPRELFPPF

SEQ ID NO: 146993 - protein, 10 aa, Artificial Sequence
  Description of Artificial Sequence: Synthetic peptide
  Seed: RHVMNPLETL (PRAME_HUMAN)
RMVMNPLETI

SEQ ID NO: 146994 - protein, 9 aa, Artificial Sequence
  Description of Artificial Sequence: Synthetic peptide
  Seed: TDDQLLALL (PRAME_HUMAN)
TADQLLALV

SEQ ID NO: 146995 - protein, 9 aa, Artificial Sequence
  Description of Artificial Sequence: Synthetic peptide
  Seed: ELFSYLIEK (PRAME_HUMAN)
EQFSYLIER

SEQ ID NO: 146996 - protein, 9 aa, Artificial Sequence
  Description of Artificial Sequence: Synthetic peptide
  Seed: LFMAAFDGR (PRAME_HUMAN)
LYMAAFDGR

SEQ ID NO: 146997 - protein, 9 aa, Artificial Sequence
  Description of Artificial Sequence: Synthetic peptide
  Seed: RELFPPLFM (PRAME_HUMAN)
RQLFPPLFV

SEQ ID NO: 146998 - protein, 10 aa, Artificial Sequence
  Description of Artificial Sequence: Synthetic peptide
  Seed: ALYVDSLFFL (PRAME_HUMAN)
ARYVDSLFFW

SEQ ID NO: 146999 - protein, 9 aa, Artificial Sequence
  Description of Artificial Sequence: Synthetic peptide
  Seed: SYEDIHGTL (PRAME_HUMAN)
SSEDIHGTL

SEQ ID NO: 147000 - protein, 9 aa, Artificial Sequence
  Description of Artificial Sequence: Synthetic peptide
  Seed: ALLERASAT (PRAME_HUMAN)
ATLERASAV

SEQ ID NO: 147001 - protein, 10 aa, Artificial Sequence
  Description of Artificial Sequence: Synthetic peptide
  Seed: DQLLALLPSL (PRAME_HUMAN)
DMLLALLPSI

SEQ ID NO: 147002 - protein, 9 aa, Artificial Sequence
  Description of Artificial Sequence: Synthetic peptide
  Seed: AAFDGRHSQ (PRAME_HUMAN)
ATFDGRHSF

SEQ ID NO: 147003 - protein, 10 aa, Artificial Sequence
  Description of Artificial Sequence: Synthetic peptide
  Seed: VLMKGQHLHL (PRAME_HUMAN)
VTMKGQHLHR

SEQ ID NO: 147004 - protein, 9 aa, Artificial Sequence
  Description of Artificial Sequence: Synthetic peptide
  Seed: SIQSRYISM (PRAME_HUMAN)
SPQSRYISA

SEQ ID NO: 147005 - protein, 9 aa, Artificial Sequence
  Description of Artificial Sequence: Synthetic peptide
  Seed: LLRHVMNPL (PRAME_HUMAN)
LHRHVMNPF

SEQ ID NO: 147006 - protein, 11 aa, Artificial Sequence
  Description of Artificial Sequence: Synthetic peptide
  Seed: QALYVDSLFFL (PRAME_HUMAN)
QGLYVDSLFFV

SEQ ID NO: 147007 - protein, 9 aa, Artificial Sequence
  Description of Artificial Sequence: Synthetic peptide
  Seed: YVDSLFFLR (PRAME_HUMAN)
YVDSLFFLK

SEQ ID NO: 147008 - protein, 10 aa, Artificial Sequence
  Description of Artificial Sequence: Synthetic peptide
  Seed: RLSEGDVMHL (PRAME_HUMAN)
RQSEGDVMHI

SEQ ID NO: 147009 - protein, 10 aa, Artificial Sequence
  Description of Artificial Sequence: Synthetic peptide
  Seed: TFYDPEPILC (PRAME_HUMAN)
TWYDPEPILY

SEQ ID NO: 147010 - protein, 9 aa, Artificial Sequence
  Description of Artificial Sequence: Synthetic peptide
  Seed: ISISALQSL (PRAME_HUMAN)
IKISALQSL

SEQ ID NO: 147011 - protein, 10 aa, Artificial Sequence
  Description of Artificial Sequence: Synthetic peptide
  Seed: TVWSGNRASL (PRAME_HUMAN)
TAWSGNRASY

SEQ ID NO: 147012 - protein, 10 aa, Artificial Sequence
  Description of Artificial Sequence: Synthetic peptide
  Seed: ALLERASATL (PRAME_HUMAN)
AQLERASATV

SEQ ID NO: 147013 - protein, 11 aa, Artificial Sequence
  Description of Artificial Sequence: Synthetic peptide
  Seed: CRLSEGDVMHL (PRAME_HUMAN)
CHLSEGDVMHI

SEQ ID NO: 147014 - protein, 9 aa, Artificial Sequence
  Description of Artificial Sequence: Synthetic peptide
  Seed: LPLGVLMKG (PRAME_HUMAN)
LPLGVLMKA

SEQ ID NO: 147015 - protein, 10 aa, Artificial Sequence
  Description of Artificial Sequence: Synthetic peptide
  Seed: AVLDGLDVLL (PRAME_HUMAN)
ALLDGLDVLW

SEQ ID NO: 147016 - protein, 8 aa, Artificial Sequence
  Description of Artificial Sequence: Synthetic peptide
  Seed: VSPEPLQA (PRAME_HUMAN)
VAPEPLQL

SEQ ID NO: 147017 - protein, 11 aa, Artificial Sequence
  Description of Artificial Sequence: Synthetic peptide
  Seed: TVWSGNRASLY (PRAME_HUMAN)
TQWSGNRASLF

SEQ ID NO: 147018 - protein, 9 aa, Artificial Sequence
  Description of Artificial Sequence: Synthetic peptide
  Seed: KLQVLDLRK (PRAME_HUMAN)
KTQVLDLRR

SEQ ID NO: 147019 - protein, 9 aa, Artificial Sequence
  Description of Artificial Sequence: Synthetic peptide
  Seed: QMINLRRLL (PRAME_HUMAN)
QVINLRRLW

SEQ ID NO: 147020 - protein, 10 aa, Artificial Sequence
  Description of Artificial Sequence: Synthetic peptide
  Seed: LERLAYLHAR (PRAME_HUMAN)
LYRLAYLHAK

SEQ ID NO: 147021 - protein, 9 aa, Artificial Sequence
  Description of Artificial Sequence: Synthetic peptide
  Seed: ALYVDSLFF (PRAME_HUMAN)
AQYVDSLFL

SEQ ID NO: 147022 - protein, 9 aa, Artificial Sequence
  Description of Artificial Sequence: Synthetic peptide
  Seed: RLWGSIQSR (PRAME_HUMAN)
RQWGSIQSL

SEQ ID NO: 147023 - protein, 10 aa, Artificial Sequence
  Description of Artificial Sequence: Synthetic peptide
  Seed: LKAMVQAWPF (PRAME_HUMAN)
LAAMVQAWPF

SEQ ID NO: 147024 - protein, 10 aa, Artificial Sequence
  Description of Artificial Sequence: Synthetic peptide
  Seed: LLPRELFPPL (PRAME_HUMAN)
LIPRELFPPI

SEQ ID NO: 147025 - protein, 10 aa, Artificial Sequence
  Description of Artificial Sequence: Synthetic peptide
  Seed: VLYPVPLESY (PRAME_HUMAN)
VFYPVPLESF

SEQ ID NO: 147026 - protein, 10 aa, Artificial Sequence
  Description of Artificial Sequence: Synthetic peptide
  Seed: AAFDGRHSQT (PRAME_HUMAN)
AQFDGRHSQY

SEQ ID NO: 147027 - protein, 9 aa, Artificial Sequence
  Description of Artificial Sequence: Synthetic peptide
  Seed: RRWKLQVLD (PRAME_HUMAN)
RKWKLQVLL

SEQ ID NO: 147028 - protein, 10 aa, Artificial Sequence
  Description of Artificial Sequence: Synthetic peptide
  Seed: RLVELAGQSL (PRAME_HUMAN)
RMVELAGQSV

SEQ ID NO: 147029 - protein, 10 aa, Artificial Sequence
  Description of Artificial Sequence: Synthetic peptide
  Seed: LKAMVQAWPF (PRAME_HUMAN)
LMAMVQAWPY

SEQ ID NO: 147030 - protein, 9 aa, Artificial Sequence
  Description of Artificial Sequence: Synthetic peptide
  Seed: EVRPRRWKL (PRAME_HUMAN)
EMRPRRWKI

SEQ ID NO: 147031 - protein, 10 aa, Artificial Sequence
  Description of Artificial Sequence: Synthetic peptide
  Seed: DIHGTLHLER (PRAME_HUMAN)
DIHGTLHLEK

SEQ ID NO: 147032 - protein, 9 aa, Artificial Sequence
  Description of Artificial Sequence: Synthetic peptide
  Seed: ALYVDSLFF (PRAME_HUMAN)
ASYVDSLFL

SEQ ID NO: 147033 - protein, 10 aa, Artificial Sequence
  Description of Artificial Sequence: Synthetic peptide
  Seed: GQHLHLETFK (PRAME_HUMAN)
GLHLHLETFK

SEQ ID NO: 147034 - protein, 10 aa, Artificial Sequence
  Description of Artificial Sequence: Synthetic peptide
  Seed: LQALYVDSLF (PRAME_HUMAN)
LAALYVDSLF

SEQ ID NO: 147035 - protein, 8 aa, Artificial Sequence
  Description of Artificial Sequence: Synthetic peptide
  Seed: FSYLIEKV (PRAME_HUMAN)
FAYLIEKL

SEQ ID NO: 147036 - protein, 9 aa, Artificial Sequence
  Description of Artificial Sequence: Synthetic peptide
  Seed: HARLRELLC (PRAME_HUMAN)
HPRLRELLM

SEQ ID NO: 147037 - protein, 9 aa, Artificial Sequence
  Description of Artificial Sequence: Synthetic peptide
  Seed: MVQAWPFTC (PRAME_HUMAN)
MTQAWPFTV

SEQ ID NO: 147038 - protein, 10 aa, Artificial Sequence
  Description of Artificial Sequence: Synthetic peptide
  Seed: FFLRGRLDQL (PRAME_HUMAN)
FRLRGRLDQL

SEQ ID NO: 147039 - protein, 9 aa, Artificial Sequence
  Description of Artificial Sequence: Synthetic peptide
  Seed: RLAYLHARL (PRAME_HUMAN)
RIAYLHARW

SEQ ID NO: 147040 - protein, 8 aa, Artificial Sequence
  Description of Artificial Sequence: Synthetic peptide
  Seed: IQSRYISM (PRAME_HUMAN)
IQSRYISY

SEQ ID NO: 147041 - protein, 9 aa, Artificial Sequence
  Description of Artificial Sequence: Synthetic peptide
  Seed: KEEQYIAQF (PRAME_HUMAN)
KEEQYIAQY

SEQ ID NO: 147042 - protein, 10 aa, Artificial Sequence
  Description of Artificial Sequence: Synthetic peptide
  Seed: EDLEVTCTWK (PRAME_HUMAN)
ETLEVTCTWR

SEQ ID NO: 147043 - protein, 9 aa, Artificial Sequence
  Description of Artificial Sequence: Synthetic peptide
  Seed: ALQSLLQHL (PRAME_HUMAN)
AQQSLLQHY

SEQ ID NO: 147044 - protein, 11 aa, Artificial Sequence
  Description of Artificial Sequence: Synthetic peptide
  Seed: HLSQSPSVSQL (PRAME_HUMAN)
HQSQSPSVSQW

SEQ ID NO: 147045 - protein, 9 aa, Artificial Sequence
  Description of Artificial Sequence: Synthetic peptide
  Seed: SPSVSQLSV (PRAME_HUMAN)
SASVSQLSL

SEQ ID NO: 147046 - protein, 9 aa, Artificial Sequence
  Description of Artificial Sequence: Synthetic peptide
  Seed: EVLVDLFLK (PRAME_HUMAN)
ESLVDLFLR

SEQ ID NO: 147047 - protein, 8 aa, Artificial Sequence
  Description of Artificial Sequence: Synthetic peptide
  Seed: KKLKIFAM (PRAME_HUMAN)
KQLKIFAF

SEQ ID NO: 147048 - protein, 10 aa, Artificial Sequence
  Description of Artificial Sequence: Synthetic peptide
  Seed: LSVLSLSGVM (PRAME_HUMAN)
LVVLSLSGVY

SEQ ID NO: 147049 - protein, 9 aa, Artificial Sequence
  Description of Artificial Sequence: Synthetic peptide
  Seed: IAALELLPR (PRAME_HUMAN)
IAALELLPK

SEQ ID NO: 147050 - protein, 10 aa, Artificial Sequence
  Description of Artificial Sequence: Synthetic peptide
  Seed: GLSNLTHVLY (PRAME_HUMAN)
GMSNLTHVLI

SEQ ID NO: 147051 - protein, 9 aa, Artificial Sequence
  Description of Artificial Sequence: Synthetic peptide
  Seed: FPEPEAAQP (PRAME_HUMAN)
FPEPEAAQI

SEQ ID NO: 147052 - protein, 9 aa, Artificial Sequence
  Description of Artificial Sequence: Synthetic peptide
  Seed: RLRELLCEL (PRAME_HUMAN)
RVRELLCEW

SEQ ID NO: 147053 - protein, 9 aa, Artificial Sequence
  Description of Artificial Sequence: Synthetic peptide
  Seed: WSGNRASLY (PRAME_HUMAN)
WAGNRASLF

SEQ ID NO: 147054 - protein, 10 aa, Artificial Sequence
  Description of Artificial Sequence: Synthetic peptide
  Seed: LLSHIHASSY (PRAME_HUMAN)
LDSHIHASSY

SEQ ID NO: 147055 - protein, 10 aa, Artificial Sequence
  Description of Artificial Sequence: Synthetic peptide
  Seed: IQSRYISMSV (PRAME_HUMAN)
IVSRYISMSK

SEQ ID NO: 147056 - protein, 10 aa, Artificial Sequence
  Description of Artificial Sequence: Synthetic peptide
  Seed: TSQFLSLQCL (PRAME_HUMAN)
TRQFLSLQCY

SEQ ID NO: 147057 - protein, 10 aa, Artificial Sequence
  Description of Artificial Sequence: Synthetic peptide
  Seed: ETLSITNCRL (PRAME_HUMAN)
EALSITNCRV

SEQ ID NO: 147058 - protein, 10 aa, Artificial Sequence
  Description of Artificial Sequence: Synthetic peptide
  Seed: IKMILKMVQL (PRAME_HUMAN)
INMILKMVQV

SEQ ID NO: 147059 - protein, 10 aa, Artificial Sequence
  Description of Artificial Sequence: Synthetic peptide
  Seed: DQLLALLPSL (PRAME_HUMAN)
DALLALLPSI

SEQ ID NO: 147060 - protein, 9 aa, Artificial Sequence
  Description of Artificial Sequence: Synthetic peptide
  Seed: LELLPRELF (PRAME_HUMAN)
LKLLPRELF

SEQ ID NO: 147061 - protein, 11 aa, Artificial Sequence
  Description of Artificial Sequence: Synthetic peptide
  Seed: QALYVDSLFFL (PRAME_HUMAN)
QYLYVDSLFFL

SEQ ID NO: 147062 - protein, 9 aa, Artificial Sequence
  Description of Artificial Sequence: Synthetic peptide
  Seed: SVLSLSGVM (PRAME_HUMAN)
SNLSLSGVF

SEQ ID NO: 147063 - protein, 10 aa, Artificial Sequence
  Description of Artificial Sequence: Synthetic peptide
  Seed: AVLDGLDVLL (PRAME_HUMAN)
AILDGLDVLI

SEQ ID NO: 147064 - protein, 10 aa, Artificial Sequence
  Description of Artificial Sequence: Synthetic peptide
  Seed: SALQSLLQHL (PRAME_HUMAN)
STLQSLLQHF

SEQ ID NO: 147065 - protein, 10 aa, Artificial Sequence
  Description of Artificial Sequence: Synthetic peptide
  Seed: VLYPVPLESY (PRAME_HUMAN)
VFYPVPLESM

SEQ ID NO: 147066 - protein, 10 aa, Artificial Sequence
  Description of Artificial Sequence: Synthetic peptide
  Seed: CTWKLPTLAK (PRAME_HUMAN)
CMWKLPTLAK

SEQ ID NO: 147067 - protein, 9 aa, Artificial Sequence
  Description of Artificial Sequence: Synthetic peptide
  Seed: RLDQLLRHV (PRAME_HUMAN)
RIDQLLRHI

SEQ ID NO: 147068 - protein, 10 aa, Artificial Sequence
  Description of Artificial Sequence: Synthetic peptide
  Seed: LSVLSLSGVM (PRAME_HUMAN)
LMVLSLSGVM

SEQ ID NO: 147069 - protein, 11 aa, Artificial Sequence
  Description of Artificial Sequence: Synthetic peptide
  Seed: SIEDLEVTCTW (PRAME_HUMAN)
SEEDLEVTCTW

SEQ ID NO: 147070 - protein, 9 aa, Artificial Sequence
  Description of Artificial Sequence: Synthetic peptide
  Seed: YEDIHGTLH (PRAME_HUMAN)
YTDIHGTLY

SEQ ID NO: 147071 - protein, 9 aa, Artificial Sequence
  Description of Artificial Sequence: Synthetic peptide
  Seed: GLSNLTHVL (PRAME_HUMAN)
GMSNLTHVR

SEQ ID NO: 147072 - protein, 10 aa, Artificial Sequence
  Description of Artificial Sequence: Synthetic peptide
  Seed: ESYEDIHGTL (PRAME_HUMAN)
EMYEDIHGTY

SEQ ID NO: 147073 - protein, 10 aa, Artificial Sequence
  Description of Artificial Sequence: Synthetic peptide
  Seed: RLSEGDVMHL (PRAME_HUMAN)
RTSEGDVMHF

SEQ ID NO: 147074 - protein, 9 aa, Artificial Sequence
  Description of Artificial Sequence: Synthetic peptide
  Seed: AAFDGRHSQ (PRAME_HUMAN)
ATFDGRHSI

SEQ ID NO: 147075 - protein, 9 aa, Artificial Sequence
  Description of Artificial Sequence: Synthetic peptide
  Seed: FPPLFMAAF (PRAME_HUMAN)
FTPLFMAAM

SEQ ID NO: 147076 - protein, 9 aa, Artificial Sequence
  Description of Artificial Sequence: Synthetic peptide
  Seed: SFYGNSISI (PRAME_HUMAN)
SYYGNSIST

SEQ ID NO: 147077 - protein, 9 aa, Artificial Sequence
  Description of Artificial Sequence: Synthetic peptide
  Seed: YLIEKVKRK (PRAME_HUMAN)
YMIEKVKRV

SEQ ID NO: 147078 - protein, 9 aa, Artificial Sequence
  Description of Artificial Sequence: Synthetic peptide
  Seed: YVDSLFFLR (PRAME_HUMAN)
YLDSLFFLR

SEQ ID NO: 147079 - protein, 9 aa, Artificial Sequence
  Description of Artificial Sequence: Synthetic peptide
  Seed: LLRHVMNPL (PRAME_HUMAN)
LQRHVMNPL

SEQ ID NO: 147080 - protein, 9 aa, Artificial Sequence
  Description of Artificial Sequence: Synthetic peptide
  Seed: LRKNSHQDF (PRAME_HUMAN)
LQKNSHQDF

SEQ ID NO: 147081 - protein, 11 aa, Artificial Sequence
  Description of Artificial Sequence: Synthetic peptide
  Seed: LSNLTHVLYPV (PRAME_HUMAN)
LPNLTHVLYPV

SEQ ID NO: 147082 - protein, 11 aa, Artificial Sequence
  Description of Artificial Sequence: Synthetic peptide
  Seed: YISMSVWTSPR (PRAME_HUMAN)
YLSMSVWTSPR

SEQ ID NO: 147083 - protein, 11 aa, Artificial Sequence
  Description of Artificial Sequence: Synthetic peptide
  Seed: YISMSVWTSPR (PRAME_HUMAN)
YSSMSVWTSPR

SEQ ID NO: 147084 - protein, 9 aa, Artificial Sequence
  Description of Artificial Sequence: Synthetic peptide
  Seed: YPVPLESYE (PRAME_HUMAN)
YLVPLESYY

SEQ ID NO: 147085 - protein, 10 aa, Artificial Sequence
  Description of Artificial Sequence: Synthetic peptide
  Seed: EAAQPMTKKR (PRAME_HUMAN)
ETAQPMTKKK

SEQ ID NO: 147086 - protein, 9 aa, Artificial Sequence
  Description of Artificial Sequence: Synthetic peptide
  Seed: FAMPMQDIK (PRAME_HUMAN)
FTMPMQDIK

SEQ ID NO: 147087 - protein, 10 aa, Artificial Sequence
  Description of Artificial Sequence: Synthetic peptide
  Seed: SPSVSQLSVL (PRAME_HUMAN)
SKSVSQLSVW

SEQ ID NO: 147088 - protein, 10 aa, Artificial Sequence
  Description of Artificial Sequence: Synthetic peptide
  Seed: RGRLDQLLRH (PRAME_HUMAN)
RGRLDQLLRM

SEQ ID NO: 147089 - protein, 11 aa, Artificial Sequence
  Description of Artificial Sequence: Synthetic peptide
  Seed: LPTLAKFSPYL (PRAME_HUMAN)
LITLAKFSPYI

SEQ ID NO: 147090 - protein, 9 aa, Artificial Sequence
  Description of Artificial Sequence: Synthetic peptide
  Seed: SQFLSLQCL (PRAME_HUMAN)
SLFLSLQCI

SEQ ID NO: 147091 - protein, 9 aa, Artificial Sequence
  Description of Artificial Sequence: Synthetic peptide
  Seed: YLHARLREL (PRAME_HUMAN)
YQHARLREV

SEQ ID NO: 147092 - protein, 9 aa, Artificial Sequence
  Description of Artificial Sequence: Synthetic peptide
  Seed: FYDPEPILC (PRAME_HUMAN)
FFDPEPILY

SEQ ID NO: 147093 - protein, 9 aa, Artificial Sequence
  Description of Artificial Sequence: Synthetic peptide
  Seed: VSPEPLQAL (PRAME_HUMAN)
VAPEPLQAR

SEQ ID NO: 147094 - protein, 9 aa, Artificial Sequence
  Description of Artificial Sequence: Synthetic peptide
  Seed: EDLEVTCTW (PRAME_HUMAN)
EALEVTCTF

SEQ ID NO: 147095 - protein, 11 aa, Artificial Sequence
  Description of Artificial Sequence: Synthetic peptide
  Seed: KAVLDGLDVLL (PRAME_HUMAN)
KQVLDGLDVLF

SEQ ID NO: 147096 - protein, 11 aa, Artificial Sequence
  Description of Artificial Sequence: Synthetic peptide
  Seed: RRLLLSHIHAS (PRAME_HUMAN)
RRLLLSHIHAL

SEQ ID NO: 147097 - protein, 10 aa, Artificial Sequence
  Description of Artificial Sequence: Synthetic peptide
  Seed: VLSLSGVMLT (PRAME_HUMAN)
VLSLSGVMLL

SEQ ID NO: 147098 - protein, 9 aa, Artificial Sequence
  Description of Artificial Sequence: Synthetic peptide
  Seed: TCLPLGVLM (PRAME_HUMAN)
TALPLGVLL

SEQ ID NO: 147099 - protein, 11 aa, Artificial Sequence
  Description of Artificial Sequence: Synthetic peptide
  Seed: LTDVSPEPLQA (PRAME_HUMAN)
LIDVSPEPLQI

SEQ ID NO: 147100 - protein, 11 aa, Artificial Sequence
  Description of Artificial Sequence: Synthetic peptide
  Seed: AAFDGRHSQTL (PRAME_HUMAN)
AGFDGRHSQTF

SEQ ID NO: 147101 - protein, 9 aa, Artificial Sequence
  Description of Artificial Sequence: Synthetic peptide
  Seed: VLMKGQHLH (PRAME_HUMAN)
VQMKGQHLK

SEQ ID NO: 147102 - protein, 10 aa, Artificial Sequence
  Description of Artificial Sequence: Synthetic peptide
  Seed: RASATLQDLV (PRAME_HUMAN)
RGSATLQDLW

SEQ ID NO: 147103 - protein, 9 aa, Artificial Sequence
  Description of Artificial Sequence: Synthetic peptide
  Seed: FPPLFMAAF (PRAME_HUMAN)
FLPLFMAAL

SEQ ID NO: 147104 - protein, 9 aa, Artificial Sequence
  Description of Artificial Sequence: Synthetic peptide
  Seed: LSEGDVMHL (PRAME_HUMAN)
LGEGDVMHL

SEQ ID NO: 147105 - protein, 10 aa, Artificial Sequence
  Description of Artificial Sequence: Synthetic peptide
  Seed: SNLTHVLYPV (PRAME_HUMAN)
SFLTHVLYPM

SEQ ID NO: 147106 - protein, 9 aa, Artificial Sequence
  Description of Artificial Sequence: Synthetic peptide
  Seed: AMPMQDIKM (PRAME_HUMAN)
AQPMQDIKY

SEQ ID NO: 147107 - protein, 9 aa, Artificial Sequence
  Description of Artificial Sequence: Synthetic peptide
  Seed: FTCLPLGVL (PRAME_HUMAN)
FVCLPLGVY

SEQ ID NO: 147108 - protein, 10 aa, Artificial Sequence
  Description of Artificial Sequence: Synthetic peptide
  Seed: SPYLGQMINL (PRAME_HUMAN)
SFYLGQMINW

SEQ ID NO: 147109 - protein, 10 aa, Artificial Sequence
  Description of Artificial Sequence: Synthetic peptide
  Seed: SLYSFPEPEA (PRAME_HUMAN)
SVYSFPEPEV

SEQ ID NO: 147110 - protein, 10 aa, Artificial Sequence
  Description of Artificial Sequence: Synthetic peptide
  Seed: IGLSNLTHVL (PRAME_HUMAN)
ILLSNLTHVL

SEQ ID NO: 147111 - protein, 11 aa, Artificial Sequence
  Description of Artificial Sequence: Synthetic peptide
  Seed: RELFPPLFMAA (PRAME_HUMAN)
RMLFPPLFMAL

SEQ ID NO: 147112 - protein, 10 aa, Artificial Sequence
  Description of Artificial Sequence: Synthetic peptide
  Seed: TTLSFYGNSI (PRAME_HUMAN)
TFLSFYGNSI

SEQ ID NO: 147113 - protein, 11 aa, Artificial Sequence
  Description of Artificial Sequence: Synthetic peptide
  Seed: ALYVDSLFFLR (PRAME_HUMAN)
AMYVDSLFFLC

SEQ ID NO: 147114 - protein, 11 aa, Artificial Sequence
  Description of Artificial Sequence: Synthetic peptide
  Seed: CRLSEGDVMHL (PRAME_HUMAN)
CRLSEGDVMHF

SEQ ID NO: 147115 - protein, 10 aa, Artificial Sequence
  Description of Artificial Sequence: Synthetic peptide
  Seed: AALELLPREL (PRAME_HUMAN)
AMLELLPREA

SEQ ID NO: 147116 - protein, 10 aa, Artificial Sequence
  Description of Artificial Sequence: Synthetic peptide
  Seed: IGLSNLTHVL (PRAME_HUMAN)
IFLSNLTHVA

SEQ ID NO: 147117 - protein, 11 aa, Artificial Sequence
  Description of Artificial Sequence: Synthetic peptide
  Seed: KIFAMPMQDIK (PRAME_HUMAN)
KLFAMPMQDIK

SEQ ID NO: 147118 - protein, 9 aa, Artificial Sequence
  Description of Artificial Sequence: Synthetic peptide
  Seed: ITDDQLLAL (PRAME_HUMAN)
INDDQLLAV

SEQ ID NO: 147119 - protein, 9 aa, Artificial Sequence
  Description of Artificial Sequence: Synthetic peptide
  Seed: VFDECGITD (PRAME_HUMAN)
VIDECGITI

SEQ ID NO: 147120 - protein, 10 aa, Artificial Sequence
  Description of Artificial Sequence: Synthetic peptide
  Seed: GTLHLERLAY (PRAME_HUMAN)
GMLHLERLAY

SEQ ID NO: 147121 - protein, 9 aa, Artificial Sequence
  Description of Artificial Sequence: Synthetic peptide
  Seed: LTDVSPEPL (PRAME_HUMAN)
LGDVSPEPL

SEQ ID NO: 147122 - protein, 10 aa, Artificial Sequence
  Description of Artificial Sequence: Synthetic peptide
  Seed: RHVMNPLETL (PRAME_HUMAN)
RMVMNPLETM

SEQ ID NO: 147123 - protein, 9 aa, Artificial Sequence
  Description of Artificial Sequence: Synthetic peptide
  Seed: LSLQCLQAL (PRAME_HUMAN)
LHLQCLQAF

SEQ ID NO: 147124 - protein, 9 aa, Artificial Sequence
  Description of Artificial Sequence: Synthetic peptide
  Seed: YPVPLESYE (PRAME_HUMAN)
YIVPLESYY

SEQ ID NO: 147125 - protein, 9 aa, Artificial Sequence
  Description of Artificial Sequence: Synthetic peptide
  Seed: KAMVQAWPF (PRAME_HUMAN)
KMMVQAWPM

SEQ ID NO: 147126 - protein, 9 aa, Artificial Sequence
  Description of Artificial Sequence: Synthetic peptide
  Seed: KLKIFAMPM (PRAME_HUMAN)
KIKIFAMPT

SEQ ID NO: 147127 - protein, 10 aa, Artificial Sequence
  Description of Artificial Sequence: Synthetic peptide
  Seed: ARLRELLCEL (PRAME_HUMAN)
AGLRELLCEI

SEQ ID NO: 147128 - protein, 10 aa, Artificial Sequence
  Description of Artificial Sequence: Synthetic peptide
  Seed: AQFTSQFLSL (PRAME_HUMAN)
AEFTSQFLSV

SEQ ID NO: 147129 - protein, 9 aa, Artificial Sequence
  Description of Artificial Sequence: Synthetic peptide
  Seed: NSISISALQ (PRAME_HUMAN)
NTISISALY

SEQ ID NO: 147130 - protein, 9 aa, Artificial Sequence
  Description of Artificial Sequence: Synthetic peptide
  Seed: AFDGRHSQT (PRAME_HUMAN)
AYDGRHSQM

SEQ ID NO: 147131 - protein, 9 aa, Artificial Sequence
  Description of Artificial Sequence: Synthetic peptide
  Seed: EDLEVTCTW (PRAME_HUMAN)
EPLEVTCTW

SEQ ID NO: 147132 - protein, 9 aa, Artificial Sequence
  Description of Artificial Sequence: Synthetic peptide
  Seed: YIAQFTSQF (PRAME_HUMAN)
YMAQFTSQR

SEQ ID NO: 147133 - protein, 9 aa, Artificial Sequence
  Description of Artificial Sequence: Synthetic peptide
  Seed: AQFTSQFLS (PRAME_HUMAN)
AQFTSQFLL

SEQ ID NO: 147134 - protein, 10 aa, Artificial Sequence
  Description of Artificial Sequence: Synthetic peptide
  Seed: RLAYLHARLR (PRAME_HUMAN)
RSAYLHARLR

SEQ ID NO: 147135 - protein, 10 aa, Artificial Sequence
  Description of Artificial Sequence: Synthetic peptide
  Seed: QLLALLPSLS (PRAME_HUMAN)
QVLALLPSLV

SEQ ID NO: 147136 - protein, 9 aa, Artificial Sequence
  Description of Artificial Sequence: Synthetic peptide
  Seed: YIAQFTSQF (PRAME_HUMAN)
YKAQFTSQI

SEQ ID NO: 147137 - protein, 9 aa, Artificial Sequence
  Description of Artificial Sequence: Synthetic peptide
  Seed: KEEQYIAQF (PRAME_HUMAN)
KMEQYIAQL

SEQ ID NO: 147138 - protein, 9 aa, Artificial Sequence
  Description of Artificial Sequence: Synthetic peptide
  Seed: NLTHVLYPV (PRAME_HUMAN)
NLTHVLYPR

SEQ ID NO: 147139 - protein, 9 aa, Artificial Sequence
  Description of Artificial Sequence: Synthetic peptide
  Seed: YPVPLESYE (PRAME_HUMAN)
YPVPLESYH

SEQ ID NO: 147140 - protein, 9 aa, Artificial Sequence
  Description of Artificial Sequence: Synthetic peptide
  Seed: LYVDSLFFL (PRAME_HUMAN)
LWVDSLFFF

SEQ ID NO: 147141 - protein, 11 aa, Artificial Sequence
  Description of Artificial Sequence: Synthetic peptide
  Seed: PRELFPPLFMA (PRAME_HUMAN)
PRELFPPLFMV

SEQ ID NO: 147142 - protein, 10 aa, Artificial Sequence
  Description of Artificial Sequence: Synthetic peptide
  Seed: KGQHLHLETF (PRAME_HUMAN)
KHQHLHLETY

SEQ ID NO: 147143 - protein, 10 aa, Artificial Sequence
  Description of Artificial Sequence: Synthetic peptide
  Seed: SNLTHVLYPV (PRAME_HUMAN)
SMLTHVLYPV

SEQ ID NO: 147144 - protein, 9 aa, Artificial Sequence
  Description of Artificial Sequence: Synthetic peptide
  Seed: LSEGDVMHL (PRAME_HUMAN)
LTEGDVMHL

SEQ ID NO: 147145 - protein, 9 aa, Artificial Sequence
  Description of Artificial Sequence: Synthetic peptide
  Seed: YGNSISISA (PRAME_HUMAN)
YVNSISISV

SEQ ID NO: 147146 - protein, 10 aa, Artificial Sequence
  Description of Artificial Sequence: Synthetic peptide
  Seed: RLVELAGQSL (PRAME_HUMAN)
RRVELAGQSF

SEQ ID NO: 147147 - protein, 9 aa, Artificial Sequence
  Description of Artificial Sequence: Synthetic peptide
  Seed: KLKIFAMPM (PRAME_HUMAN)
KYKIFAMPS

SEQ ID NO: 147148 - protein, 9 aa, Artificial Sequence
  Description of Artificial Sequence: Synthetic peptide
  Seed: HVMNPLETL (PRAME_HUMAN)
HLMNPLETI

SEQ ID NO: 147149 - protein, 11 aa, Artificial Sequence
  Description of Artificial Sequence: Synthetic peptide
  Seed: AVLDGLDVLLA (PRAME_HUMAN)
AQLDGLDVLLV

SEQ ID NO: 147150 - protein, 9 aa, Artificial Sequence
  Description of Artificial Sequence: Synthetic peptide
  Seed: RLDQLLRHV (PRAME_HUMAN)
RQDQLLRHF

SEQ ID NO: 147151 - protein, 9 aa, Artificial Sequence
  Description of Artificial Sequence: Synthetic peptide
  Seed: SQLTTLSFY (PRAME_HUMAN)
STLTTLSFW

SEQ ID NO: 147152 - protein, 10 aa, Artificial Sequence
  Description of Artificial Sequence: Synthetic peptide
  Seed: RLWGSIQSRY (PRAME_HUMAN)
RSWGSIQSRF

SEQ ID NO: 147153 - protein, 10 aa, Artificial Sequence
  Description of Artificial Sequence: Synthetic peptide
  Seed: LSFYGNSISI (PRAME_HUMAN)
LCFYGNSISW

SEQ ID NO: 147154 - protein, 9 aa, Artificial Sequence
  Description of Artificial Sequence: Synthetic peptide
  Seed: TCTWKLPTL (PRAME_HUMAN)
TTTWKLPTL

SEQ ID NO: 147155 - protein, 11 aa, Artificial Sequence
  Description of Artificial Sequence: Synthetic peptide
  Seed: RASATLQDLVF (PRAME_HUMAN)
RQSATLQDLVM

SEQ ID NO: 147156 - protein, 9 aa, Artificial Sequence
  Description of Artificial Sequence: Synthetic peptide
  Seed: TLHLERLAY (PRAME_HUMAN)
TSHLERLAL

SEQ ID NO: 147157 - protein, 9 aa, Artificial Sequence
  Description of Artificial Sequence: Synthetic peptide
  Seed: VQAWPFTCL (PRAME_HUMAN)
VEAWPFTCL

SEQ ID NO: 147158 - protein, 11 aa, Artificial Sequence
  Description of Artificial Sequence: Synthetic peptide
  Seed: QALYVDSLFFL (PRAME_HUMAN)
QALYVDSLFFV

SEQ ID NO: 147159 - protein, 10 aa, Artificial Sequence
  Description of Artificial Sequence: Synthetic peptide
  Seed: RRWKLQVLDL (PRAME_HUMAN)
RRWKLQVLDT

SEQ ID NO: 147160 - protein, 9 aa, Artificial Sequence
  Description of Artificial Sequence: Synthetic peptide
  Seed: GNRASLYSF (PRAME_HUMAN)
GLRASLYSY

SEQ ID NO: 147161 - protein, 10 aa, Artificial Sequence
  Description of Artificial Sequence: Synthetic peptide
  Seed: LSQSPSVSQL (PRAME_HUMAN)
LAQSPSVSQL

SEQ ID NO: 147162 - protein, 11 aa, Artificial Sequence
  Description of Artificial Sequence: Synthetic peptide
  Seed: LPTLAKFSPYL (PRAME_HUMAN)
LMTLAKFSPYL

SEQ ID NO: 147163 - protein, 10 aa, Artificial Sequence
  Description of Artificial Sequence: Synthetic peptide
  Seed: LPTLAKFSPY (PRAME_HUMAN)
LATLAKFSPW

SEQ ID NO: 147164 - protein, 9 aa, Artificial Sequence
  Description of Artificial Sequence: Synthetic peptide
  Seed: EVLVDLFLK (PRAME_HUMAN)
ENLVDLFLR

SEQ ID NO: 147165 - protein, 9 aa, Artificial Sequence
  Description of Artificial Sequence: Synthetic peptide
  Seed: TLAKFSPYL (PRAME_HUMAN)
TFAKFSPYL

SEQ ID NO: 147166 - protein, 9 aa, Artificial Sequence
  Description of Artificial Sequence: Synthetic peptide
  Seed: AEQPFIPVE (PRAME_HUMAN)
AEQPFIPVL

SEQ ID NO: 147167 - protein, 10 aa, Artificial Sequence
  Description of Artificial Sequence: Synthetic peptide
  Seed: FFLRGRLDQL (PRAME_HUMAN)
FFLRGRLDQA

SEQ ID NO: 147168 - protein, 9 aa, Artificial Sequence
  Description of Artificial Sequence: Synthetic peptide
  Seed: LALLPSLSH (PRAME_HUMAN)
LQLLPSLSH

SEQ ID NO: 147169 - protein, 9 aa, Artificial Sequence
  Description of Artificial Sequence: Synthetic peptide
  Seed: VSQLSVLSL (PRAME_HUMAN)
VQQLSVLSY

SEQ ID NO: 147170 - protein, 10 aa, Artificial Sequence
  Description of Artificial Sequence: Synthetic peptide
  Seed: FFLRGRLDQL (PRAME_HUMAN)
FMLRGRLDQL

SEQ ID NO: 147171 - protein, 10 aa, Artificial Sequence
  Description of Artificial Sequence: Synthetic peptide
  Seed: GACDELFSYL (PRAME_HUMAN)
GACDELFSYI

SEQ ID NO: 147172 - protein, 10 aa, Artificial Sequence
  Description of Artificial Sequence: Synthetic peptide
  Seed: AVLDGLDVLL (PRAME_HUMAN)
ATLDGLDVLL

SEQ ID NO: 147173 - protein, 10 aa, Artificial Sequence
  Description of Artificial Sequence: Synthetic peptide
  Seed: MVQAWPFTCL (PRAME_HUMAN)
MIQAWPFTCF

SEQ ID NO: 147174 - protein, 9 aa, Artificial Sequence
  Description of Artificial Sequence: Synthetic peptide
  Seed: QFTSQFLSL (PRAME_HUMAN)
QRTSQFLSM

SEQ ID NO: 147175 - protein, 9 aa, Artificial Sequence
  Description of Artificial Sequence: Synthetic peptide
  Seed: SQLTTLSFY (PRAME_HUMAN)
SVLTTLSFY

SEQ ID NO: 147176 - protein, 10 aa, Artificial Sequence
  Description of Artificial Sequence: Synthetic peptide
  Seed: LPTLAKFSPY (PRAME_HUMAN)
LNTLAKFSPW

SEQ ID NO: 147177 - protein, 9 aa, Artificial Sequence
  Description of Artificial Sequence: Synthetic peptide
  Seed: KLKIFAMPM (PRAME_HUMAN)
KQKIFAMPI

SEQ ID NO: 147178 - protein, 9 aa, Artificial Sequence
  Description of Artificial Sequence: Synthetic peptide
  Seed: VPLESYEDI (PRAME_HUMAN)
VPLESYEDL

SEQ ID NO: 147179 - protein, 9 aa, Artificial Sequence
  Description of Artificial Sequence: Synthetic peptide
  Seed: SVWTSPRRL (PRAME_HUMAN)
SSWTSPRRF

SEQ ID NO: 147180 - protein, 10 aa, Artificial Sequence
  Description of Artificial Sequence: Synthetic peptide
  Seed: YEDIHGTLHL (PRAME_HUMAN)
YEDIHGTLHW

SEQ ID NO: 147181 - protein, 10 aa, Artificial Sequence
  Description of Artificial Sequence: Synthetic peptide
  Seed: RHVMNPLETL (PRAME_HUMAN)
RHVMNPLETF

SEQ ID NO: 147182 - protein, 9 aa, Artificial Sequence
  Description of Artificial Sequence: Synthetic peptide
  Seed: SRYISMSVW (PRAME_HUMAN)
STYISMSVF

SEQ ID NO: 147183 - protein, 8 aa, Artificial Sequence
  Description of Artificial Sequence: Synthetic peptide
  Seed: VLDGLDVL (PRAME_HUMAN)
VWDGLDVL

SEQ ID NO: 147184 - protein, 10 aa, Artificial Sequence
  Description of Artificial Sequence: Synthetic peptide
  Seed: ARLRELLCEL (PRAME_HUMAN)
ACLRELLCEL

SEQ ID NO: 147185 - protein, 9 aa, Artificial Sequence
  Description of Artificial Sequence: Synthetic peptide
  Seed: SLLQHLIGL (PRAME_HUMAN)
SALQHLIGM

SEQ ID NO: 147186 - protein, 9 aa, Artificial Sequence
  Description of Artificial Sequence: Synthetic peptide
  Seed: LQHLIGLSN (PRAME_HUMAN)
LMHLIGLSM

SEQ ID NO: 147187 - protein, 9 aa, Artificial Sequence
  Description of Artificial Sequence: Synthetic peptide
  Seed: YVDSLFFLR (PRAME_HUMAN)
YYDSLFFLK

SEQ ID NO: 147188 - protein, 10 aa, Artificial Sequence
  Description of Artificial Sequence: Synthetic peptide
  Seed: RRLWGSIQSR (PRAME_HUMAN)
RWLWGSIQSK

SEQ ID NO: 147189 - protein, 10 aa, Artificial Sequence
  Description of Artificial Sequence: Synthetic peptide
  Seed: HASSYISPEK (PRAME_HUMAN)
HLSSYISPEK

SEQ ID NO: 147190 - protein, 10 aa, Artificial Sequence
  Description of Artificial Sequence: Synthetic peptide
  Seed: RLDQLLRHVM (PRAME_HUMAN)
RMDQLLRHVV

SEQ ID NO: 147191 - protein, 8 aa, Artificial Sequence
  Description of Artificial Sequence: Synthetic peptide
  Seed: SHIHASSY (PRAME_HUMAN)
SKIHASSF

SEQ ID NO: 147192 - protein, 10 aa, Artificial Sequence
  Description of Artificial Sequence: Synthetic peptide
  Seed: AAFDGRHSQT (PRAME_HUMAN)
ASFDGRHSQF

SEQ ID NO: 147193 - protein, 8 aa, Artificial Sequence
  Description of Artificial Sequence: Synthetic peptide
  Seed: EAAQPMTK (PRAME_HUMAN)
EVAQPMTR

SEQ ID NO: 147194 - protein, 10 aa, Artificial Sequence
  Description of Artificial Sequence: Synthetic peptide
  Seed: RLWGSIQSRY (PRAME_HUMAN)
RYWGSIQSRK

SEQ ID NO: 147195 - protein, 10 aa, Artificial Sequence
  Description of Artificial Sequence: Synthetic peptide
  Seed: RLSEGDVMHL (PRAME_HUMAN)
RQSEGDVMHM

SEQ ID NO: 147196 - protein, 9 aa, Artificial Sequence
  Description of Artificial Sequence: Synthetic peptide
  Seed: CKKLKIFAM (PRAME_HUMAN)
CAKLKIFAV

SEQ ID NO: 147197 - protein, 8 aa, Artificial Sequence
  Description of Artificial Sequence: Synthetic peptide
  Seed: MINLRRLL (PRAME_HUMAN)
MPNLRRLL

SEQ ID NO: 147198 - protein, 9 aa, Artificial Sequence
  Description of Artificial Sequence: Synthetic peptide
  Seed: LAIAALELL (PRAME_HUMAN)
LSIAALELY

SEQ ID NO: 147199 - protein, 10 aa, Artificial Sequence
  Description of Artificial Sequence: Synthetic peptide
  Seed: RGRLDQLLRH (PRAME_HUMAN)
RHRLDQLLRL

SEQ ID NO: 147200 - protein, 9 aa, Artificial Sequence
  Description of Artificial Sequence: Synthetic peptide
  Seed: TLSFYGNSI (PRAME_HUMAN)
TLSFYGNSL

SEQ ID NO: 147201 - protein, 10 aa, Artificial Sequence
  Description of Artificial Sequence: Synthetic peptide
  Seed: VLYPVPLESY (PRAME_HUMAN)
VQYPVPLESY

SEQ ID NO: 147202 - protein, 9 aa, Artificial Sequence
  Description of Artificial Sequence: Synthetic peptide
  Seed: ALAIAALEL (PRAME_HUMAN)
AVAIAALEY

SEQ ID NO: 147203 - protein, 9 aa, Artificial Sequence
  Description of Artificial Sequence: Synthetic peptide
  Seed: LMKGQHLHL (PRAME_HUMAN)
LVKGQHLHF

SEQ ID NO: 147204 - protein, 8 aa, Artificial Sequence
  Description of Artificial Sequence: Synthetic peptide
  Seed: LTHVLYPV (PRAME_HUMAN)
LMHVLYPI

SEQ ID NO: 147205 - protein, 9 aa, Artificial Sequence
  Description of Artificial Sequence: Synthetic peptide
  Seed: ALYVDSLFF (PRAME_HUMAN)
ATYVDSLFF

SEQ ID NO: 147206 - protein, 10 aa, Artificial Sequence
  Description of Artificial Sequence: Synthetic peptide
  Seed: LQALYVDSLF (PRAME_HUMAN)
LPALYVDSLW

SEQ ID NO: 147207 - protein, 9 aa, Artificial Sequence
  Description of Artificial Sequence: Synthetic peptide
  Seed: VLDGLDVLL (PRAME_HUMAN)
VNDGLDVLL

SEQ ID NO: 147208 - protein, 9 aa, Artificial Sequence
  Description of Artificial Sequence: Synthetic peptide
  Seed: HVMNPLETL (PRAME_HUMAN)
HMMNPLETL

SEQ ID NO: 147209 - protein, 10 aa, Artificial Sequence
  Description of Artificial Sequence: Synthetic peptide
  Seed: LYVDSLFFLR (PRAME_HUMAN)
LWVDSLFFLK

SEQ ID NO: 147210 - protein, 9 aa, Artificial Sequence
  Description of Artificial Sequence: Synthetic peptide
  Seed: FMAAFDGRH (PRAME_HUMAN)
FQAAFDGRF

SEQ ID NO: 147211 - protein, 9 aa, Artificial Sequence
  Description of Artificial Sequence: Synthetic peptide
  Seed: LALLPSLSH (PRAME_HUMAN)
LVLLPSLSM

SEQ ID NO: 147212 - protein, 9 aa, Artificial Sequence
  Description of Artificial Sequence: Synthetic peptide
  Seed: ALQSLLQHL (PRAME_HUMAN)
AAQSLLQHM

SEQ ID NO: 147213 - protein, 9 aa, Artificial Sequence
  Description of Artificial Sequence: Synthetic peptide
  Seed: ITDDQLLAL (PRAME_HUMAN)
ITDDQLLAY

SEQ ID NO: 147214 - protein, 9 aa, Artificial Sequence
  Description of Artificial Sequence: Synthetic peptide
  Seed: LSNLTHVLY (PRAME_HUMAN)
LENLTHVLF

SEQ ID NO: 147215 - protein, 9 aa, Artificial Sequence
  Description of Artificial Sequence: Synthetic peptide
  Seed: LPRELFPPL (PRAME_HUMAN)
LLRELFPPF

SEQ ID NO: 147216 - protein, 10 aa, Artificial Sequence
  Description of Artificial Sequence: Synthetic peptide
  Seed: RGRLDQLLRH (PRAME_HUMAN)
RWRLDQLLRI

SEQ ID NO: 147217 - protein, 11 aa, Artificial Sequence
  Description of Artificial Sequence: Synthetic peptide
  Seed: AMVQAWPFTCL (PRAME_HUMAN)
ALVQAWPFTCV

SEQ ID NO: 147218 - protein, 11 aa, Artificial Sequence
  Description of Artificial Sequence: Synthetic peptide
  Seed: QALYVDSLFFL (PRAME_HUMAN)
QSLYVDSLFFV

SEQ ID NO: 147219 - protein, 9 aa, Artificial Sequence
  Description of Artificial Sequence: Synthetic peptide
  Seed: KLKIFAMPM (PRAME_HUMAN)
KVKIFAMPP

SEQ ID NO: 147220 - protein, 9 aa, Artificial Sequence
  Description of Artificial Sequence: Synthetic peptide
  Seed: YIAQFTSQF (PRAME_HUMAN)
YGAQFTSQF

SEQ ID NO: 147221 - protein, 9 aa, Artificial Sequence
  Description of Artificial Sequence: Synthetic peptide
  Seed: FYDPEPILC (PRAME_HUMAN)
FDDPEPILF

SEQ ID NO: 147222 - protein, 9 aa, Artificial Sequence
  Description of Artificial Sequence: Synthetic peptide
  Seed: QLLALLPSL (PRAME_HUMAN)
QLLALLPSR

SEQ ID NO: 147223 - protein, 9 aa, Artificial Sequence
  Description of Artificial Sequence: Synthetic peptide
  Seed: SIQSRYISM (PRAME_HUMAN)
SMQSRYISK

SEQ ID NO: 147224 - protein, 9 aa, Artificial Sequence
  Description of Artificial Sequence: Synthetic peptide
  Seed: SFPEPEAAQ (PRAME_HUMAN)
SFPEPEAAF

SEQ ID NO: 147225 - protein, 10 aa, Artificial Sequence
  Description of Artificial Sequence: Synthetic peptide
  Seed: ARLRELLCEL (PRAME_HUMAN)
ARLRELLCEK

SEQ ID NO: 147226 - protein, 9 aa, Artificial Sequence
  Description of Artificial Sequence: Synthetic peptide
  Seed: SVWTSPRRL (PRAME_HUMAN)
SIWTSPRRW

SEQ ID NO: 147227 - protein, 9 aa, Artificial Sequence
  Description of Artificial Sequence: Synthetic peptide
  Seed: VLMKGQHLH (PRAME_HUMAN)
VTMKGQHLR

SEQ ID NO: 147228 - protein, 9 aa, Artificial Sequence
  Description of Artificial Sequence: Synthetic peptide
  Seed: RWKLQVLDL (PRAME_HUMAN)
RWKLQVLDF

SEQ ID NO: 147229 - protein, 9 aa, Artificial Sequence
  Description of Artificial Sequence: Synthetic peptide
  Seed: ISISALQSL (PRAME_HUMAN)
IEISALQSY

SEQ ID NO: 147230 - protein, 10 aa, Artificial Sequence
  Description of Artificial Sequence: Synthetic peptide
  Seed: ITDDQLLALL (PRAME_HUMAN)
IADDQLLALV

SEQ ID NO: 147231 - protein, 10 aa, Artificial Sequence
  Description of Artificial Sequence: Synthetic peptide
  Seed: LSHIHASSYI (PRAME_HUMAN)
LSHIHASSYY

SEQ ID NO: 147232 - protein, 9 aa, Artificial Sequence
  Description of Artificial Sequence: Synthetic peptide
  Seed: ITDDQLLAL (PRAME_HUMAN)
IGDDQLLAF

SEQ ID NO: 147233 - protein, 9 aa, Artificial Sequence
  Description of Artificial Sequence: Synthetic peptide
  Seed: MNPLETLSI (PRAME_HUMAN)
MMPLETLSM

SEQ ID NO: 147234 - protein, 10 aa, Artificial Sequence
  Description of Artificial Sequence: Synthetic peptide
  Seed: ASATLQDLVF (PRAME_HUMAN)
AMATLQDLVW

SEQ ID NO: 147235 - protein, 10 aa, Artificial Sequence
  Description of Artificial Sequence: Synthetic peptide
  Seed: TLHLERLAYL (PRAME_HUMAN)
TVHLERLAYV

SEQ ID NO: 147236 - protein, 10 aa, Artificial Sequence
  Description of Artificial Sequence: Synthetic peptide
  Seed: RRRLWGSIQS (PRAME_HUMAN)
RRRLWGSIQF

SEQ ID NO: 147237 - protein, 11 aa, Artificial Sequence
  Description of Artificial Sequence: Synthetic peptide
  Seed: YISPEKEEQYI (PRAME_HUMAN)
YQSPEKEEQYM

SEQ ID NO: 147238 - protein, 10 aa, Artificial Sequence
  Description of Artificial Sequence: Synthetic peptide
  Seed: YGNSISISAL (PRAME_HUMAN)
YSNSISISAY

SEQ ID NO: 147239 - protein, 10 aa, Artificial Sequence
  Description of Artificial Sequence: Synthetic peptide
  Seed: IGLSNLTHVL (PRAME_HUMAN)
IHLSNLTHVV

SEQ ID NO: 147240 - protein, 10 aa, Artificial Sequence
  Description of Artificial Sequence: Synthetic peptide
  Seed: FFLRGRLDQL (PRAME_HUMAN)
FRLRGRLDQA

SEQ ID NO: 147241 - protein, 9 aa, Artificial Sequence
  Description of Artificial Sequence: Synthetic peptide
  Seed: YLHARLREL (PRAME_HUMAN)
YKHARLREF

SEQ ID NO: 147242 - protein, 9 aa, Artificial Sequence
  Description of Artificial Sequence: Synthetic peptide
  Seed: KEEQYIAQF (PRAME_HUMAN)
KDEQYIAQL

SEQ ID NO: 147243 - protein, 9 aa, Artificial Sequence
  Description of Artificial Sequence: Synthetic peptide
  Seed: VQLDSIEDL (PRAME_HUMAN)
VTLDSIEDI

SEQ ID NO: 147244 - protein, 10 aa, Artificial Sequence
  Description of Artificial Sequence: Synthetic peptide
  Seed: ISISALQSLL (PRAME_HUMAN)
IYISALQSLV

SEQ ID NO: 147245 - protein, 9 aa, Artificial Sequence
  Description of Artificial Sequence: Synthetic peptide
  Seed: HVMNPLETL (PRAME_HUMAN)
HVMNPLETY

SEQ ID NO: 147246 - protein, 9 aa, Artificial Sequence
  Description of Artificial Sequence: Synthetic peptide
  Seed: QSRYISMSV (PRAME_HUMAN)
QSRYISMSW

SEQ ID NO: 147247 - protein, 9 aa, Artificial Sequence
  Description of Artificial Sequence: Synthetic peptide
  Seed: YSFPEPEAA (PRAME_HUMAN)
YFFPEPEAM

SEQ ID NO: 147248 - protein, 9 aa, Artificial Sequence
  Description of Artificial Sequence: Synthetic peptide
  Seed: LALLPSLSH (PRAME_HUMAN)
LQLLPSLSW

SEQ ID NO: 147249 - protein, 9 aa, Artificial Sequence
  Description of Artificial Sequence: Synthetic peptide
  Seed: SQSPSVSQL (PRAME_HUMAN)
SSSPSVSQF

SEQ ID NO: 147250 - protein, 9 aa, Artificial Sequence
  Description of Artificial Sequence: Synthetic peptide
  Seed: THVLYPVPL (PRAME_HUMAN)
TMVLYPVPM

SEQ ID NO: 147251 - protein, 10 aa, Artificial Sequence
  Description of Artificial Sequence: Synthetic peptide
  Seed: VLYPVPLESY (PRAME_HUMAN)
VLYPVPLESF

SEQ ID NO: 147252 - protein, 9 aa, Artificial Sequence
  Description of Artificial Sequence: Synthetic peptide
  Seed: YIAQFTSQF (PRAME_HUMAN)
YIAQFTSQT

SEQ ID NO: 147253 - protein, 9 aa, Artificial Sequence
  Description of Artificial Sequence: Synthetic peptide
  Seed: LSEGDVMHL (PRAME_HUMAN)
LSEGDVMHM

SEQ ID NO: 147254 - protein, 9 aa, Artificial Sequence
  Description of Artificial Sequence: Synthetic peptide
  Seed: AVLDGLDVL (PRAME_HUMAN)
ALLDGLDVW

SEQ ID NO: 147255 - protein, 10 aa, Artificial Sequence
  Description of Artificial Sequence: Synthetic peptide
  Seed: FFLRGRLDQL (PRAME_HUMAN)
FLLRGRLDQM

SEQ ID NO: 147256 - protein, 9 aa, Artificial Sequence
  Description of Artificial Sequence: Synthetic peptide
  Seed: NLTHVLYPV (PRAME_HUMAN)
NVTHVLYPM

SEQ ID NO: 147257 - protein, 11 aa, Artificial Sequence
  Description of Artificial Sequence: Synthetic peptide
  Seed: MKGQHLHLETF (PRAME_HUMAN)
MFGQHLHLETY

SEQ ID NO: 147258 - protein, 10 aa, Artificial Sequence
  Description of Artificial Sequence: Synthetic peptide
  Seed: QAWPFTCLPL (PRAME_HUMAN)
QAWPFTCLPV

SEQ ID NO: 147259 - protein, 9 aa, Artificial Sequence
  Description of Artificial Sequence: Synthetic peptide
  Seed: VSPEPLQAL (PRAME_HUMAN)
VMPEPLQAM

SEQ ID NO: 147260 - protein, 9 aa, Artificial Sequence
  Description of Artificial Sequence: Synthetic peptide
  Seed: ELFPPLFMA (PRAME_HUMAN)
EQFPPLFMI

SEQ ID NO: 147261 - protein, 9 aa, Artificial Sequence
  Description of Artificial Sequence: Synthetic peptide
  Seed: GACDELFSY (PRAME_HUMAN)
GTCDELFSF

SEQ ID NO: 147262 - protein, 9 aa, Artificial Sequence
  Description of Artificial Sequence: Synthetic peptide
  Seed: ACDELFSYL (PRAME_HUMAN)
AVDELFSYY

SEQ ID NO: 147263 - protein, 9 aa, Artificial Sequence
  Description of Artificial Sequence: Synthetic peptide
  Seed: KMILKMVQL (PRAME_HUMAN)
KTILKMVQY

SEQ ID NO: 147264 - protein, 9 aa, Artificial Sequence
  Description of Artificial Sequence: Synthetic peptide
  Seed: RELFPPLFM (PRAME_HUMAN)
RHLFPPLFY

SEQ ID NO: 147265 - protein, 9 aa, Artificial Sequence
  Description of Artificial Sequence: Synthetic peptide
  Seed: AQFTSQFLS (PRAME_HUMAN)
AMFTSQFLM

SEQ ID NO: 147266 - protein, 8 aa, Artificial Sequence
  Description of Artificial Sequence: Synthetic peptide
  Seed: YEDIHGTL (PRAME_HUMAN)
YQDIHGTM

SEQ ID NO: 147267 - protein, 9 aa, Artificial Sequence
  Description of Artificial Sequence: Synthetic peptide
  Seed: VFDECGITD (PRAME_HUMAN)
VADECGITI

SEQ ID NO: 147268 - protein, 10 aa, Artificial Sequence
  Description of Artificial Sequence: Synthetic peptide
  Seed: RGRLDQLLRH (PRAME_HUMAN)
RFRLDQLLRL

SEQ ID NO: 147269 - protein, 9 aa, Artificial Sequence
  Description of Artificial Sequence: Synthetic peptide
  Seed: LTDVSPEPL (PRAME_HUMAN)
LMDVSPEPV

SEQ ID NO: 147270 - protein, 10 aa, Artificial Sequence
  Description of Artificial Sequence: Synthetic peptide
  Seed: GRPSMVWLSA (PRAME_HUMAN)
GWPSMVWLSL

SEQ ID NO: 147271 - protein, 10 aa, Artificial Sequence
  Description of Artificial Sequence: Synthetic peptide
  Seed: FLSLQCLQAL (PRAME_HUMAN)
FISLQCLQAV

SEQ ID NO: 147272 - protein, 9 aa, Artificial Sequence
  Description of Artificial Sequence: Synthetic peptide
  Seed: AFDGRHSQT (PRAME_HUMAN)
AWDGRHSQL

SEQ ID NO: 147273 - protein, 9 aa, Artificial Sequence
  Description of Artificial Sequence: Synthetic peptide
  Seed: FLRGRLDQL (PRAME_HUMAN)
FMRGRLDQL

SEQ ID NO: 147274 - protein, 9 aa, Artificial Sequence
  Description of Artificial Sequence: Synthetic peptide
  Seed: KAMVQAWPF (PRAME_HUMAN)
KVMVQAWPY

SEQ ID NO: 147275 - protein, 9 aa, Artificial Sequence
  Description of Artificial Sequence: Synthetic peptide
  Seed: LYVDSLFFL (PRAME_HUMAN)
LMVDSLFFF

SEQ ID NO: 147276 - protein, 10 aa, Artificial Sequence
  Description of Artificial Sequence: Synthetic peptide
  Seed: MVQAWPFTCL (PRAME_HUMAN)
MWQAWPFTCF

SEQ ID NO: 147277 - protein, 9 aa, Artificial Sequence
  Description of Artificial Sequence: Synthetic peptide
  Seed: YSFPEPEAA (PRAME_HUMAN)
YFFPEPEAY

SEQ ID NO: 147278 - protein, 9 aa, Artificial Sequence
  Description of Artificial Sequence: Synthetic peptide
  Seed: QDIKMILKM (PRAME_HUMAN)
QEIKMILKA

SEQ ID NO: 147279 - protein, 10 aa, Artificial Sequence
  Description of Artificial Sequence: Synthetic peptide
  Seed: FYDPEPILCP (PRAME_HUMAN)
FYDPEPILCI

SEQ ID NO: 147280 - protein, 8 aa, Artificial Sequence
  Description of Artificial Sequence: Synthetic peptide
  Seed: LLLSHIHA (PRAME_HUMAN)
LLLSHIHV

SEQ ID NO: 147281 - protein, 10 aa, Artificial Sequence
  Description of Artificial Sequence: Synthetic peptide
  Seed: RHVMNPLETL (PRAME_HUMAN)
RCVMNPLETV

SEQ ID NO: 147282 - protein, 11 aa, Artificial Sequence
  Description of Artificial Sequence: Synthetic peptide
  Seed: SQLSVLSLSGV (PRAME_HUMAN)
SMLSVLSLSGI

SEQ ID NO: 147283 - protein, 9 aa, Artificial Sequence
  Description of Artificial Sequence: Synthetic peptide
  Seed: KVDGLSTEA (PRAME_HUMAN)
KCDGLSTEM

SEQ ID NO: 147284 - protein, 9 aa, Artificial Sequence
  Description of Artificial Sequence: Synthetic peptide
  Seed: LYVDSLFFL (PRAME_HUMAN)
LFVDSLFFV

SEQ ID NO: 147285 - protein, 10 aa, Artificial Sequence
  Description of Artificial Sequence: Synthetic peptide
  Seed: MVQAWPFTCL (PRAME_HUMAN)
MAQAWPFTCY

SEQ ID NO: 147286 - protein, 11 aa, Artificial Sequence
  Description of Artificial Sequence: Synthetic peptide
  Seed: GTLHLERLAYL (PRAME_HUMAN)
GSLHLERLAYV

SEQ ID NO: 147287 - protein, 8 aa, Artificial Sequence
  Description of Artificial Sequence: Synthetic peptide
  Seed: LTHVLYPV (PRAME_HUMAN)
LSHVLYPV

SEQ ID NO: 147288 - protein, 9 aa, Artificial Sequence
  Description of Artificial Sequence: Synthetic peptide
  Seed: KLKIFAMPM (PRAME_HUMAN)
KAKIFAMPA

SEQ ID NO: 147289 - protein, 9 aa, Artificial Sequence
  Description of Artificial Sequence: Synthetic peptide
  Seed: QALYVDSLF (PRAME_HUMAN)
QQLYVDSLY

SEQ ID NO: 147290 - protein, 10 aa, Artificial Sequence
  Description of Artificial Sequence: Synthetic peptide
  Seed: LPTLAKFSPY (PRAME_HUMAN)
LFTLAKFSPF

SEQ ID NO: 147291 - protein, 10 aa, Artificial Sequence
  Description of Artificial Sequence: Synthetic peptide
  Seed: KGQHLHLETF (PRAME_HUMAN)
KRQHLHLETM

SEQ ID NO: 147292 - protein, 9 aa, Artificial Sequence
  Description of Artificial Sequence: Synthetic peptide
  Seed: RLRELLCEL (PRAME_HUMAN)
RNRELLCEK

SEQ ID NO: 147293 - protein, 10 aa, Artificial Sequence
  Description of Artificial Sequence: Synthetic peptide
  Seed: SNLTHVLYPV (PRAME_HUMAN)
SALTHVLYPA

SEQ ID NO: 147294 - protein, 10 aa, Artificial Sequence
  Description of Artificial Sequence: Synthetic peptide
  Seed: RLWGSIQSRY (PRAME_HUMAN)
RTWGSIQSRW

SEQ ID NO: 147295 - protein, 9 aa, Artificial Sequence
  Description of Artificial Sequence: Synthetic peptide
  Seed: FYDPEPILC (PRAME_HUMAN)
FNDPEPILL

SEQ ID NO: 147296 - protein, 9 aa, Artificial Sequence
  Description of Artificial Sequence: Synthetic peptide
  Seed: SIQSRYISM (PRAME_HUMAN)
SPQSRYISV

SEQ ID NO: 147297 - protein, 10 aa, Artificial Sequence
  Description of Artificial Sequence: Synthetic peptide
  Seed: IQSRYISMSV (PRAME_HUMAN)
IQSRYISMSM

SEQ ID NO: 147298 - protein, 10 aa, Artificial Sequence
  Description of Artificial Sequence: Synthetic peptide
  Seed: RRLLLSHIHA (PRAME_HUMAN)
RRLLLSHIHV

SEQ ID NO: 147299 - protein, 10 aa, Artificial Sequence
  Description of Artificial Sequence: Synthetic peptide
  Seed: SPSVSQLSVL (PRAME_HUMAN)
SESVSQLSVY

SEQ ID NO: 147300 - protein, 9 aa, Artificial Sequence
  Description of Artificial Sequence: Synthetic peptide
  Seed: AWPFTCLPL (PRAME_HUMAN)
AFPFTCLPY

SEQ ID NO: 147301 - protein, 9 aa, Artificial Sequence
  Description of Artificial Sequence: Synthetic peptide
  Seed: SYEDIHGTL (PRAME_HUMAN)
SFEDIHGTY

SEQ ID NO: 147302 - protein, 10 aa, Artificial Sequence
  Description of Artificial Sequence: Synthetic peptide
  Seed: TLQDLVFDEC (PRAME_HUMAN)
TIQDLVFDEV

SEQ ID NO: 147303 - protein, 9 aa, Artificial Sequence
  Description of Artificial Sequence: Synthetic peptide
  Seed: FYDPEPILC (PRAME_HUMAN)
FNDPEPILV

SEQ ID NO: 147304 - protein, 11 aa, Artificial Sequence
  Description of Artificial Sequence: Synthetic peptide
  Seed: FKAVLDGLDVL (PRAME_HUMAN)
FYAVLDGLDVV

SEQ ID NO: 147305 - protein, 10 aa, Artificial Sequence
  Description of Artificial Sequence: Synthetic peptide
  Seed: QSLLQHLIGL (PRAME_HUMAN)
QDLLQHLIGV

SEQ ID NO: 147306 - protein, 9 aa, Artificial Sequence
  Description of Artificial Sequence: Synthetic peptide
  Seed: CKKLKIFAM (PRAME_HUMAN)
CAKLKIFAI

SEQ ID NO: 147307 - protein, 9 aa, Artificial Sequence
  Description of Artificial Sequence: Synthetic peptide
  Seed: AAFDGRHSQ (PRAME_HUMAN)
AGFDGRHSF

SEQ ID NO: 147308 - protein, 9 aa, Artificial Sequence
  Description of Artificial Sequence: Synthetic peptide
  Seed: FYDPEPILC (PRAME_HUMAN)
FCDPEPILM

SEQ ID NO: 147309 - protein, 10 aa, Artificial Sequence
  Description of Artificial Sequence: Synthetic peptide
  Seed: YEDIHGTLHL (PRAME_HUMAN)
YFDIHGTLHI

SEQ ID NO: 147310 - protein, 10 aa, Artificial Sequence
  Description of Artificial Sequence: Synthetic peptide
  Seed: FAMPMQDIKM (PRAME_HUMAN)
FIMPMQDIKV

SEQ ID NO: 147311 - protein, 9 aa, Artificial Sequence
  Description of Artificial Sequence: Synthetic peptide
  Seed: KLKIFAMPM (PRAME_HUMAN)
KAKIFAMPG

SEQ ID NO: 147312 - protein, 11 aa, Artificial Sequence
  Description of Artificial Sequence: Synthetic peptide
  Seed: GTLHLERLAYL (PRAME_HUMAN)
GYLHLERLAYI

SEQ ID NO: 147313 - protein, 10 aa, Artificial Sequence
  Description of Artificial Sequence: Synthetic peptide
  Seed: RRWKLQVLDL (PRAME_HUMAN)
RRWKLQVLDG

SEQ ID NO: 147314 - protein, 9 aa, Artificial Sequence
  Description of Artificial Sequence: Synthetic peptide
  Seed: SVLSLSGVM (PRAME_HUMAN)
SPLSLSGVF

SEQ ID NO: 147315 - protein, 9 aa, Artificial Sequence
  Description of Artificial Sequence: Synthetic peptide
  Seed: ITDDQLLAL (PRAME_HUMAN)
ILDDQLLAR

SEQ ID NO: 147316 - protein, 9 aa, Artificial Sequence
  Description of Artificial Sequence: Synthetic peptide
  Seed: CSQLTTLSF (PRAME_HUMAN)
CVQLTTLSW

SEQ ID NO: 147317 - protein, 10 aa, Artificial Sequence
  Description of Artificial Sequence: Synthetic peptide
  Seed: CSQLTTLSFY (PRAME_HUMAN)
CQQLTTLSFY

SEQ ID NO: 147318 - protein, 10 aa, Artificial Sequence
  Description of Artificial Sequence: Synthetic peptide
  Seed: LSQSPSVSQL (PRAME_HUMAN)
LIQSPSVSQM

SEQ ID NO: 147319 - protein, 9 aa, Artificial Sequence
  Description of Artificial Sequence: Synthetic peptide
  Seed: KAVLDGLDV (PRAME_HUMAN)
KQVLDGLDV

SEQ ID NO: 147320 - protein, 9 aa, Artificial Sequence
  Description of Artificial Sequence: Synthetic peptide
  Seed: SISALQSLL (PRAME_HUMAN)
SASALQSLM

SEQ ID NO: 147321 - protein, 10 aa, Artificial Sequence
  Description of Artificial Sequence: Synthetic peptide
  Seed: MSVWTSPRRL (PRAME_HUMAN)
MSVWTSPRRF

SEQ ID NO: 147322 - protein, 11 aa, Artificial Sequence
  Description of Artificial Sequence: Synthetic peptide
  Seed: LLLSHIHASSY (PRAME_HUMAN)
LCLSHIHASSW

SEQ ID NO: 147323 - protein, 10 aa, Artificial Sequence
  Description of Artificial Sequence: Synthetic peptide
  Seed: SISISALQSL (PRAME_HUMAN)
SNSISALQSY

SEQ ID NO: 147324 - protein, 10 aa, Artificial Sequence
  Description of Artificial Sequence: Synthetic peptide
  Seed: RLVELAGQSL (PRAME_HUMAN)
RIVELAGQSV

SEQ ID NO: 147325 - protein, 9 aa, Artificial Sequence
  Description of Artificial Sequence: Synthetic peptide
  Seed: YEDIHGTLH (PRAME_HUMAN)
YTDIHGTLK

SEQ ID NO: 147326 - protein, 10 aa, Artificial Sequence
  Description of Artificial Sequence: Synthetic peptide
  Seed: YVDSLFFLRG (PRAME_HUMAN)
YFDSLFFLRR

SEQ ID NO: 147327 - protein, 10 aa, Artificial Sequence
  Description of Artificial Sequence: Synthetic peptide
  Seed: AQFTSQFLSL (PRAME_HUMAN)
ASFTSQFLSF

SEQ ID NO: 147328 - protein, 10 aa, Artificial Sequence
  Description of Artificial Sequence: Synthetic peptide
  Seed: MERRRLWGSI (PRAME_HUMAN)
MLRRRLWGSF

SEQ ID NO: 147329 - protein, 10 aa, Artificial Sequence
  Description of Artificial Sequence: Synthetic peptide
  Seed: DFWTVWSGNR (PRAME_HUMAN)
DVWTVWSGNR

SEQ ID NO: 147330 - protein, 9 aa, Artificial Sequence
  Description of Artificial Sequence: Synthetic peptide
  Seed: GLSNLTHVL (PRAME_HUMAN)
GLSNLTHVI

SEQ ID NO: 147331 - protein, 10 aa, Artificial Sequence
  Description of Artificial Sequence: Synthetic peptide
  Seed: YLHARLRELL (PRAME_HUMAN)
YLHARLRELM

SEQ ID NO: 147332 - protein, 9 aa, Artificial Sequence
  Description of Artificial Sequence: Synthetic peptide
  Seed: IGLSNLTHV (PRAME_HUMAN)
ITLSNLTHA

SEQ ID NO: 147333 - protein, 10 aa, Artificial Sequence
  Description of Artificial Sequence: Synthetic peptide
  Seed: GQMINLRRLL (PRAME_HUMAN)
GRMINLRRLM

SEQ ID NO: 147334 - protein, 9 aa, Artificial Sequence
  Description of Artificial Sequence: Synthetic peptide
  Seed: RLRELLCEL (PRAME_HUMAN)
RPRELLCEC

SEQ ID NO: 147335 - protein, 10 aa, Artificial Sequence
  Description of Artificial Sequence: Synthetic peptide
  Seed: LSFYGNSISI (PRAME_HUMAN)
LWFYGNSISM

SEQ ID NO: 147336 - protein, 9 aa, Artificial Sequence
  Description of Artificial Sequence: Synthetic peptide
  Seed: YIAQFTSQF (PRAME_HUMAN)
YMAQFTSQV

SEQ ID NO: 147337 - protein, 9 aa, Artificial Sequence
  Description of Artificial Sequence: Synthetic peptide
  Seed: LTDVSPEPL (PRAME_HUMAN)
LYDVSPEPV

SEQ ID NO: 147338 - protein, 9 aa, Artificial Sequence
  Description of Artificial Sequence: Synthetic peptide
  Seed: SYEDIHGTL (PRAME_HUMAN)
STEDIHGTI

SEQ ID NO: 147339 - protein, 9 aa, Artificial Sequence
  Description of Artificial Sequence: Synthetic peptide
  Seed: RTFYDPEPI (PRAME_HUMAN)
RQFYDPEPI

SEQ ID NO: 147340 - protein, 9 aa, Artificial Sequence
  Description of Artificial Sequence: Synthetic peptide
  Seed: YVDSLFFLR (PRAME_HUMAN)
YIDSLFFLY

SEQ ID NO: 147341 - protein, 10 aa, Artificial Sequence
  Description of Artificial Sequence: Synthetic peptide
  Seed: LLLSHIHASS (PRAME_HUMAN)
LLLSHIHASA

SEQ ID NO: 147342 - protein, 10 aa, Artificial Sequence
  Description of Artificial Sequence: Synthetic peptide
  Seed: ITDDQLLALL (PRAME_HUMAN)
IVDDQLLALY

SEQ ID NO: 147343 - protein, 9 aa, Artificial Sequence
  Description of Artificial Sequence: Synthetic peptide
  Seed: LSLQCLQAL (PRAME_HUMAN)
LVLQCLQAA

SEQ ID NO: 147344 - protein, 9 aa, Artificial Sequence
  Description of Artificial Sequence: Synthetic peptide
  Seed: LELLPRELF (PRAME_HUMAN)
LQLLPRELM

SEQ ID NO: 147345 - protein, 11 aa, Artificial Sequence
  Description of Artificial Sequence: Synthetic peptide
  Seed: AAFDGRHSQTL (PRAME_HUMAN)
ATFDGRHSQTR

SEQ ID NO: 147346 - protein, 10 aa, Artificial Sequence
  Description of Artificial Sequence: Synthetic peptide
  Seed: TVWSGNRASL (PRAME_HUMAN)
TMWSGNRASV

SEQ ID NO: 147347 - protein, 9 aa, Artificial Sequence
  Description of Artificial Sequence: Synthetic peptide
  Seed: ITDDQLLAL (PRAME_HUMAN)
IFDDQLLAY

SEQ ID NO: 147348 - protein, 9 aa, Artificial Sequence
  Description of Artificial Sequence: Synthetic peptide
  Seed: ALYVDSLFF (PRAME_HUMAN)
AQYVDSLFM

SEQ ID NO: 147349 - protein, 10 aa, Artificial Sequence
  Description of Artificial Sequence: Synthetic peptide
  Seed: RYISMSVWTS (PRAME_HUMAN)
RFISMSVWTL

SEQ ID NO: 147350 - protein, 9 aa, Artificial Sequence
  Description of Artificial Sequence: Synthetic peptide
  Seed: CELGRPSMV (PRAME_HUMAN)
CELGRPSML

SEQ ID NO: 147351 - protein, 9 aa, Artificial Sequence
  Description of Artificial Sequence: Synthetic peptide
  Seed: FYDPEPILC (PRAME_HUMAN)
FPDPEPILL

SEQ ID NO: 147352 - protein, 11 aa, Artificial Sequence
  Description of Artificial Sequence: Synthetic peptide
  Seed: LSNLTHVLYPV (PRAME_HUMAN)
LGNLTHVLYPV

SEQ ID NO: 147353 - protein, 9 aa, Artificial Sequence
  Description of Artificial Sequence: Synthetic peptide
  Seed: SFYGNSISI (PRAME_HUMAN)
SKYGNSISW

SEQ ID NO: 147354 - protein, 10 aa, Artificial Sequence
  Description of Artificial Sequence: Synthetic peptide
  Seed: YLHARLRELL (PRAME_HUMAN)
YMHARLRELM

SEQ ID NO: 147355 - protein, 10 aa, Artificial Sequence
  Description of Artificial Sequence: Synthetic peptide
  Seed: ALLERASATL (PRAME_HUMAN)
AQLERASATY

SEQ ID NO: 147356 - protein, 9 aa, Artificial Sequence
  Description of Artificial Sequence: Synthetic peptide
  Seed: YGNSISISA (PRAME_HUMAN)
YANSISISY

SEQ ID NO: 147357 - protein, 10 aa, Artificial Sequence
  Description of Artificial Sequence: Synthetic peptide
  Seed: VRPRRWKLQV (PRAME_HUMAN)
VDPRRWKLQL

SEQ ID NO: 147358 - protein, 11 aa, Artificial Sequence
  Description of Artificial Sequence: Synthetic peptide
  Seed: ALYVDSLFFLR (PRAME_HUMAN)
ALYVDSLFFLD

SEQ ID NO: 147359 - protein, 10 aa, Artificial Sequence
  Description of Artificial Sequence: Synthetic peptide
  Seed: YIAQFTSQFL (PRAME_HUMAN)
YEAQFTSQFY

SEQ ID NO: 147360 - protein, 10 aa, Artificial Sequence
  Description of Artificial Sequence: Synthetic peptide
  Seed: VTCTWKLPTL (PRAME_HUMAN)
VTCTWKLPTW

SEQ ID NO: 147361 - protein, 10 aa, Artificial Sequence
  Description of Artificial Sequence: Synthetic peptide
  Seed: SNLTHVLYPV (PRAME_HUMAN)
SQLTHVLYPV

SEQ ID NO: 147362 - protein, 9 aa, Artificial Sequence
  Description of Artificial Sequence: Synthetic peptide
  Seed: RELFPPLFM (PRAME_HUMAN)
RVLFPPLFF

SEQ ID NO: 147363 - protein, 9 aa, Artificial Sequence
  Description of Artificial Sequence: Synthetic peptide
  Seed: KVDGLSTEA (PRAME_HUMAN)
KQDGLSTEL

SEQ ID NO: 147364 - protein, 9 aa, Artificial Sequence
  Description of Artificial Sequence: Synthetic peptide
  Seed: ISISALQSL (PRAME_HUMAN)
IYISALQSF

SEQ ID NO: 147365 - protein, 9 aa, Artificial Sequence
  Description of Artificial Sequence: Synthetic peptide
  Seed: LLLSHIHAS (PRAME_HUMAN)
LMLSHIHAL

SEQ ID NO: 147366 - protein, 9 aa, Artificial Sequence
  Description of Artificial Sequence: Synthetic peptide
  Seed: LAIAALELL (PRAME_HUMAN)
LVIAALELY

SEQ ID NO: 147367 - protein, 9 aa, Artificial Sequence
  Description of Artificial Sequence: Synthetic peptide
  Seed: QALYVDSLF (PRAME_HUMAN)
QMLYVDSLM

SEQ ID NO: 147368 - protein, 9 aa, Artificial Sequence
  Description of Artificial Sequence: Synthetic peptide
  Seed: GLSNLTHVL (PRAME_HUMAN)
GMSNLTHVW

SEQ ID NO: 147369 - protein, 10 aa, Artificial Sequence
  Description of Artificial Sequence: Synthetic peptide
  Seed: CTWKLPTLAK (PRAME_HUMAN)
CVWKLPTLAK

SEQ ID NO: 147370 - protein, 10 aa, Artificial Sequence
  Description of Artificial Sequence: Synthetic peptide
  Seed: QAWPFTCLPL (PRAME_HUMAN)
QIWPFTCLPF

SEQ ID NO: 147371 - protein, 9 aa, Artificial Sequence
  Description of Artificial Sequence: Synthetic peptide
  Seed: YIAQFTSQF (PRAME_HUMAN)
YAAQFTSQY

SEQ ID NO: 147372 - protein, 10 aa, Artificial Sequence
  Description of Artificial Sequence: Synthetic peptide
  Seed: ALELLPRELF (PRAME_HUMAN)
ADELLPRELW

SEQ ID NO: 147373 - protein, 9 aa, Artificial Sequence
  Description of Artificial Sequence: Synthetic peptide
  Seed: MHLSQSPSV (PRAME_HUMAN)
MKLSQSPSL

SEQ ID NO: 147374 - protein, 9 aa, Artificial Sequence
  Description of Artificial Sequence: Synthetic peptide
  Seed: ACDELFSYL (PRAME_HUMAN)
ALDELFSYM

SEQ ID NO: 147375 - protein, 9 aa, Artificial Sequence
  Description of Artificial Sequence: Synthetic peptide
  Seed: SQSPSVSQL (PRAME_HUMAN)
SKSPSVSQF

SEQ ID NO: 147376 - protein, 10 aa, Artificial Sequence
  Description of Artificial Sequence: Synthetic peptide
  Seed: LLSHIHASSY (PRAME_HUMAN)
LYSHIHASSW

SEQ ID NO: 147377 - protein, 11 aa, Artificial Sequence
  Description of Artificial Sequence: Synthetic peptide
  Seed: SLLKDEALAIA (PRAME_HUMAN)
SLLKDEALAIV

SEQ ID NO: 147378 - protein, 10 aa, Artificial Sequence
  Description of Artificial Sequence: Synthetic peptide
  Seed: DVSPEPLQAL (PRAME_HUMAN)
DMSPEPLQAW

SEQ ID NO: 147379 - protein, 10 aa, Artificial Sequence
  Description of Artificial Sequence: Synthetic peptide
  Seed: MVQAWPFTCL (PRAME_HUMAN)
MTQAWPFTCL

SEQ ID NO: 147380 - protein, 9 aa, Artificial Sequence
  Description of Artificial Sequence: Synthetic peptide
  Seed: WKLPTLAKF (PRAME_HUMAN)
WHLPTLAKY

SEQ ID NO: 147381 - protein, 8 aa, Artificial Sequence
  Description of Artificial Sequence: Synthetic peptide
  Seed: ITDDQLLA (PRAME_HUMAN)
ITDDQLLV

SEQ ID NO: 147382 - protein, 9 aa, Artificial Sequence
  Description of Artificial Sequence: Synthetic peptide
  Seed: LYPVPLESY (PRAME_HUMAN)
LTPVPLESF

SEQ ID NO: 147383 - protein, 9 aa, Artificial Sequence
  Description of Artificial Sequence: Synthetic peptide
  Seed: TDDQLLALL (PRAME_HUMAN)
TYDQLLALV

SEQ ID NO: 147384 - protein, 9 aa, Artificial Sequence
  Description of Artificial Sequence: Synthetic peptide
  Seed: KLKIFAMPM (PRAME_HUMAN)
KSKIFAMPG

SEQ ID NO: 147385 - protein, 9 aa, Artificial Sequence
  Description of Artificial Sequence: Synthetic peptide
  Seed: YEDIHGTLH (PRAME_HUMAN)
YSDIHGTLY

SEQ ID NO: 147386 - protein, 10 aa, Artificial Sequence
  Description of Artificial Sequence: Synthetic peptide
  Seed: IGLSNLTHVL (PRAME_HUMAN)
IPLSNLTHVL

SEQ ID NO: 147387 - protein, 10 aa, Artificial Sequence
  Description of Artificial Sequence: Synthetic peptide
  Seed: ETFKAVLDGL (PRAME_HUMAN)
EIFKAVLDGV

SEQ ID NO: 147388 - protein, 9 aa, Artificial Sequence
  Description of Artificial Sequence: Synthetic peptide
  Seed: SISALQSLL (PRAME_HUMAN)
SISALQSLI

SEQ ID NO: 147389 - protein, 9 aa, Artificial Sequence
  Description of Artificial Sequence: Synthetic peptide
  Seed: SLLQHLIGL (PRAME_HUMAN)
SLLQHLIGY

SEQ ID NO: 147390 - protein, 10 aa, Artificial Sequence
  Description of Artificial Sequence: Synthetic peptide
  Seed: SALQSLLQHL (PRAME_HUMAN)
SWLQSLLQHL

SEQ ID NO: 147391 - protein, 9 aa, Artificial Sequence
  Description of Artificial Sequence: Synthetic peptide
  Seed: SISALQSLL (PRAME_HUMAN)
SMSALQSLV

SEQ ID NO: 147392 - protein, 9 aa, Artificial Sequence
  Description of Artificial Sequence: Synthetic peptide
  Seed: ALAIAALEL (PRAME_HUMAN)
ASAIAALEL

SEQ ID NO: 147393 - protein, 9 aa, Artificial Sequence
  Description of Artificial Sequence: Synthetic peptide
  Seed: ITDDQLLAL (PRAME_HUMAN)
IADDQLLAY

SEQ ID NO: 147394 - protein, 10 aa, Artificial Sequence
  Description of Artificial Sequence: Synthetic peptide
  Seed: LLLSHIHASS (PRAME_HUMAN)
LHLSHIHASL

SEQ ID NO: 147395 - protein, 11 aa, Artificial Sequence
  Description of Artificial Sequence: Synthetic peptide
  Seed: RRLWGSIQSRY (PRAME_HUMAN)
RYLWGSIQSRR

SEQ ID NO: 147396 - protein, 9 aa, Artificial Sequence
  Description of Artificial Sequence: Synthetic peptide
  Seed: VSPEPLQAL (PRAME_HUMAN)
VTPEPLQAK

SEQ ID NO: 147397 - protein, 9 aa, Artificial Sequence
  Description of Artificial Sequence: Synthetic peptide
  Seed: LLKDEALAI (PRAME_HUMAN)
LMKDEALAA

SEQ ID NO: 147398 - protein, 10 aa, Artificial Sequence
  Description of Artificial Sequence: Synthetic peptide
  Seed: MLTDVSPEPL (PRAME_HUMAN)
MLTDVSPEPM

SEQ ID NO: 147399 - protein, 9 aa, Artificial Sequence
  Description of Artificial Sequence: Synthetic peptide
  Seed: YIAQFTSQF (PRAME_HUMAN)
YPAQFTSQY

SEQ ID NO: 147400 - protein, 10 aa, Artificial Sequence
  Description of Artificial Sequence: Synthetic peptide
  Seed: MERRRLWGSI (PRAME_HUMAN)
MTRRRLWGSL

SEQ ID NO: 147401 - protein, 10 aa, Artificial Sequence
  Description of Artificial Sequence: Synthetic peptide
  Seed: SISISALQSL (PRAME_HUMAN)
SRSISALQSF

SEQ ID NO: 147402 - protein, 11 aa, Artificial Sequence
  Description of Artificial Sequence: Synthetic peptide
  Seed: KAVLDGLDVLL (PRAME_HUMAN)
KLVLDGLDVLL

SEQ ID NO: 147403 - protein, 9 aa, Artificial Sequence
  Description of Artificial Sequence: Synthetic peptide
  Seed: AMVQAWPFT (PRAME_HUMAN)
AQVQAWPFA

SEQ ID NO: 147404 - protein, 9 aa, Artificial Sequence
  Description of Artificial Sequence: Synthetic peptide
  Seed: FLRGRLDQL (PRAME_HUMAN)
FMRGRLDQA

SEQ ID NO: 147405 - protein, 9 aa, Artificial Sequence
  Description of Artificial Sequence: Synthetic peptide
  Seed: LSVLSLSGV (PRAME_HUMAN)
LQVLSLSGI

SEQ ID NO: 147406 - protein, 11 aa, Artificial Sequence
  Description of Artificial Sequence: Synthetic peptide
  Seed: RLWGSIQSRYI (PRAME_HUMAN)
RMWGSIQSRYV

SEQ ID NO: 147407 - protein, 9 aa, Artificial Sequence
  Description of Artificial Sequence: Synthetic peptide
  Seed: KVDGLSTEA (PRAME_HUMAN)
KGDGLSTEV

SEQ ID NO: 147408 - protein, 8 aa, Artificial Sequence
  Description of Artificial Sequence: Synthetic peptide
  Seed: YVDSLFFL (PRAME_HUMAN)
YMDSLFFI

SEQ ID NO: 147409 - protein, 10 aa, Artificial Sequence
  Description of Artificial Sequence: Synthetic peptide
  Seed: LLPRELFPPL (PRAME_HUMAN)
LAPRELFPPM

SEQ ID NO: 147410 - protein, 10 aa, Artificial Sequence
  Description of Artificial Sequence: Synthetic peptide
  Seed: VLYPVPLESY (PRAME_HUMAN)
VHYPVPLESY

SEQ ID NO: 147411 - protein, 11 aa, Artificial Sequence
  Description of Artificial Sequence: Synthetic peptide
  Seed: LTDVSPEPLQA (PRAME_HUMAN)
LTDVSPEPLQL

SEQ ID NO: 147412 - protein, 9 aa, Artificial Sequence
  Description of Artificial Sequence: Synthetic peptide
  Seed: MNPLETLSI (PRAME_HUMAN)
MLPLETLSM

SEQ ID NO: 147413 - protein, 10 aa, Artificial Sequence
  Description of Artificial Sequence: Synthetic peptide
  Seed: RLVELAGQSL (PRAME_HUMAN)
RVVELAGQSL

SEQ ID NO: 147414 - protein, 9 aa, Artificial Sequence
  Description of Artificial Sequence: Synthetic peptide
  Seed: VLMKGQHLH (PRAME_HUMAN)
VQMKGQHLM

SEQ ID NO: 147415 - protein, 9 aa, Artificial Sequence
  Description of Artificial Sequence: Synthetic peptide
  Seed: SVLSLSGVM (PRAME_HUMAN)
SILSLSGVW

SEQ ID NO: 147416 - protein, 9 aa, Artificial Sequence
  Description of Artificial Sequence: Synthetic peptide
  Seed: ESYEDIHGT (PRAME_HUMAN)
ETYEDIHGC

SEQ ID NO: 147417 - protein, 9 aa, Artificial Sequence
  Description of Artificial Sequence: Synthetic peptide
  Seed: ELFPPLFMA (PRAME_HUMAN)
ECFPPLFMV

SEQ ID NO: 147418 - protein, 9 aa, Artificial Sequence
  Description of Artificial Sequence: Synthetic peptide
  Seed: ISISALQSL (PRAME_HUMAN)
IAISALQSF

SEQ ID NO: 147419 - protein, 9 aa, Artificial Sequence
  Description of Artificial Sequence: Synthetic peptide
  Seed: KAMVQAWPF (PRAME_HUMAN)
KYMVQAWPV

SEQ ID NO: 147420 - protein, 9 aa, Artificial Sequence
  Description of Artificial Sequence: Synthetic peptide
  Seed: NSISISALQ (PRAME_HUMAN)
NLISISALR

SEQ ID NO: 147421 - protein, 10 aa, Artificial Sequence
  Description of Artificial Sequence: Synthetic peptide
  Seed: QAWPFTCLPL (PRAME_HUMAN)
QWWPFTCLPW

SEQ ID NO: 147422 - protein, 10 aa, Artificial Sequence
  Description of Artificial Sequence: Synthetic peptide
  Seed: SLQCLQALYV (PRAME_HUMAN)
SLQCLQALYL

SEQ ID NO: 147423 - protein, 9 aa, Artificial Sequence
  Description of Artificial Sequence: Synthetic peptide
  Seed: TFKAVLDGL (PRAME_HUMAN)
TYKAVLDGF

SEQ ID NO: 147424 - protein, 11 aa, Artificial Sequence
  Description of Artificial Sequence: Synthetic peptide
  Seed: QALYVDSLFFL (PRAME_HUMAN)
QHLYVDSLFFF

SEQ ID NO: 147425 - protein, 10 aa, Artificial Sequence
  Description of Artificial Sequence: Synthetic peptide
  Seed: RLAYLHARLR (PRAME_HUMAN)
RHAYLHARLK

SEQ ID NO: 147426 - protein, 10 aa, Artificial Sequence
  Description of Artificial Sequence: Synthetic peptide
  Seed: RHVMNPLETL (PRAME_HUMAN)
REVMNPLETY

SEQ ID NO: 147427 - protein, 9 aa, Artificial Sequence
  Description of Artificial Sequence: Synthetic peptide
  Seed: ESYEDIHGT (PRAME_HUMAN)
EAYEDIHGL

SEQ ID NO: 147428 - protein, 9 aa, Artificial Sequence
  Description of Artificial Sequence: Synthetic peptide
  Seed: LDVLLAQEV (PRAME_HUMAN)
LEVLLAQEV

SEQ ID NO: 147429 - protein, 9 aa, Artificial Sequence
  Description of Artificial Sequence: Synthetic peptide
  Seed: KLKIFAMPM (PRAME_HUMAN)
KKKIFAMPF

SEQ ID NO: 147430 - protein, 10 aa, Artificial Sequence
  Description of Artificial Sequence: Synthetic peptide
  Seed: GRPSMVWLSA (PRAME_HUMAN)
GIPSMVWLSL

SEQ ID NO: 147431 - protein, 10 aa, Artificial Sequence
  Description of Artificial Sequence: Synthetic peptide
  Seed: KVKRKKNVLR (PRAME_HUMAN)
KAKRKKNVLK

SEQ ID NO: 147432 - protein, 10 aa, Artificial Sequence
  Description of Artificial Sequence: Synthetic peptide
  Seed: LPTLAKFSPY (PRAME_HUMAN)
LPTLAKFSPW

SEQ ID NO: 147433 - protein, 9 aa, Artificial Sequence
  Description of Artificial Sequence: Synthetic peptide
  Seed: GQHLHLETF (PRAME_HUMAN)
GQHLHLETW

SEQ ID NO: 147434 - protein, 9 aa, Artificial Sequence
  Description of Artificial Sequence: Synthetic peptide
  Seed: LQSLLQHLI (PRAME_HUMAN)
LQSLLQHLY

SEQ ID NO: 147435 - protein, 8 aa, Artificial Sequence
  Description of Artificial Sequence: Synthetic peptide
  Seed: YEDIHGTL (PRAME_HUMAN)
YRDIHGTL

SEQ ID NO: 147436 - protein, 9 aa, Artificial Sequence
  Description of Artificial Sequence: Synthetic peptide
  Seed: MPMQDIKMI (PRAME_HUMAN)
MPMQDIKMY

SEQ ID NO: 147437 - protein, 10 aa, Artificial Sequence
  Description of Artificial Sequence: Synthetic peptide
  Seed: LLSHIHASSY (PRAME_HUMAN)
LKSHIHASSY

SEQ ID NO: 147438 - protein, 9 aa, Artificial Sequence
  Description of Artificial Sequence: Synthetic peptide
  Seed: SYEDIHGTL (PRAME_HUMAN)
SLEDIHGTL

SEQ ID NO: 147439 - protein, 9 aa, Artificial Sequence
  Description of Artificial Sequence: Synthetic peptide
  Seed: VLSLSGVML (PRAME_HUMAN)
VMSLSGVMY

SEQ ID NO: 147440 - protein, 9 aa, Artificial Sequence
  Description of Artificial Sequence: Synthetic peptide
  Seed: MHLSQSPSV (PRAME_HUMAN)
MILSQSPSF

SEQ ID NO: 147441 - protein, 10 aa, Artificial Sequence
  Description of Artificial Sequence: Synthetic peptide
  Seed: IQSRYISMSV (PRAME_HUMAN)
IYSRYISMSA

SEQ ID NO: 147442 - protein, 10 aa, Artificial Sequence
  Description of Artificial Sequence: Synthetic peptide
  Seed: AVLDGLDVLL (PRAME_HUMAN)
ALLDGLDVLI

SEQ ID NO: 147443 - protein, 9 aa, Artificial Sequence
  Description of Artificial Sequence: Synthetic peptide
  Seed: SFYGNSISI (PRAME_HUMAN)
SQYGNSISF

SEQ ID NO: 147444 - protein, 10 aa, Artificial Sequence
  Description of Artificial Sequence: Synthetic peptide
  Seed: ARLRELLCEL (PRAME_HUMAN)
AALRELLCEA

SEQ ID NO: 147445 - protein, 9 aa, Artificial Sequence
  Description of Artificial Sequence: Synthetic peptide
  Seed: LSTEAEQPF (PRAME_HUMAN)
LKTEAEQPM

SEQ ID NO: 147446 - protein, 9 aa, Artificial Sequence
  Description of Artificial Sequence: Synthetic peptide
  Seed: SVLSLSGVM (PRAME_HUMAN)
SQLSLSGVL

SEQ ID NO: 147447 - protein, 9 aa, Artificial Sequence
  Description of Artificial Sequence: Synthetic peptide
  Seed: MVQAWPFTC (PRAME_HUMAN)
MAQAWPFTV

SEQ ID NO: 147448 - protein, 9 aa, Artificial Sequence
  Description of Artificial Sequence: Synthetic peptide
  Seed: SLQCLQALY (PRAME_HUMAN)
SSQCLQALY

SEQ ID NO: 147449 - protein, 10 aa, Artificial Sequence
  Description of Artificial Sequence: Synthetic peptide
  Seed: RGRLDQLLRH (PRAME_HUMAN)
RWRLDQLLRK

SEQ ID NO: 147450 - protein, 9 aa, Artificial Sequence
  Description of Artificial Sequence: Synthetic peptide
  Seed: VWSGNRASL (PRAME_HUMAN)
VSSGNRASL

SEQ ID NO: 147451 - protein, 9 aa, Artificial Sequence
  Description of Artificial Sequence: Synthetic peptide
  Seed: VLDGLDVLL (PRAME_HUMAN)
VTDGLDVLF

SEQ ID NO: 147452 - protein, 9 aa, Artificial Sequence
  Description of Artificial Sequence: Synthetic peptide
  Seed: SIQSRYISM (PRAME_HUMAN)
SQQSRYISY

SEQ ID NO: 147453 - protein, 9 aa, Artificial Sequence
  Description of Artificial Sequence: Synthetic peptide
  Seed: RLAYLHARL (PRAME_HUMAN)
RQAYLHARH

SEQ ID NO: 147454 - protein, 9 aa, Artificial Sequence
  Description of Artificial Sequence: Synthetic peptide
  Seed: LQHLIGLSN (PRAME_HUMAN)
LRHLIGLSY

SEQ ID NO: 147455 - protein, 9 aa, Artificial Sequence
  Description of Artificial Sequence: Synthetic peptide
  Seed: SQLTTLSFY (PRAME_HUMAN)
SILTTLSFR

SEQ ID NO: 147456 - protein, 9 aa, Artificial Sequence
  Description of Artificial Sequence: Synthetic peptide
  Seed: HVMNPLETL (PRAME_HUMAN)
HFMNPLETI

SEQ ID NO: 147457 - protein, 10 aa, Artificial Sequence
  Description of Artificial Sequence: Synthetic peptide
  Seed: MVQAWPFTCL (PRAME_HUMAN)
MIQAWPFTCM

SEQ ID NO: 147458 - protein, 9 aa, Artificial Sequence
  Description of Artificial Sequence: Synthetic peptide
  Seed: RLAYLHARL (PRAME_HUMAN)
RIAYLHARF

SEQ ID NO: 147459 - protein, 11 aa, Artificial Sequence
  Description of Artificial Sequence: Synthetic peptide
  Seed: SNLTHVLYPVP (PRAME_HUMAN)
SLLTHVLYPVY

SEQ ID NO: 147460 - protein, 9 aa, Artificial Sequence
  Description of Artificial Sequence: Synthetic peptide
  Seed: GLSNLTHVL (PRAME_HUMAN)
GISNLTHVL

SEQ ID NO: 147461 - protein, 9 aa, Artificial Sequence
  Description of Artificial Sequence: Synthetic peptide
  Seed: YLHARLREL (PRAME_HUMAN)
YIHARLREI

SEQ ID NO: 147462 - protein, 9 aa, Artificial Sequence
  Description of Artificial Sequence: Synthetic peptide
  Seed: IGLSNLTHV (PRAME_HUMAN)
IVLSNLTHV

SEQ ID NO: 147463 - protein, 11 aa, Artificial Sequence
  Description of Artificial Sequence: Synthetic peptide
  Seed: SQLSVLSLSGV (PRAME_HUMAN)
SILSVLSLSGV

SEQ ID NO: 147464 - protein, 9 aa, Artificial Sequence
  Description of Artificial Sequence: Synthetic peptide
  Seed: VLMKGQHLH (PRAME_HUMAN)
VSMKGQHLY

SEQ ID NO: 147465 - protein, 9 aa, Artificial Sequence
  Description of Artificial Sequence: Synthetic peptide
  Seed: TLHLERLAY (PRAME_HUMAN)
TSHLERLAM

SEQ ID NO: 147466 - protein, 10 aa, Artificial Sequence
  Description of Artificial Sequence: Synthetic peptide
  Seed: IQSRYISMSV (PRAME_HUMAN)
IESRYISMSF

SEQ ID NO: 147467 - protein, 10 aa, Artificial Sequence
  Description of Artificial Sequence: Synthetic peptide
  Seed: KVKRKKNVLR (PRAME_HUMAN)
KVKRKKNVLA

SEQ ID NO: 147468 - protein, 9 aa, Artificial Sequence
  Description of Artificial Sequence: Synthetic peptide
  Seed: YIAQFTSQF (PRAME_HUMAN)
YTAQFTSQI

SEQ ID NO: 147469 - protein, 9 aa, Artificial Sequence
  Description of Artificial Sequence: Synthetic peptide
  Seed: LTDVSPEPL (PRAME_HUMAN)
LMDVSPEPY

SEQ ID NO: 147470 - protein, 9 aa, Artificial Sequence
  Description of Artificial Sequence: Synthetic peptide
  Seed: LQALYVDSL (PRAME_HUMAN)
LKALYVDSL

SEQ ID NO: 147471 - protein, 10 aa, Artificial Sequence
  Description of Artificial Sequence: Synthetic peptide
  Seed: ALELLPRELF (PRAME_HUMAN)
AHELLPRELW

SEQ ID NO: 147472 - protein, 9 aa, Artificial Sequence
  Description of Artificial Sequence: Synthetic peptide
  Seed: YLIEKVKRK (PRAME_HUMAN)
YLIEKVKRL

SEQ ID NO: 147473 - protein, 10 aa, Artificial Sequence
  Description of Artificial Sequence: Synthetic peptide
  Seed: SISISALQSL (PRAME_HUMAN)
SLSISALQSY

SEQ ID NO: 147474 - protein, 11 aa, Artificial Sequence
  Description of Artificial Sequence: Synthetic peptide
  Seed: RRRLWGSIQSR (PRAME_HUMAN)
RRRLWGSIQSY

SEQ ID NO: 147475 - protein, 9 aa, Artificial Sequence
  Description of Artificial Sequence: Synthetic peptide
  Seed: YVDSLFFLR (PRAME_HUMAN)
YADSLFFLL

SEQ ID NO: 147476 - protein, 9 aa, Artificial Sequence
  Description of Artificial Sequence: Synthetic peptide
  Seed: CRLSEGDVM (PRAME_HUMAN)
CMLSEGDVY

SEQ ID NO: 147477 - protein, 9 aa, Artificial Sequence
  Description of Artificial Sequence: Synthetic peptide
  Seed: YLHARLREL (PRAME_HUMAN)
YGHARLREL

SEQ ID NO: 147478 - protein, 10 aa, Artificial Sequence
  Description of Artificial Sequence: Synthetic peptide
  Seed: MVQAWPFTCL (PRAME_HUMAN)
MKQAWPFTCF

SEQ ID NO: 147479 - protein, 9 aa, Artificial Sequence
  Description of Artificial Sequence: Synthetic peptide
  Seed: QMINLRRLL (PRAME_HUMAN)
QMINLRRLY

SEQ ID NO: 147480 - protein, 9 aa, Artificial Sequence
  Description of Artificial Sequence: Synthetic peptide
  Seed: SATLQDLVF (PRAME_HUMAN)
STTLQDLVF

SEQ ID NO: 147481 - protein, 9 aa, Artificial Sequence
  Description of Artificial Sequence: Synthetic peptide
  Seed: AFDGRHSQT (PRAME_HUMAN)
AWDGRHSQM

SEQ ID NO: 147482 - protein, 9 aa, Artificial Sequence
  Description of Artificial Sequence: Synthetic peptide
  Seed: KLKIFAMPM (PRAME_HUMAN)
KVKIFAMPH

SEQ ID NO: 147483 - protein, 9 aa, Artificial Sequence
  Description of Artificial Sequence: Synthetic peptide
  Seed: EDLEVTCTW (PRAME_HUMAN)
ETLEVTCTW

SEQ ID NO: 147484 - protein, 9 aa, Artificial Sequence
  Description of Artificial Sequence: Synthetic peptide
  Seed: CKKLKIFAM (PRAME_HUMAN)
CIKLKIFAI

SEQ ID NO: 147485 - protein, 10 aa, Artificial Sequence
  Description of Artificial Sequence: Synthetic peptide
  Seed: TSQFLSLQCL (PRAME_HUMAN)
TEQFLSLQCF

SEQ ID NO: 147486 - protein, 9 aa, Artificial Sequence
  Description of Artificial Sequence: Synthetic peptide
  Seed: KEEQYIAQF (PRAME_HUMAN)
KQEQYIAQW

SEQ ID NO: 147487 - protein, 9 aa, Artificial Sequence
  Description of Artificial Sequence: Synthetic peptide
  Seed: KMILKMVQL (PRAME_HUMAN)
KKILKMVQY

SEQ ID NO: 147488 - protein, 10 aa, Artificial Sequence
  Description of Artificial Sequence: Synthetic peptide
  Seed: DVSPEPLQAL (PRAME_HUMAN)
DISPEPLQAR

SEQ ID NO: 147489 - protein, 9 aa, Artificial Sequence
  Description of Artificial Sequence: Synthetic peptide
  Seed: LSTEAEQPF (PRAME_HUMAN)
LATEAEQPW

SEQ ID NO: 147490 - protein, 9 aa, Artificial Sequence
  Description of Artificial Sequence: Synthetic peptide
  Seed: SISALQSLL (PRAME_HUMAN)
SQSALQSLM

SEQ ID NO: 147491 - protein, 10 aa, Artificial Sequence
  Description of Artificial Sequence: Synthetic peptide
  Seed: PTLAKFSPYL (PRAME_HUMAN)
PYLAKFSPYL

SEQ ID NO: 147492 - protein, 10 aa, Artificial Sequence
  Description of Artificial Sequence: Synthetic peptide
  Seed: MERRRLWGSI (PRAME_HUMAN)
MLRRRLWGSL

SEQ ID NO: 147493 - protein, 10 aa, Artificial Sequence
  Description of Artificial Sequence: Synthetic peptide
  Seed: TEAEQPFIPV (PRAME_HUMAN)
TEAEQPFIPL

SEQ ID NO: 147494 - protein, 10 aa, Artificial Sequence
  Description of Artificial Sequence: Synthetic peptide
  Seed: SALQSLLQHL (PRAME_HUMAN)
SCLQSLLQHV

SEQ ID NO: 147495 - protein, 9 aa, Artificial Sequence
  Description of Artificial Sequence: Synthetic peptide
  Seed: EQPFIPVEV (PRAME_HUMAN)
ETPFIPVEL

SEQ ID NO: 147496 - protein, 10 aa, Artificial Sequence
  Description of Artificial Sequence: Synthetic peptide
  Seed: KVKRKKNVLR (PRAME_HUMAN)
KFKRKKNVLR

SEQ ID NO: 147497 - protein, 9 aa, Artificial Sequence
  Description of Artificial Sequence: Synthetic peptide
  Seed: KLKIFAMPM (PRAME_HUMAN)
KMKIFAMPF

SEQ ID NO: 147498 - protein, 9 aa, Artificial Sequence
  Description of Artificial Sequence: Synthetic peptide
  Seed: SIQSRYISM (PRAME_HUMAN)
SIQSRYISY

SEQ ID NO: 147499 - protein, 10 aa, Artificial Sequence
  Description of Artificial Sequence: Synthetic peptide
  Seed: IGLSNLTHVL (PRAME_HUMAN)
IQLSNLTHVI

SEQ ID NO: 147500 - protein, 10 aa, Artificial Sequence
  Description of Artificial Sequence: Synthetic peptide
  Seed: KKLKIFAMPM (PRAME_HUMAN)
KTLKIFAMPF

SEQ ID NO: 147501 - protein, 10 aa, Artificial Sequence
  Description of Artificial Sequence: Synthetic peptide
  Seed: RASATLQDLV (PRAME_HUMAN)
RFSATLQDLW

SEQ ID NO: 147502 - protein, 10 aa, Artificial Sequence
  Description of Artificial Sequence: Synthetic peptide
  Seed: SNLTHVLYPV (PRAME_HUMAN)
SLLTHVLYPI

SEQ ID NO: 147503 - protein, 9 aa, Artificial Sequence
  Description of Artificial Sequence: Synthetic peptide
  Seed: VQAWPFTCL (PRAME_HUMAN)
VLAWPFTCA

SEQ ID NO: 147504 - protein, 9 aa, Artificial Sequence
  Description of Artificial Sequence: Synthetic peptide
  Seed: VSPEPLQAL (PRAME_HUMAN)
VYPEPLQAV

SEQ ID NO: 147505 - protein, 9 aa, Artificial Sequence
  Description of Artificial Sequence: Synthetic peptide
  Seed: SVLSLSGVM (PRAME_HUMAN)
SQLSLSGVV

SEQ ID NO: 147506 - protein, 9 aa, Artificial Sequence
  Description of Artificial Sequence: Synthetic peptide
  Seed: VQLDSIEDL (PRAME_HUMAN)
VMLDSIEDM

SEQ ID NO: 147507 - protein, 10 aa, Artificial Sequence
  Description of Artificial Sequence: Synthetic peptide
  Seed: AIAALELLPR (PRAME_HUMAN)
AVAALELLPK

SEQ ID NO: 147508 - protein, 10 aa, Artificial Sequence
  Description of Artificial Sequence: Synthetic peptide
  Seed: RELFPPLFMA (PRAME_HUMAN)
RTLFPPLFMV

SEQ ID NO: 147509 - protein, 10 aa, Artificial Sequence
  Description of Artificial Sequence: Synthetic peptide
  Seed: AAFDGRHSQT (PRAME_HUMAN)
AIFDGRHSQL

SEQ ID NO: 147510 - protein, 9 aa, Artificial Sequence
  Description of Artificial Sequence: Synthetic peptide
  Seed: GQHLHLETF (PRAME_HUMAN)
GEHLHLETA

SEQ ID NO: 147511 - protein, 9 aa, Artificial Sequence
  Description of Artificial Sequence: Synthetic peptide
  Seed: SHIHASSYI (PRAME_HUMAN)
SYIHASSYW

SEQ ID NO: 147512 - protein, 11 aa, Artificial Sequence
  Description of Artificial Sequence: Synthetic peptide
  Seed: LTDVSPEPLQA (PRAME_HUMAN)
LSDVSPEPLQI

SEQ ID NO: 147513 - protein, 9 aa, Artificial Sequence
  Description of Artificial Sequence: Synthetic peptide
  Seed: TSPRRLVEL (PRAME_HUMAN)
TTPRRLVEV

SEQ ID NO: 147514 - protein, 9 aa, Artificial Sequence
  Description of Artificial Sequence: Synthetic peptide
  Seed: LSLQCLQAL (PRAME_HUMAN)
LQLQCLQAL

SEQ ID NO: 147515 - protein, 9 aa, Artificial Sequence
  Description of Artificial Sequence: Synthetic peptide
  Seed: HVMNPLETL (PRAME_HUMAN)
HIMNPLETY

SEQ ID NO: 147516 - protein, 10 aa, Artificial Sequence
  Description of Artificial Sequence: Synthetic peptide
  Seed: QSRYISMSVW (PRAME_HUMAN)
QQRYISMSVW

SEQ ID NO: 147517 - protein, 10 aa, Artificial Sequence
  Description of Artificial Sequence: Synthetic peptide
  Seed: QSLLQHLIGL (PRAME_HUMAN)
QNLLQHLIGV

SEQ ID NO: 147518 - protein, 10 aa, Artificial Sequence
  Description of Artificial Sequence: Synthetic peptide
  Seed: MINLRRLLLS (PRAME_HUMAN)
MMNLRRLLLL

SEQ ID NO: 147519 - protein, 9 aa, Artificial Sequence
  Description of Artificial Sequence: Synthetic peptide
  Seed: LTDVSPEPL (PRAME_HUMAN)
LLDVSPEPI

SEQ ID NO: 147520 - protein, 9 aa, Artificial Sequence
  Description of Artificial Sequence: Synthetic peptide
  Seed: ASATLQDLV (PRAME_HUMAN)
ALATLQDLI

SEQ ID NO: 147521 - protein, 9 aa, Artificial Sequence
  Description of Artificial Sequence: Synthetic peptide
  Seed: SQSPSVSQL (PRAME_HUMAN)
SLSPSVSQR

SEQ ID NO: 147522 - protein, 9 aa, Artificial Sequence
  Description of Artificial Sequence: Synthetic peptide
  Seed: KAMVQAWPF (PRAME_HUMAN)
KWMVQAWPM

SEQ ID NO: 147523 - protein, 9 aa, Artificial Sequence
  Description of Artificial Sequence: Synthetic peptide
  Seed: NSHQDFWTV (PRAME_HUMAN)
NQHQDFWTL

SEQ ID NO: 147524 - protein, 9 aa, Artificial Sequence
  Description of Artificial Sequence: Synthetic peptide
  Seed: VSPEPLQAL (PRAME_HUMAN)
VLPEPLQAI

SEQ ID NO: 147525 - protein, 9 aa, Artificial Sequence
  Description of Artificial Sequence: Synthetic peptide
  Seed: SRYISMSVW (PRAME_HUMAN)
SKYISMSVF

SEQ ID NO: 147526 - protein, 9 aa, Artificial Sequence
  Description of Artificial Sequence: Synthetic peptide
  Seed: SALQSLLQH (PRAME_HUMAN)
SLLQSLLQF

SEQ ID NO: 147527 - protein, 9 aa, Artificial Sequence
  Description of Artificial Sequence: Synthetic peptide
  Seed: GQMINLRRL (PRAME_HUMAN)
GMMINLRRV

SEQ ID NO: 147528 - protein, 10 aa, Artificial Sequence
  Description of Artificial Sequence: Synthetic peptide
  Seed: FYDPEPILCP (PRAME_HUMAN)
FQDPEPILCL

SEQ ID NO: 147529 - protein, 10 aa, Artificial Sequence
  Description of Artificial Sequence: Synthetic peptide
  Seed: GLSNLTHVLY (PRAME_HUMAN)
GQSNLTHVLY

SEQ ID NO: 147530 - protein, 10 aa, Artificial Sequence
  Description of Artificial Sequence: Synthetic peptide
  Seed: KKLKIFAMPM (PRAME_HUMAN)
KLLKIFAMPF

SEQ ID NO: 147531 - protein, 9 aa, Artificial Sequence
  Description of Artificial Sequence: Synthetic peptide
  Seed: HVMNPLETL (PRAME_HUMAN)
HTMNPLETF

SEQ ID NO: 147532 - protein, 10 aa, Artificial Sequence
  Description of Artificial Sequence: Synthetic peptide
  Seed: YIAQFTSQFL (PRAME_HUMAN)
YTAQFTSQFL

SEQ ID NO: 147533 - protein, 9 aa, Artificial Sequence
  Description of Artificial Sequence: Synthetic peptide
  Seed: CSQLTTLSF (PRAME_HUMAN)
CPQLTTLSW

SEQ ID NO: 147534 - protein, 9 aa, Artificial Sequence
  Description of Artificial Sequence: Synthetic peptide
  Seed: ACDELFSYL (PRAME_HUMAN)
AMDELFSYF

SEQ ID NO: 147535 - protein, 9 aa, Artificial Sequence
  Description of Artificial Sequence: Synthetic peptide
  Seed: VQAWPFTCL (PRAME_HUMAN)
VHAWPFTCF

SEQ ID NO: 147536 - protein, 11 aa, Artificial Sequence
  Description of Artificial Sequence: Synthetic peptide
  Seed: LQSLLQHLIGL (PRAME_HUMAN)
LRSLLQHLIGV

SEQ ID NO: 147537 - protein, 9 aa, Artificial Sequence
  Description of Artificial Sequence: Synthetic peptide
  Seed: LAYLHARLR (PRAME_HUMAN)
LTYLHARLR

SEQ ID NO: 147538 - protein, 9 aa, Artificial Sequence
  Description of Artificial Sequence: Synthetic peptide
  Seed: ALQSLLQHL (PRAME_HUMAN)
ALQSLLQHV

SEQ ID NO: 147539 - protein, 9 aa, Artificial Sequence
  Description of Artificial Sequence: Synthetic peptide
  Seed: MHLSQSPSV (PRAME_HUMAN)
MHLSQSPSF

SEQ ID NO: 147540 - protein, 10 aa, Artificial Sequence
  Description of Artificial Sequence: Synthetic peptide
  Seed: LQALYVDSLF (PRAME_HUMAN)
LGALYVDSLW

SEQ ID NO: 147541 - protein, 9 aa, Artificial Sequence
  Description of Artificial Sequence: Synthetic peptide
  Seed: ISISALQSL (PRAME_HUMAN)
IVISALQSV

SEQ ID NO: 147542 - protein, 11 aa, Artificial Sequence
  Description of Artificial Sequence: Synthetic peptide
  Seed: VMLTDVSPEPL (PRAME_HUMAN)
VMLTDVSPEPV

SEQ ID NO: 147543 - protein, 10 aa, Artificial Sequence
  Description of Artificial Sequence: Synthetic peptide
  Seed: MNPLETLSIT (PRAME_HUMAN)
MLPLETLSIV

SEQ ID NO: 147544 - protein, 9 aa, Artificial Sequence
  Description of Artificial Sequence: Synthetic peptide
  Seed: LLKDEALAI (PRAME_HUMAN)
LQKDEALAL

SEQ ID NO: 147545 - protein, 11 aa, Artificial Sequence
  Description of Artificial Sequence: Synthetic peptide
  Seed: WSGNRASLYSF (PRAME_HUMAN)
WSGNRASLYSW

SEQ ID NO: 147546 - protein, 10 aa, Artificial Sequence
  Description of Artificial Sequence: Synthetic peptide
  Seed: ALYVDSLFFL (PRAME_HUMAN)
AVYVDSLFFL

SEQ ID NO: 147547 - protein, 10 aa, Artificial Sequence
  Description of Artificial Sequence: Synthetic peptide
  Seed: SISISALQSL (PRAME_HUMAN)
SLSISALQSI

SEQ ID NO: 147548 - protein, 11 aa, Artificial Sequence
  Description of Artificial Sequence: Synthetic peptide
  Seed: RLVELAGQSLL (PRAME_HUMAN)
RIVELAGQSLW

SEQ ID NO: 147549 - protein, 10 aa, Artificial Sequence
  Description of Artificial Sequence: Synthetic peptide
  Seed: LLPRELFPPL (PRAME_HUMAN)
LHPRELFPPV

SEQ ID NO: 147550 - protein, 9 aa, Artificial Sequence
  Description of Artificial Sequence: Synthetic peptide
  Seed: TSPRRLVEL (PRAME_HUMAN)
TGPRRLVEM

SEQ ID NO: 147551 - protein, 11 aa, Artificial Sequence
  Description of Artificial Sequence: Synthetic peptide
  Seed: TDVSPEPLQAL (PRAME_HUMAN)
TEVSPEPLQAC

SEQ ID NO: 147552 - protein, 10 aa, Artificial Sequence
  Description of Artificial Sequence: Synthetic peptide
  Seed: RGRLDQLLRH (PRAME_HUMAN)
RLRLDQLLRK

SEQ ID NO: 147553 - protein, 9 aa, Artificial Sequence
  Description of Artificial Sequence: Synthetic peptide
  Seed: VQAWPFTCL (PRAME_HUMAN)
VMAWPFTCM

SEQ ID NO: 147554 - protein, 9 aa, Artificial Sequence
  Description of Artificial Sequence: Synthetic peptide
  Seed: LLRHVMNPL (PRAME_HUMAN)
LMRHVMNPM

SEQ ID NO: 147555 - protein, 9 aa, Artificial Sequence
  Description of Artificial Sequence: Synthetic peptide
  Seed: SIEDLEVTC (PRAME_HUMAN)
STEDLEVTL

SEQ ID NO: 147556 - protein, 9 aa, Artificial Sequence
  Description of Artificial Sequence: Synthetic peptide
  Seed: EPLQALLER (PRAME_HUMAN)
ETLQALLEK

SEQ ID NO: 147557 - protein, 9 aa, Artificial Sequence
  Description of Artificial Sequence: Synthetic peptide
  Seed: RWKLQVLDL (PRAME_HUMAN)
RTKLQVLDK

SEQ ID NO: 147558 - protein, 9 aa, Artificial Sequence
  Description of Artificial Sequence: Synthetic peptide
  Seed: DSLFFLRGR (PRAME_HUMAN)
DYLFFLRGR

SEQ ID NO: 147559 - protein, 10 aa, Artificial Sequence
  Description of Artificial Sequence: Synthetic peptide
  Seed: FYDPEPILCP (PRAME_HUMAN)
FFDPEPILCF

SEQ ID NO: 147560 - protein, 9 aa, Artificial Sequence
  Description of Artificial Sequence: Synthetic peptide
  Seed: TCTWKLPTL (PRAME_HUMAN)
TSTWKLPTY

SEQ ID NO: 147561 - protein, 9 aa, Artificial Sequence
  Description of Artificial Sequence: Synthetic peptide
  Seed: RTFYDPEPI (PRAME_HUMAN)
RKFYDPEPF

SEQ ID NO: 147562 - protein, 9 aa, Artificial Sequence
  Description of Artificial Sequence: Synthetic peptide
  Seed: LAYLHARLR (PRAME_HUMAN)
LLYLHARLR

SEQ ID NO: 147563 - protein, 9 aa, Artificial Sequence
  Description of Artificial Sequence: Synthetic peptide
  Seed: TDDQLLALL (PRAME_HUMAN)
TSDQLLALL

SEQ ID NO: 147564 - protein, 10 aa, Artificial Sequence
  Description of Artificial Sequence: Synthetic peptide
  Seed: RGRLDQLLRH (PRAME_HUMAN)
RSRLDQLLRI

SEQ ID NO: 147565 - protein, 10 aa, Artificial Sequence
  Description of Artificial Sequence: Synthetic peptide
  Seed: RHVMNPLETL (PRAME_HUMAN)
RVVMNPLETW

SEQ ID NO: 147566 - protein, 9 aa, Artificial Sequence
  Description of Artificial Sequence: Synthetic peptide
  Seed: SIQSRYISM (PRAME_HUMAN)
SFQSRYISY

SEQ ID NO: 147567 - protein, 9 aa, Artificial Sequence
  Description of Artificial Sequence: Synthetic peptide
  Seed: LYVDSLFFL (PRAME_HUMAN)
LVVDSLFFL

SEQ ID NO: 147568 - protein, 9 aa, Artificial Sequence
  Description of Artificial Sequence: Synthetic peptide
  Seed: AVLDGLDVL (PRAME_HUMAN)
AVLDGLDVM

SEQ ID NO: 147569 - protein, 10 aa, Artificial Sequence
  Description of Artificial Sequence: Synthetic peptide
  Seed: ESYEDIHGTL (PRAME_HUMAN)
EVYEDIHGTF

SEQ ID NO: 147570 - protein, 10 aa, Artificial Sequence
  Description of Artificial Sequence: Synthetic peptide
  Seed: IEDLEVTCTW (PRAME_HUMAN)
ISDLEVTCTW

SEQ ID NO: 147571 - protein, 10 aa, Artificial Sequence
  Description of Artificial Sequence: Synthetic peptide
  Seed: KGQHLHLETF (PRAME_HUMAN)
KPQHLHLETF

SEQ ID NO: 147572 - protein, 10 aa, Artificial Sequence
  Description of Artificial Sequence: Synthetic peptide
  Seed: SPYLGQMINL (PRAME_HUMAN)
SDYLGQMINL

SEQ ID NO: 147573 - protein, 9 aa, Artificial Sequence
  Description of Artificial Sequence: Synthetic peptide
  Seed: AVLDGLDVL (PRAME_HUMAN)
ASLDGLDVV

SEQ ID NO: 147574 - protein, 9 aa, Artificial Sequence
  Description of Artificial Sequence: Synthetic peptide
  Seed: YGNSISISA (PRAME_HUMAN)
YINSISISM

SEQ ID NO: 147575 - protein, 10 aa, Artificial Sequence
  Description of Artificial Sequence: Synthetic peptide
  Seed: KFSPYLGQMI (PRAME_HUMAN)
KYSPYLGQMI

SEQ ID NO: 147576 - protein, 10 aa, Artificial Sequence
  Description of Artificial Sequence: Synthetic peptide
  Seed: QALYVDSLFF (PRAME_HUMAN)
QILYVDSLFW

SEQ ID NO: 147577 - protein, 9 aa, Artificial Sequence
  Description of Artificial Sequence: Synthetic peptide
  Seed: SHIHASSYI (PRAME_HUMAN)
SLIHASSYF

SEQ ID NO: 147578 - protein, 9 aa, Artificial Sequence
  Description of Artificial Sequence: Synthetic peptide
  Seed: CPHCGDRTF (PRAME_HUMAN)
CQHCGDRTY

SEQ ID NO: 147579 - protein, 9 aa, Artificial Sequence
  Description of Artificial Sequence: Synthetic peptide
  Seed: SFYGNSISI (PRAME_HUMAN)
SAYGNSISL

SEQ ID NO: 147580 - protein, 9 aa, Artificial Sequence
  Description of Artificial Sequence: Synthetic peptide
  Seed: YIAQFTSQF (PRAME_HUMAN)
YLAQFTSQY

SEQ ID NO: 147581 - protein, 9 aa, Artificial Sequence
  Description of Artificial Sequence: Synthetic peptide
  Seed: LSHIHASSY (PRAME_HUMAN)
LLHIHASSM

SEQ ID NO: 147582 - protein, 10 aa, Artificial Sequence
  Description of Artificial Sequence: Synthetic peptide
  Seed: QALYVDSLFF (PRAME_HUMAN)
QQLYVDSLFY

SEQ ID NO: 147583 - protein, 10 aa, Artificial Sequence
  Description of Artificial Sequence: Synthetic peptide
  Seed: VDSLFFLRGR (PRAME_HUMAN)
VVSLFFLRGR

SEQ ID NO: 147584 - protein, 9 aa, Artificial Sequence
  Description of Artificial Sequence: Synthetic peptide
  Seed: SFYGNSISI (PRAME_HUMAN)
SWYGNSISY

SEQ ID NO: 147585 - protein, 8 aa, Artificial Sequence
  Description of Artificial Sequence: Synthetic peptide
  Seed: YVDSLFFL (PRAME_HUMAN)
YLDSLFFL

SEQ ID NO: 147586 - protein, 9 aa, Artificial Sequence
  Description of Artificial Sequence: Synthetic peptide
  Seed: SPYLGQMIN (PRAME_HUMAN)
SPYLGQMIL

SEQ ID NO: 147587 - protein, 9 aa, Artificial Sequence
  Description of Artificial Sequence: Synthetic peptide
  Seed: HVMNPLETL (PRAME_HUMAN)
HQMNPLETM

SEQ ID NO: 147588 - protein, 10 aa, Artificial Sequence
  Description of Artificial Sequence: Synthetic peptide
  Seed: MNPLETLSIT (PRAME_HUMAN)
MKPLETLSIV

SEQ ID NO: 147589 - protein, 8 aa, Artificial Sequence
  Description of Artificial Sequence: Synthetic peptide
  Seed: YEDIHGTL (PRAME_HUMAN)
YFDIHGTM

SEQ ID NO: 147590 - protein, 9 aa, Artificial Sequence
  Description of Artificial Sequence: Synthetic peptide
  Seed: VSQLSVLSL (PRAME_HUMAN)
VQQLSVLSV

SEQ ID NO: 147591 - protein, 9 aa, Artificial Sequence
  Description of Artificial Sequence: Synthetic peptide
  Seed: VWSGNRASL (PRAME_HUMAN)
VFSGNRASM

SEQ ID NO: 147592 - protein, 9 aa, Artificial Sequence
  Description of Artificial Sequence: Synthetic peptide
  Seed: LMKGQHLHL (PRAME_HUMAN)
LSKGQHLHY

SEQ ID NO: 147593 - protein, 9 aa, Artificial Sequence
  Description of Artificial Sequence: Synthetic peptide
  Seed: EAAQPMTKK (PRAME_HUMAN)
EVAQPMTKL

SEQ ID NO: 147594 - protein, 10 aa, Artificial Sequence
  Description of Artificial Sequence: Synthetic peptide
  Seed: LERLAYLHAR (PRAME_HUMAN)
LHRLAYLHAK

SEQ ID NO: 147595 - protein, 9 aa, Artificial Sequence
  Description of Artificial Sequence: Synthetic peptide
  Seed: TLKAMVQAW (PRAME_HUMAN)
TAKAMVQAF

SEQ ID NO: 147596 - protein, 11 aa, Artificial Sequence
  Description of Artificial Sequence: Synthetic peptide
  Seed: FLKEGACDELF (PRAME_HUMAN)
FMKEGACDELI

SEQ ID NO: 147597 - protein, 9 aa, Artificial Sequence
  Description of Artificial Sequence: Synthetic peptide
  Seed: SIEDLEVTC (PRAME_HUMAN)
SSEDLEVTL

SEQ ID NO: 147598 - protein, 9 aa, Artificial Sequence
  Description of Artificial Sequence: Synthetic peptide
  Seed: FYDPEPILC (PRAME_HUMAN)
FADPEPILT

SEQ ID NO: 147599 - protein, 9 aa, Artificial Sequence
  Description of Artificial Sequence: Synthetic peptide
  Seed: TSPRRLVEL (PRAME_HUMAN)
TSPRRLVEM

SEQ ID NO: 147600 - protein, 9 aa, Artificial Sequence
  Description of Artificial Sequence: Synthetic peptide
  Seed: LSHIHASSY (PRAME_HUMAN)
LYHIHASSF

SEQ ID NO: 147601 - protein, 10 aa, Artificial Sequence
  Description of Artificial Sequence: Synthetic peptide
  Seed: RLAYLHARLR (PRAME_HUMAN)
RTAYLHARLV

SEQ ID NO: 147602 - protein, 10 aa, Artificial Sequence
  Description of Artificial Sequence: Synthetic peptide
  Seed: SLLKDEALAI (PRAME_HUMAN)
SHLKDEALAV

SEQ ID NO: 147603 - protein, 10 aa, Artificial Sequence
  Description of Artificial Sequence: Synthetic peptide
  Seed: YIAQFTSQFL (PRAME_HUMAN)
YHAQFTSQFY

SEQ ID NO: 147604 - protein, 9 aa, Artificial Sequence
  Description of Artificial Sequence: Synthetic peptide
  Seed: FYDPEPILC (PRAME_HUMAN)
FLDPEPILY

SEQ ID NO: 147605 - protein, 10 aa, Artificial Sequence
  Description of Artificial Sequence: Synthetic peptide
  Seed: GITDDQLLAL (PRAME_HUMAN)
GMTDDQLLAL

SEQ ID NO: 147606 - protein, 9 aa, Artificial Sequence
  Description of Artificial Sequence: Synthetic peptide
  Seed: AFDGRHSQT (PRAME_HUMAN)
AGDGRHSQL

SEQ ID NO: 147607 - protein, 10 aa, Artificial Sequence
  Description of Artificial Sequence: Synthetic peptide
  Seed: ALYVDSLFFL (PRAME_HUMAN)
AWYVDSLFFW

SEQ ID NO: 147608 - protein, 9 aa, Artificial Sequence
  Description of Artificial Sequence: Synthetic peptide
  Seed: QLLALLPSL (PRAME_HUMAN)
QMLALLPSF

SEQ ID NO: 147609 - protein, 11 aa, Artificial Sequence
  Description of Artificial Sequence: Synthetic peptide
  Seed: MKGQHLHLETF (PRAME_HUMAN)
MHGQHLHLETF

SEQ ID NO: 147610 - protein, 9 aa, Artificial Sequence
  Description of Artificial Sequence: Synthetic peptide
  Seed: LSHIHASSY (PRAME_HUMAN)
LMHIHASSL

SEQ ID NO: 147611 - protein, 10 aa, Artificial Sequence
  Description of Artificial Sequence: Synthetic peptide
  Seed: LSHIHASSYI (PRAME_HUMAN)
LTHIHASSYY

SEQ ID NO: 147612 - protein, 9 aa, Artificial Sequence
  Description of Artificial Sequence: Synthetic peptide
  Seed: EVRPRRWKL (PRAME_HUMAN)
EMRPRRWKL

SEQ ID NO: 147613 - protein, 11 aa, Artificial Sequence
  Description of Artificial Sequence: Synthetic peptide
  Seed: RRRLWGSIQSR (PRAME_HUMAN)
RNRLWGSIQSR

SEQ ID NO: 147614 - protein, 9 aa, Artificial Sequence
  Description of Artificial Sequence: Synthetic peptide
  Seed: ISISALQSL (PRAME_HUMAN)
IMISALQSF

SEQ ID NO: 147615 - protein, 10 aa, Artificial Sequence
  Description of Artificial Sequence: Synthetic peptide
  Seed: VMNPLETLSI (PRAME_HUMAN)
VLNPLETLSL

SEQ ID NO: 147616 - protein, 9 aa, Artificial Sequence
  Description of Artificial Sequence: Synthetic peptide
  Seed: FYDPEPILC (PRAME_HUMAN)
FTDPEPILW

SEQ ID NO: 147617 - protein, 9 aa, Artificial Sequence
  Description of Artificial Sequence: Synthetic peptide
  Seed: SHQDFWTVW (PRAME_HUMAN)
SWQDFWTVW

SEQ ID NO: 147618 - protein, 10 aa, Artificial Sequence
  Description of Artificial Sequence: Synthetic peptide
  Seed: LTDVSPEPLQ (PRAME_HUMAN)
LMDVSPEPLY

SEQ ID NO: 147619 - protein, 9 aa, Artificial Sequence
  Description of Artificial Sequence: Synthetic peptide
  Seed: TFYDPEPIL (PRAME_HUMAN)
TQYDPEPIV

SEQ ID NO: 147620 - protein, 11 aa, Artificial Sequence
  Description of Artificial Sequence: Synthetic peptide
  Seed: RASATLQDLVF (PRAME_HUMAN)
RASATLQDLVW

SEQ ID NO: 147621 - protein, 10 aa, Artificial Sequence
  Description of Artificial Sequence: Synthetic peptide
  Seed: LSFYGNSISI (PRAME_HUMAN)
LFFYGNSISM

SEQ ID NO: 147622 - protein, 9 aa, Artificial Sequence
  Description of Artificial Sequence: Synthetic peptide
  Seed: AMVQAWPFT (PRAME_HUMAN)
AMVQAWPFA

SEQ ID NO: 147623 - protein, 10 aa, Artificial Sequence
  Description of Artificial Sequence: Synthetic peptide
  Seed: SVLSLSGVML (PRAME_HUMAN)
SMLSLSGVMA

SEQ ID NO: 147624 - protein, 9 aa, Artificial Sequence
  Description of Artificial Sequence: Synthetic peptide
  Seed: LALLPSLSH (PRAME_HUMAN)
LTLLPSLSM

SEQ ID NO: 147625 - protein, 9 aa, Artificial Sequence
  Description of Artificial Sequence: Synthetic peptide
  Seed: AAFDGRHSQ (PRAME_HUMAN)
ASFDGRHSI

SEQ ID NO: 147626 - protein, 9 aa, Artificial Sequence
  Description of Artificial Sequence: Synthetic peptide
  Seed: GITDDQLLA (PRAME_HUMAN)
GLTDDQLLV

SEQ ID NO: 147627 - protein, 10 aa, Artificial Sequence
  Description of Artificial Sequence: Synthetic peptide
  Seed: FAMPMQDIKM (PRAME_HUMAN)
FIMPMQDIKL

SEQ ID NO: 147628 - protein, 10 aa, Artificial Sequence
  Description of Artificial Sequence: Synthetic peptide
  Seed: RHVMNPLETL (PRAME_HUMAN)
RRVMNPLETL

SEQ ID NO: 147629 - protein, 10 aa, Artificial Sequence
  Description of Artificial Sequence: Synthetic peptide
  Seed: FPEPEAAQPM (PRAME_HUMAN)
FAEPEAAQPL

SEQ ID NO: 147630 - protein, 10 aa, Artificial Sequence
  Description of Artificial Sequence: Synthetic peptide
  Seed: QTLKAMVQAW (PRAME_HUMAN)
QTLKAMVQAF

SEQ ID NO: 147631 - protein, 9 aa, Artificial Sequence
  Description of Artificial Sequence: Synthetic peptide
  Seed: TLAKFSPYL (PRAME_HUMAN)
TIAKFSPYA

SEQ ID NO: 147632 - protein, 8 aa, Artificial Sequence
  Description of Artificial Sequence: Synthetic peptide
  Seed: RRWKLQVL (PRAME_HUMAN)
RRWKLQVM

SEQ ID NO: 147633 - protein, 9 aa, Artificial Sequence
  Description of Artificial Sequence: Synthetic peptide
  Seed: KRKVDGLST (PRAME_HUMAN)
KRKVDGLSL

SEQ ID NO: 147634 - protein, 10 aa, Artificial Sequence
  Description of Artificial Sequence: Synthetic peptide
  Seed: TTLSFYGNSI (PRAME_HUMAN)
TCLSFYGNSV

SEQ ID NO: 147635 - protein, 10 aa, Artificial Sequence
  Description of Artificial Sequence: Synthetic peptide
  Seed: QLSVLSLSGV (PRAME_HUMAN)
QMSVLSLSGI

SEQ ID NO: 147636 - protein, 9 aa, Artificial Sequence
  Description of Artificial Sequence: Synthetic peptide
  Seed: AAFDGRHSQ (PRAME_HUMAN)
AGFDGRHSL

SEQ ID NO: 147637 - protein, 10 aa, Artificial Sequence
  Description of Artificial Sequence: Synthetic peptide
  Seed: AVLDGLDVLL (PRAME_HUMAN)
AMLDGLDVLM

SEQ ID NO: 147638 - protein, 9 aa, Artificial Sequence
  Description of Artificial Sequence: Synthetic peptide
  Seed: RGRLDQLLR (PRAME_HUMAN)
RTRLDQLLG

SEQ ID NO: 147639 - protein, 11 aa, Artificial Sequence
  Description of Artificial Sequence: Synthetic peptide
  Seed: SQLSVLSLSGV (PRAME_HUMAN)
SLLSVLSLSGI

SEQ ID NO: 147640 - protein, 10 aa, Artificial Sequence
  Description of Artificial Sequence: Synthetic peptide
  Seed: YLGQMINLRR (PRAME_HUMAN)
YMGQMINLRR

SEQ ID NO: 147641 - protein, 9 aa, Artificial Sequence
  Description of Artificial Sequence: Synthetic peptide
  Seed: KMILKMVQL (PRAME_HUMAN)
KRILKMVQF

SEQ ID NO: 147642 - protein, 9 aa, Artificial Sequence
  Description of Artificial Sequence: Synthetic peptide
  Seed: LTDVSPEPL (PRAME_HUMAN)
LYDVSPEPM

SEQ ID NO: 147643 - protein, 10 aa, Artificial Sequence
  Description of Artificial Sequence: Synthetic peptide
  Seed: DRTFYDPEPI (PRAME_HUMAN)
DVTFYDPEPV

SEQ ID NO: 147644 - protein, 9 aa, Artificial Sequence
  Description of Artificial Sequence: Synthetic peptide
  Seed: EAAQPMTKK (PRAME_HUMAN)
ETAQPMTKM

SEQ ID NO: 147645 - protein, 11 aa, Artificial Sequence
  Description of Artificial Sequence: Synthetic peptide
  Seed: LLLSHIHASSY (PRAME_HUMAN)
LILSHIHASSW

SEQ ID NO: 147646 - protein, 11 aa, Artificial Sequence
  Description of Artificial Sequence: Synthetic peptide
  Seed: ISALQSLLQHL (PRAME_HUMAN)
ITALQSLLQHF

SEQ ID NO: 147647 - protein, 9 aa, Artificial Sequence
  Description of Artificial Sequence: Synthetic peptide
  Seed: RLAYLHARL (PRAME_HUMAN)
RAAYLHARY

SEQ ID NO: 147648 - protein, 8 aa, Artificial Sequence
  Description of Artificial Sequence: Synthetic peptide
  Seed: YSFPEPEA (PRAME_HUMAN)
YAFPEPEY

SEQ ID NO: 147649 - protein, 10 aa, Artificial Sequence
  Description of Artificial Sequence: Synthetic peptide
  Seed: RELFPPLFMA (PRAME_HUMAN)
RNLFPPLFMA

SEQ ID NO: 147650 - protein, 9 aa, Artificial Sequence
  Description of Artificial Sequence: Synthetic peptide
  Seed: SFYGNSISI (PRAME_HUMAN)
SQYGNSISY

SEQ ID NO: 147651 - protein, 9 aa, Artificial Sequence
  Description of Artificial Sequence: Synthetic peptide
  Seed: LLSHIHASS (PRAME_HUMAN)
LMSHIHASI

SEQ ID NO: 147652 - protein, 9 aa, Artificial Sequence
  Description of Artificial Sequence: Synthetic peptide
  Seed: TSPRRLVEL (PRAME_HUMAN)
TPPRRLVEV

SEQ ID NO: 147653 - protein, 10 aa, Artificial Sequence
  Description of Artificial Sequence: Synthetic peptide
  Seed: ALYVDSLFFL (PRAME_HUMAN)
AHYVDSLFFI

SEQ ID NO: 147654 - protein, 10 aa, Artificial Sequence
  Description of Artificial Sequence: Synthetic peptide
  Seed: KVKRKKNVLR (PRAME_HUMAN)
KTKRKKNVLI

SEQ ID NO: 147655 - protein, 10 aa, Artificial Sequence
  Description of Artificial Sequence: Synthetic peptide
  Seed: TSQFLSLQCL (PRAME_HUMAN)
TKQFLSLQCF

SEQ ID NO: 147656 - protein, 11 aa, Artificial Sequence
  Description of Artificial Sequence: Synthetic peptide
  Seed: LLLSHIHASSY (PRAME_HUMAN)
LALSHIHASSW

SEQ ID NO: 147657 - protein, 9 aa, Artificial Sequence
  Description of Artificial Sequence: Synthetic peptide
  Seed: LFPPLFMAA (PRAME_HUMAN)
LWPPLFMAY

SEQ ID NO: 147658 - protein, 11 aa, Artificial Sequence
  Description of Artificial Sequence: Synthetic peptide
  Seed: LPTLAKFSPYL (PRAME_HUMAN)
LDTLAKFSPYI

SEQ ID NO: 147659 - protein, 9 aa, Artificial Sequence
  Description of Artificial Sequence: Synthetic peptide
  Seed: QSRYISMSV (PRAME_HUMAN)
QIRYISMSK

SEQ ID NO: 147660 - protein, 9 aa, Artificial Sequence
  Description of Artificial Sequence: Synthetic peptide
  Seed: FYDPEPILC (PRAME_HUMAN)
FTDPEPILA

SEQ ID NO: 147661 - protein, 11 aa, Artificial Sequence
  Description of Artificial Sequence: Synthetic peptide
  Seed: LSNLTHVLYPV (PRAME_HUMAN)
LMNLTHVLYPL

SEQ ID NO: 147662 - protein, 9 aa, Artificial Sequence
  Description of Artificial Sequence: Synthetic peptide
  Seed: ELFSYLIEK (PRAME_HUMAN)
ECFSYLIER

SEQ ID NO: 147663 - protein, 9 aa, Artificial Sequence
  Description of Artificial Sequence: Synthetic peptide
  Seed: VLSLSGVML (PRAME_HUMAN)
VISLSGVMY

SEQ ID NO: 147664 - protein, 10 aa, Artificial Sequence
  Description of Artificial Sequence: Synthetic peptide
  Seed: FLKEGACDEL (PRAME_HUMAN)
FQKEGACDEV

SEQ ID NO: 147665 - protein, 9 aa, Artificial Sequence
  Description of Artificial Sequence: Synthetic peptide
  Seed: YIAQFTSQF (PRAME_HUMAN)
YRAQFTSQI

SEQ ID NO: 147666 - protein, 11 aa, Artificial Sequence
  Description of Artificial Sequence: Synthetic peptide
  Seed: EQYIAQFTSQF (PRAME_HUMAN)
EVYIAQFTSQF

SEQ ID NO: 147667 - protein, 10 aa, Artificial Sequence
  Description of Artificial Sequence: Synthetic peptide
  Seed: AQFTSQFLSL (PRAME_HUMAN)
AMFTSQFLSA

SEQ ID NO: 147668 - protein, 10 aa, Artificial Sequence
  Description of Artificial Sequence: Synthetic peptide
  Seed: HCSQLTTLSF (PRAME_HUMAN)
HNSQLTTLSF

SEQ ID NO: 147669 - protein, 10 aa, Artificial Sequence
  Description of Artificial Sequence: Synthetic peptide
  Seed: RRRLWGSIQS (PRAME_HUMAN)
RYRLWGSIQK

SEQ ID NO: 147670 - protein, 10 aa, Artificial Sequence
  Description of Artificial Sequence: Synthetic peptide
  Seed: VLYPVPLESY (PRAME_HUMAN)
VLYPVPLESR

SEQ ID NO: 147671 - protein, 10 aa, Artificial Sequence
  Description of Artificial Sequence: Synthetic peptide
  Seed: PTLAKFSPYL (PRAME_HUMAN)
PALAKFSPYV

SEQ ID NO: 147672 - protein, 9 aa, Artificial Sequence
  Description of Artificial Sequence: Synthetic peptide
  Seed: IPVEVLVDL (PRAME_HUMAN)
IAVEVLVDF

SEQ ID NO: 147673 - protein, 9 aa, Artificial Sequence
  Description of Artificial Sequence: Synthetic peptide
  Seed: WLSANPCPH (PRAME_HUMAN)
WTSANPCPY

SEQ ID NO: 147674 - protein, 10 aa, Artificial Sequence
  Description of Artificial Sequence: Synthetic peptide
  Seed: AALELLPREL (PRAME_HUMAN)
AALELLPREW

SEQ ID NO: 147675 - protein, 8 aa, Artificial Sequence
  Description of Artificial Sequence: Synthetic peptide
  Seed: YVDSLFFL (PRAME_HUMAN)
YIDSLFFV

SEQ ID NO: 147676 - protein, 9 aa, Artificial Sequence
  Description of Artificial Sequence: Synthetic peptide
  Seed: ITDDQLLAL (PRAME_HUMAN)
IGDDQLLAI

SEQ ID NO: 147677 - protein, 10 aa, Artificial Sequence
  Description of Artificial Sequence: Synthetic peptide
  Seed: FIPVEVLVDL (PRAME_HUMAN)
FCPVEVLVDY

SEQ ID NO: 147678 - protein, 8 aa, Artificial Sequence
  Description of Artificial Sequence: Synthetic peptide
  Seed: SQLTTLSF (PRAME_HUMAN)
SMLTTLSY

SEQ ID NO: 147679 - protein, 8 aa, Artificial Sequence
  Description of Artificial Sequence: Synthetic peptide
  Seed: FYDPEPIL (PRAME_HUMAN)
FVDPEPIL

SEQ ID NO: 147680 - protein, 10 aa, Artificial Sequence
  Description of Artificial Sequence: Synthetic peptide
  Seed: YISPEKEEQY (PRAME_HUMAN)
YQSPEKEEQI

SEQ ID NO: 147681 - protein, 9 aa, Artificial Sequence
  Description of Artificial Sequence: Synthetic peptide
  Seed: IAALELLPR (PRAME_HUMAN)
ISALELLPR

SEQ ID NO: 147682 - protein, 10 aa, Artificial Sequence
  Description of Artificial Sequence: Synthetic peptide
  Seed: AAFDGRHSQT (PRAME_HUMAN)
ALFDGRHSQF

SEQ ID NO: 147683 - protein, 9 aa, Artificial Sequence
  Description of Artificial Sequence: Synthetic peptide
  Seed: LPRELFPPL (PRAME_HUMAN)
LARELFPPF

SEQ ID NO: 147684 - protein, 11 aa, Artificial Sequence
  Description of Artificial Sequence: Synthetic peptide
  Seed: SLSHCSQLTTL (PRAME_HUMAN)
SMSHCSQLTTV

SEQ ID NO: 147685 - protein, 9 aa, Artificial Sequence
  Description of Artificial Sequence: Synthetic peptide
  Seed: ALYVDSLFF (PRAME_HUMAN)
AAYVDSLFF

SEQ ID NO: 147686 - protein, 9 aa, Artificial Sequence
  Description of Artificial Sequence: Synthetic peptide
  Seed: QSRYISMSV (PRAME_HUMAN)
QARYISMSW

SEQ ID NO: 147687 - protein, 9 aa, Artificial Sequence
  Description of Artificial Sequence: Synthetic peptide
  Seed: LSLQCLQAL (PRAME_HUMAN)
LALQCLQAF

SEQ ID NO: 147688 - protein, 9 aa, Artificial Sequence
  Description of Artificial Sequence: Synthetic peptide
  Seed: FPPLFMAAF (PRAME_HUMAN)
FFPLFMAAL

SEQ ID NO: 147689 - protein, 9 aa, Artificial Sequence
  Description of Artificial Sequence: Synthetic peptide
  Seed: LALLPSLSH (PRAME_HUMAN)
LNLLPSLSF

SEQ ID NO: 147690 - protein, 9 aa, Artificial Sequence
  Description of Artificial Sequence: Synthetic peptide
  Seed: SQFLSLQCL (PRAME_HUMAN)
SKFLSLQCL

SEQ ID NO: 147691 - protein, 9 aa, Artificial Sequence
  Description of Artificial Sequence: Synthetic peptide
  Seed: LTDVSPEPL (PRAME_HUMAN)
LMDVSPEPF

SEQ ID NO: 147692 - protein, 10 aa, Artificial Sequence
  Description of Artificial Sequence: Synthetic peptide
  Seed: ALYVDSLFFL (PRAME_HUMAN)
ASYVDSLFFL

SEQ ID NO: 147693 - protein, 10 aa, Artificial Sequence
  Description of Artificial Sequence: Synthetic peptide
  Seed: FMAAFDGRHS (PRAME_HUMAN)
FLAAFDGRHM

SEQ ID NO: 147694 - protein, 9 aa, Artificial Sequence
  Description of Artificial Sequence: Synthetic peptide
  Seed: ISISALQSL (PRAME_HUMAN)
IVISALQSI

SEQ ID NO: 147695 - protein, 10 aa, Artificial Sequence
  Description of Artificial Sequence: Synthetic peptide
  Seed: QLLRHVMNPL (PRAME_HUMAN)
QRLRHVMNPV

SEQ ID NO: 147696 - protein, 10 aa, Artificial Sequence
  Description of Artificial Sequence: Synthetic peptide
  Seed: AVLDGLDVLL (PRAME_HUMAN)
AVLDGLDVLR

SEQ ID NO: 147697 - protein, 9 aa, Artificial Sequence
  Description of Artificial Sequence: Synthetic peptide
  Seed: ITDDQLLAL (PRAME_HUMAN)
ILDDQLLAW

SEQ ID NO: 147698 - protein, 9 aa, Artificial Sequence
  Description of Artificial Sequence: Synthetic peptide
  Seed: KLKIFAMPM (PRAME_HUMAN)
KAKIFAMPT

SEQ ID NO: 147699 - protein, 10 aa, Artificial Sequence
  Description of Artificial Sequence: Synthetic peptide
  Seed: KKLKIFAMPM (PRAME_HUMAN)
KALKIFAMPV

SEQ ID NO: 147700 - protein, 9 aa, Artificial Sequence
  Description of Artificial Sequence: Synthetic peptide
  Seed: SQFLSLQCL (PRAME_HUMAN)
SLFLSLQCF

SEQ ID NO: 147701 - protein, 9 aa, Artificial Sequence
  Description of Artificial Sequence: Synthetic peptide
  Seed: KMILKMVQL (PRAME_HUMAN)
KIILKMVQW

SEQ ID NO: 147702 - protein, 9 aa, Artificial Sequence
  Description of Artificial Sequence: Synthetic peptide
  Seed: ISISALQSL (PRAME_HUMAN)
IKISALQSM

SEQ ID NO: 147703 - protein, 10 aa, Artificial Sequence
  Description of Artificial Sequence: Synthetic peptide
  Seed: QLLALLPSLS (PRAME_HUMAN)
QQLALLPSLV

SEQ ID NO: 147704 - protein, 9 aa, Artificial Sequence
  Description of Artificial Sequence: Synthetic peptide
  Seed: HARLRELLC (PRAME_HUMAN)
HLRLRELLI

SEQ ID NO: 147705 - protein, 9 aa, Artificial Sequence
  Description of Artificial Sequence: Synthetic peptide
  Seed: KLKIFAMPM (PRAME_HUMAN)
KEKIFAMPF

SEQ ID NO: 147706 - protein, 9 aa, Artificial Sequence
  Description of Artificial Sequence: Synthetic peptide
  Seed: THVLYPVPL (PRAME_HUMAN)
TWVLYPVPM

SEQ ID NO: 147707 - protein, 9 aa, Artificial Sequence
  Description of Artificial Sequence: Synthetic peptide
  Seed: RTFYDPEPI (PRAME_HUMAN)
RHFYDPEPY

SEQ ID NO: 147708 - protein, 10 aa, Artificial Sequence
  Description of Artificial Sequence: Synthetic peptide
  Seed: IQSRYISMSV (PRAME_HUMAN)
ISSRYISMSA

SEQ ID NO: 147709 - protein, 10 aa, Artificial Sequence
  Description of Artificial Sequence: Synthetic peptide
  Seed: LAQEVRPRRW (PRAME_HUMAN)
LSQEVRPRRW

SEQ ID NO: 147710 - protein, 10 aa, Artificial Sequence
  Description of Artificial Sequence: Synthetic peptide
  Seed: MERRRLWGSI (PRAME_HUMAN)
MKRRRLWGSL

SEQ ID NO: 147711 - protein, 10 aa, Artificial Sequence
  Description of Artificial Sequence: Synthetic peptide
  Seed: LSQSPSVSQL (PRAME_HUMAN)
LMQSPSVSQF

SEQ ID NO: 147712 - protein, 8 aa, Artificial Sequence
  Description of Artificial Sequence: Synthetic peptide
  Seed: TDDQLLAL (PRAME_HUMAN)
TFDQLLAL

SEQ ID NO: 147713 - protein, 11 aa, Artificial Sequence
  Description of Artificial Sequence: Synthetic peptide
  Seed: TDVSPEPLQAL (PRAME_HUMAN)
TEVSPEPLQAV

SEQ ID NO: 147714 - protein, 11 aa, Artificial Sequence
  Description of Artificial Sequence: Synthetic peptide
  Seed: RRWKLQVLDLR (PRAME_HUMAN)
RRWKLQVLDLP

SEQ ID NO: 147715 - protein, 8 aa, Artificial Sequence
  Description of Artificial Sequence: Synthetic peptide
  Seed: FYGNSISI (PRAME_HUMAN)
FYGNSISM

SEQ ID NO: 147716 - protein, 10 aa, Artificial Sequence
  Description of Artificial Sequence: Synthetic peptide
  Seed: LSVLSLSGVM (PRAME_HUMAN)
LVVLSLSGVF

SEQ ID NO: 147717 - protein, 11 aa, Artificial Sequence
  Description of Artificial Sequence: Synthetic peptide
  Seed: HCSQLTTLSFY (PRAME_HUMAN)
HQSQLTTLSFF

SEQ ID NO: 147718 - protein, 9 aa, Artificial Sequence
  Description of Artificial Sequence: Synthetic peptide
  Seed: RLRELLCEL (PRAME_HUMAN)
RARELLCEK

SEQ ID NO: 147719 - protein, 9 aa, Artificial Sequence
  Description of Artificial Sequence: Synthetic peptide
  Seed: KLKIFAMPM (PRAME_HUMAN)
KVKIFAMPL

SEQ ID NO: 147720 - protein, 9 aa, Artificial Sequence
  Description of Artificial Sequence: Synthetic peptide
  Seed: ACDELFSYL (PRAME_HUMAN)
ATDELFSYL

SEQ ID NO: 147721 - protein, 10 aa, Artificial Sequence
  Description of Artificial Sequence: Synthetic peptide
  Seed: MERRRLWGSI (PRAME_HUMAN)
MFRRRLWGSM

SEQ ID NO: 147722 - protein, 10 aa, Artificial Sequence
  Description of Artificial Sequence: Synthetic peptide
  Seed: ELFPPLFMAA (PRAME_HUMAN)
EIFPPLFMAA

SEQ ID NO: 147723 - protein, 10 aa, Artificial Sequence
  Description of Artificial Sequence: Synthetic peptide
  Seed: DQLLALLPSL (PRAME_HUMAN)
DYLLALLPSA

SEQ ID NO: 147724 - protein, 9 aa, Artificial Sequence
  Description of Artificial Sequence: Synthetic peptide
  Seed: SRYISMSVW (PRAME_HUMAN)
SKYISMSVY

SEQ ID NO: 147725 - protein, 9 aa, Artificial Sequence
  Description of Artificial Sequence: Synthetic peptide
  Seed: SLLQHLIGL (PRAME_HUMAN)
SMLQHLIGV

SEQ ID NO: 147726 - protein, 9 aa, Artificial Sequence
  Description of Artificial Sequence: Synthetic peptide
  Seed: YISMSVWTS (PRAME_HUMAN)
YQSMSVWTV

SEQ ID NO: 147727 - protein, 9 aa, Artificial Sequence
  Description of Artificial Sequence: Synthetic peptide
  Seed: MINLRRLLL (PRAME_HUMAN)
MSNLRRLLV

SEQ ID NO: 147728 - protein, 9 aa, Artificial Sequence
  Description of Artificial Sequence: Synthetic peptide
  Seed: SISALQSLL (PRAME_HUMAN)
SLSALQSLV

SEQ ID NO: 147729 - protein, 10 aa, Artificial Sequence
  Description of Artificial Sequence: Synthetic peptide
  Seed: SQLTTLSFYG (PRAME_HUMAN)
SMLTTLSFYY

SEQ ID NO: 147730 - protein, 9 aa, Artificial Sequence
  Description of Artificial Sequence: Synthetic peptide
  Seed: FPPLFMAAF (PRAME_HUMAN)
FYPLFMAAY

SEQ ID NO: 147731 - protein, 9 aa, Artificial Sequence
  Description of Artificial Sequence: Synthetic peptide
  Seed: ACDELFSYL (PRAME_HUMAN)
AWDELFSYM

SEQ ID NO: 147732 - protein, 11 aa, Artificial Sequence
  Description of Artificial Sequence: Synthetic peptide
  Seed: PRELFPPLFMA (PRAME_HUMAN)
PWELFPPLFMV

SEQ ID NO: 147733 - protein, 9 aa, Artificial Sequence
  Description of Artificial Sequence: Synthetic peptide
  Seed: KAMVQAWPF (PRAME_HUMAN)
KGMVQAWPY

SEQ ID NO: 147734 - protein, 8 aa, Artificial Sequence
  Description of Artificial Sequence: Synthetic peptide
  Seed: SQLSVLSL (PRAME_HUMAN)
SELSVLSI

SEQ ID NO: 147735 - protein, 9 aa, Artificial Sequence
  Description of Artificial Sequence: Synthetic peptide
  Seed: AAFDGRHSQ (PRAME_HUMAN)
AIFDGRHSM

SEQ ID NO: 147736 - protein, 9 aa, Artificial Sequence
  Description of Artificial Sequence: Synthetic peptide
  Seed: VSPEPLQAL (PRAME_HUMAN)
VAPEPLQAC

SEQ ID NO: 147737 - protein, 10 aa, Artificial Sequence
  Description of Artificial Sequence: Synthetic peptide
  Seed: QYIAQFTSQF (PRAME_HUMAN)
QVIAQFTSQY

SEQ ID NO: 147738 - protein, 9 aa, Artificial Sequence
  Description of Artificial Sequence: Synthetic peptide
  Seed: YSFPEPEAA (PRAME_HUMAN)
YVFPEPEAA

SEQ ID NO: 147739 - protein, 10 aa, Artificial Sequence
  Description of Artificial Sequence: Synthetic peptide
  Seed: WPFTCLPLGV (PRAME_HUMAN)
WPFTCLPLGA

SEQ ID NO: 147740 - protein, 9 aa, Artificial Sequence
  Description of Artificial Sequence: Synthetic peptide
  Seed: SFYGNSISI (PRAME_HUMAN)
SNYGNSISL

SEQ ID NO: 147741 - protein, 11 aa, Artificial Sequence
  Description of Artificial Sequence: Synthetic peptide
  Seed: ALYVDSLFFLR (PRAME_HUMAN)
AMYVDSLFFLM

SEQ ID NO: 147742 - protein, 9 aa, Artificial Sequence
  Description of Artificial Sequence: Synthetic peptide
  Seed: QFTSQFLSL (PRAME_HUMAN)
QYTSQFLSL

SEQ ID NO: 147743 - protein, 9 aa, Artificial Sequence
  Description of Artificial Sequence: Synthetic peptide
  Seed: HVMNPLETL (PRAME_HUMAN)
HSMNPLETY

SEQ ID NO: 147744 - protein, 9 aa, Artificial Sequence
  Description of Artificial Sequence: Synthetic peptide
  Seed: FAMPMQDIK (PRAME_HUMAN)
FSMPMQDIY

SEQ ID NO: 147745 - protein, 9 aa, Artificial Sequence
  Description of Artificial Sequence: Synthetic peptide
  Seed: LSEGDVMHL (PRAME_HUMAN)
LTEGDVMHM

SEQ ID NO: 147746 - protein, 9 aa, Artificial Sequence
  Description of Artificial Sequence: Synthetic peptide
  Seed: RGRLDQLLR (PRAME_HUMAN)
RMRLDQLLI

SEQ ID NO: 147747 - protein, 10 aa, Artificial Sequence
  Description of Artificial Sequence: Synthetic peptide
  Seed: FFLRGRLDQL (PRAME_HUMAN)
FALRGRLDQA

SEQ ID NO: 147748 - protein, 10 aa, Artificial Sequence
  Description of Artificial Sequence: Synthetic peptide
  Seed: MNPLETLSIT (PRAME_HUMAN)
MIPLETLSIV

SEQ ID NO: 147749 - protein, 10 aa, Artificial Sequence
  Description of Artificial Sequence: Synthetic peptide
  Seed: LLPRELFPPL (PRAME_HUMAN)
LRPRELFPPF

SEQ ID NO: 147750 - protein, 9 aa, Artificial Sequence
  Description of Artificial Sequence: Synthetic peptide
  Seed: KMILKMVQL (PRAME_HUMAN)
KIILKMVQF

SEQ ID NO: 147751 - protein, 9 aa, Artificial Sequence
  Description of Artificial Sequence: Synthetic peptide
  Seed: FPPLFMAAF (PRAME_HUMAN)
FMPLFMAAF

SEQ ID NO: 147752 - protein, 9 aa, Artificial Sequence
  Description of Artificial Sequence: Synthetic peptide
  Seed: TLHLERLAY (PRAME_HUMAN)
TTHLERLAY

SEQ ID NO: 147753 - protein, 9 aa, Artificial Sequence
  Description of Artificial Sequence: Synthetic peptide
  Seed: SIQSRYISM (PRAME_HUMAN)
SYQSRYISM

SEQ ID NO: 147754 - protein, 9 aa, Artificial Sequence
  Description of Artificial Sequence: Synthetic peptide
  Seed: VLDGLDVLL (PRAME_HUMAN)
VGDGLDVLV

SEQ ID NO: 147755 - protein, 11 aa, Artificial Sequence
  Description of Artificial Sequence: Synthetic peptide
  Seed: ESYEDIHGTLH (PRAME_HUMAN)
EIYEDIHGTLK

SEQ ID NO: 147756 - protein, 11 aa, Artificial Sequence
  Description of Artificial Sequence: Synthetic peptide
  Seed: RLAYLHARLRE (PRAME_HUMAN)
RLAYLHARLRR

SEQ ID NO: 147757 - protein, 10 aa, Artificial Sequence
  Description of Artificial Sequence: Synthetic peptide
  Seed: SVSQLSVLSL (PRAME_HUMAN)
SMSQLSVLSF

SEQ ID NO: 147758 - protein, 10 aa, Artificial Sequence
  Description of Artificial Sequence: Synthetic peptide
  Seed: SNLTHVLYPV (PRAME_HUMAN)
SSLTHVLYPA

SEQ ID NO: 147759 - protein, 10 aa, Artificial Sequence
  Description of Artificial Sequence: Synthetic peptide
  Seed: ISISALQSLL (PRAME_HUMAN)
ICISALQSLW

SEQ ID NO: 147760 - protein, 10 aa, Artificial Sequence
  Description of Artificial Sequence: Synthetic peptide
  Seed: RRLLLSHIHA (PRAME_HUMAN)
RRLLLSHIHK

SEQ ID NO: 147761 - protein, 10 aa, Artificial Sequence
  Description of Artificial Sequence: Synthetic peptide
  Seed: SNLTHVLYPV (PRAME_HUMAN)
SYLTHVLYPI

SEQ ID NO: 147762 - protein, 8 aa, Artificial Sequence
  Description of Artificial Sequence: Synthetic peptide
  Seed: ALYVDSLF (PRAME_HUMAN)
AMYVDSLF

SEQ ID NO: 147763 - protein, 10 aa, Artificial Sequence
  Description of Artificial Sequence: Synthetic peptide
  Seed: KAVLDGLDVL (PRAME_HUMAN)
KMVLDGLDVW

SEQ ID NO: 147764 - protein, 10 aa, Artificial Sequence
  Description of Artificial Sequence: Synthetic peptide
  Seed: DELFSYLIEK (PRAME_HUMAN)
DPLFSYLIER

SEQ ID NO: 147765 - protein, 9 aa, Artificial Sequence
  Description of Artificial Sequence: Synthetic peptide
  Seed: SFPEPEAAQ (PRAME_HUMAN)
SYPEPEAAV

SEQ ID NO: 147766 - protein, 9 aa, Artificial Sequence
  Description of Artificial Sequence: Synthetic peptide
  Seed: KAMVQAWPF (PRAME_HUMAN)
KFMVQAWPF

SEQ ID NO: 147767 - protein, 9 aa, Artificial Sequence
  Description of Artificial Sequence: Synthetic peptide
  Seed: KLQVLDLRK (PRAME_HUMAN)
KVQVLDLRK

SEQ ID NO: 147768 - protein, 9 aa, Artificial Sequence
  Description of Artificial Sequence: Synthetic peptide
  Seed: TSPRRLVEL (PRAME_HUMAN)
TMPRRLVEV

SEQ ID NO: 147769 - protein, 10 aa, Artificial Sequence
  Description of Artificial Sequence: Synthetic peptide
  Seed: LSLQCLQALY (PRAME_HUMAN)
LCLQCLQALW

SEQ ID NO: 147770 - protein, 9 aa, Artificial Sequence
  Description of Artificial Sequence: Synthetic peptide
  Seed: LSNLTHVLY (PRAME_HUMAN)
LPNLTHVLM

SEQ ID NO: 147771 - protein, 10 aa, Artificial Sequence
  Description of Artificial Sequence: Synthetic peptide
  Seed: ALYVDSLFFL (PRAME_HUMAN)
AKYVDSLFFI

SEQ ID NO: 147772 - protein, 9 aa, Artificial Sequence
  Description of Artificial Sequence: Synthetic peptide
  Seed: VLMKGQHLH (PRAME_HUMAN)
VVMKGQHLK

SEQ ID NO: 147773 - protein, 9 aa, Artificial Sequence
  Description of Artificial Sequence: Synthetic peptide
  Seed: SQFLSLQCL (PRAME_HUMAN)
SHFLSLQCI

SEQ ID NO: 147774 - protein, 9 aa, Artificial Sequence
  Description of Artificial Sequence: Synthetic peptide
  Seed: LSHIHASSY (PRAME_HUMAN)
LKHIHASSW

SEQ ID NO: 147775 - protein, 9 aa, Artificial Sequence
  Description of Artificial Sequence: Synthetic peptide
  Seed: RGRLDQLLR (PRAME_HUMAN)
RSRLDQLLY

SEQ ID NO: 147776 - protein, 9 aa, Artificial Sequence
  Description of Artificial Sequence: Synthetic peptide
  Seed: FLRGRLDQL (PRAME_HUMAN)
FPRGRLDQA

SEQ ID NO: 147777 - protein, 11 aa, Artificial Sequence
  Description of Artificial Sequence: Synthetic peptide
  Seed: QALLERASATL (PRAME_HUMAN)
QYLLERASATL

SEQ ID NO: 147778 - protein, 9 aa, Artificial Sequence
  Description of Artificial Sequence: Synthetic peptide
  Seed: LQALYVDSL (PRAME_HUMAN)
LHALYVDSM

SEQ ID NO: 147779 - protein, 10 aa, Artificial Sequence
  Description of Artificial Sequence: Synthetic peptide
  Seed: LLPRELFPPL (PRAME_HUMAN)
LMPRELFPPM

SEQ ID NO: 147780 - protein, 9 aa, Artificial Sequence
  Description of Artificial Sequence: Synthetic peptide
  Seed: QLLALLPSL (PRAME_HUMAN)
QALALLPSF

SEQ ID NO: 147781 - protein, 9 aa, Artificial Sequence
  Description of Artificial Sequence: Synthetic peptide
  Seed: MINLRRLLL (PRAME_HUMAN)
MTNLRRLLF

SEQ ID NO: 147782 - protein, 10 aa, Artificial Sequence
  Description of Artificial Sequence: Synthetic peptide
  Seed: RHVMNPLETL (PRAME_HUMAN)
RRVMNPLETV

SEQ ID NO: 147783 - protein, 10 aa, Artificial Sequence
  Description of Artificial Sequence: Synthetic peptide
  Seed: TDVSPEPLQA (PRAME_HUMAN)
TEVSPEPLQL

SEQ ID NO: 147784 - protein, 9 aa, Artificial Sequence
  Description of Artificial Sequence: Synthetic peptide
  Seed: EAAQPMTKK (PRAME_HUMAN)
EVAQPMTKK

SEQ ID NO: 147785 - protein, 9 aa, Artificial Sequence
  Description of Artificial Sequence: Synthetic peptide
  Seed: SFPEPEAAQ (PRAME_HUMAN)
SWPEPEAAY

SEQ ID NO: 147786 - protein, 10 aa, Artificial Sequence
  Description of Artificial Sequence: Synthetic peptide
  Seed: FLSLQCLQAL (PRAME_HUMAN)
FMSLQCLQAA

SEQ ID NO: 147787 - protein, 10 aa, Artificial Sequence
  Description of Artificial Sequence: Synthetic peptide
  Seed: LKAMVQAWPF (PRAME_HUMAN)
LPAMVQAWPM

SEQ ID NO: 147788 - protein, 9 aa, Artificial Sequence
  Description of Artificial Sequence: Synthetic peptide
  Seed: YLHARLREL (PRAME_HUMAN)
YKHARLREM

SEQ ID NO: 147789 - protein, 9 aa, Artificial Sequence
  Description of Artificial Sequence: Synthetic peptide
  Seed: ISISALQSL (PRAME_HUMAN)
IRISALQSV

SEQ ID NO: 147790 - protein, 9 aa, Artificial Sequence
  Description of Artificial Sequence: Synthetic peptide
  Seed: VFDECGITD (PRAME_HUMAN)
VIDECGITL

SEQ ID NO: 147791 - protein, 9 aa, Artificial Sequence
  Description of Artificial Sequence: Synthetic peptide
  Seed: THVLYPVPL (PRAME_HUMAN)
TQVLYPVPI

SEQ ID NO: 147792 - protein, 10 aa, Artificial Sequence
  Description of Artificial Sequence: Synthetic peptide
  Seed: LLSHIHASSY (PRAME_HUMAN)
LFSHIHASSY

SEQ ID NO: 147793 - protein, 9 aa, Artificial Sequence
  Description of Artificial Sequence: Synthetic peptide
  Seed: SVLSLSGVM (PRAME_HUMAN)
STLSLSGVF

SEQ ID NO: 147794 - protein, 9 aa, Artificial Sequence
  Description of Artificial Sequence: Synthetic peptide
  Seed: SALQSLLQH (PRAME_HUMAN)
SMLQSLLQR

SEQ ID NO: 147795 - protein, 9 aa, Artificial Sequence
  Description of Artificial Sequence: Synthetic peptide
  Seed: RLRELLCEL (PRAME_HUMAN)
RSRELLCEA

SEQ ID NO: 147796 - protein, 9 aa, Artificial Sequence
  Description of Artificial Sequence: Synthetic peptide
  Seed: LQALYVDSL (PRAME_HUMAN)
LKALYVDSF

SEQ ID NO: 147797 - protein, 10 aa, Artificial Sequence
  Description of Artificial Sequence: Synthetic peptide
  Seed: DVSPEPLQAL (PRAME_HUMAN)
DLSPEPLQAW

SEQ ID NO: 147798 - protein, 10 aa, Artificial Sequence
  Description of Artificial Sequence: Synthetic peptide
  Seed: TWKLPTLAKF (PRAME_HUMAN)
TFKLPTLAKF

SEQ ID NO: 147799 - protein, 10 aa, Artificial Sequence
  Description of Artificial Sequence: Synthetic peptide
  Seed: EAAQPMTKKR (PRAME_HUMAN)
ESAQPMTKKR

SEQ ID NO: 147800 - protein, 11 aa, Artificial Sequence
  Description of Artificial Sequence: Synthetic peptide
  Seed: HVMNPLETLSI (PRAME_HUMAN)
HQMNPLETLSF

SEQ ID NO: 147801 - protein, 9 aa, Artificial Sequence
  Description of Artificial Sequence: Synthetic peptide
  Seed: FLSLQCLQA (PRAME_HUMAN)
FTSLQCLQI

SEQ ID NO: 147802 - protein, 10 aa, Artificial Sequence
  Description of Artificial Sequence: Synthetic peptide
  Seed: ISISALQSLL (PRAME_HUMAN)
IEISALQSLW

SEQ ID NO: 147803 - protein, 10 aa, Artificial Sequence
  Description of Artificial Sequence: Synthetic peptide
  Seed: RPSMVWLSAN (PRAME_HUMAN)
RPSMVWLSAV

SEQ ID NO: 147804 - protein, 9 aa, Artificial Sequence
  Description of Artificial Sequence: Synthetic peptide
  Seed: VSPEPLQAL (PRAME_HUMAN)
VAPEPLQAY

SEQ ID NO: 147805 - protein, 11 aa, Artificial Sequence
  Description of Artificial Sequence: Synthetic peptide
  Seed: GTLHLERLAYL (PRAME_HUMAN)
GKLHLERLAYV

SEQ ID NO: 147806 - protein, 9 aa, Artificial Sequence
  Description of Artificial Sequence: Synthetic peptide
  Seed: LKMVQLDSI (PRAME_HUMAN)
LLMVQLDSF

SEQ ID NO: 147807 - protein, 10 aa, Artificial Sequence
  Description of Artificial Sequence: Synthetic peptide
  Seed: RGRLDQLLRH (PRAME_HUMAN)
RLRLDQLLRR

SEQ ID NO: 147808 - protein, 10 aa, Artificial Sequence
  Description of Artificial Sequence: Synthetic peptide
  Seed: LSHCSQLTTL (PRAME_HUMAN)
LTHCSQLTTF

SEQ ID NO: 147809 - protein, 10 aa, Artificial Sequence
  Description of Artificial Sequence: Synthetic peptide
  Seed: YIAQFTSQFL (PRAME_HUMAN)
YNAQFTSQFY

SEQ ID NO: 147810 - protein, 9 aa, Artificial Sequence
  Description of Artificial Sequence: Synthetic peptide
  Seed: QPFIPVEVL (PRAME_HUMAN)
QHFIPVEVI

SEQ ID NO: 147811 - protein, 9 aa, Artificial Sequence
  Description of Artificial Sequence: Synthetic peptide
  Seed: SHIHASSYI (PRAME_HUMAN)
SYIHASSYV

SEQ ID NO: 147812 - protein, 8 aa, Artificial Sequence
  Description of Artificial Sequence: Synthetic peptide
  Seed: FYDPEPIL (PRAME_HUMAN)
FVDPEPIV

SEQ ID NO: 147813 - protein, 9 aa, Artificial Sequence
  Description of Artificial Sequence: Synthetic peptide
  Seed: RHSQTLKAM (PRAME_HUMAN)
RRSQTLKAI

SEQ ID NO: 147814 - protein, 10 aa, Artificial Sequence
  Description of Artificial Sequence: Synthetic peptide
  Seed: LLPRELFPPL (PRAME_HUMAN)
LRPRELFPPV

SEQ ID NO: 147815 - protein, 10 aa, Artificial Sequence
  Description of Artificial Sequence: Synthetic peptide
  Seed: MVQAWPFTCL (PRAME_HUMAN)
MMQAWPFTCT

SEQ ID NO: 147816 - protein, 11 aa, Artificial Sequence
  Description of Artificial Sequence: Synthetic peptide
  Seed: ESYEDIHGTLH (PRAME_HUMAN)
ETYEDIHGTLK

SEQ ID NO: 147817 - protein, 9 aa, Artificial Sequence
  Description of Artificial Sequence: Synthetic peptide
  Seed: GQHLHLETF (PRAME_HUMAN)
GEHLHLETF

SEQ ID NO: 147818 - protein, 11 aa, Artificial Sequence
  Description of Artificial Sequence: Synthetic peptide
  Seed: EALAIAALELL (PRAME_HUMAN)
EFLAIAALELL

SEQ ID NO: 147819 - protein, 9 aa, Artificial Sequence
  Description of Artificial Sequence: Synthetic peptide
  Seed: YVDSLFFLR (PRAME_HUMAN)
YSDSLFFLL

SEQ ID NO: 147820 - protein, 10 aa, Artificial Sequence
  Description of Artificial Sequence: Synthetic peptide
  Seed: KAVLDGLDVL (PRAME_HUMAN)
KSVLDGLDVF

SEQ ID NO: 147821 - protein, 9 aa, Artificial Sequence
  Description of Artificial Sequence: Synthetic peptide
  Seed: LQDLVFDEC (PRAME_HUMAN)
LSDLVFDEM

SEQ ID NO: 147822 - protein, 10 aa, Artificial Sequence
  Description of Artificial Sequence: Synthetic peptide
  Seed: LLLSHIHASS (PRAME_HUMAN)
LSLSHIHASI

SEQ ID NO: 147823 - protein, 9 aa, Artificial Sequence
  Description of Artificial Sequence: Synthetic peptide
  Seed: AAFDGRHSQ (PRAME_HUMAN)
ASFDGRHSM

SEQ ID NO: 147824 - protein, 8 aa, Artificial Sequence
  Description of Artificial Sequence: Synthetic peptide
  Seed: ITDDQLLA (PRAME_HUMAN)
ITDDQLLL

SEQ ID NO: 147825 - protein, 9 aa, Artificial Sequence
  Description of Artificial Sequence: Synthetic peptide
  Seed: QPFIPVEVL (PRAME_HUMAN)
QHFIPVEVT

SEQ ID NO: 147826 - protein, 9 aa, Artificial Sequence
  Description of Artificial Sequence: Synthetic peptide
  Seed: MINLRRLLL (PRAME_HUMAN)
MANLRRLLI

SEQ ID NO: 147827 - protein, 11 aa, Artificial Sequence
  Description of Artificial Sequence: Synthetic peptide
  Seed: FKAVLDGLDVL (PRAME_HUMAN)
FCAVLDGLDVV

SEQ ID NO: 147828 - protein, 9 aa, Artificial Sequence
  Description of Artificial Sequence: Synthetic peptide
  Seed: YLHARLREL (PRAME_HUMAN)
YPHARLREC

SEQ ID NO: 147829 - protein, 9 aa, Artificial Sequence
  Description of Artificial Sequence: Synthetic peptide
  Seed: IGLSNLTHV (PRAME_HUMAN)
ILLSNLTHL

SEQ ID NO: 147830 - protein, 9 aa, Artificial Sequence
  Description of Artificial Sequence: Synthetic peptide
  Seed: SFPEPEAAQ (PRAME_HUMAN)
SYPEPEAAL

SEQ ID NO: 147831 - protein, 9 aa, Artificial Sequence
  Description of Artificial Sequence: Synthetic peptide
  Seed: ELFSYLIEK (PRAME_HUMAN)
EQFSYLIEK

SEQ ID NO: 147832 - protein, 10 aa, Artificial Sequence
  Description of Artificial Sequence: Synthetic peptide
  Seed: LLLSHIHASS (PRAME_HUMAN)
LALSHIHASL

SEQ ID NO: 147833 - protein, 8 aa, Artificial Sequence
  Description of Artificial Sequence: Synthetic peptide
  Seed: SRYISMSV (PRAME_HUMAN)
SHYISMSA

SEQ ID NO: 147834 - protein, 10 aa, Artificial Sequence
  Description of Artificial Sequence: Synthetic peptide
  Seed: LQALYVDSLF (PRAME_HUMAN)
LKALYVDSLW

SEQ ID NO: 147835 - protein, 9 aa, Artificial Sequence
  Description of Artificial Sequence: Synthetic peptide
  Seed: SPEPLQALL (PRAME_HUMAN)
SAEPLQALV

SEQ ID NO: 147836 - protein, 10 aa, Artificial Sequence
  Description of Artificial Sequence: Synthetic peptide
  Seed: DRTFYDPEPI (PRAME_HUMAN)
DETFYDPEPV

SEQ ID NO: 147837 - protein, 10 aa, Artificial Sequence
  Description of Artificial Sequence: Synthetic peptide
  Seed: TFYDPEPILC (PRAME_HUMAN)
TWYDPEPILF

SEQ ID NO: 147838 - protein, 10 aa, Artificial Sequence
  Description of Artificial Sequence: Synthetic peptide
  Seed: AQFTSQFLSL (PRAME_HUMAN)
ALFTSQFLSY

SEQ ID NO: 147839 - protein, 10 aa, Artificial Sequence
  Description of Artificial Sequence: Synthetic peptide
  Seed: LLSHIHASSY (PRAME_HUMAN)
LQSHIHASSF

SEQ ID NO: 147840 - protein, 10 aa, Artificial Sequence
  Description of Artificial Sequence: Synthetic peptide
  Seed: QSRYISMSVW (PRAME_HUMAN)
QTRYISMSVY

SEQ ID NO: 147841 - protein, 10 aa, Artificial Sequence
  Description of Artificial Sequence: Synthetic peptide
  Seed: ESYEDIHGTL (PRAME_HUMAN)
EIYEDIHGTL

SEQ ID NO: 147842 - protein, 9 aa, Artificial Sequence
  Description of Artificial Sequence: Synthetic peptide
  Seed: ALAIAALEL (PRAME_HUMAN)
AMAIAALEY

SEQ ID NO: 147843 - protein, 9 aa, Artificial Sequence
  Description of Artificial Sequence: Synthetic peptide
  Seed: LQDLVFDEC (PRAME_HUMAN)
LMDLVFDEM

SEQ ID NO: 147844 - protein, 11 aa, Artificial Sequence
  Description of Artificial Sequence: Synthetic peptide
  Seed: QALYVDSLFFL (PRAME_HUMAN)
QQLYVDSLFFV

SEQ ID NO: 147845 - protein, 9 aa, Artificial Sequence
  Description of Artificial Sequence: Synthetic peptide
  Seed: LMKGQHLHL (PRAME_HUMAN)
LRKGQHLHL

SEQ ID NO: 147846 - protein, 10 aa, Artificial Sequence
  Description of Artificial Sequence: Synthetic peptide
  Seed: QLLRHVMNPL (PRAME_HUMAN)
QHLRHVMNPV

SEQ ID NO: 147847 - protein, 11 aa, Artificial Sequence
  Description of Artificial Sequence: Synthetic peptide
  Seed: QDFWTVWSGNR (PRAME_HUMAN)
QYFWTVWSGNR

SEQ ID NO: 147848 - protein, 9 aa, Artificial Sequence
  Description of Artificial Sequence: Synthetic peptide
  Seed: ISISALQSL (PRAME_HUMAN)
ISISALQSM

SEQ ID NO: 147849 - protein, 9 aa, Artificial Sequence
  Description of Artificial Sequence: Synthetic peptide
  Seed: RLRELLCEL (PRAME_HUMAN)
RFRELLCEA

SEQ ID NO: 147850 - protein, 9 aa, Artificial Sequence
  Description of Artificial Sequence: Synthetic peptide
  Seed: MSVWTSPRR (PRAME_HUMAN)
MLVWTSPRK

SEQ ID NO: 147851 - protein, 9 aa, Artificial Sequence
  Description of Artificial Sequence: Synthetic peptide
  Seed: SFYGNSISI (PRAME_HUMAN)
SKYGNSISV

SEQ ID NO: 147852 - protein, 9 aa, Artificial Sequence
  Description of Artificial Sequence: Synthetic peptide
  Seed: YIAQFTSQF (PRAME_HUMAN)
YYAQFTSQI

SEQ ID NO: 147853 - protein, 9 aa, Artificial Sequence
  Description of Artificial Sequence: Synthetic peptide
  Seed: TLAKFSPYL (PRAME_HUMAN)
TTAKFSPYW

SEQ ID NO: 147854 - protein, 10 aa, Artificial Sequence
  Description of Artificial Sequence: Synthetic peptide
  Seed: MPMQDIKMIL (PRAME_HUMAN)
MHMQDIKMIV

SEQ ID NO: 147855 - protein, 9 aa, Artificial Sequence
  Description of Artificial Sequence: Synthetic peptide
  Seed: RLRELLCEL (PRAME_HUMAN)
RFRELLCEK

SEQ ID NO: 147856 - protein, 9 aa, Artificial Sequence
  Description of Artificial Sequence: Synthetic peptide
  Seed: WPFTCLPLG (PRAME_HUMAN)
WPFTCLPLL

SEQ ID NO: 147857 - protein, 9 aa, Artificial Sequence
  Description of Artificial Sequence: Synthetic peptide
  Seed: VLDGLDVLL (PRAME_HUMAN)
VIDGLDVLY

SEQ ID NO: 147858 - protein, 9 aa, Artificial Sequence
  Description of Artificial Sequence: Synthetic peptide
  Seed: VSPEPLQAL (PRAME_HUMAN)
VCPEPLQAM

SEQ ID NO: 147859 - protein, 10 aa, Artificial Sequence
  Description of Artificial Sequence: Synthetic peptide
  Seed: ALYVDSLFFL (PRAME_HUMAN)
APYVDSLFFL

SEQ ID NO: 147860 - protein, 9 aa, Artificial Sequence
  Description of Artificial Sequence: Synthetic peptide
  Seed: LTDVSPEPL (PRAME_HUMAN)
LTDVSPEPI

SEQ ID NO: 147861 - protein, 8 aa, Artificial Sequence
  Description of Artificial Sequence: Synthetic peptide
  Seed: YEDIHGTL (PRAME_HUMAN)
YNDIHGTM

SEQ ID NO: 147862 - protein, 10 aa, Artificial Sequence
  Description of Artificial Sequence: Synthetic peptide
  Seed: SLQCLQALYV (PRAME_HUMAN)
SLQCLQALYI

SEQ ID NO: 147863 - protein, 11 aa, Artificial Sequence
  Description of Artificial Sequence: Synthetic peptide
  Seed: FKAVLDGLDVL (PRAME_HUMAN)
FMAVLDGLDVL

SEQ ID NO: 147864 - protein, 10 aa, Artificial Sequence
  Description of Artificial Sequence: Synthetic peptide
  Seed: AAFDGRHSQT (PRAME_HUMAN)
ASFDGRHSQM

SEQ ID NO: 147865 - protein, 11 aa, Artificial Sequence
  Description of Artificial Sequence: Synthetic peptide
  Seed: EQYIAQFTSQF (PRAME_HUMAN)
EIYIAQFTSQF

SEQ ID NO: 147866 - protein, 9 aa, Artificial Sequence
  Description of Artificial Sequence: Synthetic peptide
  Seed: SQFLSLQCL (PRAME_HUMAN)
SVFLSLQCY

SEQ ID NO: 147867 - protein, 9 aa, Artificial Sequence
  Description of Artificial Sequence: Synthetic peptide
  Seed: QALYVDSLF (PRAME_HUMAN)
QPLYVDSLM

SEQ ID NO: 147868 - protein, 9 aa, Artificial Sequence
  Description of Artificial Sequence: Synthetic peptide
  Seed: FTCLPLGVL (PRAME_HUMAN)
FMCLPLGVA

SEQ ID NO: 147869 - protein, 9 aa, Artificial Sequence
  Description of Artificial Sequence: Synthetic peptide
  Seed: FAMPMQDIK (PRAME_HUMAN)
FIMPMQDIR

SEQ ID NO: 147870 - protein, 11 aa, Artificial Sequence
  Description of Artificial Sequence: Synthetic peptide
  Seed: FYGNSISISAL (PRAME_HUMAN)
FYGNSISISAF

SEQ ID NO: 147871 - protein, 10 aa, Artificial Sequence
  Description of Artificial Sequence: Synthetic peptide
  Seed: QAWPFTCLPL (PRAME_HUMAN)
QTWPFTCLPI

SEQ ID NO: 147872 - protein, 10 aa, Artificial Sequence
  Description of Artificial Sequence: Synthetic peptide
  Seed: RELFPPLFMA (PRAME_HUMAN)
RKLFPPLFMM

SEQ ID NO: 147873 - protein, 11 aa, Artificial Sequence
  Description of Artificial Sequence: Synthetic peptide
  Seed: QALYVDSLFFL (PRAME_HUMAN)
QMLYVDSLFFI

SEQ ID NO: 147874 - protein, 10 aa, Artificial Sequence
  Description of Artificial Sequence: Synthetic peptide
  Seed: LIGLSNLTHV (PRAME_HUMAN)
LLGLSNLTHL

SEQ ID NO: 147875 - protein, 9 aa, Artificial Sequence
  Description of Artificial Sequence: Synthetic peptide
  Seed: VLMKGQHLH (PRAME_HUMAN)
VQMKGQHLL

SEQ ID NO: 147876 - protein, 10 aa, Artificial Sequence
  Description of Artificial Sequence: Synthetic peptide
  Seed: FMAAFDGRHS (PRAME_HUMAN)
FLAAFDGRHV

SEQ ID NO: 147877 - protein, 9 aa, Artificial Sequence
  Description of Artificial Sequence: Synthetic peptide
  Seed: VWTSPRRLV (PRAME_HUMAN)
VYTSPRRLM

SEQ ID NO: 147878 - protein, 10 aa, Artificial Sequence
  Description of Artificial Sequence: Synthetic peptide
  Seed: SISISALQSL (PRAME_HUMAN)
SNSISALQSF

SEQ ID NO: 147879 - protein, 10 aa, Artificial Sequence
  Description of Artificial Sequence: Synthetic peptide
  Seed: YSFPEPEAAQ (PRAME_HUMAN)
YLFPEPEAAF

SEQ ID NO: 147880 - protein, 11 aa, Artificial Sequence
  Description of Artificial Sequence: Synthetic peptide
  Seed: ISMSVWTSPRR (PRAME_HUMAN)
IVMSVWTSPRR

SEQ ID NO: 147881 - protein, 9 aa, Artificial Sequence
  Description of Artificial Sequence: Synthetic peptide
  Seed: SQFLSLQCL (PRAME_HUMAN)
SEFLSLQCI

SEQ ID NO: 147882 - protein, 9 aa, Artificial Sequence
  Description of Artificial Sequence: Synthetic peptide
  Seed: HVMNPLETL (PRAME_HUMAN)
HDMNPLETF

SEQ ID NO: 147883 - protein, 9 aa, Artificial Sequence
  Description of Artificial Sequence: Synthetic peptide
  Seed: QLLALLPSL (PRAME_HUMAN)
QMLALLPSM

SEQ ID NO: 147884 - protein, 8 aa, Artificial Sequence
  Description of Artificial Sequence: Synthetic peptide
  Seed: KKLKIFAM (PRAME_HUMAN)
KQLKIFAM

SEQ ID NO: 147885 - protein, 10 aa, Artificial Sequence
  Description of Artificial Sequence: Synthetic peptide
  Seed: SPSVSQLSVL (PRAME_HUMAN)
SWSVSQLSVF

SEQ ID NO: 147886 - protein, 9 aa, Artificial Sequence
  Description of Artificial Sequence: Synthetic peptide
  Seed: KLKIFAMPM (PRAME_HUMAN)
KVKIFAMPG

SEQ ID NO: 147887 - protein, 9 aa, Artificial Sequence
  Description of Artificial Sequence: Synthetic peptide
  Seed: LSHIHASSY (PRAME_HUMAN)
LAHIHASSW

SEQ ID NO: 147888 - protein, 10 aa, Artificial Sequence
  Description of Artificial Sequence: Synthetic peptide
  Seed: LLPRELFPPL (PRAME_HUMAN)
LSPRELFPPF

SEQ ID NO: 147889 - protein, 10 aa, Artificial Sequence
  Description of Artificial Sequence: Synthetic peptide
  Seed: RYISMSVWTS (PRAME_HUMAN)
RYISMSVWTM

SEQ ID NO: 147890 - protein, 9 aa, Artificial Sequence
  Description of Artificial Sequence: Synthetic peptide
  Seed: LSLQCLQAL (PRAME_HUMAN)
LTLQCLQAL

SEQ ID NO: 147891 - protein, 11 aa, Artificial Sequence
  Description of Artificial Sequence: Synthetic peptide
  Seed: RLRELLCELGR (PRAME_HUMAN)
RVRELLCELGR

SEQ ID NO: 147892 - protein, 10 aa, Artificial Sequence
  Description of Artificial Sequence: Synthetic peptide
  Seed: RLAYLHARLR (PRAME_HUMAN)
RIAYLHARLR

SEQ ID NO: 147893 - protein, 10 aa, Artificial Sequence
  Description of Artificial Sequence: Synthetic peptide
  Seed: GITDDQLLAL (PRAME_HUMAN)
GQTDDQLLAW

SEQ ID NO: 147894 - protein, 11 aa, Artificial Sequence
  Description of Artificial Sequence: Synthetic peptide
  Seed: ESYEDIHGTLH (PRAME_HUMAN)
ELYEDIHGTLR

SEQ ID NO: 147895 - protein, 9 aa, Artificial Sequence
  Description of Artificial Sequence: Synthetic peptide
  Seed: HVMNPLETL (PRAME_HUMAN)
HHMNPLETL

SEQ ID NO: 147896 - protein, 10 aa, Artificial Sequence
  Description of Artificial Sequence: Synthetic peptide
  Seed: ELFPPLFMAA (PRAME_HUMAN)
ETFPPLFMAV

SEQ ID NO: 147897 - protein, 10 aa, Artificial Sequence
  Description of Artificial Sequence: Synthetic peptide
  Seed: YEDIHGTLHL (PRAME_HUMAN)
YIDIHGTLHV

SEQ ID NO: 147898 - protein, 10 aa, Artificial Sequence
  Description of Artificial Sequence: Synthetic peptide
  Seed: MSVWTSPRRL (PRAME_HUMAN)
MSVWTSPRRY

SEQ ID NO: 147899 - protein, 9 aa, Artificial Sequence
  Description of Artificial Sequence: Synthetic peptide
  Seed: TFYDPEPIL (PRAME_HUMAN)
TFYDPEPIY

SEQ ID NO: 147900 - protein, 9 aa, Artificial Sequence
  Description of Artificial Sequence: Synthetic peptide
  Seed: RLRELLCEL (PRAME_HUMAN)
RTRELLCEW

SEQ ID NO: 147901 - protein, 10 aa, Artificial Sequence
  Description of Artificial Sequence: Synthetic peptide
  Seed: GRPSMVWLSA (PRAME_HUMAN)
GHPSMVWLSL

SEQ ID NO: 147902 - protein, 9 aa, Artificial Sequence
  Description of Artificial Sequence: Synthetic peptide
  Seed: WSGNRASLY (PRAME_HUMAN)
WSGNRASLF

SEQ ID NO: 147903 - protein, 9 aa, Artificial Sequence
  Description of Artificial Sequence: Synthetic peptide
  Seed: GQHLHLETF (PRAME_HUMAN)
GRHLHLETV

SEQ ID NO: 147904 - protein, 9 aa, Artificial Sequence
  Description of Artificial Sequence: Synthetic peptide
  Seed: LSVLSLSGV (PRAME_HUMAN)
LAVLSLSGV

SEQ ID NO: 147905 - protein, 10 aa, Artificial Sequence
  Description of Artificial Sequence: Synthetic peptide
  Seed: YGNSISISAL (PRAME_HUMAN)
YTNSISISAF

SEQ ID NO: 147906 - protein, 9 aa, Artificial Sequence
  Description of Artificial Sequence: Synthetic peptide
  Seed: LQSLLQHLI (PRAME_HUMAN)
LMSLLQHLF

SEQ ID NO: 147907 - protein, 10 aa, Artificial Sequence
  Description of Artificial Sequence: Synthetic peptide
  Seed: IGLSNLTHVL (PRAME_HUMAN)
ILLSNLTHVE

SEQ ID NO: 147908 - protein, 10 aa, Artificial Sequence
  Description of Artificial Sequence: Synthetic peptide
  Seed: ALYVDSLFFL (PRAME_HUMAN)
APYVDSLFFF

SEQ ID NO: 147909 - protein, 10 aa, Artificial Sequence
  Description of Artificial Sequence: Synthetic peptide
  Seed: GRLDQLLRHV (PRAME_HUMAN)
GRLDQLLRHI

SEQ ID NO: 147910 - protein, 9 aa, Artificial Sequence
  Description of Artificial Sequence: Synthetic peptide
  Seed: SRYISMSVW (PRAME_HUMAN)
SKYISMSVI

SEQ ID NO: 147911 - protein, 9 aa, Artificial Sequence
  Description of Artificial Sequence: Synthetic peptide
  Seed: LSHIHASSY (PRAME_HUMAN)
LKHIHASSM

SEQ ID NO: 147912 - protein, 9 aa, Artificial Sequence
  Description of Artificial Sequence: Synthetic peptide
  Seed: LAQEVRPRR (PRAME_HUMAN)
LMQEVRPRR

SEQ ID NO: 147913 - protein, 11 aa, Artificial Sequence
  Description of Artificial Sequence: Synthetic peptide
  Seed: RLVELAGQSLL (PRAME_HUMAN)
RLVELAGQSLF

SEQ ID NO: 147914 - protein, 10 aa, Artificial Sequence
  Description of Artificial Sequence: Synthetic peptide
  Seed: SISISALQSL (PRAME_HUMAN)
SDSISALQSY

SEQ ID NO: 147915 - protein, 10 aa, Artificial Sequence
  Description of Artificial Sequence: Synthetic peptide
  Seed: IQSRYISMSV (PRAME_HUMAN)
ILSRYISMSK

SEQ ID NO: 147916 - protein, 11 aa, Artificial Sequence
  Description of Artificial Sequence: Synthetic peptide
  Seed: IQSRYISMSVW (PRAME_HUMAN)
ITSRYISMSVW

SEQ ID NO: 147917 - protein, 9 aa, Artificial Sequence
  Description of Artificial Sequence: Synthetic peptide
  Seed: HLIGLSNLT (PRAME_HUMAN)
HVIGLSNLI

SEQ ID NO: 147918 - protein, 9 aa, Artificial Sequence
  Description of Artificial Sequence: Synthetic peptide
  Seed: LGRPSMVWL (PRAME_HUMAN)
LSRPSMVWK

SEQ ID NO: 147919 - protein, 10 aa, Artificial Sequence
  Description of Artificial Sequence: Synthetic peptide
  Seed: SISISALQSL (PRAME_HUMAN)
SYSISALQSY

SEQ ID NO: 147920 - protein, 9 aa, Artificial Sequence
  Description of Artificial Sequence: Synthetic peptide
  Seed: SMSVWTSPR (PRAME_HUMAN)
SASVWTSPK

SEQ ID NO: 147921 - protein, 9 aa, Artificial Sequence
  Description of Artificial Sequence: Synthetic peptide
  Seed: SLLQHLIGL (PRAME_HUMAN)
SSLQHLIGL

SEQ ID NO: 147922 - protein, 10 aa, Artificial Sequence
  Description of Artificial Sequence: Synthetic peptide
  Seed: VLDGLDVLLA (PRAME_HUMAN)
VMDGLDVLLL

SEQ ID NO: 147923 - protein, 10 aa, Artificial Sequence
  Description of Artificial Sequence: Synthetic peptide
  Seed: HASSYISPEK (PRAME_HUMAN)
HFSSYISPER

SEQ ID NO: 147924 - protein, 9 aa, Artificial Sequence
  Description of Artificial Sequence: Synthetic peptide
  Seed: EAAQPMTKK (PRAME_HUMAN)
EAAQPMTKL

SEQ ID NO: 147925 - protein, 9 aa, Artificial Sequence
  Description of Artificial Sequence: Synthetic peptide
  Seed: RLSEGDVMH (PRAME_HUMAN)
RQSEGDVMF

SEQ ID NO: 147926 - protein, 10 aa, Artificial Sequence
  Description of Artificial Sequence: Synthetic peptide
  Seed: RELFPPLFMA (PRAME_HUMAN)
RLLFPPLFMV

SEQ ID NO: 147927 - protein, 10 aa, Artificial Sequence
  Description of Artificial Sequence: Synthetic peptide
  Seed: LSHIHASSYI (PRAME_HUMAN)
LAHIHASSYW

SEQ ID NO: 147928 - protein, 10 aa, Artificial Sequence
  Description of Artificial Sequence: Synthetic peptide
  Seed: MERRRLWGSI (PRAME_HUMAN)
MLRRRLWGSI

SEQ ID NO: 147929 - protein, 9 aa, Artificial Sequence
  Description of Artificial Sequence: Synthetic peptide
  Seed: AVLDGLDVL (PRAME_HUMAN)
ATLDGLDVI

SEQ ID NO: 147930 - protein, 9 aa, Artificial Sequence
  Description of Artificial Sequence: Synthetic peptide
  Seed: SHIHASSYI (PRAME_HUMAN)
SQIHASSYI

SEQ ID NO: 147931 - protein, 9 aa, Artificial Sequence
  Description of Artificial Sequence: Synthetic peptide
  Seed: HVMNPLETL (PRAME_HUMAN)
HQMNPLETF

SEQ ID NO: 147932 - protein, 9 aa, Artificial Sequence
  Description of Artificial Sequence: Synthetic peptide
  Seed: TDDQLLALL (PRAME_HUMAN)
TSDQLLALF

SEQ ID NO: 147933 - protein, 10 aa, Artificial Sequence
  Description of Artificial Sequence: Synthetic peptide
  Seed: RRLWGSIQSR (PRAME_HUMAN)
RSLWGSIQSK

SEQ ID NO: 147934 - protein, 11 aa, Artificial Sequence
  Description of Artificial Sequence: Synthetic peptide
  Seed: MKGQHLHLETF (PRAME_HUMAN)
MLGQHLHLETF

SEQ ID NO: 147935 - protein, 9 aa, Artificial Sequence
  Description of Artificial Sequence: Synthetic peptide
  Seed: ITDDQLLAL (PRAME_HUMAN)
IVDDQLLAF

SEQ ID NO: 147936 - protein, 10 aa, Artificial Sequence
  Description of Artificial Sequence: Synthetic peptide
  Seed: MVQAWPFTCL (PRAME_HUMAN)
MFQAWPFTCM

SEQ ID NO: 147937 - protein, 9 aa, Artificial Sequence
  Description of Artificial Sequence: Synthetic peptide
  Seed: ALLPSLSHC (PRAME_HUMAN)
AILPSLSHM

SEQ ID NO: 147938 - protein, 9 aa, Artificial Sequence
  Description of Artificial Sequence: Synthetic peptide
  Seed: FPPLFMAAF (PRAME_HUMAN)
FAPLFMAAM

SEQ ID NO: 147939 - protein, 11 aa, Artificial Sequence
  Description of Artificial Sequence: Synthetic peptide
  Seed: KAVLDGLDVLL (PRAME_HUMAN)
KQVLDGLDVLI

SEQ ID NO: 147940 - protein, 9 aa, Artificial Sequence
  Description of Artificial Sequence: Synthetic peptide
  Seed: LYPVPLESY (PRAME_HUMAN)
LWPVPLESY

SEQ ID NO: 147941 - protein, 11 aa, Artificial Sequence
  Description of Artificial Sequence: Synthetic peptide
  Seed: DVSPEPLQALL (PRAME_HUMAN)
DTSPEPLQALK

SEQ ID NO: 147942 - protein, 9 aa, Artificial Sequence
  Description of Artificial Sequence: Synthetic peptide
  Seed: HVMNPLETL (PRAME_HUMAN)
HPMNPLETI

SEQ ID NO: 147943 - protein, 9 aa, Artificial Sequence
  Description of Artificial Sequence: Synthetic peptide
  Seed: SVWTSPRRL (PRAME_HUMAN)
SMWTSPRRL

SEQ ID NO: 147944 - protein, 9 aa, Artificial Sequence
  Description of Artificial Sequence: Synthetic peptide
  Seed: RTFYDPEPI (PRAME_HUMAN)
RLFYDPEPV

SEQ ID NO: 147945 - protein, 9 aa, Artificial Sequence
  Description of Artificial Sequence: Synthetic peptide
  Seed: SHIHASSYI (PRAME_HUMAN)
SFIHASSYY

SEQ ID NO: 147946 - protein, 9 aa, Artificial Sequence
  Description of Artificial Sequence: Synthetic peptide
  Seed: KFSPYLGQM (PRAME_HUMAN)
KYSPYLGQY

SEQ ID NO: 147947 - protein, 9 aa, Artificial Sequence
  Description of Artificial Sequence: Synthetic peptide
  Seed: SFYGNSISI (PRAME_HUMAN)
SVYGNSISL

SEQ ID NO: 147948 - protein, 9 aa, Artificial Sequence
  Description of Artificial Sequence: Synthetic peptide
  Seed: ISISALQSL (PRAME_HUMAN)
IRISALQSL

SEQ ID NO: 147949 - protein, 9 aa, Artificial Sequence
  Description of Artificial Sequence: Synthetic peptide
  Seed: YIAQFTSQF (PRAME_HUMAN)
YMAQFTSQC

SEQ ID NO: 147950 - protein, 9 aa, Artificial Sequence
  Description of Artificial Sequence: Synthetic peptide
  Seed: RLWGSIQSR (PRAME_HUMAN)
RNWGSIQSY

SEQ ID NO: 147951 - protein, 9 aa, Artificial Sequence
  Description of Artificial Sequence: Synthetic peptide
  Seed: GLSNLTHVL (PRAME_HUMAN)
GISNLTHVI

SEQ ID NO: 147952 - protein, 9 aa, Artificial Sequence
  Description of Artificial Sequence: Synthetic peptide
  Seed: LGRPSMVWL (PRAME_HUMAN)
LSRPSMVWV

SEQ ID NO: 147953 - protein, 10 aa, Artificial Sequence
  Description of Artificial Sequence: Synthetic peptide
  Seed: RHVMNPLETL (PRAME_HUMAN)
RSVMNPLETY

SEQ ID NO: 147954 - protein, 9 aa, Artificial Sequence
  Description of Artificial Sequence: Synthetic peptide
  Seed: SVWTSPRRL (PRAME_HUMAN)
SSWTSPRRY

SEQ ID NO: 147955 - protein, 9 aa, Artificial Sequence
  Description of Artificial Sequence: Synthetic peptide
  Seed: VSPEPLQAL (PRAME_HUMAN)
VSPEPLQAH

SEQ ID NO: 147956 - protein, 9 aa, Artificial Sequence
  Description of Artificial Sequence: Synthetic peptide
  Seed: VLDGLDVLL (PRAME_HUMAN)
VADGLDVLI

SEQ ID NO: 147957 - protein, 10 aa, Artificial Sequence
  Description of Artificial Sequence: Synthetic peptide
  Seed: MPMQDIKMIL (PRAME_HUMAN)
MLMQDIKMIA

SEQ ID NO: 147958 - protein, 11 aa, Artificial Sequence
  Description of Artificial Sequence: Synthetic peptide
  Seed: ISALQSLLQHL (PRAME_HUMAN)
ISALQSLLQHF

SEQ ID NO: 147959 - protein, 10 aa, Artificial Sequence
  Description of Artificial Sequence: Synthetic peptide
  Seed: ISISALQSLL (PRAME_HUMAN)
IAISALQSLY

SEQ ID NO: 147960 - protein, 10 aa, Artificial Sequence
  Description of Artificial Sequence: Synthetic peptide
  Seed: ESYEDIHGTL (PRAME_HUMAN)
EMYEDIHGTF

SEQ ID NO: 147961 - protein, 9 aa, Artificial Sequence
  Description of Artificial Sequence: Synthetic peptide
  Seed: YSFPEPEAA (PRAME_HUMAN)
YQFPEPEAV

SEQ ID NO: 147962 - protein, 9 aa, Artificial Sequence
  Description of Artificial Sequence: Synthetic peptide
  Seed: GNRASLYSF (PRAME_HUMAN)
GQRASLYSY

SEQ ID NO: 147963 - protein, 9 aa, Artificial Sequence
  Description of Artificial Sequence: Synthetic peptide
  Seed: VSQLSVLSL (PRAME_HUMAN)
VTQLSVLSV

SEQ ID NO: 147964 - protein, 10 aa, Artificial Sequence
  Description of Artificial Sequence: Synthetic peptide
  Seed: SQLTTLSFYG (PRAME_HUMAN)
SILTTLSFYY

SEQ ID NO: 147965 - protein, 9 aa, Artificial Sequence
  Description of Artificial Sequence: Synthetic peptide
  Seed: VFDECGITD (PRAME_HUMAN)
VVDECGITF

SEQ ID NO: 147966 - protein, 9 aa, Artificial Sequence
  Description of Artificial Sequence: Synthetic peptide
  Seed: ELAGQSLLK (PRAME_HUMAN)
EMAGQSLLR

SEQ ID NO: 147967 - protein, 10 aa, Artificial Sequence
  Description of Artificial Sequence: Synthetic peptide
  Seed: MLTDVSPEPL (PRAME_HUMAN)
MQTDVSPEPW

SEQ ID NO: 147968 - protein, 9 aa, Artificial Sequence
  Description of Artificial Sequence: Synthetic peptide
  Seed: SFYGNSISI (PRAME_HUMAN)
SLYGNSISM

SEQ ID NO: 147969 - protein, 8 aa, Artificial Sequence
  Description of Artificial Sequence: Synthetic peptide
  Seed: YEDIHGTL (PRAME_HUMAN)
YSDIHGTM

SEQ ID NO: 147970 - protein, 9 aa, Artificial Sequence
  Description of Artificial Sequence: Synthetic peptide
  Seed: VFDECGITD (PRAME_HUMAN)
VYDECGITC

SEQ ID NO: 147971 - protein, 11 aa, Artificial Sequence
  Description of Artificial Sequence: Synthetic peptide
  Seed: LPTLAKFSPYL (PRAME_HUMAN)
LDTLAKFSPYL

SEQ ID NO: 147972 - protein, 9 aa, Artificial Sequence
  Description of Artificial Sequence: Synthetic peptide
  Seed: SIEDLEVTC (PRAME_HUMAN)
STEDLEVTM

SEQ ID NO: 147973 - protein, 10 aa, Artificial Sequence
  Description of Artificial Sequence: Synthetic peptide
  Seed: IKMILKMVQL (PRAME_HUMAN)
ILMILKMVQV

SEQ ID NO: 147974 - protein, 11 aa, Artificial Sequence
  Description of Artificial Sequence: Synthetic peptide
  Seed: FLSLQCLQALY (PRAME_HUMAN)
FISLQCLQALL

SEQ ID NO: 147975 - protein, 10 aa, Artificial Sequence
  Description of Artificial Sequence: Synthetic peptide
  Seed: AQFTSQFLSL (PRAME_HUMAN)
ATFTSQFLSV

SEQ ID NO: 147976 - protein, 9 aa, Artificial Sequence
  Description of Artificial Sequence: Synthetic peptide
  Seed: VSPEPLQAL (PRAME_HUMAN)
VEPEPLQAM

SEQ ID NO: 147977 - protein, 10 aa, Artificial Sequence
  Description of Artificial Sequence: Synthetic peptide
  Seed: MNPLETLSIT (PRAME_HUMAN)
MPPLETLSIA

SEQ ID NO: 147978 - protein, 9 aa, Artificial Sequence
  Description of Artificial Sequence: Synthetic peptide
  Seed: ETLSITNCR (PRAME_HUMAN)
EGLSITNCR

SEQ ID NO: 147979 - protein, 9 aa, Artificial Sequence
  Description of Artificial Sequence: Synthetic peptide
  Seed: VLDGLDVLL (PRAME_HUMAN)
VVDGLDVLF

SEQ ID NO: 147980 - protein, 9 aa, Artificial Sequence
  Description of Artificial Sequence: Synthetic peptide
  Seed: VSQLSVLSL (PRAME_HUMAN)
VDQLSVLSL

SEQ ID NO: 147981 - protein, 9 aa, Artificial Sequence
  Description of Artificial Sequence: Synthetic peptide
  Seed: KLKIFAMPM (PRAME_HUMAN)
KQKIFAMPF

SEQ ID NO: 147982 - protein, 10 aa, Artificial Sequence
  Description of Artificial Sequence: Synthetic peptide
  Seed: AAFDGRHSQT (PRAME_HUMAN)
AAFDGRHSQY

SEQ ID NO: 147983 - protein, 9 aa, Artificial Sequence
  Description of Artificial Sequence: Synthetic peptide
  Seed: TDDQLLALL (PRAME_HUMAN)
TMDQLLALV

SEQ ID NO: 147984 - protein, 9 aa, Artificial Sequence
  Description of Artificial Sequence: Synthetic peptide
  Seed: VLMKGQHLH (PRAME_HUMAN)
VMMKGQHLR

SEQ ID NO: 147985 - protein, 10 aa, Artificial Sequence
  Description of Artificial Sequence: Synthetic peptide
  Seed: IQSRYISMSV (PRAME_HUMAN)
IWSRYISMSA

SEQ ID NO: 147986 - protein, 9 aa, Artificial Sequence
  Description of Artificial Sequence: Synthetic peptide
  Seed: RLDQLLRHV (PRAME_HUMAN)
RGDQLLRHL

SEQ ID NO: 147987 - protein, 10 aa, Artificial Sequence
  Description of Artificial Sequence: Synthetic peptide
  Seed: RELFPPLFMA (PRAME_HUMAN)
RNLFPPLFML

SEQ ID NO: 147988 - protein, 9 aa, Artificial Sequence
  Description of Artificial Sequence: Synthetic peptide
  Seed: ALQSLLQHL (PRAME_HUMAN)
AQQSLLQHV

SEQ ID NO: 147989 - protein, 9 aa, Artificial Sequence
  Description of Artificial Sequence: Synthetic peptide
  Seed: MNPLETLSI (PRAME_HUMAN)
MRPLETLSM

SEQ ID NO: 147990 - protein, 10 aa, Artificial Sequence
  Description of Artificial Sequence: Synthetic peptide
  Seed: SPYLGQMINL (PRAME_HUMAN)
SNYLGQMINF

SEQ ID NO: 147991 - protein, 10 aa, Artificial Sequence
  Description of Artificial Sequence: Synthetic peptide
  Seed: FFLRGRLDQL (PRAME_HUMAN)
FALRGRLDQL

SEQ ID NO: 147992 - protein, 10 aa, Artificial Sequence
  Description of Artificial Sequence: Synthetic peptide
  Seed: QAWPFTCLPL (PRAME_HUMAN)
QTWPFTCLPY

SEQ ID NO: 147993 - protein, 9 aa, Artificial Sequence
  Description of Artificial Sequence: Synthetic peptide
  Seed: TLAKFSPYL (PRAME_HUMAN)
TQAKFSPYM

SEQ ID NO: 147994 - protein, 10 aa, Artificial Sequence
  Description of Artificial Sequence: Synthetic peptide
  Seed: YGNSISISAL (PRAME_HUMAN)
YVNSISISAF

SEQ ID NO: 147995 - protein, 11 aa, Artificial Sequence
  Description of Artificial Sequence: Synthetic peptide
  Seed: LCELGRPSMVW (PRAME_HUMAN)
LTELGRPSMVW

SEQ ID NO: 147996 - protein, 10 aa, Artificial Sequence
  Description of Artificial Sequence: Synthetic peptide
  Seed: AYLHARLREL (PRAME_HUMAN)
AYLHARLREF

SEQ ID NO: 147997 - protein, 9 aa, Artificial Sequence
  Description of Artificial Sequence: Synthetic peptide
  Seed: LSLQCLQAL (PRAME_HUMAN)
LPLQCLQAY

SEQ ID NO: 147998 - protein, 11 aa, Artificial Sequence
  Description of Artificial Sequence: Synthetic peptide
  Seed: KAVLDGLDVLL (PRAME_HUMAN)
KLVLDGLDVLF

SEQ ID NO: 147999 - protein, 11 aa, Artificial Sequence
  Description of Artificial Sequence: Synthetic peptide
  Seed: VMLTDVSPEPL (PRAME_HUMAN)
VYLTDVSPEPL

SEQ ID NO: 148000 - protein, 10 aa, Artificial Sequence
  Description of Artificial Sequence: Synthetic peptide
  Seed: ITDDQLLALL (PRAME_HUMAN)
IWDDQLLALF

SEQ ID NO: 148001 - protein, 9 aa, Artificial Sequence
  Description of Artificial Sequence: Synthetic peptide
  Seed: YIAQFTSQF (PRAME_HUMAN)
YAAQFTSQV

SEQ ID NO: 148002 - protein, 9 aa, Artificial Sequence
  Description of Artificial Sequence: Synthetic peptide
  Seed: YSFPEPEAA (PRAME_HUMAN)
YHFPEPEAL

SEQ ID NO: 148003 - protein, 9 aa, Artificial Sequence
  Description of Artificial Sequence: Synthetic peptide
  Seed: SFPEPEAAQ (PRAME_HUMAN)
SLPEPEAAL

SEQ ID NO: 148004 - protein, 9 aa, Artificial Sequence
  Description of Artificial Sequence: Synthetic peptide
  Seed: LLERASATL (PRAME_HUMAN)
LQERASATY

SEQ ID NO: 148005 - protein, 10 aa, Artificial Sequence
  Description of Artificial Sequence: Synthetic peptide
  Seed: LFPPLFMAAF (PRAME_HUMAN)
LYPPLFMAAW

SEQ ID NO: 148006 - protein, 9 aa, Artificial Sequence
  Description of Artificial Sequence: Synthetic peptide
  Seed: SHIHASSYI (PRAME_HUMAN)
STIHASSYY

SEQ ID NO: 148007 - protein, 9 aa, Artificial Sequence
  Description of Artificial Sequence: Synthetic peptide
  Seed: WLSANPCPH (PRAME_HUMAN)
WSSANPCPF

SEQ ID NO: 148008 - protein, 10 aa, Artificial Sequence
  Description of Artificial Sequence: Synthetic peptide
  Seed: SNLTHVLYPV (PRAME_HUMAN)
SHLTHVLYPL

SEQ ID NO: 148009 - protein, 10 aa, Artificial Sequence
  Description of Artificial Sequence: Synthetic peptide
  Seed: ALYVDSLFFL (PRAME_HUMAN)
ANYVDSLFFF

SEQ ID NO: 148010 - protein, 9 aa, Artificial Sequence
  Description of Artificial Sequence: Synthetic peptide
  Seed: KFSPYLGQM (PRAME_HUMAN)
KLSPYLGQF

SEQ ID NO: 148011 - protein, 9 aa, Artificial Sequence
  Description of Artificial Sequence: Synthetic peptide
  Seed: ISISALQSL (PRAME_HUMAN)
IEISALQSM

SEQ ID NO: 148012 - protein, 11 aa, Artificial Sequence
  Description of Artificial Sequence: Synthetic peptide
  Seed: GITDDQLLALL (PRAME_HUMAN)
GLTDDQLLALL

SEQ ID NO: 148013 - protein, 9 aa, Artificial Sequence
  Description of Artificial Sequence: Synthetic peptide
  Seed: FLRGRLDQL (PRAME_HUMAN)
FQRGRLDQL

SEQ ID NO: 148014 - protein, 9 aa, Artificial Sequence
  Description of Artificial Sequence: Synthetic peptide
  Seed: LLRHVMNPL (PRAME_HUMAN)
LLRHVMNPI

SEQ ID NO: 148015 - protein, 9 aa, Artificial Sequence
  Description of Artificial Sequence: Synthetic peptide
  Seed: GQSLLKDEA (PRAME_HUMAN)
GQSLLKDEV

SEQ ID NO: 148016 - protein, 11 aa, Artificial Sequence
  Description of Artificial Sequence: Synthetic peptide
  Seed: SFPEPEAAQPM (PRAME_HUMAN)
SMPEPEAAQPL

SEQ ID NO: 148017 - protein, 9 aa, Artificial Sequence
  Description of Artificial Sequence: Synthetic peptide
  Seed: KAMVQAWPF (PRAME_HUMAN)
KPMVQAWPI

SEQ ID NO: 148018 - protein, 9 aa, Artificial Sequence
  Description of Artificial Sequence: Synthetic peptide
  Seed: LSNLTHVLY (PRAME_HUMAN)
LSNLTHVLL

SEQ ID NO: 148019 - protein, 9 aa, Artificial Sequence
  Description of Artificial Sequence: Synthetic peptide
  Seed: SFYGNSISI (PRAME_HUMAN)
SIYGNSISI

SEQ ID NO: 148020 - protein, 11 aa, Artificial Sequence
  Description of Artificial Sequence: Synthetic peptide
  Seed: HLSQSPSVSQL (PRAME_HUMAN)
HMSQSPSVSQL

SEQ ID NO: 148021 - protein, 9 aa, Artificial Sequence
  Description of Artificial Sequence: Synthetic peptide
  Seed: AQFTSQFLS (PRAME_HUMAN)
AQFTSQFLA

SEQ ID NO: 148022 - protein, 10 aa, Artificial Sequence
  Description of Artificial Sequence: Synthetic peptide
  Seed: AQFTSQFLSL (PRAME_HUMAN)
ALFTSQFLSL

SEQ ID NO: 148023 - protein, 9 aa, Artificial Sequence
  Description of Artificial Sequence: Synthetic peptide
  Seed: VSPEPLQAL (PRAME_HUMAN)
VNPEPLQAY

SEQ ID NO: 148024 - protein, 9 aa, Artificial Sequence
  Description of Artificial Sequence: Synthetic peptide
  Seed: ISISALQSL (PRAME_HUMAN)
IIISALQSY

SEQ ID NO: 148025 - protein, 9 aa, Artificial Sequence
  Description of Artificial Sequence: Synthetic peptide
  Seed: SLFFLRGRL (PRAME_HUMAN)
SMFFLRGRV

SEQ ID NO: 148026 - protein, 9 aa, Artificial Sequence
  Description of Artificial Sequence: Synthetic peptide
  Seed: LQSLLQHLI (PRAME_HUMAN)
LMSLLQHLL

SEQ ID NO: 148027 - protein, 9 aa, Artificial Sequence
  Description of Artificial Sequence: Synthetic peptide
  Seed: HVMNPLETL (PRAME_HUMAN)
HVMNPLETV

SEQ ID NO: 148028 - protein, 10 aa, Artificial Sequence
  Description of Artificial Sequence: Synthetic peptide
  Seed: TSQFLSLQCL (PRAME_HUMAN)
TCQFLSLQCY

SEQ ID NO: 148029 - protein, 9 aa, Artificial Sequence
  Description of Artificial Sequence: Synthetic peptide
  Seed: LPTLAKFSP (PRAME_HUMAN)
LPTLAKFSA

SEQ ID NO: 148030 - protein, 9 aa, Artificial Sequence
  Description of Artificial Sequence: Synthetic peptide
  Seed: MPMQDIKMI (PRAME_HUMAN)
MLMQDIKMY

SEQ ID NO: 148031 - protein, 9 aa, Artificial Sequence
  Description of Artificial Sequence: Synthetic peptide
  Seed: SQSPSVSQL (PRAME_HUMAN)
SFSPSVSQY

SEQ ID NO: 148032 - protein, 9 aa, Artificial Sequence
  Description of Artificial Sequence: Synthetic peptide
  Seed: ACDELFSYL (PRAME_HUMAN)
AADELFSYM

SEQ ID NO: 148033 - protein, 9 aa, Artificial Sequence
  Description of Artificial Sequence: Synthetic peptide
  Seed: SHQDFWTVW (PRAME_HUMAN)
SMQDFWTVW

SEQ ID NO: 148034 - protein, 9 aa, Artificial Sequence
  Description of Artificial Sequence: Synthetic peptide
  Seed: LLKDEALAI (PRAME_HUMAN)
LSKDEALAM

SEQ ID NO: 148035 - protein, 9 aa, Artificial Sequence
  Description of Artificial Sequence: Synthetic peptide
  Seed: LAIAALELL (PRAME_HUMAN)
LVIAALELL

SEQ ID NO: 148036 - protein, 9 aa, Artificial Sequence
  Description of Artificial Sequence: Synthetic peptide
  Seed: QSRYISMSV (PRAME_HUMAN)
QSRYISMSI

SEQ ID NO: 148037 - protein, 11 aa, Artificial Sequence
  Description of Artificial Sequence: Synthetic peptide
  Seed: RRWKLQVLDLR (PRAME_HUMAN)
RMWKLQVLDLR

SEQ ID NO: 148038 - protein, 10 aa, Artificial Sequence
  Description of Artificial Sequence: Synthetic peptide
  Seed: FIPVEVLVDL (PRAME_HUMAN)
FNPVEVLVDY

SEQ ID NO: 148039 - protein, 10 aa, Artificial Sequence
  Description of Artificial Sequence: Synthetic peptide
  Seed: RLAYLHARLR (PRAME_HUMAN)
RHAYLHARLR

SEQ ID NO: 148040 - protein, 11 aa, Artificial Sequence
  Description of Artificial Sequence: Synthetic peptide
  Seed: AAFDGRHSQTL (PRAME_HUMAN)
AQFDGRHSQTF

SEQ ID NO: 148041 - protein, 9 aa, Artificial Sequence
  Description of Artificial Sequence: Synthetic peptide
  Seed: DGRHSQTLK (PRAME_HUMAN)
DFRHSQTLR

SEQ ID NO: 148042 - protein, 9 aa, Artificial Sequence
  Description of Artificial Sequence: Synthetic peptide
  Seed: EPLQALLER (PRAME_HUMAN)
EWLQALLER

SEQ ID NO: 148043 - protein, 9 aa, Artificial Sequence
  Description of Artificial Sequence: Synthetic peptide
  Seed: GACDELFSY (PRAME_HUMAN)
GTCDELFSW

SEQ ID NO: 148044 - protein, 10 aa, Artificial Sequence
  Description of Artificial Sequence: Synthetic peptide
  Seed: MPMQDIKMIL (PRAME_HUMAN)
MCMQDIKMIL

SEQ ID NO: 148045 - protein, 10 aa, Artificial Sequence
  Description of Artificial Sequence: Synthetic peptide
  Seed: RLWGSIQSRY (PRAME_HUMAN)
RYWGSIQSRR

SEQ ID NO: 148046 - protein, 10 aa, Artificial Sequence
  Description of Artificial Sequence: Synthetic peptide
  Seed: GRPSMVWLSA (PRAME_HUMAN)
GVPSMVWLSL

SEQ ID NO: 148047 - protein, 10 aa, Artificial Sequence
  Description of Artificial Sequence: Synthetic peptide
  Seed: AIAALELLPR (PRAME_HUMAN)
ALAALELLPR

SEQ ID NO: 148048 - protein, 9 aa, Artificial Sequence
  Description of Artificial Sequence: Synthetic peptide
  Seed: MINLRRLLL (PRAME_HUMAN)
MMNLRRLLI

SEQ ID NO: 148049 - protein, 11 aa, Artificial Sequence
  Description of Artificial Sequence: Synthetic peptide
  Seed: IAQFTSQFLSL (PRAME_HUMAN)
IRQFTSQFLSY

SEQ ID NO: 148050 - protein, 9 aa, Artificial Sequence
  Description of Artificial Sequence: Synthetic peptide
  Seed: MINLRRLLL (PRAME_HUMAN)
MPNLRRLLI

SEQ ID NO: 148051 - protein, 9 aa, Artificial Sequence
  Description of Artificial Sequence: Synthetic peptide
  Seed: ELFSYLIEK (PRAME_HUMAN)
EAFSYLIER

SEQ ID NO: 148052 - protein, 9 aa, Artificial Sequence
  Description of Artificial Sequence: Synthetic peptide
  Seed: NLTHVLYPV (PRAME_HUMAN)
NLTHVLYPA

SEQ ID NO: 148053 - protein, 9 aa, Artificial Sequence
  Description of Artificial Sequence: Synthetic peptide
  Seed: NLTHVLYPV (PRAME_HUMAN)
NNTHVLYPV

SEQ ID NO: 148054 - protein, 9 aa, Artificial Sequence
  Description of Artificial Sequence: Synthetic peptide
  Seed: FLRGRLDQL (PRAME_HUMAN)
FYRGRLDQY

SEQ ID NO: 148055 - protein, 9 aa, Artificial Sequence
  Description of Artificial Sequence: Synthetic peptide
  Seed: ISPEKEEQY (PRAME_HUMAN)
IRPEKEEQF

SEQ ID NO: 148056 - protein, 11 aa, Artificial Sequence
  Description of Artificial Sequence: Synthetic peptide
  Seed: YISPEKEEQYI (PRAME_HUMAN)
YASPEKEEQYL

SEQ ID NO: 148057 - protein, 9 aa, Artificial Sequence
  Description of Artificial Sequence: Synthetic peptide
  Seed: NLTHVLYPV (PRAME_HUMAN)
NVTHVLYPV

SEQ ID NO: 148058 - protein, 8 aa, Artificial Sequence
  Description of Artificial Sequence: Synthetic peptide
  Seed: YVDSLFFL (PRAME_HUMAN)
YMDSLFFA

SEQ ID NO: 148059 - protein, 9 aa, Artificial Sequence
  Description of Artificial Sequence: Synthetic peptide
  Seed: TDDQLLALL (PRAME_HUMAN)
TMDQLLALI

SEQ ID NO: 148060 - protein, 9 aa, Artificial Sequence
  Description of Artificial Sequence: Synthetic peptide
  Seed: TCLPLGVLM (PRAME_HUMAN)
TTLPLGVLW

SEQ ID NO: 148061 - protein, 9 aa, Artificial Sequence
  Description of Artificial Sequence: Synthetic peptide
  Seed: SYEDIHGTL (PRAME_HUMAN)
SSEDIHGTI

SEQ ID NO: 148062 - protein, 11 aa, Artificial Sequence
  Description of Artificial Sequence: Synthetic peptide
  Seed: VQLDSIEDLEV (PRAME_HUMAN)
VLLDSIEDLEV

SEQ ID NO: 148063 - protein, 9 aa, Artificial Sequence
  Description of Artificial Sequence: Synthetic peptide
  Seed: LKMVQLDSI (PRAME_HUMAN)
LRMVQLDSY

SEQ ID NO: 148064 - protein, 9 aa, Artificial Sequence
  Description of Artificial Sequence: Synthetic peptide
  Seed: YIAQFTSQF (PRAME_HUMAN)
YTAQFTSQF

SEQ ID NO: 148065 - protein, 9 aa, Artificial Sequence
  Description of Artificial Sequence: Synthetic peptide
  Seed: SLLQHLIGL (PRAME_HUMAN)
SQLQHLIGL

SEQ ID NO: 148066 - protein, 9 aa, Artificial Sequence
  Description of Artificial Sequence: Synthetic peptide
  Seed: SMSVWTSPR (PRAME_HUMAN)
SISVWTSPY

SEQ ID NO: 148067 - protein, 9 aa, Artificial Sequence
  Description of Artificial Sequence: Synthetic peptide
  Seed: VFDECGITD (PRAME_HUMAN)
VCDECGITL

SEQ ID NO: 148068 - protein, 10 aa, Artificial Sequence
  Description of Artificial Sequence: Synthetic peptide
  Seed: AQFTSQFLSL (PRAME_HUMAN)
AMFTSQFLSI

SEQ ID NO: 148069 - protein, 9 aa, Artificial Sequence
  Description of Artificial Sequence: Synthetic peptide
  Seed: FSPYLGQMI (PRAME_HUMAN)
FAPYLGQMM

SEQ ID NO: 148070 - protein, 9 aa, Artificial Sequence
  Description of Artificial Sequence: Synthetic peptide
  Seed: VLYPVPLES (PRAME_HUMAN)
VLYPVPLEI

SEQ ID NO: 148071 - protein, 10 aa, Artificial Sequence
  Description of Artificial Sequence: Synthetic peptide
  Seed: KNVLRLCCKK (PRAME_HUMAN)
KFVLRLCCKR

SEQ ID NO: 148072 - protein, 9 aa, Artificial Sequence
  Description of Artificial Sequence: Synthetic peptide
  Seed: SLLQHLIGL (PRAME_HUMAN)
SLLQHLIGC

SEQ ID NO: 148073 - protein, 8 aa, Artificial Sequence
  Description of Artificial Sequence: Synthetic peptide
  Seed: YVDSLFFL (PRAME_HUMAN)
YLDSLFFI

SEQ ID NO: 148074 - protein, 10 aa, Artificial Sequence
  Description of Artificial Sequence: Synthetic peptide
  Seed: DRTFYDPEPI (PRAME_HUMAN)
DKTFYDPEPV

SEQ ID NO: 148075 - protein, 11 aa, Artificial Sequence
  Description of Artificial Sequence: Synthetic peptide
  Seed: YISMSVWTSPR (PRAME_HUMAN)
YYSMSVWTSPR

SEQ ID NO: 148076 - protein, 11 aa, Artificial Sequence
  Description of Artificial Sequence: Synthetic peptide
  Seed: LTDVSPEPLQA (PRAME_HUMAN)
LVDVSPEPLQI

SEQ ID NO: 148077 - protein, 9 aa, Artificial Sequence
  Description of Artificial Sequence: Synthetic peptide
  Seed: RGRLDQLLR (PRAME_HUMAN)
RARLDQLLA

SEQ ID NO: 148078 - protein, 9 aa, Artificial Sequence
  Description of Artificial Sequence: Synthetic peptide
  Seed: AVLDGLDVL (PRAME_HUMAN)
ALLDGLDVY

SEQ ID NO: 148079 - protein, 8 aa, Artificial Sequence
  Description of Artificial Sequence: Synthetic peptide
  Seed: VMNPLETL (PRAME_HUMAN)
VANPLETF

SEQ ID NO: 148080 - protein, 9 aa, Artificial Sequence
  Description of Artificial Sequence: Synthetic peptide
  Seed: YSFPEPEAA (PRAME_HUMAN)
YYFPEPEAF

SEQ ID NO: 148081 - protein, 9 aa, Artificial Sequence
  Description of Artificial Sequence: Synthetic peptide
  Seed: FPPLFMAAF (PRAME_HUMAN)
FAPLFMAAF

SEQ ID NO: 148082 - protein, 10 aa, Artificial Sequence
  Description of Artificial Sequence: Synthetic peptide
  Seed: KKLKIFAMPM (PRAME_HUMAN)
KMLKIFAMPF

SEQ ID NO: 148083 - protein, 9 aa, Artificial Sequence
  Description of Artificial Sequence: Synthetic peptide
  Seed: LTDVSPEPL (PRAME_HUMAN)
LADVSPEPL

SEQ ID NO: 148084 - protein, 10 aa, Artificial Sequence
  Description of Artificial Sequence: Synthetic peptide
  Seed: VTCTWKLPTL (PRAME_HUMAN)
VVCTWKLPTI

SEQ ID NO: 148085 - protein, 10 aa, Artificial Sequence
  Description of Artificial Sequence: Synthetic peptide
  Seed: YSFPEPEAAQ (PRAME_HUMAN)
YSFPEPEAAI

SEQ ID NO: 148086 - protein, 10 aa, Artificial Sequence
  Description of Artificial Sequence: Synthetic peptide
  Seed: QLLRHVMNPL (PRAME_HUMAN)
QGLRHVMNPV

SEQ ID NO: 148087 - protein, 9 aa, Artificial Sequence
  Description of Artificial Sequence: Synthetic peptide
  Seed: NSISISALQ (PRAME_HUMAN)
NGISISALR

SEQ ID NO: 148088 - protein, 9 aa, Artificial Sequence
  Description of Artificial Sequence: Synthetic peptide
  Seed: RLAYLHARL (PRAME_HUMAN)
RMAYLHARI

SEQ ID NO: 148089 - protein, 11 aa, Artificial Sequence
  Description of Artificial Sequence: Synthetic peptide
  Seed: AAFDGRHSQTL (PRAME_HUMAN)
AMFDGRHSQTK

SEQ ID NO: 148090 - protein, 9 aa, Artificial Sequence
  Description of Artificial Sequence: Synthetic peptide
  Seed: TCLPLGVLM (PRAME_HUMAN)
TILPLGVLL

SEQ ID NO: 148091 - protein, 10 aa, Artificial Sequence
  Description of Artificial Sequence: Synthetic peptide
  Seed: RELFPPLFMA (PRAME_HUMAN)
RMLFPPLFMI

SEQ ID NO: 148092 - protein, 11 aa, Artificial Sequence
  Description of Artificial Sequence: Synthetic peptide
  Seed: RRWKLQVLDLR (PRAME_HUMAN)
RFWKLQVLDLR

SEQ ID NO: 148093 - protein, 10 aa, Artificial Sequence
  Description of Artificial Sequence: Synthetic peptide
  Seed: MLTDVSPEPL (PRAME_HUMAN)
MVTDVSPEPI

SEQ ID NO: 148094 - protein, 9 aa, Artificial Sequence
  Description of Artificial Sequence: Synthetic peptide
  Seed: FLRGRLDQL (PRAME_HUMAN)
FSRGRLDQY

SEQ ID NO: 148095 - protein, 9 aa, Artificial Sequence
  Description of Artificial Sequence: Synthetic peptide
  Seed: MVQAWPFTC (PRAME_HUMAN)
MQQAWPFTM

SEQ ID NO: 148096 - protein, 10 aa, Artificial Sequence
  Description of Artificial Sequence: Synthetic peptide
  Seed: LSVLSLSGVM (PRAME_HUMAN)
LYVLSLSGVY

SEQ ID NO: 148097 - protein, 11 aa, Artificial Sequence
  Description of Artificial Sequence: Synthetic peptide
  Seed: IGLSNLTHVLY (PRAME_HUMAN)
ITLSNLTHVLY

SEQ ID NO: 148098 - protein, 11 aa, Artificial Sequence
  Description of Artificial Sequence: Synthetic peptide
  Seed: LPTLAKFSPYL (PRAME_HUMAN)
LYTLAKFSPYL

SEQ ID NO: 148099 - protein, 9 aa, Artificial Sequence
  Description of Artificial Sequence: Synthetic peptide
  Seed: FLRGRLDQL (PRAME_HUMAN)
FLRGRLDQT

SEQ ID NO: 148100 - protein, 10 aa, Artificial Sequence
  Description of Artificial Sequence: Synthetic peptide
  Seed: RRRLWGSIQS (PRAME_HUMAN)
RGRLWGSIQR

SEQ ID NO: 148101 - protein, 10 aa, Artificial Sequence
  Description of Artificial Sequence: Synthetic peptide
  Seed: VELAGQSLLK (PRAME_HUMAN)
VPLAGQSLLK

SEQ ID NO: 148102 - protein, 9 aa, Artificial Sequence
  Description of Artificial Sequence: Synthetic peptide
  Seed: SPSVSQLSV (PRAME_HUMAN)
SASVSQLSF

SEQ ID NO: 148103 - protein, 9 aa, Artificial Sequence
  Description of Artificial Sequence: Synthetic peptide
  Seed: VQLDSIEDL (PRAME_HUMAN)
VVLDSIEDL

SEQ ID NO: 148104 - protein, 9 aa, Artificial Sequence
  Description of Artificial Sequence: Synthetic peptide
  Seed: YLHARLREL (PRAME_HUMAN)
YRHARLREF

SEQ ID NO: 148105 - protein, 9 aa, Artificial Sequence
  Description of Artificial Sequence: Synthetic peptide
  Seed: ACDELFSYL (PRAME_HUMAN)
ALDELFSYL

SEQ ID NO: 148106 - protein, 9 aa, Artificial Sequence
  Description of Artificial Sequence: Synthetic peptide
  Seed: SQSPSVSQL (PRAME_HUMAN)
SSSPSVSQL

SEQ ID NO: 148107 - protein, 11 aa, Artificial Sequence
  Description of Artificial Sequence: Synthetic peptide
  Seed: RRLWGSIQSRY (PRAME_HUMAN)
RTLWGSIQSRR

SEQ ID NO: 148108 - protein, 9 aa, Artificial Sequence
  Description of Artificial Sequence: Synthetic peptide
  Seed: FYDPEPILC (PRAME_HUMAN)
FPDPEPILV

SEQ ID NO: 148109 - protein, 9 aa, Artificial Sequence
  Description of Artificial Sequence: Synthetic peptide
  Seed: SLLQHLIGL (PRAME_HUMAN)
SMLQHLIGM

SEQ ID NO: 148110 - protein, 10 aa, Artificial Sequence
  Description of Artificial Sequence: Synthetic peptide
  Seed: LSQSPSVSQL (PRAME_HUMAN)
LEQSPSVSQF

SEQ ID NO: 148111 - protein, 9 aa, Artificial Sequence
  Description of Artificial Sequence: Synthetic peptide
  Seed: ALAIAALEL (PRAME_HUMAN)
ASAIAALEF

SEQ ID NO: 148112 - protein, 10 aa, Artificial Sequence
  Description of Artificial Sequence: Synthetic peptide
  Seed: MVQAWPFTCL (PRAME_HUMAN)
MTQAWPFTCW

SEQ ID NO: 148113 - protein, 10 aa, Artificial Sequence
  Description of Artificial Sequence: Synthetic peptide
  Seed: TTLSFYGNSI (PRAME_HUMAN)
TLLSFYGNSL

SEQ ID NO: 148114 - protein, 9 aa, Artificial Sequence
  Description of Artificial Sequence: Synthetic peptide
  Seed: AWPFTCLPL (PRAME_HUMAN)
AYPFTCLPI

SEQ ID NO: 148115 - protein, 10 aa, Artificial Sequence
  Description of Artificial Sequence: Synthetic peptide
  Seed: ALLERASATL (PRAME_HUMAN)
ALLERASATA

SEQ ID NO: 148116 - protein, 10 aa, Artificial Sequence
  Description of Artificial Sequence: Synthetic peptide
  Seed: AMVQAWPFTC (PRAME_HUMAN)
APVQAWPFTV

SEQ ID NO: 148117 - protein, 10 aa, Artificial Sequence
  Description of Artificial Sequence: Synthetic peptide
  Seed: RPRRWKLQVL (PRAME_HUMAN)
RPRRWKLQVM

SEQ ID NO: 148118 - protein, 10 aa, Artificial Sequence
  Description of Artificial Sequence: Synthetic peptide
  Seed: YVDSLFFLRG (PRAME_HUMAN)
YYDSLFFLRR

SEQ ID NO: 148119 - protein, 9 aa, Artificial Sequence
  Description of Artificial Sequence: Synthetic peptide
  Seed: LAYLHARLR (PRAME_HUMAN)
LQYLHARLR

SEQ ID NO: 148120 - protein, 9 aa, Artificial Sequence
  Description of Artificial Sequence: Synthetic peptide
  Seed: LYVDSLFFL (PRAME_HUMAN)
LQVDSLFFT

SEQ ID NO: 148121 - protein, 10 aa, Artificial Sequence
  Description of Artificial Sequence: Synthetic peptide
  Seed: SPYLGQMINL (PRAME_HUMAN)
SYYLGQMINF

SEQ ID NO: 148122 - protein, 11 aa, Artificial Sequence
  Description of Artificial Sequence: Synthetic peptide
  Seed: SQSPSVSQLSV (PRAME_HUMAN)
SLSPSVSQLSV

SEQ ID NO: 148123 - protein, 9 aa, Artificial Sequence
  Description of Artificial Sequence: Synthetic peptide
  Seed: RLWGSIQSR (PRAME_HUMAN)
RIWGSIQSA

SEQ ID NO: 148124 - protein, 10 aa, Artificial Sequence
  Description of Artificial Sequence: Synthetic peptide
  Seed: EAAQPMTKKR (PRAME_HUMAN)
EVAQPMTKKR

SEQ ID NO: 148125 - protein, 11 aa, Artificial Sequence
  Description of Artificial Sequence: Synthetic peptide
  Seed: SLYSFPEPEAA (PRAME_HUMAN)
SLYSFPEPEAI

SEQ ID NO: 148126 - protein, 9 aa, Artificial Sequence
  Description of Artificial Sequence: Synthetic peptide
  Seed: VLDGLDVLL (PRAME_HUMAN)
VMDGLDVLL

SEQ ID NO: 148127 - protein, 9 aa, Artificial Sequence
  Description of Artificial Sequence: Synthetic peptide
  Seed: FYDPEPILC (PRAME_HUMAN)
FHDPEPILI

SEQ ID NO: 148128 - protein, 9 aa, Artificial Sequence
  Description of Artificial Sequence: Synthetic peptide
  Seed: SMSVWTSPR (PRAME_HUMAN)
STSVWTSPY

SEQ ID NO: 148129 - protein, 9 aa, Artificial Sequence
  Description of Artificial Sequence: Synthetic peptide
  Seed: ISISALQSL (PRAME_HUMAN)
IIISALQSV

SEQ ID NO: 148130 - protein, 8 aa, Artificial Sequence
  Description of Artificial Sequence: Synthetic peptide
  Seed: YEDIHGTL (PRAME_HUMAN)
YTDIHGTV

SEQ ID NO: 148131 - protein, 9 aa, Artificial Sequence
  Description of Artificial Sequence: Synthetic peptide
  Seed: TWKLPTLAK (PRAME_HUMAN)
TAKLPTLAR

SEQ ID NO: 148132 - protein, 9 aa, Artificial Sequence
  Description of Artificial Sequence: Synthetic peptide
  Seed: LLLSHIHAS (PRAME_HUMAN)
LVLSHIHAM

SEQ ID NO: 148133 - protein, 9 aa, Artificial Sequence
  Description of Artificial Sequence: Synthetic peptide
  Seed: MHLSQSPSV (PRAME_HUMAN)
MQLSQSPSL

SEQ ID NO: 148134 - protein, 11 aa, Artificial Sequence
  Description of Artificial Sequence: Synthetic peptide
  Seed: YLGQMINLRRL (PRAME_HUMAN)
YLGQMINLRRV

SEQ ID NO: 148135 - protein, 9 aa, Artificial Sequence
  Description of Artificial Sequence: Synthetic peptide
  Seed: EVLVDLFLK (PRAME_HUMAN)
EFLVDLFLR

SEQ ID NO: 148136 - protein, 9 aa, Artificial Sequence
  Description of Artificial Sequence: Synthetic peptide
  Seed: ISISALQSL (PRAME_HUMAN)
IGISALQSF

SEQ ID NO: 148137 - protein, 9 aa, Artificial Sequence
  Description of Artificial Sequence: Synthetic peptide
  Seed: HARLRELLC (PRAME_HUMAN)
HPRLRELLL

SEQ ID NO: 148138 - protein, 11 aa, Artificial Sequence
  Description of Artificial Sequence: Synthetic peptide
  Seed: LPTLAKFSPYL (PRAME_HUMAN)
LNTLAKFSPYV

SEQ ID NO: 148139 - protein, 10 aa, Artificial Sequence
  Description of Artificial Sequence: Synthetic peptide
  Seed: YIAQFTSQFL (PRAME_HUMAN)
YLAQFTSQFA

SEQ ID NO: 148140 - protein, 9 aa, Artificial Sequence
  Description of Artificial Sequence: Synthetic peptide
  Seed: RGRLDQLLR (PRAME_HUMAN)
RSRLDQLLI

SEQ ID NO: 148141 - protein, 11 aa, Artificial Sequence
  Description of Artificial Sequence: Synthetic peptide
  Seed: RASATLQDLVF (PRAME_HUMAN)
RGSATLQDLVW

SEQ ID NO: 148142 - protein, 9 aa, Artificial Sequence
  Description of Artificial Sequence: Synthetic peptide
  Seed: RHSQTLKAM (PRAME_HUMAN)
RMSQTLKAY

SEQ ID NO: 148143 - protein, 9 aa, Artificial Sequence
  Description of Artificial Sequence: Synthetic peptide
  Seed: LFPPLFMAA (PRAME_HUMAN)
LYPPLFMAM

SEQ ID NO: 148144 - protein, 10 aa, Artificial Sequence
  Description of Artificial Sequence: Synthetic peptide
  Seed: VMNPLETLSI (PRAME_HUMAN)
VMNPLETLSV

SEQ ID NO: 148145 - protein, 10 aa, Artificial Sequence
  Description of Artificial Sequence: Synthetic peptide
  Seed: FFLRGRLDQL (PRAME_HUMAN)
FYLRGRLDQY

SEQ ID NO: 148146 - protein, 9 aa, Artificial Sequence
  Description of Artificial Sequence: Synthetic peptide
  Seed: RWKLQVLDL (PRAME_HUMAN)
RQKLQVLDK

SEQ ID NO: 148147 - protein, 10 aa, Artificial Sequence
  Description of Artificial Sequence: Synthetic peptide
  Seed: ESYEDIHGTL (PRAME_HUMAN)
EAYEDIHGTY

SEQ ID NO: 148148 - protein, 9 aa, Artificial Sequence
  Description of Artificial Sequence: Synthetic peptide
  Seed: RLWGSIQSR (PRAME_HUMAN)
RGWGSIQSY

SEQ ID NO: 148149 - protein, 10 aa, Artificial Sequence
  Description of Artificial Sequence: Synthetic peptide
  Seed: LKAMVQAWPF (PRAME_HUMAN)
LPAMVQAWPL

SEQ ID NO: 148150 - protein, 9 aa, Artificial Sequence
  Description of Artificial Sequence: Synthetic peptide
  Seed: AAFDGRHSQ (PRAME_HUMAN)
AIFDGRHSY

SEQ ID NO: 148151 - protein, 9 aa, Artificial Sequence
  Description of Artificial Sequence: Synthetic peptide
  Seed: KMILKMVQL (PRAME_HUMAN)
KLILKMVQA

SEQ ID NO: 148152 - protein, 9 aa, Artificial Sequence
  Description of Artificial Sequence: Synthetic peptide
  Seed: VLDGLDVLL (PRAME_HUMAN)
VVDGLDVLL

SEQ ID NO: 148153 - protein, 9 aa, Artificial Sequence
  Description of Artificial Sequence: Synthetic peptide
  Seed: SLSHCSQLT (PRAME_HUMAN)
SMSHCSQLM

SEQ ID NO: 148154 - protein, 9 aa, Artificial Sequence
  Description of Artificial Sequence: Synthetic peptide
  Seed: AWPFTCLPL (PRAME_HUMAN)
AMPFTCLPF

SEQ ID NO: 148155 - protein, 10 aa, Artificial Sequence
  Description of Artificial Sequence: Synthetic peptide
  Seed: RTFYDPEPIL (PRAME_HUMAN)
RAFYDPEPIW

SEQ ID NO: 148156 - protein, 9 aa, Artificial Sequence
  Description of Artificial Sequence: Synthetic peptide
  Seed: SPEPLQALL (PRAME_HUMAN)
SFEPLQALL

SEQ ID NO: 148157 - protein, 9 aa, Artificial Sequence
  Description of Artificial Sequence: Synthetic peptide
  Seed: RELFPPLFM (PRAME_HUMAN)
RELFPPLFF

SEQ ID NO: 148158 - protein, 10 aa, Artificial Sequence
  Description of Artificial Sequence: Synthetic peptide
  Seed: AVLDGLDVLL (PRAME_HUMAN)
AMLDGLDVLI

SEQ ID NO: 148159 - protein, 9 aa, Artificial Sequence
  Description of Artificial Sequence: Synthetic peptide
  Seed: ALLERASAT (PRAME_HUMAN)
AMLERASAM

SEQ ID NO: 148160 - protein, 9 aa, Artificial Sequence
  Description of Artificial Sequence: Synthetic peptide
  Seed: VFDECGITD (PRAME_HUMAN)
VYDECGITA

SEQ ID NO: 148161 - protein, 9 aa, Artificial Sequence
  Description of Artificial Sequence: Synthetic peptide
  Seed: TLAKFSPYL (PRAME_HUMAN)
TVAKFSPYY

SEQ ID NO: 148162 - protein, 11 aa, Artificial Sequence
  Description of Artificial Sequence: Synthetic peptide
  Seed: MKGQHLHLETF (PRAME_HUMAN)
MRGQHLHLETY

SEQ ID NO: 148163 - protein, 9 aa, Artificial Sequence
  Description of Artificial Sequence: Synthetic peptide
  Seed: LSLQCLQAL (PRAME_HUMAN)
LLLQCLQAY

SEQ ID NO: 148164 - protein, 10 aa, Artificial Sequence
  Description of Artificial Sequence: Synthetic peptide
  Seed: FSYLIEKVKR (PRAME_HUMAN)
FTYLIEKVKK

SEQ ID NO: 148165 - protein, 10 aa, Artificial Sequence
  Description of Artificial Sequence: Synthetic peptide
  Seed: DELFSYLIEK (PRAME_HUMAN)
DGLFSYLIER

SEQ ID NO: 148166 - protein, 10 aa, Artificial Sequence
  Description of Artificial Sequence: Synthetic peptide
  Seed: LLLSHIHASS (PRAME_HUMAN)
LDLSHIHASL

SEQ ID NO: 148167 - protein, 9 aa, Artificial Sequence
  Description of Artificial Sequence: Synthetic peptide
  Seed: FYDPEPILC (PRAME_HUMAN)
FTDPEPILV

SEQ ID NO: 148168 - protein, 8 aa, Artificial Sequence
  Description of Artificial Sequence: Synthetic peptide
  Seed: SQLSVLSL (PRAME_HUMAN)
SELSVLSV

SEQ ID NO: 148169 - protein, 9 aa, Artificial Sequence
  Description of Artificial Sequence: Synthetic peptide
  Seed: SFPEPEAAQ (PRAME_HUMAN)
SMPEPEAAM

SEQ ID NO: 148170 - protein, 10 aa, Artificial Sequence
  Description of Artificial Sequence: Synthetic peptide
  Seed: LSQSPSVSQL (PRAME_HUMAN)
LKQSPSVSQM

SEQ ID NO: 148171 - protein, 9 aa, Artificial Sequence
  Description of Artificial Sequence: Synthetic peptide
  Seed: SLLQHLIGL (PRAME_HUMAN)
SQLQHLIGW

SEQ ID NO: 148172 - protein, 11 aa, Artificial Sequence
  Description of Artificial Sequence: Synthetic peptide
  Seed: SFPEPEAAQPM (PRAME_HUMAN)
SSPEPEAAQPL

SEQ ID NO: 148173 - protein, 10 aa, Artificial Sequence
  Description of Artificial Sequence: Synthetic peptide
  Seed: RHVMNPLETL (PRAME_HUMAN)
RIVMNPLETW

SEQ ID NO: 148174 - protein, 10 aa, Artificial Sequence
  Description of Artificial Sequence: Synthetic peptide
  Seed: AVLDGLDVLL (PRAME_HUMAN)
AMLDGLDVLL

SEQ ID NO: 148175 - protein, 9 aa, Artificial Sequence
  Description of Artificial Sequence: Synthetic peptide
  Seed: RLRELLCEL (PRAME_HUMAN)
RERELLCEY

SEQ ID NO: 148176 - protein, 9 aa, Artificial Sequence
  Description of Artificial Sequence: Synthetic peptide
  Seed: LVELAGQSL (PRAME_HUMAN)
LAELAGQSI

SEQ ID NO: 148177 - protein, 10 aa, Artificial Sequence
  Description of Artificial Sequence: Synthetic peptide
  Seed: ALYVDSLFFL (PRAME_HUMAN)
ADYVDSLFFF

SEQ ID NO: 148178 - protein, 11 aa, Artificial Sequence
  Description of Artificial Sequence: Synthetic peptide
  Seed: RELFPPLFMAA (PRAME_HUMAN)
RVLFPPLFMAV

SEQ ID NO: 148179 - protein, 9 aa, Artificial Sequence
  Description of Artificial Sequence: Synthetic peptide
  Seed: YLHARLREL (PRAME_HUMAN)
YTHARLREV

SEQ ID NO: 148180 - protein, 10 aa, Artificial Sequence
  Description of Artificial Sequence: Synthetic peptide
  Seed: ALYVDSLFFL (PRAME_HUMAN)
AIYVDSLFFL

SEQ ID NO: 148181 - protein, 11 aa, Artificial Sequence
  Description of Artificial Sequence: Synthetic peptide
  Seed: HLSQSPSVSQL (PRAME_HUMAN)
HSSQSPSVSQY

SEQ ID NO: 148182 - protein, 9 aa, Artificial Sequence
  Description of Artificial Sequence: Synthetic peptide
  Seed: YIAQFTSQF (PRAME_HUMAN)
YPAQFTSQM

SEQ ID NO: 148183 - protein, 10 aa, Artificial Sequence
  Description of Artificial Sequence: Synthetic peptide
  Seed: KIFAMPMQDI (PRAME_HUMAN)
KMFAMPMQDA

SEQ ID NO: 148184 - protein, 10 aa, Artificial Sequence
  Description of Artificial Sequence: Synthetic peptide
  Seed: RASATLQDLV (PRAME_HUMAN)
RMSATLQDLF

SEQ ID NO: 148185 - protein, 9 aa, Artificial Sequence
  Description of Artificial Sequence: Synthetic peptide
  Seed: TLHLERLAY (PRAME_HUMAN)
TRHLERLAY

SEQ ID NO: 148186 - protein, 9 aa, Artificial Sequence
  Description of Artificial Sequence: Synthetic peptide
  Seed: ITDDQLLAL (PRAME_HUMAN)
IEDDQLLAM

SEQ ID NO: 148187 - protein, 11 aa, Artificial Sequence
  Description of Artificial Sequence: Synthetic peptide
  Seed: RLVELAGQSLL (PRAME_HUMAN)
RVVELAGQSLF

SEQ ID NO: 148188 - protein, 9 aa, Artificial Sequence
  Description of Artificial Sequence: Synthetic peptide
  Seed: RLRELLCEL (PRAME_HUMAN)
RWRELLCEY

SEQ ID NO: 148189 - protein, 9 aa, Artificial Sequence
  Description of Artificial Sequence: Synthetic peptide
  Seed: SQFLSLQCL (PRAME_HUMAN)
SPFLSLQCY

SEQ ID NO: 148190 - protein, 10 aa, Artificial Sequence
  Description of Artificial Sequence: Synthetic peptide
  Seed: LLPRELFPPL (PRAME_HUMAN)
LWPRELFPPI

SEQ ID NO: 148191 - protein, 9 aa, Artificial Sequence
  Description of Artificial Sequence: Synthetic peptide
  Seed: GQMINLRRL (PRAME_HUMAN)
GRMINLRRI

SEQ ID NO: 148192 - protein, 9 aa, Artificial Sequence
  Description of Artificial Sequence: Synthetic peptide
  Seed: VLYPVPLES (PRAME_HUMAN)
VLYPVPLET

SEQ ID NO: 148193 - protein, 10 aa, Artificial Sequence
  Description of Artificial Sequence: Synthetic peptide
  Seed: TSQFLSLQCL (PRAME_HUMAN)
TQQFLSLQCF

SEQ ID NO: 148194 - protein, 10 aa, Artificial Sequence
  Description of Artificial Sequence: Synthetic peptide
  Seed: YSFPEPEAAQ (PRAME_HUMAN)
YAFPEPEAAH

SEQ ID NO: 148195 - protein, 8 aa, Artificial Sequence
  Description of Artificial Sequence: Synthetic peptide
  Seed: QLDSIEDL (PRAME_HUMAN)
QFDSIEDL

SEQ ID NO: 148196 - protein, 9 aa, Artificial Sequence
  Description of Artificial Sequence: Synthetic peptide
  Seed: ISISALQSL (PRAME_HUMAN)
ILISALQSI

SEQ ID NO: 148197 - protein, 9 aa, Artificial Sequence
  Description of Artificial Sequence: Synthetic peptide
  Seed: YIAQFTSQF (PRAME_HUMAN)
YIAQFTSQM

SEQ ID NO: 148198 - protein, 10 aa, Artificial Sequence
  Description of Artificial Sequence: Synthetic peptide
  Seed: RGRLDQLLRH (PRAME_HUMAN)
RDRLDQLLRL

SEQ ID NO: 148199 - protein, 8 aa, Artificial Sequence
  Description of Artificial Sequence: Synthetic peptide
  Seed: RELFPPLF (PRAME_HUMAN)
RELFPPLL

SEQ ID NO: 148200 - protein, 10 aa, Artificial Sequence
  Description of Artificial Sequence: Synthetic peptide
  Seed: RGRLDQLLRH (PRAME_HUMAN)
RPRLDQLLRM

SEQ ID NO: 148201 - protein, 10 aa, Artificial Sequence
  Description of Artificial Sequence: Synthetic peptide
  Seed: FSYLIEKVKR (PRAME_HUMAN)
FVYLIEKVKR

SEQ ID NO: 148202 - protein, 8 aa, Artificial Sequence
  Description of Artificial Sequence: Synthetic peptide
  Seed: YVDSLFFL (PRAME_HUMAN)
YLDSLFFM

SEQ ID NO: 148203 - protein, 10 aa, Artificial Sequence
  Description of Artificial Sequence: Synthetic peptide
  Seed: KAVLDGLDVL (PRAME_HUMAN)
KSVLDGLDVW

SEQ ID NO: 148204 - protein, 11 aa, Artificial Sequence
  Description of Artificial Sequence: Synthetic peptide
  Seed: ALYVDSLFFLR (PRAME_HUMAN)
AKYVDSLFFLR

SEQ ID NO: 148205 - protein, 9 aa, Artificial Sequence
  Description of Artificial Sequence: Synthetic peptide
  Seed: IAALELLPR (PRAME_HUMAN)
IVALELLPR

SEQ ID NO: 148206 - protein, 8 aa, Artificial Sequence
  Description of Artificial Sequence: Synthetic peptide
  Seed: FTSQFLSL (PRAME_HUMAN)
FSSQFLSM

SEQ ID NO: 148207 - protein, 10 aa, Artificial Sequence
  Description of Artificial Sequence: Synthetic peptide
  Seed: RGRLDQLLRH (PRAME_HUMAN)
RTRLDQLLRK

SEQ ID NO: 148208 - protein, 9 aa, Artificial Sequence
  Description of Artificial Sequence: Synthetic peptide
  Seed: TSPRRLVEL (PRAME_HUMAN)
TVPRRLVEI

SEQ ID NO: 148209 - protein, 10 aa, Artificial Sequence
  Description of Artificial Sequence: Synthetic peptide
  Seed: RASATLQDLV (PRAME_HUMAN)
RASATLQDLY

SEQ ID NO: 148210 - protein, 10 aa, Artificial Sequence
  Description of Artificial Sequence: Synthetic peptide
  Seed: ALYVDSLFFL (PRAME_HUMAN)
AMYVDSLFFV

SEQ ID NO: 148211 - protein, 9 aa, Artificial Sequence
  Description of Artificial Sequence: Synthetic peptide
  Seed: ESYEDIHGT (PRAME_HUMAN)
EIYEDIHGI

SEQ ID NO: 148212 - protein, 9 aa, Artificial Sequence
  Description of Artificial Sequence: Synthetic peptide
  Seed: RHSQTLKAM (PRAME_HUMAN)
RMSQTLKAL

SEQ ID NO: 148213 - protein, 9 aa, Artificial Sequence
  Description of Artificial Sequence: Synthetic peptide
  Seed: SQLTTLSFY (PRAME_HUMAN)
STLTTLSFR

SEQ ID NO: 148214 - protein, 9 aa, Artificial Sequence
  Description of Artificial Sequence: Synthetic peptide
  Seed: SATLQDLVF (PRAME_HUMAN)
STTLQDLVY

SEQ ID NO: 148215 - protein, 8 aa, Artificial Sequence
  Description of Artificial Sequence: Synthetic peptide
  Seed: YEDIHGTL (PRAME_HUMAN)
YWDIHGTM

SEQ ID NO: 148216 - protein, 9 aa, Artificial Sequence
  Description of Artificial Sequence: Synthetic peptide
  Seed: SVLSLSGVM (PRAME_HUMAN)
SMLSLSGVL

SEQ ID NO: 148217 - protein, 9 aa, Artificial Sequence
  Description of Artificial Sequence: Synthetic peptide
  Seed: IPVEVLVDL (PRAME_HUMAN)
IMVEVLVDF

SEQ ID NO: 148218 - protein, 9 aa, Artificial Sequence
  Description of Artificial Sequence: Synthetic peptide
  Seed: TCLPLGVLM (PRAME_HUMAN)
TSLPLGVLL

SEQ ID NO: 148219 - protein, 9 aa, Artificial Sequence
  Description of Artificial Sequence: Synthetic peptide
  Seed: LQSLLQHLI (PRAME_HUMAN)
LESLLQHLV

SEQ ID NO: 148220 - protein, 9 aa, Artificial Sequence
  Description of Artificial Sequence: Synthetic peptide
  Seed: VSPEPLQAL (PRAME_HUMAN)
VYPEPLQAA

SEQ ID NO: 148221 - protein, 11 aa, Artificial Sequence
  Description of Artificial Sequence: Synthetic peptide
  Seed: ALYVDSLFFLR (PRAME_HUMAN)
ALYVDSLFFLS

SEQ ID NO: 148222 - protein, 9 aa, Artificial Sequence
  Description of Artificial Sequence: Synthetic peptide
  Seed: ITDDQLLAL (PRAME_HUMAN)
ICDDQLLAL

SEQ ID NO: 148223 - protein, 9 aa, Artificial Sequence
  Description of Artificial Sequence: Synthetic peptide
  Seed: LYVDSLFFL (PRAME_HUMAN)
LMVDSLFFL

SEQ ID NO: 148224 - protein, 9 aa, Artificial Sequence
  Description of Artificial Sequence: Synthetic peptide
  Seed: RLDQLLRHV (PRAME_HUMAN)
RSDQLLRHM

SEQ ID NO: 148225 - protein, 9 aa, Artificial Sequence
  Description of Artificial Sequence: Synthetic peptide
  Seed: VSQLSVLSL (PRAME_HUMAN)
VFQLSVLSL

SEQ ID NO: 148226 - protein, 8 aa, Artificial Sequence
  Description of Artificial Sequence: Synthetic peptide
  Seed: YVDSLFFL (PRAME_HUMAN)
YTDSLFFL

SEQ ID NO: 148227 - protein, 9 aa, Artificial Sequence
  Description of Artificial Sequence: Synthetic peptide
  Seed: SISALQSLL (PRAME_HUMAN)
SASALQSLY

SEQ ID NO: 148228 - protein, 9 aa, Artificial Sequence
  Description of Artificial Sequence: Synthetic peptide
  Seed: SHIHASSYI (PRAME_HUMAN)
SKIHASSYL

SEQ ID NO: 148229 - protein, 10 aa, Artificial Sequence
  Description of Artificial Sequence: Synthetic peptide
  Seed: RELFPPLFMA (PRAME_HUMAN)
RSLFPPLFMV

SEQ ID NO: 148230 - protein, 8 aa, Artificial Sequence
  Description of Artificial Sequence: Synthetic peptide
  Seed: TDDQLLAL (PRAME_HUMAN)
TADQLLAI

SEQ ID NO: 148231 - protein, 9 aa, Artificial Sequence
  Description of Artificial Sequence: Synthetic peptide
  Seed: SLQCLQALY (PRAME_HUMAN)
SQQCLQALF

SEQ ID NO: 148232 - protein, 10 aa, Artificial Sequence
  Description of Artificial Sequence: Synthetic peptide
  Seed: SVSQLSVLSL (PRAME_HUMAN)
STSQLSVLSV

SEQ ID NO: 148233 - protein, 9 aa, Artificial Sequence
  Description of Artificial Sequence: Synthetic peptide
  Seed: RRWKLQVLD (PRAME_HUMAN)
RKWKLQVLM

SEQ ID NO: 148234 - protein, 11 aa, Artificial Sequence
  Description of Artificial Sequence: Synthetic peptide
  Seed: HLSQSPSVSQL (PRAME_HUMAN)
HMSQSPSVSQY

SEQ ID NO: 148235 - protein, 11 aa, Artificial Sequence
  Description of Artificial Sequence: Synthetic peptide
  Seed: LLLSHIHASSY (PRAME_HUMAN)
LTLSHIHASSY

SEQ ID NO: 148236 - protein, 11 aa, Artificial Sequence
  Description of Artificial Sequence: Synthetic peptide
  Seed: SLYSFPEPEAA (PRAME_HUMAN)
SMYSFPEPEAV

SEQ ID NO: 148237 - protein, 9 aa, Artificial Sequence
  Description of Artificial Sequence: Synthetic peptide
  Seed: NSHQDFWTV (PRAME_HUMAN)
NTHQDFWTA

SEQ ID NO: 148238 - protein, 9 aa, Artificial Sequence
  Description of Artificial Sequence: Synthetic peptide
  Seed: SIQSRYISM (PRAME_HUMAN)
SIQSRYISI

SEQ ID NO: 148239 - protein, 9 aa, Artificial Sequence
  Description of Artificial Sequence: Synthetic peptide
  Seed: KLKIFAMPM (PRAME_HUMAN)
KVKIFAMPC

SEQ ID NO: 148240 - protein, 9 aa, Artificial Sequence
  Description of Artificial Sequence: Synthetic peptide
  Seed: LALLPSLSH (PRAME_HUMAN)
LSLLPSLSL

SEQ ID NO: 148241 - protein, 10 aa, Artificial Sequence
  Description of Artificial Sequence: Synthetic peptide
  Seed: LSVLSLSGVM (PRAME_HUMAN)
LMVLSLSGVY

SEQ ID NO: 148242 - protein, 10 aa, Artificial Sequence
  Description of Artificial Sequence: Synthetic peptide
  Seed: SQLTTLSFYG (PRAME_HUMAN)
SSLTTLSFYY

SEQ ID NO: 148243 - protein, 10 aa, Artificial Sequence
  Description of Artificial Sequence: Synthetic peptide
  Seed: YIAQFTSQFL (PRAME_HUMAN)
YMAQFTSQFM

SEQ ID NO: 148244 - protein, 10 aa, Artificial Sequence
  Description of Artificial Sequence: Synthetic peptide
  Seed: RELFPPLFMA (PRAME_HUMAN)
RRLFPPLFML

SEQ ID NO: 148245 - protein, 9 aa, Artificial Sequence
  Description of Artificial Sequence: Synthetic peptide
  Seed: TLAKFSPYL (PRAME_HUMAN)
TLAKFSPYR

SEQ ID NO: 148246 - protein, 9 aa, Artificial Sequence
  Description of Artificial Sequence: Synthetic peptide
  Seed: QPFIPVEVL (PRAME_HUMAN)
QAFIPVEVV

SEQ ID NO: 148247 - protein, 10 aa, Artificial Sequence
  Description of Artificial Sequence: Synthetic peptide
  Seed: RPRRWKLQVL (PRAME_HUMAN)
RPRRWKLQVV

SEQ ID NO: 148248 - protein, 9 aa, Artificial Sequence
  Description of Artificial Sequence: Synthetic peptide
  Seed: LLKDEALAI (PRAME_HUMAN)
LLKDEALAM

SEQ ID NO: 148249 - protein, 10 aa, Artificial Sequence
  Description of Artificial Sequence: Synthetic peptide
  Seed: SVSQLSVLSL (PRAME_HUMAN)
SLSQLSVLSL

SEQ ID NO: 148250 - protein, 9 aa, Artificial Sequence
  Description of Artificial Sequence: Synthetic peptide
  Seed: ISPEKEEQY (PRAME_HUMAN)
ISPEKEEQW

SEQ ID NO: 148251 - protein, 9 aa, Artificial Sequence
  Description of Artificial Sequence: Synthetic peptide
  Seed: TDDQLLALL (PRAME_HUMAN)
TVDQLLALI

SEQ ID NO: 148252 - protein, 10 aa, Artificial Sequence
  Description of Artificial Sequence: Synthetic peptide
  Seed: AEQPFIPVEV (PRAME_HUMAN)
AEQPFIPVEA

SEQ ID NO: 148253 - protein, 9 aa, Artificial Sequence
  Description of Artificial Sequence: Synthetic peptide
  Seed: VLDGLDVLL (PRAME_HUMAN)
VWDGLDVLF

SEQ ID NO: 148254 - protein, 9 aa, Artificial Sequence
  Description of Artificial Sequence: Synthetic peptide
  Seed: GACDELFSY (PRAME_HUMAN)
GWCDELFSY

SEQ ID NO: 148255 - protein, 11 aa, Artificial Sequence
  Description of Artificial Sequence: Synthetic peptide
  Seed: FKAVLDGLDVL (PRAME_HUMAN)
FQAVLDGLDVV

SEQ ID NO: 148256 - protein, 10 aa, Artificial Sequence
  Description of Artificial Sequence: Synthetic peptide
  Seed: IQSRYISMSV (PRAME_HUMAN)
IKSRYISMSF

SEQ ID NO: 148257 - protein, 9 aa, Artificial Sequence
  Description of Artificial Sequence: Synthetic peptide
  Seed: KLKIFAMPM (PRAME_HUMAN)
KGKIFAMPV

SEQ ID NO: 148258 - protein, 9 aa, Artificial Sequence
  Description of Artificial Sequence: Synthetic peptide
  Seed: EQPFIPVEV (PRAME_HUMAN)
EEPFIPVEL

SEQ ID NO: 148259 - protein, 9 aa, Artificial Sequence
  Description of Artificial Sequence: Synthetic peptide
  Seed: GACDELFSY (PRAME_HUMAN)
GPCDELFSY

SEQ ID NO: 148260 - protein, 10 aa, Artificial Sequence
  Description of Artificial Sequence: Synthetic peptide
  Seed: QSLLQHLIGL (PRAME_HUMAN)
QTLLQHLIGV

SEQ ID NO: 148261 - protein, 9 aa, Artificial Sequence
  Description of Artificial Sequence: Synthetic peptide
  Seed: ACDELFSYL (PRAME_HUMAN)
AYDELFSYV

SEQ ID NO: 148262 - protein, 10 aa, Artificial Sequence
  Description of Artificial Sequence: Synthetic peptide
  Seed: TSQFLSLQCL (PRAME_HUMAN)
TRQFLSLQCF

SEQ ID NO: 148263 - protein, 9 aa, Artificial Sequence
  Description of Artificial Sequence: Synthetic peptide
  Seed: LYVDSLFFL (PRAME_HUMAN)
LQVDSLFFI

SEQ ID NO: 148264 - protein, 10 aa, Artificial Sequence
  Description of Artificial Sequence: Synthetic peptide
  Seed: RLSEGDVMHL (PRAME_HUMAN)
RTSEGDVMHL

SEQ ID NO: 148265 - protein, 11 aa, Artificial Sequence
  Description of Artificial Sequence: Synthetic peptide
  Seed: VQLDSIEDLEV (PRAME_HUMAN)
VQLDSIEDLEF

SEQ ID NO: 148266 - protein, 10 aa, Artificial Sequence
  Description of Artificial Sequence: Synthetic peptide
  Seed: VSPEPLQALL (PRAME_HUMAN)
VVPEPLQALW

SEQ ID NO: 148267 - protein, 10 aa, Artificial Sequence
  Description of Artificial Sequence: Synthetic peptide
  Seed: ALLERASATL (PRAME_HUMAN)
AQLERASATL

SEQ ID NO: 148268 - protein, 10 aa, Artificial Sequence
  Description of Artificial Sequence: Synthetic peptide
  Seed: ALYVDSLFFL (PRAME_HUMAN)
ALYVDSLFFT

SEQ ID NO: 148269 - protein, 10 aa, Artificial Sequence
  Description of Artificial Sequence: Synthetic peptide
  Seed: SGNRASLYSF (PRAME_HUMAN)
SMNRASLYSF

SEQ ID NO: 148270 - protein, 9 aa, Artificial Sequence
  Description of Artificial Sequence: Synthetic peptide
  Seed: ACDELFSYL (PRAME_HUMAN)
AWDELFSYV

SEQ ID NO: 148271 - protein, 9 aa, Artificial Sequence
  Description of Artificial Sequence: Synthetic peptide
  Seed: TSPRRLVEL (PRAME_HUMAN)
TFPRRLVEL

SEQ ID NO: 148272 - protein, 10 aa, Artificial Sequence
  Description of Artificial Sequence: Synthetic peptide
  Seed: FIPVEVLVDL (PRAME_HUMAN)
FYPVEVLVDF

SEQ ID NO: 148273 - protein, 9 aa, Artificial Sequence
  Description of Artificial Sequence: Synthetic peptide
  Seed: LVELAGQSL (PRAME_HUMAN)
LSELAGQSL

SEQ ID NO: 148274 - protein, 9 aa, Artificial Sequence
  Description of Artificial Sequence: Synthetic peptide
  Seed: LSVLSLSGV (PRAME_HUMAN)
LIVLSLSGA

SEQ ID NO: 148275 - protein, 10 aa, Artificial Sequence
  Description of Artificial Sequence: Synthetic peptide
  Seed: RLAYLHARLR (PRAME_HUMAN)
RYAYLHARLR

SEQ ID NO: 148276 - protein, 9 aa, Artificial Sequence
  Description of Artificial Sequence: Synthetic peptide
  Seed: TSPRRLVEL (PRAME_HUMAN)
TAPRRLVEY

SEQ ID NO: 148277 - protein, 9 aa, Artificial Sequence
  Description of Artificial Sequence: Synthetic peptide
  Seed: LLKDEALAI (PRAME_HUMAN)
LPKDEALAY

SEQ ID NO: 148278 - protein, 9 aa, Artificial Sequence
  Description of Artificial Sequence: Synthetic peptide
  Seed: YGNSISISA (PRAME_HUMAN)
YPNSISISL

SEQ ID NO: 148279 - protein, 9 aa, Artificial Sequence
  Description of Artificial Sequence: Synthetic peptide
  Seed: ELFPPLFMA (PRAME_HUMAN)
EAFPPLFML

SEQ ID NO: 148280 - protein, 11 aa, Artificial Sequence
  Description of Artificial Sequence: Synthetic peptide
  Seed: EQYIAQFTSQF (PRAME_HUMAN)
EYYIAQFTSQF

SEQ ID NO: 148281 - protein, 9 aa, Artificial Sequence
  Description of Artificial Sequence: Synthetic peptide
  Seed: IGLSNLTHV (PRAME_HUMAN)
IALSNLTHF

SEQ ID NO: 148282 - protein, 9 aa, Artificial Sequence
  Description of Artificial Sequence: Synthetic peptide
  Seed: GLSNLTHVL (PRAME_HUMAN)
GQSNLTHVI

SEQ ID NO: 148283 - protein, 10 aa, Artificial Sequence
  Description of Artificial Sequence: Synthetic peptide
  Seed: AQFTSQFLSL (PRAME_HUMAN)
AHFTSQFLSY

SEQ ID NO: 148284 - protein, 9 aa, Artificial Sequence
  Description of Artificial Sequence: Synthetic peptide
  Seed: MHLSQSPSV (PRAME_HUMAN)
MQLSQSPSW

SEQ ID NO: 148285 - protein, 8 aa, Artificial Sequence
  Description of Artificial Sequence: Synthetic peptide
  Seed: YVDSLFFL (PRAME_HUMAN)
YMDSLFFV

SEQ ID NO: 148286 - protein, 9 aa, Artificial Sequence
  Description of Artificial Sequence: Synthetic peptide
  Seed: RLWGSIQSR (PRAME_HUMAN)
RLWGSIQSI

SEQ ID NO: 148287 - protein, 10 aa, Artificial Sequence
  Description of Artificial Sequence: Synthetic peptide
  Seed: SPSVSQLSVL (PRAME_HUMAN)
SESVSQLSVF

SEQ ID NO: 148288 - protein, 9 aa, Artificial Sequence
  Description of Artificial Sequence: Synthetic peptide
  Seed: RELLCELGR (PRAME_HUMAN)
RMLLCELGK

SEQ ID NO: 148289 - protein, 11 aa, Artificial Sequence
  Description of Artificial Sequence: Synthetic peptide
  Seed: DVSPEPLQALL (PRAME_HUMAN)
DMSPEPLQALR

SEQ ID NO: 148290 - protein, 10 aa, Artificial Sequence
  Description of Artificial Sequence: Synthetic peptide
  Seed: KKLKIFAMPM (PRAME_HUMAN)
KGLKIFAMPY

SEQ ID NO: 148291 - protein, 10 aa, Artificial Sequence
  Description of Artificial Sequence: Synthetic peptide
  Seed: ERLAYLHARL (PRAME_HUMAN)
EFLAYLHARL

SEQ ID NO: 148292 - protein, 10 aa, Artificial Sequence
  Description of Artificial Sequence: Synthetic peptide
  Seed: KGQHLHLETF (PRAME_HUMAN)
KNQHLHLETY

SEQ ID NO: 148293 - protein, 10 aa, Artificial Sequence
  Description of Artificial Sequence: Synthetic peptide
  Seed: LKAMVQAWPF (PRAME_HUMAN)
LCAMVQAWPY

SEQ ID NO: 148294 - protein, 9 aa, Artificial Sequence
  Description of Artificial Sequence: Synthetic peptide
  Seed: CKKLKIFAM (PRAME_HUMAN)
CMKLKIFAL

SEQ ID NO: 148295 - protein, 10 aa, Artificial Sequence
  Description of Artificial Sequence: Synthetic peptide
  Seed: DRTFYDPEPI (PRAME_HUMAN)
DLTFYDPEPV

SEQ ID NO: 148296 - protein, 10 aa, Artificial Sequence
  Description of Artificial Sequence: Synthetic peptide
  Seed: AQFTSQFLSL (PRAME_HUMAN)
ARFTSQFLSA

SEQ ID NO: 148297 - protein, 10 aa, Artificial Sequence
  Description of Artificial Sequence: Synthetic peptide
  Seed: SNLTHVLYPV (PRAME_HUMAN)
SELTHVLYPA

SEQ ID NO: 148298 - protein, 10 aa, Artificial Sequence
  Description of Artificial Sequence: Synthetic peptide
  Seed: ALYVDSLFFL (PRAME_HUMAN)
AAYVDSLFFI

SEQ ID NO: 148299 - protein, 10 aa, Artificial Sequence
  Description of Artificial Sequence: Synthetic peptide
  Seed: ALYVDSLFFL (PRAME_HUMAN)
AYYVDSLFFM

SEQ ID NO: 148300 - protein, 9 aa, Artificial Sequence
  Description of Artificial Sequence: Synthetic peptide
  Seed: MVQAWPFTC (PRAME_HUMAN)
MIQAWPFTM

SEQ ID NO: 148301 - protein, 10 aa, Artificial Sequence
  Description of Artificial Sequence: Synthetic peptide
  Seed: FFLRGRLDQL (PRAME_HUMAN)
FKLRGRLDQI

SEQ ID NO: 148302 - protein, 9 aa, Artificial Sequence
  Description of Artificial Sequence: Synthetic peptide
  Seed: RHSQTLKAM (PRAME_HUMAN)
RVSQTLKAF

SEQ ID NO: 148303 - protein, 9 aa, Artificial Sequence
  Description of Artificial Sequence: Synthetic peptide
  Seed: SHQDFWTVW (PRAME_HUMAN)
SYQDFWTVV

SEQ ID NO: 148304 - protein, 11 aa, Artificial Sequence
  Description of Artificial Sequence: Synthetic peptide
  Seed: LIGLSNLTHVL (PRAME_HUMAN)
LMGLSNLTHVL

SEQ ID NO: 148305 - protein, 11 aa, Artificial Sequence
  Description of Artificial Sequence: Synthetic peptide
  Seed: AAFDGRHSQTL (PRAME_HUMAN)
AAFDGRHSQTI

SEQ ID NO: 148306 - protein, 9 aa, Artificial Sequence
  Description of Artificial Sequence: Synthetic peptide
  Seed: SATLQDLVF (PRAME_HUMAN)
SATLQDLVL

SEQ ID NO: 148307 - protein, 8 aa, Artificial Sequence
  Description of Artificial Sequence: Synthetic peptide
  Seed: TDDQLLAL (PRAME_HUMAN)
TSDQLLAF

SEQ ID NO: 148308 - protein, 9 aa, Artificial Sequence
  Description of Artificial Sequence: Synthetic peptide
  Seed: LSEGDVMHL (PRAME_HUMAN)
LLEGDVMHI

SEQ ID NO: 148309 - protein, 9 aa, Artificial Sequence
  Description of Artificial Sequence: Synthetic peptide
  Seed: LMKGQHLHL (PRAME_HUMAN)
LRKGQHLHY

SEQ ID NO: 148310 - protein, 10 aa, Artificial Sequence
  Description of Artificial Sequence: Synthetic peptide
  Seed: DQLLALLPSL (PRAME_HUMAN)
DFLLALLPSM

SEQ ID NO: 148311 - protein, 10 aa, Artificial Sequence
  Description of Artificial Sequence: Synthetic peptide
  Seed: SALQSLLQHL (PRAME_HUMAN)
SWLQSLLQHV

SEQ ID NO: 148312 - protein, 9 aa, Artificial Sequence
  Description of Artificial Sequence: Synthetic peptide
  Seed: KLKIFAMPM (PRAME_HUMAN)
KWKIFAMPK

SEQ ID NO: 148313 - protein, 10 aa, Artificial Sequence
  Description of Artificial Sequence: Synthetic peptide
  Seed: MNPLETLSIT (PRAME_HUMAN)
MEPLETLSIA

SEQ ID NO: 148314 - protein, 10 aa, Artificial Sequence
  Description of Artificial Sequence: Synthetic peptide
  Seed: LLPRELFPPL (PRAME_HUMAN)
LEPRELFPPI

SEQ ID NO: 148315 - protein, 9 aa, Artificial Sequence
  Description of Artificial Sequence: Synthetic peptide
  Seed: ASATLQDLV (PRAME_HUMAN)
AAATLQDLW

SEQ ID NO: 148316 - protein, 9 aa, Artificial Sequence
  Description of Artificial Sequence: Synthetic peptide
  Seed: SYEDIHGTL (PRAME_HUMAN)
SVEDIHGTM

SEQ ID NO: 148317 - protein, 9 aa, Artificial Sequence
  Description of Artificial Sequence: Synthetic peptide
  Seed: LVELAGQSL (PRAME_HUMAN)
LSELAGQSM

SEQ ID NO: 148318 - protein, 11 aa, Artificial Sequence
  Description of Artificial Sequence: Synthetic peptide
  Seed: RASATLQDLVF (PRAME_HUMAN)
RTSATLQDLVW

SEQ ID NO: 148319 - protein, 10 aa, Artificial Sequence
  Description of Artificial Sequence: Synthetic peptide
  Seed: ETFKAVLDGL (PRAME_HUMAN)
ELFKAVLDGK

SEQ ID NO: 148320 - protein, 9 aa, Artificial Sequence
  Description of Artificial Sequence: Synthetic peptide
  Seed: KEEQYIAQF (PRAME_HUMAN)
KQEQYIAQI

SEQ ID NO: 148321 - protein, 11 aa, Artificial Sequence
  Description of Artificial Sequence: Synthetic peptide
  Seed: RLVELAGQSLL (PRAME_HUMAN)
RQVELAGQSLF

SEQ ID NO: 148322 - protein, 10 aa, Artificial Sequence
  Description of Artificial Sequence: Synthetic peptide
  Seed: SPSVSQLSVL (PRAME_HUMAN)
SCSVSQLSVY

SEQ ID NO: 148323 - protein, 9 aa, Artificial Sequence
  Description of Artificial Sequence: Synthetic peptide
  Seed: RPRRWKLQV (PRAME_HUMAN)
RPRRWKLQM

SEQ ID NO: 148324 - protein, 9 aa, Artificial Sequence
  Description of Artificial Sequence: Synthetic peptide
  Seed: SRYISMSVW (PRAME_HUMAN)
SGYISMSVF

SEQ ID NO: 148325 - protein, 9 aa, Artificial Sequence
  Description of Artificial Sequence: Synthetic peptide
  Seed: AVLDGLDVL (PRAME_HUMAN)
AMLDGLDVM

SEQ ID NO: 148326 - protein, 10 aa, Artificial Sequence
  Description of Artificial Sequence: Synthetic peptide
  Seed: ESYEDIHGTL (PRAME_HUMAN)
ETYEDIHGTW

SEQ ID NO: 148327 - protein, 9 aa, Artificial Sequence
  Description of Artificial Sequence: Synthetic peptide
  Seed: SLLQHLIGL (PRAME_HUMAN)
SSLQHLIGR

SEQ ID NO: 148328 - protein, 8 aa, Artificial Sequence
  Description of Artificial Sequence: Synthetic peptide
  Seed: YEDIHGTL (PRAME_HUMAN)
YWDIHGTF

SEQ ID NO: 148329 - protein, 9 aa, Artificial Sequence
  Description of Artificial Sequence: Synthetic peptide
  Seed: AVLDGLDVL (PRAME_HUMAN)
ASLDGLDVL

SEQ ID NO: 148330 - protein, 9 aa, Artificial Sequence
  Description of Artificial Sequence: Synthetic peptide
  Seed: GLSNLTHVL (PRAME_HUMAN)
GTSNLTHVV

SEQ ID NO: 148331 - protein, 10 aa, Artificial Sequence
  Description of Artificial Sequence: Synthetic peptide
  Seed: LSFYGNSISI (PRAME_HUMAN)
LEFYGNSISL

SEQ ID NO: 148332 - protein, 10 aa, Artificial Sequence
  Description of Artificial Sequence: Synthetic peptide
  Seed: LIGLSNLTHV (PRAME_HUMAN)
LLGLSNLTHV

SEQ ID NO: 148333 - protein, 9 aa, Artificial Sequence
  Description of Artificial Sequence: Synthetic peptide
  Seed: GACDELFSY (PRAME_HUMAN)
GRCDELFSF

SEQ ID NO: 148334 - protein, 9 aa, Artificial Sequence
  Description of Artificial Sequence: Synthetic peptide
  Seed: SHCSQLTTL (PRAME_HUMAN)
SQCSQLTTV

SEQ ID NO: 148335 - protein, 9 aa, Artificial Sequence
  Description of Artificial Sequence: Synthetic peptide
  Seed: SRYISMSVW (PRAME_HUMAN)
SQYISMSVI

SEQ ID NO: 148336 - protein, 9 aa, Artificial Sequence
  Description of Artificial Sequence: Synthetic peptide
  Seed: RRWKLQVLD (PRAME_HUMAN)
RRWKLQVLK

SEQ ID NO: 148337 - protein, 9 aa, Artificial Sequence
  Description of Artificial Sequence: Synthetic peptide
  Seed: FPEPEAAQP (PRAME_HUMAN)
FPEPEAAQA

SEQ ID NO: 148338 - protein, 10 aa, Artificial Sequence
  Description of Artificial Sequence: Synthetic peptide
  Seed: FIPVEVLVDL (PRAME_HUMAN)
FGPVEVLVDY

SEQ ID NO: 148339 - protein, 9 aa, Artificial Sequence
  Description of Artificial Sequence: Synthetic peptide
  Seed: THVLYPVPL (PRAME_HUMAN)
TFVLYPVPF

SEQ ID NO: 148340 - protein, 9 aa, Artificial Sequence
  Description of Artificial Sequence: Synthetic peptide
  Seed: CSQLTTLSF (PRAME_HUMAN)
CAQLTTLSF

SEQ ID NO: 148341 - protein, 10 aa, Artificial Sequence
  Description of Artificial Sequence: Synthetic peptide
  Seed: AALELLPREL (PRAME_HUMAN)
AQLELLPREL

SEQ ID NO: 148342 - protein, 9 aa, Artificial Sequence
  Description of Artificial Sequence: Synthetic peptide
  Seed: LDQLLRHVM (PRAME_HUMAN)
LEQLLRHVA

SEQ ID NO: 148343 - protein, 10 aa, Artificial Sequence
  Description of Artificial Sequence: Synthetic peptide
  Seed: ISMSVWTSPR (PRAME_HUMAN)
IYMSVWTSPR

SEQ ID NO: 148344 - protein, 10 aa, Artificial Sequence
  Description of Artificial Sequence: Synthetic peptide
  Seed: AQFTSQFLSL (PRAME_HUMAN)
ALFTSQFLSM

SEQ ID NO: 148345 - protein, 10 aa, Artificial Sequence
  Description of Artificial Sequence: Synthetic peptide
  Seed: SPYLGQMINL (PRAME_HUMAN)
SIYLGQMINF

SEQ ID NO: 148346 - protein, 10 aa, Artificial Sequence
  Description of Artificial Sequence: Synthetic peptide
  Seed: AVLDGLDVLL (PRAME_HUMAN)
AYLDGLDVLV

SEQ ID NO: 148347 - protein, 9 aa, Artificial Sequence
  Description of Artificial Sequence: Synthetic peptide
  Seed: RPSMVWLSA (PRAME_HUMAN)
RPSMVWLSI

SEQ ID NO: 148348 - protein, 10 aa, Artificial Sequence
  Description of Artificial Sequence: Synthetic peptide
  Seed: SPSVSQLSVL (PRAME_HUMAN)
SKSVSQLSVY

SEQ ID NO: 148349 - protein, 10 aa, Artificial Sequence
  Description of Artificial Sequence: Synthetic peptide
  Seed: RWKLQVLDLR (PRAME_HUMAN)
RSKLQVLDLR

SEQ ID NO: 148350 - protein, 10 aa, Artificial Sequence
  Description of Artificial Sequence: Synthetic peptide
  Seed: RRLWGSIQSR (PRAME_HUMAN)
RLLWGSIQSK

SEQ ID NO: 148351 - protein, 9 aa, Artificial Sequence
  Description of Artificial Sequence: Synthetic peptide
  Seed: KMILKMVQL (PRAME_HUMAN)
KQILKMVQY

SEQ ID NO: 148352 - protein, 9 aa, Artificial Sequence
  Description of Artificial Sequence: Synthetic peptide
  Seed: KMILKMVQL (PRAME_HUMAN)
KQILKMVQF

SEQ ID NO: 148353 - protein, 11 aa, Artificial Sequence
  Description of Artificial Sequence: Synthetic peptide
  Seed: MKGQHLHLETF (PRAME_HUMAN)
MHGQHLHLETY

SEQ ID NO: 148354 - protein, 9 aa, Artificial Sequence
  Description of Artificial Sequence: Synthetic peptide
  Seed: RRLLLSHIH (PRAME_HUMAN)
RRLLLSHIA

SEQ ID NO: 148355 - protein, 10 aa, Artificial Sequence
  Description of Artificial Sequence: Synthetic peptide
  Seed: KKLKIFAMPM (PRAME_HUMAN)
KFLKIFAMPK

SEQ ID NO: 148356 - protein, 10 aa, Artificial Sequence
  Description of Artificial Sequence: Synthetic peptide
  Seed: ESYEDIHGTL (PRAME_HUMAN)
ELYEDIHGTR

SEQ ID NO: 148357 - protein, 9 aa, Artificial Sequence
  Description of Artificial Sequence: Synthetic peptide
  Seed: RRWKLQVLD (PRAME_HUMAN)
RRWKLQVLE

SEQ ID NO: 148358 - protein, 10 aa, Artificial Sequence
  Description of Artificial Sequence: Synthetic peptide
  Seed: MVQAWPFTCL (PRAME_HUMAN)
MPQAWPFTCY

SEQ ID NO: 148359 - protein, 9 aa, Artificial Sequence
  Description of Artificial Sequence: Synthetic peptide
  Seed: TDDQLLALL (PRAME_HUMAN)
TCDQLLALM

SEQ ID NO: 148360 - protein, 9 aa, Artificial Sequence
  Description of Artificial Sequence: Synthetic peptide
  Seed: LQHLIGLSN (PRAME_HUMAN)
LGHLIGLSY

SEQ ID NO: 148361 - protein, 10 aa, Artificial Sequence
  Description of Artificial Sequence: Synthetic peptide
  Seed: FPEPEAAQPM (PRAME_HUMAN)
FAEPEAAQPY

SEQ ID NO: 148362 - protein, 10 aa, Artificial Sequence
  Description of Artificial Sequence: Synthetic peptide
  Seed: ALELLPRELF (PRAME_HUMAN)
ATELLPRELW

SEQ ID NO: 148363 - protein, 9 aa, Artificial Sequence
  Description of Artificial Sequence: Synthetic peptide
  Seed: ELAGQSLLK (PRAME_HUMAN)
EIAGQSLLY

SEQ ID NO: 148364 - protein, 10 aa, Artificial Sequence
  Description of Artificial Sequence: Synthetic peptide
  Seed: LLLSHIHASS (PRAME_HUMAN)
LCLSHIHASA

SEQ ID NO: 148365 - protein, 9 aa, Artificial Sequence
  Description of Artificial Sequence: Synthetic peptide
  Seed: SHIHASSYI (PRAME_HUMAN)
SYIHASSYL

SEQ ID NO: 148366 - protein, 9 aa, Artificial Sequence
  Description of Artificial Sequence: Synthetic peptide
  Seed: SLQCLQALY (PRAME_HUMAN)
SMQCLQALW

SEQ ID NO: 148367 - protein, 9 aa, Artificial Sequence
  Description of Artificial Sequence: Synthetic peptide
  Seed: TDDQLLALL (PRAME_HUMAN)
TVDQLLALV

SEQ ID NO: 148368 - protein, 11 aa, Artificial Sequence
  Description of Artificial Sequence: Synthetic peptide
  Seed: LVELAGQSLLK (PRAME_HUMAN)
LSELAGQSLLY

SEQ ID NO: 148369 - protein, 10 aa, Artificial Sequence
  Description of Artificial Sequence: Synthetic peptide
  Seed: MVQAWPFTCL (PRAME_HUMAN)
MRQAWPFTCF

SEQ ID NO: 148370 - protein, 10 aa, Artificial Sequence
  Description of Artificial Sequence: Synthetic peptide
  Seed: ALYVDSLFFL (PRAME_HUMAN)
AMYVDSLFFL

SEQ ID NO: 148371 - protein, 9 aa, Artificial Sequence
  Description of Artificial Sequence: Synthetic peptide
  Seed: ISISALQSL (PRAME_HUMAN)
INISALQSY

SEQ ID NO: 148372 - protein, 9 aa, Artificial Sequence
  Description of Artificial Sequence: Synthetic peptide
  Seed: LGRPSMVWL (PRAME_HUMAN)
LTRPSMVWM

SEQ ID NO: 148373 - protein, 9 aa, Artificial Sequence
  Description of Artificial Sequence: Synthetic peptide
  Seed: AQFTSQFLS (PRAME_HUMAN)
ASFTSQFLV

SEQ ID NO: 148374 - protein, 11 aa, Artificial Sequence
  Description of Artificial Sequence: Synthetic peptide
  Seed: QALYVDSLFFL (PRAME_HUMAN)
QMLYVDSLFFV

SEQ ID NO: 148375 - protein, 10 aa, Artificial Sequence
  Description of Artificial Sequence: Synthetic peptide
  Seed: HCSQLTTLSF (PRAME_HUMAN)
HASQLTTLSY

SEQ ID NO: 148376 - protein, 10 aa, Artificial Sequence
  Description of Artificial Sequence: Synthetic peptide
  Seed: WTSPRRLVEL (PRAME_HUMAN)
WASPRRLVEL

SEQ ID NO: 148377 - protein, 9 aa, Artificial Sequence
  Description of Artificial Sequence: Synthetic peptide
  Seed: LSTEAEQPF (PRAME_HUMAN)
LSTEAEQPY

SEQ ID NO: 148378 - protein, 10 aa, Artificial Sequence
  Description of Artificial Sequence: Synthetic peptide
  Seed: MPMQDIKMIL (PRAME_HUMAN)
MPMQDIKMIY

SEQ ID NO: 148379 - protein, 10 aa, Artificial Sequence
  Description of Artificial Sequence: Synthetic peptide
  Seed: RRLWGSIQSR (PRAME_HUMAN)
RQLWGSIQSK

SEQ ID NO: 148380 - protein, 10 aa, Artificial Sequence
  Description of Artificial Sequence: Synthetic peptide
  Seed: SALQSLLQHL (PRAME_HUMAN)
SELQSLLQHV

SEQ ID NO: 148381 - protein, 9 aa, Artificial Sequence
  Description of Artificial Sequence: Synthetic peptide
  Seed: SALQSLLQH (PRAME_HUMAN)
SILQSLLQY

SEQ ID NO: 148382 - protein, 9 aa, Artificial Sequence
  Description of Artificial Sequence: Synthetic peptide
  Seed: VLMKGQHLH (PRAME_HUMAN)
VSMKGQHLK

SEQ ID NO: 148383 - protein, 10 aa, Artificial Sequence
  Description of Artificial Sequence: Synthetic peptide
  Seed: TTLSFYGNSI (PRAME_HUMAN)
TMLSFYGNSV

SEQ ID NO: 148384 - protein, 9 aa, Artificial Sequence
  Description of Artificial Sequence: Synthetic peptide
  Seed: RLWGSIQSR (PRAME_HUMAN)
RQWGSIQSF

SEQ ID NO: 148385 - protein, 9 aa, Artificial Sequence
  Description of Artificial Sequence: Synthetic peptide
  Seed: RLDQLLRHV (PRAME_HUMAN)
RFDQLLRHI

SEQ ID NO: 148386 - protein, 10 aa, Artificial Sequence
  Description of Artificial Sequence: Synthetic peptide
  Seed: EDLEVTCTWK (PRAME_HUMAN)
EILEVTCTWK

SEQ ID NO: 148387 - protein, 9 aa, Artificial Sequence
  Description of Artificial Sequence: Synthetic peptide
  Seed: WSGNRASLY (PRAME_HUMAN)
WLGNRASLY

SEQ ID NO: 148388 - protein, 9 aa, Artificial Sequence
  Description of Artificial Sequence: Synthetic peptide
  Seed: HLIGLSNLT (PRAME_HUMAN)
HLIGLSNLL

SEQ ID NO: 148389 - protein, 9 aa, Artificial Sequence
  Description of Artificial Sequence: Synthetic peptide
  Seed: LPRELFPPL (PRAME_HUMAN)
LPRELFPPF

SEQ ID NO: 148390 - protein, 9 aa, Artificial Sequence
  Description of Artificial Sequence: Synthetic peptide
  Seed: EDLEVTCTW (PRAME_HUMAN)
EELEVTCTY

SEQ ID NO: 148391 - protein, 9 aa, Artificial Sequence
  Description of Artificial Sequence: Synthetic peptide
  Seed: HLHLETFKA (PRAME_HUMAN)
HMHLETFKV

SEQ ID NO: 148392 - protein, 10 aa, Artificial Sequence
  Description of Artificial Sequence: Synthetic peptide
  Seed: GRLDQLLRHV (PRAME_HUMAN)
GRLDQLLRHY

SEQ ID NO: 148393 - protein, 10 aa, Artificial Sequence
  Description of Artificial Sequence: Synthetic peptide
  Seed: SVSQLSVLSL (PRAME_HUMAN)
SVSQLSVLSV

SEQ ID NO: 148394 - protein, 9 aa, Artificial Sequence
  Description of Artificial Sequence: Synthetic peptide
  Seed: FSYLIEKVK (PRAME_HUMAN)
FSYLIEKVR

SEQ ID NO: 148395 - protein, 10 aa, Artificial Sequence
  Description of Artificial Sequence: Synthetic peptide
  Seed: RYISMSVWTS (PRAME_HUMAN)
RMISMSVWTF

SEQ ID NO: 148396 - protein, 10 aa, Artificial Sequence
  Description of Artificial Sequence: Synthetic peptide
  Seed: FFLRGRLDQL (PRAME_HUMAN)
FTLRGRLDQL

SEQ ID NO: 148397 - protein, 10 aa, Artificial Sequence
  Description of Artificial Sequence: Synthetic peptide
  Seed: SPYLGQMINL (PRAME_HUMAN)
STYLGQMINI

SEQ ID NO: 148398 - protein, 9 aa, Artificial Sequence
  Description of Artificial Sequence: Synthetic peptide
  Seed: RWKLQVLDL (PRAME_HUMAN)
RAKLQVLDA

SEQ ID NO: 148399 - protein, 10 aa, Artificial Sequence
  Description of Artificial Sequence: Synthetic peptide
  Seed: DVSPEPLQAL (PRAME_HUMAN)
DVSPEPLQAR

SEQ ID NO: 148400 - protein, 9 aa, Artificial Sequence
  Description of Artificial Sequence: Synthetic peptide
  Seed: EAAQPMTKK (PRAME_HUMAN)
EVAQPMTKH

SEQ ID NO: 148401 - protein, 9 aa, Artificial Sequence
  Description of Artificial Sequence: Synthetic peptide
  Seed: SLLQHLIGL (PRAME_HUMAN)
SALQHLIGY

SEQ ID NO: 148402 - protein, 9 aa, Artificial Sequence
  Description of Artificial Sequence: Synthetic peptide
  Seed: QPFIPVEVL (PRAME_HUMAN)
QPFIPVEVF

SEQ ID NO: 148403 - protein, 9 aa, Artificial Sequence
  Description of Artificial Sequence: Synthetic peptide
  Seed: LSHIHASSY (PRAME_HUMAN)
LLHIHASSF

SEQ ID NO: 148404 - protein, 10 aa, Artificial Sequence
  Description of Artificial Sequence: Synthetic peptide
  Seed: LYVDSLFFLR (PRAME_HUMAN)
LTVDSLFFLK

SEQ ID NO: 148405 - protein, 9 aa, Artificial Sequence
  Description of Artificial Sequence: Synthetic peptide
  Seed: QSRYISMSV (PRAME_HUMAN)
QIRYISMSV

SEQ ID NO: 148406 - protein, 10 aa, Artificial Sequence
  Description of Artificial Sequence: Synthetic peptide
  Seed: LLSHIHASSY (PRAME_HUMAN)
LTSHIHASSY

SEQ ID NO: 148407 - protein, 10 aa, Artificial Sequence
  Description of Artificial Sequence: Synthetic peptide
  Seed: SPRRLVELAG (PRAME_HUMAN)
SPRRLVELAI

SEQ ID NO: 148408 - protein, 9 aa, Artificial Sequence
  Description of Artificial Sequence: Synthetic peptide
  Seed: YIAQFTSQF (PRAME_HUMAN)
YAAQFTSQI

SEQ ID NO: 148409 - protein, 9 aa, Artificial Sequence
  Description of Artificial Sequence: Synthetic peptide
  Seed: LWGSIQSRY (PRAME_HUMAN)
LMGSIQSRY

SEQ ID NO: 148410 - protein, 9 aa, Artificial Sequence
  Description of Artificial Sequence: Synthetic peptide
  Seed: SIQSRYISM (PRAME_HUMAN)
SRQSRYISL

SEQ ID NO: 148411 - protein, 10 aa, Artificial Sequence
  Description of Artificial Sequence: Synthetic peptide
  Seed: MERRRLWGSI (PRAME_HUMAN)
MLRRRLWGSM

SEQ ID NO: 148412 - protein, 9 aa, Artificial Sequence
  Description of Artificial Sequence: Synthetic peptide
  Seed: SPEPLQALL (PRAME_HUMAN)
SVEPLQALL

SEQ ID NO: 148413 - protein, 9 aa, Artificial Sequence
  Description of Artificial Sequence: Synthetic peptide
  Seed: SMSVWTSPR (PRAME_HUMAN)
SFSVWTSPK

SEQ ID NO: 148414 - protein, 10 aa, Artificial Sequence
  Description of Artificial Sequence: Synthetic peptide
  Seed: AAFDGRHSQT (PRAME_HUMAN)
ATFDGRHSQI

SEQ ID NO: 148415 - protein, 9 aa, Artificial Sequence
  Description of Artificial Sequence: Synthetic peptide
  Seed: ISISALQSL (PRAME_HUMAN)
IRISALQSF

SEQ ID NO: 148416 - protein, 9 aa, Artificial Sequence
  Description of Artificial Sequence: Synthetic peptide
  Seed: LAIAALELL (PRAME_HUMAN)
LVIAALELF

SEQ ID NO: 148417 - protein, 9 aa, Artificial Sequence
  Description of Artificial Sequence: Synthetic peptide
  Seed: QLLALLPSL (PRAME_HUMAN)
QVLALLPSY

SEQ ID NO: 148418 - protein, 10 aa, Artificial Sequence
  Description of Artificial Sequence: Synthetic peptide
  Seed: RYISMSVWTS (PRAME_HUMAN)
RYISMSVWTF

SEQ ID NO: 148419 - protein, 9 aa, Artificial Sequence
  Description of Artificial Sequence: Synthetic peptide
  Seed: LMKGQHLHL (PRAME_HUMAN)
LTKGQHLHW

SEQ ID NO: 148420 - protein, 9 aa, Artificial Sequence
  Description of Artificial Sequence: Synthetic peptide
  Seed: ISISALQSL (PRAME_HUMAN)
IRISALQSY

SEQ ID NO: 148421 - protein, 10 aa, Artificial Sequence
  Description of Artificial Sequence: Synthetic peptide
  Seed: QLLRHVMNPL (PRAME_HUMAN)
QALRHVMNPV

SEQ ID NO: 148422 - protein, 9 aa, Artificial Sequence
  Description of Artificial Sequence: Synthetic peptide
  Seed: TDDQLLALL (PRAME_HUMAN)
TSDQLLALI

SEQ ID NO: 148423 - protein, 9 aa, Artificial Sequence
  Description of Artificial Sequence: Synthetic peptide
  Seed: MNPLETLSI (PRAME_HUMAN)
MVPLETLSM

SEQ ID NO: 148424 - protein, 10 aa, Artificial Sequence
  Description of Artificial Sequence: Synthetic peptide
  Seed: ETFKAVLDGL (PRAME_HUMAN)
ETFKAVLDGI

SEQ ID NO: 148425 - protein, 9 aa, Artificial Sequence
  Description of Artificial Sequence: Synthetic peptide
  Seed: IAQFTSQFL (PRAME_HUMAN)
ILQFTSQFI

SEQ ID NO: 148426 - protein, 9 aa, Artificial Sequence
  Description of Artificial Sequence: Synthetic peptide
  Seed: ALYVDSLFF (PRAME_HUMAN)
ALYVDSLFY

SEQ ID NO: 148427 - protein, 9 aa, Artificial Sequence
  Description of Artificial Sequence: Synthetic peptide
  Seed: ELFSYLIEK (PRAME_HUMAN)
EYFSYLIEK

SEQ ID NO: 148428 - protein, 10 aa, Artificial Sequence
  Description of Artificial Sequence: Synthetic peptide
  Seed: YIAQFTSQFL (PRAME_HUMAN)
YLAQFTSQFL

SEQ ID NO: 148429 - protein, 9 aa, Artificial Sequence
  Description of Artificial Sequence: Synthetic peptide
  Seed: HVMNPLETL (PRAME_HUMAN)
HPMNPLETF

SEQ ID NO: 148430 - protein, 9 aa, Artificial Sequence
  Description of Artificial Sequence: Synthetic peptide
  Seed: LSHIHASSY (PRAME_HUMAN)
LQHIHASSY

SEQ ID NO: 148431 - protein, 10 aa, Artificial Sequence
  Description of Artificial Sequence: Synthetic peptide
  Seed: IGLSNLTHVL (PRAME_HUMAN)
IELSNLTHVV

SEQ ID NO: 148432 - protein, 10 aa, Artificial Sequence
  Description of Artificial Sequence: Synthetic peptide
  Seed: SISISALQSL (PRAME_HUMAN)
SESISALQSW

SEQ ID NO: 148433 - protein, 9 aa, Artificial Sequence
  Description of Artificial Sequence: Synthetic peptide
  Seed: YVDSLFFLR (PRAME_HUMAN)
YTDSLFFLK

SEQ ID NO: 148434 - protein, 9 aa, Artificial Sequence
  Description of Artificial Sequence: Synthetic peptide
  Seed: YSFPEPEAA (PRAME_HUMAN)
YTFPEPEAF

SEQ ID NO: 148435 - protein, 11 aa, Artificial Sequence
  Description of Artificial Sequence: Synthetic peptide
  Seed: SNLTHVLYPVP (PRAME_HUMAN)
SMLTHVLYPVI

SEQ ID NO: 148436 - protein, 8 aa, Artificial Sequence
  Description of Artificial Sequence: Synthetic peptide
  Seed: FYDPEPIL (PRAME_HUMAN)
FGDPEPII

SEQ ID NO: 148437 - protein, 10 aa, Artificial Sequence
  Description of Artificial Sequence: Synthetic peptide
  Seed: ISMSVWTSPR (PRAME_HUMAN)
IMMSVWTSPY

SEQ ID NO: 148438 - protein, 10 aa, Artificial Sequence
  Description of Artificial Sequence: Synthetic peptide
  Seed: VELAGQSLLK (PRAME_HUMAN)
VKLAGQSLLK

SEQ ID NO: 148439 - protein, 9 aa, Artificial Sequence
  Description of Artificial Sequence: Synthetic peptide
  Seed: AVLDGLDVL (PRAME_HUMAN)
AILDGLDVA

SEQ ID NO: 148440 - protein, 9 aa, Artificial Sequence
  Description of Artificial Sequence: Synthetic peptide
  Seed: ITDDQLLAL (PRAME_HUMAN)
ILDDQLLAY

SEQ ID NO: 148441 - protein, 11 aa, Artificial Sequence
  Description of Artificial Sequence: Synthetic peptide
  Seed: HLSQSPSVSQL (PRAME_HUMAN)
HQSQSPSVSQY

SEQ ID NO: 148442 - protein, 9 aa, Artificial Sequence
  Description of Artificial Sequence: Synthetic peptide
  Seed: LTDVSPEPL (PRAME_HUMAN)
LIDVSPEPM

SEQ ID NO: 148443 - protein, 10 aa, Artificial Sequence
  Description of Artificial Sequence: Synthetic peptide
  Seed: MVQAWPFTCL (PRAME_HUMAN)
MTQAWPFTCM

SEQ ID NO: 148444 - protein, 10 aa, Artificial Sequence
  Description of Artificial Sequence: Synthetic peptide
  Seed: QTLKAMVQAW (PRAME_HUMAN)
QALKAMVQAW

SEQ ID NO: 148445 - protein, 9 aa, Artificial Sequence
  Description of Artificial Sequence: Synthetic peptide
  Seed: ELFPPLFMA (PRAME_HUMAN)
EVFPPLFMA

SEQ ID NO: 148446 - protein, 10 aa, Artificial Sequence
  Description of Artificial Sequence: Synthetic peptide
  Seed: RGRLDQLLRH (PRAME_HUMAN)
RVRLDQLLRR

SEQ ID NO: 148447 - protein, 11 aa, Artificial Sequence
  Description of Artificial Sequence: Synthetic peptide
  Seed: AAFDGRHSQTL (PRAME_HUMAN)
AIFDGRHSQTR

SEQ ID NO: 148448 - protein, 9 aa, Artificial Sequence
  Description of Artificial Sequence: Synthetic peptide
  Seed: ISPEKEEQY (PRAME_HUMAN)
IIPEKEEQV

SEQ ID NO: 148449 - protein, 9 aa, Artificial Sequence
  Description of Artificial Sequence: Synthetic peptide
  Seed: FYDPEPILC (PRAME_HUMAN)
FGDPEPILC

SEQ ID NO: 148450 - protein, 10 aa, Artificial Sequence
  Description of Artificial Sequence: Synthetic peptide
  Seed: MSVWTSPRRL (PRAME_HUMAN)
MTVWTSPRRY

SEQ ID NO: 148451 - protein, 9 aa, Artificial Sequence
  Description of Artificial Sequence: Synthetic peptide
  Seed: LHLETFKAV (PRAME_HUMAN)
LHLETFKAL

SEQ ID NO: 148452 - protein, 10 aa, Artificial Sequence
  Description of Artificial Sequence: Synthetic peptide
  Seed: SISISALQSL (PRAME_HUMAN)
SMSISALQSW

SEQ ID NO: 148453 - protein, 10 aa, Artificial Sequence
  Description of Artificial Sequence: Synthetic peptide
  Seed: QALYVDSLFF (PRAME_HUMAN)
QKLYVDSLFY

SEQ ID NO: 148454 - protein, 9 aa, Artificial Sequence
  Description of Artificial Sequence: Synthetic peptide
  Seed: EPLQALLER (PRAME_HUMAN)
EGLQALLER

SEQ ID NO: 148455 - protein, 10 aa, Artificial Sequence
  Description of Artificial Sequence: Synthetic peptide
  Seed: MVQAWPFTCL (PRAME_HUMAN)
MVQAWPFTCI

SEQ ID NO: 148456 - protein, 10 aa, Artificial Sequence
  Description of Artificial Sequence: Synthetic peptide
  Seed: HCSQLTTLSF (PRAME_HUMAN)
HMSQLTTLSW

SEQ ID NO: 148457 - protein, 10 aa, Artificial Sequence
  Description of Artificial Sequence: Synthetic peptide
  Seed: YVDSLFFLRG (PRAME_HUMAN)
YMDSLFFLRR

SEQ ID NO: 148458 - protein, 11 aa, Artificial Sequence
  Description of Artificial Sequence: Synthetic peptide
  Seed: LSLSGVMLTDV (PRAME_HUMAN)
LLLSGVMLTDI

SEQ ID NO: 148459 - protein, 9 aa, Artificial Sequence
  Description of Artificial Sequence: Synthetic peptide
  Seed: LTDVSPEPL (PRAME_HUMAN)
LIDVSPEPI

SEQ ID NO: 148460 - protein, 10 aa, Artificial Sequence
  Description of Artificial Sequence: Synthetic peptide
  Seed: MINLRRLLLS (PRAME_HUMAN)
MMNLRRLLLI

SEQ ID NO: 148461 - protein, 9 aa, Artificial Sequence
  Description of Artificial Sequence: Synthetic peptide
  Seed: ISPEKEEQY (PRAME_HUMAN)
IQPEKEEQY

SEQ ID NO: 148462 - protein, 10 aa, Artificial Sequence
  Description of Artificial Sequence: Synthetic peptide
  Seed: RELFPPLFMA (PRAME_HUMAN)
RSLFPPLFML

SEQ ID NO: 148463 - protein, 10 aa, Artificial Sequence
  Description of Artificial Sequence: Synthetic peptide
  Seed: SISISALQSL (PRAME_HUMAN)
SFSISALQSW

SEQ ID NO: 148464 - protein, 10 aa, Artificial Sequence
  Description of Artificial Sequence: Synthetic peptide
  Seed: YEDIHGTLHL (PRAME_HUMAN)
YYDIHGTLHM

SEQ ID NO: 148465 - protein, 10 aa, Artificial Sequence
  Description of Artificial Sequence: Synthetic peptide
  Seed: IQSRYISMSV (PRAME_HUMAN)
IRSRYISMSF

SEQ ID NO: 148466 - protein, 10 aa, Artificial Sequence
  Description of Artificial Sequence: Synthetic peptide
  Seed: YISPEKEEQY (PRAME_HUMAN)
YLSPEKEEQF

SEQ ID NO: 148467 - protein, 9 aa, Artificial Sequence
  Description of Artificial Sequence: Synthetic peptide
  Seed: LQHLIGLSN (PRAME_HUMAN)
LMHLIGLSL

SEQ ID NO: 148468 - protein, 9 aa, Artificial Sequence
  Description of Artificial Sequence: Synthetic peptide
  Seed: SMSVWTSPR (PRAME_HUMAN)
STSVWTSPR

SEQ ID NO: 148469 - protein, 9 aa, Artificial Sequence
  Description of Artificial Sequence: Synthetic peptide
  Seed: AVLDGLDVL (PRAME_HUMAN)
ATLDGLDVV

SEQ ID NO: 148470 - protein, 9 aa, Artificial Sequence
  Description of Artificial Sequence: Synthetic peptide
  Seed: VQAWPFTCL (PRAME_HUMAN)
VSAWPFTCF

SEQ ID NO: 148471 - protein, 9 aa, Artificial Sequence
  Description of Artificial Sequence: Synthetic peptide
  Seed: SYLIEKVKR (PRAME_HUMAN)
SALIEKVKR

SEQ ID NO: 148472 - protein, 9 aa, Artificial Sequence
  Description of Artificial Sequence: Synthetic peptide
  Seed: MERRRLWGS (PRAME_HUMAN)
MERRRLWGI

SEQ ID NO: 148473 - protein, 9 aa, Artificial Sequence
  Description of Artificial Sequence: Synthetic peptide
  Seed: AWPFTCLPL (PRAME_HUMAN)
AFPFTCLPF

SEQ ID NO: 148474 - protein, 10 aa, Artificial Sequence
  Description of Artificial Sequence: Synthetic peptide
  Seed: YIAQFTSQFL (PRAME_HUMAN)
YFAQFTSQFF

SEQ ID NO: 148475 - protein, 9 aa, Artificial Sequence
  Description of Artificial Sequence: Synthetic peptide
  Seed: YISMSVWTS (PRAME_HUMAN)
YLSMSVWTT

SEQ ID NO: 148476 - protein, 9 aa, Artificial Sequence
  Description of Artificial Sequence: Synthetic peptide
  Seed: TFYDPEPIL (PRAME_HUMAN)
TQYDPEPIL

SEQ ID NO: 148477 - protein, 9 aa, Artificial Sequence
  Description of Artificial Sequence: Synthetic peptide
  Seed: MHLSQSPSV (PRAME_HUMAN)
MALSQSPSY

SEQ ID NO: 148478 - protein, 9 aa, Artificial Sequence
  Description of Artificial Sequence: Synthetic peptide
  Seed: YPVPLESYE (PRAME_HUMAN)
YSVPLESYF

SEQ ID NO: 148479 - protein, 9 aa, Artificial Sequence
  Description of Artificial Sequence: Synthetic peptide
  Seed: RLDQLLRHV (PRAME_HUMAN)
RADQLLRHF

SEQ ID NO: 148480 - protein, 9 aa, Artificial Sequence
  Description of Artificial Sequence: Synthetic peptide
  Seed: LTDVSPEPL (PRAME_HUMAN)
LTDVSPEPM

SEQ ID NO: 148481 - protein, 10 aa, Artificial Sequence
  Description of Artificial Sequence: Synthetic peptide
  Seed: LPTLAKFSPY (PRAME_HUMAN)
LMTLAKFSPF

SEQ ID NO: 148482 - protein, 9 aa, Artificial Sequence
  Description of Artificial Sequence: Synthetic peptide
  Seed: HLIGLSNLT (PRAME_HUMAN)
HTIGLSNLV

SEQ ID NO: 148483 - protein, 9 aa, Artificial Sequence
  Description of Artificial Sequence: Synthetic peptide
  Seed: KFSPYLGQM (PRAME_HUMAN)
KISPYLGQY

SEQ ID NO: 148484 - protein, 10 aa, Artificial Sequence
  Description of Artificial Sequence: Synthetic peptide
  Seed: DELFSYLIEK (PRAME_HUMAN)
DNLFSYLIER

SEQ ID NO: 148485 - protein, 9 aa, Artificial Sequence
  Description of Artificial Sequence: Synthetic peptide
  Seed: NSHQDFWTV (PRAME_HUMAN)
NMHQDFWTV

SEQ ID NO: 148486 - protein, 10 aa, Artificial Sequence
  Description of Artificial Sequence: Synthetic peptide
  Seed: IGLSNLTHVL (PRAME_HUMAN)
IILSNLTHVL

SEQ ID NO: 148487 - protein, 9 aa, Artificial Sequence
  Description of Artificial Sequence: Synthetic peptide
  Seed: SQLTTLSFY (PRAME_HUMAN)
SALTTLSFK

SEQ ID NO: 148488 - protein, 9 aa, Artificial Sequence
  Description of Artificial Sequence: Synthetic peptide
  Seed: LLRHVMNPL (PRAME_HUMAN)
LPRHVMNPC

SEQ ID NO: 148489 - protein, 9 aa, Artificial Sequence
  Description of Artificial Sequence: Synthetic peptide
  Seed: MINLRRLLL (PRAME_HUMAN)
MYNLRRLLY

SEQ ID NO: 148490 - protein, 11 aa, Artificial Sequence
  Description of Artificial Sequence: Synthetic peptide
  Seed: IGLSNLTHVLY (PRAME_HUMAN)
ITLSNLTHVLW

SEQ ID NO: 148491 - protein, 9 aa, Artificial Sequence
  Description of Artificial Sequence: Synthetic peptide
  Seed: LQALYVDSL (PRAME_HUMAN)
LLALYVDSV

SEQ ID NO: 148492 - protein, 9 aa, Artificial Sequence
  Description of Artificial Sequence: Synthetic peptide
  Seed: LALLPSLSH (PRAME_HUMAN)
LRLLPSLSF

SEQ ID NO: 148493 - protein, 9 aa, Artificial Sequence
  Description of Artificial Sequence: Synthetic peptide
  Seed: RLDQLLRHV (PRAME_HUMAN)
RSDQLLRHV

SEQ ID NO: 148494 - protein, 9 aa, Artificial Sequence
  Description of Artificial Sequence: Synthetic peptide
  Seed: SFPEPEAAQ (PRAME_HUMAN)
SYPEPEAAF

SEQ ID NO: 148495 - protein, 9 aa, Artificial Sequence
  Description of Artificial Sequence: Synthetic peptide
  Seed: KLKIFAMPM (PRAME_HUMAN)
KLKIFAMPI

SEQ ID NO: 148496 - protein, 11 aa, Artificial Sequence
  Description of Artificial Sequence: Synthetic peptide
  Seed: ALYVDSLFFLR (PRAME_HUMAN)
AMYVDSLFFLE

SEQ ID NO: 148497 - protein, 9 aa, Artificial Sequence
  Description of Artificial Sequence: Synthetic peptide
  Seed: NLTHVLYPV (PRAME_HUMAN)
NQTHVLYPI

SEQ ID NO: 148498 - protein, 10 aa, Artificial Sequence
  Description of Artificial Sequence: Synthetic peptide
  Seed: SNLTHVLYPV (PRAME_HUMAN)
SKLTHVLYPV

SEQ ID NO: 148499 - protein, 10 aa, Artificial Sequence
  Description of Artificial Sequence: Synthetic peptide
  Seed: SPYLGQMINL (PRAME_HUMAN)
SMYLGQMINF

SEQ ID NO: 148500 - protein, 10 aa, Artificial Sequence
  Description of Artificial Sequence: Synthetic peptide
  Seed: RRLWGSIQSR (PRAME_HUMAN)
RDLWGSIQSR

SEQ ID NO: 148501 - protein, 9 aa, Artificial Sequence
  Description of Artificial Sequence: Synthetic peptide
  Seed: SHQDFWTVW (PRAME_HUMAN)
SHQDFWTVV

SEQ ID NO: 148502 - protein, 9 aa, Artificial Sequence
  Description of Artificial Sequence: Synthetic peptide
  Seed: FYDPEPILC (PRAME_HUMAN)
FCDPEPILI

SEQ ID NO: 148503 - protein, 9 aa, Artificial Sequence
  Description of Artificial Sequence: Synthetic peptide
  Seed: MINLRRLLL (PRAME_HUMAN)
MRNLRRLLF

SEQ ID NO: 148504 - protein, 9 aa, Artificial Sequence
  Description of Artificial Sequence: Synthetic peptide
  Seed: NLTHVLYPV (PRAME_HUMAN)
NLTHVLYPI

SEQ ID NO: 148505 - protein, 10 aa, Artificial Sequence
  Description of Artificial Sequence: Synthetic peptide
  Seed: AFDGRHSQTL (PRAME_HUMAN)
AVDGRHSQTM

SEQ ID NO: 148506 - protein, 11 aa, Artificial Sequence
  Description of Artificial Sequence: Synthetic peptide
  Seed: RELFPPLFMAA (PRAME_HUMAN)
RSLFPPLFMAI

SEQ ID NO: 148507 - protein, 9 aa, Artificial Sequence
  Description of Artificial Sequence: Synthetic peptide
  Seed: SVLSLSGVM (PRAME_HUMAN)
SMLSLSGVM

SEQ ID NO: 148508 - protein, 9 aa, Artificial Sequence
  Description of Artificial Sequence: Synthetic peptide
  Seed: KLKIFAMPM (PRAME_HUMAN)
KTKIFAMPG

SEQ ID NO: 148509 - protein, 10 aa, Artificial Sequence
  Description of Artificial Sequence: Synthetic peptide
  Seed: FAMPMQDIKM (PRAME_HUMAN)
FLMPMQDIKM

SEQ ID NO: 148510 - protein, 10 aa, Artificial Sequence
  Description of Artificial Sequence: Synthetic peptide
  Seed: AQFTSQFLSL (PRAME_HUMAN)
AQFTSQFLSH

SEQ ID NO: 148511 - protein, 10 aa, Artificial Sequence
  Description of Artificial Sequence: Synthetic peptide
  Seed: FIPVEVLVDL (PRAME_HUMAN)
FKPVEVLVDM

SEQ ID NO: 148512 - protein, 9 aa, Artificial Sequence
  Description of Artificial Sequence: Synthetic peptide
  Seed: AAQPMTKKR (PRAME_HUMAN)
AMQPMTKKK

SEQ ID NO: 148513 - protein, 10 aa, Artificial Sequence
  Description of Artificial Sequence: Synthetic peptide
  Seed: AFDGRHSQTL (PRAME_HUMAN)
ASDGRHSQTF

SEQ ID NO: 148514 - protein, 9 aa, Artificial Sequence
  Description of Artificial Sequence: Synthetic peptide
  Seed: QTLKAMVQA (PRAME_HUMAN)
QALKAMVQV

SEQ ID NO: 148515 - protein, 10 aa, Artificial Sequence
  Description of Artificial Sequence: Synthetic peptide
  Seed: KIFAMPMQDI (PRAME_HUMAN)
KIFAMPMQDV

SEQ ID NO: 148516 - protein, 10 aa, Artificial Sequence
  Description of Artificial Sequence: Synthetic peptide
  Seed: SLLQHLIGLS (PRAME_HUMAN)
STLQHLIGLV

SEQ ID NO: 148517 - protein, 9 aa, Artificial Sequence
  Description of Artificial Sequence: Synthetic peptide
  Seed: KFSPYLGQM (PRAME_HUMAN)
KWSPYLGQF

SEQ ID NO: 148518 - protein, 9 aa, Artificial Sequence
  Description of Artificial Sequence: Synthetic peptide
  Seed: SHIHASSYI (PRAME_HUMAN)
SRIHASSYF

SEQ ID NO: 148519 - protein, 10 aa, Artificial Sequence
  Description of Artificial Sequence: Synthetic peptide
  Seed: YGNSISISAL (PRAME_HUMAN)
YINSISISAY

SEQ ID NO: 148520 - protein, 9 aa, Artificial Sequence
  Description of Artificial Sequence: Synthetic peptide
  Seed: LLLSHIHAS (PRAME_HUMAN)
LLLSHIHAA

SEQ ID NO: 148521 - protein, 10 aa, Artificial Sequence
  Description of Artificial Sequence: Synthetic peptide
  Seed: YSFPEPEAAQ (PRAME_HUMAN)
YMFPEPEAAM

SEQ ID NO: 148522 - protein, 9 aa, Artificial Sequence
  Description of Artificial Sequence: Synthetic peptide
  Seed: NSISISALQ (PRAME_HUMAN)
NVISISALK

SEQ ID NO: 148523 - protein, 10 aa, Artificial Sequence
  Description of Artificial Sequence: Synthetic peptide
  Seed: MLTDVSPEPL (PRAME_HUMAN)
MATDVSPEPM

SEQ ID NO: 148524 - protein, 10 aa, Artificial Sequence
  Description of Artificial Sequence: Synthetic peptide
  Seed: MPMQDIKMIL (PRAME_HUMAN)
MFMQDIKMIV

SEQ ID NO: 148525 - protein, 8 aa, Artificial Sequence
  Description of Artificial Sequence: Synthetic peptide
  Seed: MINLRRLL (PRAME_HUMAN)
MPNLRRLM

SEQ ID NO: 148526 - protein, 9 aa, Artificial Sequence
  Description of Artificial Sequence: Synthetic peptide
  Seed: KFSPYLGQM (PRAME_HUMAN)
KSSPYLGQL

SEQ ID NO: 148527 - protein, 8 aa, Artificial Sequence
  Description of Artificial Sequence: Synthetic peptide
  Seed: FTSQFLSL (PRAME_HUMAN)
FASQFLSL

SEQ ID NO: 148528 - protein, 9 aa, Artificial Sequence
  Description of Artificial Sequence: Synthetic peptide
  Seed: LQHLIGLSN (PRAME_HUMAN)
LSHLIGLSY

SEQ ID NO: 148529 - protein, 9 aa, Artificial Sequence
  Description of Artificial Sequence: Synthetic peptide
  Seed: SLLQHLIGL (PRAME_HUMAN)
SALQHLIGA

SEQ ID NO: 148530 - protein, 10 aa, Artificial Sequence
  Description of Artificial Sequence: Synthetic peptide
  Seed: ETLSITNCRL (PRAME_HUMAN)
ESLSITNCRK

SEQ ID NO: 148531 - protein, 10 aa, Artificial Sequence
  Description of Artificial Sequence: Synthetic peptide
  Seed: MVQAWPFTCL (PRAME_HUMAN)
MQQAWPFTCF

SEQ ID NO: 148532 - protein, 9 aa, Artificial Sequence
  Description of Artificial Sequence: Synthetic peptide
  Seed: SLLQHLIGL (PRAME_HUMAN)
SSLQHLIGK

SEQ ID NO: 148533 - protein, 11 aa, Artificial Sequence
  Description of Artificial Sequence: Synthetic peptide
  Seed: HLERLAYLHAR (PRAME_HUMAN)
HTERLAYLHAR

SEQ ID NO: 148534 - protein, 9 aa, Artificial Sequence
  Description of Artificial Sequence: Synthetic peptide
  Seed: QSRYISMSV (PRAME_HUMAN)
QPRYISMSC

SEQ ID NO: 148535 - protein, 9 aa, Artificial Sequence
  Description of Artificial Sequence: Synthetic peptide
  Seed: SHIHASSYI (PRAME_HUMAN)
SFIHASSYV

SEQ ID NO: 148536 - protein, 10 aa, Artificial Sequence
  Description of Artificial Sequence: Synthetic peptide
  Seed: MVQAWPFTCL (PRAME_HUMAN)
MLQAWPFTCM

SEQ ID NO: 148537 - protein, 10 aa, Artificial Sequence
  Description of Artificial Sequence: Synthetic peptide
  Seed: SISISALQSL (PRAME_HUMAN)
SSSISALQSM

SEQ ID NO: 148538 - protein, 10 aa, Artificial Sequence
  Description of Artificial Sequence: Synthetic peptide
  Seed: YIAQFTSQFL (PRAME_HUMAN)
YGAQFTSQFF

SEQ ID NO: 148539 - protein, 11 aa, Artificial Sequence
  Description of Artificial Sequence: Synthetic peptide
  Seed: LSNLTHVLYPV (PRAME_HUMAN)
LMNLTHVLYPV

SEQ ID NO: 148540 - protein, 10 aa, Artificial Sequence
  Description of Artificial Sequence: Synthetic peptide
  Seed: LPTLAKFSPY (PRAME_HUMAN)
LKTLAKFSPW

SEQ ID NO: 148541 - protein, 11 aa, Artificial Sequence
  Description of Artificial Sequence: Synthetic peptide
  Seed: RLRELLCELGR (PRAME_HUMAN)
RIRELLCELGR

SEQ ID NO: 148542 - protein, 10 aa, Artificial Sequence
  Description of Artificial Sequence: Synthetic peptide
  Seed: RASATLQDLV (PRAME_HUMAN)
RVSATLQDLW

SEQ ID NO: 148543 - protein, 10 aa, Artificial Sequence
  Description of Artificial Sequence: Synthetic peptide
  Seed: IGLSNLTHVL (PRAME_HUMAN)
ILLSNLTHVT

SEQ ID NO: 148544 - protein, 9 aa, Artificial Sequence
  Description of Artificial Sequence: Synthetic peptide
  Seed: RLRELLCEL (PRAME_HUMAN)
RYRELLCES

SEQ ID NO: 148545 - protein, 9 aa, Artificial Sequence
  Description of Artificial Sequence: Synthetic peptide
  Seed: SQLTTLSFY (PRAME_HUMAN)
SILTTLSFK

SEQ ID NO: 148546 - protein, 11 aa, Artificial Sequence
  Description of Artificial Sequence: Synthetic peptide
  Seed: NSISISALQSL (PRAME_HUMAN)
NSISISALQSF

SEQ ID NO: 148547 - protein, 11 aa, Artificial Sequence
  Description of Artificial Sequence: Synthetic peptide
  Seed: RASATLQDLVF (PRAME_HUMAN)
RYSATLQDLVW

SEQ ID NO: 148548 - protein, 9 aa, Artificial Sequence
  Description of Artificial Sequence: Synthetic peptide
  Seed: LQALYVDSL (PRAME_HUMAN)
LSALYVDSY

SEQ ID NO: 148549 - protein, 9 aa, Artificial Sequence
  Description of Artificial Sequence: Synthetic peptide
  Seed: FYDPEPILC (PRAME_HUMAN)
FADPEPILC

SEQ ID NO: 148550 - protein, 9 aa, Artificial Sequence
  Description of Artificial Sequence: Synthetic peptide
  Seed: LSLQCLQAL (PRAME_HUMAN)
LQLQCLQAY

SEQ ID NO: 148551 - protein, 10 aa, Artificial Sequence
  Description of Artificial Sequence: Synthetic peptide
  Seed: RYISMSVWTS (PRAME_HUMAN)
RYISMSVWTY

SEQ ID NO: 148552 - protein, 9 aa, Artificial Sequence
  Description of Artificial Sequence: Synthetic peptide
  Seed: LLRHVMNPL (PRAME_HUMAN)
LMRHVMNPA

SEQ ID NO: 148553 - protein, 9 aa, Artificial Sequence
  Description of Artificial Sequence: Synthetic peptide
  Seed: DELFSYLIE (PRAME_HUMAN)
DELFSYLIM

SEQ ID NO: 148554 - protein, 9 aa, Artificial Sequence
  Description of Artificial Sequence: Synthetic peptide
  Seed: RPSMVWLSA (PRAME_HUMAN)
RPSMVWLSM

SEQ ID NO: 148555 - protein, 9 aa, Artificial Sequence
  Description of Artificial Sequence: Synthetic peptide
  Seed: GNRASLYSF (PRAME_HUMAN)
GARASLYSF

SEQ ID NO: 148556 - protein, 9 aa, Artificial Sequence
  Description of Artificial Sequence: Synthetic peptide
  Seed: FYDPEPILC (PRAME_HUMAN)
FADPEPILY

SEQ ID NO: 148557 - protein, 9 aa, Artificial Sequence
  Description of Artificial Sequence: Synthetic peptide
  Seed: SIQSRYISM (PRAME_HUMAN)
SLQSRYISL

SEQ ID NO: 148558 - protein, 9 aa, Artificial Sequence
  Description of Artificial Sequence: Synthetic peptide
  Seed: FLRGRLDQL (PRAME_HUMAN)
FARGRLDQY

SEQ ID NO: 148559 - protein, 11 aa, Artificial Sequence
  Description of Artificial Sequence: Synthetic peptide
  Seed: LLLSHIHASSY (PRAME_HUMAN)
LMLSHIHASSF

SEQ ID NO: 148560 - protein, 10 aa, Artificial Sequence
  Description of Artificial Sequence: Synthetic peptide
  Seed: KKLKIFAMPM (PRAME_HUMAN)
KQLKIFAMPK

SEQ ID NO: 148561 - protein, 11 aa, Artificial Sequence
  Description of Artificial Sequence: Synthetic peptide
  Seed: FKAVLDGLDVL (PRAME_HUMAN)
FFAVLDGLDVV

SEQ ID NO: 148562 - protein, 9 aa, Artificial Sequence
  Description of Artificial Sequence: Synthetic peptide
  Seed: SHIHASSYI (PRAME_HUMAN)
SMIHASSYY

SEQ ID NO: 148563 - protein, 10 aa, Artificial Sequence
  Description of Artificial Sequence: Synthetic peptide
  Seed: KDEALAIAAL (PRAME_HUMAN)
KPEALAIAAL

SEQ ID NO: 148564 - protein, 11 aa, Artificial Sequence
  Description of Artificial Sequence: Synthetic peptide
  Seed: AAFDGRHSQTL (PRAME_HUMAN)
AIFDGRHSQTY

SEQ ID NO: 148565 - protein, 10 aa, Artificial Sequence
  Description of Artificial Sequence: Synthetic peptide
  Seed: MTKKRKVDGL (PRAME_HUMAN)
MMKKRKVDGL

SEQ ID NO: 148566 - protein, 9 aa, Artificial Sequence
  Description of Artificial Sequence: Synthetic peptide
  Seed: ALYVDSLFF (PRAME_HUMAN)
AQYVDSLFI

SEQ ID NO: 148567 - protein, 10 aa, Artificial Sequence
  Description of Artificial Sequence: Synthetic peptide
  Seed: FAMPMQDIKM (PRAME_HUMAN)
FTMPMQDIKW

SEQ ID NO: 148568 - protein, 9 aa, Artificial Sequence
  Description of Artificial Sequence: Synthetic peptide
  Seed: ASATLQDLV (PRAME_HUMAN)
AIATLQDLV

SEQ ID NO: 148569 - protein, 9 aa, Artificial Sequence
  Description of Artificial Sequence: Synthetic peptide
  Seed: KFSPYLGQM (PRAME_HUMAN)
KASPYLGQY

SEQ ID NO: 148570 - protein, 10 aa, Artificial Sequence
  Description of Artificial Sequence: Synthetic peptide
  Seed: CTWKLPTLAK (PRAME_HUMAN)
CSWKLPTLAR

SEQ ID NO: 148571 - protein, 9 aa, Artificial Sequence
  Description of Artificial Sequence: Synthetic peptide
  Seed: MQDIKMILK (PRAME_HUMAN)
MQDIKMILY

SEQ ID NO: 148572 - protein, 10 aa, Artificial Sequence
  Description of Artificial Sequence: Synthetic peptide
  Seed: FTCLPLGVLM (PRAME_HUMAN)
FTCLPLGVLV

SEQ ID NO: 148573 - protein, 10 aa, Artificial Sequence
  Description of Artificial Sequence: Synthetic peptide
  Seed: LLLSHIHASS (PRAME_HUMAN)
LCLSHIHASV

SEQ ID NO: 148574 - protein, 9 aa, Artificial Sequence
  Description of Artificial Sequence: Synthetic peptide
  Seed: RTFYDPEPI (PRAME_HUMAN)
RLFYDPEPL

SEQ ID NO: 148575 - protein, 11 aa, Artificial Sequence
  Description of Artificial Sequence: Synthetic peptide
  Seed: SNLTHVLYPVP (PRAME_HUMAN)
SMLTHVLYPVD

SEQ ID NO: 148576 - protein, 9 aa, Artificial Sequence
  Description of Artificial Sequence: Synthetic peptide
  Seed: YIAQFTSQF (PRAME_HUMAN)
YKAQFTSQM

SEQ ID NO: 148577 - protein, 10 aa, Artificial Sequence
  Description of Artificial Sequence: Synthetic peptide
  Seed: RRLWGSIQSR (PRAME_HUMAN)
RHLWGSIQSR

SEQ ID NO: 148578 - protein, 11 aa, Artificial Sequence
  Description of Artificial Sequence: Synthetic peptide
  Seed: RASATLQDLVF (PRAME_HUMAN)
RWSATLQDLVW

SEQ ID NO: 148579 - protein, 9 aa, Artificial Sequence
  Description of Artificial Sequence: Synthetic peptide
  Seed: SIQSRYISM (PRAME_HUMAN)
SPQSRYISM

SEQ ID NO: 148580 - protein, 9 aa, Artificial Sequence
  Description of Artificial Sequence: Synthetic peptide
  Seed: ISPEKEEQY (PRAME_HUMAN)
IIPEKEEQF

SEQ ID NO: 148581 - protein, 11 aa, Artificial Sequence
  Description of Artificial Sequence: Synthetic peptide
  Seed: LLLSHIHASSY (PRAME_HUMAN)
LTLSHIHASSW

SEQ ID NO: 148582 - protein, 9 aa, Artificial Sequence
  Description of Artificial Sequence: Synthetic peptide
  Seed: LPRELFPPL (PRAME_HUMAN)
LQRELFPPF

SEQ ID NO: 148583 - protein, 10 aa, Artificial Sequence
  Description of Artificial Sequence: Synthetic peptide
  Seed: SVSQLSVLSL (PRAME_HUMAN)
SASQLSVLSF

SEQ ID NO: 148584 - protein, 11 aa, Artificial Sequence
  Description of Artificial Sequence: Synthetic peptide
  Seed: DVSPEPLQALL (PRAME_HUMAN)
DISPEPLQALR

SEQ ID NO: 148585 - protein, 10 aa, Artificial Sequence
  Description of Artificial Sequence: Synthetic peptide
  Seed: GACDELFSYL (PRAME_HUMAN)
GQCDELFSYI

SEQ ID NO: 148586 - protein, 10 aa, Artificial Sequence
  Description of Artificial Sequence: Synthetic peptide
  Seed: ISMSVWTSPR (PRAME_HUMAN)
ICMSVWTSPK

SEQ ID NO: 148587 - protein, 10 aa, Artificial Sequence
  Description of Artificial Sequence: Synthetic peptide
  Seed: DRTFYDPEPI (PRAME_HUMAN)
DFTFYDPEPV

SEQ ID NO: 148588 - protein, 9 aa, Artificial Sequence
  Description of Artificial Sequence: Synthetic peptide
  Seed: LQHLIGLSN (PRAME_HUMAN)
LRHLIGLSF

SEQ ID NO: 148589 - protein, 9 aa, Artificial Sequence
  Description of Artificial Sequence: Synthetic peptide
  Seed: LAIAALELL (PRAME_HUMAN)
LAIAALELY

SEQ ID NO: 148590 - protein, 9 aa, Artificial Sequence
  Description of Artificial Sequence: Synthetic peptide
  Seed: LSNLTHVLY (PRAME_HUMAN)
LTNLTHVLV

SEQ ID NO: 148591 - protein, 9 aa, Artificial Sequence
  Description of Artificial Sequence: Synthetic peptide
  Seed: IGLSNLTHV (PRAME_HUMAN)
ISLSNLTHL

SEQ ID NO: 148592 - protein, 9 aa, Artificial Sequence
  Description of Artificial Sequence: Synthetic peptide
  Seed: ALAIAALEL (PRAME_HUMAN)
AQAIAALEM

SEQ ID NO: 148593 - protein, 10 aa, Artificial Sequence
  Description of Artificial Sequence: Synthetic peptide
  Seed: ARLRELLCEL (PRAME_HUMAN)
ATLRELLCEA

SEQ ID NO: 148594 - protein, 9 aa, Artificial Sequence
  Description of Artificial Sequence: Synthetic peptide
  Seed: FYDPEPILC (PRAME_HUMAN)
FLDPEPILI

SEQ ID NO: 148595 - protein, 9 aa, Artificial Sequence
  Description of Artificial Sequence: Synthetic peptide
  Seed: VSPEPLQAL (PRAME_HUMAN)
VVPEPLQAY

SEQ ID NO: 148596 - protein, 11 aa, Artificial Sequence
  Description of Artificial Sequence: Synthetic peptide
  Seed: ESYEDIHGTLH (PRAME_HUMAN)
ESYEDIHGTLR

SEQ ID NO: 148597 - protein, 9 aa, Artificial Sequence
  Description of Artificial Sequence: Synthetic peptide
  Seed: LSEGDVMHL (PRAME_HUMAN)
LYEGDVMHL

SEQ ID NO: 148598 - protein, 9 aa, Artificial Sequence
  Description of Artificial Sequence: Synthetic peptide
  Seed: YISMSVWTS (PRAME_HUMAN)
YVSMSVWTM

SEQ ID NO: 148599 - protein, 9 aa, Artificial Sequence
  Description of Artificial Sequence: Synthetic peptide
  Seed: AAFDGRHSQ (PRAME_HUMAN)
ANFDGRHSF

SEQ ID NO: 148600 - protein, 9 aa, Artificial Sequence
  Description of Artificial Sequence: Synthetic peptide
  Seed: ERLAYLHAR (PRAME_HUMAN)
EMLAYLHAR

SEQ ID NO: 148601 - protein, 10 aa, Artificial Sequence
  Description of Artificial Sequence: Synthetic peptide
  Seed: LSFYGNSISI (PRAME_HUMAN)
LPFYGNSISL

SEQ ID NO: 148602 - protein, 9 aa, Artificial Sequence
  Description of Artificial Sequence: Synthetic peptide
  Seed: RHSQTLKAM (PRAME_HUMAN)
RESQTLKAY

SEQ ID NO: 148603 - protein, 9 aa, Artificial Sequence
  Description of Artificial Sequence: Synthetic peptide
  Seed: RELFPPLFM (PRAME_HUMAN)
RTLFPPLFF

SEQ ID NO: 148604 - protein, 10 aa, Artificial Sequence
  Description of Artificial Sequence: Synthetic peptide
  Seed: RRRLWGSIQS (PRAME_HUMAN)
RMRLWGSIQK

SEQ ID NO: 148605 - protein, 9 aa, Artificial Sequence
  Description of Artificial Sequence: Synthetic peptide
  Seed: EAAQPMTKK (PRAME_HUMAN)
EIAQPMTKF

SEQ ID NO: 148606 - protein, 9 aa, Artificial Sequence
  Description of Artificial Sequence: Synthetic peptide
  Seed: RTFYDPEPI (PRAME_HUMAN)
RVFYDPEPM

SEQ ID NO: 148607 - protein, 9 aa, Artificial Sequence
  Description of Artificial Sequence: Synthetic peptide
  Seed: LSNLTHVLY (PRAME_HUMAN)
LLNLTHVLF

SEQ ID NO: 148608 - protein, 9 aa, Artificial Sequence
  Description of Artificial Sequence: Synthetic peptide
  Seed: TLKAMVQAW (PRAME_HUMAN)
TTKAMVQAY

SEQ ID NO: 148609 - protein, 8 aa, Artificial Sequence
  Description of Artificial Sequence: Synthetic peptide
  Seed: SPRRLVEL (PRAME_HUMAN)
SPRRLVEI

SEQ ID NO: 148610 - protein, 9 aa, Artificial Sequence
  Description of Artificial Sequence: Synthetic peptide
  Seed: MHLSQSPSV (PRAME_HUMAN)
MRLSQSPSA

SEQ ID NO: 148611 - protein, 9 aa, Artificial Sequence
  Description of Artificial Sequence: Synthetic peptide
  Seed: GLSNLTHVL (PRAME_HUMAN)
GVSNLTHVY

SEQ ID NO: 148612 - protein, 11 aa, Artificial Sequence
  Description of Artificial Sequence: Synthetic peptide
  Seed: QALYVDSLFFL (PRAME_HUMAN)
QNLYVDSLFFL

SEQ ID NO: 148613 - protein, 9 aa, Artificial Sequence
  Description of Artificial Sequence: Synthetic peptide
  Seed: SPSVSQLSV (PRAME_HUMAN)
SASVSQLSY

SEQ ID NO: 148614 - protein, 9 aa, Artificial Sequence
  Description of Artificial Sequence: Synthetic peptide
  Seed: QSRYISMSV (PRAME_HUMAN)
QVRYISMSA

SEQ ID NO: 148615 - protein, 9 aa, Artificial Sequence
  Description of Artificial Sequence: Synthetic peptide
  Seed: KLQVLDLRK (PRAME_HUMAN)
KMQVLDLRK

SEQ ID NO: 148616 - protein, 11 aa, Artificial Sequence
  Description of Artificial Sequence: Synthetic peptide
  Seed: LLPRELFPPLF (PRAME_HUMAN)
LYPRELFPPLI

SEQ ID NO: 148617 - protein, 9 aa, Artificial Sequence
  Description of Artificial Sequence: Synthetic peptide
  Seed: ESYEDIHGT (PRAME_HUMAN)
EAYEDIHGV

SEQ ID NO: 148618 - protein, 10 aa, Artificial Sequence
  Description of Artificial Sequence: Synthetic peptide
  Seed: RRLWGSIQSR (PRAME_HUMAN)
RELWGSIQSR

SEQ ID NO: 148619 - protein, 9 aa, Artificial Sequence
  Description of Artificial Sequence: Synthetic peptide
  Seed: GLSNLTHVL (PRAME_HUMAN)
GASNLTHVV

SEQ ID NO: 148620 - protein, 11 aa, Artificial Sequence
  Description of Artificial Sequence: Synthetic peptide
  Seed: LPTLAKFSPYL (PRAME_HUMAN)
LITLAKFSPYL

SEQ ID NO: 148621 - protein, 10 aa, Artificial Sequence
  Description of Artificial Sequence: Synthetic peptide
  Seed: LSLQCLQALY (PRAME_HUMAN)
LTLQCLQALF

SEQ ID NO: 148622 - protein, 9 aa, Artificial Sequence
  Description of Artificial Sequence: Synthetic peptide
  Seed: TCLPLGVLM (PRAME_HUMAN)
TGLPLGVLW

SEQ ID NO: 148623 - protein, 9 aa, Artificial Sequence
  Description of Artificial Sequence: Synthetic peptide
  Seed: VDLFLKEGA (PRAME_HUMAN)
VELFLKEGA

SEQ ID NO: 148624 - protein, 9 aa, Artificial Sequence
  Description of Artificial Sequence: Synthetic peptide
  Seed: LSVLSLSGV (PRAME_HUMAN)
LLVLSLSGI

SEQ ID NO: 148625 - protein, 9 aa, Artificial Sequence
  Description of Artificial Sequence: Synthetic peptide
  Seed: SHCSQLTTL (PRAME_HUMAN)
SLCSQLTTF

SEQ ID NO: 148626 - protein, 9 aa, Artificial Sequence
  Description of Artificial Sequence: Synthetic peptide
  Seed: KAMVQAWPF (PRAME_HUMAN)
KFMVQAWPM

SEQ ID NO: 148627 - protein, 9 aa, Artificial Sequence
  Description of Artificial Sequence: Synthetic peptide
  Seed: SFYGNSISI (PRAME_HUMAN)
SQYGNSISC

SEQ ID NO: 148628 - protein, 10 aa, Artificial Sequence
  Description of Artificial Sequence: Synthetic peptide
  Seed: SISISALQSL (PRAME_HUMAN)
SISISALQSW

SEQ ID NO: 148629 - protein, 9 aa, Artificial Sequence
  Description of Artificial Sequence: Synthetic peptide
  Seed: KAMVQAWPF (PRAME_HUMAN)
KQMVQAWPM

SEQ ID NO: 148630 - protein, 10 aa, Artificial Sequence
  Description of Artificial Sequence: Synthetic peptide
  Seed: LSFYGNSISI (PRAME_HUMAN)
LLFYGNSISI

SEQ ID NO: 148631 - protein, 10 aa, Artificial Sequence
  Description of Artificial Sequence: Synthetic peptide
  Seed: RLDQLLRHVM (PRAME_HUMAN)
REDQLLRHVL

SEQ ID NO: 148632 - protein, 9 aa, Artificial Sequence
  Description of Artificial Sequence: Synthetic peptide
  Seed: TSPRRLVEL (PRAME_HUMAN)
TFPRRLVEF

SEQ ID NO: 148633 - protein, 10 aa, Artificial Sequence
  Description of Artificial Sequence: Synthetic peptide
  Seed: MNPLETLSIT (PRAME_HUMAN)
MIPLETLSIA

SEQ ID NO: 148634 - protein, 9 aa, Artificial Sequence
  Description of Artificial Sequence: Synthetic peptide
  Seed: RLRELLCEL (PRAME_HUMAN)
RIRELLCEA

SEQ ID NO: 148635 - protein, 10 aa, Artificial Sequence
  Description of Artificial Sequence: Synthetic peptide
  Seed: EEQYIAQFTS (PRAME_HUMAN)
EEQYIAQFTA

SEQ ID NO: 148636 - protein, 10 aa, Artificial Sequence
  Description of Artificial Sequence: Synthetic peptide
  Seed: DIHGTLHLER (PRAME_HUMAN)
DSHGTLHLER

SEQ ID NO: 148637 - protein, 9 aa, Artificial Sequence
  Description of Artificial Sequence: Synthetic peptide
  Seed: MNPLETLSI (PRAME_HUMAN)
MTPLETLSM

SEQ ID NO: 148638 - protein, 10 aa, Artificial Sequence
  Description of Artificial Sequence: Synthetic peptide
  Seed: LLCELGRPSM (PRAME_HUMAN)
LQCELGRPSF

SEQ ID NO: 148639 - protein, 9 aa, Artificial Sequence
  Description of Artificial Sequence: Synthetic peptide
  Seed: CPHCGDRTF (PRAME_HUMAN)
CPHCGDRTW

SEQ ID NO: 148640 - protein, 10 aa, Artificial Sequence
  Description of Artificial Sequence: Synthetic peptide
  Seed: ETLSITNCRL (PRAME_HUMAN)
EVLSITNCRY

SEQ ID NO: 148641 - protein, 10 aa, Artificial Sequence
  Description of Artificial Sequence: Synthetic peptide
  Seed: IQSRYISMSV (PRAME_HUMAN)
IASRYISMSF

SEQ ID NO: 148642 - protein, 11 aa, Artificial Sequence
  Description of Artificial Sequence: Synthetic peptide
  Seed: LPTLAKFSPYL (PRAME_HUMAN)
LVTLAKFSPYL

SEQ ID NO: 148643 - protein, 9 aa, Artificial Sequence
  Description of Artificial Sequence: Synthetic peptide
  Seed: SQSPSVSQL (PRAME_HUMAN)
SQSPSVSQV

SEQ ID NO: 148644 - protein, 10 aa, Artificial Sequence
  Description of Artificial Sequence: Synthetic peptide
  Seed: YIAQFTSQFL (PRAME_HUMAN)
YSAQFTSQFV

SEQ ID NO: 148645 - protein, 9 aa, Artificial Sequence
  Description of Artificial Sequence: Synthetic peptide
  Seed: SHIHASSYI (PRAME_HUMAN)
SSIHASSYF

SEQ ID NO: 148646 - protein, 10 aa, Artificial Sequence
  Description of Artificial Sequence: Synthetic peptide
  Seed: ETLSITNCRL (PRAME_HUMAN)
ETLSITNCRW

SEQ ID NO: 148647 - protein, 9 aa, Artificial Sequence
  Description of Artificial Sequence: Synthetic peptide
  Seed: ITDDQLLAL (PRAME_HUMAN)
IWDDQLLAI

SEQ ID NO: 148648 - protein, 9 aa, Artificial Sequence
  Description of Artificial Sequence: Synthetic peptide
  Seed: KLKIFAMPM (PRAME_HUMAN)
KWKIFAMPA

SEQ ID NO: 148649 - protein, 11 aa, Artificial Sequence
  Description of Artificial Sequence: Synthetic peptide
  Seed: LSNLTHVLYPV (PRAME_HUMAN)
LQNLTHVLYPV

SEQ ID NO: 148650 - protein, 11 aa, Artificial Sequence
  Description of Artificial Sequence: Synthetic peptide
  Seed: LTDVSPEPLQA (PRAME_HUMAN)
LVDVSPEPLQM

SEQ ID NO: 148651 - protein, 11 aa, Artificial Sequence
  Description of Artificial Sequence: Synthetic peptide
  Seed: LSNLTHVLYPV (PRAME_HUMAN)
LDNLTHVLYPV

SEQ ID NO: 148652 - protein, 9 aa, Artificial Sequence
  Description of Artificial Sequence: Synthetic peptide
  Seed: LQDLVFDEC (PRAME_HUMAN)
LSDLVFDEV

SEQ ID NO: 148653 - protein, 9 aa, Artificial Sequence
  Description of Artificial Sequence: Synthetic peptide
  Seed: TDDQLLALL (PRAME_HUMAN)
TEDQLLALM

SEQ ID NO: 148654 - protein, 8 aa, Artificial Sequence
  Description of Artificial Sequence: Synthetic peptide
  Seed: ITDDQLLA (PRAME_HUMAN)
IVDDQLLI

SEQ ID NO: 148655 - protein, 9 aa, Artificial Sequence
  Description of Artificial Sequence: Synthetic peptide
  Seed: VQLDSIEDL (PRAME_HUMAN)
VALDSIEDF

SEQ ID NO: 148656 - protein, 11 aa, Artificial Sequence
  Description of Artificial Sequence: Synthetic peptide
  Seed: RELFPPLFMAA (PRAME_HUMAN)
RMLFPPLFMAV

SEQ ID NO: 148657 - protein, 10 aa, Artificial Sequence
  Description of Artificial Sequence: Synthetic peptide
  Seed: QSLLQHLIGL (PRAME_HUMAN)
QILLQHLIGV

SEQ ID NO: 148658 - protein, 9 aa, Artificial Sequence
  Description of Artificial Sequence: Synthetic peptide
  Seed: ISISALQSL (PRAME_HUMAN)
IIISALQSL

SEQ ID NO: 148659 - protein, 9 aa, Artificial Sequence
  Description of Artificial Sequence: Synthetic peptide
  Seed: NLTHVLYPV (PRAME_HUMAN)
NTTHVLYPA

SEQ ID NO: 148660 - protein, 10 aa, Artificial Sequence
  Description of Artificial Sequence: Synthetic peptide
  Seed: RLWGSIQSRY (PRAME_HUMAN)
RMWGSIQSRI

SEQ ID NO: 148661 - protein, 10 aa, Artificial Sequence
  Description of Artificial Sequence: Synthetic peptide
  Seed: PTLAKFSPYL (PRAME_HUMAN)
PYLAKFSPYV

SEQ ID NO: 148662 - protein, 10 aa, Artificial Sequence
  Description of Artificial Sequence: Synthetic peptide
  Seed: SALQSLLQHL (PRAME_HUMAN)
SVLQSLLQHI

SEQ ID NO: 148663 - protein, 9 aa, Artificial Sequence
  Description of Artificial Sequence: Synthetic peptide
  Seed: KMILKMVQL (PRAME_HUMAN)
KMILKMVQI

SEQ ID NO: 148664 - protein, 10 aa, Artificial Sequence
  Description of Artificial Sequence: Synthetic peptide
  Seed: FPEPEAAQPM (PRAME_HUMAN)
FMEPEAAQPY

SEQ ID NO: 148665 - protein, 9 aa, Artificial Sequence
  Description of Artificial Sequence: Synthetic peptide
  Seed: KLKIFAMPM (PRAME_HUMAN)
KHKIFAMPK

SEQ ID NO: 148666 - protein, 10 aa, Artificial Sequence
  Description of Artificial Sequence: Synthetic peptide
  Seed: CTWKLPTLAK (PRAME_HUMAN)
CVWKLPTLAR

SEQ ID NO: 148667 - protein, 9 aa, Artificial Sequence
  Description of Artificial Sequence: Synthetic peptide
  Seed: RGRLDQLLR (PRAME_HUMAN)
RVRLDQLLS

SEQ ID NO: 148668 - protein, 9 aa, Artificial Sequence
  Description of Artificial Sequence: Synthetic peptide
  Seed: GQMINLRRL (PRAME_HUMAN)
GKMINLRRF

SEQ ID NO: 148669 - protein, 9 aa, Artificial Sequence
  Description of Artificial Sequence: Synthetic peptide
  Seed: RWKLQVLDL (PRAME_HUMAN)
RTKLQVLDL

SEQ ID NO: 148670 - protein, 9 aa, Artificial Sequence
  Description of Artificial Sequence: Synthetic peptide
  Seed: FYDPEPILC (PRAME_HUMAN)
FWDPEPILV

SEQ ID NO: 148671 - protein, 9 aa, Artificial Sequence
  Description of Artificial Sequence: Synthetic peptide
  Seed: MHLSQSPSV (PRAME_HUMAN)
MKLSQSPSY

SEQ ID NO: 148672 - protein, 9 aa, Artificial Sequence
  Description of Artificial Sequence: Synthetic peptide
  Seed: KMILKMVQL (PRAME_HUMAN)
KLILKMVQK

SEQ ID NO: 148673 - protein, 9 aa, Artificial Sequence
  Description of Artificial Sequence: Synthetic peptide
  Seed: LYVDSLFFL (PRAME_HUMAN)
LIVDSLFFM

SEQ ID NO: 148674 - protein, 9 aa, Artificial Sequence
  Description of Artificial Sequence: Synthetic peptide
  Seed: LSHIHASSY (PRAME_HUMAN)
LVHIHASSW

SEQ ID NO: 148675 - protein, 10 aa, Artificial Sequence
  Description of Artificial Sequence: Synthetic peptide
  Seed: SPYLGQMINL (PRAME_HUMAN)
SMYLGQMINW

SEQ ID NO: 148676 - protein, 11 aa, Artificial Sequence
  Description of Artificial Sequence: Synthetic peptide
  Seed: SLLKDEALAIA (PRAME_HUMAN)
SMLKDEALAII

SEQ ID NO: 148677 - protein, 9 aa, Artificial Sequence
  Description of Artificial Sequence: Synthetic peptide
  Seed: LTDVSPEPL (PRAME_HUMAN)
LYDVSPEPY

SEQ ID NO: 148678 - protein, 9 aa, Artificial Sequence
  Description of Artificial Sequence: Synthetic peptide
  Seed: LAYLHARLR (PRAME_HUMAN)
LMYLHARLR

SEQ ID NO: 148679 - protein, 9 aa, Artificial Sequence
  Description of Artificial Sequence: Synthetic peptide
  Seed: KLKIFAMPM (PRAME_HUMAN)
KSKIFAMPV

SEQ ID NO: 148680 - protein, 10 aa, Artificial Sequence
  Description of Artificial Sequence: Synthetic peptide
  Seed: SPSVSQLSVL (PRAME_HUMAN)
SRSVSQLSVY

SEQ ID NO: 148681 - protein, 10 aa, Artificial Sequence
  Description of Artificial Sequence: Synthetic peptide
  Seed: CELGRPSMVW (PRAME_HUMAN)
CTLGRPSMVW

SEQ ID NO: 148682 - protein, 9 aa, Artificial Sequence
  Description of Artificial Sequence: Synthetic peptide
  Seed: RRWKLQVLD (PRAME_HUMAN)
RRWKLQVLF

SEQ ID NO: 148683 - protein, 10 aa, Artificial Sequence
  Description of Artificial Sequence: Synthetic peptide
  Seed: RHVMNPLETL (PRAME_HUMAN)
RRVMNPLETY

SEQ ID NO: 148684 - protein, 9 aa, Artificial Sequence
  Description of Artificial Sequence: Synthetic peptide
  Seed: SIQSRYISM (PRAME_HUMAN)
SWQSRYISM

SEQ ID NO: 148685 - protein, 9 aa, Artificial Sequence
  Description of Artificial Sequence: Synthetic peptide
  Seed: ACDELFSYL (PRAME_HUMAN)
AWDELFSYI

SEQ ID NO: 148686 - protein, 10 aa, Artificial Sequence
  Description of Artificial Sequence: Synthetic peptide
  Seed: ETLSITNCRL (PRAME_HUMAN)
EQLSITNCRR

SEQ ID NO: 148687 - protein, 9 aa, Artificial Sequence
  Description of Artificial Sequence: Synthetic peptide
  Seed: LSNLTHVLY (PRAME_HUMAN)
LSNLTHVLF

SEQ ID NO: 148688 - protein, 9 aa, Artificial Sequence
  Description of Artificial Sequence: Synthetic peptide
  Seed: RTFYDPEPI (PRAME_HUMAN)
RTFYDPEPL

SEQ ID NO: 148689 - protein, 10 aa, Artificial Sequence
  Description of Artificial Sequence: Synthetic peptide
  Seed: LPTLAKFSPY (PRAME_HUMAN)
LMTLAKFSPW

SEQ ID NO: 148690 - protein, 9 aa, Artificial Sequence
  Description of Artificial Sequence: Synthetic peptide
  Seed: SQLSVLSLS (PRAME_HUMAN)
SMLSVLSLV

SEQ ID NO: 148691 - protein, 9 aa, Artificial Sequence
  Description of Artificial Sequence: Synthetic peptide
  Seed: LLLSHIHAS (PRAME_HUMAN)
LILSHIHAT

SEQ ID NO: 148692 - protein, 11 aa, Artificial Sequence
  Description of Artificial Sequence: Synthetic peptide
  Seed: IAQFTSQFLSL (PRAME_HUMAN)
IMQFTSQFLSM

SEQ ID NO: 148693 - protein, 11 aa, Artificial Sequence
  Description of Artificial Sequence: Synthetic peptide
  Seed: IAQFTSQFLSL (PRAME_HUMAN)
IFQFTSQFLSY

SEQ ID NO: 148694 - protein, 9 aa, Artificial Sequence
  Description of Artificial Sequence: Synthetic peptide
  Seed: HGTLHLERL (PRAME_HUMAN)
HATLHLERF

SEQ ID NO: 148695 - protein, 9 aa, Artificial Sequence
  Description of Artificial Sequence: Synthetic peptide
  Seed: YLHARLREL (PRAME_HUMAN)
YWHARLREL

SEQ ID NO: 148696 - protein, 11 aa, Artificial Sequence
  Description of Artificial Sequence: Synthetic peptide
  Seed: AAFDGRHSQTL (PRAME_HUMAN)
ATFDGRHSQTM

SEQ ID NO: 148697 - protein, 8 aa, Artificial Sequence
  Description of Artificial Sequence: Synthetic peptide
  Seed: FYDPEPIL (PRAME_HUMAN)
FIDPEPIV

SEQ ID NO: 148698 - protein, 11 aa, Artificial Sequence
  Description of Artificial Sequence: Synthetic peptide
  Seed: RRWKLQVLDLR (PRAME_HUMAN)
RRWKLQVLDLS

SEQ ID NO: 148699 - protein, 9 aa, Artificial Sequence
  Description of Artificial Sequence: Synthetic peptide
  Seed: KLKIFAMPM (PRAME_HUMAN)
KTKIFAMPC

SEQ ID NO: 148700 - protein, 9 aa, Artificial Sequence
  Description of Artificial Sequence: Synthetic peptide
  Seed: SQSPSVSQL (PRAME_HUMAN)
SMSPSVSQV

SEQ ID NO: 148701 - protein, 9 aa, Artificial Sequence
  Description of Artificial Sequence: Synthetic peptide
  Seed: YSFPEPEAA (PRAME_HUMAN)
YVFPEPEAM

SEQ ID NO: 148702 - protein, 10 aa, Artificial Sequence
  Description of Artificial Sequence: Synthetic peptide
  Seed: ALYVDSLFFL (PRAME_HUMAN)
ALYVDSLFFC

SEQ ID NO: 148703 - protein, 10 aa, Artificial Sequence
  Description of Artificial Sequence: Synthetic peptide
  Seed: VRPRRWKLQV (PRAME_HUMAN)
VQPRRWKLQL

SEQ ID NO: 148704 - protein, 10 aa, Artificial Sequence
  Description of Artificial Sequence: Synthetic peptide
  Seed: ARLRELLCEL (PRAME_HUMAN)
APLRELLCEV

SEQ ID NO: 148705 - protein, 9 aa, Artificial Sequence
  Description of Artificial Sequence: Synthetic peptide
  Seed: RTFYDPEPI (PRAME_HUMAN)
REFYDPEPY

SEQ ID NO: 148706 - protein, 10 aa, Artificial Sequence
  Description of Artificial Sequence: Synthetic peptide
  Seed: ARLRELLCEL (PRAME_HUMAN)
ADLRELLCEA

SEQ ID NO: 148707 - protein, 10 aa, Artificial Sequence
  Description of Artificial Sequence: Synthetic peptide
  Seed: KDEALAIAAL (PRAME_HUMAN)
KGEALAIAAA

SEQ ID NO: 148708 - protein, 10 aa, Artificial Sequence
  Description of Artificial Sequence: Synthetic peptide
  Seed: FIPVEVLVDL (PRAME_HUMAN)
FGPVEVLVDW

SEQ ID NO: 148709 - protein, 8 aa, Artificial Sequence
  Description of Artificial Sequence: Synthetic peptide
  Seed: FYDPEPIL (PRAME_HUMAN)
FMDPEPIL

SEQ ID NO: 148710 - protein, 10 aa, Artificial Sequence
  Description of Artificial Sequence: Synthetic peptide
  Seed: RRLWGSIQSR (PRAME_HUMAN)
RRLWGSIQSY

SEQ ID NO: 148711 - protein, 11 aa, Artificial Sequence
  Description of Artificial Sequence: Synthetic peptide
  Seed: SIQSRYISMSV (PRAME_HUMAN)
SIQSRYISMSK

SEQ ID NO: 148712 - protein, 10 aa, Artificial Sequence
  Description of Artificial Sequence: Synthetic peptide
  Seed: YLHARLRELL (PRAME_HUMAN)
YLHARLRELI

SEQ ID NO: 148713 - protein, 9 aa, Artificial Sequence
  Description of Artificial Sequence: Synthetic peptide
  Seed: QLLALLPSL (PRAME_HUMAN)
QLLALLPST

SEQ ID NO: 148714 - protein, 11 aa, Artificial Sequence
  Description of Artificial Sequence: Synthetic peptide
  Seed: ALYVDSLFFLR (PRAME_HUMAN)
AMYVDSLFFLN

SEQ ID NO: 148715 - protein, 10 aa, Artificial Sequence
  Description of Artificial Sequence: Synthetic peptide
  Seed: KIFAMPMQDI (PRAME_HUMAN)
KIFAMPMQDF

SEQ ID NO: 148716 - protein, 9 aa, Artificial Sequence
  Description of Artificial Sequence: Synthetic peptide
  Seed: LLLSHIHAS (PRAME_HUMAN)
LMLSHIHAM

SEQ ID NO: 148717 - protein, 9 aa, Artificial Sequence
  Description of Artificial Sequence: Synthetic peptide
  Seed: KLKIFAMPM (PRAME_HUMAN)
KMKIFAMPG

SEQ ID NO: 148718 - protein, 11 aa, Artificial Sequence
  Description of Artificial Sequence: Synthetic peptide
  Seed: SNLTHVLYPVP (PRAME_HUMAN)
SMLTHVLYPVM

SEQ ID NO: 148719 - protein, 9 aa, Artificial Sequence
  Description of Artificial Sequence: Synthetic peptide
  Seed: LPRELFPPL (PRAME_HUMAN)
LPRELFPPC

SEQ ID NO: 148720 - protein, 9 aa, Artificial Sequence
  Description of Artificial Sequence: Synthetic peptide
  Seed: ISPEKEEQY (PRAME_HUMAN)
IAPEKEEQY

SEQ ID NO: 148721 - protein, 9 aa, Artificial Sequence
  Description of Artificial Sequence: Synthetic peptide
  Seed: IAALELLPR (PRAME_HUMAN)
ITALELLPR

SEQ ID NO: 148722 - protein, 9 aa, Artificial Sequence
  Description of Artificial Sequence: Synthetic peptide
  Seed: YPVPLESYE (PRAME_HUMAN)
YCVPLESYY

SEQ ID NO: 148723 - protein, 11 aa, Artificial Sequence
  Description of Artificial Sequence: Synthetic peptide
  Seed: RLVELAGQSLL (PRAME_HUMAN)
RMVELAGQSLV

SEQ ID NO: 148724 - protein, 9 aa, Artificial Sequence
  Description of Artificial Sequence: Synthetic peptide
  Seed: ELFSYLIEK (PRAME_HUMAN)
EIFSYLIEK

SEQ ID NO: 148725 - protein, 9 aa, Artificial Sequence
  Description of Artificial Sequence: Synthetic peptide
  Seed: LSEGDVMHL (PRAME_HUMAN)
LAEGDVMHL

SEQ ID NO: 148726 - protein, 9 aa, Artificial Sequence
  Description of Artificial Sequence: Synthetic peptide
  Seed: SLLQHLIGL (PRAME_HUMAN)
SMLQHLIGT

SEQ ID NO: 148727 - protein, 9 aa, Artificial Sequence
  Description of Artificial Sequence: Synthetic peptide
  Seed: ERLAYLHAR (PRAME_HUMAN)
EVLAYLHAR

SEQ ID NO: 148728 - protein, 9 aa, Artificial Sequence
  Description of Artificial Sequence: Synthetic peptide
  Seed: LELLPRELF (PRAME_HUMAN)
LELLPRELY

SEQ ID NO: 148729 - protein, 9 aa, Artificial Sequence
  Description of Artificial Sequence: Synthetic peptide
  Seed: RLAYLHARL (PRAME_HUMAN)
RQAYLHARW

SEQ ID NO: 148730 - protein, 10 aa, Artificial Sequence
  Description of Artificial Sequence: Synthetic peptide
  Seed: RHVMNPLETL (PRAME_HUMAN)
RRVMNPLETW

SEQ ID NO: 148731 - protein, 10 aa, Artificial Sequence
  Description of Artificial Sequence: Synthetic peptide
  Seed: ITDDQLLALL (PRAME_HUMAN)
IMDDQLLALY

SEQ ID NO: 148732 - protein, 9 aa, Artificial Sequence
  Description of Artificial Sequence: Synthetic peptide
  Seed: VDLFLKEGA (PRAME_HUMAN)
VELFLKEGV

SEQ ID NO: 148733 - protein, 9 aa, Artificial Sequence
  Description of Artificial Sequence: Synthetic peptide
  Seed: KMILKMVQL (PRAME_HUMAN)
KAILKMVQM

SEQ ID NO: 148734 - protein, 11 aa, Artificial Sequence
  Description of Artificial Sequence: Synthetic peptide
  Seed: ALYVDSLFFLR (PRAME_HUMAN)
ALYVDSLFFLE

SEQ ID NO: 148735 - protein, 9 aa, Artificial Sequence
  Description of Artificial Sequence: Synthetic peptide
  Seed: AAFDGRHSQ (PRAME_HUMAN)
ALFDGRHSY

SEQ ID NO: 148736 - protein, 9 aa, Artificial Sequence
  Description of Artificial Sequence: Synthetic peptide
  Seed: KVDGLSTEA (PRAME_HUMAN)
KLDGLSTEF

SEQ ID NO: 148737 - protein, 9 aa, Artificial Sequence
  Description of Artificial Sequence: Synthetic peptide
  Seed: MVQAWPFTC (PRAME_HUMAN)
MTQAWPFTA

SEQ ID NO: 148738 - protein, 10 aa, Artificial Sequence
  Description of Artificial Sequence: Synthetic peptide
  Seed: SISISALQSL (PRAME_HUMAN)
SDSISALQSF

SEQ ID NO: 148739 - protein, 10 aa, Artificial Sequence
  Description of Artificial Sequence: Synthetic peptide
  Seed: MVQAWPFTCL (PRAME_HUMAN)
MTQAWPFTCY

SEQ ID NO: 148740 - protein, 11 aa, Artificial Sequence
  Description of Artificial Sequence: Synthetic peptide
  Seed: LQALYVDSLFF (PRAME_HUMAN)
LQALYVDSLFY

SEQ ID NO: 148741 - protein, 9 aa, Artificial Sequence
  Description of Artificial Sequence: Synthetic peptide
  Seed: YVDSLFFLR (PRAME_HUMAN)
YTDSLFFLR

SEQ ID NO: 148742 - protein, 11 aa, Artificial Sequence
  Description of Artificial Sequence: Synthetic peptide
  Seed: AVLDGLDVLLA (PRAME_HUMAN)
ALLDGLDVLLI

SEQ ID NO: 148743 - protein, 9 aa, Artificial Sequence
  Description of Artificial Sequence: Synthetic peptide
  Seed: SQLSVLSLS (PRAME_HUMAN)
SALSVLSLV

SEQ ID NO: 148744 - protein, 9 aa, Artificial Sequence
  Description of Artificial Sequence: Synthetic peptide
  Seed: LMKGQHLHL (PRAME_HUMAN)
LSKGQHLHF

SEQ ID NO: 148745 - protein, 9 aa, Artificial Sequence
  Description of Artificial Sequence: Synthetic peptide
  Seed: LSTEAEQPF (PRAME_HUMAN)
LPTEAEQPY

SEQ ID NO: 148746 - protein, 9 aa, Artificial Sequence
  Description of Artificial Sequence: Synthetic peptide
  Seed: LSEGDVMHL (PRAME_HUMAN)
LMEGDVMHL

SEQ ID NO: 148747 - protein, 9 aa, Artificial Sequence
  Description of Artificial Sequence: Synthetic peptide
  Seed: LLRHVMNPL (PRAME_HUMAN)
LLRHVMNPV

SEQ ID NO: 148748 - protein, 8 aa, Artificial Sequence
  Description of Artificial Sequence: Synthetic peptide
  Seed: LTHVLYPV (PRAME_HUMAN)
LLHVLYPV

SEQ ID NO: 148749 - protein, 10 aa, Artificial Sequence
  Description of Artificial Sequence: Synthetic peptide
  Seed: ARLRELLCEL (PRAME_HUMAN)
AWLRELLCEL

SEQ ID NO: 148750 - protein, 9 aa, Artificial Sequence
  Description of Artificial Sequence: Synthetic peptide
  Seed: TSPRRLVEL (PRAME_HUMAN)
TGPRRLVEL

SEQ ID NO: 148751 - protein, 9 aa, Artificial Sequence
  Description of Artificial Sequence: Synthetic peptide
  Seed: ITDDQLLAL (PRAME_HUMAN)
IADDQLLAC

SEQ ID NO: 148752 - protein, 10 aa, Artificial Sequence
  Description of Artificial Sequence: Synthetic peptide
  Seed: ELFPPLFMAA (PRAME_HUMAN)
ETFPPLFMAM

SEQ ID NO: 148753 - protein, 9 aa, Artificial Sequence
  Description of Artificial Sequence: Synthetic peptide
  Seed: YSFPEPEAA (PRAME_HUMAN)
YIFPEPEAT

SEQ ID NO: 148754 - protein, 9 aa, Artificial Sequence
  Description of Artificial Sequence: Synthetic peptide
  Seed: SHCSQLTTL (PRAME_HUMAN)
SHCSQLTTF

SEQ ID NO: 148755 - protein, 9 aa, Artificial Sequence
  Description of Artificial Sequence: Synthetic peptide
  Seed: RGRLDQLLR (PRAME_HUMAN)
RVRLDQLLG

SEQ ID NO: 148756 - protein, 9 aa, Artificial Sequence
  Description of Artificial Sequence: Synthetic peptide
  Seed: KLKIFAMPM (PRAME_HUMAN)
KYKIFAMPI

SEQ ID NO: 148757 - protein, 9 aa, Artificial Sequence
  Description of Artificial Sequence: Synthetic peptide
  Seed: ESYEDIHGT (PRAME_HUMAN)
EIYEDIHGM

SEQ ID NO: 148758 - protein, 9 aa, Artificial Sequence
  Description of Artificial Sequence: Synthetic peptide
  Seed: SATLQDLVF (PRAME_HUMAN)
SVTLQDLVW

SEQ ID NO: 148759 - protein, 9 aa, Artificial Sequence
  Description of Artificial Sequence: Synthetic peptide
  Seed: TSPRRLVEL (PRAME_HUMAN)
TTPRRLVEI

SEQ ID NO: 148760 - protein, 9 aa, Artificial Sequence
  Description of Artificial Sequence: Synthetic peptide
  Seed: VSPEPLQAL (PRAME_HUMAN)
VVPEPLQAM

SEQ ID NO: 148761 - protein, 9 aa, Artificial Sequence
  Description of Artificial Sequence: Synthetic peptide
  Seed: ALAIAALEL (PRAME_HUMAN)
AAAIAALEM

SEQ ID NO: 148762 - protein, 9 aa, Artificial Sequence
  Description of Artificial Sequence: Synthetic peptide
  Seed: LSHIHASSY (PRAME_HUMAN)
LIHIHASSF

SEQ ID NO: 148763 - protein, 10 aa, Artificial Sequence
  Description of Artificial Sequence: Synthetic peptide
  Seed: RLWGSIQSRY (PRAME_HUMAN)
RLWGSIQSRK

SEQ ID NO: 148764 - protein, 9 aa, Artificial Sequence
  Description of Artificial Sequence: Synthetic peptide
  Seed: ALYVDSLFF (PRAME_HUMAN)
AMYVDSLFW

SEQ ID NO: 148765 - protein, 9 aa, Artificial Sequence
  Description of Artificial Sequence: Synthetic peptide
  Seed: DGRHSQTLK (PRAME_HUMAN)
DARHSQTLK

SEQ ID NO: 148766 - protein, 10 aa, Artificial Sequence
  Description of Artificial Sequence: Synthetic peptide
  Seed: SALQSLLQHL (PRAME_HUMAN)
SMLQSLLQHM

SEQ ID NO: 148767 - protein, 10 aa, Artificial Sequence
  Description of Artificial Sequence: Synthetic peptide
  Seed: SISISALQSL (PRAME_HUMAN)
STSISALQSF

SEQ ID NO: 148768 - protein, 8 aa, Artificial Sequence
  Description of Artificial Sequence: Synthetic peptide
  Seed: YEDIHGTL (PRAME_HUMAN)
YLDIHGTL

SEQ ID NO: 148769 - protein, 9 aa, Artificial Sequence
  Description of Artificial Sequence: Synthetic peptide
  Seed: YVDSLFFLR (PRAME_HUMAN)
YVDSLFFLY

SEQ ID NO: 148770 - protein, 9 aa, Artificial Sequence
  Description of Artificial Sequence: Synthetic peptide
  Seed: SLLQHLIGL (PRAME_HUMAN)
STLQHLIGV

SEQ ID NO: 148771 - protein, 10 aa, Artificial Sequence
  Description of Artificial Sequence: Synthetic peptide
  Seed: VLYPVPLESY (PRAME_HUMAN)
VYYPVPLESM

SEQ ID NO: 148772 - protein, 9 aa, Artificial Sequence
  Description of Artificial Sequence: Synthetic peptide
  Seed: LYVDSLFFL (PRAME_HUMAN)
LFVDSLFFF

SEQ ID NO: 148773 - protein, 11 aa, Artificial Sequence
  Description of Artificial Sequence: Synthetic peptide
  Seed: SIEDLEVTCTW (PRAME_HUMAN)
SPEDLEVTCTW

SEQ ID NO: 148774 - protein, 9 aa, Artificial Sequence
  Description of Artificial Sequence: Synthetic peptide
  Seed: RTFYDPEPI (PRAME_HUMAN)
RVFYDPEPK

SEQ ID NO: 148775 - protein, 9 aa, Artificial Sequence
  Description of Artificial Sequence: Synthetic peptide
  Seed: VSPEPLQAL (PRAME_HUMAN)
VGPEPLQAY

SEQ ID NO: 148776 - protein, 9 aa, Artificial Sequence
  Description of Artificial Sequence: Synthetic peptide
  Seed: HGTLHLERL (PRAME_HUMAN)
HRTLHLERF

SEQ ID NO: 148777 - protein, 9 aa, Artificial Sequence
  Description of Artificial Sequence: Synthetic peptide
  Seed: LSHIHASSY (PRAME_HUMAN)
LVHIHASSK

SEQ ID NO: 148778 - protein, 9 aa, Artificial Sequence
  Description of Artificial Sequence: Synthetic peptide
  Seed: LTDVSPEPL (PRAME_HUMAN)
LFDVSPEPV

SEQ ID NO: 148779 - protein, 9 aa, Artificial Sequence
  Description of Artificial Sequence: Synthetic peptide
  Seed: RLWGSIQSR (PRAME_HUMAN)
RVWGSIQSR

SEQ ID NO: 148780 - protein, 9 aa, Artificial Sequence
  Description of Artificial Sequence: Synthetic peptide
  Seed: KAMVQAWPF (PRAME_HUMAN)
KLMVQAWPW

SEQ ID NO: 148781 - protein, 9 aa, Artificial Sequence
  Description of Artificial Sequence: Synthetic peptide
  Seed: RLWGSIQSR (PRAME_HUMAN)
RQWGSIQSR

SEQ ID NO: 148782 - protein, 11 aa, Artificial Sequence
  Description of Artificial Sequence: Synthetic peptide
  Seed: SHCSQLTTLSF (PRAME_HUMAN)
SKCSQLTTLSF

SEQ ID NO: 148783 - protein, 9 aa, Artificial Sequence
  Description of Artificial Sequence: Synthetic peptide
  Seed: RLAYLHARL (PRAME_HUMAN)
RWAYLHARY

SEQ ID NO: 148784 - protein, 10 aa, Artificial Sequence
  Description of Artificial Sequence: Synthetic peptide
  Seed: RLSEGDVMHL (PRAME_HUMAN)
RMSEGDVMHW

SEQ ID NO: 148785 - protein, 11 aa, Artificial Sequence
  Description of Artificial Sequence: Synthetic peptide
  Seed: RTFYDPEPILC (PRAME_HUMAN)
RTFYDPEPILY

SEQ ID NO: 148786 - protein, 9 aa, Artificial Sequence
  Description of Artificial Sequence: Synthetic peptide
  Seed: SQLSVLSLS (PRAME_HUMAN)
SILSVLSLA

SEQ ID NO: 148787 - protein, 10 aa, Artificial Sequence
  Description of Artificial Sequence: Synthetic peptide
  Seed: LETLSITNCR (PRAME_HUMAN)
LTTLSITNCR

SEQ ID NO: 148788 - protein, 10 aa, Artificial Sequence
  Description of Artificial Sequence: Synthetic peptide
  Seed: KNVLRLCCKK (PRAME_HUMAN)
KLVLRLCCKR

SEQ ID NO: 148789 - protein, 9 aa, Artificial Sequence
  Description of Artificial Sequence: Synthetic peptide
  Seed: ACDELFSYL (PRAME_HUMAN)
AFDELFSYL

SEQ ID NO: 148790 - protein, 10 aa, Artificial Sequence
  Description of Artificial Sequence: Synthetic peptide
  Seed: QALYVDSLFF (PRAME_HUMAN)
QSLYVDSLFW

SEQ ID NO: 148791 - protein, 11 aa, Artificial Sequence
  Description of Artificial Sequence: Synthetic peptide
  Seed: AAFDGRHSQTL (PRAME_HUMAN)
AGFDGRHSQTW

SEQ ID NO: 148792 - protein, 9 aa, Artificial Sequence
  Description of Artificial Sequence: Synthetic peptide
  Seed: KLKIFAMPM (PRAME_HUMAN)
KLKIFAMPW

SEQ ID NO: 148793 - protein, 10 aa, Artificial Sequence
  Description of Artificial Sequence: Synthetic peptide
  Seed: YEDIHGTLHL (PRAME_HUMAN)
YIDIHGTLHL

SEQ ID NO: 148794 - protein, 9 aa, Artificial Sequence
  Description of Artificial Sequence: Synthetic peptide
  Seed: YSFPEPEAA (PRAME_HUMAN)
YAFPEPEAK

SEQ ID NO: 148795 - protein, 9 aa, Artificial Sequence
  Description of Artificial Sequence: Synthetic peptide
  Seed: ITDDQLLAL (PRAME_HUMAN)
IVDDQLLAA

SEQ ID NO: 148796 - protein, 9 aa, Artificial Sequence
  Description of Artificial Sequence: Synthetic peptide
  Seed: SVWTSPRRL (PRAME_HUMAN)
SQWTSPRRV

SEQ ID NO: 148797 - protein, 10 aa, Artificial Sequence
  Description of Artificial Sequence: Synthetic peptide
  Seed: MSVWTSPRRL (PRAME_HUMAN)
MTVWTSPRRM

SEQ ID NO: 148798 - protein, 10 aa, Artificial Sequence
  Description of Artificial Sequence: Synthetic peptide
  Seed: IQSRYISMSV (PRAME_HUMAN)
IQSRYISMSK

SEQ ID NO: 148799 - protein, 10 aa, Artificial Sequence
  Description of Artificial Sequence: Synthetic peptide
  Seed: VLMKGQHLHL (PRAME_HUMAN)
VMMKGQHLHI

SEQ ID NO: 148800 - protein, 9 aa, Artificial Sequence
  Description of Artificial Sequence: Synthetic peptide
  Seed: AEQPFIPVE (PRAME_HUMAN)
AEQPFIPVM

SEQ ID NO: 148801 - protein, 9 aa, Artificial Sequence
  Description of Artificial Sequence: Synthetic peptide
  Seed: KVDGLSTEA (PRAME_HUMAN)
KVDGLSTEM

SEQ ID NO: 148802 - protein, 11 aa, Artificial Sequence
  Description of Artificial Sequence: Synthetic peptide
  Seed: LTDVSPEPLQA (PRAME_HUMAN)
LGDVSPEPLQL

SEQ ID NO: 148803 - protein, 9 aa, Artificial Sequence
  Description of Artificial Sequence: Synthetic peptide
  Seed: MINLRRLLL (PRAME_HUMAN)
MINLRRLLY

SEQ ID NO: 148804 - protein, 9 aa, Artificial Sequence
  Description of Artificial Sequence: Synthetic peptide
  Seed: RLSEGDVMH (PRAME_HUMAN)
RLSEGDVMF

SEQ ID NO: 148805 - protein, 9 aa, Artificial Sequence
  Description of Artificial Sequence: Synthetic peptide
  Seed: FMAAFDGRH (PRAME_HUMAN)
FAAAFDGRF

SEQ ID NO: 148806 - protein, 9 aa, Artificial Sequence
  Description of Artificial Sequence: Synthetic peptide
  Seed: RGRLDQLLR (PRAME_HUMAN)
RVRLDQLLA

SEQ ID NO: 148807 - protein, 9 aa, Artificial Sequence
  Description of Artificial Sequence: Synthetic peptide
  Seed: KVDGLSTEA (PRAME_HUMAN)
KQDGLSTEM

SEQ ID NO: 148808 - protein, 9 aa, Artificial Sequence
  Description of Artificial Sequence: Synthetic peptide
  Seed: VSQLSVLSL (PRAME_HUMAN)
VYQLSVLSY

SEQ ID NO: 148809 - protein, 9 aa, Artificial Sequence
  Description of Artificial Sequence: Synthetic peptide
  Seed: EQPFIPVEV (PRAME_HUMAN)
EMPFIPVEV

SEQ ID NO: 148810 - protein, 9 aa, Artificial Sequence
  Description of Artificial Sequence: Synthetic peptide
  Seed: HVMNPLETL (PRAME_HUMAN)
HQMNPLETA

SEQ ID NO: 148811 - protein, 10 aa, Artificial Sequence
  Description of Artificial Sequence: Synthetic peptide
  Seed: LSQSPSVSQL (PRAME_HUMAN)
LKQSPSVSQY

SEQ ID NO: 148812 - protein, 10 aa, Artificial Sequence
  Description of Artificial Sequence: Synthetic peptide
  Seed: DELFSYLIEK (PRAME_HUMAN)
DLLFSYLIER

SEQ ID NO: 148813 - protein, 9 aa, Artificial Sequence
  Description of Artificial Sequence: Synthetic peptide
  Seed: HVMNPLETL (PRAME_HUMAN)
HFMNPLETF

SEQ ID NO: 148814 - protein, 10 aa, Artificial Sequence
  Description of Artificial Sequence: Synthetic peptide
  Seed: VLYPVPLESY (PRAME_HUMAN)
VIYPVPLESW

SEQ ID NO: 148815 - protein, 10 aa, Artificial Sequence
  Description of Artificial Sequence: Synthetic peptide
  Seed: AVLDGLDVLL (PRAME_HUMAN)
ASLDGLDVLW

SEQ ID NO: 148816 - protein, 10 aa, Artificial Sequence
  Description of Artificial Sequence: Synthetic peptide
  Seed: ETFKAVLDGL (PRAME_HUMAN)
EAFKAVLDGI

SEQ ID NO: 148817 - protein, 9 aa, Artificial Sequence
  Description of Artificial Sequence: Synthetic peptide
  Seed: LSLQCLQAL (PRAME_HUMAN)
LTLQCLQAW

SEQ ID NO: 148818 - protein, 10 aa, Artificial Sequence
  Description of Artificial Sequence: Synthetic peptide
  Seed: LLPRELFPPL (PRAME_HUMAN)
LRPRELFPPL

SEQ ID NO: 148819 - protein, 10 aa, Artificial Sequence
  Description of Artificial Sequence: Synthetic peptide
  Seed: EDLEVTCTWK (PRAME_HUMAN)
EALEVTCTWR

SEQ ID NO: 148820 - protein, 9 aa, Artificial Sequence
  Description of Artificial Sequence: Synthetic peptide
  Seed: AWPFTCLPL (PRAME_HUMAN)
AYPFTCLPV

SEQ ID NO: 148821 - protein, 9 aa, Artificial Sequence
  Description of Artificial Sequence: Synthetic peptide
  Seed: LLLSHIHAS (PRAME_HUMAN)
LVLSHIHAA

SEQ ID NO: 148822 - protein, 9 aa, Artificial Sequence
  Description of Artificial Sequence: Synthetic peptide
  Seed: RLWGSIQSR (PRAME_HUMAN)
RVWGSIQSL

SEQ ID NO: 148823 - protein, 10 aa, Artificial Sequence
  Description of Artificial Sequence: Synthetic peptide
  Seed: IGLSNLTHVL (PRAME_HUMAN)
IKLSNLTHVL

SEQ ID NO: 148824 - protein, 10 aa, Artificial Sequence
  Description of Artificial Sequence: Synthetic peptide
  Seed: RELFPPLFMA (PRAME_HUMAN)
RHLFPPLFMA

SEQ ID NO: 148825 - protein, 10 aa, Artificial Sequence
  Description of Artificial Sequence: Synthetic peptide
  Seed: RRLWGSIQSR (PRAME_HUMAN)
RWLWGSIQSR

SEQ ID NO: 148826 - protein, 9 aa, Artificial Sequence
  Description of Artificial Sequence: Synthetic peptide
  Seed: QLLALLPSL (PRAME_HUMAN)
QMLALLPSA

SEQ ID NO: 148827 - protein, 9 aa, Artificial Sequence
  Description of Artificial Sequence: Synthetic peptide
  Seed: SQLSVLSLS (PRAME_HUMAN)
SVLSVLSLI

SEQ ID NO: 148828 - protein, 10 aa, Artificial Sequence
  Description of Artificial Sequence: Synthetic peptide
  Seed: TSQFLSLQCL (PRAME_HUMAN)
TVQFLSLQCY

SEQ ID NO: 148829 - protein, 10 aa, Artificial Sequence
  Description of Artificial Sequence: Synthetic peptide
  Seed: RLWGSIQSRY (PRAME_HUMAN)
RVWGSIQSRK

SEQ ID NO: 148830 - protein, 9 aa, Artificial Sequence
  Description of Artificial Sequence: Synthetic peptide
  Seed: KFSPYLGQM (PRAME_HUMAN)
KVSPYLGQY

SEQ ID NO: 148831 - protein, 10 aa, Artificial Sequence
  Description of Artificial Sequence: Synthetic peptide
  Seed: QLLALLPSLS (PRAME_HUMAN)
QLLALLPSLV

SEQ ID NO: 148832 - protein, 11 aa, Artificial Sequence
  Description of Artificial Sequence: Synthetic peptide
  Seed: RASATLQDLVF (PRAME_HUMAN)
RTSATLQDLVF

SEQ ID NO: 148833 - protein, 10 aa, Artificial Sequence
  Description of Artificial Sequence: Synthetic peptide
  Seed: LPTLAKFSPY (PRAME_HUMAN)
LKTLAKFSPM

SEQ ID NO: 148834 - protein, 9 aa, Artificial Sequence
  Description of Artificial Sequence: Synthetic peptide
  Seed: VSQLSVLSL (PRAME_HUMAN)
VEQLSVLSM

SEQ ID NO: 148835 - protein, 10 aa, Artificial Sequence
  Description of Artificial Sequence: Synthetic peptide
  Seed: IQSRYISMSV (PRAME_HUMAN)
IRSRYISMSL

SEQ ID NO: 148836 - protein, 10 aa, Artificial Sequence
  Description of Artificial Sequence: Synthetic peptide
  Seed: TSQFLSLQCL (PRAME_HUMAN)
TEQFLSLQCY

SEQ ID NO: 148837 - protein, 10 aa, Artificial Sequence
  Description of Artificial Sequence: Synthetic peptide
  Seed: MINLRRLLLS (PRAME_HUMAN)
MMNLRRLLLF

SEQ ID NO: 148838 - protein, 9 aa, Artificial Sequence
  Description of Artificial Sequence: Synthetic peptide
  Seed: MVQAWPFTC (PRAME_HUMAN)
MTQAWPFTI

SEQ ID NO: 148839 - protein, 9 aa, Artificial Sequence
  Description of Artificial Sequence: Synthetic peptide
  Seed: ISISALQSL (PRAME_HUMAN)
IAISALQSI

SEQ ID NO: 148840 - protein, 9 aa, Artificial Sequence
  Description of Artificial Sequence: Synthetic peptide
  Seed: LELLPRELF (PRAME_HUMAN)
LQLLPRELF

SEQ ID NO: 148841 - protein, 9 aa, Artificial Sequence
  Description of Artificial Sequence: Synthetic peptide
  Seed: LFMAAFDGR (PRAME_HUMAN)
LMMAAFDGR

SEQ ID NO: 148842 - protein, 10 aa, Artificial Sequence
  Description of Artificial Sequence: Synthetic peptide
  Seed: RGRLDQLLRH (PRAME_HUMAN)
RCRLDQLLRL

SEQ ID NO: 148843 - protein, 10 aa, Artificial Sequence
  Description of Artificial Sequence: Synthetic peptide
  Seed: SLSGVMLTDV (PRAME_HUMAN)
SVSGVMLTDV

SEQ ID NO: 148844 - protein, 11 aa, Artificial Sequence
  Description of Artificial Sequence: Synthetic peptide
  Seed: RASATLQDLVF (PRAME_HUMAN)
RCSATLQDLVW

SEQ ID NO: 148845 - protein, 10 aa, Artificial Sequence
  Description of Artificial Sequence: Synthetic peptide
  Seed: RGRLDQLLRH (PRAME_HUMAN)
RLRLDQLLRM

SEQ ID NO: 148846 - protein, 9 aa, Artificial Sequence
  Description of Artificial Sequence: Synthetic peptide
  Seed: ACDELFSYL (PRAME_HUMAN)
ALDELFSYA

SEQ ID NO: 148847 - protein, 10 aa, Artificial Sequence
  Description of Artificial Sequence: Synthetic peptide
  Seed: YGNSISISAL (PRAME_HUMAN)
YANSISISAH

SEQ ID NO: 148848 - protein, 9 aa, Artificial Sequence
  Description of Artificial Sequence: Synthetic peptide
  Seed: KAMVQAWPF (PRAME_HUMAN)
KWMVQAWPW

SEQ ID NO: 148849 - protein, 9 aa, Artificial Sequence
  Description of Artificial Sequence: Synthetic peptide
  Seed: ALELLPREL (PRAME_HUMAN)
AWELLPREL

SEQ ID NO: 148850 - protein, 10 aa, Artificial Sequence
  Description of Artificial Sequence: Synthetic peptide
  Seed: ITDDQLLALL (PRAME_HUMAN)
IMDDQLLALM

SEQ ID NO: 148851 - protein, 9 aa, Artificial Sequence
  Description of Artificial Sequence: Synthetic peptide
  Seed: TEAEQPFIP (PRAME_HUMAN)
TEAEQPFIM

SEQ ID NO: 148852 - protein, 9 aa, Artificial Sequence
  Description of Artificial Sequence: Synthetic peptide
  Seed: ALLERASAT (PRAME_HUMAN)
AALERASAV

SEQ ID NO: 148853 - protein, 10 aa, Artificial Sequence
  Description of Artificial Sequence: Synthetic peptide
  Seed: AAFDGRHSQT (PRAME_HUMAN)
AIFDGRHSQF

SEQ ID NO: 148854 - protein, 9 aa, Artificial Sequence
  Description of Artificial Sequence: Synthetic peptide
  Seed: LGRPSMVWL (PRAME_HUMAN)
LVRPSMVWV

SEQ ID NO: 148855 - protein, 10 aa, Artificial Sequence
  Description of Artificial Sequence: Synthetic peptide
  Seed: LSLQCLQALY (PRAME_HUMAN)
LQLQCLQALY

SEQ ID NO: 148856 - protein, 9 aa, Artificial Sequence
  Description of Artificial Sequence: Synthetic peptide
  Seed: SFYGNSISI (PRAME_HUMAN)
SKYGNSISI

SEQ ID NO: 148857 - protein, 8 aa, Artificial Sequence
  Description of Artificial Sequence: Synthetic peptide
  Seed: LSNLTHVL (PRAME_HUMAN)
LANLTHVL

SEQ ID NO: 148858 - protein, 9 aa, Artificial Sequence
  Description of Artificial Sequence: Synthetic peptide
  Seed: SRYISMSVW (PRAME_HUMAN)
SNYISMSVM

SEQ ID NO: 148859 - protein, 10 aa, Artificial Sequence
  Description of Artificial Sequence: Synthetic peptide
  Seed: ITDDQLLALL (PRAME_HUMAN)
ILDDQLLALL

SEQ ID NO: 148860 - protein, 10 aa, Artificial Sequence
  Description of Artificial Sequence: Synthetic peptide
  Seed: ISISALQSLL (PRAME_HUMAN)
ITISALQSLV

SEQ ID NO: 148861 - protein, 10 aa, Artificial Sequence
  Description of Artificial Sequence: Synthetic peptide
  Seed: RLSEGDVMHL (PRAME_HUMAN)
RASEGDVMHY

SEQ ID NO: 148862 - protein, 9 aa, Artificial Sequence
  Description of Artificial Sequence: Synthetic peptide
  Seed: QSRYISMSV (PRAME_HUMAN)
QIRYISMSA

SEQ ID NO: 148863 - protein, 9 aa, Artificial Sequence
  Description of Artificial Sequence: Synthetic peptide
  Seed: MINLRRLLL (PRAME_HUMAN)
MANLRRLLM

SEQ ID NO: 148864 - protein, 9 aa, Artificial Sequence
  Description of Artificial Sequence: Synthetic peptide
  Seed: LVELAGQSL (PRAME_HUMAN)
LTELAGQSL

SEQ ID NO: 148865 - protein, 11 aa, Artificial Sequence
  Description of Artificial Sequence: Synthetic peptide
  Seed: LSNLTHVLYPV (PRAME_HUMAN)
LRNLTHVLYPV

SEQ ID NO: 148866 - protein, 10 aa, Artificial Sequence
  Description of Artificial Sequence: Synthetic peptide
  Seed: LPTLAKFSPY (PRAME_HUMAN)
LWTLAKFSPY

SEQ ID NO: 148867 - protein, 10 aa, Artificial Sequence
  Description of Artificial Sequence: Synthetic peptide
  Seed: MNPLETLSIT (PRAME_HUMAN)
MDPLETLSIA

SEQ ID NO: 148868 - protein, 9 aa, Artificial Sequence
  Description of Artificial Sequence: Synthetic peptide
  Seed: YISMSVWTS (PRAME_HUMAN)
YASMSVWTL

SEQ ID NO: 148869 - protein, 10 aa, Artificial Sequence
  Description of Artificial Sequence: Synthetic peptide
  Seed: FTCLPLGVLM (PRAME_HUMAN)
FACLPLGVLF

SEQ ID NO: 148870 - protein, 10 aa, Artificial Sequence
  Description of Artificial Sequence: Synthetic peptide
  Seed: RPRRWKLQVL (PRAME_HUMAN)
RRRRWKLQVK

SEQ ID NO: 148871 - protein, 9 aa, Artificial Sequence
  Description of Artificial Sequence: Synthetic peptide
  Seed: CSQLTTLSF (PRAME_HUMAN)
CIQLTTLSF

SEQ ID NO: 148872 - protein, 10 aa, Artificial Sequence
  Description of Artificial Sequence: Synthetic peptide
  Seed: FYDPEPILCP (PRAME_HUMAN)
FFDPEPILCL

SEQ ID NO: 148873 - protein, 9 aa, Artificial Sequence
  Description of Artificial Sequence: Synthetic peptide
  Seed: SFYGNSISI (PRAME_HUMAN)
SVYGNSISM

SEQ ID NO: 148874 - protein, 9 aa, Artificial Sequence
  Description of Artificial Sequence: Synthetic peptide
  Seed: FLRGRLDQL (PRAME_HUMAN)
FLRGRLDQM

SEQ ID NO: 148875 - protein, 11 aa, Artificial Sequence
  Description of Artificial Sequence: Synthetic peptide
  Seed: EQYIAQFTSQF (PRAME_HUMAN)
ESYIAQFTSQF

SEQ ID NO: 148876 - protein, 9 aa, Artificial Sequence
  Description of Artificial Sequence: Synthetic peptide
  Seed: RLRELLCEL (PRAME_HUMAN)
RSRELLCEK

SEQ ID NO: 148877 - protein, 10 aa, Artificial Sequence
  Description of Artificial Sequence: Synthetic peptide
  Seed: SISISALQSL (PRAME_HUMAN)
SKSISALQSY

SEQ ID NO: 148878 - protein, 11 aa, Artificial Sequence
  Description of Artificial Sequence: Synthetic peptide
  Seed: ALYVDSLFFLR (PRAME_HUMAN)
AQYVDSLFFLV

SEQ ID NO: 148879 - protein, 9 aa, Artificial Sequence
  Description of Artificial Sequence: Synthetic peptide
  Seed: YGNSISISA (PRAME_HUMAN)
YANSISISM

SEQ ID NO: 148880 - protein, 9 aa, Artificial Sequence
  Description of Artificial Sequence: Synthetic peptide
  Seed: QLLALLPSL (PRAME_HUMAN)
QQLALLPSI

SEQ ID NO: 148881 - protein, 10 aa, Artificial Sequence
  Description of Artificial Sequence: Synthetic peptide
  Seed: IQSRYISMSV (PRAME_HUMAN)
ITSRYISMSY

SEQ ID NO: 148882 - protein, 10 aa, Artificial Sequence
  Description of Artificial Sequence: Synthetic peptide
  Seed: FIPVEVLVDL (PRAME_HUMAN)
FHPVEVLVDY

SEQ ID NO: 148883 - protein, 9 aa, Artificial Sequence
  Description of Artificial Sequence: Synthetic peptide
  Seed: LSHIHASSY (PRAME_HUMAN)
LNHIHASSF

SEQ ID NO: 148884 - protein, 9 aa, Artificial Sequence
  Description of Artificial Sequence: Synthetic peptide
  Seed: LSHIHASSY (PRAME_HUMAN)
LYHIHASSI

SEQ ID NO: 148885 - protein, 11 aa, Artificial Sequence
  Description of Artificial Sequence: Synthetic peptide
  Seed: LLSHIHASSYI (PRAME_HUMAN)
LMSHIHASSYI

SEQ ID NO: 148886 - protein, 9 aa, Artificial Sequence
  Description of Artificial Sequence: Synthetic peptide
  Seed: QFTSQFLSL (PRAME_HUMAN)
QFTSQFLSM

SEQ ID NO: 148887 - protein, 9 aa, Artificial Sequence
  Description of Artificial Sequence: Synthetic peptide
  Seed: QLLALLPSL (PRAME_HUMAN)
QLLALLPSM

SEQ ID NO: 148888 - protein, 9 aa, Artificial Sequence
  Description of Artificial Sequence: Synthetic peptide
  Seed: KVDGLSTEA (PRAME_HUMAN)
KGDGLSTEL

SEQ ID NO: 148889 - protein, 11 aa, Artificial Sequence
  Description of Artificial Sequence: Synthetic peptide
  Seed: SFPEPEAAQPM (PRAME_HUMAN)
SIPEPEAAQPL

SEQ ID NO: 148890 - protein, 9 aa, Artificial Sequence
  Description of Artificial Sequence: Synthetic peptide
  Seed: SHCSQLTTL (PRAME_HUMAN)
SRCSQLTTI

SEQ ID NO: 148891 - protein, 9 aa, Artificial Sequence
  Description of Artificial Sequence: Synthetic peptide
  Seed: VQLDSIEDL (PRAME_HUMAN)
VELDSIEDV

SEQ ID NO: 148892 - protein, 10 aa, Artificial Sequence
  Description of Artificial Sequence: Synthetic peptide
  Seed: AAFDGRHSQT (PRAME_HUMAN)
AVFDGRHSQY

SEQ ID NO: 148893 - protein, 11 aa, Artificial Sequence
  Description of Artificial Sequence: Synthetic peptide
  Seed: RELFPPLFMAA (PRAME_HUMAN)
RFLFPPLFMAA

SEQ ID NO: 148894 - protein, 10 aa, Artificial Sequence
  Description of Artificial Sequence: Synthetic peptide
  Seed: YLHARLRELL (PRAME_HUMAN)
YLHARLRELV

SEQ ID NO: 148895 - protein, 11 aa, Artificial Sequence
  Description of Artificial Sequence: Synthetic peptide
  Seed: NPCPHCGDRTF (PRAME_HUMAN)
NTCPHCGDRTW

SEQ ID NO: 148896 - protein, 10 aa, Artificial Sequence
  Description of Artificial Sequence: Synthetic peptide
  Seed: YEDIHGTLHL (PRAME_HUMAN)
YYDIHGTLHF

SEQ ID NO: 148897 - protein, 9 aa, Artificial Sequence
  Description of Artificial Sequence: Synthetic peptide
  Seed: KLKIFAMPM (PRAME_HUMAN)
KCKIFAMPK

SEQ ID NO: 148898 - protein, 11 aa, Artificial Sequence
  Description of Artificial Sequence: Synthetic peptide
  Seed: ALYVDSLFFLR (PRAME_HUMAN)
AGYVDSLFFLR

SEQ ID NO: 148899 - protein, 10 aa, Artificial Sequence
  Description of Artificial Sequence: Synthetic peptide
  Seed: AQFTSQFLSL (PRAME_HUMAN)
AMFTSQFLSL

SEQ ID NO: 148900 - protein, 10 aa, Artificial Sequence
  Description of Artificial Sequence: Synthetic peptide
  Seed: KKLKIFAMPM (PRAME_HUMAN)
KMLKIFAMPK

SEQ ID NO: 148901 - protein, 9 aa, Artificial Sequence
  Description of Artificial Sequence: Synthetic peptide
  Seed: FTCLPLGVL (PRAME_HUMAN)
FSCLPLGVW

SEQ ID NO: 148902 - protein, 10 aa, Artificial Sequence
  Description of Artificial Sequence: Synthetic peptide
  Seed: KAVLDGLDVL (PRAME_HUMAN)
KLVLDGLDVL

SEQ ID NO: 148903 - protein, 9 aa, Artificial Sequence
  Description of Artificial Sequence: Synthetic peptide
  Seed: AEQPFIPVE (PRAME_HUMAN)
ADQPFIPVA

SEQ ID NO: 148904 - protein, 9 aa, Artificial Sequence
  Description of Artificial Sequence: Synthetic peptide
  Seed: QSRYISMSV (PRAME_HUMAN)
QARYISMSK

SEQ ID NO: 148905 - protein, 9 aa, Artificial Sequence
  Description of Artificial Sequence: Synthetic peptide
  Seed: TWKLPTLAK (PRAME_HUMAN)
TVKLPTLAR

SEQ ID NO: 148906 - protein, 9 aa, Artificial Sequence
  Description of Artificial Sequence: Synthetic peptide
  Seed: FSPYLGQMI (PRAME_HUMAN)
FAPYLGQMI

SEQ ID NO: 148907 - protein, 10 aa, Artificial Sequence
  Description of Artificial Sequence: Synthetic peptide
  Seed: MQDIKMILKM (PRAME_HUMAN)
MMDIKMILKY

SEQ ID NO: 148908 - protein, 9 aa, Artificial Sequence
  Description of Artificial Sequence: Synthetic peptide
  Seed: LQDLVFDEC (PRAME_HUMAN)
LMDLVFDEI

SEQ ID NO: 148909 - protein, 9 aa, Artificial Sequence
  Description of Artificial Sequence: Synthetic peptide
  Seed: KNVLRLCCK (PRAME_HUMAN)
KYVLRLCCR

SEQ ID NO: 148910 - protein, 10 aa, Artificial Sequence
  Description of Artificial Sequence: Synthetic peptide
  Seed: QSLLQHLIGL (PRAME_HUMAN)
QVLLQHLIGI

SEQ ID NO: 148911 - protein, 11 aa, Artificial Sequence
  Description of Artificial Sequence: Synthetic peptide
  Seed: RLAYLHARLRE (PRAME_HUMAN)
RYAYLHARLRR

SEQ ID NO: 148912 - protein, 9 aa, Artificial Sequence
  Description of Artificial Sequence: Synthetic peptide
  Seed: CKKLKIFAM (PRAME_HUMAN)
CLKLKIFAF

SEQ ID NO: 148913 - protein, 9 aa, Artificial Sequence
  Description of Artificial Sequence: Synthetic peptide
  Seed: KLKIFAMPM (PRAME_HUMAN)
KTKIFAMPA

SEQ ID NO: 148914 - protein, 9 aa, Artificial Sequence
  Description of Artificial Sequence: Synthetic peptide
  Seed: FSPYLGQMI (PRAME_HUMAN)
FRPYLGQML

SEQ ID NO: 148915 - protein, 8 aa, Artificial Sequence
  Description of Artificial Sequence: Synthetic peptide
  Seed: LAIAALEL (PRAME_HUMAN)
LQIAALEV

SEQ ID NO: 148916 - protein, 11 aa, Artificial Sequence
  Description of Artificial Sequence: Synthetic peptide
  Seed: RRWKLQVLDLR (PRAME_HUMAN)
RRWKLQVLDLN

SEQ ID NO: 148917 - protein, 11 aa, Artificial Sequence
  Description of Artificial Sequence: Synthetic peptide
  Seed: ALYVDSLFFLR (PRAME_HUMAN)
ARYVDSLFFLR

SEQ ID NO: 148918 - protein, 9 aa, Artificial Sequence
  Description of Artificial Sequence: Synthetic peptide
  Seed: SHIHASSYI (PRAME_HUMAN)
SHIHASSYM

SEQ ID NO: 148919 - protein, 9 aa, Artificial Sequence
  Description of Artificial Sequence: Synthetic peptide
  Seed: TLKAMVQAW (PRAME_HUMAN)
TMKAMVQAL

SEQ ID NO: 148920 - protein, 11 aa, Artificial Sequence
  Description of Artificial Sequence: Synthetic peptide
  Seed: AAFDGRHSQTL (PRAME_HUMAN)
ARFDGRHSQTW

SEQ ID NO: 148921 - protein, 10 aa, Artificial Sequence
  Description of Artificial Sequence: Synthetic peptide
  Seed: KKLKIFAMPM (PRAME_HUMAN)
KTLKIFAMPI

SEQ ID NO: 148922 - protein, 9 aa, Artificial Sequence
  Description of Artificial Sequence: Synthetic peptide
  Seed: LSEGDVMHL (PRAME_HUMAN)
LIEGDVMHM

SEQ ID NO: 148923 - protein, 9 aa, Artificial Sequence
  Description of Artificial Sequence: Synthetic peptide
  Seed: SQSPSVSQL (PRAME_HUMAN)
STSPSVSQR

SEQ ID NO: 148924 - protein, 10 aa, Artificial Sequence
  Description of Artificial Sequence: Synthetic peptide
  Seed: YISPEKEEQY (PRAME_HUMAN)
YQSPEKEEQL

SEQ ID NO: 148925 - protein, 10 aa, Artificial Sequence
  Description of Artificial Sequence: Synthetic peptide
  Seed: LLPRELFPPL (PRAME_HUMAN)
LHPRELFPPF

SEQ ID NO: 148926 - protein, 10 aa, Artificial Sequence
  Description of Artificial Sequence: Synthetic peptide
  Seed: GRLDQLLRHV (PRAME_HUMAN)
GMLDQLLRHV

SEQ ID NO: 148927 - protein, 9 aa, Artificial Sequence
  Description of Artificial Sequence: Synthetic peptide
  Seed: ESYEDIHGT (PRAME_HUMAN)
EGYEDIHGV

SEQ ID NO: 148928 - protein, 9 aa, Artificial Sequence
  Description of Artificial Sequence: Synthetic peptide
  Seed: FLSLQCLQA (PRAME_HUMAN)
FLSLQCLQM

SEQ ID NO: 148929 - protein, 10 aa, Artificial Sequence
  Description of Artificial Sequence: Synthetic peptide
  Seed: HCSQLTTLSF (PRAME_HUMAN)
HQSQLTTLSY

SEQ ID NO: 148930 - protein, 9 aa, Artificial Sequence
  Description of Artificial Sequence: Synthetic peptide
  Seed: KLKIFAMPM (PRAME_HUMAN)
KGKIFAMPM

SEQ ID NO: 148931 - protein, 10 aa, Artificial Sequence
  Description of Artificial Sequence: Synthetic peptide
  Seed: MPMQDIKMIL (PRAME_HUMAN)
MAMQDIKMIF

SEQ ID NO: 148932 - protein, 11 aa, Artificial Sequence
  Description of Artificial Sequence: Synthetic peptide
  Seed: QALYVDSLFFL (PRAME_HUMAN)
QKLYVDSLFFV

SEQ ID NO: 148933 - protein, 9 aa, Artificial Sequence
  Description of Artificial Sequence: Synthetic peptide
  Seed: FYDPEPILC (PRAME_HUMAN)
FSDPEPILW

SEQ ID NO: 148934 - protein, 10 aa, Artificial Sequence
  Description of Artificial Sequence: Synthetic peptide
  Seed: SISISALQSL (PRAME_HUMAN)
SQSISALQSF

SEQ ID NO: 148935 - protein, 9 aa, Artificial Sequence
  Description of Artificial Sequence: Synthetic peptide
  Seed: LYVDSLFFL (PRAME_HUMAN)
LAVDSLFFM

SEQ ID NO: 148936 - protein, 10 aa, Artificial Sequence
  Description of Artificial Sequence: Synthetic peptide
  Seed: SISISALQSL (PRAME_HUMAN)
SWSISALQSW

SEQ ID NO: 148937 - protein, 9 aa, Artificial Sequence
  Description of Artificial Sequence: Synthetic peptide
  Seed: ASSYISPEK (PRAME_HUMAN)
ATSYISPER

SEQ ID NO: 148938 - protein, 9 aa, Artificial Sequence
  Description of Artificial Sequence: Synthetic peptide
  Seed: GQMINLRRL (PRAME_HUMAN)
GQMINLRRY

SEQ ID NO: 148939 - protein, 9 aa, Artificial Sequence
  Description of Artificial Sequence: Synthetic peptide
  Seed: ITDDQLLAL (PRAME_HUMAN)
IRDDQLLAM

SEQ ID NO: 148940 - protein, 10 aa, Artificial Sequence
  Description of Artificial Sequence: Synthetic peptide
  Seed: KVKRKKNVLR (PRAME_HUMAN)
KSKRKKNVLK

SEQ ID NO: 148941 - protein, 10 aa, Artificial Sequence
  Description of Artificial Sequence: Synthetic peptide
  Seed: LFPPLFMAAF (PRAME_HUMAN)
LYPPLFMAAI

SEQ ID NO: 148942 - protein, 9 aa, Artificial Sequence
  Description of Artificial Sequence: Synthetic peptide
  Seed: RPRRWKLQV (PRAME_HUMAN)
RPRRWKLQL

SEQ ID NO: 148943 - protein, 10 aa, Artificial Sequence
  Description of Artificial Sequence: Synthetic peptide
  Seed: MLTDVSPEPL (PRAME_HUMAN)
MQTDVSPEPF

SEQ ID NO: 148944 - protein, 9 aa, Artificial Sequence
  Description of Artificial Sequence: Synthetic peptide
  Seed: KVDGLSTEA (PRAME_HUMAN)
KMDGLSTEL

SEQ ID NO: 148945 - protein, 11 aa, Artificial Sequence
  Description of Artificial Sequence: Synthetic peptide
  Seed: SFPEPEAAQPM (PRAME_HUMAN)
SAPEPEAAQPL

SEQ ID NO: 148946 - protein, 9 aa, Artificial Sequence
  Description of Artificial Sequence: Synthetic peptide
  Seed: QPFIPVEVL (PRAME_HUMAN)
QLFIPVEVY

SEQ ID NO: 148947 - protein, 9 aa, Artificial Sequence
  Description of Artificial Sequence: Synthetic peptide
  Seed: YSFPEPEAA (PRAME_HUMAN)
YHFPEPEAP

SEQ ID NO: 148948 - protein, 10 aa, Artificial Sequence
  Description of Artificial Sequence: Synthetic peptide
  Seed: ISISALQSLL (PRAME_HUMAN)
ILISALQSLM

SEQ ID NO: 148949 - protein, 10 aa, Artificial Sequence
  Description of Artificial Sequence: Synthetic peptide
  Seed: HCSQLTTLSF (PRAME_HUMAN)
HESQLTTLSF

SEQ ID NO: 148950 - protein, 9 aa, Artificial Sequence
  Description of Artificial Sequence: Synthetic peptide
  Seed: LLKDEALAI (PRAME_HUMAN)
LMKDEALAY

SEQ ID NO: 148951 - protein, 10 aa, Artificial Sequence
  Description of Artificial Sequence: Synthetic peptide
  Seed: ALYVDSLFFL (PRAME_HUMAN)
ALYVDSLFFF

SEQ ID NO: 148952 - protein, 10 aa, Artificial Sequence
  Description of Artificial Sequence: Synthetic peptide
  Seed: ALYVDSLFFL (PRAME_HUMAN)
ATYVDSLFFV

SEQ ID NO: 148953 - protein, 9 aa, Artificial Sequence
  Description of Artificial Sequence: Synthetic peptide
  Seed: KAMVQAWPF (PRAME_HUMAN)
KYMVQAWPL

SEQ ID NO: 148954 - protein, 9 aa, Artificial Sequence
  Description of Artificial Sequence: Synthetic peptide
  Seed: YIAQFTSQF (PRAME_HUMAN)
YSAQFTSQY

SEQ ID NO: 148955 - protein, 10 aa, Artificial Sequence
  Description of Artificial Sequence: Synthetic peptide
  Seed: AAFDGRHSQT (PRAME_HUMAN)
AQFDGRHSQF

SEQ ID NO: 148956 - protein, 9 aa, Artificial Sequence
  Description of Artificial Sequence: Synthetic peptide
  Seed: LQDLVFDEC (PRAME_HUMAN)
LTDLVFDEV

SEQ ID NO: 148957 - protein, 9 aa, Artificial Sequence
  Description of Artificial Sequence: Synthetic peptide
  Seed: LLSHIHASS (PRAME_HUMAN)
LLSHIHASI

SEQ ID NO: 148958 - protein, 9 aa, Artificial Sequence
  Description of Artificial Sequence: Synthetic peptide
  Seed: QSLLKDEAL (PRAME_HUMAN)
QQLLKDEAF

SEQ ID NO: 148959 - protein, 9 aa, Artificial Sequence
  Description of Artificial Sequence: Synthetic peptide
  Seed: GNRASLYSF (PRAME_HUMAN)
GIRASLYSF

SEQ ID NO: 148960 - protein, 8 aa, Artificial Sequence
  Description of Artificial Sequence: Synthetic peptide
  Seed: MSVWTSPR (PRAME_HUMAN)
MVVWTSPR

SEQ ID NO: 148961 - protein, 9 aa, Artificial Sequence
  Description of Artificial Sequence: Synthetic peptide
  Seed: TFYDPEPIL (PRAME_HUMAN)
TAYDPEPIM

SEQ ID NO: 148962 - protein, 10 aa, Artificial Sequence
  Description of Artificial Sequence: Synthetic peptide
  Seed: QAWPFTCLPL (PRAME_HUMAN)
QVWPFTCLPI

SEQ ID NO: 148963 - protein, 9 aa, Artificial Sequence
  Description of Artificial Sequence: Synthetic peptide
  Seed: SRYISMSVW (PRAME_HUMAN)
SLYISMSVM

SEQ ID NO: 148964 - protein, 9 aa, Artificial Sequence
  Description of Artificial Sequence: Synthetic peptide
  Seed: YSFPEPEAA (PRAME_HUMAN)
YHFPEPEAC

SEQ ID NO: 148965 - protein, 9 aa, Artificial Sequence
  Description of Artificial Sequence: Synthetic peptide
  Seed: QSRYISMSV (PRAME_HUMAN)
QSRYISMSF

SEQ ID NO: 148966 - protein, 9 aa, Artificial Sequence
  Description of Artificial Sequence: Synthetic peptide
  Seed: LLKDEALAI (PRAME_HUMAN)
LTKDEALAF

SEQ ID NO: 148967 - protein, 9 aa, Artificial Sequence
  Description of Artificial Sequence: Synthetic peptide
  Seed: LLSHIHASS (PRAME_HUMAN)
LVSHIHASL

SEQ ID NO: 148968 - protein, 9 aa, Artificial Sequence
  Description of Artificial Sequence: Synthetic peptide
  Seed: SQSPSVSQL (PRAME_HUMAN)
SASPSVSQY

SEQ ID NO: 148969 - protein, 11 aa, Artificial Sequence
  Description of Artificial Sequence: Synthetic peptide
  Seed: SLYSFPEPEAA (PRAME_HUMAN)
SMYSFPEPEAL

SEQ ID NO: 148970 - protein, 9 aa, Artificial Sequence
  Description of Artificial Sequence: Synthetic peptide
  Seed: LPRELFPPL (PRAME_HUMAN)
LPRELFPPW

SEQ ID NO: 148971 - protein, 9 aa, Artificial Sequence
  Description of Artificial Sequence: Synthetic peptide
  Seed: CKKLKIFAM (PRAME_HUMAN)
CVKLKIFAI

SEQ ID NO: 148972 - protein, 9 aa, Artificial Sequence
  Description of Artificial Sequence: Synthetic peptide
  Seed: LSHIHASSY (PRAME_HUMAN)
LKHIHASSY

SEQ ID NO: 148973 - protein, 9 aa, Artificial Sequence
  Description of Artificial Sequence: Synthetic peptide
  Seed: SIQSRYISM (PRAME_HUMAN)
SAQSRYISM

SEQ ID NO: 148974 - protein, 9 aa, Artificial Sequence
  Description of Artificial Sequence: Synthetic peptide
  Seed: LTDVSPEPL (PRAME_HUMAN)
LYDVSPEPF

SEQ ID NO: 148975 - protein, 9 aa, Artificial Sequence
  Description of Artificial Sequence: Synthetic peptide
  Seed: GACDELFSY (PRAME_HUMAN)
GACDELFSK

SEQ ID NO: 148976 - protein, 9 aa, Artificial Sequence
  Description of Artificial Sequence: Synthetic peptide
  Seed: LAIAALELL (PRAME_HUMAN)
LSIAALELI

SEQ ID NO: 148977 - protein, 9 aa, Artificial Sequence
  Description of Artificial Sequence: Synthetic peptide
  Seed: RGRLDQLLR (PRAME_HUMAN)
RMRLDQLLY

SEQ ID NO: 148978 - protein, 9 aa, Artificial Sequence
  Description of Artificial Sequence: Synthetic peptide
  Seed: LSTEAEQPF (PRAME_HUMAN)
LLTEAEQPF

SEQ ID NO: 148979 - protein, 10 aa, Artificial Sequence
  Description of Artificial Sequence: Synthetic peptide
  Seed: ESYEDIHGTL (PRAME_HUMAN)
EVYEDIHGTR

SEQ ID NO: 148980 - protein, 11 aa, Artificial Sequence
  Description of Artificial Sequence: Synthetic peptide
  Seed: FLKEGACDELF (PRAME_HUMAN)
FLKEGACDELL

SEQ ID NO: 148981 - protein, 10 aa, Artificial Sequence
  Description of Artificial Sequence: Synthetic peptide
  Seed: RRRLWGSIQS (PRAME_HUMAN)
RYRLWGSIQR

SEQ ID NO: 148982 - protein, 9 aa, Artificial Sequence
  Description of Artificial Sequence: Synthetic peptide
  Seed: LYVDSLFFL (PRAME_HUMAN)
LSVDSLFFL

SEQ ID NO: 148983 - protein, 9 aa, Artificial Sequence
  Description of Artificial Sequence: Synthetic peptide
  Seed: HVMNPLETL (PRAME_HUMAN)
HIMNPLETL

SEQ ID NO: 148984 - protein, 11 aa, Artificial Sequence
  Description of Artificial Sequence: Synthetic peptide
  Seed: AALELLPRELF (PRAME_HUMAN)
AALELLPRELW

SEQ ID NO: 148985 - protein, 9 aa, Artificial Sequence
  Description of Artificial Sequence: Synthetic peptide
  Seed: QPFIPVEVL (PRAME_HUMAN)
QHFIPVEVL

SEQ ID NO: 148986 - protein, 10 aa, Artificial Sequence
  Description of Artificial Sequence: Synthetic peptide
  Seed: SLLKDEALAI (PRAME_HUMAN)
SMLKDEALAV

SEQ ID NO: 148987 - protein, 9 aa, Artificial Sequence
  Description of Artificial Sequence: Synthetic peptide
  Seed: RLSEGDVMH (PRAME_HUMAN)
RASEGDVMY

SEQ ID NO: 148988 - protein, 9 aa, Artificial Sequence
  Description of Artificial Sequence: Synthetic peptide
  Seed: YGNSISISA (PRAME_HUMAN)
YPNSISIST

SEQ ID NO: 148989 - protein, 9 aa, Artificial Sequence
  Description of Artificial Sequence: Synthetic peptide
  Seed: KMILKMVQL (PRAME_HUMAN)
KVILKMVQY

SEQ ID NO: 148990 - protein, 9 aa, Artificial Sequence
  Description of Artificial Sequence: Synthetic peptide
  Seed: SIEDLEVTC (PRAME_HUMAN)
SIEDLEVTL

SEQ ID NO: 148991 - protein, 9 aa, Artificial Sequence
  Description of Artificial Sequence: Synthetic peptide
  Seed: TSPRRLVEL (PRAME_HUMAN)
TYPRRLVEM

SEQ ID NO: 148992 - protein, 9 aa, Artificial Sequence
  Description of Artificial Sequence: Synthetic peptide
  Seed: LQDLVFDEC (PRAME_HUMAN)
LTDLVFDEL

SEQ ID NO: 148993 - protein, 9 aa, Artificial Sequence
  Description of Artificial Sequence: Synthetic peptide
  Seed: KEEQYIAQF (PRAME_HUMAN)
KEEQYIAQA

SEQ ID NO: 148994 - protein, 9 aa, Artificial Sequence
  Description of Artificial Sequence: Synthetic peptide
  Seed: GQHLHLETF (PRAME_HUMAN)
GKHLHLETY

SEQ ID NO: 148995 - protein, 10 aa, Artificial Sequence
  Description of Artificial Sequence: Synthetic peptide
  Seed: AAFDGRHSQT (PRAME_HUMAN)
ANFDGRHSQY

SEQ ID NO: 148996 - protein, 9 aa, Artificial Sequence
  Description of Artificial Sequence: Synthetic peptide
  Seed: VFDECGITD (PRAME_HUMAN)
VLDECGITV

SEQ ID NO: 148997 - protein, 10 aa, Artificial Sequence
  Description of Artificial Sequence: Synthetic peptide
  Seed: VLYPVPLESY (PRAME_HUMAN)
VAYPVPLESY

SEQ ID NO: 148998 - protein, 8 aa, Artificial Sequence
  Description of Artificial Sequence: Synthetic peptide
  Seed: SHIHASSY (PRAME_HUMAN)
SQIHASSL

SEQ ID NO: 148999 - protein, 10 aa, Artificial Sequence
  Description of Artificial Sequence: Synthetic peptide
  Seed: MVQAWPFTCL (PRAME_HUMAN)
MYQAWPFTCM

SEQ ID NO: 149000 - protein, 9 aa, Artificial Sequence
  Description of Artificial Sequence: Synthetic peptide
  Seed: VLDGLDVLL (PRAME_HUMAN)
VWDGLDVLI

SEQ ID NO: 149001 - protein, 9 aa, Artificial Sequence
  Description of Artificial Sequence: Synthetic peptide
  Seed: TLAKFSPYL (PRAME_HUMAN)
TYAKFSPYF

SEQ ID NO: 149002 - protein, 9 aa, Artificial Sequence
  Description of Artificial Sequence: Synthetic peptide
  Seed: FYDPEPILC (PRAME_HUMAN)
FVDPEPILW

SEQ ID NO: 149003 - protein, 11 aa, Artificial Sequence
  Description of Artificial Sequence: Synthetic peptide
  Seed: RRLLLSHIHAS (PRAME_HUMAN)
RRLLLSHIHAY

SEQ ID NO: 149004 - protein, 9 aa, Artificial Sequence
  Description of Artificial Sequence: Synthetic peptide
  Seed: KFSPYLGQM (PRAME_HUMAN)
KYSPYLGQI

SEQ ID NO: 149005 - protein, 9 aa, Artificial Sequence
  Description of Artificial Sequence: Synthetic peptide
  Seed: EQPFIPVEV (PRAME_HUMAN)
ETPFIPVEI

SEQ ID NO: 149006 - protein, 10 aa, Artificial Sequence
  Description of Artificial Sequence: Synthetic peptide
  Seed: QLLRHVMNPL (PRAME_HUMAN)
QFLRHVMNPL

SEQ ID NO: 149007 - protein, 9 aa, Artificial Sequence
  Description of Artificial Sequence: Synthetic peptide
  Seed: SFYGNSISI (PRAME_HUMAN)
SKYGNSISF

SEQ ID NO: 149008 - protein, 10 aa, Artificial Sequence
  Description of Artificial Sequence: Synthetic peptide
  Seed: HASSYISPEK (PRAME_HUMAN)
HQSSYISPER

SEQ ID NO: 149009 - protein, 10 aa, Artificial Sequence
  Description of Artificial Sequence: Synthetic peptide
  Seed: FMAAFDGRHS (PRAME_HUMAN)
FMAAFDGRHV

SEQ ID NO: 149010 - protein, 10 aa, Artificial Sequence
  Description of Artificial Sequence: Synthetic peptide
  Seed: DQLLALLPSL (PRAME_HUMAN)
DFLLALLPSI

SEQ ID NO: 149011 - protein, 10 aa, Artificial Sequence
  Description of Artificial Sequence: Synthetic peptide
  Seed: VLYPVPLESY (PRAME_HUMAN)
VTYPVPLESF

SEQ ID NO: 149012 - protein, 10 aa, Artificial Sequence
  Description of Artificial Sequence: Synthetic peptide
  Seed: LPTLAKFSPY (PRAME_HUMAN)
LKTLAKFSPF

SEQ ID NO: 149013 - protein, 9 aa, Artificial Sequence
  Description of Artificial Sequence: Synthetic peptide
  Seed: KMILKMVQL (PRAME_HUMAN)
KVILKMVQF

SEQ ID NO: 149014 - protein, 9 aa, Artificial Sequence
  Description of Artificial Sequence: Synthetic peptide
  Seed: DSLFFLRGR (PRAME_HUMAN)
DVLFFLRGR

SEQ ID NO: 149015 - protein, 9 aa, Artificial Sequence
  Description of Artificial Sequence: Synthetic peptide
  Seed: SVLSLSGVM (PRAME_HUMAN)
SHLSLSGVF

SEQ ID NO: 149016 - protein, 9 aa, Artificial Sequence
  Description of Artificial Sequence: Synthetic peptide
  Seed: SRYISMSVW (PRAME_HUMAN)
SMYISMSVI

SEQ ID NO: 149017 - protein, 9 aa, Artificial Sequence
  Description of Artificial Sequence: Synthetic peptide
  Seed: FSPYLGQMI (PRAME_HUMAN)
FLPYLGQMI

SEQ ID NO: 149018 - protein, 9 aa, Artificial Sequence
  Description of Artificial Sequence: Synthetic peptide
  Seed: RRWKLQVLD (PRAME_HUMAN)
RRWKLQVLV

SEQ ID NO: 149019 - protein, 9 aa, Artificial Sequence
  Description of Artificial Sequence: Synthetic peptide
  Seed: VSQLSVLSL (PRAME_HUMAN)
VAQLSVLSL

SEQ ID NO: 149020 - protein, 9 aa, Artificial Sequence
  Description of Artificial Sequence: Synthetic peptide
  Seed: YVDSLFFLR (PRAME_HUMAN)
YMDSLFFLY

SEQ ID NO: 149021 - protein, 9 aa, Artificial Sequence
  Description of Artificial Sequence: Synthetic peptide
  Seed: RASATLQDL (PRAME_HUMAN)
RMSATLQDL

SEQ ID NO: 149022 - protein, 10 aa, Artificial Sequence
  Description of Artificial Sequence: Synthetic peptide
  Seed: DFWTVWSGNR (PRAME_HUMAN)
DIWTVWSGNR

SEQ ID NO: 149023 - protein, 9 aa, Artificial Sequence
  Description of Artificial Sequence: Synthetic peptide
  Seed: KAMVQAWPF (PRAME_HUMAN)
KYMVQAWPI

SEQ ID NO: 149024 - protein, 9 aa, Artificial Sequence
  Description of Artificial Sequence: Synthetic peptide
  Seed: HVMNPLETL (PRAME_HUMAN)
HVMNPLETI

SEQ ID NO: 149025 - protein, 9 aa, Artificial Sequence
  Description of Artificial Sequence: Synthetic peptide
  Seed: VLDGLDVLL (PRAME_HUMAN)
VSDGLDVLV

SEQ ID NO: 149026 - protein, 9 aa, Artificial Sequence
  Description of Artificial Sequence: Synthetic peptide
  Seed: LLKDEALAI (PRAME_HUMAN)
LTKDEALAL

SEQ ID NO: 149027 - protein, 9 aa, Artificial Sequence
  Description of Artificial Sequence: Synthetic peptide
  Seed: SYEDIHGTL (PRAME_HUMAN)
SQEDIHGTF

SEQ ID NO: 149028 - protein, 10 aa, Artificial Sequence
  Description of Artificial Sequence: Synthetic peptide
  Seed: RHVMNPLETL (PRAME_HUMAN)
RMVMNPLETW

SEQ ID NO: 149029 - protein, 9 aa, Artificial Sequence
  Description of Artificial Sequence: Synthetic peptide
  Seed: GNRASLYSF (PRAME_HUMAN)
GQRASLYSM

SEQ ID NO: 149030 - protein, 9 aa, Artificial Sequence
  Description of Artificial Sequence: Synthetic peptide
  Seed: GNRASLYSF (PRAME_HUMAN)
GKRASLYSF

SEQ ID NO: 149031 - protein, 10 aa, Artificial Sequence
  Description of Artificial Sequence: Synthetic peptide
  Seed: HCSQLTTLSF (PRAME_HUMAN)
HTSQLTTLSW

SEQ ID NO: 149032 - protein, 10 aa, Artificial Sequence
  Description of Artificial Sequence: Synthetic peptide
  Seed: KGQHLHLETF (PRAME_HUMAN)
KQQHLHLETM

SEQ ID NO: 149033 - protein, 10 aa, Artificial Sequence
  Description of Artificial Sequence: Synthetic peptide
  Seed: LQALYVDSLF (PRAME_HUMAN)
LQALYVDSLM

SEQ ID NO: 149034 - protein, 10 aa, Artificial Sequence
  Description of Artificial Sequence: Synthetic peptide
  Seed: MPMQDIKMIL (PRAME_HUMAN)
MIMQDIKMIL

SEQ ID NO: 149035 - protein, 9 aa, Artificial Sequence
  Description of Artificial Sequence: Synthetic peptide
  Seed: SLLQHLIGL (PRAME_HUMAN)
SILQHLIGV

SEQ ID NO: 149036 - protein, 9 aa, Artificial Sequence
  Description of Artificial Sequence: Synthetic peptide
  Seed: LFMAAFDGR (PRAME_HUMAN)
LLMAAFDGR

SEQ ID NO: 149037 - protein, 9 aa, Artificial Sequence
  Description of Artificial Sequence: Synthetic peptide
  Seed: LQALYVDSL (PRAME_HUMAN)
LRALYVDSL

SEQ ID NO: 149038 - protein, 10 aa, Artificial Sequence
  Description of Artificial Sequence: Synthetic peptide
  Seed: FFLRGRLDQL (PRAME_HUMAN)
FNLRGRLDQL

SEQ ID NO: 149039 - protein, 9 aa, Artificial Sequence
  Description of Artificial Sequence: Synthetic peptide
  Seed: MINLRRLLL (PRAME_HUMAN)
MINLRRLLK

SEQ ID NO: 149040 - protein, 9 aa, Artificial Sequence
  Description of Artificial Sequence: Synthetic peptide
  Seed: FYDPEPILC (PRAME_HUMAN)
FADPEPILW

SEQ ID NO: 149041 - protein, 11 aa, Artificial Sequence
  Description of Artificial Sequence: Synthetic peptide
  Seed: RTFYDPEPILC (PRAME_HUMAN)
RMFYDPEPILW

SEQ ID NO: 149042 - protein, 9 aa, Artificial Sequence
  Description of Artificial Sequence: Synthetic peptide
  Seed: ITDDQLLAL (PRAME_HUMAN)
IRDDQLLAL

SEQ ID NO: 149043 - protein, 11 aa, Artificial Sequence
  Description of Artificial Sequence: Synthetic peptide
  Seed: ALYVDSLFFLR (PRAME_HUMAN)
AAYVDSLFFLR

SEQ ID NO: 149044 - protein, 10 aa, Artificial Sequence
  Description of Artificial Sequence: Synthetic peptide
  Seed: MERRRLWGSI (PRAME_HUMAN)
MMRRRLWGSA

SEQ ID NO: 149045 - protein, 9 aa, Artificial Sequence
  Description of Artificial Sequence: Synthetic peptide
  Seed: SLLQHLIGL (PRAME_HUMAN)
SMLQHLIGF

SEQ ID NO: 149046 - protein, 10 aa, Artificial Sequence
  Description of Artificial Sequence: Synthetic peptide
  Seed: ETLSITNCRL (PRAME_HUMAN)
ENLSITNCRR

SEQ ID NO: 149047 - protein, 10 aa, Artificial Sequence
  Description of Artificial Sequence: Synthetic peptide
  Seed: AMVQAWPFTC (PRAME_HUMAN)
AMVQAWPFTM

SEQ ID NO: 149048 - protein, 10 aa, Artificial Sequence
  Description of Artificial Sequence: Synthetic peptide
  Seed: LSFYGNSISI (PRAME_HUMAN)
LFFYGNSISF

SEQ ID NO: 149049 - protein, 10 aa, Artificial Sequence
  Description of Artificial Sequence: Synthetic peptide
  Seed: ELFSYLIEKV (PRAME_HUMAN)
ETFSYLIEKL

SEQ ID NO: 149050 - protein, 10 aa, Artificial Sequence
  Description of Artificial Sequence: Synthetic peptide
  Seed: IGLSNLTHVL (PRAME_HUMAN)
ISLSNLTHVI

SEQ ID NO: 149051 - protein, 10 aa, Artificial Sequence
  Description of Artificial Sequence: Synthetic peptide
  Seed: LLSHIHASSY (PRAME_HUMAN)
LMSHIHASSY

SEQ ID NO: 149052 - protein, 10 aa, Artificial Sequence
  Description of Artificial Sequence: Synthetic peptide
  Seed: MVQAWPFTCL (PRAME_HUMAN)
MWQAWPFTCM

SEQ ID NO: 149053 - protein, 10 aa, Artificial Sequence
  Description of Artificial Sequence: Synthetic peptide
  Seed: ALYVDSLFFL (PRAME_HUMAN)
AIYVDSLFFV

SEQ ID NO: 149054 - protein, 10 aa, Artificial Sequence
  Description of Artificial Sequence: Synthetic peptide
  Seed: SVLSLSGVML (PRAME_HUMAN)
SQLSLSGVMV

SEQ ID NO: 149055 - protein, 10 aa, Artificial Sequence
  Description of Artificial Sequence: Synthetic peptide
  Seed: GACDELFSYL (PRAME_HUMAN)
GVCDELFSYI

SEQ ID NO: 149056 - protein, 10 aa, Artificial Sequence
  Description of Artificial Sequence: Synthetic peptide
  Seed: ELFPPLFMAA (PRAME_HUMAN)
ESFPPLFMAL

SEQ ID NO: 149057 - protein, 10 aa, Artificial Sequence
  Description of Artificial Sequence: Synthetic peptide
  Seed: FFLRGRLDQL (PRAME_HUMAN)
FRLRGRLDQV

SEQ ID NO: 149058 - protein, 9 aa, Artificial Sequence
  Description of Artificial Sequence: Synthetic peptide
  Seed: TLAKFSPYL (PRAME_HUMAN)
TVAKFSPYR

SEQ ID NO: 149059 - protein, 9 aa, Artificial Sequence
  Description of Artificial Sequence: Synthetic peptide
  Seed: QSRYISMSV (PRAME_HUMAN)
QPRYISMSF

SEQ ID NO: 149060 - protein, 9 aa, Artificial Sequence
  Description of Artificial Sequence: Synthetic peptide
  Seed: SLLQHLIGL (PRAME_HUMAN)
STLQHLIGA

SEQ ID NO: 149061 - protein, 9 aa, Artificial Sequence
  Description of Artificial Sequence: Synthetic peptide
  Seed: AVLDGLDVL (PRAME_HUMAN)
ALLDGLDVM

SEQ ID NO: 149062 - protein, 9 aa, Artificial Sequence
  Description of Artificial Sequence: Synthetic peptide
  Seed: THVLYPVPL (PRAME_HUMAN)
TQVLYPVPF

SEQ ID NO: 149063 - protein, 9 aa, Artificial Sequence
  Description of Artificial Sequence: Synthetic peptide
  Seed: LSHIHASSY (PRAME_HUMAN)
LAHIHASSK

SEQ ID NO: 149064 - protein, 9 aa, Artificial Sequence
  Description of Artificial Sequence: Synthetic peptide
  Seed: SIQSRYISM (PRAME_HUMAN)
SPQSRYISI

SEQ ID NO: 149065 - protein, 8 aa, Artificial Sequence
  Description of Artificial Sequence: Synthetic peptide
  Seed: VKRKKNVL (PRAME_HUMAN)
VIRKKNVL

SEQ ID NO: 149066 - protein, 9 aa, Artificial Sequence
  Description of Artificial Sequence: Synthetic peptide
  Seed: VLDGLDVLL (PRAME_HUMAN)
VADGLDVLF

SEQ ID NO: 149067 - protein, 9 aa, Artificial Sequence
  Description of Artificial Sequence: Synthetic peptide
  Seed: LELLPRELF (PRAME_HUMAN)
LELLPRELW

SEQ ID NO: 149068 - protein, 9 aa, Artificial Sequence
  Description of Artificial Sequence: Synthetic peptide
  Seed: LPTLAKFSP (PRAME_HUMAN)
LPTLAKFSV

SEQ ID NO: 149069 - protein, 11 aa, Artificial Sequence
  Description of Artificial Sequence: Synthetic peptide
  Seed: QYIAQFTSQFL (PRAME_HUMAN)
QYIAQFTSQFW

SEQ ID NO: 149070 - protein, 9 aa, Artificial Sequence
  Description of Artificial Sequence: Synthetic peptide
  Seed: KAMVQAWPF (PRAME_HUMAN)
KVMVQAWPM

SEQ ID NO: 149071 - protein, 9 aa, Artificial Sequence
  Description of Artificial Sequence: Synthetic peptide
  Seed: SVLSLSGVM (PRAME_HUMAN)
SILSLSGVF

SEQ ID NO: 149072 - protein, 9 aa, Artificial Sequence
  Description of Artificial Sequence: Synthetic peptide
  Seed: SHIHASSYI (PRAME_HUMAN)
SRIHASSYY

SEQ ID NO: 149073 - protein, 10 aa, Artificial Sequence
  Description of Artificial Sequence: Synthetic peptide
  Seed: SLSGVMLTDV (PRAME_HUMAN)
SLSGVMLTDL

SEQ ID NO: 149074 - protein, 9 aa, Artificial Sequence
  Description of Artificial Sequence: Synthetic peptide
  Seed: SATLQDLVF (PRAME_HUMAN)
STTLQDLVW

SEQ ID NO: 149075 - protein, 9 aa, Artificial Sequence
  Description of Artificial Sequence: Synthetic peptide
  Seed: LYVDSLFFL (PRAME_HUMAN)
LQVDSLFFA

SEQ ID NO: 149076 - protein, 9 aa, Artificial Sequence
  Description of Artificial Sequence: Synthetic peptide
  Seed: SVWTSPRRL (PRAME_HUMAN)
SSWTSPRRW

SEQ ID NO: 149077 - protein, 9 aa, Artificial Sequence
  Description of Artificial Sequence: Synthetic peptide
  Seed: VSPEPLQAL (PRAME_HUMAN)
VAPEPLQAW

SEQ ID NO: 149078 - protein, 9 aa, Artificial Sequence
  Description of Artificial Sequence: Synthetic peptide
  Seed: CKKLKIFAM (PRAME_HUMAN)
CQKLKIFAL

SEQ ID NO: 149079 - protein, 11 aa, Artificial Sequence
  Description of Artificial Sequence: Synthetic peptide
  Seed: RLAYLHARLRE (PRAME_HUMAN)
RAAYLHARLRR

SEQ ID NO: 149080 - protein, 9 aa, Artificial Sequence
  Description of Artificial Sequence: Synthetic peptide
  Seed: SFYGNSISI (PRAME_HUMAN)
SEYGNSISY

SEQ ID NO: 149081 - protein, 9 aa, Artificial Sequence
  Description of Artificial Sequence: Synthetic peptide
  Seed: HVMNPLETL (PRAME_HUMAN)
HMMNPLETV

SEQ ID NO: 149082 - protein, 10 aa, Artificial Sequence
  Description of Artificial Sequence: Synthetic peptide
  Seed: ITDDQLLALL (PRAME_HUMAN)
IMDDQLLALF

SEQ ID NO: 149083 - protein, 9 aa, Artificial Sequence
  Description of Artificial Sequence: Synthetic peptide
  Seed: YEDIHGTLH (PRAME_HUMAN)
YMDIHGTLY

SEQ ID NO: 149084 - protein, 10 aa, Artificial Sequence
  Description of Artificial Sequence: Synthetic peptide
  Seed: AMVQAWPFTC (PRAME_HUMAN)
AGVQAWPFTV

SEQ ID NO: 149085 - protein, 10 aa, Artificial Sequence
  Description of Artificial Sequence: Synthetic peptide
  Seed: GQHLHLETFK (PRAME_HUMAN)
GMHLHLETFR

SEQ ID NO: 149086 - protein, 9 aa, Artificial Sequence
  Description of Artificial Sequence: Synthetic peptide
  Seed: TFYDPEPIL (PRAME_HUMAN)
TVYDPEPIF

SEQ ID NO: 149087 - protein, 9 aa, Artificial Sequence
  Description of Artificial Sequence: Synthetic peptide
  Seed: EAAQPMTKK (PRAME_HUMAN)
ETAQPMTKL

SEQ ID NO: 149088 - protein, 9 aa, Artificial Sequence
  Description of Artificial Sequence: Synthetic peptide
  Seed: QLLALLPSL (PRAME_HUMAN)
QTLALLPSK

SEQ ID NO: 149089 - protein, 11 aa, Artificial Sequence
  Description of Artificial Sequence: Synthetic peptide
  Seed: MKGQHLHLETF (PRAME_HUMAN)
MSGQHLHLETF

SEQ ID NO: 149090 - protein, 9 aa, Artificial Sequence
  Description of Artificial Sequence: Synthetic peptide
  Seed: LLLSHIHAS (PRAME_HUMAN)
LILSHIHAV

SEQ ID NO: 149091 - protein, 9 aa, Artificial Sequence
  Description of Artificial Sequence: Synthetic peptide
  Seed: SHIHASSYI (PRAME_HUMAN)
SYIHASSYM

SEQ ID NO: 149092 - protein, 10 aa, Artificial Sequence
  Description of Artificial Sequence: Synthetic peptide
  Seed: MVQAWPFTCL (PRAME_HUMAN)
MQQAWPFTCL

SEQ ID NO: 149093 - protein, 9 aa, Artificial Sequence
  Description of Artificial Sequence: Synthetic peptide
  Seed: LYPVPLESY (PRAME_HUMAN)
LAPVPLESI

SEQ ID NO: 149094 - protein, 10 aa, Artificial Sequence
  Description of Artificial Sequence: Synthetic peptide
  Seed: IGLSNLTHVL (PRAME_HUMAN)
IKLSNLTHVI

SEQ ID NO: 149095 - protein, 9 aa, Artificial Sequence
  Description of Artificial Sequence: Synthetic peptide
  Seed: MVQAWPFTC (PRAME_HUMAN)
MSQAWPFTL

SEQ ID NO: 149096 - protein, 9 aa, Artificial Sequence
  Description of Artificial Sequence: Synthetic peptide
  Seed: YISMSVWTS (PRAME_HUMAN)
YMSMSVWTM

SEQ ID NO: 149097 - protein, 8 aa, Artificial Sequence
  Description of Artificial Sequence: Synthetic peptide
  Seed: YEDIHGTL (PRAME_HUMAN)
YQDIHGTI

SEQ ID NO: 149098 - protein, 10 aa, Artificial Sequence
  Description of Artificial Sequence: Synthetic peptide
  Seed: RGRLDQLLRH (PRAME_HUMAN)
RERLDQLLRM

SEQ ID NO: 149099 - protein, 11 aa, Artificial Sequence
  Description of Artificial Sequence: Synthetic peptide
  Seed: ALYVDSLFFLR (PRAME_HUMAN)
ALYVDSLFFLL

SEQ ID NO: 149100 - protein, 10 aa, Artificial Sequence
  Description of Artificial Sequence: Synthetic peptide
  Seed: MVQAWPFTCL (PRAME_HUMAN)
MAQAWPFTCV

SEQ ID NO: 149101 - protein, 9 aa, Artificial Sequence
  Description of Artificial Sequence: Synthetic peptide
  Seed: SIQSRYISM (PRAME_HUMAN)
SMQSRYISV

SEQ ID NO: 149102 - protein, 9 aa, Artificial Sequence
  Description of Artificial Sequence: Synthetic peptide
  Seed: SRYISMSVW (PRAME_HUMAN)
SMYISMSVW

SEQ ID NO: 149103 - protein, 11 aa, Artificial Sequence
  Description of Artificial Sequence: Synthetic peptide
  Seed: AAFDGRHSQTL (PRAME_HUMAN)
AMFDGRHSQTF

SEQ ID NO: 149104 - protein, 9 aa, Artificial Sequence
  Description of Artificial Sequence: Synthetic peptide
  Seed: LAIAALELL (PRAME_HUMAN)
LSIAALELW

SEQ ID NO: 149105 - protein, 9 aa, Artificial Sequence
  Description of Artificial Sequence: Synthetic peptide
  Seed: LSVLSLSGV (PRAME_HUMAN)
LMVLSLSGI

SEQ ID NO: 149106 - protein, 9 aa, Artificial Sequence
  Description of Artificial Sequence: Synthetic peptide
  Seed: NSHQDFWTV (PRAME_HUMAN)
NMHQDFWTA

SEQ ID NO: 149107 - protein, 9 aa, Artificial Sequence
  Description of Artificial Sequence: Synthetic peptide
  Seed: NSHQDFWTV (PRAME_HUMAN)
NIHQDFWTL

SEQ ID NO: 149108 - protein, 10 aa, Artificial Sequence
  Description of Artificial Sequence: Synthetic peptide
  Seed: LSVLSLSGVM (PRAME_HUMAN)
LQVLSLSGVY

SEQ ID NO: 149109 - protein, 10 aa, Artificial Sequence
  Description of Artificial Sequence: Synthetic peptide
  Seed: VEVLVDLFLK (PRAME_HUMAN)
VFVLVDLFLR

SEQ ID NO: 149110 - protein, 11 aa, Artificial Sequence
  Description of Artificial Sequence: Synthetic peptide
  Seed: KNSHQDFWTVW (PRAME_HUMAN)
KMSHQDFWTVW

SEQ ID NO: 149111 - protein, 9 aa, Artificial Sequence
  Description of Artificial Sequence: Synthetic peptide
  Seed: KLKIFAMPM (PRAME_HUMAN)
KIKIFAMPI

SEQ ID NO: 149112 - protein, 10 aa, Artificial Sequence
  Description of Artificial Sequence: Synthetic peptide
  Seed: ELFPPLFMAA (PRAME_HUMAN)
EAFPPLFMAL

SEQ ID NO: 149113 - protein, 10 aa, Artificial Sequence
  Description of Artificial Sequence: Synthetic peptide
  Seed: MINLRRLLLS (PRAME_HUMAN)
MPNLRRLLLM

SEQ ID NO: 149114 - protein, 11 aa, Artificial Sequence
  Description of Artificial Sequence: Synthetic peptide
  Seed: ALYVDSLFFLR (PRAME_HUMAN)
ASYVDSLFFLR

SEQ ID NO: 149115 - protein, 9 aa, Artificial Sequence
  Description of Artificial Sequence: Synthetic peptide
  Seed: KAMVQAWPF (PRAME_HUMAN)
KIMVQAWPI

SEQ ID NO: 149116 - protein, 10 aa, Artificial Sequence
  Description of Artificial Sequence: Synthetic peptide
  Seed: RLSEGDVMHL (PRAME_HUMAN)
RISEGDVMHV

SEQ ID NO: 149117 - protein, 9 aa, Artificial Sequence
  Description of Artificial Sequence: Synthetic peptide
  Seed: KMILKMVQL (PRAME_HUMAN)
KMILKMVQA

SEQ ID NO: 149118 - protein, 9 aa, Artificial Sequence
  Description of Artificial Sequence: Synthetic peptide
  Seed: YLHARLREL (PRAME_HUMAN)
YVHARLREF

SEQ ID NO: 149119 - protein, 10 aa, Artificial Sequence
  Description of Artificial Sequence: Synthetic peptide
  Seed: ETFKAVLDGL (PRAME_HUMAN)
EAFKAVLDGK

SEQ ID NO: 149120 - protein, 9 aa, Artificial Sequence
  Description of Artificial Sequence: Synthetic peptide
  Seed: ITDDQLLAL (PRAME_HUMAN)
ICDDQLLAI

SEQ ID NO: 149121 - protein, 9 aa, Artificial Sequence
  Description of Artificial Sequence: Synthetic peptide
  Seed: KFSPYLGQM (PRAME_HUMAN)
KRSPYLGQV

SEQ ID NO: 149122 - protein, 9 aa, Artificial Sequence
  Description of Artificial Sequence: Synthetic peptide
  Seed: SFYGNSISI (PRAME_HUMAN)
STYGNSISL

SEQ ID NO: 149123 - protein, 9 aa, Artificial Sequence
  Description of Artificial Sequence: Synthetic peptide
  Seed: LSVLSLSGV (PRAME_HUMAN)
LMVLSLSGL

SEQ ID NO: 149124 - protein, 9 aa, Artificial Sequence
  Description of Artificial Sequence: Synthetic peptide
  Seed: QSRYISMSV (PRAME_HUMAN)
QIRYISMSL

SEQ ID NO: 149125 - protein, 9 aa, Artificial Sequence
  Description of Artificial Sequence: Synthetic peptide
  Seed: VLMKGQHLH (PRAME_HUMAN)
VTMKGQHLY

SEQ ID NO: 149126 - protein, 10 aa, Artificial Sequence
  Description of Artificial Sequence: Synthetic peptide
  Seed: LLPRELFPPL (PRAME_HUMAN)
LCPRELFPPL

SEQ ID NO: 149127 - protein, 11 aa, Artificial Sequence
  Description of Artificial Sequence: Synthetic peptide
  Seed: ALLERASATLQ (PRAME_HUMAN)
ALLERASATLV

SEQ ID NO: 149128 - protein, 9 aa, Artificial Sequence
  Description of Artificial Sequence: Synthetic peptide
  Seed: ALLERASAT (PRAME_HUMAN)
ALLERASAL

SEQ ID NO: 149129 - protein, 11 aa, Artificial Sequence
  Description of Artificial Sequence: Synthetic peptide
  Seed: IQSRYISMSVW (PRAME_HUMAN)
IMSRYISMSVF

SEQ ID NO: 149130 - protein, 9 aa, Artificial Sequence
  Description of Artificial Sequence: Synthetic peptide
  Seed: LSNLTHVLY (PRAME_HUMAN)
LVNLTHVLW

SEQ ID NO: 149131 - protein, 9 aa, Artificial Sequence
  Description of Artificial Sequence: Synthetic peptide
  Seed: RLAYLHARL (PRAME_HUMAN)
RYAYLHARY

SEQ ID NO: 149132 - protein, 10 aa, Artificial Sequence
  Description of Artificial Sequence: Synthetic peptide
  Seed: SMSVWTSPRR (PRAME_HUMAN)
SASVWTSPRR

SEQ ID NO: 149133 - protein, 10 aa, Artificial Sequence
  Description of Artificial Sequence: Synthetic peptide
  Seed: VLYPVPLESY (PRAME_HUMAN)
VHYPVPLESF

SEQ ID NO: 149134 - protein, 9 aa, Artificial Sequence
  Description of Artificial Sequence: Synthetic peptide
  Seed: YSFPEPEAA (PRAME_HUMAN)
YTFPEPEAY

SEQ ID NO: 149135 - protein, 9 aa, Artificial Sequence
  Description of Artificial Sequence: Synthetic peptide
  Seed: AVLDGLDVL (PRAME_HUMAN)
ASLDGLDVY

SEQ ID NO: 149136 - protein, 11 aa, Artificial Sequence
  Description of Artificial Sequence: Synthetic peptide
  Seed: SMSVWTSPRRL (PRAME_HUMAN)
SMSVWTSPRRV

SEQ ID NO: 149137 - protein, 9 aa, Artificial Sequence
  Description of Artificial Sequence: Synthetic peptide
  Seed: YISMSVWTS (PRAME_HUMAN)
YTSMSVWTV

SEQ ID NO: 149138 - protein, 9 aa, Artificial Sequence
  Description of Artificial Sequence: Synthetic peptide
  Seed: LEVTCTWKL (PRAME_HUMAN)
LQVTCTWKL

SEQ ID NO: 149139 - protein, 9 aa, Artificial Sequence
  Description of Artificial Sequence: Synthetic peptide
  Seed: SLSHCSQLT (PRAME_HUMAN)
SQSHCSQLI

SEQ ID NO: 149140 - protein, 11 aa, Artificial Sequence
  Description of Artificial Sequence: Synthetic peptide
  Seed: LQSLLQHLIGL (PRAME_HUMAN)
LISLLQHLIGV

SEQ ID NO: 149141 - protein, 10 aa, Artificial Sequence
  Description of Artificial Sequence: Synthetic peptide
  Seed: RLAYLHARLR (PRAME_HUMAN)
RQAYLHARLK

SEQ ID NO: 149142 - protein, 11 aa, Artificial Sequence
  Description of Artificial Sequence: Synthetic peptide
  Seed: AAFDGRHSQTL (PRAME_HUMAN)
AAFDGRHSQTY

SEQ ID NO: 149143 - protein, 9 aa, Artificial Sequence
  Description of Artificial Sequence: Synthetic peptide
  Seed: LSVLSLSGV (PRAME_HUMAN)
LQVLSLSGV

SEQ ID NO: 149144 - protein, 10 aa, Artificial Sequence
  Description of Artificial Sequence: Synthetic peptide
  Seed: VMNPLETLSI (PRAME_HUMAN)
VQNPLETLSM

SEQ ID NO: 149145 - protein, 9 aa, Artificial Sequence
  Description of Artificial Sequence: Synthetic peptide
  Seed: VSQLSVLSL (PRAME_HUMAN)
VQQLSVLSF

SEQ ID NO: 149146 - protein, 10 aa, Artificial Sequence
  Description of Artificial Sequence: Synthetic peptide
  Seed: VTCTWKLPTL (PRAME_HUMAN)
VMCTWKLPTM

SEQ ID NO: 149147 - protein, 10 aa, Artificial Sequence
  Description of Artificial Sequence: Synthetic peptide
  Seed: ARLRELLCEL (PRAME_HUMAN)
ALLRELLCEL

SEQ ID NO: 149148 - protein, 9 aa, Artificial Sequence
  Description of Artificial Sequence: Synthetic peptide
  Seed: VLDGLDVLL (PRAME_HUMAN)
VFDGLDVLF

SEQ ID NO: 149149 - protein, 11 aa, Artificial Sequence
  Description of Artificial Sequence: Synthetic peptide
  Seed: ALYVDSLFFLR (PRAME_HUMAN)
AMYVDSLFFLD

SEQ ID NO: 149150 - protein, 9 aa, Artificial Sequence
  Description of Artificial Sequence: Synthetic peptide
  Seed: LQSLLQHLI (PRAME_HUMAN)
LASLLQHLL

SEQ ID NO: 149151 - protein, 9 aa, Artificial Sequence
  Description of Artificial Sequence: Synthetic peptide
  Seed: RRWKLQVLD (PRAME_HUMAN)
RRWKLQVLS

SEQ ID NO: 149152 - protein, 9 aa, Artificial Sequence
  Description of Artificial Sequence: Synthetic peptide
  Seed: FYDPEPILC (PRAME_HUMAN)
FQDPEPILI

SEQ ID NO: 149153 - protein, 9 aa, Artificial Sequence
  Description of Artificial Sequence: Synthetic peptide
  Seed: KMILKMVQL (PRAME_HUMAN)
KSILKMVQV

SEQ ID NO: 149154 - protein, 9 aa, Artificial Sequence
  Description of Artificial Sequence: Synthetic peptide
  Seed: HVMNPLETL (PRAME_HUMAN)
HPMNPLETY

SEQ ID NO: 149155 - protein, 9 aa, Artificial Sequence
  Description of Artificial Sequence: Synthetic peptide
  Seed: RRWKLQVLD (PRAME_HUMAN)
RRWKLQVLT

SEQ ID NO: 149156 - protein, 10 aa, Artificial Sequence
  Description of Artificial Sequence: Synthetic peptide
  Seed: RWKLQVLDLR (PRAME_HUMAN)
RAKLQVLDLR

SEQ ID NO: 149157 - protein, 9 aa, Artificial Sequence
  Description of Artificial Sequence: Synthetic peptide
  Seed: MINLRRLLL (PRAME_HUMAN)
MGNLRRLLM

SEQ ID NO: 149158 - protein, 10 aa, Artificial Sequence
  Description of Artificial Sequence: Synthetic peptide
  Seed: LKAMVQAWPF (PRAME_HUMAN)
LNAMVQAWPY

SEQ ID NO: 149159 - protein, 11 aa, Artificial Sequence
  Description of Artificial Sequence: Synthetic peptide
  Seed: RLWGSIQSRYI (PRAME_HUMAN)
RAWGSIQSRYW

SEQ ID NO: 149160 - protein, 9 aa, Artificial Sequence
  Description of Artificial Sequence: Synthetic peptide
  Seed: QPFIPVEVL (PRAME_HUMAN)
QAFIPVEVY

SEQ ID NO: 149161 - protein, 9 aa, Artificial Sequence
  Description of Artificial Sequence: Synthetic peptide
  Seed: SIQSRYISM (PRAME_HUMAN)
STQSRYISF

SEQ ID NO: 149162 - protein, 11 aa, Artificial Sequence
  Description of Artificial Sequence: Synthetic peptide
  Seed: QALYVDSLFFL (PRAME_HUMAN)
QTLYVDSLFFL

SEQ ID NO: 149163 - protein, 8 aa, Artificial Sequence
  Description of Artificial Sequence: Synthetic peptide
  Seed: AQFTSQFL (PRAME_HUMAN)
AQFTSQFV

SEQ ID NO: 149164 - protein, 8 aa, Artificial Sequence
  Description of Artificial Sequence: Synthetic peptide
  Seed: VKRKKNVL (PRAME_HUMAN)
VMRKKNVL

SEQ ID NO: 149165 - protein, 9 aa, Artificial Sequence
  Description of Artificial Sequence: Synthetic peptide
  Seed: SVLSLSGVM (PRAME_HUMAN)
SRLSLSGVY

SEQ ID NO: 149166 - protein, 11 aa, Artificial Sequence
  Description of Artificial Sequence: Synthetic peptide
  Seed: LIGLSNLTHVL (PRAME_HUMAN)
LFGLSNLTHVV

SEQ ID NO: 149167 - protein, 10 aa, Artificial Sequence
  Description of Artificial Sequence: Synthetic peptide
  Seed: AMVQAWPFTC (PRAME_HUMAN)
AWVQAWPFTV

SEQ ID NO: 149168 - protein, 10 aa, Artificial Sequence
  Description of Artificial Sequence: Synthetic peptide
  Seed: ASATLQDLVF (PRAME_HUMAN)
AQATLQDLVF

SEQ ID NO: 149169 - protein, 8 aa, Artificial Sequence
  Description of Artificial Sequence: Synthetic peptide
  Seed: RLAYLHAR (PRAME_HUMAN)
RYAYLHAR

SEQ ID NO: 149170 - protein, 9 aa, Artificial Sequence
  Description of Artificial Sequence: Synthetic peptide
  Seed: ELFPPLFMA (PRAME_HUMAN)
EAFPPLFMT

SEQ ID NO: 149171 - protein, 9 aa, Artificial Sequence
  Description of Artificial Sequence: Synthetic peptide
  Seed: ALQSLLQHL (PRAME_HUMAN)
AVQSLLQHV

SEQ ID NO: 149172 - protein, 10 aa, Artificial Sequence
  Description of Artificial Sequence: Synthetic peptide
  Seed: LTHVLYPVPL (PRAME_HUMAN)
LTHVLYPVPW

SEQ ID NO: 149173 - protein, 11 aa, Artificial Sequence
  Description of Artificial Sequence: Synthetic peptide
  Seed: KIFAMPMQDIK (PRAME_HUMAN)
KSFAMPMQDIK

SEQ ID NO: 149174 - protein, 9 aa, Artificial Sequence
  Description of Artificial Sequence: Synthetic peptide
  Seed: WTVWSGNRA (PRAME_HUMAN)
WTVWSGNRV

SEQ ID NO: 149175 - protein, 9 aa, Artificial Sequence
  Description of Artificial Sequence: Synthetic peptide
  Seed: GQHLHLETF (PRAME_HUMAN)
GMHLHLETV

SEQ ID NO: 149176 - protein, 9 aa, Artificial Sequence
  Description of Artificial Sequence: Synthetic peptide
  Seed: RLWGSIQSR (PRAME_HUMAN)
RFWGSIQSY

SEQ ID NO: 149177 - protein, 10 aa, Artificial Sequence
  Description of Artificial Sequence: Synthetic peptide
  Seed: KDEALAIAAL (PRAME_HUMAN)
KNEALAIAAA

SEQ ID NO: 149178 - protein, 10 aa, Artificial Sequence
  Description of Artificial Sequence: Synthetic peptide
  Seed: TWKLPTLAKF (PRAME_HUMAN)
TYKLPTLAKF

SEQ ID NO: 149179 - protein, 11 aa, Artificial Sequence
  Description of Artificial Sequence: Synthetic peptide
  Seed: IQSRYISMSVW (PRAME_HUMAN)
IQSRYISMSVF

SEQ ID NO: 149180 - protein, 10 aa, Artificial Sequence
  Description of Artificial Sequence: Synthetic peptide
  Seed: FYDPEPILCP (PRAME_HUMAN)
FADPEPILCF

SEQ ID NO: 149181 - protein, 9 aa, Artificial Sequence
  Description of Artificial Sequence: Synthetic peptide
  Seed: IPVEVLVDL (PRAME_HUMAN)
IPVEVLVDM

SEQ ID NO: 149182 - protein, 9 aa, Artificial Sequence
  Description of Artificial Sequence: Synthetic peptide
  Seed: IPVEVLVDL (PRAME_HUMAN)
IQVEVLVDF

SEQ ID NO: 149183 - protein, 10 aa, Artificial Sequence
  Description of Artificial Sequence: Synthetic peptide
  Seed: MNPLETLSIT (PRAME_HUMAN)
MSPLETLSIA

SEQ ID NO: 149184 - protein, 10 aa, Artificial Sequence
  Description of Artificial Sequence: Synthetic peptide
  Seed: ISISALQSLL (PRAME_HUMAN)
IQISALQSLV

SEQ ID NO: 149185 - protein, 9 aa, Artificial Sequence
  Description of Artificial Sequence: Synthetic peptide
  Seed: MHLSQSPSV (PRAME_HUMAN)
MMLSQSPSL

SEQ ID NO: 149186 - protein, 8 aa, Artificial Sequence
  Description of Artificial Sequence: Synthetic peptide
  Seed: DQLLRHVM (PRAME_HUMAN)
DMLLRHVL

SEQ ID NO: 149187 - protein, 9 aa, Artificial Sequence
  Description of Artificial Sequence: Synthetic peptide
  Seed: YLHARLREL (PRAME_HUMAN)
YAHARLREY

SEQ ID NO: 149188 - protein, 9 aa, Artificial Sequence
  Description of Artificial Sequence: Synthetic peptide
  Seed: ISISALQSL (PRAME_HUMAN)
IRISALQSI

SEQ ID NO: 149189 - protein, 9 aa, Artificial Sequence
  Description of Artificial Sequence: Synthetic peptide
  Seed: ISPEKEEQY (PRAME_HUMAN)
IVPEKEEQY

SEQ ID NO: 149190 - protein, 9 aa, Artificial Sequence
  Description of Artificial Sequence: Synthetic peptide
  Seed: QSRYISMSV (PRAME_HUMAN)
QSRYISMSS

SEQ ID NO: 149191 - protein, 9 aa, Artificial Sequence
  Description of Artificial Sequence: Synthetic peptide
  Seed: ACDELFSYL (PRAME_HUMAN)
ASDELFSYM

SEQ ID NO: 149192 - protein, 9 aa, Artificial Sequence
  Description of Artificial Sequence: Synthetic peptide
  Seed: LSHIHASSY (PRAME_HUMAN)
LKHIHASSL

SEQ ID NO: 149193 - protein, 9 aa, Artificial Sequence
  Description of Artificial Sequence: Synthetic peptide
  Seed: RLRELLCEL (PRAME_HUMAN)
RQRELLCEK

SEQ ID NO: 149194 - protein, 9 aa, Artificial Sequence
  Description of Artificial Sequence: Synthetic peptide
  Seed: SQSPSVSQL (PRAME_HUMAN)
SSSPSVSQH

SEQ ID NO: 149195 - protein, 9 aa, Artificial Sequence
  Description of Artificial Sequence: Synthetic peptide
  Seed: GLSNLTHVL (PRAME_HUMAN)
GISNLTHVW

SEQ ID NO: 149196 - protein, 10 aa, Artificial Sequence
  Description of Artificial Sequence: Synthetic peptide
  Seed: ERLAYLHARL (PRAME_HUMAN)
EYLAYLHARV

SEQ ID NO: 149197 - protein, 10 aa, Artificial Sequence
  Description of Artificial Sequence: Synthetic peptide
  Seed: ETFKAVLDGL (PRAME_HUMAN)
ESFKAVLDGK

SEQ ID NO: 149198 - protein, 10 aa, Artificial Sequence
  Description of Artificial Sequence: Synthetic peptide
  Seed: VLYPVPLESY (PRAME_HUMAN)
VAYPVPLESL

SEQ ID NO: 149199 - protein, 9 aa, Artificial Sequence
  Description of Artificial Sequence: Synthetic peptide
  Seed: FTCLPLGVL (PRAME_HUMAN)
FACLPLGVM

SEQ ID NO: 149200 - protein, 10 aa, Artificial Sequence
  Description of Artificial Sequence: Synthetic peptide
  Seed: RLWGSIQSRY (PRAME_HUMAN)
RQWGSIQSRY

SEQ ID NO: 149201 - protein, 9 aa, Artificial Sequence
  Description of Artificial Sequence: Synthetic peptide
  Seed: KAMVQAWPF (PRAME_HUMAN)
KCMVQAWPW

SEQ ID NO: 149202 - protein, 10 aa, Artificial Sequence
  Description of Artificial Sequence: Synthetic peptide
  Seed: AALELLPREL (PRAME_HUMAN)
ATLELLPREW

SEQ ID NO: 149203 - protein, 9 aa, Artificial Sequence
  Description of Artificial Sequence: Synthetic peptide
  Seed: YLGQMINLR (PRAME_HUMAN)
YMGQMINLK

SEQ ID NO: 149204 - protein, 10 aa, Artificial Sequence
  Description of Artificial Sequence: Synthetic peptide
  Seed: KIFAMPMQDI (PRAME_HUMAN)
KMFAMPMQDI

SEQ ID NO: 149205 - protein, 10 aa, Artificial Sequence
  Description of Artificial Sequence: Synthetic peptide
  Seed: LSQSPSVSQL (PRAME_HUMAN)
LNQSPSVSQY

SEQ ID NO: 149206 - protein, 10 aa, Artificial Sequence
  Description of Artificial Sequence: Synthetic peptide
  Seed: SVLSLSGVML (PRAME_HUMAN)
SLLSLSGVML

SEQ ID NO: 149207 - protein, 10 aa, Artificial Sequence
  Description of Artificial Sequence: Synthetic peptide
  Seed: AVLDGLDVLL (PRAME_HUMAN)
AALDGLDVLY

SEQ ID NO: 149208 - protein, 9 aa, Artificial Sequence
  Description of Artificial Sequence: Synthetic peptide
  Seed: QLLALLPSL (PRAME_HUMAN)
QTLALLPSY

SEQ ID NO: 149209 - protein, 8 aa, Artificial Sequence
  Description of Artificial Sequence: Synthetic peptide
  Seed: YEDIHGTL (PRAME_HUMAN)
YQDIHGTV

SEQ ID NO: 149210 - protein, 10 aa, Artificial Sequence
  Description of Artificial Sequence: Synthetic peptide
  Seed: GLSNLTHVLY (PRAME_HUMAN)
GMSNLTHVLK

SEQ ID NO: 149211 - protein, 9 aa, Artificial Sequence
  Description of Artificial Sequence: Synthetic peptide
  Seed: SISALQSLL (PRAME_HUMAN)
SISALQSLY

SEQ ID NO: 149212 - protein, 9 aa, Artificial Sequence
  Description of Artificial Sequence: Synthetic peptide
  Seed: MHLSQSPSV (PRAME_HUMAN)
MALSQSPSM

SEQ ID NO: 149213 - protein, 9 aa, Artificial Sequence
  Description of Artificial Sequence: Synthetic peptide
  Seed: WSGNRASLY (PRAME_HUMAN)
WTGNRASLW

SEQ ID NO: 149214 - protein, 10 aa, Artificial Sequence
  Description of Artificial Sequence: Synthetic peptide
  Seed: LFPPLFMAAF (PRAME_HUMAN)
LYPPLFMAAL

SEQ ID NO: 149215 - protein, 10 aa, Artificial Sequence
  Description of Artificial Sequence: Synthetic peptide
  Seed: MPMQDIKMIL (PRAME_HUMAN)
MKMQDIKMIL

SEQ ID NO: 149216 - protein, 10 aa, Artificial Sequence
  Description of Artificial Sequence: Synthetic peptide
  Seed: RLWGSIQSRY (PRAME_HUMAN)
RVWGSIQSRR

SEQ ID NO: 149217 - protein, 9 aa, Artificial Sequence
  Description of Artificial Sequence: Synthetic peptide
  Seed: YSFPEPEAA (PRAME_HUMAN)
YQFPEPEAM

SEQ ID NO: 149218 - protein, 9 aa, Artificial Sequence
  Description of Artificial Sequence: Synthetic peptide
  Seed: SQSPSVSQL (PRAME_HUMAN)
SASPSVSQM

SEQ ID NO: 149219 - protein, 9 aa, Artificial Sequence
  Description of Artificial Sequence: Synthetic peptide
  Seed: WKLPTLAKF (PRAME_HUMAN)
WLLPTLAKF

SEQ ID NO: 149220 - protein, 9 aa, Artificial Sequence
  Description of Artificial Sequence: Synthetic peptide
  Seed: TDDQLLALL (PRAME_HUMAN)
TLDQLLALL

SEQ ID NO: 149221 - protein, 9 aa, Artificial Sequence
  Description of Artificial Sequence: Synthetic peptide
  Seed: ESYEDIHGT (PRAME_HUMAN)
ETYEDIHGI

SEQ ID NO: 149222 - protein, 8 aa, Artificial Sequence
  Description of Artificial Sequence: Synthetic peptide
  Seed: LFPPLFMA (PRAME_HUMAN)
LFPPLFMV

SEQ ID NO: 149223 - protein, 10 aa, Artificial Sequence
  Description of Artificial Sequence: Synthetic peptide
  Seed: RYISMSVWTS (PRAME_HUMAN)
RYISMSVWTW

SEQ ID NO: 149224 - protein, 9 aa, Artificial Sequence
  Description of Artificial Sequence: Synthetic peptide
  Seed: ISISALQSL (PRAME_HUMAN)
ITISALQSV

SEQ ID NO: 149225 - protein, 9 aa, Artificial Sequence
  Description of Artificial Sequence: Synthetic peptide
  Seed: SVLSLSGVM (PRAME_HUMAN)
SQLSLSGVW

SEQ ID NO: 149226 - protein, 9 aa, Artificial Sequence
  Description of Artificial Sequence: Synthetic peptide
  Seed: FYDPEPILC (PRAME_HUMAN)
FQDPEPILV

SEQ ID NO: 149227 - protein, 9 aa, Artificial Sequence
  Description of Artificial Sequence: Synthetic peptide
  Seed: YGNSISISA (PRAME_HUMAN)
YSNSISISI

SEQ ID NO: 149228 - protein, 9 aa, Artificial Sequence
  Description of Artificial Sequence: Synthetic peptide
  Seed: QLLALLPSL (PRAME_HUMAN)
QLLALLPSI

SEQ ID NO: 149229 - protein, 10 aa, Artificial Sequence
  Description of Artificial Sequence: Synthetic peptide
  Seed: HCSQLTTLSF (PRAME_HUMAN)
HHSQLTTLSF

SEQ ID NO: 149230 - protein, 10 aa, Artificial Sequence
  Description of Artificial Sequence: Synthetic peptide
  Seed: LKAMVQAWPF (PRAME_HUMAN)
LNAMVQAWPW

SEQ ID NO: 149231 - protein, 10 aa, Artificial Sequence
  Description of Artificial Sequence: Synthetic peptide
  Seed: LSFYGNSISI (PRAME_HUMAN)
LPFYGNSISF

SEQ ID NO: 149232 - protein, 9 aa, Artificial Sequence
  Description of Artificial Sequence: Synthetic peptide
  Seed: QSRYISMSV (PRAME_HUMAN)
QSRYISMSY

SEQ ID NO: 149233 - protein, 9 aa, Artificial Sequence
  Description of Artificial Sequence: Synthetic peptide
  Seed: IAQFTSQFL (PRAME_HUMAN)
ITQFTSQFM

SEQ ID NO: 149234 - protein, 10 aa, Artificial Sequence
  Description of Artificial Sequence: Synthetic peptide
  Seed: KDEALAIAAL (PRAME_HUMAN)
KYEALAIAAA

SEQ ID NO: 149235 - protein, 9 aa, Artificial Sequence
  Description of Artificial Sequence: Synthetic peptide
  Seed: YISMSVWTS (PRAME_HUMAN)
YTSMSVWTA

SEQ ID NO: 149236 - protein, 9 aa, Artificial Sequence
  Description of Artificial Sequence: Synthetic peptide
  Seed: HGTLHLERL (PRAME_HUMAN)
HHTLHLERL

SEQ ID NO: 149237 - protein, 11 aa, Artificial Sequence
  Description of Artificial Sequence: Synthetic peptide
  Seed: RLWGSIQSRYI (PRAME_HUMAN)
RQWGSIQSRYW

SEQ ID NO: 149238 - protein, 11 aa, Artificial Sequence
  Description of Artificial Sequence: Synthetic peptide
  Seed: MKGQHLHLETF (PRAME_HUMAN)
MFGQHLHLETF

SEQ ID NO: 149239 - protein, 9 aa, Artificial Sequence
  Description of Artificial Sequence: Synthetic peptide
  Seed: ALELLPREL (PRAME_HUMAN)
AAELLPREL

SEQ ID NO: 149240 - protein, 10 aa, Artificial Sequence
  Description of Artificial Sequence: Synthetic peptide
  Seed: RLVELAGQSL (PRAME_HUMAN)
RAVELAGQSM

SEQ ID NO: 149241 - protein, 9 aa, Artificial Sequence
  Description of Artificial Sequence: Synthetic peptide
  Seed: LYVDSLFFL (PRAME_HUMAN)
LWVDSLFFI

SEQ ID NO: 149242 - protein, 9 aa, Artificial Sequence
  Description of Artificial Sequence: Synthetic peptide
  Seed: VSPEPLQAL (PRAME_HUMAN)
VIPEPLQAV

SEQ ID NO: 149243 - protein, 9 aa, Artificial Sequence
  Description of Artificial Sequence: Synthetic peptide
  Seed: SVWTSPRRL (PRAME_HUMAN)
STWTSPRRY

SEQ ID NO: 149244 - protein, 11 aa, Artificial Sequence
  Description of Artificial Sequence: Synthetic peptide
  Seed: LQSLLQHLIGL (PRAME_HUMAN)
LSSLLQHLIGV

SEQ ID NO: 149245 - protein, 9 aa, Artificial Sequence
  Description of Artificial Sequence: Synthetic peptide
  Seed: FLRGRLDQL (PRAME_HUMAN)
FTRGRLDQM

SEQ ID NO: 149246 - protein, 10 aa, Artificial Sequence
  Description of Artificial Sequence: Synthetic peptide
  Seed: LERLAYLHAR (PRAME_HUMAN)
LQRLAYLHAK

SEQ ID NO: 149247 - protein, 9 aa, Artificial Sequence
  Description of Artificial Sequence: Synthetic peptide
  Seed: ISISALQSL (PRAME_HUMAN)
IMISALQSV

SEQ ID NO: 149248 - protein, 9 aa, Artificial Sequence
  Description of Artificial Sequence: Synthetic peptide
  Seed: SIQSRYISM (PRAME_HUMAN)
SRQSRYISY

SEQ ID NO: 149249 - protein, 9 aa, Artificial Sequence
  Description of Artificial Sequence: Synthetic peptide
  Seed: QSRYISMSV (PRAME_HUMAN)
QIRYISMSW

SEQ ID NO: 149250 - protein, 10 aa, Artificial Sequence
  Description of Artificial Sequence: Synthetic peptide
  Seed: RELFPPLFMA (PRAME_HUMAN)
RYLFPPLFMM

SEQ ID NO: 149251 - protein, 9 aa, Artificial Sequence
  Description of Artificial Sequence: Synthetic peptide
  Seed: LPRELFPPL (PRAME_HUMAN)
LQRELFPPY

SEQ ID NO: 149252 - protein, 10 aa, Artificial Sequence
  Description of Artificial Sequence: Synthetic peptide
  Seed: LLLSHIHASS (PRAME_HUMAN)
LPLSHIHASL

SEQ ID NO: 149253 - protein, 9 aa, Artificial Sequence
  Description of Artificial Sequence: Synthetic peptide
  Seed: RELFPPLFM (PRAME_HUMAN)
RQLFPPLFY

SEQ ID NO: 149254 - protein, 9 aa, Artificial Sequence
  Description of Artificial Sequence: Synthetic peptide
  Seed: KEEQYIAQF (PRAME_HUMAN)
KQEQYIAQM

SEQ ID NO: 149255 - protein, 10 aa, Artificial Sequence
  Description of Artificial Sequence: Synthetic peptide
  Seed: SLYSFPEPEA (PRAME_HUMAN)
SQYSFPEPEV

SEQ ID NO: 149256 - protein, 10 aa, Artificial Sequence
  Description of Artificial Sequence: Synthetic peptide
  Seed: RRLWGSIQSR (PRAME_HUMAN)
RRLWGSIQSI

SEQ ID NO: 149257 - protein, 9 aa, Artificial Sequence
  Description of Artificial Sequence: Synthetic peptide
  Seed: SQLSVLSLS (PRAME_HUMAN)
SILSVLSLL

SEQ ID NO: 149258 - protein, 9 aa, Artificial Sequence
  Description of Artificial Sequence: Synthetic peptide
  Seed: RRWKLQVLD (PRAME_HUMAN)
RKWKLQVLV

SEQ ID NO: 149259 - protein, 8 aa, Artificial Sequence
  Description of Artificial Sequence: Synthetic peptide
  Seed: LSFYGNSI (PRAME_HUMAN)
LSFYGNSF

SEQ ID NO: 149260 - protein, 9 aa, Artificial Sequence
  Description of Artificial Sequence: Synthetic peptide
  Seed: ALAIAALEL (PRAME_HUMAN)
AGAIAALEY

SEQ ID NO: 149261 - protein, 9 aa, Artificial Sequence
  Description of Artificial Sequence: Synthetic peptide
  Seed: FYDPEPILC (PRAME_HUMAN)
FCDPEPILF

SEQ ID NO: 149262 - protein, 9 aa, Artificial Sequence
  Description of Artificial Sequence: Synthetic peptide
  Seed: ACDELFSYL (PRAME_HUMAN)
ATDELFSYV

SEQ ID NO: 149263 - protein, 10 aa, Artificial Sequence
  Description of Artificial Sequence: Synthetic peptide
  Seed: LSFYGNSISI (PRAME_HUMAN)
LQFYGNSISL

SEQ ID NO: 149264 - protein, 10 aa, Artificial Sequence
  Description of Artificial Sequence: Synthetic peptide
  Seed: SLLKDEALAI (PRAME_HUMAN)
SILKDEALAV

SEQ ID NO: 149265 - protein, 9 aa, Artificial Sequence
  Description of Artificial Sequence: Synthetic peptide
  Seed: TDDQLLALL (PRAME_HUMAN)
TSDQLLALM

SEQ ID NO: 149266 - protein, 9 aa, Artificial Sequence
  Description of Artificial Sequence: Synthetic peptide
  Seed: FSYLIEKVK (PRAME_HUMAN)
FAYLIEKVR

SEQ ID NO: 149267 - protein, 9 aa, Artificial Sequence
  Description of Artificial Sequence: Synthetic peptide
  Seed: EAAQPMTKK (PRAME_HUMAN)
EVAQPMTKF

SEQ ID NO: 149268 - protein, 10 aa, Artificial Sequence
  Description of Artificial Sequence: Synthetic peptide
  Seed: RHVMNPLETL (PRAME_HUMAN)
RSVMNPLETM

SEQ ID NO: 149269 - protein, 9 aa, Artificial Sequence
  Description of Artificial Sequence: Synthetic peptide
  Seed: VQAWPFTCL (PRAME_HUMAN)
VAAWPFTCV

SEQ ID NO: 149270 - protein, 8 aa, Artificial Sequence
  Description of Artificial Sequence: Synthetic peptide
  Seed: ITDDQLLA (PRAME_HUMAN)
ISDDQLLV

SEQ ID NO: 149271 - protein, 9 aa, Artificial Sequence
  Description of Artificial Sequence: Synthetic peptide
  Seed: MINLRRLLL (PRAME_HUMAN)
MVNLRRLLY

SEQ ID NO: 149272 - protein, 9 aa, Artificial Sequence
  Description of Artificial Sequence: Synthetic peptide
  Seed: RGRLDQLLR (PRAME_HUMAN)
RGRLDQLLK

SEQ ID NO: 149273 - protein, 10 aa, Artificial Sequence
  Description of Artificial Sequence: Synthetic peptide
  Seed: LLSHIHASSY (PRAME_HUMAN)
LWSHIHASSW

SEQ ID NO: 149274 - protein, 9 aa, Artificial Sequence
  Description of Artificial Sequence: Synthetic peptide
  Seed: SLSHCSQLT (PRAME_HUMAN)
SLSHCSQLM

SEQ ID NO: 149275 - protein, 10 aa, Artificial Sequence
  Description of Artificial Sequence: Synthetic peptide
  Seed: LTDVSPEPLQ (PRAME_HUMAN)
LSDVSPEPLY

SEQ ID NO: 149276 - protein, 11 aa, Artificial Sequence
  Description of Artificial Sequence: Synthetic peptide
  Seed: VMLTDVSPEPL (PRAME_HUMAN)
VLLTDVSPEPV

SEQ ID NO: 149277 - protein, 8 aa, Artificial Sequence
  Description of Artificial Sequence: Synthetic peptide
  Seed: LKIFAMPM (PRAME_HUMAN)
LQIFAMPF

SEQ ID NO: 149278 - protein, 9 aa, Artificial Sequence
  Description of Artificial Sequence: Synthetic peptide
  Seed: IPVEVLVDL (PRAME_HUMAN)
IMVEVLVDY

SEQ ID NO: 149279 - protein, 9 aa, Artificial Sequence
  Description of Artificial Sequence: Synthetic peptide
  Seed: ASSYISPEK (PRAME_HUMAN)
AQSYISPEK

SEQ ID NO: 149280 - protein, 9 aa, Artificial Sequence
  Description of Artificial Sequence: Synthetic peptide
  Seed: HVMNPLETL (PRAME_HUMAN)
HAMNPLETL

SEQ ID NO: 149281 - protein, 10 aa, Artificial Sequence
  Description of Artificial Sequence: Synthetic peptide
  Seed: LLPRELFPPL (PRAME_HUMAN)
LKPRELFPPM

SEQ ID NO: 149282 - protein, 11 aa, Artificial Sequence
  Description of Artificial Sequence: Synthetic peptide
  Seed: RLWGSIQSRYI (PRAME_HUMAN)
RMWGSIQSRYW

SEQ ID NO: 149283 - protein, 10 aa, Artificial Sequence
  Description of Artificial Sequence: Synthetic peptide
  Seed: SISISALQSL (PRAME_HUMAN)
SWSISALQSY

SEQ ID NO: 149284 - protein, 9 aa, Artificial Sequence
  Description of Artificial Sequence: Synthetic peptide
  Seed: QDIKMILKM (PRAME_HUMAN)
QDIKMILKL

SEQ ID NO: 149285 - protein, 9 aa, Artificial Sequence
  Description of Artificial Sequence: Synthetic peptide
  Seed: SRYISMSVW (PRAME_HUMAN)
SHYISMSVY

SEQ ID NO: 149286 - protein, 10 aa, Artificial Sequence
  Description of Artificial Sequence: Synthetic peptide
  Seed: SMVWLSANPC (PRAME_HUMAN)
SLVWLSANPA

SEQ ID NO: 149287 - protein, 9 aa, Artificial Sequence
  Description of Artificial Sequence: Synthetic peptide
  Seed: ASSYISPEK (PRAME_HUMAN)
AISYISPER

SEQ ID NO: 149288 - protein, 10 aa, Artificial Sequence
  Description of Artificial Sequence: Synthetic peptide
  Seed: FPEPEAAQPM (PRAME_HUMAN)
FPEPEAAQPL

SEQ ID NO: 149289 - protein, 10 aa, Artificial Sequence
  Description of Artificial Sequence: Synthetic peptide
  Seed: LLSHIHASSY (PRAME_HUMAN)
LHSHIHASSY

SEQ ID NO: 149290 - protein, 10 aa, Artificial Sequence
  Description of Artificial Sequence: Synthetic peptide
  Seed: VLYPVPLESY (PRAME_HUMAN)
VTYPVPLESM

SEQ ID NO: 149291 - protein, 8 aa, Artificial Sequence
  Description of Artificial Sequence: Synthetic peptide
  Seed: FYDPEPIL (PRAME_HUMAN)
FQDPEPIL

SEQ ID NO: 149292 - protein, 9 aa, Artificial Sequence
  Description of Artificial Sequence: Synthetic peptide
  Seed: SLSHCSQLT (PRAME_HUMAN)
SQSHCSQLV

SEQ ID NO: 149293 - protein, 8 aa, Artificial Sequence
  Description of Artificial Sequence: Synthetic peptide
  Seed: FTSQFLSL (PRAME_HUMAN)
FASQFLSM

SEQ ID NO: 149294 - protein, 10 aa, Artificial Sequence
  Description of Artificial Sequence: Synthetic peptide
  Seed: LYVDSLFFLR (PRAME_HUMAN)
LIVDSLFFLK

SEQ ID NO: 149295 - protein, 10 aa, Artificial Sequence
  Description of Artificial Sequence: Synthetic peptide
  Seed: PTLAKFSPYL (PRAME_HUMAN)
PYLAKFSPYM

SEQ ID NO: 149296 - protein, 9 aa, Artificial Sequence
  Description of Artificial Sequence: Synthetic peptide
  Seed: LMKGQHLHL (PRAME_HUMAN)
LLKGQHLHI

SEQ ID NO: 149297 - protein, 9 aa, Artificial Sequence
  Description of Artificial Sequence: Synthetic peptide
  Seed: KEEQYIAQF (PRAME_HUMAN)
KAEQYIAQF

SEQ ID NO: 149298 - protein, 11 aa, Artificial Sequence
  Description of Artificial Sequence: Synthetic peptide
  Seed: RTFYDPEPILC (PRAME_HUMAN)
RCFYDPEPILW

SEQ ID NO: 149299 - protein, 9 aa, Artificial Sequence
  Description of Artificial Sequence: Synthetic peptide
  Seed: SQFLSLQCL (PRAME_HUMAN)
SEFLSLQCA

SEQ ID NO: 149300 - protein, 9 aa, Artificial Sequence
  Description of Artificial Sequence: Synthetic peptide
  Seed: FLRGRLDQL (PRAME_HUMAN)
FPRGRLDQI

SEQ ID NO: 149301 - protein, 9 aa, Artificial Sequence
  Description of Artificial Sequence: Synthetic peptide
  Seed: CKKLKIFAM (PRAME_HUMAN)
CIKLKIFAL

SEQ ID NO: 149302 - protein, 9 aa, Artificial Sequence
  Description of Artificial Sequence: Synthetic peptide
  Seed: MHLSQSPSV (PRAME_HUMAN)
MQLSQSPSF

SEQ ID NO: 149303 - protein, 10 aa, Artificial Sequence
  Description of Artificial Sequence: Synthetic peptide
  Seed: SISISALQSL (PRAME_HUMAN)
SDSISALQSW

SEQ ID NO: 149304 - protein, 9 aa, Artificial Sequence
  Description of Artificial Sequence: Synthetic peptide
  Seed: GRLDQLLRH (PRAME_HUMAN)
GRLDQLLRV

SEQ ID NO: 149305 - protein, 9 aa, Artificial Sequence
  Description of Artificial Sequence: Synthetic peptide
  Seed: VSPEPLQAL (PRAME_HUMAN)
VPPEPLQAW

SEQ ID NO: 149306 - protein, 10 aa, Artificial Sequence
  Description of Artificial Sequence: Synthetic peptide
  Seed: IGLSNLTHVL (PRAME_HUMAN)
IMLSNLTHVI

SEQ ID NO: 149307 - protein, 9 aa, Artificial Sequence
  Description of Artificial Sequence: Synthetic peptide
  Seed: LSHIHASSY (PRAME_HUMAN)
LVHIHASSY

SEQ ID NO: 149308 - protein, 8 aa, Artificial Sequence
  Description of Artificial Sequence: Synthetic peptide
  Seed: RRLLLSHI (PRAME_HUMAN)
RRLLLSHL

SEQ ID NO: 149309 - protein, 9 aa, Artificial Sequence
  Description of Artificial Sequence: Synthetic peptide
  Seed: LDVLLAQEV (PRAME_HUMAN)
LEVLLAQEL

SEQ ID NO: 149310 - protein, 9 aa, Artificial Sequence
  Description of Artificial Sequence: Synthetic peptide
  Seed: LALLPSLSH (PRAME_HUMAN)
LQLLPSLSA

SEQ ID NO: 149311 - protein, 9 aa, Artificial Sequence
  Description of Artificial Sequence: Synthetic peptide
  Seed: KLKIFAMPM (PRAME_HUMAN)
KTKIFAMPR

SEQ ID NO: 149312 - protein, 9 aa, Artificial Sequence
  Description of Artificial Sequence: Synthetic peptide
  Seed: SQSPSVSQL (PRAME_HUMAN)
STSPSVSQL

SEQ ID NO: 149313 - protein, 9 aa, Artificial Sequence
  Description of Artificial Sequence: Synthetic peptide
  Seed: YSFPEPEAA (PRAME_HUMAN)
YMFPEPEAI

SEQ ID NO: 149314 - protein, 9 aa, Artificial Sequence
  Description of Artificial Sequence: Synthetic peptide
  Seed: RTFYDPEPI (PRAME_HUMAN)
RMFYDPEPA

SEQ ID NO: 149315 - protein, 11 aa, Artificial Sequence
  Description of Artificial Sequence: Synthetic peptide
  Seed: LLLSHIHASSY (PRAME_HUMAN)
LELSHIHASSW

SEQ ID NO: 149316 - protein, 9 aa, Artificial Sequence
  Description of Artificial Sequence: Synthetic peptide
  Seed: ACDELFSYL (PRAME_HUMAN)
ALDELFSYF

SEQ ID NO: 149317 - protein, 9 aa, Artificial Sequence
  Description of Artificial Sequence: Synthetic peptide
  Seed: LMKGQHLHL (PRAME_HUMAN)
LIKGQHLHF

SEQ ID NO: 149318 - protein, 10 aa, Artificial Sequence
  Description of Artificial Sequence: Synthetic peptide
  Seed: IKMILKMVQL (PRAME_HUMAN)
IFMILKMVQA

SEQ ID NO: 149319 - protein, 9 aa, Artificial Sequence
  Description of Artificial Sequence: Synthetic peptide
  Seed: LYVDSLFFL (PRAME_HUMAN)
LIVDSLFFT

SEQ ID NO: 149320 - protein, 9 aa, Artificial Sequence
  Description of Artificial Sequence: Synthetic peptide
  Seed: SIQSRYISM (PRAME_HUMAN)
SHQSRYISL

SEQ ID NO: 149321 - protein, 9 aa, Artificial Sequence
  Description of Artificial Sequence: Synthetic peptide
  Seed: YSFPEPEAA (PRAME_HUMAN)
YLFPEPEAT

SEQ ID NO: 149322 - protein, 8 aa, Artificial Sequence
  Description of Artificial Sequence: Synthetic peptide
  Seed: YEDIHGTL (PRAME_HUMAN)
YNDIHGTI

SEQ ID NO: 149323 - protein, 9 aa, Artificial Sequence
  Description of Artificial Sequence: Synthetic peptide
  Seed: ISPEKEEQY (PRAME_HUMAN)
IRPEKEEQM

SEQ ID NO: 149324 - protein, 9 aa, Artificial Sequence
  Description of Artificial Sequence: Synthetic peptide
  Seed: FMAAFDGRH (PRAME_HUMAN)
FQAAFDGRL

SEQ ID NO: 149325 - protein, 10 aa, Artificial Sequence
  Description of Artificial Sequence: Synthetic peptide
  Seed: RRLWGSIQSR (PRAME_HUMAN)
RELWGSIQSK

SEQ ID NO: 149326 - protein, 9 aa, Artificial Sequence
  Description of Artificial Sequence: Synthetic peptide
  Seed: LALLPSLSH (PRAME_HUMAN)
LNLLPSLSY

SEQ ID NO: 149327 - protein, 9 aa, Artificial Sequence
  Description of Artificial Sequence: Synthetic peptide
  Seed: RRLLLSHIH (PRAME_HUMAN)
RRLLLSHIM

SEQ ID NO: 149328 - protein, 10 aa, Artificial Sequence
  Description of Artificial Sequence: Synthetic peptide
  Seed: RLWGSIQSRY (PRAME_HUMAN)
RGWGSIQSRY

SEQ ID NO: 149329 - protein, 9 aa, Artificial Sequence
  Description of Artificial Sequence: Synthetic peptide
  Seed: RRWKLQVLD (PRAME_HUMAN)
RQWKLQVLV

SEQ ID NO: 149330 - protein, 11 aa, Artificial Sequence
  Description of Artificial Sequence: Synthetic peptide
  Seed: VQAWPFTCLPL (PRAME_HUMAN)
VLAWPFTCLPY

SEQ ID NO: 149331 - protein, 11 aa, Artificial Sequence
  Description of Artificial Sequence: Synthetic peptide
  Seed: RASATLQDLVF (PRAME_HUMAN)
RMSATLQDLVM

SEQ ID NO: 149332 - protein, 8 aa, Artificial Sequence
  Description of Artificial Sequence: Synthetic peptide
  Seed: YVDSLFFL (PRAME_HUMAN)
YVDSLFFV

SEQ ID NO: 149333 - protein, 9 aa, Artificial Sequence
  Description of Artificial Sequence: Synthetic peptide
  Seed: SHCSQLTTL (PRAME_HUMAN)
SRCSQLTTM

SEQ ID NO: 149334 - protein, 9 aa, Artificial Sequence
  Description of Artificial Sequence: Synthetic peptide
  Seed: SMVWLSANP (PRAME_HUMAN)
SMVWLSANA

SEQ ID NO: 149335 - protein, 10 aa, Artificial Sequence
  Description of Artificial Sequence: Synthetic peptide
  Seed: SPSVSQLSVL (PRAME_HUMAN)
SNSVSQLSVY

SEQ ID NO: 149336 - protein, 9 aa, Artificial Sequence
  Description of Artificial Sequence: Synthetic peptide
  Seed: VLDGLDVLL (PRAME_HUMAN)
VMDGLDVLV

SEQ ID NO: 149337 - protein, 10 aa, Artificial Sequence
  Description of Artificial Sequence: Synthetic peptide
  Seed: VLYPVPLESY (PRAME_HUMAN)
VMYPVPLESF

SEQ ID NO: 149338 - protein, 9 aa, Artificial Sequence
  Description of Artificial Sequence: Synthetic peptide
  Seed: RLAYLHARL (PRAME_HUMAN)
RLAYLHARV

SEQ ID NO: 149339 - protein, 9 aa, Artificial Sequence
  Description of Artificial Sequence: Synthetic peptide
  Seed: AWPFTCLPL (PRAME_HUMAN)
AFPFTCLPM

SEQ ID NO: 149340 - protein, 9 aa, Artificial Sequence
  Description of Artificial Sequence: Synthetic peptide
  Seed: FAMPMQDIK (PRAME_HUMAN)
FSMPMQDIM

SEQ ID NO: 149341 - protein, 11 aa, Artificial Sequence
  Description of Artificial Sequence: Synthetic peptide
  Seed: YISPEKEEQYI (PRAME_HUMAN)
YQSPEKEEQYW

SEQ ID NO: 149342 - protein, 8 aa, Artificial Sequence
  Description of Artificial Sequence: Synthetic peptide
  Seed: YEDIHGTL (PRAME_HUMAN)
YGDIHGTF

SEQ ID NO: 149343 - protein, 9 aa, Artificial Sequence
  Description of Artificial Sequence: Synthetic peptide
  Seed: LQSLLQHLI (PRAME_HUMAN)
LTSLLQHLV

SEQ ID NO: 149344 - protein, 8 aa, Artificial Sequence
  Description of Artificial Sequence: Synthetic peptide
  Seed: FIPVEVLV (PRAME_HUMAN)
FMPVEVLV

SEQ ID NO: 149345 - protein, 10 aa, Artificial Sequence
  Description of Artificial Sequence: Synthetic peptide
  Seed: SPSVSQLSVL (PRAME_HUMAN)
SESVSQLSVW

SEQ ID NO: 149346 - protein, 10 aa, Artificial Sequence
  Description of Artificial Sequence: Synthetic peptide
  Seed: MVQAWPFTCL (PRAME_HUMAN)
MKQAWPFTCM

SEQ ID NO: 149347 - protein, 11 aa, Artificial Sequence
  Description of Artificial Sequence: Synthetic peptide
  Seed: SNLTHVLYPVP (PRAME_HUMAN)
SLLTHVLYPVI

SEQ ID NO: 149348 - protein, 9 aa, Artificial Sequence
  Description of Artificial Sequence: Synthetic peptide
  Seed: ACDELFSYL (PRAME_HUMAN)
ASDELFSYW

SEQ ID NO: 149349 - protein, 10 aa, Artificial Sequence
  Description of Artificial Sequence: Synthetic peptide
  Seed: VLMKGQHLHL (PRAME_HUMAN)
VLMKGQHLHR

SEQ ID NO: 149350 - protein, 9 aa, Artificial Sequence
  Description of Artificial Sequence: Synthetic peptide
  Seed: QSRYISMSV (PRAME_HUMAN)
QTRYISMSW

SEQ ID NO: 149351 - protein, 10 aa, Artificial Sequence
  Description of Artificial Sequence: Synthetic peptide
  Seed: RELFPPLFMA (PRAME_HUMAN)
RFLFPPLFML

SEQ ID NO: 149352 - protein, 9 aa, Artificial Sequence
  Description of Artificial Sequence: Synthetic peptide
  Seed: TDDQLLALL (PRAME_HUMAN)
TTDQLLALF

SEQ ID NO: 149353 - protein, 9 aa, Artificial Sequence
  Description of Artificial Sequence: Synthetic peptide
  Seed: ESYEDIHGT (PRAME_HUMAN)
EIYEDIHGA

SEQ ID NO: 149354 - protein, 10 aa, Artificial Sequence
  Description of Artificial Sequence: Synthetic peptide
  Seed: SLLQHLIGLS (PRAME_HUMAN)
SMLQHLIGLI

SEQ ID NO: 149355 - protein, 10 aa, Artificial Sequence
  Description of Artificial Sequence: Synthetic peptide
  Seed: ALYVDSLFFL (PRAME_HUMAN)
AEYVDSLFFW

SEQ ID NO: 149356 - protein, 9 aa, Artificial Sequence
  Description of Artificial Sequence: Synthetic peptide
  Seed: VFDECGITD (PRAME_HUMAN)
VADECGITM

SEQ ID NO: 149357 - protein, 10 aa, Artificial Sequence
  Description of Artificial Sequence: Synthetic peptide
  Seed: AKFSPYLGQM (PRAME_HUMAN)
ARFSPYLGQL

SEQ ID NO: 149358 - protein, 11 aa, Artificial Sequence
  Description of Artificial Sequence: Synthetic peptide
  Seed: RTFYDPEPILC (PRAME_HUMAN)
RLFYDPEPILW

SEQ ID NO: 149359 - protein, 9 aa, Artificial Sequence
  Description of Artificial Sequence: Synthetic peptide
  Seed: LRKNSHQDF (PRAME_HUMAN)
LMKNSHQDY

SEQ ID NO: 149360 - protein, 9 aa, Artificial Sequence
  Description of Artificial Sequence: Synthetic peptide
  Seed: RTFYDPEPI (PRAME_HUMAN)
RMFYDPEPY

SEQ ID NO: 149361 - protein, 9 aa, Artificial Sequence
  Description of Artificial Sequence: Synthetic peptide
  Seed: RASATLQDL (PRAME_HUMAN)
RASATLQDM

SEQ ID NO: 149362 - protein, 10 aa, Artificial Sequence
  Description of Artificial Sequence: Synthetic peptide
  Seed: FAMPMQDIKM (PRAME_HUMAN)
FPMPMQDIKY

SEQ ID NO: 149363 - protein, 9 aa, Artificial Sequence
  Description of Artificial Sequence: Synthetic peptide
  Seed: LMKGQHLHL (PRAME_HUMAN)
LLKGQHLHY

SEQ ID NO: 149364 - protein, 9 aa, Artificial Sequence
  Description of Artificial Sequence: Synthetic peptide
  Seed: YIAQFTSQF (PRAME_HUMAN)
YNAQFTSQY

SEQ ID NO: 149365 - protein, 9 aa, Artificial Sequence
  Description of Artificial Sequence: Synthetic peptide
  Seed: VFDECGITD (PRAME_HUMAN)
VYDECGITV

SEQ ID NO: 149366 - protein, 10 aa, Artificial Sequence
  Description of Artificial Sequence: Synthetic peptide
  Seed: VELAGQSLLK (PRAME_HUMAN)
VTLAGQSLLK

SEQ ID NO: 149367 - protein, 9 aa, Artificial Sequence
  Description of Artificial Sequence: Synthetic peptide
  Seed: LQHLIGLSN (PRAME_HUMAN)
LQHLIGLSY

SEQ ID NO: 149368 - protein, 10 aa, Artificial Sequence
  Description of Artificial Sequence: Synthetic peptide
  Seed: IKMILKMVQL (PRAME_HUMAN)
IWMILKMVQV

SEQ ID NO: 149369 - protein, 9 aa, Artificial Sequence
  Description of Artificial Sequence: Synthetic peptide
  Seed: ITDDQLLAL (PRAME_HUMAN)
IYDDQLLAC

SEQ ID NO: 149370 - protein, 9 aa, Artificial Sequence
  Description of Artificial Sequence: Synthetic peptide
  Seed: VSPEPLQAL (PRAME_HUMAN)
VLPEPLQAM

SEQ ID NO: 149371 - protein, 10 aa, Artificial Sequence
  Description of Artificial Sequence: Synthetic peptide
  Seed: LKAMVQAWPF (PRAME_HUMAN)
LQAMVQAWPW

SEQ ID NO: 149372 - protein, 9 aa, Artificial Sequence
  Description of Artificial Sequence: Synthetic peptide
  Seed: VSQLSVLSL (PRAME_HUMAN)
VRQLSVLSY

SEQ ID NO: 149373 - protein, 11 aa, Artificial Sequence
  Description of Artificial Sequence: Synthetic peptide
  Seed: AAFDGRHSQTL (PRAME_HUMAN)
ASFDGRHSQTM

SEQ ID NO: 149374 - protein, 9 aa, Artificial Sequence
  Description of Artificial Sequence: Synthetic peptide
  Seed: QSRYISMSV (PRAME_HUMAN)
QVRYISMSI

SEQ ID NO: 149375 - protein, 9 aa, Artificial Sequence
  Description of Artificial Sequence: Synthetic peptide
  Seed: LSEGDVMHL (PRAME_HUMAN)
LYEGDVMHM

SEQ ID NO: 149376 - protein, 10 aa, Artificial Sequence
  Description of Artificial Sequence: Synthetic peptide
  Seed: RWKLQVLDLR (PRAME_HUMAN)
RVKLQVLDLR

SEQ ID NO: 149377 - protein, 9 aa, Artificial Sequence
  Description of Artificial Sequence: Synthetic peptide
  Seed: LSHIHASSY (PRAME_HUMAN)
LWHIHASSY

SEQ ID NO: 149378 - protein, 10 aa, Artificial Sequence
  Description of Artificial Sequence: Synthetic peptide
  Seed: LSQSPSVSQL (PRAME_HUMAN)
LRQSPSVSQM

SEQ ID NO: 149379 - protein, 9 aa, Artificial Sequence
  Description of Artificial Sequence: Synthetic peptide
  Seed: YSFPEPEAA (PRAME_HUMAN)
YSFPEPEAH

SEQ ID NO: 149380 - protein, 9 aa, Artificial Sequence
  Description of Artificial Sequence: Synthetic peptide
  Seed: LAYLHARLR (PRAME_HUMAN)
LSYLHARLR

SEQ ID NO: 149381 - protein, 10 aa, Artificial Sequence
  Description of Artificial Sequence: Synthetic peptide
  Seed: KAVLDGLDVL (PRAME_HUMAN)
KAVLDGLDVW

SEQ ID NO: 149382 - protein, 9 aa, Artificial Sequence
  Description of Artificial Sequence: Synthetic peptide
  Seed: VSPEPLQAL (PRAME_HUMAN)
VKPEPLQAY

SEQ ID NO: 149383 - protein, 9 aa, Artificial Sequence
  Description of Artificial Sequence: Synthetic peptide
  Seed: GQHLHLETF (PRAME_HUMAN)
GMHLHLETM

SEQ ID NO: 149384 - protein, 9 aa, Artificial Sequence
  Description of Artificial Sequence: Synthetic peptide
  Seed: WKLPTLAKF (PRAME_HUMAN)
WVLPTLAKF

SEQ ID NO: 149385 - protein, 9 aa, Artificial Sequence
  Description of Artificial Sequence: Synthetic peptide
  Seed: HLIGLSNLT (PRAME_HUMAN)
HIIGLSNLL

SEQ ID NO: 149386 - protein, 10 aa, Artificial Sequence
  Description of Artificial Sequence: Synthetic peptide
  Seed: ASATLQDLVF (PRAME_HUMAN)
ATATLQDLVF

SEQ ID NO: 149387 - protein, 10 aa, Artificial Sequence
  Description of Artificial Sequence: Synthetic peptide
  Seed: RRLWGSIQSR (PRAME_HUMAN)
RSLWGSIQSR

SEQ ID NO: 149388 - protein, 9 aa, Artificial Sequence
  Description of Artificial Sequence: Synthetic peptide
  Seed: SMSVWTSPR (PRAME_HUMAN)
SLSVWTSPY

SEQ ID NO: 149389 - protein, 9 aa, Artificial Sequence
  Description of Artificial Sequence: Synthetic peptide
  Seed: LLRHVMNPL (PRAME_HUMAN)
LTRHVMNPF

SEQ ID NO: 149390 - protein, 9 aa, Artificial Sequence
  Description of Artificial Sequence: Synthetic peptide
  Seed: QLLALLPSL (PRAME_HUMAN)
QILALLPSF

SEQ ID NO: 149391 - protein, 9 aa, Artificial Sequence
  Description of Artificial Sequence: Synthetic peptide
  Seed: ACDELFSYL (PRAME_HUMAN)
AADELFSYI

SEQ ID NO: 149392 - protein, 9 aa, Artificial Sequence
  Description of Artificial Sequence: Synthetic peptide
  Seed: KLKIFAMPM (PRAME_HUMAN)
KQKIFAMPW

SEQ ID NO: 149393 - protein, 9 aa, Artificial Sequence
  Description of Artificial Sequence: Synthetic peptide
  Seed: VSQLSVLSL (PRAME_HUMAN)
VLQLSVLSF

SEQ ID NO: 149394 - protein, 10 aa, Artificial Sequence
  Description of Artificial Sequence: Synthetic peptide
  Seed: MERRRLWGSI (PRAME_HUMAN)
MSRRRLWGSM

SEQ ID NO: 149395 - protein, 10 aa, Artificial Sequence
  Description of Artificial Sequence: Synthetic peptide
  Seed: LQALYVDSLF (PRAME_HUMAN)
LYALYVDSLW

SEQ ID NO: 149396 - protein, 9 aa, Artificial Sequence
  Description of Artificial Sequence: Synthetic peptide
  Seed: EDLEVTCTW (PRAME_HUMAN)
ESLEVTCTY

SEQ ID NO: 149397 - protein, 10 aa, Artificial Sequence
  Description of Artificial Sequence: Synthetic peptide
  Seed: ELFPPLFMAA (PRAME_HUMAN)
ETFPPLFMAI

SEQ ID NO: 149398 - protein, 10 aa, Artificial Sequence
  Description of Artificial Sequence: Synthetic peptide
  Seed: FFLRGRLDQL (PRAME_HUMAN)
FWLRGRLDQI

SEQ ID NO: 149399 - protein, 9 aa, Artificial Sequence
  Description of Artificial Sequence: Synthetic peptide
  Seed: HLIGLSNLT (PRAME_HUMAN)
HQIGLSNLV

SEQ ID NO: 149400 - protein, 9 aa, Artificial Sequence
  Description of Artificial Sequence: Synthetic peptide
  Seed: MNPLETLSI (PRAME_HUMAN)
MSPLETLSV

SEQ ID NO: 149401 - protein, 10 aa, Artificial Sequence
  Description of Artificial Sequence: Synthetic peptide
  Seed: SNLTHVLYPV (PRAME_HUMAN)
SVLTHVLYPA

SEQ ID NO: 149402 - protein, 9 aa, Artificial Sequence
  Description of Artificial Sequence: Synthetic peptide
  Seed: TLKAMVQAW (PRAME_HUMAN)
TQKAMVQAF

SEQ ID NO: 149403 - protein, 9 aa, Artificial Sequence
  Description of Artificial Sequence: Synthetic peptide
  Seed: LAIAALELL (PRAME_HUMAN)
LTIAALELY

SEQ ID NO: 149404 - protein, 9 aa, Artificial Sequence
  Description of Artificial Sequence: Synthetic peptide
  Seed: VQLDSIEDL (PRAME_HUMAN)
VQLDSIEDV

SEQ ID NO: 149405 - protein, 10 aa, Artificial Sequence
  Description of Artificial Sequence: Synthetic peptide
  Seed: YIAQFTSQFL (PRAME_HUMAN)
YTAQFTSQFI

SEQ ID NO: 149406 - protein, 9 aa, Artificial Sequence
  Description of Artificial Sequence: Synthetic peptide
  Seed: KLKIFAMPM (PRAME_HUMAN)
KFKIFAMPS

SEQ ID NO: 149407 - protein, 9 aa, Artificial Sequence
  Description of Artificial Sequence: Synthetic peptide
  Seed: TLAKFSPYL (PRAME_HUMAN)
TQAKFSPYV

SEQ ID NO: 149408 - protein, 11 aa, Artificial Sequence
  Description of Artificial Sequence: Synthetic peptide
  Seed: FSPYLGQMINL (PRAME_HUMAN)
FQPYLGQMINF

SEQ ID NO: 149409 - protein, 11 aa, Artificial Sequence
  Description of Artificial Sequence: Synthetic peptide
  Seed: LTDVSPEPLQA (PRAME_HUMAN)
LIDVSPEPLQL

SEQ ID NO: 149410 - protein, 11 aa, Artificial Sequence
  Description of Artificial Sequence: Synthetic peptide
  Seed: SYEDIHGTLHL (PRAME_HUMAN)
SYEDIHGTLHI

SEQ ID NO: 149411 - protein, 9 aa, Artificial Sequence
  Description of Artificial Sequence: Synthetic peptide
  Seed: TCTWKLPTL (PRAME_HUMAN)
TATWKLPTM

SEQ ID NO: 149412 - protein, 9 aa, Artificial Sequence
  Description of Artificial Sequence: Synthetic peptide
  Seed: FAMPMQDIK (PRAME_HUMAN)
FVMPMQDIY

SEQ ID NO: 149413 - protein, 9 aa, Artificial Sequence
  Description of Artificial Sequence: Synthetic peptide
  Seed: TSPRRLVEL (PRAME_HUMAN)
TAPRRLVEI

SEQ ID NO: 149414 - protein, 9 aa, Artificial Sequence
  Description of Artificial Sequence: Synthetic peptide
  Seed: SQLTTLSFY (PRAME_HUMAN)
SRLTTLSFY

SEQ ID NO: 149415 - protein, 8 aa, Artificial Sequence
  Description of Artificial Sequence: Synthetic peptide
  Seed: FYDPEPIL (PRAME_HUMAN)
FIDPEPIL

SEQ ID NO: 149416 - protein, 10 aa, Artificial Sequence
  Description of Artificial Sequence: Synthetic peptide
  Seed: LSFYGNSISI (PRAME_HUMAN)
LSFYGNSISL

SEQ ID NO: 149417 - protein, 10 aa, Artificial Sequence
  Description of Artificial Sequence: Synthetic peptide
  Seed: ESYEDIHGTL (PRAME_HUMAN)
EVYEDIHGTY

SEQ ID NO: 149418 - protein, 10 aa, Artificial Sequence
  Description of Artificial Sequence: Synthetic peptide
  Seed: LLPRELFPPL (PRAME_HUMAN)
LVPRELFPPI

SEQ ID NO: 149419 - protein, 10 aa, Artificial Sequence
  Description of Artificial Sequence: Synthetic peptide
  Seed: RLVELAGQSL (PRAME_HUMAN)
RQVELAGQSI

SEQ ID NO: 149420 - protein, 9 aa, Artificial Sequence
  Description of Artificial Sequence: Synthetic peptide
  Seed: YSFPEPEAA (PRAME_HUMAN)
YDFPEPEAF

SEQ ID NO: 149421 - protein, 10 aa, Artificial Sequence
  Description of Artificial Sequence: Synthetic peptide
  Seed: KNVLRLCCKK (PRAME_HUMAN)
KSVLRLCCKR

SEQ ID NO: 149422 - protein, 9 aa, Artificial Sequence
  Description of Artificial Sequence: Synthetic peptide
  Seed: LSHIHASSY (PRAME_HUMAN)
LYHIHASSL

SEQ ID NO: 149423 - protein, 9 aa, Artificial Sequence
  Description of Artificial Sequence: Synthetic peptide
  Seed: KLKIFAMPM (PRAME_HUMAN)
KMKIFAMPR

SEQ ID NO: 149424 - protein, 9 aa, Artificial Sequence
  Description of Artificial Sequence: Synthetic peptide
  Seed: AAFDGRHSQ (PRAME_HUMAN)
ACFDGRHSL

SEQ ID NO: 149425 - protein, 9 aa, Artificial Sequence
  Description of Artificial Sequence: Synthetic peptide
  Seed: FTCLPLGVL (PRAME_HUMAN)
FVCLPLGVV

SEQ ID NO: 149426 - protein, 9 aa, Artificial Sequence
  Description of Artificial Sequence: Synthetic peptide
  Seed: YEDIHGTLH (PRAME_HUMAN)
YEDIHGTLC

SEQ ID NO: 149427 - protein, 9 aa, Artificial Sequence
  Description of Artificial Sequence: Synthetic peptide
  Seed: ELAGQSLLK (PRAME_HUMAN)
ESAGQSLLR

SEQ ID NO: 149428 - protein, 10 aa, Artificial Sequence
  Description of Artificial Sequence: Synthetic peptide
  Seed: RHVMNPLETL (PRAME_HUMAN)
RNVMNPLETW

SEQ ID NO: 149429 - protein, 9 aa, Artificial Sequence
  Description of Artificial Sequence: Synthetic peptide
  Seed: KLKIFAMPM (PRAME_HUMAN)
KIKIFAMPG

SEQ ID NO: 149430 - protein, 9 aa, Artificial Sequence
  Description of Artificial Sequence: Synthetic peptide
  Seed: RLAYLHARL (PRAME_HUMAN)
RQAYLHARY

SEQ ID NO: 149431 - protein, 10 aa, Artificial Sequence
  Description of Artificial Sequence: Synthetic peptide
  Seed: FAMPMQDIKM (PRAME_HUMAN)
FSMPMQDIKV

SEQ ID NO: 149432 - protein, 9 aa, Artificial Sequence
  Description of Artificial Sequence: Synthetic peptide
  Seed: ELAGQSLLK (PRAME_HUMAN)
ETAGQSLLY

SEQ ID NO: 149433 - protein, 10 aa, Artificial Sequence
  Description of Artificial Sequence: Synthetic peptide
  Seed: RLSEGDVMHL (PRAME_HUMAN)
RMSEGDVMHR

SEQ ID NO: 149434 - protein, 10 aa, Artificial Sequence
  Description of Artificial Sequence: Synthetic peptide
  Seed: VTCTWKLPTL (PRAME_HUMAN)
VICTWKLPTI

SEQ ID NO: 149435 - protein, 9 aa, Artificial Sequence
  Description of Artificial Sequence: Synthetic peptide
  Seed: KMILKMVQL (PRAME_HUMAN)
KAILKMVQW

SEQ ID NO: 149436 - protein, 10 aa, Artificial Sequence
  Description of Artificial Sequence: Synthetic peptide
  Seed: RASATLQDLV (PRAME_HUMAN)
RTSATLQDLY

SEQ ID NO: 149437 - protein, 11 aa, Artificial Sequence
  Description of Artificial Sequence: Synthetic peptide
  Seed: AAFDGRHSQTL (PRAME_HUMAN)
AMFDGRHSQTW

SEQ ID NO: 149438 - protein, 9 aa, Artificial Sequence
  Description of Artificial Sequence: Synthetic peptide
  Seed: VWTSPRRLV (PRAME_HUMAN)
VYTSPRRLF

SEQ ID NO: 149439 - protein, 8 aa, Artificial Sequence
  Description of Artificial Sequence: Synthetic peptide
  Seed: YEDIHGTL (PRAME_HUMAN)
YYDIHGTY

SEQ ID NO: 149440 - protein, 10 aa, Artificial Sequence
  Description of Artificial Sequence: Synthetic peptide
  Seed: LLPRELFPPL (PRAME_HUMAN)
LDPRELFPPM

SEQ ID NO: 149441 - protein, 9 aa, Artificial Sequence
  Description of Artificial Sequence: Synthetic peptide
  Seed: GQMINLRRL (PRAME_HUMAN)
GQMINLRRF

SEQ ID NO: 149442 - protein, 10 aa, Artificial Sequence
  Description of Artificial Sequence: Synthetic peptide
  Seed: VLYPVPLESY (PRAME_HUMAN)
VAYPVPLESW

SEQ ID NO: 149443 - protein, 10 aa, Artificial Sequence
  Description of Artificial Sequence: Synthetic peptide
  Seed: SISISALQSL (PRAME_HUMAN)
SHSISALQSF

SEQ ID NO: 149444 - protein, 10 aa, Artificial Sequence
  Description of Artificial Sequence: Synthetic peptide
  Seed: FFLRGRLDQL (PRAME_HUMAN)
FNLRGRLDQV

SEQ ID NO: 149445 - protein, 10 aa, Artificial Sequence
  Description of Artificial Sequence: Synthetic peptide
  Seed: RELFPPLFMA (PRAME_HUMAN)
RWLFPPLFMV

SEQ ID NO: 149446 - protein, 10 aa, Artificial Sequence
  Description of Artificial Sequence: Synthetic peptide
  Seed: AFDGRHSQTL (PRAME_HUMAN)
AVDGRHSQTL

SEQ ID NO: 149447 - protein, 10 aa, Artificial Sequence
  Description of Artificial Sequence: Synthetic peptide
  Seed: RLVELAGQSL (PRAME_HUMAN)
RMVELAGQSM

SEQ ID NO: 149448 - protein, 11 aa, Artificial Sequence
  Description of Artificial Sequence: Synthetic peptide
  Seed: FYGNSISISAL (PRAME_HUMAN)
FYGNSISISAM

SEQ ID NO: 149449 - protein, 9 aa, Artificial Sequence
  Description of Artificial Sequence: Synthetic peptide
  Seed: KEEQYIAQF (PRAME_HUMAN)
KLEQYIAQF

SEQ ID NO: 149450 - protein, 9 aa, Artificial Sequence
  Description of Artificial Sequence: Synthetic peptide
  Seed: SHIHASSYI (PRAME_HUMAN)
SSIHASSYM

SEQ ID NO: 149451 - protein, 10 aa, Artificial Sequence
  Description of Artificial Sequence: Synthetic peptide
  Seed: GACDELFSYL (PRAME_HUMAN)
GVCDELFSYV

SEQ ID NO: 149452 - protein, 10 aa, Artificial Sequence
  Description of Artificial Sequence: Synthetic peptide
  Seed: MNPLETLSIT (PRAME_HUMAN)
MVPLETLSIA

SEQ ID NO: 149453 - protein, 9 aa, Artificial Sequence
  Description of Artificial Sequence: Synthetic peptide
  Seed: LSHIHASSY (PRAME_HUMAN)
LLHIHASSY

SEQ ID NO: 149454 - protein, 8 aa, Artificial Sequence
  Description of Artificial Sequence: Synthetic peptide
  Seed: VELAGQSL (PRAME_HUMAN)
VQLAGQSI

SEQ ID NO: 149455 - protein, 10 aa, Artificial Sequence
  Description of Artificial Sequence: Synthetic peptide
  Seed: RRRLWGSIQS (PRAME_HUMAN)
RRRLWGSIQI

SEQ ID NO: 149456 - protein, 9 aa, Artificial Sequence
  Description of Artificial Sequence: Synthetic peptide
  Seed: QTLKAMVQA (PRAME_HUMAN)
QVLKAMVQV

SEQ ID NO: 149457 - protein, 9 aa, Artificial Sequence
  Description of Artificial Sequence: Synthetic peptide
  Seed: RASATLQDL (PRAME_HUMAN)
RTSATLQDM

SEQ ID NO: 149458 - protein, 9 aa, Artificial Sequence
  Description of Artificial Sequence: Synthetic peptide
  Seed: KVDGLSTEA (PRAME_HUMAN)
KGDGLSTEF

SEQ ID NO: 149459 - protein, 10 aa, Artificial Sequence
  Description of Artificial Sequence: Synthetic peptide
  Seed: LSFYGNSISI (PRAME_HUMAN)
LFFYGNSISY

SEQ ID NO: 149460 - protein, 9 aa, Artificial Sequence
  Description of Artificial Sequence: Synthetic peptide
  Seed: HLIGLSNLT (PRAME_HUMAN)
HQIGLSNLL

SEQ ID NO: 149461 - protein, 10 aa, Artificial Sequence
  Description of Artificial Sequence: Synthetic peptide
  Seed: HASSYISPEK (PRAME_HUMAN)
HCSSYISPER

SEQ ID NO: 149462 - protein, 9 aa, Artificial Sequence
  Description of Artificial Sequence: Synthetic peptide
  Seed: LALLPSLSH (PRAME_HUMAN)
LMLLPSLSW

SEQ ID NO: 149463 - protein, 9 aa, Artificial Sequence
  Description of Artificial Sequence: Synthetic peptide
  Seed: TLHLERLAY (PRAME_HUMAN)
TPHLERLAM

SEQ ID NO: 149464 - protein, 9 aa, Artificial Sequence
  Description of Artificial Sequence: Synthetic peptide
  Seed: AVLDGLDVL (PRAME_HUMAN)
ALLDGLDVT

SEQ ID NO: 149465 - protein, 10 aa, Artificial Sequence
  Description of Artificial Sequence: Synthetic peptide
  Seed: IQSRYISMSV (PRAME_HUMAN)
IMSRYISMSL

SEQ ID NO: 149466 - protein, 9 aa, Artificial Sequence
  Description of Artificial Sequence: Synthetic peptide
  Seed: LQALYVDSL (PRAME_HUMAN)
LLALYVDSL

SEQ ID NO: 149467 - protein, 10 aa, Artificial Sequence
  Description of Artificial Sequence: Synthetic peptide
  Seed: SPYLGQMINL (PRAME_HUMAN)
SMYLGQMINL

SEQ ID NO: 149468 - protein, 10 aa, Artificial Sequence
  Description of Artificial Sequence: Synthetic peptide
  Seed: RLAYLHARLR (PRAME_HUMAN)
RLAYLHARLV

SEQ ID NO: 149469 - protein, 9 aa, Artificial Sequence
  Description of Artificial Sequence: Synthetic peptide
  Seed: LLRHVMNPL (PRAME_HUMAN)
LQRHVMNPV

SEQ ID NO: 149470 - protein, 10 aa, Artificial Sequence
  Description of Artificial Sequence: Synthetic peptide
  Seed: YSFPEPEAAQ (PRAME_HUMAN)
YVFPEPEAAY

SEQ ID NO: 149471 - protein, 9 aa, Artificial Sequence
  Description of Artificial Sequence: Synthetic peptide
  Seed: QPFIPVEVL (PRAME_HUMAN)
QAFIPVEVL

SEQ ID NO: 149472 - protein, 10 aa, Artificial Sequence
  Description of Artificial Sequence: Synthetic peptide
  Seed: FFLRGRLDQL (PRAME_HUMAN)
FWLRGRLDQA

SEQ ID NO: 149473 - protein, 10 aa, Artificial Sequence
  Description of Artificial Sequence: Synthetic peptide
  Seed: YISPEKEEQY (PRAME_HUMAN)
YMSPEKEEQF

SEQ ID NO: 149474 - protein, 10 aa, Artificial Sequence
  Description of Artificial Sequence: Synthetic peptide
  Seed: YSFPEPEAAQ (PRAME_HUMAN)
YSFPEPEAAL

SEQ ID NO: 149475 - protein, 9 aa, Artificial Sequence
  Description of Artificial Sequence: Synthetic peptide
  Seed: SQFLSLQCL (PRAME_HUMAN)
SHFLSLQCA

SEQ ID NO: 149476 - protein, 10 aa, Artificial Sequence
  Description of Artificial Sequence: Synthetic peptide
  Seed: YSFPEPEAAQ (PRAME_HUMAN)
YAFPEPEAAV

SEQ ID NO: 149477 - protein, 9 aa, Artificial Sequence
  Description of Artificial Sequence: Synthetic peptide
  Seed: FSPYLGQMI (PRAME_HUMAN)
FAPYLGQML

SEQ ID NO: 149478 - protein, 9 aa, Artificial Sequence
  Description of Artificial Sequence: Synthetic peptide
  Seed: MINLRRLLL (PRAME_HUMAN)
MFNLRRLLF

SEQ ID NO: 149479 - protein, 10 aa, Artificial Sequence
  Description of Artificial Sequence: Synthetic peptide
  Seed: SVSQLSVLSL (PRAME_HUMAN)
SVSQLSVLSW

SEQ ID NO: 149480 - protein, 9 aa, Artificial Sequence
  Description of Artificial Sequence: Synthetic peptide
  Seed: ACDELFSYL (PRAME_HUMAN)
AVDELFSYA

SEQ ID NO: 149481 - protein, 9 aa, Artificial Sequence
  Description of Artificial Sequence: Synthetic peptide
  Seed: SVLSLSGVM (PRAME_HUMAN)
SMLSLSGVW

SEQ ID NO: 149482 - protein, 8 aa, Artificial Sequence
  Description of Artificial Sequence: Synthetic peptide
  Seed: TDDQLLAL (PRAME_HUMAN)
TEDQLLAL

SEQ ID NO: 149483 - protein, 9 aa, Artificial Sequence
  Description of Artificial Sequence: Synthetic peptide
  Seed: SVLSLSGVM (PRAME_HUMAN)
SPLSLSGVY

SEQ ID NO: 149484 - protein, 11 aa, Artificial Sequence
  Description of Artificial Sequence: Synthetic peptide
  Seed: VQLDSIEDLEV (PRAME_HUMAN)
VMLDSIEDLEI

SEQ ID NO: 149485 - protein, 10 aa, Artificial Sequence
  Description of Artificial Sequence: Synthetic peptide
  Seed: MERRRLWGSI (PRAME_HUMAN)
MNRRRLWGSL

SEQ ID NO: 149486 - protein, 10 aa, Artificial Sequence
  Description of Artificial Sequence: Synthetic peptide
  Seed: LLLSHIHASS (PRAME_HUMAN)
LTLSHIHASA

SEQ ID NO: 149487 - protein, 9 aa, Artificial Sequence
  Description of Artificial Sequence: Synthetic peptide
  Seed: LSEGDVMHL (PRAME_HUMAN)
LIEGDVMHY

SEQ ID NO: 149488 - protein, 9 aa, Artificial Sequence
  Description of Artificial Sequence: Synthetic peptide
  Seed: LSVLSLSGV (PRAME_HUMAN)
LSVLSLSGI

SEQ ID NO: 149489 - protein, 10 aa, Artificial Sequence
  Description of Artificial Sequence: Synthetic peptide
  Seed: CSQLTTLSFY (PRAME_HUMAN)
CKQLTTLSFF

SEQ ID NO: 149490 - protein, 9 aa, Artificial Sequence
  Description of Artificial Sequence: Synthetic peptide
  Seed: FLRGRLDQL (PRAME_HUMAN)
FARGRLDQL

SEQ ID NO: 149491 - protein, 10 aa, Artificial Sequence
  Description of Artificial Sequence: Synthetic peptide
  Seed: FMAAFDGRHS (PRAME_HUMAN)
FVAAFDGRHV

SEQ ID NO: 149492 - protein, 9 aa, Artificial Sequence
  Description of Artificial Sequence: Synthetic peptide
  Seed: LQSLLQHLI (PRAME_HUMAN)
LMSLLQHLI

SEQ ID NO: 149493 - protein, 10 aa, Artificial Sequence
  Description of Artificial Sequence: Synthetic peptide
  Seed: QSLLQHLIGL (PRAME_HUMAN)
QSLLQHLIGF

SEQ ID NO: 149494 - protein, 9 aa, Artificial Sequence
  Description of Artificial Sequence: Synthetic peptide
  Seed: YSFPEPEAA (PRAME_HUMAN)
YAFPEPEAF

SEQ ID NO: 149495 - protein, 10 aa, Artificial Sequence
  Description of Artificial Sequence: Synthetic peptide
  Seed: ELFPPLFMAA (PRAME_HUMAN)
EAFPPLFMAA

SEQ ID NO: 149496 - protein, 10 aa, Artificial Sequence
  Description of Artificial Sequence: Synthetic peptide
  Seed: MVQAWPFTCL (PRAME_HUMAN)
MLQAWPFTCW

SEQ ID NO: 149497 - protein, 9 aa, Artificial Sequence
  Description of Artificial Sequence: Synthetic peptide
  Seed: EAAQPMTKK (PRAME_HUMAN)
EGAQPMTKR

SEQ ID NO: 149498 - protein, 10 aa, Artificial Sequence
  Description of Artificial Sequence: Synthetic peptide
  Seed: YISPEKEEQY (PRAME_HUMAN)
YLSPEKEEQY

SEQ ID NO: 149499 - protein, 10 aa, Artificial Sequence
  Description of Artificial Sequence: Synthetic peptide
  Seed: RRLWGSIQSR (PRAME_HUMAN)
RNLWGSIQSR

SEQ ID NO: 149500 - protein, 10 aa, Artificial Sequence
  Description of Artificial Sequence: Synthetic peptide
  Seed: ALELLPRELF (PRAME_HUMAN)
AIELLPRELW

SEQ ID NO: 149501 - protein, 10 aa, Artificial Sequence
  Description of Artificial Sequence: Synthetic peptide
  Seed: DELFSYLIEK (PRAME_HUMAN)
DKLFSYLIER

SEQ ID NO: 149502 - protein, 11 aa, Artificial Sequence
  Description of Artificial Sequence: Synthetic peptide
  Seed: RELFPPLFMAA (PRAME_HUMAN)
RKLFPPLFMAL

SEQ ID NO: 149503 - protein, 9 aa, Artificial Sequence
  Description of Artificial Sequence: Synthetic peptide
  Seed: AAFDGRHSQ (PRAME_HUMAN)
AGFDGRHSY

SEQ ID NO: 149504 - protein, 10 aa, Artificial Sequence
  Description of Artificial Sequence: Synthetic peptide
  Seed: RLWGSIQSRY (PRAME_HUMAN)
RIWGSIQSRW

SEQ ID NO: 149505 - protein, 9 aa, Artificial Sequence
  Description of Artificial Sequence: Synthetic peptide
  Seed: HARLRELLC (PRAME_HUMAN)
HQRLRELLL

SEQ ID NO: 149506 - protein, 9 aa, Artificial Sequence
  Description of Artificial Sequence: Synthetic peptide
  Seed: SLLQHLIGL (PRAME_HUMAN)
SLLQHLIGI

SEQ ID NO: 149507 - protein, 10 aa, Artificial Sequence
  Description of Artificial Sequence: Synthetic peptide
  Seed: ISISALQSLL (PRAME_HUMAN)
ISISALQSLF

SEQ ID NO: 149508 - protein, 10 aa, Artificial Sequence
  Description of Artificial Sequence: Synthetic peptide
  Seed: RRRLWGSIQS (PRAME_HUMAN)
RPRLWGSIQK

SEQ ID NO: 149509 - protein, 9 aa, Artificial Sequence
  Description of Artificial Sequence: Synthetic peptide
  Seed: SIQSRYISM (PRAME_HUMAN)
SHQSRYISY

SEQ ID NO: 149510 - protein, 11 aa, Artificial Sequence
  Description of Artificial Sequence: Synthetic peptide
  Seed: HLSQSPSVSQL (PRAME_HUMAN)
HLSQSPSVSQY

SEQ ID NO: 149511 - protein, 10 aa, Artificial Sequence
  Description of Artificial Sequence: Synthetic peptide
  Seed: RLVELAGQSL (PRAME_HUMAN)
RTVELAGQSY

SEQ ID NO: 149512 - protein, 9 aa, Artificial Sequence
  Description of Artificial Sequence: Synthetic peptide
  Seed: QFTSQFLSL (PRAME_HUMAN)
QYTSQFLSW

SEQ ID NO: 149513 - protein, 9 aa, Artificial Sequence
  Description of Artificial Sequence: Synthetic peptide
  Seed: LSANPCPHC (PRAME_HUMAN)
LSANPCPHF

SEQ ID NO: 149514 - protein, 10 aa, Artificial Sequence
  Description of Artificial Sequence: Synthetic peptide
  Seed: YSFPEPEAAQ (PRAME_HUMAN)
YMFPEPEAAY

SEQ ID NO: 149515 - protein, 9 aa, Artificial Sequence
  Description of Artificial Sequence: Synthetic peptide
  Seed: MINLRRLLL (PRAME_HUMAN)
MPNLRRLLT

SEQ ID NO: 149516 - protein, 9 aa, Artificial Sequence
  Description of Artificial Sequence: Synthetic peptide
  Seed: SMSVWTSPR (PRAME_HUMAN)
SMSVWTSPK

SEQ ID NO: 149517 - protein, 9 aa, Artificial Sequence
  Description of Artificial Sequence: Synthetic peptide
  Seed: YSFPEPEAA (PRAME_HUMAN)
YPFPEPEAV

SEQ ID NO: 149518 - protein, 9 aa, Artificial Sequence
  Description of Artificial Sequence: Synthetic peptide
  Seed: ASSYISPEK (PRAME_HUMAN)
AISYISPEK

SEQ ID NO: 149519 - protein, 9 aa, Artificial Sequence
  Description of Artificial Sequence: Synthetic peptide
  Seed: LWGSIQSRY (PRAME_HUMAN)
LQGSIQSRY

SEQ ID NO: 149520 - protein, 9 aa, Artificial Sequence
  Description of Artificial Sequence: Synthetic peptide
  Seed: KLKIFAMPM (PRAME_HUMAN)
KQKIFAMPS

SEQ ID NO: 149521 - protein, 9 aa, Artificial Sequence
  Description of Artificial Sequence: Synthetic peptide
  Seed: MPMQDIKMI (PRAME_HUMAN)
MPMQDIKML

SEQ ID NO: 149522 - protein, 9 aa, Artificial Sequence
  Description of Artificial Sequence: Synthetic peptide
  Seed: GQHLHLETF (PRAME_HUMAN)
GDHLHLETM

SEQ ID NO: 149523 - protein, 10 aa, Artificial Sequence
  Description of Artificial Sequence: Synthetic peptide
  Seed: ALYVDSLFFL (PRAME_HUMAN)
ALYVDSLFFS

SEQ ID NO: 149524 - protein, 9 aa, Artificial Sequence
  Description of Artificial Sequence: Synthetic peptide
  Seed: ISPEKEEQY (PRAME_HUMAN)
IAPEKEEQF

SEQ ID NO: 149525 - protein, 9 aa, Artificial Sequence
  Description of Artificial Sequence: Synthetic peptide
  Seed: LTDVSPEPL (PRAME_HUMAN)
LVDVSPEPI

SEQ ID NO: 149526 - protein, 9 aa, Artificial Sequence
  Description of Artificial Sequence: Synthetic peptide
  Seed: VELAGQSLL (PRAME_HUMAN)
VHLAGQSLF

SEQ ID NO: 149527 - protein, 10 aa, Artificial Sequence
  Description of Artificial Sequence: Synthetic peptide
  Seed: LPTLAKFSPY (PRAME_HUMAN)
LSTLAKFSPW

SEQ ID NO: 149528 - protein, 10 aa, Artificial Sequence
  Description of Artificial Sequence: Synthetic peptide
  Seed: SLYSFPEPEA (PRAME_HUMAN)
SLYSFPEPEL

SEQ ID NO: 149529 - protein, 9 aa, Artificial Sequence
  Description of Artificial Sequence: Synthetic peptide
  Seed: YISMSVWTS (PRAME_HUMAN)
YMSMSVWTL

SEQ ID NO: 149530 - protein, 10 aa, Artificial Sequence
  Description of Artificial Sequence: Synthetic peptide
  Seed: FTCLPLGVLM (PRAME_HUMAN)
FVCLPLGVLV

SEQ ID NO: 149531 - protein, 9 aa, Artificial Sequence
  Description of Artificial Sequence: Synthetic peptide
  Seed: AFDGRHSQT (PRAME_HUMAN)
AYDGRHSQL

SEQ ID NO: 149532 - protein, 9 aa, Artificial Sequence
  Description of Artificial Sequence: Synthetic peptide
  Seed: EPILCPCFM (PRAME_HUMAN)
EAILCPCFW

SEQ ID NO: 149533 - protein, 10 aa, Artificial Sequence
  Description of Artificial Sequence: Synthetic peptide
  Seed: QALYVDSLFF (PRAME_HUMAN)
QQLYVDSLFM

SEQ ID NO: 149534 - protein, 9 aa, Artificial Sequence
  Description of Artificial Sequence: Synthetic peptide
  Seed: KFSPYLGQM (PRAME_HUMAN)
KQSPYLGQL

SEQ ID NO: 149535 - protein, 10 aa, Artificial Sequence
  Description of Artificial Sequence: Synthetic peptide
  Seed: RRRLWGSIQS (PRAME_HUMAN)
RRRLWGSIQK

SEQ ID NO: 149536 - protein, 9 aa, Artificial Sequence
  Description of Artificial Sequence: Synthetic peptide
  Seed: TLAKFSPYL (PRAME_HUMAN)
TTAKFSPYV

SEQ ID NO: 149537 - protein, 9 aa, Artificial Sequence
  Description of Artificial Sequence: Synthetic peptide
  Seed: ISISALQSL (PRAME_HUMAN)
ILISALQST

SEQ ID NO: 149538 - protein, 9 aa, Artificial Sequence
  Description of Artificial Sequence: Synthetic peptide
  Seed: RLRELLCEL (PRAME_HUMAN)
RYRELLCEF

SEQ ID NO: 149539 - protein, 9 aa, Artificial Sequence
  Description of Artificial Sequence: Synthetic peptide
  Seed: LSEGDVMHL (PRAME_HUMAN)
LQEGDVMHI

SEQ ID NO: 149540 - protein, 11 aa, Artificial Sequence
  Description of Artificial Sequence: Synthetic peptide
  Seed: VMLTDVSPEPL (PRAME_HUMAN)
VFLTDVSPEPL

SEQ ID NO: 149541 - protein, 10 aa, Artificial Sequence
  Description of Artificial Sequence: Synthetic peptide
  Seed: RASATLQDLV (PRAME_HUMAN)
RISATLQDLF

SEQ ID NO: 149542 - protein, 9 aa, Artificial Sequence
  Description of Artificial Sequence: Synthetic peptide
  Seed: CRLSEGDVM (PRAME_HUMAN)
CHLSEGDVF

SEQ ID NO: 149543 - protein, 9 aa, Artificial Sequence
  Description of Artificial Sequence: Synthetic peptide
  Seed: THVLYPVPL (PRAME_HUMAN)
TQVLYPVPM

SEQ ID NO: 149544 - protein, 10 aa, Artificial Sequence
  Description of Artificial Sequence: Synthetic peptide
  Seed: RGRLDQLLRH (PRAME_HUMAN)
RWRLDQLLRR

SEQ ID NO: 149545 - protein, 10 aa, Artificial Sequence
  Description of Artificial Sequence: Synthetic peptide
  Seed: KVKRKKNVLR (PRAME_HUMAN)
KQKRKKNVLK

SEQ ID NO: 149546 - protein, 9 aa, Artificial Sequence
  Description of Artificial Sequence: Synthetic peptide
  Seed: RLRELLCEL (PRAME_HUMAN)
RYRELLCEI

SEQ ID NO: 149547 - protein, 11 aa, Artificial Sequence
  Description of Artificial Sequence: Synthetic peptide
  Seed: AAFDGRHSQTL (PRAME_HUMAN)
AMFDGRHSQTI

SEQ ID NO: 149548 - protein, 10 aa, Artificial Sequence
  Description of Artificial Sequence: Synthetic peptide
  Seed: ALLERASATL (PRAME_HUMAN)
AMLERASATF

SEQ ID NO: 149549 - protein, 9 aa, Artificial Sequence
  Description of Artificial Sequence: Synthetic peptide
  Seed: MINLRRLLL (PRAME_HUMAN)
MTNLRRLLL

SEQ ID NO: 149550 - protein, 10 aa, Artificial Sequence
  Description of Artificial Sequence: Synthetic peptide
  Seed: ITDDQLLALL (PRAME_HUMAN)
IWDDQLLALM

SEQ ID NO: 149551 - protein, 9 aa, Artificial Sequence
  Description of Artificial Sequence: Synthetic peptide
  Seed: VLDGLDVLL (PRAME_HUMAN)
VSDGLDVLI

SEQ ID NO: 149552 - protein, 9 aa, Artificial Sequence
  Description of Artificial Sequence: Synthetic peptide
  Seed: LTDVSPEPL (PRAME_HUMAN)
LLDVSPEPL

SEQ ID NO: 149553 - protein, 9 aa, Artificial Sequence
  Description of Artificial Sequence: Synthetic peptide
  Seed: VFDECGITD (PRAME_HUMAN)
VGDECGITL

SEQ ID NO: 149554 - protein, 9 aa, Artificial Sequence
  Description of Artificial Sequence: Synthetic peptide
  Seed: SLLQHLIGL (PRAME_HUMAN)
SQLQHLIGR

SEQ ID NO: 149555 - protein, 9 aa, Artificial Sequence
  Description of Artificial Sequence: Synthetic peptide
  Seed: TFYDPEPIL (PRAME_HUMAN)
TAYDPEPIV

SEQ ID NO: 149556 - protein, 9 aa, Artificial Sequence
  Description of Artificial Sequence: Synthetic peptide
  Seed: ELFPPLFMA (PRAME_HUMAN)
EIFPPLFMM

SEQ ID NO: 149557 - protein, 10 aa, Artificial Sequence
  Description of Artificial Sequence: Synthetic peptide
  Seed: SPYLGQMINL (PRAME_HUMAN)
SFYLGQMINF

SEQ ID NO: 149558 - protein, 9 aa, Artificial Sequence
  Description of Artificial Sequence: Synthetic peptide
  Seed: LVELAGQSL (PRAME_HUMAN)
LAELAGQSV

SEQ ID NO: 149559 - protein, 9 aa, Artificial Sequence
  Description of Artificial Sequence: Synthetic peptide
  Seed: RRLLLSHIH (PRAME_HUMAN)
RRLLLSHIV

SEQ ID NO: 149560 - protein, 9 aa, Artificial Sequence
  Description of Artificial Sequence: Synthetic peptide
  Seed: QSRYISMSV (PRAME_HUMAN)
QVRYISMSK

SEQ ID NO: 149561 - protein, 10 aa, Artificial Sequence
  Description of Artificial Sequence: Synthetic peptide
  Seed: ETLSITNCRL (PRAME_HUMAN)
ELLSITNCRK

SEQ ID NO: 149562 - protein, 10 aa, Artificial Sequence
  Description of Artificial Sequence: Synthetic peptide
  Seed: IQSRYISMSV (PRAME_HUMAN)
IKSRYISMSM

SEQ ID NO: 149563 - protein, 9 aa, Artificial Sequence
  Description of Artificial Sequence: Synthetic peptide
  Seed: RLWGSIQSR (PRAME_HUMAN)
RLWGSIQSF

SEQ ID NO: 149564 - protein, 9 aa, Artificial Sequence
  Description of Artificial Sequence: Synthetic peptide
  Seed: RLRELLCEL (PRAME_HUMAN)
RTRELLCEK

SEQ ID NO: 149565 - protein, 10 aa, Artificial Sequence
  Description of Artificial Sequence: Synthetic peptide
  Seed: AAFDGRHSQT (PRAME_HUMAN)
AIFDGRHSQM

SEQ ID NO: 149566 - protein, 9 aa, Artificial Sequence
  Description of Artificial Sequence: Synthetic peptide
  Seed: VWSGNRASL (PRAME_HUMAN)
VFSGNRASI

SEQ ID NO: 149567 - protein, 9 aa, Artificial Sequence
  Description of Artificial Sequence: Synthetic peptide
  Seed: YGNSISISA (PRAME_HUMAN)
YMNSISISF

SEQ ID NO: 149568 - protein, 10 aa, Artificial Sequence
  Description of Artificial Sequence: Synthetic peptide
  Seed: LSHCSQLTTL (PRAME_HUMAN)
LAHCSQLTTF

SEQ ID NO: 149569 - protein, 10 aa, Artificial Sequence
  Description of Artificial Sequence: Synthetic peptide
  Seed: YIAQFTSQFL (PRAME_HUMAN)
YTAQFTSQFM

SEQ ID NO: 149570 - protein, 10 aa, Artificial Sequence
  Description of Artificial Sequence: Synthetic peptide
  Seed: LLLSHIHASS (PRAME_HUMAN)
LDLSHIHASV

SEQ ID NO: 149571 - protein, 9 aa, Artificial Sequence
  Description of Artificial Sequence: Synthetic peptide
  Seed: ALLPSLSHC (PRAME_HUMAN)
AMLPSLSHM

SEQ ID NO: 149572 - protein, 10 aa, Artificial Sequence
  Description of Artificial Sequence: Synthetic peptide
  Seed: ALELLPRELF (PRAME_HUMAN)
AVELLPRELW

SEQ ID NO: 149573 - protein, 8 aa, Artificial Sequence
  Description of Artificial Sequence: Synthetic peptide
  Seed: HARLRELL (PRAME_HUMAN)
HLRLRELL

SEQ ID NO: 149574 - protein, 11 aa, Artificial Sequence
  Description of Artificial Sequence: Synthetic peptide
  Seed: AAFDGRHSQTL (PRAME_HUMAN)
ALFDGRHSQTV

SEQ ID NO: 149575 - protein, 8 aa, Artificial Sequence
  Description of Artificial Sequence: Synthetic peptide
  Seed: FYDPEPIL (PRAME_HUMAN)
FFDPEPIL

SEQ ID NO: 149576 - protein, 9 aa, Artificial Sequence
  Description of Artificial Sequence: Synthetic peptide
  Seed: YLIEKVKRK (PRAME_HUMAN)
YAIEKVKRK

SEQ ID NO: 149577 - protein, 10 aa, Artificial Sequence
  Description of Artificial Sequence: Synthetic peptide
  Seed: RELFPPLFMA (PRAME_HUMAN)
RVLFPPLFMM

SEQ ID NO: 149578 - protein, 9 aa, Artificial Sequence
  Description of Artificial Sequence: Synthetic peptide
  Seed: RLWGSIQSR (PRAME_HUMAN)
RAWGSIQSV

SEQ ID NO: 149579 - protein, 9 aa, Artificial Sequence
  Description of Artificial Sequence: Synthetic peptide
  Seed: AMVQAWPFT (PRAME_HUMAN)
ALVQAWPFM

SEQ ID NO: 149580 - protein, 11 aa, Artificial Sequence
  Description of Artificial Sequence: Synthetic peptide
  Seed: EALAIAALELL (PRAME_HUMAN)
EFLAIAALELV

SEQ ID NO: 149581 - protein, 10 aa, Artificial Sequence
  Description of Artificial Sequence: Synthetic peptide
  Seed: SLYSFPEPEA (PRAME_HUMAN)
SLYSFPEPEI

SEQ ID NO: 149582 - protein, 9 aa, Artificial Sequence
  Description of Artificial Sequence: Synthetic peptide
  Seed: ACDELFSYL (PRAME_HUMAN)
ANDELFSYM

SEQ ID NO: 149583 - protein, 9 aa, Artificial Sequence
  Description of Artificial Sequence: Synthetic peptide
  Seed: SQSPSVSQL (PRAME_HUMAN)
SMSPSVSQK

SEQ ID NO: 149584 - protein, 10 aa, Artificial Sequence
  Description of Artificial Sequence: Synthetic peptide
  Seed: GLSNLTHVLY (PRAME_HUMAN)
GRSNLTHVLY

SEQ ID NO: 149585 - protein, 10 aa, Artificial Sequence
  Description of Artificial Sequence: Synthetic peptide
  Seed: LSQSPSVSQL (PRAME_HUMAN)
LVQSPSVSQY

SEQ ID NO: 149586 - protein, 9 aa, Artificial Sequence
  Description of Artificial Sequence: Synthetic peptide
  Seed: YSFPEPEAA (PRAME_HUMAN)
YFFPEPEAI

SEQ ID NO: 149587 - protein, 9 aa, Artificial Sequence
  Description of Artificial Sequence: Synthetic peptide
  Seed: ESYEDIHGT (PRAME_HUMAN)
ESYEDIHGL

SEQ ID NO: 149588 - protein, 10 aa, Artificial Sequence
  Description of Artificial Sequence: Synthetic peptide
  Seed: FAMPMQDIKM (PRAME_HUMAN)
FPMPMQDIKM

SEQ ID NO: 149589 - protein, 10 aa, Artificial Sequence
  Description of Artificial Sequence: Synthetic peptide
  Seed: MVQAWPFTCL (PRAME_HUMAN)
MHQAWPFTCM

SEQ ID NO: 149590 - protein, 10 aa, Artificial Sequence
  Description of Artificial Sequence: Synthetic peptide
  Seed: SALQSLLQHL (PRAME_HUMAN)
SVLQSLLQHW

SEQ ID NO: 149591 - protein, 9 aa, Artificial Sequence
  Description of Artificial Sequence: Synthetic peptide
  Seed: AVLDGLDVL (PRAME_HUMAN)
AQLDGLDVF

SEQ ID NO: 149592 - protein, 9 aa, Artificial Sequence
  Description of Artificial Sequence: Synthetic peptide
  Seed: TDDQLLALL (PRAME_HUMAN)
TTDQLLALL

SEQ ID NO: 149593 - protein, 9 aa, Artificial Sequence
  Description of Artificial Sequence: Synthetic peptide
  Seed: LQALYVDSL (PRAME_HUMAN)
LHALYVDSA

SEQ ID NO: 149594 - protein, 9 aa, Artificial Sequence
  Description of Artificial Sequence: Synthetic peptide
  Seed: LEVTCTWKL (PRAME_HUMAN)
LHVTCTWKI

SEQ ID NO: 149595 - protein, 11 aa, Artificial Sequence
  Description of Artificial Sequence: Synthetic peptide
  Seed: IAQFTSQFLSL (PRAME_HUMAN)
IRQFTSQFLSF

SEQ ID NO: 149596 - protein, 9 aa, Artificial Sequence
  Description of Artificial Sequence: Synthetic peptide
  Seed: MVQAWPFTC (PRAME_HUMAN)
MVQAWPFTV

SEQ ID NO: 149597 - protein, 9 aa, Artificial Sequence
  Description of Artificial Sequence: Synthetic peptide
  Seed: VSPEPLQAL (PRAME_HUMAN)
VFPEPLQAY

SEQ ID NO: 149598 - protein, 9 aa, Artificial Sequence
  Description of Artificial Sequence: Synthetic peptide
  Seed: RLAYLHARL (PRAME_HUMAN)
RKAYLHARM

SEQ ID NO: 149599 - protein, 9 aa, Artificial Sequence
  Description of Artificial Sequence: Synthetic peptide
  Seed: RASATLQDL (PRAME_HUMAN)
RLSATLQDI

SEQ ID NO: 149600 - protein, 9 aa, Artificial Sequence
  Description of Artificial Sequence: Synthetic peptide
  Seed: VSPEPLQAL (PRAME_HUMAN)
VPPEPLQAA

SEQ ID NO: 149601 - protein, 9 aa, Artificial Sequence
  Description of Artificial Sequence: Synthetic peptide
  Seed: DGRHSQTLK (PRAME_HUMAN)
DSRHSQTLR

SEQ ID NO: 149602 - protein, 10 aa, Artificial Sequence
  Description of Artificial Sequence: Synthetic peptide
  Seed: FIPVEVLVDL (PRAME_HUMAN)
FFPVEVLVDF

SEQ ID NO: 149603 - protein, 9 aa, Artificial Sequence
  Description of Artificial Sequence: Synthetic peptide
  Seed: SPRRLVELA (PRAME_HUMAN)
SPRRLVELV

SEQ ID NO: 149604 - protein, 9 aa, Artificial Sequence
  Description of Artificial Sequence: Synthetic peptide
  Seed: TSPRRLVEL (PRAME_HUMAN)
TFPRRLVEY

SEQ ID NO: 149605 - protein, 11 aa, Artificial Sequence
  Description of Artificial Sequence: Synthetic peptide
  Seed: KIFAMPMQDIK (PRAME_HUMAN)
KMFAMPMQDIK

SEQ ID NO: 149606 - protein, 11 aa, Artificial Sequence
  Description of Artificial Sequence: Synthetic peptide
  Seed: PRELFPPLFMA (PRAME_HUMAN)
PKELFPPLFMV

SEQ ID NO: 149607 - protein, 9 aa, Artificial Sequence
  Description of Artificial Sequence: Synthetic peptide
  Seed: ELFPPLFMA (PRAME_HUMAN)
ESFPPLFML

SEQ ID NO: 149608 - protein, 9 aa, Artificial Sequence
  Description of Artificial Sequence: Synthetic peptide
  Seed: SISALQSLL (PRAME_HUMAN)
SVSALQSLA

SEQ ID NO: 149609 - protein, 9 aa, Artificial Sequence
  Description of Artificial Sequence: Synthetic peptide
  Seed: QTLKAMVQA (PRAME_HUMAN)
QMLKAMVQI

SEQ ID NO: 149610 - protein, 11 aa, Artificial Sequence
  Description of Artificial Sequence: Synthetic peptide
  Seed: RTFYDPEPILC (PRAME_HUMAN)
RSFYDPEPILY

SEQ ID NO: 149611 - protein, 9 aa, Artificial Sequence
  Description of Artificial Sequence: Synthetic peptide
  Seed: KMILKMVQL (PRAME_HUMAN)
KIILKMVQL

SEQ ID NO: 149612 - protein, 10 aa, Artificial Sequence
  Description of Artificial Sequence: Synthetic peptide
  Seed: TLHLERLAYL (PRAME_HUMAN)
TIHLERLAYV

SEQ ID NO: 149613 - protein, 9 aa, Artificial Sequence
  Description of Artificial Sequence: Synthetic peptide
  Seed: LYVDSLFFL (PRAME_HUMAN)
LQVDSLFFM

SEQ ID NO: 149614 - protein, 11 aa, Artificial Sequence
  Description of Artificial Sequence: Synthetic peptide
  Seed: AEQPFIPVEVL (PRAME_HUMAN)
AEQPFIPVEVA

SEQ ID NO: 149615 - protein, 9 aa, Artificial Sequence
  Description of Artificial Sequence: Synthetic peptide
  Seed: FYDPEPILC (PRAME_HUMAN)
FPDPEPILM

SEQ ID NO: 149616 - protein, 9 aa, Artificial Sequence
  Description of Artificial Sequence: Synthetic peptide
  Seed: FLRGRLDQL (PRAME_HUMAN)
FYRGRLDQL

SEQ ID NO: 149617 - protein, 10 aa, Artificial Sequence
  Description of Artificial Sequence: Synthetic peptide
  Seed: FFLRGRLDQL (PRAME_HUMAN)
FYLRGRLDQF

SEQ ID NO: 149618 - protein, 10 aa, Artificial Sequence
  Description of Artificial Sequence: Synthetic peptide
  Seed: PTLAKFSPYL (PRAME_HUMAN)
PFLAKFSPYI

SEQ ID NO: 149619 - protein, 10 aa, Artificial Sequence
  Description of Artificial Sequence: Synthetic peptide
  Seed: ALELLPRELF (PRAME_HUMAN)
AQELLPRELW

SEQ ID NO: 149620 - protein, 10 aa, Artificial Sequence
  Description of Artificial Sequence: Synthetic peptide
  Seed: KIFAMPMQDI (PRAME_HUMAN)
KTFAMPMQDW

SEQ ID NO: 149621 - protein, 10 aa, Artificial Sequence
  Description of Artificial Sequence: Synthetic peptide
  Seed: RGRLDQLLRH (PRAME_HUMAN)
RCRLDQLLRM

SEQ ID NO: 149622 - protein, 9 aa, Artificial Sequence
  Description of Artificial Sequence: Synthetic peptide
  Seed: QFTSQFLSL (PRAME_HUMAN)
QWTSQFLSI

SEQ ID NO: 149623 - protein, 9 aa, Artificial Sequence
  Description of Artificial Sequence: Synthetic peptide
  Seed: FYDPEPILC (PRAME_HUMAN)
FFDPEPILF

SEQ ID NO: 149624 - protein, 10 aa, Artificial Sequence
  Description of Artificial Sequence: Synthetic peptide
  Seed: LKAMVQAWPF (PRAME_HUMAN)
LHAMVQAWPW

SEQ ID NO: 149625 - protein, 9 aa, Artificial Sequence
  Description of Artificial Sequence: Synthetic peptide
  Seed: ELFSYLIEK (PRAME_HUMAN)
EAFSYLIEY

SEQ ID NO: 149626 - protein, 9 aa, Artificial Sequence
  Description of Artificial Sequence: Synthetic peptide
  Seed: KMILKMVQL (PRAME_HUMAN)
KAILKMVQI

SEQ ID NO: 149627 - protein, 10 aa, Artificial Sequence
  Description of Artificial Sequence: Synthetic peptide
  Seed: AAFDGRHSQT (PRAME_HUMAN)
AAFDGRHSQF

SEQ ID NO: 149628 - protein, 10 aa, Artificial Sequence
  Description of Artificial Sequence: Synthetic peptide
  Seed: LKAMVQAWPF (PRAME_HUMAN)
LCAMVQAWPW

SEQ ID NO: 149629 - protein, 10 aa, Artificial Sequence
  Description of Artificial Sequence: Synthetic peptide
  Seed: FYDPEPILCP (PRAME_HUMAN)
FYDPEPILCL

SEQ ID NO: 149630 - protein, 9 aa, Artificial Sequence
  Description of Artificial Sequence: Synthetic peptide
  Seed: TLAKFSPYL (PRAME_HUMAN)
TYAKFSPYV

SEQ ID NO: 149631 - protein, 10 aa, Artificial Sequence
  Description of Artificial Sequence: Synthetic peptide
  Seed: RHVMNPLETL (PRAME_HUMAN)
RYVMNPLETW

SEQ ID NO: 149632 - protein, 9 aa, Artificial Sequence
  Description of Artificial Sequence: Synthetic peptide
  Seed: KLKIFAMPM (PRAME_HUMAN)
KSKIFAMPC

SEQ ID NO: 149633 - protein, 10 aa, Artificial Sequence
  Description of Artificial Sequence: Synthetic peptide
  Seed: IQSRYISMSV (PRAME_HUMAN)
IVSRYISMSY

SEQ ID NO: 149634 - protein, 9 aa, Artificial Sequence
  Description of Artificial Sequence: Synthetic peptide
  Seed: KLKIFAMPM (PRAME_HUMAN)
KLKIFAMPL

SEQ ID NO: 149635 - protein, 10 aa, Artificial Sequence
  Description of Artificial Sequence: Synthetic peptide
  Seed: LAQEVRPRRW (PRAME_HUMAN)
LTQEVRPRRW

SEQ ID NO: 149636 - protein, 9 aa, Artificial Sequence
  Description of Artificial Sequence: Synthetic peptide
  Seed: KAMVQAWPF (PRAME_HUMAN)
KMMVQAWPW

SEQ ID NO: 149637 - protein, 9 aa, Artificial Sequence
  Description of Artificial Sequence: Synthetic peptide
  Seed: HVMNPLETL (PRAME_HUMAN)
HDMNPLETM

SEQ ID NO: 149638 - protein, 10 aa, Artificial Sequence
  Description of Artificial Sequence: Synthetic peptide
  Seed: RLVELAGQSL (PRAME_HUMAN)
REVELAGQSY

SEQ ID NO: 149639 - protein, 9 aa, Artificial Sequence
  Description of Artificial Sequence: Synthetic peptide
  Seed: LLLSHIHAS (PRAME_HUMAN)
LLLSHIHAL

SEQ ID NO: 149640 - protein, 9 aa, Artificial Sequence
  Description of Artificial Sequence: Synthetic peptide
  Seed: ALLPSLSHC (PRAME_HUMAN)
AMLPSLSHL

SEQ ID NO: 149641 - protein, 9 aa, Artificial Sequence
  Description of Artificial Sequence: Synthetic peptide
  Seed: AQFTSQFLS (PRAME_HUMAN)
ALFTSQFLA

SEQ ID NO: 149642 - protein, 9 aa, Artificial Sequence
  Description of Artificial Sequence: Synthetic peptide
  Seed: LAIAALELL (PRAME_HUMAN)
LAIAALELM

SEQ ID NO: 149643 - protein, 9 aa, Artificial Sequence
  Description of Artificial Sequence: Synthetic peptide
  Seed: SQSPSVSQL (PRAME_HUMAN)
SLSPSVSQI

SEQ ID NO: 149644 - protein, 9 aa, Artificial Sequence
  Description of Artificial Sequence: Synthetic peptide
  Seed: VQAWPFTCL (PRAME_HUMAN)
VMAWPFTCI

SEQ ID NO: 149645 - protein, 9 aa, Artificial Sequence
  Description of Artificial Sequence: Synthetic peptide
  Seed: LSVLSLSGV (PRAME_HUMAN)
LLVLSLSGL

SEQ ID NO: 149646 - protein, 10 aa, Artificial Sequence
  Description of Artificial Sequence: Synthetic peptide
  Seed: ISMSVWTSPR (PRAME_HUMAN)
IEMSVWTSPR

SEQ ID NO: 149647 - protein, 10 aa, Artificial Sequence
  Description of Artificial Sequence: Synthetic peptide
  Seed: RELFPPLFMA (PRAME_HUMAN)
RPLFPPLFMM

SEQ ID NO: 149648 - protein, 10 aa, Artificial Sequence
  Description of Artificial Sequence: Synthetic peptide
  Seed: YSFPEPEAAQ (PRAME_HUMAN)
YSFPEPEAAM

SEQ ID NO: 149649 - protein, 10 aa, Artificial Sequence
  Description of Artificial Sequence: Synthetic peptide
  Seed: LSQSPSVSQL (PRAME_HUMAN)
LDQSPSVSQM

SEQ ID NO: 149650 - protein, 9 aa, Artificial Sequence
  Description of Artificial Sequence: Synthetic peptide
  Seed: MINLRRLLL (PRAME_HUMAN)
MRNLRRLLL

SEQ ID NO: 149651 - protein, 10 aa, Artificial Sequence
  Description of Artificial Sequence: Synthetic peptide
  Seed: KKLKIFAMPM (PRAME_HUMAN)
KKLKIFAMPF

SEQ ID NO: 149652 - protein, 9 aa, Artificial Sequence
  Description of Artificial Sequence: Synthetic peptide
  Seed: TDDQLLALL (PRAME_HUMAN)
TYDQLLALM

SEQ ID NO: 149653 - protein, 9 aa, Artificial Sequence
  Description of Artificial Sequence: Synthetic peptide
  Seed: ISISALQSL (PRAME_HUMAN)
ILISALQSV

SEQ ID NO: 149654 - protein, 9 aa, Artificial Sequence
  Description of Artificial Sequence: Synthetic peptide
  Seed: THVLYPVPL (PRAME_HUMAN)
THVLYPVPM

SEQ ID NO: 149655 - protein, 9 aa, Artificial Sequence
  Description of Artificial Sequence: Synthetic peptide
  Seed: RASATLQDL (PRAME_HUMAN)
RLSATLQDF

SEQ ID NO: 149656 - protein, 9 aa, Artificial Sequence
  Description of Artificial Sequence: Synthetic peptide
  Seed: SIQSRYISM (PRAME_HUMAN)
SMQSRYISI

SEQ ID NO: 149657 - protein, 9 aa, Artificial Sequence
  Description of Artificial Sequence: Synthetic peptide
  Seed: CSQLTTLSF (PRAME_HUMAN)
CPQLTTLSF

SEQ ID NO: 149658 - protein, 10 aa, Artificial Sequence
  Description of Artificial Sequence: Synthetic peptide
  Seed: ISMSVWTSPR (PRAME_HUMAN)
IQMSVWTSPR

SEQ ID NO: 149659 - protein, 11 aa, Artificial Sequence
  Description of Artificial Sequence: Synthetic peptide
  Seed: AAFDGRHSQTL (PRAME_HUMAN)
APFDGRHSQTA

SEQ ID NO: 149660 - protein, 9 aa, Artificial Sequence
  Description of Artificial Sequence: Synthetic peptide
  Seed: LAIAALELL (PRAME_HUMAN)
LLIAALELM

SEQ ID NO: 149661 - protein, 9 aa, Artificial Sequence
  Description of Artificial Sequence: Synthetic peptide
  Seed: SQLTTLSFY (PRAME_HUMAN)
SQLTTLSFM

SEQ ID NO: 149662 - protein, 9 aa, Artificial Sequence
  Description of Artificial Sequence: Synthetic peptide
  Seed: LAIAALELL (PRAME_HUMAN)
LTIAALELW

SEQ ID NO: 149663 - protein, 9 aa, Artificial Sequence
  Description of Artificial Sequence: Synthetic peptide
  Seed: SLLKDEALA (PRAME_HUMAN)
SLLKDEALL

SEQ ID NO: 149664 - protein, 10 aa, Artificial Sequence
  Description of Artificial Sequence: Synthetic peptide
  Seed: VEVLVDLFLK (PRAME_HUMAN)
VMVLVDLFLK

SEQ ID NO: 149665 - protein, 11 aa, Artificial Sequence
  Description of Artificial Sequence: Synthetic peptide
  Seed: NPCPHCGDRTF (PRAME_HUMAN)
NACPHCGDRTW

SEQ ID NO: 149666 - protein, 10 aa, Artificial Sequence
  Description of Artificial Sequence: Synthetic peptide
  Seed: IQSRYISMSV (PRAME_HUMAN)
IKSRYISMSL

SEQ ID NO: 149667 - protein, 10 aa, Artificial Sequence
  Description of Artificial Sequence: Synthetic peptide
  Seed: MVQAWPFTCL (PRAME_HUMAN)
MCQAWPFTCV

SEQ ID NO: 149668 - protein, 9 aa, Artificial Sequence
  Description of Artificial Sequence: Synthetic peptide
  Seed: KMILKMVQL (PRAME_HUMAN)
KGILKMVQW

SEQ ID NO: 149669 - protein, 9 aa, Artificial Sequence
  Description of Artificial Sequence: Synthetic peptide
  Seed: RTFYDPEPI (PRAME_HUMAN)
RSFYDPEPI

SEQ ID NO: 149670 - protein, 9 aa, Artificial Sequence
  Description of Artificial Sequence: Synthetic peptide
  Seed: MINLRRLLL (PRAME_HUMAN)
MFNLRRLLY

SEQ ID NO: 149671 - protein, 8 aa, Artificial Sequence
  Description of Artificial Sequence: Synthetic peptide
  Seed: YEDIHGTL (PRAME_HUMAN)
YCDIHGTM

SEQ ID NO: 149672 - protein, 9 aa, Artificial Sequence
  Description of Artificial Sequence: Synthetic peptide
  Seed: ISISALQSL (PRAME_HUMAN)
IKISALQSY

SEQ ID NO: 149673 - protein, 11 aa, Artificial Sequence
  Description of Artificial Sequence: Synthetic peptide
  Seed: LPTLAKFSPYL (PRAME_HUMAN)
LHTLAKFSPYL

SEQ ID NO: 149674 - protein, 11 aa, Artificial Sequence
  Description of Artificial Sequence: Synthetic peptide
  Seed: LTDVSPEPLQA (PRAME_HUMAN)
LADVSPEPLQI

SEQ ID NO: 149675 - protein, 9 aa, Artificial Sequence
  Description of Artificial Sequence: Synthetic peptide
  Seed: ALYVDSLFF (PRAME_HUMAN)
AHYVDSLFF

SEQ ID NO: 149676 - protein, 9 aa, Artificial Sequence
  Description of Artificial Sequence: Synthetic peptide
  Seed: MINLRRLLL (PRAME_HUMAN)
MFNLRRLLM

SEQ ID NO: 149677 - protein, 9 aa, Artificial Sequence
  Description of Artificial Sequence: Synthetic peptide
  Seed: SLLQHLIGL (PRAME_HUMAN)
SALQHLIGL

SEQ ID NO: 149678 - protein, 9 aa, Artificial Sequence
  Description of Artificial Sequence: Synthetic peptide
  Seed: HVMNPLETL (PRAME_HUMAN)
HVMNPLETA

SEQ ID NO: 149679 - protein, 9 aa, Artificial Sequence
  Description of Artificial Sequence: Synthetic peptide
  Seed: LFPPLFMAA (PRAME_HUMAN)
LFPPLFMAY

SEQ ID NO: 149680 - protein, 9 aa, Artificial Sequence
  Description of Artificial Sequence: Synthetic peptide
  Seed: VSPEPLQAL (PRAME_HUMAN)
VWPEPLQAL

SEQ ID NO: 149681 - protein, 10 aa, Artificial Sequence
  Description of Artificial Sequence: Synthetic peptide
  Seed: MERRRLWGSI (PRAME_HUMAN)
MMRRRLWGSI

SEQ ID NO: 149682 - protein, 9 aa, Artificial Sequence
  Description of Artificial Sequence: Synthetic peptide
  Seed: TCLPLGVLM (PRAME_HUMAN)
TVLPLGVLL

SEQ ID NO: 149683 - protein, 9 aa, Artificial Sequence
  Description of Artificial Sequence: Synthetic peptide
  Seed: AEQPFIPVE (PRAME_HUMAN)
AEQPFIPVT

SEQ ID NO: 149684 - protein, 10 aa, Artificial Sequence
  Description of Artificial Sequence: Synthetic peptide
  Seed: YEDIHGTLHL (PRAME_HUMAN)
YVDIHGTLHM

SEQ ID NO: 149685 - protein, 11 aa, Artificial Sequence
  Description of Artificial Sequence: Synthetic peptide
  Seed: LPTLAKFSPYL (PRAME_HUMAN)
LNTLAKFSPYI

SEQ ID NO: 149686 - protein, 9 aa, Artificial Sequence
  Description of Artificial Sequence: Synthetic peptide
  Seed: LLALLPSLS (PRAME_HUMAN)
LLALLPSLA

SEQ ID NO: 149687 - protein, 9 aa, Artificial Sequence
  Description of Artificial Sequence: Synthetic peptide
  Seed: LPRELFPPL (PRAME_HUMAN)
LPRELFPPA

SEQ ID NO: 149688 - protein, 9 aa, Artificial Sequence
  Description of Artificial Sequence: Synthetic peptide
  Seed: ALAIAALEL (PRAME_HUMAN)
AVAIAALEF

SEQ ID NO: 149689 - protein, 9 aa, Artificial Sequence
  Description of Artificial Sequence: Synthetic peptide
  Seed: KFSPYLGQM (PRAME_HUMAN)
KISPYLGQF

SEQ ID NO: 149690 - protein, 10 aa, Artificial Sequence
  Description of Artificial Sequence: Synthetic peptide
  Seed: ISMSVWTSPR (PRAME_HUMAN)
INMSVWTSPK

SEQ ID NO: 149691 - protein, 11 aa, Artificial Sequence
  Description of Artificial Sequence: Synthetic peptide
  Seed: SIQSRYISMSV (PRAME_HUMAN)
SNQSRYISMSK

SEQ ID NO: 149692 - protein, 9 aa, Artificial Sequence
  Description of Artificial Sequence: Synthetic peptide
  Seed: SQLSVLSLS (PRAME_HUMAN)
SVLSVLSLA

SEQ ID NO: 149693 - protein, 9 aa, Artificial Sequence
  Description of Artificial Sequence: Synthetic peptide
  Seed: YIAQFTSQF (PRAME_HUMAN)
YYAQFTSQY

SEQ ID NO: 149694 - protein, 10 aa, Artificial Sequence
  Description of Artificial Sequence: Synthetic peptide
  Seed: KKLKIFAMPM (PRAME_HUMAN)
KMLKIFAMPY

SEQ ID NO: 149695 - protein, 9 aa, Artificial Sequence
  Description of Artificial Sequence: Synthetic peptide
  Seed: SQLSVLSLS (PRAME_HUMAN)
SQLSVLSLI

SEQ ID NO: 149696 - protein, 10 aa, Artificial Sequence
  Description of Artificial Sequence: Synthetic peptide
  Seed: RLSEGDVMHL (PRAME_HUMAN)
RRSEGDVMHY

SEQ ID NO: 149697 - protein, 9 aa, Artificial Sequence
  Description of Artificial Sequence: Synthetic peptide
  Seed: FAMPMQDIK (PRAME_HUMAN)
FAMPMQDIR

SEQ ID NO: 149698 - protein, 9 aa, Artificial Sequence
  Description of Artificial Sequence: Synthetic peptide
  Seed: HARLRELLC (PRAME_HUMAN)
HVRLRELLL

SEQ ID NO: 149699 - protein, 9 aa, Artificial Sequence
  Description of Artificial Sequence: Synthetic peptide
  Seed: VQAWPFTCL (PRAME_HUMAN)
VAAWPFTCI

SEQ ID NO: 149700 - protein, 9 aa, Artificial Sequence
  Description of Artificial Sequence: Synthetic peptide
  Seed: LETLSITNC (PRAME_HUMAN)
LETLSITNL

SEQ ID NO: 149701 - protein, 9 aa, Artificial Sequence
  Description of Artificial Sequence: Synthetic peptide
  Seed: RLWGSIQSR (PRAME_HUMAN)
RMWGSIQSR

SEQ ID NO: 149702 - protein, 9 aa, Artificial Sequence
  Description of Artificial Sequence: Synthetic peptide
  Seed: MQDIKMILK (PRAME_HUMAN)
MFDIKMILR

SEQ ID NO: 149703 - protein, 9 aa, Artificial Sequence
  Description of Artificial Sequence: Synthetic peptide
  Seed: ISPEKEEQY (PRAME_HUMAN)
ITPEKEEQW

SEQ ID NO: 149704 - protein, 10 aa, Artificial Sequence
  Description of Artificial Sequence: Synthetic peptide
  Seed: MVQAWPFTCL (PRAME_HUMAN)
MQQAWPFTCM

SEQ ID NO: 149705 - protein, 11 aa, Artificial Sequence
  Description of Artificial Sequence: Synthetic peptide
  Seed: SNLTHVLYPVP (PRAME_HUMAN)
SMLTHVLYPVG

SEQ ID NO: 149706 - protein, 9 aa, Artificial Sequence
  Description of Artificial Sequence: Synthetic peptide
  Seed: SALQSLLQH (PRAME_HUMAN)
SVLQSLLQK

SEQ ID NO: 149707 - protein, 10 aa, Artificial Sequence
  Description of Artificial Sequence: Synthetic peptide
  Seed: QYIAQFTSQF (PRAME_HUMAN)
QYIAQFTSQM

SEQ ID NO: 149708 - protein, 9 aa, Artificial Sequence
  Description of Artificial Sequence: Synthetic peptide
  Seed: KDEALAIAA (PRAME_HUMAN)
KEEALAIAC

SEQ ID NO: 149709 - protein, 9 aa, Artificial Sequence
  Description of Artificial Sequence: Synthetic peptide
  Seed: VSPEPLQAL (PRAME_HUMAN)
VMPEPLQAF

SEQ ID NO: 149710 - protein, 10 aa, Artificial Sequence
  Description of Artificial Sequence: Synthetic peptide
  Seed: ARLRELLCEL (PRAME_HUMAN)
AWLRELLCEV

SEQ ID NO: 149711 - protein, 9 aa, Artificial Sequence
  Description of Artificial Sequence: Synthetic peptide
  Seed: KLKIFAMPM (PRAME_HUMAN)
KSKIFAMPQ

SEQ ID NO: 149712 - protein, 10 aa, Artificial Sequence
  Description of Artificial Sequence: Synthetic peptide
  Seed: MERRRLWGSI (PRAME_HUMAN)
MMRRRLWGSV

SEQ ID NO: 149713 - protein, 10 aa, Artificial Sequence
  Description of Artificial Sequence: Synthetic peptide
  Seed: RHVMNPLETL (PRAME_HUMAN)
RNVMNPLETV

SEQ ID NO: 149714 - protein, 10 aa, Artificial Sequence
  Description of Artificial Sequence: Synthetic peptide
  Seed: LERLAYLHAR (PRAME_HUMAN)
LSRLAYLHAK

SEQ ID NO: 149715 - protein, 10 aa, Artificial Sequence
  Description of Artificial Sequence: Synthetic peptide
  Seed: TSQFLSLQCL (PRAME_HUMAN)
TNQFLSLQCF

SEQ ID NO: 149716 - protein, 9 aa, Artificial Sequence
  Description of Artificial Sequence: Synthetic peptide
  Seed: VQAWPFTCL (PRAME_HUMAN)
VKAWPFTCY

SEQ ID NO: 149717 - protein, 10 aa, Artificial Sequence
  Description of Artificial Sequence: Synthetic peptide
  Seed: ALYVDSLFFL (PRAME_HUMAN)
AHYVDSLFFW

SEQ ID NO: 149718 - protein, 10 aa, Artificial Sequence
  Description of Artificial Sequence: Synthetic peptide
  Seed: AVLDGLDVLL (PRAME_HUMAN)
ATLDGLDVLW

SEQ ID NO: 149719 - protein, 10 aa, Artificial Sequence
  Description of Artificial Sequence: Synthetic peptide
  Seed: LPTLAKFSPY (PRAME_HUMAN)
LETLAKFSPW

SEQ ID NO: 149720 - protein, 10 aa, Artificial Sequence
  Description of Artificial Sequence: Synthetic peptide
  Seed: DVSPEPLQAL (PRAME_HUMAN)
DASPEPLQAR

SEQ ID NO: 149721 - protein, 9 aa, Artificial Sequence
  Description of Artificial Sequence: Synthetic peptide
  Seed: EDLEVTCTW (PRAME_HUMAN)
ELLEVTCTW

SEQ ID NO: 149722 - protein, 9 aa, Artificial Sequence
  Description of Artificial Sequence: Synthetic peptide
  Seed: FYDPEPILC (PRAME_HUMAN)
FIDPEPILF

SEQ ID NO: 149723 - protein, 9 aa, Artificial Sequence
  Description of Artificial Sequence: Synthetic peptide
  Seed: KFSPYLGQM (PRAME_HUMAN)
KFSPYLGQF

SEQ ID NO: 149724 - protein, 9 aa, Artificial Sequence
  Description of Artificial Sequence: Synthetic peptide
  Seed: ALAIAALEL (PRAME_HUMAN)
ALAIAALEF

SEQ ID NO: 149725 - protein, 9 aa, Artificial Sequence
  Description of Artificial Sequence: Synthetic peptide
  Seed: LMKGQHLHL (PRAME_HUMAN)
LQKGQHLHY

SEQ ID NO: 149726 - protein, 8 aa, Artificial Sequence
  Description of Artificial Sequence: Synthetic peptide
  Seed: TDDQLLAL (PRAME_HUMAN)
TSDQLLAL

SEQ ID NO: 149727 - protein, 10 aa, Artificial Sequence
  Description of Artificial Sequence: Synthetic peptide
  Seed: YIAQFTSQFL (PRAME_HUMAN)
YDAQFTSQFY

SEQ ID NO: 149728 - protein, 9 aa, Artificial Sequence
  Description of Artificial Sequence: Synthetic peptide
  Seed: RGRLDQLLR (PRAME_HUMAN)
RSRLDQLLM

SEQ ID NO: 149729 - protein, 9 aa, Artificial Sequence
  Description of Artificial Sequence: Synthetic peptide
  Seed: LLKDEALAI (PRAME_HUMAN)
LPKDEALAF

SEQ ID NO: 149730 - protein, 9 aa, Artificial Sequence
  Description of Artificial Sequence: Synthetic peptide
  Seed: LSTEAEQPF (PRAME_HUMAN)
LSTEAEQPM

SEQ ID NO: 149731 - protein, 9 aa, Artificial Sequence
  Description of Artificial Sequence: Synthetic peptide
  Seed: IGLSNLTHV (PRAME_HUMAN)
IILSNLTHI

SEQ ID NO: 149732 - protein, 9 aa, Artificial Sequence
  Description of Artificial Sequence: Synthetic peptide
  Seed: LLKDEALAI (PRAME_HUMAN)
LLKDEALAA

SEQ ID NO: 149733 - protein, 9 aa, Artificial Sequence
  Description of Artificial Sequence: Synthetic peptide
  Seed: SFYGNSISI (PRAME_HUMAN)
SRYGNSISM

SEQ ID NO: 149734 - protein, 9 aa, Artificial Sequence
  Description of Artificial Sequence: Synthetic peptide
  Seed: TEAEQPFIP (PRAME_HUMAN)
TEAEQPFII

SEQ ID NO: 149735 - protein, 9 aa, Artificial Sequence
  Description of Artificial Sequence: Synthetic peptide
  Seed: FSPYLGQMI (PRAME_HUMAN)
FMPYLGQMV

SEQ ID NO: 149736 - protein, 9 aa, Artificial Sequence
  Description of Artificial Sequence: Synthetic peptide
  Seed: VFDECGITD (PRAME_HUMAN)
VLDECGITF

SEQ ID NO: 149737 - protein, 9 aa, Artificial Sequence
  Description of Artificial Sequence: Synthetic peptide
  Seed: YSFPEPEAA (PRAME_HUMAN)
YGFPEPEAH

SEQ ID NO: 149738 - protein, 10 aa, Artificial Sequence
  Description of Artificial Sequence: Synthetic peptide
  Seed: SLLKDEALAI (PRAME_HUMAN)
SMLKDEALAI

SEQ ID NO: 149739 - protein, 9 aa, Artificial Sequence
  Description of Artificial Sequence: Synthetic peptide
  Seed: ACDELFSYL (PRAME_HUMAN)
ANDELFSYY

SEQ ID NO: 149740 - protein, 9 aa, Artificial Sequence
  Description of Artificial Sequence: Synthetic peptide
  Seed: RTFYDPEPI (PRAME_HUMAN)
RAFYDPEPF

SEQ ID NO: 149741 - protein, 10 aa, Artificial Sequence
  Description of Artificial Sequence: Synthetic peptide
  Seed: VLSLSGVMLT (PRAME_HUMAN)
VISLSGVMLV

SEQ ID NO: 149742 - protein, 9 aa, Artificial Sequence
  Description of Artificial Sequence: Synthetic peptide
  Seed: HVMNPLETL (PRAME_HUMAN)
HMMNPLETR

SEQ ID NO: 149743 - protein, 9 aa, Artificial Sequence
  Description of Artificial Sequence: Synthetic peptide
  Seed: IAQFTSQFL (PRAME_HUMAN)
ILQFTSQFV

SEQ ID NO: 149744 - protein, 9 aa, Artificial Sequence
  Description of Artificial Sequence: Synthetic peptide
  Seed: LLKDEALAI (PRAME_HUMAN)
LAKDEALAV

SEQ ID NO: 149745 - protein, 11 aa, Artificial Sequence
  Description of Artificial Sequence: Synthetic peptide
  Seed: IQSRYISMSVW (PRAME_HUMAN)
IMSRYISMSVW

SEQ ID NO: 149746 - protein, 10 aa, Artificial Sequence
  Description of Artificial Sequence: Synthetic peptide
  Seed: LSQSPSVSQL (PRAME_HUMAN)
LCQSPSVSQM

SEQ ID NO: 149747 - protein, 9 aa, Artificial Sequence
  Description of Artificial Sequence: Synthetic peptide
  Seed: HGTLHLERL (PRAME_HUMAN)
HRTLHLERL

SEQ ID NO: 149748 - protein, 9 aa, Artificial Sequence
  Description of Artificial Sequence: Synthetic peptide
  Seed: TLSFYGNSI (PRAME_HUMAN)
TISFYGNSV

SEQ ID NO: 149749 - protein, 9 aa, Artificial Sequence
  Description of Artificial Sequence: Synthetic peptide
  Seed: AFDGRHSQT (PRAME_HUMAN)
AWDGRHSQV

SEQ ID NO: 149750 - protein, 8 aa, Artificial Sequence
  Description of Artificial Sequence: Synthetic peptide
  Seed: MQDIKMIL (PRAME_HUMAN)
MADIKMIL

SEQ ID NO: 149751 - protein, 10 aa, Artificial Sequence
  Description of Artificial Sequence: Synthetic peptide
  Seed: RLVELAGQSL (PRAME_HUMAN)
RQVELAGQSV

SEQ ID NO: 149752 - protein, 10 aa, Artificial Sequence
  Description of Artificial Sequence: Synthetic peptide
  Seed: QSLLQHLIGL (PRAME_HUMAN)
QKLLQHLIGV

SEQ ID NO: 149753 - protein, 11 aa, Artificial Sequence
  Description of Artificial Sequence: Synthetic peptide
  Seed: SIQSRYISMSV (PRAME_HUMAN)
SRQSRYISMSK

SEQ ID NO: 149754 - protein, 9 aa, Artificial Sequence
  Description of Artificial Sequence: Synthetic peptide
  Seed: TLAKFSPYL (PRAME_HUMAN)
TTAKFSPYY

SEQ ID NO: 149755 - protein, 9 aa, Artificial Sequence
  Description of Artificial Sequence: Synthetic peptide
  Seed: VLDGLDVLL (PRAME_HUMAN)
VGDGLDVLF

SEQ ID NO: 149756 - protein, 9 aa, Artificial Sequence
  Description of Artificial Sequence: Synthetic peptide
  Seed: TDDQLLALL (PRAME_HUMAN)
TFDQLLALF

SEQ ID NO: 149757 - protein, 10 aa, Artificial Sequence
  Description of Artificial Sequence: Synthetic peptide
  Seed: AAFDGRHSQT (PRAME_HUMAN)
AGFDGRHSQF

SEQ ID NO: 149758 - protein, 9 aa, Artificial Sequence
  Description of Artificial Sequence: Synthetic peptide
  Seed: RELFPPLFM (PRAME_HUMAN)
RSLFPPLFF

SEQ ID NO: 149759 - protein, 10 aa, Artificial Sequence
  Description of Artificial Sequence: Synthetic peptide
  Seed: IKMILKMVQL (PRAME_HUMAN)
IMMILKMVQL

SEQ ID NO: 149760 - protein, 11 aa, Artificial Sequence
  Description of Artificial Sequence: Synthetic peptide
  Seed: SNLTHVLYPVP (PRAME_HUMAN)
SMLTHVLYPVH

SEQ ID NO: 149761 - protein, 10 aa, Artificial Sequence
  Description of Artificial Sequence: Synthetic peptide
  Seed: SPRRLVELAG (PRAME_HUMAN)
SPRRLVELAA

SEQ ID NO: 149762 - protein, 9 aa, Artificial Sequence
  Description of Artificial Sequence: Synthetic peptide
  Seed: YIAQFTSQF (PRAME_HUMAN)
YWAQFTSQF

SEQ ID NO: 149763 - protein, 10 aa, Artificial Sequence
  Description of Artificial Sequence: Synthetic peptide
  Seed: LQHLIGLSNL (PRAME_HUMAN)
LKHLIGLSNF

SEQ ID NO: 149764 - protein, 9 aa, Artificial Sequence
  Description of Artificial Sequence: Synthetic peptide
  Seed: LAIAALELL (PRAME_HUMAN)
LIIAALELW

SEQ ID NO: 149765 - protein, 9 aa, Artificial Sequence
  Description of Artificial Sequence: Synthetic peptide
  Seed: RELFPPLFM (PRAME_HUMAN)
RQLFPPLFF

SEQ ID NO: 149766 - protein, 9 aa, Artificial Sequence
  Description of Artificial Sequence: Synthetic peptide
  Seed: QSRYISMSV (PRAME_HUMAN)
QPRYISMSA

SEQ ID NO: 149767 - protein, 9 aa, Artificial Sequence
  Description of Artificial Sequence: Synthetic peptide
  Seed: KLKIFAMPM (PRAME_HUMAN)
KYKIFAMPK

SEQ ID NO: 149768 - protein, 9 aa, Artificial Sequence
  Description of Artificial Sequence: Synthetic peptide
  Seed: LAIAALELL (PRAME_HUMAN)
LCIAALELW

SEQ ID NO: 149769 - protein, 10 aa, Artificial Sequence
  Description of Artificial Sequence: Synthetic peptide
  Seed: LERLAYLHAR (PRAME_HUMAN)
LRRLAYLHAF

SEQ ID NO: 149770 - protein, 11 aa, Artificial Sequence
  Description of Artificial Sequence: Synthetic peptide
  Seed: RRRLWGSIQSR (PRAME_HUMAN)
RMRLWGSIQSR

SEQ ID NO: 149771 - protein, 11 aa, Artificial Sequence
  Description of Artificial Sequence: Synthetic peptide
  Seed: FLSLQCLQALY (PRAME_HUMAN)
FMSLQCLQALY

SEQ ID NO: 149772 - protein, 10 aa, Artificial Sequence
  Description of Artificial Sequence: Synthetic peptide
  Seed: RGRLDQLLRH (PRAME_HUMAN)
RLRLDQLLRI

SEQ ID NO: 149773 - protein, 9 aa, Artificial Sequence
  Description of Artificial Sequence: Synthetic peptide
  Seed: ACDELFSYL (PRAME_HUMAN)
ACDELFSYY

SEQ ID NO: 149774 - protein, 9 aa, Artificial Sequence
  Description of Artificial Sequence: Synthetic peptide
  Seed: RLWGSIQSR (PRAME_HUMAN)
RSWGSIQSV

SEQ ID NO: 149775 - protein, 9 aa, Artificial Sequence
  Description of Artificial Sequence: Synthetic peptide
  Seed: SPEPLQALL (PRAME_HUMAN)
SPEPLQALA

SEQ ID NO: 149776 - protein, 9 aa, Artificial Sequence
  Description of Artificial Sequence: Synthetic peptide
  Seed: LYVDSLFFL (PRAME_HUMAN)
LLVDSLFFL

SEQ ID NO: 149777 - protein, 9 aa, Artificial Sequence
  Description of Artificial Sequence: Synthetic peptide
  Seed: QSRYISMSV (PRAME_HUMAN)
QTRYISMSA

SEQ ID NO: 149778 - protein, 10 aa, Artificial Sequence
  Description of Artificial Sequence: Synthetic peptide
  Seed: AVLDGLDVLL (PRAME_HUMAN)
ATLDGLDVLI

SEQ ID NO: 149779 - protein, 10 aa, Artificial Sequence
  Description of Artificial Sequence: Synthetic peptide
  Seed: SLSGVMLTDV (PRAME_HUMAN)
SMSGVMLTDI

SEQ ID NO: 149780 - protein, 10 aa, Artificial Sequence
  Description of Artificial Sequence: Synthetic peptide
  Seed: LPTLAKFSPY (PRAME_HUMAN)
LVTLAKFSPF

SEQ ID NO: 149781 - protein, 9 aa, Artificial Sequence
  Description of Artificial Sequence: Synthetic peptide
  Seed: MINLRRLLL (PRAME_HUMAN)
MTNLRRLLV

SEQ ID NO: 149782 - protein, 11 aa, Artificial Sequence
  Description of Artificial Sequence: Synthetic peptide
  Seed: QALLERASATL (PRAME_HUMAN)
QYLLERASATI

SEQ ID NO: 149783 - protein, 10 aa, Artificial Sequence
  Description of Artificial Sequence: Synthetic peptide
  Seed: VLYPVPLESY (PRAME_HUMAN)
VAYPVPLESM

SEQ ID NO: 149784 - protein, 9 aa, Artificial Sequence
  Description of Artificial Sequence: Synthetic peptide
  Seed: LLLSHIHAS (PRAME_HUMAN)
LALSHIHAL

SEQ ID NO: 149785 - protein, 10 aa, Artificial Sequence
  Description of Artificial Sequence: Synthetic peptide
  Seed: QLLRHVMNPL (PRAME_HUMAN)
QILRHVMNPV

SEQ ID NO: 149786 - protein, 10 aa, Artificial Sequence
  Description of Artificial Sequence: Synthetic peptide
  Seed: RHVMNPLETL (PRAME_HUMAN)
RQVMNPLETV

SEQ ID NO: 149787 - protein, 9 aa, Artificial Sequence
  Description of Artificial Sequence: Synthetic peptide
  Seed: SRYISMSVW (PRAME_HUMAN)
SQYISMSVA

SEQ ID NO: 149788 - protein, 9 aa, Artificial Sequence
  Description of Artificial Sequence: Synthetic peptide
  Seed: AQEVRPRRW (PRAME_HUMAN)
ASEVRPRRW

SEQ ID NO: 149789 - protein, 9 aa, Artificial Sequence
  Description of Artificial Sequence: Synthetic peptide
  Seed: YSFPEPEAA (PRAME_HUMAN)
YPFPEPEAG

SEQ ID NO: 149790 - protein, 9 aa, Artificial Sequence
  Description of Artificial Sequence: Synthetic peptide
  Seed: FYDPEPILC (PRAME_HUMAN)
FEDPEPILF

SEQ ID NO: 149791 - protein, 10 aa, Artificial Sequence
  Description of Artificial Sequence: Synthetic peptide
  Seed: TTLSFYGNSI (PRAME_HUMAN)
TKLSFYGNSV

SEQ ID NO: 149792 - protein, 9 aa, Artificial Sequence
  Description of Artificial Sequence: Synthetic peptide
  Seed: MNPLETLSI (PRAME_HUMAN)
MMPLETLSL

SEQ ID NO: 149793 - protein, 9 aa, Artificial Sequence
  Description of Artificial Sequence: Synthetic peptide
  Seed: DSLFFLRGR (PRAME_HUMAN)
DALFFLRGK

SEQ ID NO: 149794 - protein, 9 aa, Artificial Sequence
  Description of Artificial Sequence: Synthetic peptide
  Seed: GNRASLYSF (PRAME_HUMAN)
GKRASLYSM

SEQ ID NO: 149795 - protein, 11 aa, Artificial Sequence
  Description of Artificial Sequence: Synthetic peptide
  Seed: RLRELLCELGR (PRAME_HUMAN)
RTRELLCELGR

SEQ ID NO: 149796 - protein, 10 aa, Artificial Sequence
  Description of Artificial Sequence: Synthetic peptide
  Seed: AYLHARLREL (PRAME_HUMAN)
AWLHARLREF

SEQ ID NO: 149797 - protein, 10 aa, Artificial Sequence
  Description of Artificial Sequence: Synthetic peptide
  Seed: VLDGLDVLLA (PRAME_HUMAN)
VMDGLDVLLI

SEQ ID NO: 149798 - protein, 9 aa, Artificial Sequence
  Description of Artificial Sequence: Synthetic peptide
  Seed: SQLTTLSFY (PRAME_HUMAN)
SRLTTLSFF

SEQ ID NO: 149799 - protein, 9 aa, Artificial Sequence
  Description of Artificial Sequence: Synthetic peptide
  Seed: CKKLKIFAM (PRAME_HUMAN)
CAKLKIFAA

SEQ ID NO: 149800 - protein, 9 aa, Artificial Sequence
  Description of Artificial Sequence: Synthetic peptide
  Seed: ELFSYLIEK (PRAME_HUMAN)
ENFSYLIER

SEQ ID NO: 149801 - protein, 9 aa, Artificial Sequence
  Description of Artificial Sequence: Synthetic peptide
  Seed: FLRGRLDQL (PRAME_HUMAN)
FIRGRLDQA

SEQ ID NO: 149802 - protein, 8 aa, Artificial Sequence
  Description of Artificial Sequence: Synthetic peptide
  Seed: LSFYGNSI (PRAME_HUMAN)
LSFYGNSW

SEQ ID NO: 149803 - protein, 10 aa, Artificial Sequence
  Description of Artificial Sequence: Synthetic peptide
  Seed: SISISALQSL (PRAME_HUMAN)
SVSISALQSF

SEQ ID NO: 149804 - protein, 9 aa, Artificial Sequence
  Description of Artificial Sequence: Synthetic peptide
  Seed: QDIKMILKM (PRAME_HUMAN)
QEIKMILKT

SEQ ID NO: 149805 - protein, 10 aa, Artificial Sequence
  Description of Artificial Sequence: Synthetic peptide
  Seed: SVSQLSVLSL (PRAME_HUMAN)
SASQLSVLSY

SEQ ID NO: 149806 - protein, 9 aa, Artificial Sequence
  Description of Artificial Sequence: Synthetic peptide
  Seed: EQPFIPVEV (PRAME_HUMAN)
ELPFIPVEV

SEQ ID NO: 149807 - protein, 9 aa, Artificial Sequence
  Description of Artificial Sequence: Synthetic peptide
  Seed: AQFTSQFLS (PRAME_HUMAN)
AIFTSQFLV

SEQ ID NO: 149808 - protein, 10 aa, Artificial Sequence
  Description of Artificial Sequence: Synthetic peptide
  Seed: MPMQDIKMIL (PRAME_HUMAN)
MPMQDIKMIC

SEQ ID NO: 149809 - protein, 9 aa, Artificial Sequence
  Description of Artificial Sequence: Synthetic peptide
  Seed: KEEQYIAQF (PRAME_HUMAN)
KEEQYIAQI

SEQ ID NO: 149810 - protein, 10 aa, Artificial Sequence
  Description of Artificial Sequence: Synthetic peptide
  Seed: MPMQDIKMIL (PRAME_HUMAN)
MTMQDIKMIL

SEQ ID NO: 149811 - protein, 10 aa, Artificial Sequence
  Description of Artificial Sequence: Synthetic peptide
  Seed: MVQAWPFTCL (PRAME_HUMAN)
MYQAWPFTCF

SEQ ID NO: 149812 - protein, 10 aa, Artificial Sequence
  Description of Artificial Sequence: Synthetic peptide
  Seed: AQFTSQFLSL (PRAME_HUMAN)
AMFTSQFLSM

SEQ ID NO: 149813 - protein, 10 aa, Artificial Sequence
  Description of Artificial Sequence: Synthetic peptide
  Seed: KGQHLHLETF (PRAME_HUMAN)
KPQHLHLETY

SEQ ID NO: 149814 - protein, 10 aa, Artificial Sequence
  Description of Artificial Sequence: Synthetic peptide
  Seed: MVQAWPFTCL (PRAME_HUMAN)
MPQAWPFTCM

SEQ ID NO: 149815 - protein, 10 aa, Artificial Sequence
  Description of Artificial Sequence: Synthetic peptide
  Seed: RELFPPLFMA (PRAME_HUMAN)
RYLFPPLFMA

SEQ ID NO: 149816 - protein, 9 aa, Artificial Sequence
  Description of Artificial Sequence: Synthetic peptide
  Seed: FSYLIEKVK (PRAME_HUMAN)
FTYLIEKVR

SEQ ID NO: 149817 - protein, 9 aa, Artificial Sequence
  Description of Artificial Sequence: Synthetic peptide
  Seed: SHIHASSYI (PRAME_HUMAN)
SMIHASSYL

SEQ ID NO: 149818 - protein, 9 aa, Artificial Sequence
  Description of Artificial Sequence: Synthetic peptide
  Seed: SRYISMSVW (PRAME_HUMAN)
SIYISMSVY

SEQ ID NO: 149819 - protein, 10 aa, Artificial Sequence
  Description of Artificial Sequence: Synthetic peptide
  Seed: LFPPLFMAAF (PRAME_HUMAN)
LYPPLFMAAF

SEQ ID NO: 149820 - protein, 9 aa, Artificial Sequence
  Description of Artificial Sequence: Synthetic peptide
  Seed: SPRRLVELA (PRAME_HUMAN)
SPRRLVELF

SEQ ID NO: 149821 - protein, 10 aa, Artificial Sequence
  Description of Artificial Sequence: Synthetic peptide
  Seed: ALYVDSLFFL (PRAME_HUMAN)
APYVDSLFFI

SEQ ID NO: 149822 - protein, 9 aa, Artificial Sequence
  Description of Artificial Sequence: Synthetic peptide
  Seed: KVDGLSTEA (PRAME_HUMAN)
KYDGLSTEL

SEQ ID NO: 149823 - protein, 10 aa, Artificial Sequence
  Description of Artificial Sequence: Synthetic peptide
  Seed: RLVELAGQSL (PRAME_HUMAN)
RAVELAGQSL

SEQ ID NO: 149824 - protein, 9 aa, Artificial Sequence
  Description of Artificial Sequence: Synthetic peptide
  Seed: YIAQFTSQF (PRAME_HUMAN)
YLAQFTSQL

SEQ ID NO: 149825 - protein, 9 aa, Artificial Sequence
  Description of Artificial Sequence: Synthetic peptide
  Seed: FLRGRLDQL (PRAME_HUMAN)
FQRGRLDQV

SEQ ID NO: 149826 - protein, 9 aa, Artificial Sequence
  Description of Artificial Sequence: Synthetic peptide
  Seed: LTDVSPEPL (PRAME_HUMAN)
LMDVSPEPL

SEQ ID NO: 149827 - protein, 10 aa, Artificial Sequence
  Description of Artificial Sequence: Synthetic peptide
  Seed: RLSEGDVMHL (PRAME_HUMAN)
RVSEGDVMHF

SEQ ID NO: 149828 - protein, 10 aa, Artificial Sequence
  Description of Artificial Sequence: Synthetic peptide
  Seed: KKLKIFAMPM (PRAME_HUMAN)
KSLKIFAMPF

SEQ ID NO: 149829 - protein, 9 aa, Artificial Sequence
  Description of Artificial Sequence: Synthetic peptide
  Seed: CKKLKIFAM (PRAME_HUMAN)
CVKLKIFAM

SEQ ID NO: 149830 - protein, 9 aa, Artificial Sequence
  Description of Artificial Sequence: Synthetic peptide
  Seed: HVMNPLETL (PRAME_HUMAN)
HSMNPLETI

SEQ ID NO: 149831 - protein, 10 aa, Artificial Sequence
  Description of Artificial Sequence: Synthetic peptide
  Seed: IQSRYISMSV (PRAME_HUMAN)
IMSRYISMSM

SEQ ID NO: 149832 - protein, 10 aa, Artificial Sequence
  Description of Artificial Sequence: Synthetic peptide
  Seed: SPSVSQLSVL (PRAME_HUMAN)
SASVSQLSVW

SEQ ID NO: 149833 - protein, 9 aa, Artificial Sequence
  Description of Artificial Sequence: Synthetic peptide
  Seed: GQHLHLETF (PRAME_HUMAN)
GTHLHLETF

SEQ ID NO: 149834 - protein, 9 aa, Artificial Sequence
  Description of Artificial Sequence: Synthetic peptide
  Seed: RLAYLHARL (PRAME_HUMAN)
RVAYLHARL

SEQ ID NO: 149835 - protein, 9 aa, Artificial Sequence
  Description of Artificial Sequence: Synthetic peptide
  Seed: SQSPSVSQL (PRAME_HUMAN)
SHSPSVSQV

SEQ ID NO: 149836 - protein, 10 aa, Artificial Sequence
  Description of Artificial Sequence: Synthetic peptide
  Seed: GRPSMVWLSA (PRAME_HUMAN)
GPPSMVWLSL

SEQ ID NO: 149837 - protein, 8 aa, Artificial Sequence
  Description of Artificial Sequence: Synthetic peptide
  Seed: TDDQLLAL (PRAME_HUMAN)
TWDQLLAL

SEQ ID NO: 149838 - protein, 10 aa, Artificial Sequence
  Description of Artificial Sequence: Synthetic peptide
  Seed: AVLDGLDVLL (PRAME_HUMAN)
AMLDGLDVLR

SEQ ID NO: 149839 - protein, 10 aa, Artificial Sequence
  Description of Artificial Sequence: Synthetic peptide
  Seed: EAAQPMTKKR (PRAME_HUMAN)
EIAQPMTKKK

SEQ ID NO: 149840 - protein, 10 aa, Artificial Sequence
  Description of Artificial Sequence: Synthetic peptide
  Seed: FIPVEVLVDL (PRAME_HUMAN)
FEPVEVLVDY

SEQ ID NO: 149841 - protein, 10 aa, Artificial Sequence
  Description of Artificial Sequence: Synthetic peptide
  Seed: ETFKAVLDGL (PRAME_HUMAN)
EIFKAVLDGK

SEQ ID NO: 149842 - protein, 9 aa, Artificial Sequence
  Description of Artificial Sequence: Synthetic peptide
  Seed: SIQSRYISM (PRAME_HUMAN)
SQQSRYISM

SEQ ID NO: 149843 - protein, 10 aa, Artificial Sequence
  Description of Artificial Sequence: Synthetic peptide
  Seed: LPTLAKFSPY (PRAME_HUMAN)
LMTLAKFSPY

SEQ ID NO: 149844 - protein, 9 aa, Artificial Sequence
  Description of Artificial Sequence: Synthetic peptide
  Seed: MVQAWPFTC (PRAME_HUMAN)
MTQAWPFTL

SEQ ID NO: 149845 - protein, 9 aa, Artificial Sequence
  Description of Artificial Sequence: Synthetic peptide
  Seed: RLLLSHIHA (PRAME_HUMAN)
RTLLSHIHK

SEQ ID NO: 149846 - protein, 9 aa, Artificial Sequence
  Description of Artificial Sequence: Synthetic peptide
  Seed: ISPEKEEQY (PRAME_HUMAN)
IMPEKEEQI

SEQ ID NO: 149847 - protein, 10 aa, Artificial Sequence
  Description of Artificial Sequence: Synthetic peptide
  Seed: ALAIAALELL (PRAME_HUMAN)
AQAIAALELI

SEQ ID NO: 149848 - protein, 10 aa, Artificial Sequence
  Description of Artificial Sequence: Synthetic peptide
  Seed: LLLSHIHASS (PRAME_HUMAN)
LMLSHIHASM

SEQ ID NO: 149849 - protein, 8 aa, Artificial Sequence
  Description of Artificial Sequence: Synthetic peptide
  Seed: FTSQFLSL (PRAME_HUMAN)
FASQFLSF

SEQ ID NO: 149850 - protein, 10 aa, Artificial Sequence
  Description of Artificial Sequence: Synthetic peptide
  Seed: RGRLDQLLRH (PRAME_HUMAN)
RLRLDQLLRF

SEQ ID NO: 149851 - protein, 10 aa, Artificial Sequence
  Description of Artificial Sequence: Synthetic peptide
  Seed: ESYEDIHGTL (PRAME_HUMAN)
ESYEDIHGTR

SEQ ID NO: 149852 - protein, 10 aa, Artificial Sequence
  Description of Artificial Sequence: Synthetic peptide
  Seed: RLDQLLRHVM (PRAME_HUMAN)
RQDQLLRHVF

SEQ ID NO: 149853 - protein, 10 aa, Artificial Sequence
  Description of Artificial Sequence: Synthetic peptide
  Seed: SNLTHVLYPV (PRAME_HUMAN)
SGLTHVLYPI

SEQ ID NO: 149854 - protein, 9 aa, Artificial Sequence
  Description of Artificial Sequence: Synthetic peptide
  Seed: QLLALLPSL (PRAME_HUMAN)
QSLALLPSV

SEQ ID NO: 149855 - protein, 10 aa, Artificial Sequence
  Description of Artificial Sequence: Synthetic peptide
  Seed: AQFTSQFLSL (PRAME_HUMAN)
ATFTSQFLSY

SEQ ID NO: 149856 - protein, 9 aa, Artificial Sequence
  Description of Artificial Sequence: Synthetic peptide
  Seed: AQFTSQFLS (PRAME_HUMAN)
AIFTSQFLI

SEQ ID NO: 149857 - protein, 10 aa, Artificial Sequence
  Description of Artificial Sequence: Synthetic peptide
  Seed: RELFPPLFMA (PRAME_HUMAN)
RSLFPPLFMM

SEQ ID NO: 149858 - protein, 9 aa, Artificial Sequence
  Description of Artificial Sequence: Synthetic peptide
  Seed: KAMVQAWPF (PRAME_HUMAN)
KTMVQAWPL

SEQ ID NO: 149859 - protein, 9 aa, Artificial Sequence
  Description of Artificial Sequence: Synthetic peptide
  Seed: ALQSLLQHL (PRAME_HUMAN)
ATQSLLQHR

SEQ ID NO: 149860 - protein, 9 aa, Artificial Sequence
  Description of Artificial Sequence: Synthetic peptide
  Seed: YLGQMINLR (PRAME_HUMAN)
YVGQMINLK

SEQ ID NO: 149861 - protein, 10 aa, Artificial Sequence
  Description of Artificial Sequence: Synthetic peptide
  Seed: KDEALAIAAL (PRAME_HUMAN)
KCEALAIAAA

SEQ ID NO: 149862 - protein, 9 aa, Artificial Sequence
  Description of Artificial Sequence: Synthetic peptide
  Seed: YLHARLREL (PRAME_HUMAN)
YLHARLREV

SEQ ID NO: 149863 - protein, 10 aa, Artificial Sequence
  Description of Artificial Sequence: Synthetic peptide
  Seed: FAMPMQDIKM (PRAME_HUMAN)
FAMPMQDIKV

SEQ ID NO: 149864 - protein, 10 aa, Artificial Sequence
  Description of Artificial Sequence: Synthetic peptide
  Seed: LKAMVQAWPF (PRAME_HUMAN)
LFAMVQAWPW

SEQ ID NO: 149865 - protein, 10 aa, Artificial Sequence
  Description of Artificial Sequence: Synthetic peptide
  Seed: RGRLDQLLRH (PRAME_HUMAN)
RQRLDQLLRR

SEQ ID NO: 149866 - protein, 10 aa, Artificial Sequence
  Description of Artificial Sequence: Synthetic peptide
  Seed: RHVMNPLETL (PRAME_HUMAN)
RWVMNPLETV

SEQ ID NO: 149867 - protein, 9 aa, Artificial Sequence
  Description of Artificial Sequence: Synthetic peptide
  Seed: TSPRRLVEL (PRAME_HUMAN)
TAPRRLVEL

SEQ ID NO: 149868 - protein, 9 aa, Artificial Sequence
  Description of Artificial Sequence: Synthetic peptide
  Seed: DVSPEPLQA (PRAME_HUMAN)
DTSPEPLQV

SEQ ID NO: 149869 - protein, 9 aa, Artificial Sequence
  Description of Artificial Sequence: Synthetic peptide
  Seed: ETLSITNCR (PRAME_HUMAN)
EVLSITNCY

SEQ ID NO: 149870 - protein, 9 aa, Artificial Sequence
  Description of Artificial Sequence: Synthetic peptide
  Seed: LQCLQALYV (PRAME_HUMAN)
LLCLQALYL

SEQ ID NO: 149871 - protein, 9 aa, Artificial Sequence
  Description of Artificial Sequence: Synthetic peptide
  Seed: QMINLRRLL (PRAME_HUMAN)
QQINLRRLM

SEQ ID NO: 149872 - protein, 9 aa, Artificial Sequence
  Description of Artificial Sequence: Synthetic peptide
  Seed: LQCLQALYV (PRAME_HUMAN)
LMCLQALYV

SEQ ID NO: 149873 - protein, 10 aa, Artificial Sequence
  Description of Artificial Sequence: Synthetic peptide
  Seed: RHVMNPLETL (PRAME_HUMAN)
RFVMNPLETV

SEQ ID NO: 149874 - protein, 10 aa, Artificial Sequence
  Description of Artificial Sequence: Synthetic peptide
  Seed: YEDIHGTLHL (PRAME_HUMAN)
YADIHGTLHM

SEQ ID NO: 149875 - protein, 9 aa, Artificial Sequence
  Description of Artificial Sequence: Synthetic peptide
  Seed: MINLRRLLL (PRAME_HUMAN)
MFNLRRLLK

SEQ ID NO: 149876 - protein, 9 aa, Artificial Sequence
  Description of Artificial Sequence: Synthetic peptide
  Seed: ISISALQSL (PRAME_HUMAN)
ITISALQSA

SEQ ID NO: 149877 - protein, 9 aa, Artificial Sequence
  Description of Artificial Sequence: Synthetic peptide
  Seed: LAIAALELL (PRAME_HUMAN)
LQIAALELV

SEQ ID NO: 149878 - protein, 10 aa, Artificial Sequence
  Description of Artificial Sequence: Synthetic peptide
  Seed: KAVLDGLDVL (PRAME_HUMAN)
KQVLDGLDVL

SEQ ID NO: 149879 - protein, 9 aa, Artificial Sequence
  Description of Artificial Sequence: Synthetic peptide
  Seed: KNVLRLCCK (PRAME_HUMAN)
KLVLRLCCR

SEQ ID NO: 149880 - protein, 10 aa, Artificial Sequence
  Description of Artificial Sequence: Synthetic peptide
  Seed: IQSRYISMSV (PRAME_HUMAN)
IKSRYISMSK

SEQ ID NO: 149881 - protein, 10 aa, Artificial Sequence
  Description of Artificial Sequence: Synthetic peptide
  Seed: CSQLTTLSFY (PRAME_HUMAN)
CRQLTTLSFY

SEQ ID NO: 149882 - protein, 11 aa, Artificial Sequence
  Description of Artificial Sequence: Synthetic peptide
  Seed: SLLKDEALAIA (PRAME_HUMAN)
SLLKDEALAII

SEQ ID NO: 149883 - protein, 9 aa, Artificial Sequence
  Description of Artificial Sequence: Synthetic peptide
  Seed: TLAKFSPYL (PRAME_HUMAN)
TMAKFSPYT

SEQ ID NO: 149884 - protein, 9 aa, Artificial Sequence
  Description of Artificial Sequence: Synthetic peptide
  Seed: SIEDLEVTC (PRAME_HUMAN)
SMEDLEVTM

SEQ ID NO: 149885 - protein, 9 aa, Artificial Sequence
  Description of Artificial Sequence: Synthetic peptide
  Seed: SRYISMSVW (PRAME_HUMAN)
SSYISMSVY

SEQ ID NO: 149886 - protein, 9 aa, Artificial Sequence
  Description of Artificial Sequence: Synthetic peptide
  Seed: QALYVDSLF (PRAME_HUMAN)
QGLYVDSLW

SEQ ID NO: 149887 - protein, 10 aa, Artificial Sequence
  Description of Artificial Sequence: Synthetic peptide
  Seed: LSTEAEQPFI (PRAME_HUMAN)
LTTEAEQPFW

SEQ ID NO: 149888 - protein, 9 aa, Artificial Sequence
  Description of Artificial Sequence: Synthetic peptide
  Seed: YIAQFTSQF (PRAME_HUMAN)
YYAQFTSQA

SEQ ID NO: 149889 - protein, 9 aa, Artificial Sequence
  Description of Artificial Sequence: Synthetic peptide
  Seed: RGRLDQLLR (PRAME_HUMAN)
RVRLDQLLR

SEQ ID NO: 149890 - protein, 11 aa, Artificial Sequence
  Description of Artificial Sequence: Synthetic peptide
  Seed: SIQSRYISMSV (PRAME_HUMAN)
SVQSRYISMSK

SEQ ID NO: 149891 - protein, 9 aa, Artificial Sequence
  Description of Artificial Sequence: Synthetic peptide
  Seed: WPFTCLPLG (PRAME_HUMAN)
WPFTCLPLV

SEQ ID NO: 149892 - protein, 9 aa, Artificial Sequence
  Description of Artificial Sequence: Synthetic peptide
  Seed: HVMNPLETL (PRAME_HUMAN)
HYMNPLETY

SEQ ID NO: 149893 - protein, 10 aa, Artificial Sequence
  Description of Artificial Sequence: Synthetic peptide
  Seed: GRPSMVWLSA (PRAME_HUMAN)
GRPSMVWLSM

SEQ ID NO: 149894 - protein, 9 aa, Artificial Sequence
  Description of Artificial Sequence: Synthetic peptide
  Seed: LSNLTHVLY (PRAME_HUMAN)
LFNLTHVLY

SEQ ID NO: 149895 - protein, 10 aa, Artificial Sequence
  Description of Artificial Sequence: Synthetic peptide
  Seed: QLLALLPSLS (PRAME_HUMAN)
QILALLPSLV

SEQ ID NO: 149896 - protein, 10 aa, Artificial Sequence
  Description of Artificial Sequence: Synthetic peptide
  Seed: DVSPEPLQAL (PRAME_HUMAN)
DASPEPLQAW

SEQ ID NO: 149897 - protein, 9 aa, Artificial Sequence
  Description of Artificial Sequence: Synthetic peptide
  Seed: KVDGLSTEA (PRAME_HUMAN)
KGDGLSTEI

SEQ ID NO: 149898 - protein, 9 aa, Artificial Sequence
  Description of Artificial Sequence: Synthetic peptide
  Seed: MVQAWPFTC (PRAME_HUMAN)
MQQAWPFTI

SEQ ID NO: 149899 - protein, 10 aa, Artificial Sequence
  Description of Artificial Sequence: Synthetic peptide
  Seed: IGLSNLTHVL (PRAME_HUMAN)
IVLSNLTHVI

SEQ ID NO: 149900 - protein, 9 aa, Artificial Sequence
  Description of Artificial Sequence: Synthetic peptide
  Seed: LYVDSLFFL (PRAME_HUMAN)
LVVDSLFFV

SEQ ID NO: 149901 - protein, 10 aa, Artificial Sequence
  Description of Artificial Sequence: Synthetic peptide
  Seed: MQDIKMILKM (PRAME_HUMAN)
MQDIKMILKY

SEQ ID NO: 149902 - protein, 10 aa, Artificial Sequence
  Description of Artificial Sequence: Synthetic peptide
  Seed: AVLDGLDVLL (PRAME_HUMAN)
AILDGLDVLV

SEQ ID NO: 149903 - protein, 10 aa, Artificial Sequence
  Description of Artificial Sequence: Synthetic peptide
  Seed: IGLSNLTHVL (PRAME_HUMAN)
IPLSNLTHVI

SEQ ID NO: 149904 - protein, 9 aa, Artificial Sequence
  Description of Artificial Sequence: Synthetic peptide
  Seed: VLDGLDVLL (PRAME_HUMAN)
VVDGLDVLM

SEQ ID NO: 149905 - protein, 9 aa, Artificial Sequence
  Description of Artificial Sequence: Synthetic peptide
  Seed: ALAIAALEL (PRAME_HUMAN)
AAAIAALEL

SEQ ID NO: 149906 - protein, 9 aa, Artificial Sequence
  Description of Artificial Sequence: Synthetic peptide
  Seed: HVMNPLETL (PRAME_HUMAN)
HTMNPLETY

SEQ ID NO: 149907 - protein, 10 aa, Artificial Sequence
  Description of Artificial Sequence: Synthetic peptide
  Seed: KKLKIFAMPM (PRAME_HUMAN)
KTLKIFAMPV

SEQ ID NO: 149908 - protein, 10 aa, Artificial Sequence
  Description of Artificial Sequence: Synthetic peptide
  Seed: FYDPEPILCP (PRAME_HUMAN)
FWDPEPILCF

SEQ ID NO: 149909 - protein, 9 aa, Artificial Sequence
  Description of Artificial Sequence: Synthetic peptide
  Seed: QALYVDSLF (PRAME_HUMAN)
QQLYVDSLF

SEQ ID NO: 149910 - protein, 10 aa, Artificial Sequence
  Description of Artificial Sequence: Synthetic peptide
  Seed: KKLKIFAMPM (PRAME_HUMAN)
KLLKIFAMPY

SEQ ID NO: 149911 - protein, 9 aa, Artificial Sequence
  Description of Artificial Sequence: Synthetic peptide
  Seed: EDLEVTCTW (PRAME_HUMAN)
EILEVTCTY

SEQ ID NO: 149912 - protein, 10 aa, Artificial Sequence
  Description of Artificial Sequence: Synthetic peptide
  Seed: TTLSFYGNSI (PRAME_HUMAN)
TFLSFYGNSL

SEQ ID NO: 149913 - protein, 9 aa, Artificial Sequence
  Description of Artificial Sequence: Synthetic peptide
  Seed: YGNSISISA (PRAME_HUMAN)
YTNSISISY

SEQ ID NO: 149914 - protein, 11 aa, Artificial Sequence
  Description of Artificial Sequence: Synthetic peptide
  Seed: YISPEKEEQYI (PRAME_HUMAN)
YLSPEKEEQYL

SEQ ID NO: 149915 - protein, 9 aa, Artificial Sequence
  Description of Artificial Sequence: Synthetic peptide
  Seed: VSQLSVLSL (PRAME_HUMAN)
VMQLSVLSL

SEQ ID NO: 149916 - protein, 10 aa, Artificial Sequence
  Description of Artificial Sequence: Synthetic peptide
  Seed: GACDELFSYL (PRAME_HUMAN)
GACDELFSYY

SEQ ID NO: 149917 - protein, 9 aa, Artificial Sequence
  Description of Artificial Sequence: Synthetic peptide
  Seed: LSLQCLQAL (PRAME_HUMAN)
LVLQCLQAV

SEQ ID NO: 149918 - protein, 9 aa, Artificial Sequence
  Description of Artificial Sequence: Synthetic peptide
  Seed: LFMAAFDGR (PRAME_HUMAN)
LSMAAFDGK

SEQ ID NO: 149919 - protein, 11 aa, Artificial Sequence
  Description of Artificial Sequence: Synthetic peptide
  Seed: ISMSVWTSPRR (PRAME_HUMAN)
IQMSVWTSPRR

SEQ ID NO: 149920 - protein, 9 aa, Artificial Sequence
  Description of Artificial Sequence: Synthetic peptide
  Seed: VSPEPLQAL (PRAME_HUMAN)
VVPEPLQAW

SEQ ID NO: 149921 - protein, 9 aa, Artificial Sequence
  Description of Artificial Sequence: Synthetic peptide
  Seed: SQLTTLSFY (PRAME_HUMAN)
SLLTTLSFF

SEQ ID NO: 149922 - protein, 9 aa, Artificial Sequence
  Description of Artificial Sequence: Synthetic peptide
  Seed: SISALQSLL (PRAME_HUMAN)
SASALQSLL

SEQ ID NO: 149923 - protein, 10 aa, Artificial Sequence
  Description of Artificial Sequence: Synthetic peptide
  Seed: DELFSYLIEK (PRAME_HUMAN)
DALFSYLIEK

SEQ ID NO: 149924 - protein, 9 aa, Artificial Sequence
  Description of Artificial Sequence: Synthetic peptide
  Seed: VQLDSIEDL (PRAME_HUMAN)
VMLDSIEDA

SEQ ID NO: 149925 - protein, 9 aa, Artificial Sequence
  Description of Artificial Sequence: Synthetic peptide
  Seed: MVQAWPFTC (PRAME_HUMAN)
MSQAWPFTI

SEQ ID NO: 149926 - protein, 8 aa, Artificial Sequence
  Description of Artificial Sequence: Synthetic peptide
  Seed: YVDSLFFL (PRAME_HUMAN)
YQDSLFFL

SEQ ID NO: 149927 - protein, 9 aa, Artificial Sequence
  Description of Artificial Sequence: Synthetic peptide
  Seed: CSQLTTLSF (PRAME_HUMAN)
CPQLTTLSM

SEQ ID NO: 149928 - protein, 9 aa, Artificial Sequence
  Description of Artificial Sequence: Synthetic peptide
  Seed: ELFSYLIEK (PRAME_HUMAN)
ESFSYLIER

SEQ ID NO: 149929 - protein, 9 aa, Artificial Sequence
  Description of Artificial Sequence: Synthetic peptide
  Seed: ISPEKEEQY (PRAME_HUMAN)
IAPEKEEQW

SEQ ID NO: 149930 - protein, 10 aa, Artificial Sequence
  Description of Artificial Sequence: Synthetic peptide
  Seed: RLAYLHARLR (PRAME_HUMAN)
RLAYLHARLK

SEQ ID NO: 149931 - protein, 9 aa, Artificial Sequence
  Description of Artificial Sequence: Synthetic peptide
  Seed: VQAWPFTCL (PRAME_HUMAN)
VVAWPFTCL

SEQ ID NO: 149932 - protein, 10 aa, Artificial Sequence
  Description of Artificial Sequence: Synthetic peptide
  Seed: KGQHLHLETF (PRAME_HUMAN)
KEQHLHLETY

SEQ ID NO: 149933 - protein, 9 aa, Artificial Sequence
  Description of Artificial Sequence: Synthetic peptide
  Seed: ALLPSLSHC (PRAME_HUMAN)
AVLPSLSHA

SEQ ID NO: 149934 - protein, 10 aa, Artificial Sequence
  Description of Artificial Sequence: Synthetic peptide
  Seed: ALLERASATL (PRAME_HUMAN)
AMLERASATV

SEQ ID NO: 149935 - protein, 10 aa, Artificial Sequence
  Description of Artificial Sequence: Synthetic peptide
  Seed: QYIAQFTSQF (PRAME_HUMAN)
QMIAQFTSQM

SEQ ID NO: 149936 - protein, 9 aa, Artificial Sequence
  Description of Artificial Sequence: Synthetic peptide
  Seed: SHIHASSYI (PRAME_HUMAN)
SEIHASSYF

SEQ ID NO: 149937 - protein, 11 aa, Artificial Sequence
  Description of Artificial Sequence: Synthetic peptide
  Seed: AAFDGRHSQTL (PRAME_HUMAN)
ASFDGRHSQTY

SEQ ID NO: 149938 - protein, 8 aa, Artificial Sequence
  Description of Artificial Sequence: Synthetic peptide
  Seed: CTWKLPTL (PRAME_HUMAN)
CQWKLPTV

SEQ ID NO: 149939 - protein, 10 aa, Artificial Sequence
  Description of Artificial Sequence: Synthetic peptide
  Seed: AVLDGLDVLL (PRAME_HUMAN)
AALDGLDVLL

SEQ ID NO: 149940 - protein, 10 aa, Artificial Sequence
  Description of Artificial Sequence: Synthetic peptide
  Seed: LPTLAKFSPY (PRAME_HUMAN)
LGTLAKFSPF

SEQ ID NO: 149941 - protein, 10 aa, Artificial Sequence
  Description of Artificial Sequence: Synthetic peptide
  Seed: RGRLDQLLRH (PRAME_HUMAN)
RDRLDQLLRK

SEQ ID NO: 149942 - protein, 9 aa, Artificial Sequence
  Description of Artificial Sequence: Synthetic peptide
  Seed: RLSEGDVMH (PRAME_HUMAN)
RVSEGDVMY

SEQ ID NO: 149943 - protein, 9 aa, Artificial Sequence
  Description of Artificial Sequence: Synthetic peptide
  Seed: LTDVSPEPL (PRAME_HUMAN)
LNDVSPEPL

SEQ ID NO: 149944 - protein, 9 aa, Artificial Sequence
  Description of Artificial Sequence: Synthetic peptide
  Seed: KLKIFAMPM (PRAME_HUMAN)
KFKIFAMPY

SEQ ID NO: 149945 - protein, 8 aa, Artificial Sequence
  Description of Artificial Sequence: Synthetic peptide
  Seed: TDDQLLAL (PRAME_HUMAN)
TADQLLAV

SEQ ID NO: 149946 - protein, 9 aa, Artificial Sequence
  Description of Artificial Sequence: Synthetic peptide
  Seed: FAMPMQDIK (PRAME_HUMAN)
FVMPMQDIR

SEQ ID NO: 149947 - protein, 10 aa, Artificial Sequence
  Description of Artificial Sequence: Synthetic peptide
  Seed: ALYVDSLFFL (PRAME_HUMAN)
ANYVDSLFFL

SEQ ID NO: 149948 - protein, 9 aa, Artificial Sequence
  Description of Artificial Sequence: Synthetic peptide
  Seed: FTCLPLGVL (PRAME_HUMAN)
FTCLPLGVW

SEQ ID NO: 149949 - protein, 9 aa, Artificial Sequence
  Description of Artificial Sequence: Synthetic peptide
  Seed: YSFPEPEAA (PRAME_HUMAN)
YCFPEPEAF

SEQ ID NO: 149950 - protein, 9 aa, Artificial Sequence
  Description of Artificial Sequence: Synthetic peptide
  Seed: LSHIHASSY (PRAME_HUMAN)
LHHIHASSY

SEQ ID NO: 149951 - protein, 9 aa, Artificial Sequence
  Description of Artificial Sequence: Synthetic peptide
  Seed: SFYGNSISI (PRAME_HUMAN)
SVYGNSISY

SEQ ID NO: 149952 - protein, 9 aa, Artificial Sequence
  Description of Artificial Sequence: Synthetic peptide
  Seed: VSPEPLQAL (PRAME_HUMAN)
VMPEPLQAV

SEQ ID NO: 149953 - protein, 9 aa, Artificial Sequence
  Description of Artificial Sequence: Synthetic peptide
  Seed: VSQLSVLSL (PRAME_HUMAN)
VTQLSVLSI

SEQ ID NO: 149954 - protein, 9 aa, Artificial Sequence
  Description of Artificial Sequence: Synthetic peptide
  Seed: MHLSQSPSV (PRAME_HUMAN)
MNLSQSPSF

SEQ ID NO: 149955 - protein, 9 aa, Artificial Sequence
  Description of Artificial Sequence: Synthetic peptide
  Seed: NSHQDFWTV (PRAME_HUMAN)
NMHQDFWTM

SEQ ID NO: 149956 - protein, 11 aa, Artificial Sequence
  Description of Artificial Sequence: Synthetic peptide
  Seed: ESYEDIHGTLH (PRAME_HUMAN)
ETYEDIHGTLR

SEQ ID NO: 149957 - protein, 9 aa, Artificial Sequence
  Description of Artificial Sequence: Synthetic peptide
  Seed: IFAMPMQDI (PRAME_HUMAN)
IYAMPMQDL

SEQ ID NO: 149958 - protein, 9 aa, Artificial Sequence
  Description of Artificial Sequence: Synthetic peptide
  Seed: GACDELFSY (PRAME_HUMAN)
GLCDELFSF

SEQ ID NO: 149959 - protein, 10 aa, Artificial Sequence
  Description of Artificial Sequence: Synthetic peptide
  Seed: RHVMNPLETL (PRAME_HUMAN)
RSVMNPLETL

SEQ ID NO: 149960 - protein, 9 aa, Artificial Sequence
  Description of Artificial Sequence: Synthetic peptide
  Seed: CPHCGDRTF (PRAME_HUMAN)
CPHCGDRTM

SEQ ID NO: 149961 - protein, 10 aa, Artificial Sequence
  Description of Artificial Sequence: Synthetic peptide
  Seed: SPYLGQMINL (PRAME_HUMAN)
SVYLGQMINI

SEQ ID NO: 149962 - protein, 9 aa, Artificial Sequence
  Description of Artificial Sequence: Synthetic peptide
  Seed: DEALAIAAL (PRAME_HUMAN)
DEALAIAAI

SEQ ID NO: 149963 - protein, 9 aa, Artificial Sequence
  Description of Artificial Sequence: Synthetic peptide
  Seed: TLHLERLAY (PRAME_HUMAN)
TAHLERLAL

SEQ ID NO: 149964 - protein, 9 aa, Artificial Sequence
  Description of Artificial Sequence: Synthetic peptide
  Seed: LYVDSLFFL (PRAME_HUMAN)
LMVDSLFFI

SEQ ID NO: 149965 - protein, 9 aa, Artificial Sequence
  Description of Artificial Sequence: Synthetic peptide
  Seed: LYPVPLESY (PRAME_HUMAN)
LRPVPLESY

SEQ ID NO: 149966 - protein, 9 aa, Artificial Sequence
  Description of Artificial Sequence: Synthetic peptide
  Seed: AVLDGLDVL (PRAME_HUMAN)
AALDGLDVF

SEQ ID NO: 149967 - protein, 8 aa, Artificial Sequence
  Description of Artificial Sequence: Synthetic peptide
  Seed: ITDDQLLA (PRAME_HUMAN)
IFDDQLLL

SEQ ID NO: 149968 - protein, 9 aa, Artificial Sequence
  Description of Artificial Sequence: Synthetic peptide
  Seed: LTDVSPEPL (PRAME_HUMAN)
LIDVSPEPF

SEQ ID NO: 149969 - protein, 9 aa, Artificial Sequence
  Description of Artificial Sequence: Synthetic peptide
  Seed: LGRPSMVWL (PRAME_HUMAN)
LIRPSMVWK

SEQ ID NO: 149970 - protein, 9 aa, Artificial Sequence
  Description of Artificial Sequence: Synthetic peptide
  Seed: LPRELFPPL (PRAME_HUMAN)
LQRELFPPV

SEQ ID NO: 149971 - protein, 10 aa, Artificial Sequence
  Description of Artificial Sequence: Synthetic peptide
  Seed: FLRGRLDQLL (PRAME_HUMAN)
FLRGRLDQLV

SEQ ID NO: 149972 - protein, 9 aa, Artificial Sequence
  Description of Artificial Sequence: Synthetic peptide
  Seed: YISMSVWTS (PRAME_HUMAN)
YMSMSVWTC

SEQ ID NO: 149973 - protein, 11 aa, Artificial Sequence
  Description of Artificial Sequence: Synthetic peptide
  Seed: SANPCPHCGDR (PRAME_HUMAN)
STNPCPHCGDY

SEQ ID NO: 149974 - protein, 9 aa, Artificial Sequence
  Description of Artificial Sequence: Synthetic peptide
  Seed: ACDELFSYL (PRAME_HUMAN)
AGDELFSYM

SEQ ID NO: 149975 - protein, 10 aa, Artificial Sequence
  Description of Artificial Sequence: Synthetic peptide
  Seed: GTLHLERLAY (PRAME_HUMAN)
GQLHLERLAY

SEQ ID NO: 149976 - protein, 9 aa, Artificial Sequence
  Description of Artificial Sequence: Synthetic peptide
  Seed: QLLALLPSL (PRAME_HUMAN)
QMLALLPSR

SEQ ID NO: 149977 - protein, 9 aa, Artificial Sequence
  Description of Artificial Sequence: Synthetic peptide
  Seed: TDDQLLALL (PRAME_HUMAN)
TFDQLLALM

SEQ ID NO: 149978 - protein, 10 aa, Artificial Sequence
  Description of Artificial Sequence: Synthetic peptide
  Seed: MPMQDIKMIL (PRAME_HUMAN)
MAMQDIKMIL

SEQ ID NO: 149979 - protein, 9 aa, Artificial Sequence
  Description of Artificial Sequence: Synthetic peptide
  Seed: LLRHVMNPL (PRAME_HUMAN)
LSRHVMNPY

SEQ ID NO: 149980 - protein, 10 aa, Artificial Sequence
  Description of Artificial Sequence: Synthetic peptide
  Seed: RPRRWKLQVL (PRAME_HUMAN)
RRRRWKLQVL

SEQ ID NO: 149981 - protein, 9 aa, Artificial Sequence
  Description of Artificial Sequence: Synthetic peptide
  Seed: VLDGLDVLL (PRAME_HUMAN)
VSDGLDVLM

SEQ ID NO: 149982 - protein, 10 aa, Artificial Sequence
  Description of Artificial Sequence: Synthetic peptide
  Seed: DRTFYDPEPI (PRAME_HUMAN)
DSTFYDPEPV

SEQ ID NO: 149983 - protein, 10 aa, Artificial Sequence
  Description of Artificial Sequence: Synthetic peptide
  Seed: HASSYISPEK (PRAME_HUMAN)
HMSSYISPEK

SEQ ID NO: 149984 - protein, 9 aa, Artificial Sequence
  Description of Artificial Sequence: Synthetic peptide
  Seed: AVLDGLDVL (PRAME_HUMAN)
AALDGLDVM

SEQ ID NO: 149985 - protein, 10 aa, Artificial Sequence
  Description of Artificial Sequence: Synthetic peptide
  Seed: DIHGTLHLER (PRAME_HUMAN)
DAHGTLHLEK

SEQ ID NO: 149986 - protein, 9 aa, Artificial Sequence
  Description of Artificial Sequence: Synthetic peptide
  Seed: HARLRELLC (PRAME_HUMAN)
HSRLRELLL

SEQ ID NO: 149987 - protein, 9 aa, Artificial Sequence
  Description of Artificial Sequence: Synthetic peptide
  Seed: RLRELLCEL (PRAME_HUMAN)
RYRELLCEA

SEQ ID NO: 149988 - protein, 10 aa, Artificial Sequence
  Description of Artificial Sequence: Synthetic peptide
  Seed: ITDDQLLALL (PRAME_HUMAN)
IVDDQLLALI

SEQ ID NO: 149989 - protein, 9 aa, Artificial Sequence
  Description of Artificial Sequence: Synthetic peptide
  Seed: FPPLFMAAF (PRAME_HUMAN)
FPPLFMAAW

SEQ ID NO: 149990 - protein, 10 aa, Artificial Sequence
  Description of Artificial Sequence: Synthetic peptide
  Seed: FIPVEVLVDL (PRAME_HUMAN)
FFPVEVLVDY

SEQ ID NO: 149991 - protein, 9 aa, Artificial Sequence
  Description of Artificial Sequence: Synthetic peptide
  Seed: TDDQLLALL (PRAME_HUMAN)
TTDQLLALI

SEQ ID NO: 149992 - protein, 10 aa, Artificial Sequence
  Description of Artificial Sequence: Synthetic peptide
  Seed: FMAAFDGRHS (PRAME_HUMAN)
FIAAFDGRHV

SEQ ID NO: 149993 - protein, 9 aa, Artificial Sequence
  Description of Artificial Sequence: Synthetic peptide
  Seed: YLHARLREL (PRAME_HUMAN)
YMHARLREA

SEQ ID NO: 149994 - protein, 8 aa, Artificial Sequence
  Description of Artificial Sequence: Synthetic peptide
  Seed: DEALAIAA (PRAME_HUMAN)
DEALAIAF

SEQ ID NO: 149995 - protein, 10 aa, Artificial Sequence
  Description of Artificial Sequence: Synthetic peptide
  Seed: YSFPEPEAAQ (PRAME_HUMAN)
YVFPEPEAAM

SEQ ID NO: 149996 - protein, 9 aa, Artificial Sequence
  Description of Artificial Sequence: Synthetic peptide
  Seed: THVLYPVPL (PRAME_HUMAN)
TLVLYPVPY

SEQ ID NO: 149997 - protein, 10 aa, Artificial Sequence
  Description of Artificial Sequence: Synthetic peptide
  Seed: RRRLWGSIQS (PRAME_HUMAN)
RTRLWGSIQK

SEQ ID NO: 149998 - protein, 9 aa, Artificial Sequence
  Description of Artificial Sequence: Synthetic peptide
  Seed: QPFIPVEVL (PRAME_HUMAN)
QPFIPVEVV

SEQ ID NO: 149999 - protein, 11 aa, Artificial Sequence
  Description of Artificial Sequence: Synthetic peptide
  Seed: KIFAMPMQDIK (PRAME_HUMAN)
KYFAMPMQDIR

SEQ ID NO: 150000 - protein, 9 aa, Artificial Sequence
  Description of Artificial Sequence: Synthetic peptide
  Seed: LSNLTHVLY (PRAME_HUMAN)
LSNLTHVLV

SEQ ID NO: 150001 - protein, 8 aa, Artificial Sequence
  Description of Artificial Sequence: Synthetic peptide
  Seed: VSPEPLQA (PRAME_HUMAN)
VVPEPLQL

SEQ ID NO: 150002 - protein, 9 aa, Artificial Sequence
  Description of Artificial Sequence: Synthetic peptide
  Seed: YISMSVWTS (PRAME_HUMAN)
YLSMSVWTV

SEQ ID NO: 150003 - protein, 8 aa, Artificial Sequence
  Description of Artificial Sequence: Synthetic peptide
  Seed: YEDIHGTL (PRAME_HUMAN)
YVDIHGTL

SEQ ID NO: 150004 - protein, 9 aa, Artificial Sequence
  Description of Artificial Sequence: Synthetic peptide
  Seed: FTCLPLGVL (PRAME_HUMAN)
FACLPLGVW

SEQ ID NO: 150005 - protein, 8 aa, Artificial Sequence
  Description of Artificial Sequence: Synthetic peptide
  Seed: LTHVLYPV (PRAME_HUMAN)
LLHVLYPL

SEQ ID NO: 150006 - protein, 11 aa, Artificial Sequence
  Description of Artificial Sequence: Synthetic peptide
  Seed: FAMPMQDIKMI (PRAME_HUMAN)
FAMPMQDIKMW

SEQ ID NO: 150007 - protein, 9 aa, Artificial Sequence
  Description of Artificial Sequence: Synthetic peptide
  Seed: YSFPEPEAA (PRAME_HUMAN)
YQFPEPEAW

SEQ ID NO: 150008 - protein, 10 aa, Artificial Sequence
  Description of Artificial Sequence: Synthetic peptide
  Seed: ARLRELLCEL (PRAME_HUMAN)
AKLRELLCEA

SEQ ID NO: 150009 - protein, 9 aa, Artificial Sequence
  Description of Artificial Sequence: Synthetic peptide
  Seed: CKKLKIFAM (PRAME_HUMAN)
CLKLKIFAI

SEQ ID NO: 150010 - protein, 9 aa, Artificial Sequence
  Description of Artificial Sequence: Synthetic peptide
  Seed: LQHLIGLSN (PRAME_HUMAN)
LQHLIGLSA

SEQ ID NO: 150011 - protein, 11 aa, Artificial Sequence
  Description of Artificial Sequence: Synthetic peptide
  Seed: FAMPMQDIKMI (PRAME_HUMAN)
FSMPMQDIKMW

SEQ ID NO: 150012 - protein, 9 aa, Artificial Sequence
  Description of Artificial Sequence: Synthetic peptide
  Seed: HVMNPLETL (PRAME_HUMAN)
HYMNPLETV

SEQ ID NO: 150013 - protein, 10 aa, Artificial Sequence
  Description of Artificial Sequence: Synthetic peptide
  Seed: ETFKAVLDGL (PRAME_HUMAN)
EVFKAVLDGW

SEQ ID NO: 150014 - protein, 10 aa, Artificial Sequence
  Description of Artificial Sequence: Synthetic peptide
  Seed: TTLSFYGNSI (PRAME_HUMAN)
TMLSFYGNSL

SEQ ID NO: 150015 - protein, 11 aa, Artificial Sequence
  Description of Artificial Sequence: Synthetic peptide
  Seed: FLSLQCLQALY (PRAME_HUMAN)
FFSLQCLQALL

SEQ ID NO: 150016 - protein, 10 aa, Artificial Sequence
  Description of Artificial Sequence: Synthetic peptide
  Seed: KKLKIFAMPM (PRAME_HUMAN)
KALKIFAMPK

SEQ ID NO: 150017 - protein, 10 aa, Artificial Sequence
  Description of Artificial Sequence: Synthetic peptide
  Seed: LPRELFPPLF (PRAME_HUMAN)
LPRELFPPLW

SEQ ID NO: 150018 - protein, 11 aa, Artificial Sequence
  Description of Artificial Sequence: Synthetic peptide
  Seed: ALYVDSLFFLR (PRAME_HUMAN)
AMYVDSLFFLP

SEQ ID NO: 150019 - protein, 9 aa, Artificial Sequence
  Description of Artificial Sequence: Synthetic peptide
  Seed: SLLQHLIGL (PRAME_HUMAN)
SALQHLIGV

SEQ ID NO: 150020 - protein, 9 aa, Artificial Sequence
  Description of Artificial Sequence: Synthetic peptide
  Seed: SIQSRYISM (PRAME_HUMAN)
STQSRYISM

SEQ ID NO: 150021 - protein, 8 aa, Artificial Sequence
  Description of Artificial Sequence: Synthetic peptide
  Seed: SQLTTLSF (PRAME_HUMAN)
SKLTTLSF

SEQ ID NO: 150022 - protein, 11 aa, Artificial Sequence
  Description of Artificial Sequence: Synthetic peptide
  Seed: QALYVDSLFFL (PRAME_HUMAN)
QTLYVDSLFFF

SEQ ID NO: 150023 - protein, 9 aa, Artificial Sequence
  Description of Artificial Sequence: Synthetic peptide
  Seed: LTDVSPEPL (PRAME_HUMAN)
LLDVSPEPF

SEQ ID NO: 150024 - protein, 10 aa, Artificial Sequence
  Description of Artificial Sequence: Synthetic peptide
  Seed: LFPPLFMAAF (PRAME_HUMAN)
LWPPLFMAAF

SEQ ID NO: 150025 - protein, 9 aa, Artificial Sequence
  Description of Artificial Sequence: Synthetic peptide
  Seed: YLHARLREL (PRAME_HUMAN)
YPHARLREI

SEQ ID NO: 150026 - protein, 9 aa, Artificial Sequence
  Description of Artificial Sequence: Synthetic peptide
  Seed: SQSPSVSQL (PRAME_HUMAN)
SYSPSVSQL

SEQ ID NO: 150027 - protein, 8 aa, Artificial Sequence
  Description of Artificial Sequence: Synthetic peptide
  Seed: SQFLSLQC (PRAME_HUMAN)
SQFLSLQV

SEQ ID NO: 150028 - protein, 10 aa, Artificial Sequence
  Description of Artificial Sequence: Synthetic peptide
  Seed: LKAMVQAWPF (PRAME_HUMAN)
LIAMVQAWPF

SEQ ID NO: 150029 - protein, 9 aa, Artificial Sequence
  Description of Artificial Sequence: Synthetic peptide
  Seed: LCCKKLKIF (PRAME_HUMAN)
LTCKKLKIW

SEQ ID NO: 150030 - protein, 9 aa, Artificial Sequence
  Description of Artificial Sequence: Synthetic peptide
  Seed: CRLSEGDVM (PRAME_HUMAN)
CKLSEGDVF

SEQ ID NO: 150031 - protein, 9 aa, Artificial Sequence
  Description of Artificial Sequence: Synthetic peptide
  Seed: FYDPEPILC (PRAME_HUMAN)
FTDPEPILL

SEQ ID NO: 150032 - protein, 10 aa, Artificial Sequence
  Description of Artificial Sequence: Synthetic peptide
  Seed: FLKEGACDEL (PRAME_HUMAN)
FMKEGACDEV

SEQ ID NO: 150033 - protein, 10 aa, Artificial Sequence
  Description of Artificial Sequence: Synthetic peptide
  Seed: RLVELAGQSL (PRAME_HUMAN)
RTVELAGQSF

SEQ ID NO: 150034 - protein, 10 aa, Artificial Sequence
  Description of Artificial Sequence: Synthetic peptide
  Seed: DQLLALLPSL (PRAME_HUMAN)
DWLLALLPSL

SEQ ID NO: 150035 - protein, 9 aa, Artificial Sequence
  Description of Artificial Sequence: Synthetic peptide
  Seed: VLDGLDVLL (PRAME_HUMAN)
VNDGLDVLM

SEQ ID NO: 150036 - protein, 10 aa, Artificial Sequence
  Description of Artificial Sequence: Synthetic peptide
  Seed: RLWGSIQSRY (PRAME_HUMAN)
RQWGSIQSRM

SEQ ID NO: 150037 - protein, 9 aa, Artificial Sequence
  Description of Artificial Sequence: Synthetic peptide
  Seed: SATLQDLVF (PRAME_HUMAN)
SKTLQDLVY

SEQ ID NO: 150038 - protein, 10 aa, Artificial Sequence
  Description of Artificial Sequence: Synthetic peptide
  Seed: ETLSITNCRL (PRAME_HUMAN)
EMLSITNCRR

SEQ ID NO: 150039 - protein, 9 aa, Artificial Sequence
  Description of Artificial Sequence: Synthetic peptide
  Seed: SQSPSVSQL (PRAME_HUMAN)
SESPSVSQL

SEQ ID NO: 150040 - protein, 8 aa, Artificial Sequence
  Description of Artificial Sequence: Synthetic peptide
  Seed: LTHVLYPV (PRAME_HUMAN)
LMHVLYPV

SEQ ID NO: 150041 - protein, 10 aa, Artificial Sequence
  Description of Artificial Sequence: Synthetic peptide
  Seed: ETFKAVLDGL (PRAME_HUMAN)
EAFKAVLDGV

SEQ ID NO: 150042 - protein, 11 aa, Artificial Sequence
  Description of Artificial Sequence: Synthetic peptide
  Seed: AAFDGRHSQTL (PRAME_HUMAN)
AQFDGRHSQTL

SEQ ID NO: 150043 - protein, 10 aa, Artificial Sequence
  Description of Artificial Sequence: Synthetic peptide
  Seed: RHVMNPLETL (PRAME_HUMAN)
RAVMNPLETF

SEQ ID NO: 150044 - protein, 10 aa, Artificial Sequence
  Description of Artificial Sequence: Synthetic peptide
  Seed: SISISALQSL (PRAME_HUMAN)
SMSISALQSV

SEQ ID NO: 150045 - protein, 9 aa, Artificial Sequence
  Description of Artificial Sequence: Synthetic peptide
  Seed: LHLERLAYL (PRAME_HUMAN)
LRLERLAYF

SEQ ID NO: 150046 - protein, 9 aa, Artificial Sequence
  Description of Artificial Sequence: Synthetic peptide
  Seed: LELLPRELF (PRAME_HUMAN)
LMLLPRELY

SEQ ID NO: 150047 - protein, 11 aa, Artificial Sequence
  Description of Artificial Sequence: Synthetic peptide
  Seed: QALYVDSLFFL (PRAME_HUMAN)
QNLYVDSLFFF

SEQ ID NO: 150048 - protein, 9 aa, Artificial Sequence
  Description of Artificial Sequence: Synthetic peptide
  Seed: LETLSITNC (PRAME_HUMAN)
LETLSITNM

SEQ ID NO: 150049 - protein, 9 aa, Artificial Sequence
  Description of Artificial Sequence: Synthetic peptide
  Seed: LQHLIGLSN (PRAME_HUMAN)
LMHLIGLSY

SEQ ID NO: 150050 - protein, 10 aa, Artificial Sequence
  Description of Artificial Sequence: Synthetic peptide
  Seed: MERRRLWGSI (PRAME_HUMAN)
MPRRRLWGSL

SEQ ID NO: 150051 - protein, 10 aa, Artificial Sequence
  Description of Artificial Sequence: Synthetic peptide
  Seed: MVQAWPFTCL (PRAME_HUMAN)
MRQAWPFTCV

SEQ ID NO: 150052 - protein, 9 aa, Artificial Sequence
  Description of Artificial Sequence: Synthetic peptide
  Seed: LVELAGQSL (PRAME_HUMAN)
LFELAGQSL

SEQ ID NO: 150053 - protein, 9 aa, Artificial Sequence
  Description of Artificial Sequence: Synthetic peptide
  Seed: AMVQAWPFT (PRAME_HUMAN)
ALVQAWPFA

SEQ ID NO: 150054 - protein, 10 aa, Artificial Sequence
  Description of Artificial Sequence: Synthetic peptide
  Seed: SPYLGQMINL (PRAME_HUMAN)
SVYLGQMINF

SEQ ID NO: 150055 - protein, 10 aa, Artificial Sequence
  Description of Artificial Sequence: Synthetic peptide
  Seed: QYIAQFTSQF (PRAME_HUMAN)
QWIAQFTSQW

SEQ ID NO: 150056 - protein, 10 aa, Artificial Sequence
  Description of Artificial Sequence: Synthetic peptide
  Seed: SISISALQSL (PRAME_HUMAN)
SHSISALQSY

SEQ ID NO: 150057 - protein, 10 aa, Artificial Sequence
  Description of Artificial Sequence: Synthetic peptide
  Seed: SNLTHVLYPV (PRAME_HUMAN)
SVLTHVLYPL

SEQ ID NO: 150058 - protein, 9 aa, Artificial Sequence
  Description of Artificial Sequence: Synthetic peptide
  Seed: SRYISMSVW (PRAME_HUMAN)
SEYISMSVM

SEQ ID NO: 150059 - protein, 10 aa, Artificial Sequence
  Description of Artificial Sequence: Synthetic peptide
  Seed: RRRLWGSIQS (PRAME_HUMAN)
RPRLWGSIQR

SEQ ID NO: 150060 - protein, 9 aa, Artificial Sequence
  Description of Artificial Sequence: Synthetic peptide
  Seed: FSYLIEKVK (PRAME_HUMAN)
FVYLIEKVR

SEQ ID NO: 150061 - protein, 11 aa, Artificial Sequence
  Description of Artificial Sequence: Synthetic peptide
  Seed: YISMSVWTSPR (PRAME_HUMAN)
YASMSVWTSPR

SEQ ID NO: 150062 - protein, 9 aa, Artificial Sequence
  Description of Artificial Sequence: Synthetic peptide
  Seed: QSLLKDEAL (PRAME_HUMAN)
QELLKDEAV

SEQ ID NO: 150063 - protein, 10 aa, Artificial Sequence
  Description of Artificial Sequence: Synthetic peptide
  Seed: TLQDLVFDEC (PRAME_HUMAN)
TLQDLVFDEM

SEQ ID NO: 150064 - protein, 10 aa, Artificial Sequence
  Description of Artificial Sequence: Synthetic peptide
  Seed: RLDQLLRHVM (PRAME_HUMAN)
REDQLLRHVI

SEQ ID NO: 150065 - protein, 9 aa, Artificial Sequence
  Description of Artificial Sequence: Synthetic peptide
  Seed: TDDQLLALL (PRAME_HUMAN)
TLDQLLALI

SEQ ID NO: 150066 - protein, 9 aa, Artificial Sequence
  Description of Artificial Sequence: Synthetic peptide
  Seed: LLRHVMNPL (PRAME_HUMAN)
LQRHVMNPY

SEQ ID NO: 150067 - protein, 10 aa, Artificial Sequence
  Description of Artificial Sequence: Synthetic peptide
  Seed: SPYLGQMINL (PRAME_HUMAN)
SDYLGQMINI

SEQ ID NO: 150068 - protein, 9 aa, Artificial Sequence
  Description of Artificial Sequence: Synthetic peptide
  Seed: VSQLSVLSL (PRAME_HUMAN)
VTQLSVLSY

SEQ ID NO: 150069 - protein, 10 aa, Artificial Sequence
  Description of Artificial Sequence: Synthetic peptide
  Seed: HCSQLTTLSF (PRAME_HUMAN)
HLSQLTTLSF

SEQ ID NO: 150070 - protein, 9 aa, Artificial Sequence
  Description of Artificial Sequence: Synthetic peptide
  Seed: LGRPSMVWL (PRAME_HUMAN)
LTRPSMVWS

SEQ ID NO: 150071 - protein, 10 aa, Artificial Sequence
  Description of Artificial Sequence: Synthetic peptide
  Seed: IGLSNLTHVL (PRAME_HUMAN)
IHLSNLTHVI

SEQ ID NO: 150072 - protein, 9 aa, Artificial Sequence
  Description of Artificial Sequence: Synthetic peptide
  Seed: LPRELFPPL (PRAME_HUMAN)
LSRELFPPF

SEQ ID NO: 150073 - protein, 10 aa, Artificial Sequence
  Description of Artificial Sequence: Synthetic peptide
  Seed: GITDDQLLAL (PRAME_HUMAN)
GMTDDQLLAV

SEQ ID NO: 150074 - protein, 10 aa, Artificial Sequence
  Description of Artificial Sequence: Synthetic peptide
  Seed: TTLSFYGNSI (PRAME_HUMAN)
TLLSFYGNSV

SEQ ID NO: 150075 - protein, 9 aa, Artificial Sequence
  Description of Artificial Sequence: Synthetic peptide
  Seed: HLETFKAVL (PRAME_HUMAN)
HFETFKAVM

SEQ ID NO: 150076 - protein, 10 aa, Artificial Sequence
  Description of Artificial Sequence: Synthetic peptide
  Seed: ITDDQLLALL (PRAME_HUMAN)
ITDDQLLALI

SEQ ID NO: 150077 - protein, 9 aa, Artificial Sequence
  Description of Artificial Sequence: Synthetic peptide
  Seed: KFSPYLGQM (PRAME_HUMAN)
KTSPYLGQY

SEQ ID NO: 150078 - protein, 9 aa, Artificial Sequence
  Description of Artificial Sequence: Synthetic peptide
  Seed: AVLDGLDVL (PRAME_HUMAN)
AILDGLDVV

SEQ ID NO: 150079 - protein, 10 aa, Artificial Sequence
  Description of Artificial Sequence: Synthetic peptide
  Seed: LSLQCLQALY (PRAME_HUMAN)
LILQCLQALY

SEQ ID NO: 150080 - protein, 10 aa, Artificial Sequence
  Description of Artificial Sequence: Synthetic peptide
  Seed: LLKDEALAIA (PRAME_HUMAN)
LMKDEALAIL

SEQ ID NO: 150081 - protein, 9 aa, Artificial Sequence
  Description of Artificial Sequence: Synthetic peptide
  Seed: LYVDSLFFL (PRAME_HUMAN)
LMVDSLFFC

SEQ ID NO: 150082 - protein, 9 aa, Artificial Sequence
  Description of Artificial Sequence: Synthetic peptide
  Seed: RLRELLCEL (PRAME_HUMAN)
RIRELLCEV

SEQ ID NO: 150083 - protein, 9 aa, Artificial Sequence
  Description of Artificial Sequence: Synthetic peptide
  Seed: VLDGLDVLL (PRAME_HUMAN)
VVDGLDVLI

SEQ ID NO: 150084 - protein, 10 aa, Artificial Sequence
  Description of Artificial Sequence: Synthetic peptide
  Seed: KGQHLHLETF (PRAME_HUMAN)
KYQHLHLETY

SEQ ID NO: 150085 - protein, 8 aa, Artificial Sequence
  Description of Artificial Sequence: Synthetic peptide
  Seed: YEDIHGTL (PRAME_HUMAN)
YWDIHGTI

SEQ ID NO: 150086 - protein, 11 aa, Artificial Sequence
  Description of Artificial Sequence: Synthetic peptide
  Seed: QALYVDSLFFL (PRAME_HUMAN)
QSLYVDSLFFI

SEQ ID NO: 150087 - protein, 9 aa, Artificial Sequence
  Description of Artificial Sequence: Synthetic peptide
  Seed: ISPEKEEQY (PRAME_HUMAN)
ITPEKEEQY

SEQ ID NO: 150088 - protein, 10 aa, Artificial Sequence
  Description of Artificial Sequence: Synthetic peptide
  Seed: FYDPEPILCP (PRAME_HUMAN)
FIDPEPILCF

SEQ ID NO: 150089 - protein, 11 aa, Artificial Sequence
  Description of Artificial Sequence: Synthetic peptide
  Seed: ALYVDSLFFLR (PRAME_HUMAN)
AMYVDSLFFLV

SEQ ID NO: 150090 - protein, 9 aa, Artificial Sequence
  Description of Artificial Sequence: Synthetic peptide
  Seed: HVMNPLETL (PRAME_HUMAN)
HPMNPLETM

SEQ ID NO: 150091 - protein, 9 aa, Artificial Sequence
  Description of Artificial Sequence: Synthetic peptide
  Seed: RHSQTLKAM (PRAME_HUMAN)
RISQTLKAY

SEQ ID NO: 150092 - protein, 10 aa, Artificial Sequence
  Description of Artificial Sequence: Synthetic peptide
  Seed: RLWGSIQSRY (PRAME_HUMAN)
RSWGSIQSRK

SEQ ID NO: 150093 - protein, 11 aa, Artificial Sequence
  Description of Artificial Sequence: Synthetic peptide
  Seed: GTLHLERLAYL (PRAME_HUMAN)
GFLHLERLAYV

SEQ ID NO: 150094 - protein, 10 aa, Artificial Sequence
  Description of Artificial Sequence: Synthetic peptide
  Seed: RWKLQVLDLR (PRAME_HUMAN)
RTKLQVLDLR

SEQ ID NO: 150095 - protein, 9 aa, Artificial Sequence
  Description of Artificial Sequence: Synthetic peptide
  Seed: KNVLRLCCK (PRAME_HUMAN)
KFVLRLCCR

SEQ ID NO: 150096 - protein, 9 aa, Artificial Sequence
  Description of Artificial Sequence: Synthetic peptide
  Seed: HLETFKAVL (PRAME_HUMAN)
HAETFKAVL

SEQ ID NO: 150097 - protein, 11 aa, Artificial Sequence
  Description of Artificial Sequence: Synthetic peptide
  Seed: IAQFTSQFLSL (PRAME_HUMAN)
ITQFTSQFLSF

SEQ ID NO: 150098 - protein, 9 aa, Artificial Sequence
  Description of Artificial Sequence: Synthetic peptide
  Seed: ISPEKEEQY (PRAME_HUMAN)
IAPEKEEQL

SEQ ID NO: 150099 - protein, 8 aa, Artificial Sequence
  Description of Artificial Sequence: Synthetic peptide
  Seed: YVDSLFFL (PRAME_HUMAN)
YFDSLFFL

SEQ ID NO: 150100 - protein, 9 aa, Artificial Sequence
  Description of Artificial Sequence: Synthetic peptide
  Seed: KLKIFAMPM (PRAME_HUMAN)
KAKIFAMPL

SEQ ID NO: 150101 - protein, 9 aa, Artificial Sequence
  Description of Artificial Sequence: Synthetic peptide
  Seed: RLDQLLRHV (PRAME_HUMAN)
RLDQLLRHF

SEQ ID NO: 150102 - protein, 9 aa, Artificial Sequence
  Description of Artificial Sequence: Synthetic peptide
  Seed: TFYDPEPIL (PRAME_HUMAN)
TTYDPEPIL

SEQ ID NO: 150103 - protein, 9 aa, Artificial Sequence
  Description of Artificial Sequence: Synthetic peptide
  Seed: SMSVWTSPR (PRAME_HUMAN)
SNSVWTSPR

SEQ ID NO: 150104 - protein, 10 aa, Artificial Sequence
  Description of Artificial Sequence: Synthetic peptide
  Seed: ERLAYLHARL (PRAME_HUMAN)
EYLAYLHARL

SEQ ID NO: 150105 - protein, 9 aa, Artificial Sequence
  Description of Artificial Sequence: Synthetic peptide
  Seed: GQHLHLETF (PRAME_HUMAN)
GHHLHLETY

SEQ ID NO: 150106 - protein, 9 aa, Artificial Sequence
  Description of Artificial Sequence: Synthetic peptide
  Seed: HVMNPLETL (PRAME_HUMAN)
HIMNPLETR

SEQ ID NO: 150107 - protein, 10 aa, Artificial Sequence
  Description of Artificial Sequence: Synthetic peptide
  Seed: LTHVLYPVPL (PRAME_HUMAN)
LSHVLYPVPW

SEQ ID NO: 150108 - protein, 10 aa, Artificial Sequence
  Description of Artificial Sequence: Synthetic peptide
  Seed: RLWGSIQSRY (PRAME_HUMAN)
RTWGSIQSRR

SEQ ID NO: 150109 - protein, 10 aa, Artificial Sequence
  Description of Artificial Sequence: Synthetic peptide
  Seed: MVQAWPFTCL (PRAME_HUMAN)
MGQAWPFTCM

SEQ ID NO: 150110 - protein, 9 aa, Artificial Sequence
  Description of Artificial Sequence: Synthetic peptide
  Seed: YVDSLFFLR (PRAME_HUMAN)
YWDSLFFLR

SEQ ID NO: 150111 - protein, 9 aa, Artificial Sequence
  Description of Artificial Sequence: Synthetic peptide
  Seed: FYDPEPILC (PRAME_HUMAN)
FADPEPILP

SEQ ID NO: 150112 - protein, 9 aa, Artificial Sequence
  Description of Artificial Sequence: Synthetic peptide
  Seed: SISALQSLL (PRAME_HUMAN)
SSSALQSLY

SEQ ID NO: 150113 - protein, 10 aa, Artificial Sequence
  Description of Artificial Sequence: Synthetic peptide
  Seed: ALLERASATL (PRAME_HUMAN)
AMLERASATI

SEQ ID NO: 150114 - protein, 10 aa, Artificial Sequence
  Description of Artificial Sequence: Synthetic peptide
  Seed: RLRELLCELG (PRAME_HUMAN)
RLRELLCELA

SEQ ID NO: 150115 - protein, 11 aa, Artificial Sequence
  Description of Artificial Sequence: Synthetic peptide
  Seed: TLSFYGNSISI (PRAME_HUMAN)
TLSFYGNSISV

SEQ ID NO: 150116 - protein, 10 aa, Artificial Sequence
  Description of Artificial Sequence: Synthetic peptide
  Seed: QSLLQHLIGL (PRAME_HUMAN)
QNLLQHLIGI

SEQ ID NO: 150117 - protein, 9 aa, Artificial Sequence
  Description of Artificial Sequence: Synthetic peptide
  Seed: KVKRKKNVL (PRAME_HUMAN)
KTKRKKNVV

SEQ ID NO: 150118 - protein, 9 aa, Artificial Sequence
  Description of Artificial Sequence: Synthetic peptide
  Seed: LQDLVFDEC (PRAME_HUMAN)
LLDLVFDEV

SEQ ID NO: 150119 - protein, 10 aa, Artificial Sequence
  Description of Artificial Sequence: Synthetic peptide
  Seed: SNLTHVLYPV (PRAME_HUMAN)
SMLTHVLYPI

SEQ ID NO: 150120 - protein, 9 aa, Artificial Sequence
  Description of Artificial Sequence: Synthetic peptide
  Seed: RLRELLCEL (PRAME_HUMAN)
RRRELLCEF

SEQ ID NO: 150121 - protein, 11 aa, Artificial Sequence
  Description of Artificial Sequence: Synthetic peptide
  Seed: NPCPHCGDRTF (PRAME_HUMAN)
NPCPHCGDRTY

SEQ ID NO: 150122 - protein, 9 aa, Artificial Sequence
  Description of Artificial Sequence: Synthetic peptide
  Seed: SQFLSLQCL (PRAME_HUMAN)
SKFLSLQCM

SEQ ID NO: 150123 - protein, 11 aa, Artificial Sequence
  Description of Artificial Sequence: Synthetic peptide
  Seed: VQAWPFTCLPL (PRAME_HUMAN)
VQAWPFTCLPF

SEQ ID NO: 150124 - protein, 10 aa, Artificial Sequence
  Description of Artificial Sequence: Synthetic peptide
  Seed: RTFYDPEPIL (PRAME_HUMAN)
RVFYDPEPIY

SEQ ID NO: 150125 - protein, 9 aa, Artificial Sequence
  Description of Artificial Sequence: Synthetic peptide
  Seed: RELLCELGR (PRAME_HUMAN)
RSLLCELGR

SEQ ID NO: 150126 - protein, 10 aa, Artificial Sequence
  Description of Artificial Sequence: Synthetic peptide
  Seed: SLYSFPEPEA (PRAME_HUMAN)
SMYSFPEPEL

SEQ ID NO: 150127 - protein, 8 aa, Artificial Sequence
  Description of Artificial Sequence: Synthetic peptide
  Seed: FYDPEPIL (PRAME_HUMAN)
FLDPEPIF

SEQ ID NO: 150128 - protein, 9 aa, Artificial Sequence
  Description of Artificial Sequence: Synthetic peptide
  Seed: YGNSISISA (PRAME_HUMAN)
YGNSISISM

SEQ ID NO: 150129 - protein, 8 aa, Artificial Sequence
  Description of Artificial Sequence: Synthetic peptide
  Seed: LAIAALEL (PRAME_HUMAN)
LPIAALEI

SEQ ID NO: 150130 - protein, 9 aa, Artificial Sequence
  Description of Artificial Sequence: Synthetic peptide
  Seed: VFDECGITD (PRAME_HUMAN)
VADECGITL

SEQ ID NO: 150131 - protein, 9 aa, Artificial Sequence
  Description of Artificial Sequence: Synthetic peptide
  Seed: VSPEPLQAL (PRAME_HUMAN)
VGPEPLQAI

SEQ ID NO: 150132 - protein, 9 aa, Artificial Sequence
  Description of Artificial Sequence: Synthetic peptide
  Seed: YGNSISISA (PRAME_HUMAN)
YINSISISL

SEQ ID NO: 150133 - protein, 9 aa, Artificial Sequence
  Description of Artificial Sequence: Synthetic peptide
  Seed: GLSNLTHVL (PRAME_HUMAN)
GQSNLTHVF

SEQ ID NO: 150134 - protein, 9 aa, Artificial Sequence
  Description of Artificial Sequence: Synthetic peptide
  Seed: TSPRRLVEL (PRAME_HUMAN)
TVPRRLVEM

SEQ ID NO: 150135 - protein, 9 aa, Artificial Sequence
  Description of Artificial Sequence: Synthetic peptide
  Seed: EAAQPMTKK (PRAME_HUMAN)
EIAQPMTKY

SEQ ID NO: 150136 - protein, 11 aa, Artificial Sequence
  Description of Artificial Sequence: Synthetic peptide
  Seed: RLWGSIQSRYI (PRAME_HUMAN)
RLWGSIQSRYF

SEQ ID NO: 150137 - protein, 9 aa, Artificial Sequence
  Description of Artificial Sequence: Synthetic peptide
  Seed: SLLKDEALA (PRAME_HUMAN)
SMLKDEALI

SEQ ID NO: 150138 - protein, 9 aa, Artificial Sequence
  Description of Artificial Sequence: Synthetic peptide
  Seed: TLAKFSPYL (PRAME_HUMAN)
TSAKFSPYL

SEQ ID NO: 150139 - protein, 9 aa, Artificial Sequence
  Description of Artificial Sequence: Synthetic peptide
  Seed: LTDVSPEPL (PRAME_HUMAN)
LPDVSPEPY

SEQ ID NO: 150140 - protein, 10 aa, Artificial Sequence
  Description of Artificial Sequence: Synthetic peptide
  Seed: AKFSPYLGQM (PRAME_HUMAN)
AMFSPYLGQF

SEQ ID NO: 150141 - protein, 9 aa, Artificial Sequence
  Description of Artificial Sequence: Synthetic peptide
  Seed: SFYGNSISI (PRAME_HUMAN)
SAYGNSISW

SEQ ID NO: 150142 - protein, 10 aa, Artificial Sequence
  Description of Artificial Sequence: Synthetic peptide
  Seed: RLSEGDVMHL (PRAME_HUMAN)
RMSEGDVMHY

SEQ ID NO: 150143 - protein, 8 aa, Artificial Sequence
  Description of Artificial Sequence: Synthetic peptide
  Seed: ALYVDSLF (PRAME_HUMAN)
AQYVDSLF

SEQ ID NO: 150144 - protein, 9 aa, Artificial Sequence
  Description of Artificial Sequence: Synthetic peptide
  Seed: WKLPTLAKF (PRAME_HUMAN)
WSLPTLAKF

SEQ ID NO: 150145 - protein, 10 aa, Artificial Sequence
  Description of Artificial Sequence: Synthetic peptide
  Seed: RGRLDQLLRH (PRAME_HUMAN)
RRRLDQLLRV

SEQ ID NO: 150146 - protein, 9 aa, Artificial Sequence
  Description of Artificial Sequence: Synthetic peptide
  Seed: MHLSQSPSV (PRAME_HUMAN)
MQLSQSPSI

SEQ ID NO: 150147 - protein, 10 aa, Artificial Sequence
  Description of Artificial Sequence: Synthetic peptide
  Seed: RLWGSIQSRY (PRAME_HUMAN)
RMWGSIQSRW

SEQ ID NO: 150148 - protein, 10 aa, Artificial Sequence
  Description of Artificial Sequence: Synthetic peptide
  Seed: EALAIAALEL (PRAME_HUMAN)
ESLAIAALEV

SEQ ID NO: 150149 - protein, 9 aa, Artificial Sequence
  Description of Artificial Sequence: Synthetic peptide
  Seed: SYEDIHGTL (PRAME_HUMAN)
SSEDIHGTM

SEQ ID NO: 150150 - protein, 9 aa, Artificial Sequence
  Description of Artificial Sequence: Synthetic peptide
  Seed: SQSPSVSQL (PRAME_HUMAN)
SLSPSVSQA

SEQ ID NO: 150151 - protein, 10 aa, Artificial Sequence
  Description of Artificial Sequence: Synthetic peptide
  Seed: KKLKIFAMPM (PRAME_HUMAN)
KCLKIFAMPK

SEQ ID NO: 150152 - protein, 10 aa, Artificial Sequence
  Description of Artificial Sequence: Synthetic peptide
  Seed: MNPLETLSIT (PRAME_HUMAN)
MHPLETLSIA

SEQ ID NO: 150153 - protein, 11 aa, Artificial Sequence
  Description of Artificial Sequence: Synthetic peptide
  Seed: SIEDLEVTCTW (PRAME_HUMAN)
SLEDLEVTCTY

SEQ ID NO: 150154 - protein, 10 aa, Artificial Sequence
  Description of Artificial Sequence: Synthetic peptide
  Seed: QSLLQHLIGL (PRAME_HUMAN)
QMLLQHLIGL

SEQ ID NO: 150155 - protein, 9 aa, Artificial Sequence
  Description of Artificial Sequence: Synthetic peptide
  Seed: TLKAMVQAW (PRAME_HUMAN)
TVKAMVQAY

SEQ ID NO: 150156 - protein, 10 aa, Artificial Sequence
  Description of Artificial Sequence: Synthetic peptide
  Seed: ARLRELLCEL (PRAME_HUMAN)
AELRELLCEI

SEQ ID NO: 150157 - protein, 9 aa, Artificial Sequence
  Description of Artificial Sequence: Synthetic peptide
  Seed: SFPEPEAAQ (PRAME_HUMAN)
SWPEPEAAM

SEQ ID NO: 150158 - protein, 10 aa, Artificial Sequence
  Description of Artificial Sequence: Synthetic peptide
  Seed: LPTLAKFSPY (PRAME_HUMAN)
LETLAKFSPY

SEQ ID NO: 150159 - protein, 10 aa, Artificial Sequence
  Description of Artificial Sequence: Synthetic peptide
  Seed: LYVDSLFFLR (PRAME_HUMAN)
LKVDSLFFLR

SEQ ID NO: 150160 - protein, 9 aa, Artificial Sequence
  Description of Artificial Sequence: Synthetic peptide
  Seed: LSTEAEQPF (PRAME_HUMAN)
LMTEAEQPF

SEQ ID NO: 150161 - protein, 11 aa, Artificial Sequence
  Description of Artificial Sequence: Synthetic peptide
  Seed: SNLTHVLYPVP (PRAME_HUMAN)
SLLTHVLYPVR

SEQ ID NO: 150162 - protein, 10 aa, Artificial Sequence
  Description of Artificial Sequence: Synthetic peptide
  Seed: RELFPPLFMA (PRAME_HUMAN)
RMLFPPLFMM

SEQ ID NO: 150163 - protein, 10 aa, Artificial Sequence
  Description of Artificial Sequence: Synthetic peptide
  Seed: YIAQFTSQFL (PRAME_HUMAN)
YMAQFTSQFF

SEQ ID NO: 150164 - protein, 9 aa, Artificial Sequence
  Description of Artificial Sequence: Synthetic peptide
  Seed: SLLQHLIGL (PRAME_HUMAN)
SMLQHLIGA

SEQ ID NO: 150165 - protein, 10 aa, Artificial Sequence
  Description of Artificial Sequence: Synthetic peptide
  Seed: ALYVDSLFFL (PRAME_HUMAN)
AQYVDSLFFA

SEQ ID NO: 150166 - protein, 10 aa, Artificial Sequence
  Description of Artificial Sequence: Synthetic peptide
  Seed: ELFPPLFMAA (PRAME_HUMAN)
EAFPPLFMAI

SEQ ID NO: 150167 - protein, 10 aa, Artificial Sequence
  Description of Artificial Sequence: Synthetic peptide
  Seed: VMNPLETLSI (PRAME_HUMAN)
VLNPLETLSY

SEQ ID NO: 150168 - protein, 11 aa, Artificial Sequence
  Description of Artificial Sequence: Synthetic peptide
  Seed: YISMSVWTSPR (PRAME_HUMAN)
YHSMSVWTSPR

SEQ ID NO: 150169 - protein, 9 aa, Artificial Sequence
  Description of Artificial Sequence: Synthetic peptide
  Seed: FYDPEPILC (PRAME_HUMAN)
FIDPEPILM

SEQ ID NO: 150170 - protein, 9 aa, Artificial Sequence
  Description of Artificial Sequence: Synthetic peptide
  Seed: RLRELLCEL (PRAME_HUMAN)
RQRELLCEM

SEQ ID NO: 150171 - protein, 9 aa, Artificial Sequence
  Description of Artificial Sequence: Synthetic peptide
  Seed: SLSHCSQLT (PRAME_HUMAN)
SISHCSQLV

SEQ ID NO: 150172 - protein, 9 aa, Artificial Sequence
  Description of Artificial Sequence: Synthetic peptide
  Seed: VLDGLDVLL (PRAME_HUMAN)
VLDGLDVLY

SEQ ID NO: 150173 - protein, 9 aa, Artificial Sequence
  Description of Artificial Sequence: Synthetic peptide
  Seed: MPMQDIKMI (PRAME_HUMAN)
MAMQDIKMW

SEQ ID NO: 150174 - protein, 10 aa, Artificial Sequence
  Description of Artificial Sequence: Synthetic peptide
  Seed: ALELLPRELF (PRAME_HUMAN)
AMELLPRELW

SEQ ID NO: 150175 - protein, 9 aa, Artificial Sequence
  Description of Artificial Sequence: Synthetic peptide
  Seed: EDLEVTCTW (PRAME_HUMAN)
EVLEVTCTW

SEQ ID NO: 150176 - protein, 9 aa, Artificial Sequence
  Description of Artificial Sequence: Synthetic peptide
  Seed: LAIAALELL (PRAME_HUMAN)
LPIAALELY

SEQ ID NO: 150177 - protein, 9 aa, Artificial Sequence
  Description of Artificial Sequence: Synthetic peptide
  Seed: VFDECGITD (PRAME_HUMAN)
VYDECGITT

SEQ ID NO: 150178 - protein, 10 aa, Artificial Sequence
  Description of Artificial Sequence: Synthetic peptide
  Seed: YIAQFTSQFL (PRAME_HUMAN)
YRAQFTSQFF

SEQ ID NO: 150179 - protein, 9 aa, Artificial Sequence
  Description of Artificial Sequence: Synthetic peptide
  Seed: SLLQHLIGL (PRAME_HUMAN)
SMLQHLIGY

SEQ ID NO: 150180 - protein, 10 aa, Artificial Sequence
  Description of Artificial Sequence: Synthetic peptide
  Seed: SMSVWTSPRR (PRAME_HUMAN)
SSSVWTSPRR

SEQ ID NO: 150181 - protein, 9 aa, Artificial Sequence
  Description of Artificial Sequence: Synthetic peptide
  Seed: ALYVDSLFF (PRAME_HUMAN)
ASYVDSLFY

SEQ ID NO: 150182 - protein, 10 aa, Artificial Sequence
  Description of Artificial Sequence: Synthetic peptide
  Seed: DQLLALLPSL (PRAME_HUMAN)
DALLALLPSL

SEQ ID NO: 150183 - protein, 9 aa, Artificial Sequence
  Description of Artificial Sequence: Synthetic peptide
  Seed: GQSLLKDEA (PRAME_HUMAN)
GESLLKDEV

SEQ ID NO: 150184 - protein, 9 aa, Artificial Sequence
  Description of Artificial Sequence: Synthetic peptide
  Seed: SMVWLSANP (PRAME_HUMAN)
SMVWLSANL

SEQ ID NO: 150185 - protein, 10 aa, Artificial Sequence
  Description of Artificial Sequence: Synthetic peptide
  Seed: TTLSFYGNSI (PRAME_HUMAN)
TPLSFYGNSV

SEQ ID NO: 150186 - protein, 9 aa, Artificial Sequence
  Description of Artificial Sequence: Synthetic peptide
  Seed: SYEDIHGTL (PRAME_HUMAN)
SREDIHGTM

SEQ ID NO: 150187 - protein, 9 aa, Artificial Sequence
  Description of Artificial Sequence: Synthetic peptide
  Seed: SIQSRYISM (PRAME_HUMAN)
SVQSRYISI

SEQ ID NO: 150188 - protein, 9 aa, Artificial Sequence
  Description of Artificial Sequence: Synthetic peptide
  Seed: LLSHIHASS (PRAME_HUMAN)
LVSHIHASV

SEQ ID NO: 150189 - protein, 9 aa, Artificial Sequence
  Description of Artificial Sequence: Synthetic peptide
  Seed: LELLPRELF (PRAME_HUMAN)
LELLPRELI

SEQ ID NO: 150190 - protein, 9 aa, Artificial Sequence
  Description of Artificial Sequence: Synthetic peptide
  Seed: AWPFTCLPL (PRAME_HUMAN)
AFPFTCLPW

SEQ ID NO: 150191 - protein, 9 aa, Artificial Sequence
  Description of Artificial Sequence: Synthetic peptide
  Seed: RLAYLHARL (PRAME_HUMAN)
RMAYLHARR

SEQ ID NO: 150192 - protein, 11 aa, Artificial Sequence
  Description of Artificial Sequence: Synthetic peptide
  Seed: RRLWGSIQSRY (PRAME_HUMAN)
RRLWGSIQSRF

SEQ ID NO: 150193 - protein, 9 aa, Artificial Sequence
  Description of Artificial Sequence: Synthetic peptide
  Seed: RGRLDQLLR (PRAME_HUMAN)
RMRLDQLLK

SEQ ID NO: 150194 - protein, 9 aa, Artificial Sequence
  Description of Artificial Sequence: Synthetic peptide
  Seed: YSFPEPEAA (PRAME_HUMAN)
YQFPEPEAI

SEQ ID NO: 150195 - protein, 9 aa, Artificial Sequence
  Description of Artificial Sequence: Synthetic peptide
  Seed: ALLERASAT (PRAME_HUMAN)
ALLERASAA

SEQ ID NO: 150196 - protein, 9 aa, Artificial Sequence
  Description of Artificial Sequence: Synthetic peptide
  Seed: TDDQLLALL (PRAME_HUMAN)
TFDQLLALL

SEQ ID NO: 150197 - protein, 9 aa, Artificial Sequence
  Description of Artificial Sequence: Synthetic peptide
  Seed: LLKDEALAI (PRAME_HUMAN)
LTKDEALAY

SEQ ID NO: 150198 - protein, 9 aa, Artificial Sequence
  Description of Artificial Sequence: Synthetic peptide
  Seed: KNVLRLCCK (PRAME_HUMAN)
KVVLRLCCR

SEQ ID NO: 150199 - protein, 9 aa, Artificial Sequence
  Description of Artificial Sequence: Synthetic peptide
  Seed: TLHLERLAY (PRAME_HUMAN)
TIHLERLAF

SEQ ID NO: 150200 - protein, 10 aa, Artificial Sequence
  Description of Artificial Sequence: Synthetic peptide
  Seed: GLSNLTHVLY (PRAME_HUMAN)
GSSNLTHVLF

SEQ ID NO: 150201 - protein, 11 aa, Artificial Sequence
  Description of Artificial Sequence: Synthetic peptide
  Seed: ERLAYLHARLR (PRAME_HUMAN)
ETLAYLHARLR

SEQ ID NO: 150202 - protein, 10 aa, Artificial Sequence
  Description of Artificial Sequence: Synthetic peptide
  Seed: LLLSHIHASS (PRAME_HUMAN)
LRLSHIHASV

SEQ ID NO: 150203 - protein, 9 aa, Artificial Sequence
  Description of Artificial Sequence: Synthetic peptide
  Seed: RLWGSIQSR (PRAME_HUMAN)
RLWGSIQSY

SEQ ID NO: 150204 - protein, 9 aa, Artificial Sequence
  Description of Artificial Sequence: Synthetic peptide
  Seed: SMSVWTSPR (PRAME_HUMAN)
SSSVWTSPY

SEQ ID NO: 150205 - protein, 9 aa, Artificial Sequence
  Description of Artificial Sequence: Synthetic peptide
  Seed: LRKNSHQDF (PRAME_HUMAN)
LQKNSHQDY

SEQ ID NO: 150206 - protein, 10 aa, Artificial Sequence
  Description of Artificial Sequence: Synthetic peptide
  Seed: FLKEGACDEL (PRAME_HUMAN)
FLKEGACDEI

SEQ ID NO: 150207 - protein, 9 aa, Artificial Sequence
  Description of Artificial Sequence: Synthetic peptide
  Seed: AWPFTCLPL (PRAME_HUMAN)
AVPFTCLPL

SEQ ID NO: 150208 - protein, 9 aa, Artificial Sequence
  Description of Artificial Sequence: Synthetic peptide
  Seed: EAAQPMTKK (PRAME_HUMAN)
EAAQPMTKR

SEQ ID NO: 150209 - protein, 10 aa, Artificial Sequence
  Description of Artificial Sequence: Synthetic peptide
  Seed: ISISALQSLL (PRAME_HUMAN)
IIISALQSLI

SEQ ID NO: 150210 - protein, 9 aa, Artificial Sequence
  Description of Artificial Sequence: Synthetic peptide
  Seed: SATLQDLVF (PRAME_HUMAN)
SPTLQDLVF

SEQ ID NO: 150211 - protein, 10 aa, Artificial Sequence
  Description of Artificial Sequence: Synthetic peptide
  Seed: EDLEVTCTWK (PRAME_HUMAN)
EALEVTCTWK

SEQ ID NO: 150212 - protein, 9 aa, Artificial Sequence
  Description of Artificial Sequence: Synthetic peptide
  Seed: GQHLHLETF (PRAME_HUMAN)
GRHLHLETF

SEQ ID NO: 150213 - protein, 10 aa, Artificial Sequence
  Description of Artificial Sequence: Synthetic peptide
  Seed: LKAMVQAWPF (PRAME_HUMAN)
LLAMVQAWPF

SEQ ID NO: 150214 - protein, 9 aa, Artificial Sequence
  Description of Artificial Sequence: Synthetic peptide
  Seed: RLCCKKLKI (PRAME_HUMAN)
RMCCKKLKY

SEQ ID NO: 150215 - protein, 10 aa, Artificial Sequence
  Description of Artificial Sequence: Synthetic peptide
  Seed: KAVLDGLDVL (PRAME_HUMAN)
KYVLDGLDVV

SEQ ID NO: 150216 - protein, 9 aa, Artificial Sequence
  Description of Artificial Sequence: Synthetic peptide
  Seed: TFYDPEPIL (PRAME_HUMAN)
TAYDPEPIY

SEQ ID NO: 150217 - protein, 9 aa, Artificial Sequence
  Description of Artificial Sequence: Synthetic peptide
  Seed: YGNSISISA (PRAME_HUMAN)
YTNSISISI

SEQ ID NO: 150218 - protein, 9 aa, Artificial Sequence
  Description of Artificial Sequence: Synthetic peptide
  Seed: ACDELFSYL (PRAME_HUMAN)
AYDELFSYL

SEQ ID NO: 150219 - protein, 9 aa, Artificial Sequence
  Description of Artificial Sequence: Synthetic peptide
  Seed: SQSPSVSQL (PRAME_HUMAN)
STSPSVSQA

SEQ ID NO: 150220 - protein, 9 aa, Artificial Sequence
  Description of Artificial Sequence: Synthetic peptide
  Seed: ITDDQLLAL (PRAME_HUMAN)
IMDDQLLAC

SEQ ID NO: 150221 - protein, 9 aa, Artificial Sequence
  Description of Artificial Sequence: Synthetic peptide
  Seed: TFYDPEPIL (PRAME_HUMAN)
TAYDPEPIF

SEQ ID NO: 150222 - protein, 10 aa, Artificial Sequence
  Description of Artificial Sequence: Synthetic peptide
  Seed: FAMPMQDIKM (PRAME_HUMAN)
FTMPMQDIKV

SEQ ID NO: 150223 - protein, 10 aa, Artificial Sequence
  Description of Artificial Sequence: Synthetic peptide
  Seed: GITDDQLLAL (PRAME_HUMAN)
GLTDDQLLAI

SEQ ID NO: 150224 - protein, 11 aa, Artificial Sequence
  Description of Artificial Sequence: Synthetic peptide
  Seed: ALYVDSLFFLR (PRAME_HUMAN)
AMYVDSLFFLW

SEQ ID NO: 150225 - protein, 10 aa, Artificial Sequence
  Description of Artificial Sequence: Synthetic peptide
  Seed: SNLTHVLYPV (PRAME_HUMAN)
SLLTHVLYPT

SEQ ID NO: 150226 - protein, 10 aa, Artificial Sequence
  Description of Artificial Sequence: Synthetic peptide
  Seed: SISISALQSL (PRAME_HUMAN)
SVSISALQSW

SEQ ID NO: 150227 - protein, 10 aa, Artificial Sequence
  Description of Artificial Sequence: Synthetic peptide
  Seed: RLAYLHARLR (PRAME_HUMAN)
RYAYLHARLK

SEQ ID NO: 150228 - protein, 9 aa, Artificial Sequence
  Description of Artificial Sequence: Synthetic peptide
  Seed: ESYEDIHGT (PRAME_HUMAN)
ETYEDIHGA

SEQ ID NO: 150229 - protein, 9 aa, Artificial Sequence
  Description of Artificial Sequence: Synthetic peptide
  Seed: VSQLSVLSL (PRAME_HUMAN)
VMQLSVLSF

SEQ ID NO: 150230 - protein, 8 aa, Artificial Sequence
  Description of Artificial Sequence: Synthetic peptide
  Seed: TDDQLLAL (PRAME_HUMAN)
TADQLLAM

SEQ ID NO: 150231 - protein, 8 aa, Artificial Sequence
  Description of Artificial Sequence: Synthetic peptide
  Seed: YEDIHGTL (PRAME_HUMAN)
YMDIHGTI

SEQ ID NO: 150232 - protein, 9 aa, Artificial Sequence
  Description of Artificial Sequence: Synthetic peptide
  Seed: KLKIFAMPM (PRAME_HUMAN)
KYKIFAMPA

SEQ ID NO: 150233 - protein, 9 aa, Artificial Sequence
  Description of Artificial Sequence: Synthetic peptide
  Seed: EVLVDLFLK (PRAME_HUMAN)
EILVDLFLK

SEQ ID NO: 150234 - protein, 8 aa, Artificial Sequence
  Description of Artificial Sequence: Synthetic peptide
  Seed: YEDIHGTL (PRAME_HUMAN)
YIDIHGTM

SEQ ID NO: 150235 - protein, 9 aa, Artificial Sequence
  Description of Artificial Sequence: Synthetic peptide
  Seed: TDDQLLALL (PRAME_HUMAN)
TLDQLLALM

SEQ ID NO: 150236 - protein, 10 aa, Artificial Sequence
  Description of Artificial Sequence: Synthetic peptide
  Seed: SNLTHVLYPV (PRAME_HUMAN)
SNLTHVLYPA

SEQ ID NO: 150237 - protein, 10 aa, Artificial Sequence
  Description of Artificial Sequence: Synthetic peptide
  Seed: DVSPEPLQAL (PRAME_HUMAN)
DISPEPLQAW

SEQ ID NO: 150238 - protein, 9 aa, Artificial Sequence
  Description of Artificial Sequence: Synthetic peptide
  Seed: YISMSVWTS (PRAME_HUMAN)
YTSMSVWTM

SEQ ID NO: 150239 - protein, 9 aa, Artificial Sequence
  Description of Artificial Sequence: Synthetic peptide
  Seed: ELFSYLIEK (PRAME_HUMAN)
ETFSYLIEH

SEQ ID NO: 150240 - protein, 9 aa, Artificial Sequence
  Description of Artificial Sequence: Synthetic peptide
  Seed: AFDGRHSQT (PRAME_HUMAN)
AWDGRHSQF

SEQ ID NO: 150241 - protein, 9 aa, Artificial Sequence
  Description of Artificial Sequence: Synthetic peptide
  Seed: FAMPMQDIK (PRAME_HUMAN)
FAMPMQDIF

SEQ ID NO: 150242 - protein, 9 aa, Artificial Sequence
  Description of Artificial Sequence: Synthetic peptide
  Seed: ISPEKEEQY (PRAME_HUMAN)
IYPEKEEQY

SEQ ID NO: 150243 - protein, 9 aa, Artificial Sequence
  Description of Artificial Sequence: Synthetic peptide
  Seed: VQLDSIEDL (PRAME_HUMAN)
VALDSIEDM

SEQ ID NO: 150244 - protein, 9 aa, Artificial Sequence
  Description of Artificial Sequence: Synthetic peptide
  Seed: RLRELLCEL (PRAME_HUMAN)
RVRELLCER

SEQ ID NO: 150245 - protein, 9 aa, Artificial Sequence
  Description of Artificial Sequence: Synthetic peptide
  Seed: SQLSVLSLS (PRAME_HUMAN)
SMLSVLSLM

SEQ ID NO: 150246 - protein, 11 aa, Artificial Sequence
  Description of Artificial Sequence: Synthetic peptide
  Seed: SIQSRYISMSV (PRAME_HUMAN)
SQQSRYISMSK

SEQ ID NO: 150247 - protein, 9 aa, Artificial Sequence
  Description of Artificial Sequence: Synthetic peptide
  Seed: YLHARLREL (PRAME_HUMAN)
YFHARLREL

SEQ ID NO: 150248 - protein, 9 aa, Artificial Sequence
  Description of Artificial Sequence: Synthetic peptide
  Seed: VFDECGITD (PRAME_HUMAN)
VVDECGITM

SEQ ID NO: 150249 - protein, 9 aa, Artificial Sequence
  Description of Artificial Sequence: Synthetic peptide
  Seed: KMILKMVQL (PRAME_HUMAN)
KIILKMVQY

SEQ ID NO: 150250 - protein, 9 aa, Artificial Sequence
  Description of Artificial Sequence: Synthetic peptide
  Seed: ACDELFSYL (PRAME_HUMAN)
AIDELFSYL

SEQ ID NO: 150251 - protein, 10 aa, Artificial Sequence
  Description of Artificial Sequence: Synthetic peptide
  Seed: LLPRELFPPL (PRAME_HUMAN)
LRPRELFPPM

SEQ ID NO: 150252 - protein, 9 aa, Artificial Sequence
  Description of Artificial Sequence: Synthetic peptide
  Seed: SQLTTLSFY (PRAME_HUMAN)
SYLTTLSFY

SEQ ID NO: 150253 - protein, 9 aa, Artificial Sequence
  Description of Artificial Sequence: Synthetic peptide
  Seed: LLLSHIHAS (PRAME_HUMAN)
LSLSHIHAI

SEQ ID NO: 150254 - protein, 10 aa, Artificial Sequence
  Description of Artificial Sequence: Synthetic peptide
  Seed: FIPVEVLVDL (PRAME_HUMAN)
FNPVEVLVDW

SEQ ID NO: 150255 - protein, 9 aa, Artificial Sequence
  Description of Artificial Sequence: Synthetic peptide
  Seed: QSLLKDEAL (PRAME_HUMAN)
QRLLKDEAL

SEQ ID NO: 150256 - protein, 11 aa, Artificial Sequence
  Description of Artificial Sequence: Synthetic peptide
  Seed: AAFDGRHSQTL (PRAME_HUMAN)
APFDGRHSQTI

SEQ ID NO: 150257 - protein, 9 aa, Artificial Sequence
  Description of Artificial Sequence: Synthetic peptide
  Seed: EVLVDLFLK (PRAME_HUMAN)
EMLVDLFLR

SEQ ID NO: 150258 - protein, 9 aa, Artificial Sequence
  Description of Artificial Sequence: Synthetic peptide
  Seed: RLAYLHARL (PRAME_HUMAN)
RLAYLHARK

SEQ ID NO: 150259 - protein, 8 aa, Artificial Sequence
  Description of Artificial Sequence: Synthetic peptide
  Seed: YPVPLESY (PRAME_HUMAN)
YQVPLESY

SEQ ID NO: 150260 - protein, 10 aa, Artificial Sequence
  Description of Artificial Sequence: Synthetic peptide
  Seed: KIFAMPMQDI (PRAME_HUMAN)
KLFAMPMQDI

SEQ ID NO: 150261 - protein, 10 aa, Artificial Sequence
  Description of Artificial Sequence: Synthetic peptide
  Seed: SISISALQSL (PRAME_HUMAN)
SQSISALQSV

SEQ ID NO: 150262 - protein, 9 aa, Artificial Sequence
  Description of Artificial Sequence: Synthetic peptide
  Seed: KLKIFAMPM (PRAME_HUMAN)
KVKIFAMPT

SEQ ID NO: 150263 - protein, 10 aa, Artificial Sequence
  Description of Artificial Sequence: Synthetic peptide
  Seed: KVKRKKNVLR (PRAME_HUMAN)
KSKRKKNVLV

SEQ ID NO: 150264 - protein, 9 aa, Artificial Sequence
  Description of Artificial Sequence: Synthetic peptide
  Seed: VSPEPLQAL (PRAME_HUMAN)
VHPEPLQAM

SEQ ID NO: 150265 - protein, 10 aa, Artificial Sequence
  Description of Artificial Sequence: Synthetic peptide
  Seed: LLSHIHASSY (PRAME_HUMAN)
LYSHIHASSY

SEQ ID NO: 150266 - protein, 9 aa, Artificial Sequence
  Description of Artificial Sequence: Synthetic peptide
  Seed: RLAYLHARL (PRAME_HUMAN)
RSAYLHARY

SEQ ID NO: 150267 - protein, 10 aa, Artificial Sequence
  Description of Artificial Sequence: Synthetic peptide
  Seed: KKLKIFAMPM (PRAME_HUMAN)
KSLKIFAMPI

SEQ ID NO: 150268 - protein, 10 aa, Artificial Sequence
  Description of Artificial Sequence: Synthetic peptide
  Seed: LLLSHIHASS (PRAME_HUMAN)
LQLSHIHASI

SEQ ID NO: 150269 - protein, 8 aa, Artificial Sequence
  Description of Artificial Sequence: Synthetic peptide
  Seed: FYDPEPIL (PRAME_HUMAN)
FWDPEPIV

SEQ ID NO: 150270 - protein, 10 aa, Artificial Sequence
  Description of Artificial Sequence: Synthetic peptide
  Seed: VEVLVDLFLK (PRAME_HUMAN)
VVVLVDLFLK

SEQ ID NO: 150271 - protein, 9 aa, Artificial Sequence
  Description of Artificial Sequence: Synthetic peptide
  Seed: FYDPEPILC (PRAME_HUMAN)
FSDPEPILT

SEQ ID NO: 150272 - protein, 10 aa, Artificial Sequence
  Description of Artificial Sequence: Synthetic peptide
  Seed: SNLTHVLYPV (PRAME_HUMAN)
SHLTHVLYPA

SEQ ID NO: 150273 - protein, 10 aa, Artificial Sequence
  Description of Artificial Sequence: Synthetic peptide
  Seed: FYDPEPILCP (PRAME_HUMAN)
FMDPEPILCF

SEQ ID NO: 150274 - protein, 9 aa, Artificial Sequence
  Description of Artificial Sequence: Synthetic peptide
  Seed: LALLPSLSH (PRAME_HUMAN)
LRLLPSLSY

SEQ ID NO: 150275 - protein, 9 aa, Artificial Sequence
  Description of Artificial Sequence: Synthetic peptide
  Seed: LSLQCLQAL (PRAME_HUMAN)
LHLQCLQAY

SEQ ID NO: 150276 - protein, 10 aa, Artificial Sequence
  Description of Artificial Sequence: Synthetic peptide
  Seed: ETFKAVLDGL (PRAME_HUMAN)
EVFKAVLDGA

SEQ ID NO: 150277 - protein, 10 aa, Artificial Sequence
  Description of Artificial Sequence: Synthetic peptide
  Seed: MPMQDIKMIL (PRAME_HUMAN)
MYMQDIKMIV

SEQ ID NO: 150278 - protein, 9 aa, Artificial Sequence
  Description of Artificial Sequence: Synthetic peptide
  Seed: LLRHVMNPL (PRAME_HUMAN)
LPRHVMNPA

SEQ ID NO: 150279 - protein, 10 aa, Artificial Sequence
  Description of Artificial Sequence: Synthetic peptide
  Seed: PTLAKFSPYL (PRAME_HUMAN)
PLLAKFSPYV

SEQ ID NO: 150280 - protein, 9 aa, Artificial Sequence
  Description of Artificial Sequence: Synthetic peptide
  Seed: SYEDIHGTL (PRAME_HUMAN)
SIEDIHGTM

SEQ ID NO: 150281 - protein, 9 aa, Artificial Sequence
  Description of Artificial Sequence: Synthetic peptide
  Seed: SALQSLLQH (PRAME_HUMAN)
SLLQSLLQR

SEQ ID NO: 150282 - protein, 9 aa, Artificial Sequence
  Description of Artificial Sequence: Synthetic peptide
  Seed: YSFPEPEAA (PRAME_HUMAN)
YRFPEPEAV

SEQ ID NO: 150283 - protein, 10 aa, Artificial Sequence
  Description of Artificial Sequence: Synthetic peptide
  Seed: FLKEGACDEL (PRAME_HUMAN)
FMKEGACDEA

SEQ ID NO: 150284 - protein, 9 aa, Artificial Sequence
  Description of Artificial Sequence: Synthetic peptide
  Seed: YSFPEPEAA (PRAME_HUMAN)
YRFPEPEAK

SEQ ID NO: 150285 - protein, 9 aa, Artificial Sequence
  Description of Artificial Sequence: Synthetic peptide
  Seed: LLKDEALAI (PRAME_HUMAN)
LAKDEALAY

SEQ ID NO: 150286 - protein, 9 aa, Artificial Sequence
  Description of Artificial Sequence: Synthetic peptide
  Seed: LYPVPLESY (PRAME_HUMAN)
LTPVPLESL

SEQ ID NO: 150287 - protein, 9 aa, Artificial Sequence
  Description of Artificial Sequence: Synthetic peptide
  Seed: SPEPLQALL (PRAME_HUMAN)
SFEPLQALI

SEQ ID NO: 150288 - protein, 9 aa, Artificial Sequence
  Description of Artificial Sequence: Synthetic peptide
  Seed: RLAYLHARL (PRAME_HUMAN)
RAAYLHARW

SEQ ID NO: 150289 - protein, 9 aa, Artificial Sequence
  Description of Artificial Sequence: Synthetic peptide
  Seed: FLSLQCLQA (PRAME_HUMAN)
FQSLQCLQL

SEQ ID NO: 150290 - protein, 9 aa, Artificial Sequence
  Description of Artificial Sequence: Synthetic peptide
  Seed: SQSPSVSQL (PRAME_HUMAN)
SFSPSVSQF

SEQ ID NO: 150291 - protein, 9 aa, Artificial Sequence
  Description of Artificial Sequence: Synthetic peptide
  Seed: HLETFKAVL (PRAME_HUMAN)
HWETFKAVL

SEQ ID NO: 150292 - protein, 9 aa, Artificial Sequence
  Description of Artificial Sequence: Synthetic peptide
  Seed: YSFPEPEAA (PRAME_HUMAN)
YFFPEPEAF

SEQ ID NO: 150293 - protein, 9 aa, Artificial Sequence
  Description of Artificial Sequence: Synthetic peptide
  Seed: ELFSYLIEK (PRAME_HUMAN)
EVFSYLIER

SEQ ID NO: 150294 - protein, 9 aa, Artificial Sequence
  Description of Artificial Sequence: Synthetic peptide
  Seed: MPMQDIKMI (PRAME_HUMAN)
MIMQDIKMY

SEQ ID NO: 150295 - protein, 10 aa, Artificial Sequence
  Description of Artificial Sequence: Synthetic peptide
  Seed: ARLRELLCEL (PRAME_HUMAN)
ADLRELLCEL

SEQ ID NO: 150296 - protein, 9 aa, Artificial Sequence
  Description of Artificial Sequence: Synthetic peptide
  Seed: YSFPEPEAA (PRAME_HUMAN)
YGFPEPEAI

SEQ ID NO: 150297 - protein, 10 aa, Artificial Sequence
  Description of Artificial Sequence: Synthetic peptide
  Seed: MERRRLWGSI (PRAME_HUMAN)
MPRRRLWGSV

SEQ ID NO: 150298 - protein, 8 aa, Artificial Sequence
  Description of Artificial Sequence: Synthetic peptide
  Seed: YEDIHGTL (PRAME_HUMAN)
YNDIHGTV

SEQ ID NO: 150299 - protein, 11 aa, Artificial Sequence
  Description of Artificial Sequence: Synthetic peptide
  Seed: AAFDGRHSQTL (PRAME_HUMAN)
AEFDGRHSQTF

SEQ ID NO: 150300 - protein, 9 aa, Artificial Sequence
  Description of Artificial Sequence: Synthetic peptide
  Seed: RLWGSIQSR (PRAME_HUMAN)
RVWGSIQSI

SEQ ID NO: 150301 - protein, 9 aa, Artificial Sequence
  Description of Artificial Sequence: Synthetic peptide
  Seed: KEEQYIAQF (PRAME_HUMAN)
KYEQYIAQF

SEQ ID NO: 150302 - protein, 10 aa, Artificial Sequence
  Description of Artificial Sequence: Synthetic peptide
  Seed: QYIAQFTSQF (PRAME_HUMAN)
QKIAQFTSQY

SEQ ID NO: 150303 - protein, 11 aa, Artificial Sequence
  Description of Artificial Sequence: Synthetic peptide
  Seed: AAFDGRHSQTL (PRAME_HUMAN)
APFDGRHSQTV

SEQ ID NO: 150304 - protein, 9 aa, Artificial Sequence
  Description of Artificial Sequence: Synthetic peptide
  Seed: YLIEKVKRK (PRAME_HUMAN)
YSIEKVKRK

SEQ ID NO: 150305 - protein, 9 aa, Artificial Sequence
  Description of Artificial Sequence: Synthetic peptide
  Seed: ELAGQSLLK (PRAME_HUMAN)
EVAGQSLLK

SEQ ID NO: 150306 - protein, 10 aa, Artificial Sequence
  Description of Artificial Sequence: Synthetic peptide
  Seed: IKMILKMVQL (PRAME_HUMAN)
IGMILKMVQV

SEQ ID NO: 150307 - protein, 9 aa, Artificial Sequence
  Description of Artificial Sequence: Synthetic peptide
  Seed: ISISALQSL (PRAME_HUMAN)
IKISALQSI

SEQ ID NO: 150308 - protein, 9 aa, Artificial Sequence
  Description of Artificial Sequence: Synthetic peptide
  Seed: VFDECGITD (PRAME_HUMAN)
VSDECGITL

SEQ ID NO: 150309 - protein, 10 aa, Artificial Sequence
  Description of Artificial Sequence: Synthetic peptide
  Seed: RHVMNPLETL (PRAME_HUMAN)
RHVMNPLETW

SEQ ID NO: 150310 - protein, 9 aa, Artificial Sequence
  Description of Artificial Sequence: Synthetic peptide
  Seed: SQSPSVSQL (PRAME_HUMAN)
SRSPSVSQV

SEQ ID NO: 150311 - protein, 10 aa, Artificial Sequence
  Description of Artificial Sequence: Synthetic peptide
  Seed: ESYEDIHGTL (PRAME_HUMAN)
ELYEDIHGTF

SEQ ID NO: 150312 - protein, 10 aa, Artificial Sequence
  Description of Artificial Sequence: Synthetic peptide
  Seed: RLVELAGQSL (PRAME_HUMAN)
RVVELAGQSY

SEQ ID NO: 150313 - protein, 9 aa, Artificial Sequence
  Description of Artificial Sequence: Synthetic peptide
  Seed: RGRLDQLLR (PRAME_HUMAN)
RMRLDQLLR

SEQ ID NO: 150314 - protein, 10 aa, Artificial Sequence
  Description of Artificial Sequence: Synthetic peptide
  Seed: HCSQLTTLSF (PRAME_HUMAN)
HYSQLTTLSF

SEQ ID NO: 150315 - protein, 10 aa, Artificial Sequence
  Description of Artificial Sequence: Synthetic peptide
  Seed: LSQSPSVSQL (PRAME_HUMAN)
LAQSPSVSQF

SEQ ID NO: 150316 - protein, 9 aa, Artificial Sequence
  Description of Artificial Sequence: Synthetic peptide
  Seed: SVLSLSGVM (PRAME_HUMAN)
SQLSLSGVM

SEQ ID NO: 150317 - protein, 10 aa, Artificial Sequence
  Description of Artificial Sequence: Synthetic peptide
  Seed: IQSRYISMSV (PRAME_HUMAN)
ISSRYISMSK

SEQ ID NO: 150318 - protein, 9 aa, Artificial Sequence
  Description of Artificial Sequence: Synthetic peptide
  Seed: HVMNPLETL (PRAME_HUMAN)
HTMNPLETM

SEQ ID NO: 150319 - protein, 10 aa, Artificial Sequence
  Description of Artificial Sequence: Synthetic peptide
  Seed: SALQSLLQHL (PRAME_HUMAN)
SALQSLLQHW

SEQ ID NO: 150320 - protein, 9 aa, Artificial Sequence
  Description of Artificial Sequence: Synthetic peptide
  Seed: LSHIHASSY (PRAME_HUMAN)
LSHIHASSF

SEQ ID NO: 150321 - protein, 10 aa, Artificial Sequence
  Description of Artificial Sequence: Synthetic peptide
  Seed: RLSEGDVMHL (PRAME_HUMAN)
RASEGDVMHM

SEQ ID NO: 150322 - protein, 10 aa, Artificial Sequence
  Description of Artificial Sequence: Synthetic peptide
  Seed: YGNSISISAL (PRAME_HUMAN)
YVNSISISAY

SEQ ID NO: 150323 - protein, 9 aa, Artificial Sequence
  Description of Artificial Sequence: Synthetic peptide
  Seed: CPHCGDRTF (PRAME_HUMAN)
CPHCGDRTL

SEQ ID NO: 150324 - protein, 9 aa, Artificial Sequence
  Description of Artificial Sequence: Synthetic peptide
  Seed: AVLDGLDVL (PRAME_HUMAN)
AALDGLDVV

SEQ ID NO: 150325 - protein, 9 aa, Artificial Sequence
  Description of Artificial Sequence: Synthetic peptide
  Seed: ELFPPLFMA (PRAME_HUMAN)
ELFPPLFML

SEQ ID NO: 150326 - protein, 8 aa, Artificial Sequence
  Description of Artificial Sequence: Synthetic peptide
  Seed: LKIFAMPM (PRAME_HUMAN)
LQIFAMPM

SEQ ID NO: 150327 - protein, 9 aa, Artificial Sequence
  Description of Artificial Sequence: Synthetic peptide
  Seed: WSGNRASLY (PRAME_HUMAN)
WTGNRASLF

SEQ ID NO: 150328 - protein, 9 aa, Artificial Sequence
  Description of Artificial Sequence: Synthetic peptide
  Seed: ALELLPREL (PRAME_HUMAN)
AYELLPREL

SEQ ID NO: 150329 - protein, 11 aa, Artificial Sequence
  Description of Artificial Sequence: Synthetic peptide
  Seed: RLVELAGQSLL (PRAME_HUMAN)
RQVELAGQSLM

SEQ ID NO: 150330 - protein, 9 aa, Artificial Sequence
  Description of Artificial Sequence: Synthetic peptide
  Seed: MNPLETLSI (PRAME_HUMAN)
MIPLETLSM

SEQ ID NO: 150331 - protein, 9 aa, Artificial Sequence
  Description of Artificial Sequence: Synthetic peptide
  Seed: SRYISMSVW (PRAME_HUMAN)
SGYISMSVY

SEQ ID NO: 150332 - protein, 9 aa, Artificial Sequence
  Description of Artificial Sequence: Synthetic peptide
  Seed: LYVDSLFFL (PRAME_HUMAN)
LRVDSLFFL

SEQ ID NO: 150333 - protein, 10 aa, Artificial Sequence
  Description of Artificial Sequence: Synthetic peptide
  Seed: GITDDQLLAL (PRAME_HUMAN)
GTTDDQLLAV

SEQ ID NO: 150334 - protein, 10 aa, Artificial Sequence
  Description of Artificial Sequence: Synthetic peptide
  Seed: ETFKAVLDGL (PRAME_HUMAN)
ETFKAVLDGA

SEQ ID NO: 150335 - protein, 10 aa, Artificial Sequence
  Description of Artificial Sequence: Synthetic peptide
  Seed: SPSVSQLSVL (PRAME_HUMAN)
SCSVSQLSVF

SEQ ID NO: 150336 - protein, 10 aa, Artificial Sequence
  Description of Artificial Sequence: Synthetic peptide
  Seed: LLKDEALAIA (PRAME_HUMAN)
LVKDEALAIV

SEQ ID NO: 150337 - protein, 9 aa, Artificial Sequence
  Description of Artificial Sequence: Synthetic peptide
  Seed: NSHQDFWTV (PRAME_HUMAN)
NAHQDFWTY

SEQ ID NO: 150338 - protein, 9 aa, Artificial Sequence
  Description of Artificial Sequence: Synthetic peptide
  Seed: SLLQHLIGL (PRAME_HUMAN)
SLLQHLIGV

SEQ ID NO: 150339 - protein, 8 aa, Artificial Sequence
  Description of Artificial Sequence: Synthetic peptide
  Seed: FYDPEPIL (PRAME_HUMAN)
FTDPEPIF

SEQ ID NO: 150340 - protein, 10 aa, Artificial Sequence
  Description of Artificial Sequence: Synthetic peptide
  Seed: LLCELGRPSM (PRAME_HUMAN)
LLCELGRPSV

SEQ ID NO: 150341 - protein, 11 aa, Artificial Sequence
  Description of Artificial Sequence: Synthetic peptide
  Seed: FLKEGACDELF (PRAME_HUMAN)
FMKEGACDELY

SEQ ID NO: 150342 - protein, 10 aa, Artificial Sequence
  Description of Artificial Sequence: Synthetic peptide
  Seed: ISMSVWTSPR (PRAME_HUMAN)
IYMSVWTSPK

SEQ ID NO: 150343 - protein, 9 aa, Artificial Sequence
  Description of Artificial Sequence: Synthetic peptide
  Seed: AWPFTCLPL (PRAME_HUMAN)
AYPFTCLPW

SEQ ID NO: 150344 - protein, 10 aa, Artificial Sequence
  Description of Artificial Sequence: Synthetic peptide
  Seed: HASSYISPEK (PRAME_HUMAN)
HISSYISPER

SEQ ID NO: 150345 - protein, 9 aa, Artificial Sequence
  Description of Artificial Sequence: Synthetic peptide
  Seed: FYDPEPILC (PRAME_HUMAN)
FYDPEPILT

SEQ ID NO: 150346 - protein, 9 aa, Artificial Sequence
  Description of Artificial Sequence: Synthetic peptide
  Seed: LYPVPLESY (PRAME_HUMAN)
LLPVPLESF

SEQ ID NO: 150347 - protein, 10 aa, Artificial Sequence
  Description of Artificial Sequence: Synthetic peptide
  Seed: LLLSHIHASS (PRAME_HUMAN)
LWLSHIHASL

SEQ ID NO: 150348 - protein, 9 aa, Artificial Sequence
  Description of Artificial Sequence: Synthetic peptide
  Seed: NSHQDFWTV (PRAME_HUMAN)
NSHQDFWTW

SEQ ID NO: 150349 - protein, 10 aa, Artificial Sequence
  Description of Artificial Sequence: Synthetic peptide
  Seed: AIAALELLPR (PRAME_HUMAN)
AIAALELLPK

SEQ ID NO: 150350 - protein, 10 aa, Artificial Sequence
  Description of Artificial Sequence: Synthetic peptide
  Seed: QLSVLSLSGV (PRAME_HUMAN)
QMSVLSLSGV

SEQ ID NO: 150351 - protein, 10 aa, Artificial Sequence
  Description of Artificial Sequence: Synthetic peptide
  Seed: IGLSNLTHVL (PRAME_HUMAN)
ICLSNLTHVL

SEQ ID NO: 150352 - protein, 10 aa, Artificial Sequence
  Description of Artificial Sequence: Synthetic peptide
  Seed: QLSVLSLSGV (PRAME_HUMAN)
QISVLSLSGV

SEQ ID NO: 150353 - protein, 10 aa, Artificial Sequence
  Description of Artificial Sequence: Synthetic peptide
  Seed: LKAMVQAWPF (PRAME_HUMAN)
LVAMVQAWPF

SEQ ID NO: 150354 - protein, 10 aa, Artificial Sequence
  Description of Artificial Sequence: Synthetic peptide
  Seed: MNPLETLSIT (PRAME_HUMAN)
MTPLETLSIV

SEQ ID NO: 150355 - protein, 10 aa, Artificial Sequence
  Description of Artificial Sequence: Synthetic peptide
  Seed: FIPVEVLVDL (PRAME_HUMAN)
FNPVEVLVDF

SEQ ID NO: 150356 - protein, 10 aa, Artificial Sequence
  Description of Artificial Sequence: Synthetic peptide
  Seed: RLWGSIQSRY (PRAME_HUMAN)
RIWGSIQSRK

SEQ ID NO: 150357 - protein, 9 aa, Artificial Sequence
  Description of Artificial Sequence: Synthetic peptide
  Seed: IAQFTSQFL (PRAME_HUMAN)
IIQFTSQFV

SEQ ID NO: 150358 - protein, 9 aa, Artificial Sequence
  Description of Artificial Sequence: Synthetic peptide
  Seed: ISISALQSL (PRAME_HUMAN)
ICISALQSW

SEQ ID NO: 150359 - protein, 9 aa, Artificial Sequence
  Description of Artificial Sequence: Synthetic peptide
  Seed: RLRELLCEL (PRAME_HUMAN)
RVRELLCEF

SEQ ID NO: 150360 - protein, 10 aa, Artificial Sequence
  Description of Artificial Sequence: Synthetic peptide
  Seed: GRLDQLLRHV (PRAME_HUMAN)
GLLDQLLRHA

SEQ ID NO: 150361 - protein, 10 aa, Artificial Sequence
  Description of Artificial Sequence: Synthetic peptide
  Seed: TSQFLSLQCL (PRAME_HUMAN)
TDQFLSLQCY

SEQ ID NO: 150362 - protein, 9 aa, Artificial Sequence
  Description of Artificial Sequence: Synthetic peptide
  Seed: YLIEKVKRK (PRAME_HUMAN)
YTIEKVKRR

SEQ ID NO: 150363 - protein, 10 aa, Artificial Sequence
  Description of Artificial Sequence: Synthetic peptide
  Seed: LQALYVDSLF (PRAME_HUMAN)
LSALYVDSLF

SEQ ID NO: 150364 - protein, 9 aa, Artificial Sequence
  Description of Artificial Sequence: Synthetic peptide
  Seed: YIAQFTSQF (PRAME_HUMAN)
YSAQFTSQV

SEQ ID NO: 150365 - protein, 11 aa, Artificial Sequence
  Description of Artificial Sequence: Synthetic peptide
  Seed: IAQFTSQFLSL (PRAME_HUMAN)
IWQFTSQFLSY

SEQ ID NO: 150366 - protein, 9 aa, Artificial Sequence
  Description of Artificial Sequence: Synthetic peptide
  Seed: AVLDGLDVL (PRAME_HUMAN)
AVLDGLDVV

SEQ ID NO: 150367 - protein, 9 aa, Artificial Sequence
  Description of Artificial Sequence: Synthetic peptide
  Seed: KEEQYIAQF (PRAME_HUMAN)
KQEQYIAQF

SEQ ID NO: 150368 - protein, 9 aa, Artificial Sequence
  Description of Artificial Sequence: Synthetic peptide
  Seed: HVMNPLETL (PRAME_HUMAN)
HIMNPLETK

SEQ ID NO: 150369 - protein, 9 aa, Artificial Sequence
  Description of Artificial Sequence: Synthetic peptide
  Seed: KVDGLSTEA (PRAME_HUMAN)
KSDGLSTEM

SEQ ID NO: 150370 - protein, 10 aa, Artificial Sequence
  Description of Artificial Sequence: Synthetic peptide
  Seed: SALQSLLQHL (PRAME_HUMAN)
SILQSLLQHL

SEQ ID NO: 150371 - protein, 9 aa, Artificial Sequence
  Description of Artificial Sequence: Synthetic peptide
  Seed: YLHARLREL (PRAME_HUMAN)
YYHARLREI

SEQ ID NO: 150372 - protein, 11 aa, Artificial Sequence
  Description of Artificial Sequence: Synthetic peptide
  Seed: ELFSYLIEKVK (PRAME_HUMAN)
EVFSYLIEKVR

SEQ ID NO: 150373 - protein, 9 aa, Artificial Sequence
  Description of Artificial Sequence: Synthetic peptide
  Seed: RLDQLLRHV (PRAME_HUMAN)
RMDQLLRHV

SEQ ID NO: 150374 - protein, 10 aa, Artificial Sequence
  Description of Artificial Sequence: Synthetic peptide
  Seed: FTCLPLGVLM (PRAME_HUMAN)
FMCLPLGVLV

SEQ ID NO: 150375 - protein, 10 aa, Artificial Sequence
  Description of Artificial Sequence: Synthetic peptide
  Seed: ARLRELLCEL (PRAME_HUMAN)
AHLRELLCEL

SEQ ID NO: 150376 - protein, 10 aa, Artificial Sequence
  Description of Artificial Sequence: Synthetic peptide
  Seed: ALLERASATL (PRAME_HUMAN)
AMLERASATM

SEQ ID NO: 150377 - protein, 9 aa, Artificial Sequence
  Description of Artificial Sequence: Synthetic peptide
  Seed: RLAYLHARL (PRAME_HUMAN)
RTAYLHARY

SEQ ID NO: 150378 - protein, 9 aa, Artificial Sequence
  Description of Artificial Sequence: Synthetic peptide
  Seed: SYEDIHGTL (PRAME_HUMAN)
STEDIHGTW

SEQ ID NO: 150379 - protein, 10 aa, Artificial Sequence
  Description of Artificial Sequence: Synthetic peptide
  Seed: ISMSVWTSPR (PRAME_HUMAN)
IWMSVWTSPR

SEQ ID NO: 150380 - protein, 11 aa, Artificial Sequence
  Description of Artificial Sequence: Synthetic peptide
  Seed: DVSPEPLQALL (PRAME_HUMAN)
DASPEPLQALK

SEQ ID NO: 150381 - protein, 11 aa, Artificial Sequence
  Description of Artificial Sequence: Synthetic peptide
  Seed: QALYVDSLFFL (PRAME_HUMAN)
QQLYVDSLFFI

SEQ ID NO: 150382 - protein, 10 aa, Artificial Sequence
  Description of Artificial Sequence: Synthetic peptide
  Seed: ESYEDIHGTL (PRAME_HUMAN)
EAYEDIHGTI

SEQ ID NO: 150383 - protein, 10 aa, Artificial Sequence
  Description of Artificial Sequence: Synthetic peptide
  Seed: PTLAKFSPYL (PRAME_HUMAN)
PMLAKFSPYL

SEQ ID NO: 150384 - protein, 9 aa, Artificial Sequence
  Description of Artificial Sequence: Synthetic peptide
  Seed: GNRASLYSF (PRAME_HUMAN)
GSRASLYSF

SEQ ID NO: 150385 - protein, 9 aa, Artificial Sequence
  Description of Artificial Sequence: Synthetic peptide
  Seed: LYPVPLESY (PRAME_HUMAN)
LRPVPLESM

SEQ ID NO: 150386 - protein, 10 aa, Artificial Sequence
  Description of Artificial Sequence: Synthetic peptide
  Seed: YSFPEPEAAQ (PRAME_HUMAN)
YQFPEPEAAF

SEQ ID NO: 150387 - protein, 10 aa, Artificial Sequence
  Description of Artificial Sequence: Synthetic peptide
  Seed: RLDQLLRHVM (PRAME_HUMAN)
REDQLLRHVF

SEQ ID NO: 150388 - protein, 9 aa, Artificial Sequence
  Description of Artificial Sequence: Synthetic peptide
  Seed: YIAQFTSQF (PRAME_HUMAN)
YLAQFTSQV

SEQ ID NO: 150389 - protein, 11 aa, Artificial Sequence
  Description of Artificial Sequence: Synthetic peptide
  Seed: RRLVELAGQSL (PRAME_HUMAN)
RRLVELAGQSF

SEQ ID NO: 150390 - protein, 9 aa, Artificial Sequence
  Description of Artificial Sequence: Synthetic peptide
  Seed: ALLPSLSHC (PRAME_HUMAN)
AVLPSLSHI

SEQ ID NO: 150391 - protein, 10 aa, Artificial Sequence
  Description of Artificial Sequence: Synthetic peptide
  Seed: FIPVEVLVDL (PRAME_HUMAN)
FWPVEVLVDM

SEQ ID NO: 150392 - protein, 11 aa, Artificial Sequence
  Description of Artificial Sequence: Synthetic peptide
  Seed: RRWKLQVLDLR (PRAME_HUMAN)
RVWKLQVLDLR

SEQ ID NO: 150393 - protein, 11 aa, Artificial Sequence
  Description of Artificial Sequence: Synthetic peptide
  Seed: KIFAMPMQDIK (PRAME_HUMAN)
KIFAMPMQDIR

SEQ ID NO: 150394 - protein, 10 aa, Artificial Sequence
  Description of Artificial Sequence: Synthetic peptide
  Seed: SPSVSQLSVL (PRAME_HUMAN)
SVSVSQLSVY

SEQ ID NO: 150395 - protein, 10 aa, Artificial Sequence
  Description of Artificial Sequence: Synthetic peptide
  Seed: VELAGQSLLK (PRAME_HUMAN)
VVLAGQSLLK

SEQ ID NO: 150396 - protein, 9 aa, Artificial Sequence
  Description of Artificial Sequence: Synthetic peptide
  Seed: QTLKAMVQA (PRAME_HUMAN)
QLLKAMVQI

SEQ ID NO: 150397 - protein, 10 aa, Artificial Sequence
  Description of Artificial Sequence: Synthetic peptide
  Seed: LSHIHASSYI (PRAME_HUMAN)
LVHIHASSYV

SEQ ID NO: 150398 - protein, 9 aa, Artificial Sequence
  Description of Artificial Sequence: Synthetic peptide
  Seed: VSPEPLQAL (PRAME_HUMAN)
VCPEPLQAI

SEQ ID NO: 150399 - protein, 8 aa, Artificial Sequence
  Description of Artificial Sequence: Synthetic peptide
  Seed: YEDIHGTL (PRAME_HUMAN)
YTDIHGTF

SEQ ID NO: 150400 - protein, 9 aa, Artificial Sequence
  Description of Artificial Sequence: Synthetic peptide
  Seed: LYVDSLFFL (PRAME_HUMAN)
LYVDSLFFM

SEQ ID NO: 150401 - protein, 9 aa, Artificial Sequence
  Description of Artificial Sequence: Synthetic peptide
  Seed: SIQSRYISM (PRAME_HUMAN)
SKQSRYISF

SEQ ID NO: 150402 - protein, 10 aa, Artificial Sequence
  Description of Artificial Sequence: Synthetic peptide
  Seed: IGLSNLTHVL (PRAME_HUMAN)
IALSNLTHVV

SEQ ID NO: 150403 - protein, 10 aa, Artificial Sequence
  Description of Artificial Sequence: Synthetic peptide
  Seed: FIPVEVLVDL (PRAME_HUMAN)
FPPVEVLVDW

SEQ ID NO: 150404 - protein, 10 aa, Artificial Sequence
  Description of Artificial Sequence: Synthetic peptide
  Seed: LQALYVDSLF (PRAME_HUMAN)
LKALYVDSLY

SEQ ID NO: 150405 - protein, 10 aa, Artificial Sequence
  Description of Artificial Sequence: Synthetic peptide
  Seed: RLWGSIQSRY (PRAME_HUMAN)
RVWGSIQSRW

SEQ ID NO: 150406 - protein, 8 aa, Artificial Sequence
  Description of Artificial Sequence: Synthetic peptide
  Seed: TDDQLLAL (PRAME_HUMAN)
TADQLLAF

SEQ ID NO: 150407 - protein, 10 aa, Artificial Sequence
  Description of Artificial Sequence: Synthetic peptide
  Seed: FLKEGACDEL (PRAME_HUMAN)
FLKEGACDEA

SEQ ID NO: 150408 - protein, 9 aa, Artificial Sequence
  Description of Artificial Sequence: Synthetic peptide
  Seed: FDGRHSQTL (PRAME_HUMAN)
FAGRHSQTV

SEQ ID NO: 150409 - protein, 11 aa, Artificial Sequence
  Description of Artificial Sequence: Synthetic peptide
  Seed: EDIHGTLHLER (PRAME_HUMAN)
ESIHGTLHLER

SEQ ID NO: 150410 - protein, 10 aa, Artificial Sequence
  Description of Artificial Sequence: Synthetic peptide
  Seed: MPMQDIKMIL (PRAME_HUMAN)
MPMQDIKMIT

SEQ ID NO: 150411 - protein, 10 aa, Artificial Sequence
  Description of Artificial Sequence: Synthetic peptide
  Seed: YSFPEPEAAQ (PRAME_HUMAN)
YIFPEPEAAM

SEQ ID NO: 150412 - protein, 9 aa, Artificial Sequence
  Description of Artificial Sequence: Synthetic peptide
  Seed: GLSNLTHVL (PRAME_HUMAN)
GLSNLTHVY

SEQ ID NO: 150413 - protein, 10 aa, Artificial Sequence
  Description of Artificial Sequence: Synthetic peptide
  Seed: RGRLDQLLRH (PRAME_HUMAN)
RNRLDQLLRK

SEQ ID NO: 150414 - protein, 10 aa, Artificial Sequence
  Description of Artificial Sequence: Synthetic peptide
  Seed: ARLRELLCEL (PRAME_HUMAN)
ARLRELLCEF

SEQ ID NO: 150415 - protein, 10 aa, Artificial Sequence
  Description of Artificial Sequence: Synthetic peptide
  Seed: DQLLALLPSL (PRAME_HUMAN)
DNLLALLPSV

SEQ ID NO: 150416 - protein, 9 aa, Artificial Sequence
  Description of Artificial Sequence: Synthetic peptide
  Seed: ELFPPLFMA (PRAME_HUMAN)
EIFPPLFMT

SEQ ID NO: 150417 - protein, 9 aa, Artificial Sequence
  Description of Artificial Sequence: Synthetic peptide
  Seed: RLDQLLRHV (PRAME_HUMAN)
RYDQLLRHM

SEQ ID NO: 150418 - protein, 9 aa, Artificial Sequence
  Description of Artificial Sequence: Synthetic peptide
  Seed: SQSPSVSQL (PRAME_HUMAN)
SGSPSVSQL

SEQ ID NO: 150419 - protein, 9 aa, Artificial Sequence
  Description of Artificial Sequence: Synthetic peptide
  Seed: LLSHIHASS (PRAME_HUMAN)
LISHIHASI

SEQ ID NO: 150420 - protein, 9 aa, Artificial Sequence
  Description of Artificial Sequence: Synthetic peptide
  Seed: QMINLRRLL (PRAME_HUMAN)
QTINLRRLW

SEQ ID NO: 150421 - protein, 10 aa, Artificial Sequence
  Description of Artificial Sequence: Synthetic peptide
  Seed: SPSVSQLSVL (PRAME_HUMAN)
SQSVSQLSVW

SEQ ID NO: 150422 - protein, 9 aa, Artificial Sequence
  Description of Artificial Sequence: Synthetic peptide
  Seed: LTDVSPEPL (PRAME_HUMAN)
LVDVSPEPY

SEQ ID NO: 150423 - protein, 11 aa, Artificial Sequence
  Description of Artificial Sequence: Synthetic peptide
  Seed: LQSLLQHLIGL (PRAME_HUMAN)
LTSLLQHLIGV

SEQ ID NO: 150424 - protein, 9 aa, Artificial Sequence
  Description of Artificial Sequence: Synthetic peptide
  Seed: KMILKMVQL (PRAME_HUMAN)
KQILKMVQI

SEQ ID NO: 150425 - protein, 10 aa, Artificial Sequence
  Description of Artificial Sequence: Synthetic peptide
  Seed: SNLTHVLYPV (PRAME_HUMAN)
SLLTHVLYPM

SEQ ID NO: 150426 - protein, 9 aa, Artificial Sequence
  Description of Artificial Sequence: Synthetic peptide
  Seed: NVLRLCCKK (PRAME_HUMAN)
NSLRLCCKR

SEQ ID NO: 150427 - protein, 10 aa, Artificial Sequence
  Description of Artificial Sequence: Synthetic peptide
  Seed: KVKRKKNVLR (PRAME_HUMAN)
KFKRKKNVLA

SEQ ID NO: 150428 - protein, 9 aa, Artificial Sequence
  Description of Artificial Sequence: Synthetic peptide
  Seed: LSNLTHVLY (PRAME_HUMAN)
LSNLTHVLI

SEQ ID NO: 150429 - protein, 9 aa, Artificial Sequence
  Description of Artificial Sequence: Synthetic peptide
  Seed: ALAIAALEL (PRAME_HUMAN)
AQAIAALEV

SEQ ID NO: 150430 - protein, 9 aa, Artificial Sequence
  Description of Artificial Sequence: Synthetic peptide
  Seed: VLDGLDVLL (PRAME_HUMAN)
VQDGLDVLW

SEQ ID NO: 150431 - protein, 9 aa, Artificial Sequence
  Description of Artificial Sequence: Synthetic peptide
  Seed: LSHIHASSY (PRAME_HUMAN)
LHHIHASSF

SEQ ID NO: 150432 - protein, 9 aa, Artificial Sequence
  Description of Artificial Sequence: Synthetic peptide
  Seed: KAMVQAWPF (PRAME_HUMAN)
KYMVQAWPY

SEQ ID NO: 150433 - protein, 9 aa, Artificial Sequence
  Description of Artificial Sequence: Synthetic peptide
  Seed: SIQSRYISM (PRAME_HUMAN)
SLQSRYISM

SEQ ID NO: 150434 - protein, 9 aa, Artificial Sequence
  Description of Artificial Sequence: Synthetic peptide
  Seed: TLAKFSPYL (PRAME_HUMAN)
TIAKFSPYI

SEQ ID NO: 150435 - protein, 9 aa, Artificial Sequence
  Description of Artificial Sequence: Synthetic peptide
  Seed: ACDELFSYL (PRAME_HUMAN)
AGDELFSYY

SEQ ID NO: 150436 - protein, 9 aa, Artificial Sequence
  Description of Artificial Sequence: Synthetic peptide
  Seed: SQLTTLSFY (PRAME_HUMAN)
SQLTTLSFR

SEQ ID NO: 150437 - protein, 9 aa, Artificial Sequence
  Description of Artificial Sequence: Synthetic peptide
  Seed: CRLSEGDVM (PRAME_HUMAN)
CHLSEGDVL

SEQ ID NO: 150438 - protein, 10 aa, Artificial Sequence
  Description of Artificial Sequence: Synthetic peptide
  Seed: SVLSLSGVML (PRAME_HUMAN)
SMLSLSGVMI

SEQ ID NO: 150439 - protein, 10 aa, Artificial Sequence
  Description of Artificial Sequence: Synthetic peptide
  Seed: RRWKLQVLDL (PRAME_HUMAN)
RRWKLQVLDC

SEQ ID NO: 150440 - protein, 11 aa, Artificial Sequence
  Description of Artificial Sequence: Synthetic peptide
  Seed: AYLHARLRELL (PRAME_HUMAN)
AYLHARLRELF

SEQ ID NO: 150441 - protein, 10 aa, Artificial Sequence
  Description of Artificial Sequence: Synthetic peptide
  Seed: FLSLQCLQAL (PRAME_HUMAN)
FLSLQCLQAI

SEQ ID NO: 150442 - protein, 9 aa, Artificial Sequence
  Description of Artificial Sequence: Synthetic peptide
  Seed: FYDPEPILC (PRAME_HUMAN)
FFDPEPILC

SEQ ID NO: 150443 - protein, 9 aa, Artificial Sequence
  Description of Artificial Sequence: Synthetic peptide
  Seed: YSFPEPEAA (PRAME_HUMAN)
YIFPEPEAA

SEQ ID NO: 150444 - protein, 10 aa, Artificial Sequence
  Description of Artificial Sequence: Synthetic peptide
  Seed: LLPRELFPPL (PRAME_HUMAN)
LWPRELFPPV

SEQ ID NO: 150445 - protein, 9 aa, Artificial Sequence
  Description of Artificial Sequence: Synthetic peptide
  Seed: MINLRRLLL (PRAME_HUMAN)
MANLRRLLY

SEQ ID NO: 150446 - protein, 9 aa, Artificial Sequence
  Description of Artificial Sequence: Synthetic peptide
  Seed: TWKLPTLAK (PRAME_HUMAN)
TMKLPTLAK

SEQ ID NO: 150447 - protein, 9 aa, Artificial Sequence
  Description of Artificial Sequence: Synthetic peptide
  Seed: YSFPEPEAA (PRAME_HUMAN)
YAFPEPEAM

SEQ ID NO: 150448 - protein, 10 aa, Artificial Sequence
  Description of Artificial Sequence: Synthetic peptide
  Seed: SMSVWTSPRR (PRAME_HUMAN)
STSVWTSPRK

SEQ ID NO: 150449 - protein, 11 aa, Artificial Sequence
  Description of Artificial Sequence: Synthetic peptide
  Seed: SQSPSVSQLSV (PRAME_HUMAN)
SQSPSVSQLSF

SEQ ID NO: 150450 - protein, 10 aa, Artificial Sequence
  Description of Artificial Sequence: Synthetic peptide
  Seed: RASATLQDLV (PRAME_HUMAN)
RRSATLQDLW

SEQ ID NO: 150451 - protein, 9 aa, Artificial Sequence
  Description of Artificial Sequence: Synthetic peptide
  Seed: GACDELFSY (PRAME_HUMAN)
GFCDELFSY

SEQ ID NO: 150452 - protein, 9 aa, Artificial Sequence
  Description of Artificial Sequence: Synthetic peptide
  Seed: KAMVQAWPF (PRAME_HUMAN)
KLMVQAWPI

SEQ ID NO: 150453 - protein, 9 aa, Artificial Sequence
  Description of Artificial Sequence: Synthetic peptide
  Seed: SFYGNSISI (PRAME_HUMAN)
SCYGNSISM

SEQ ID NO: 150454 - protein, 9 aa, Artificial Sequence
  Description of Artificial Sequence: Synthetic peptide
  Seed: FLRGRLDQL (PRAME_HUMAN)
FPRGRLDQL

SEQ ID NO: 150455 - protein, 9 aa, Artificial Sequence
  Description of Artificial Sequence: Synthetic peptide
  Seed: NLTHVLYPV (PRAME_HUMAN)
NATHVLYPA

SEQ ID NO: 150456 - protein, 9 aa, Artificial Sequence
  Description of Artificial Sequence: Synthetic peptide
  Seed: LLRHVMNPL (PRAME_HUMAN)
LIRHVMNPF

SEQ ID NO: 150457 - protein, 9 aa, Artificial Sequence
  Description of Artificial Sequence: Synthetic peptide
  Seed: RLCCKKLKI (PRAME_HUMAN)
RLCCKKLKW

SEQ ID NO: 150458 - protein, 10 aa, Artificial Sequence
  Description of Artificial Sequence: Synthetic peptide
  Seed: HASSYISPEK (PRAME_HUMAN)
HESSYISPER

SEQ ID NO: 150459 - protein, 10 aa, Artificial Sequence
  Description of Artificial Sequence: Synthetic peptide
  Seed: SPYLGQMINL (PRAME_HUMAN)
SEYLGQMINF

SEQ ID NO: 150460 - protein, 9 aa, Artificial Sequence
  Description of Artificial Sequence: Synthetic peptide
  Seed: VSPEPLQAL (PRAME_HUMAN)
VQPEPLQAF

SEQ ID NO: 150461 - protein, 10 aa, Artificial Sequence
  Description of Artificial Sequence: Synthetic peptide
  Seed: IGLSNLTHVL (PRAME_HUMAN)
IKLSNLTHVV

SEQ ID NO: 150462 - protein, 10 aa, Artificial Sequence
  Description of Artificial Sequence: Synthetic peptide
  Seed: LPTLAKFSPY (PRAME_HUMAN)
LNTLAKFSPF

SEQ ID NO: 150463 - protein, 9 aa, Artificial Sequence
  Description of Artificial Sequence: Synthetic peptide
  Seed: LSNLTHVLY (PRAME_HUMAN)
LCNLTHVLW

SEQ ID NO: 150464 - protein, 10 aa, Artificial Sequence
  Description of Artificial Sequence: Synthetic peptide
  Seed: RELFPPLFMA (PRAME_HUMAN)
RGLFPPLFMA

SEQ ID NO: 150465 - protein, 9 aa, Artificial Sequence
  Description of Artificial Sequence: Synthetic peptide
  Seed: SHIHASSYI (PRAME_HUMAN)
SKIHASSYF

SEQ ID NO: 150466 - protein, 10 aa, Artificial Sequence
  Description of Artificial Sequence: Synthetic peptide
  Seed: VLMKGQHLHL (PRAME_HUMAN)
VMMKGQHLHW

SEQ ID NO: 150467 - protein, 9 aa, Artificial Sequence
  Description of Artificial Sequence: Synthetic peptide
  Seed: LQALYVDSL (PRAME_HUMAN)
LHALYVDSL

SEQ ID NO: 150468 - protein, 10 aa, Artificial Sequence
  Description of Artificial Sequence: Synthetic peptide
  Seed: RELFPPLFMA (PRAME_HUMAN)
RSLFPPLFMT

SEQ ID NO: 150469 - protein, 11 aa, Artificial Sequence
  Description of Artificial Sequence: Synthetic peptide
  Seed: QALYVDSLFFL (PRAME_HUMAN)
QHLYVDSLFFI

SEQ ID NO: 150470 - protein, 9 aa, Artificial Sequence
  Description of Artificial Sequence: Synthetic peptide
  Seed: LSHIHASSY (PRAME_HUMAN)
LFHIHASSI

SEQ ID NO: 150471 - protein, 9 aa, Artificial Sequence
  Description of Artificial Sequence: Synthetic peptide
  Seed: ISISALQSL (PRAME_HUMAN)
IVISALQSL

SEQ ID NO: 150472 - protein, 9 aa, Artificial Sequence
  Description of Artificial Sequence: Synthetic peptide
  Seed: LGRPSMVWL (PRAME_HUMAN)
LYRPSMVWA

SEQ ID NO: 150473 - protein, 10 aa, Artificial Sequence
  Description of Artificial Sequence: Synthetic peptide
  Seed: SNLTHVLYPV (PRAME_HUMAN)
SPLTHVLYPA

SEQ ID NO: 150474 - protein, 9 aa, Artificial Sequence
  Description of Artificial Sequence: Synthetic peptide
  Seed: GQHLHLETF (PRAME_HUMAN)
GTHLHLETM

SEQ ID NO: 150475 - protein, 9 aa, Artificial Sequence
  Description of Artificial Sequence: Synthetic peptide
  Seed: LQSLLQHLI (PRAME_HUMAN)
LHSLLQHLV

SEQ ID NO: 150476 - protein, 10 aa, Artificial Sequence
  Description of Artificial Sequence: Synthetic peptide
  Seed: FAMPMQDIKM (PRAME_HUMAN)
FMMPMQDIKV

SEQ ID NO: 150477 - protein, 9 aa, Artificial Sequence
  Description of Artificial Sequence: Synthetic peptide
  Seed: YSFPEPEAA (PRAME_HUMAN)
YPFPEPEAP

SEQ ID NO: 150478 - protein, 9 aa, Artificial Sequence
  Description of Artificial Sequence: Synthetic peptide
  Seed: SIQSRYISM (PRAME_HUMAN)
SLQSRYISR

SEQ ID NO: 150479 - protein, 11 aa, Artificial Sequence
  Description of Artificial Sequence: Synthetic peptide
  Seed: FKAVLDGLDVL (PRAME_HUMAN)
FRAVLDGLDVV

SEQ ID NO: 150480 - protein, 9 aa, Artificial Sequence
  Description of Artificial Sequence: Synthetic peptide
  Seed: RTFYDPEPI (PRAME_HUMAN)
RTFYDPEPW

SEQ ID NO: 150481 - protein, 9 aa, Artificial Sequence
  Description of Artificial Sequence: Synthetic peptide
  Seed: TLHLERLAY (PRAME_HUMAN)
TAHLERLAF

SEQ ID NO: 150482 - protein, 9 aa, Artificial Sequence
  Description of Artificial Sequence: Synthetic peptide
  Seed: AVLDGLDVL (PRAME_HUMAN)
AQLDGLDVI

SEQ ID NO: 150483 - protein, 9 aa, Artificial Sequence
  Description of Artificial Sequence: Synthetic peptide
  Seed: VWSGNRASL (PRAME_HUMAN)
VYSGNRASF

SEQ ID NO: 150484 - protein, 9 aa, Artificial Sequence
  Description of Artificial Sequence: Synthetic peptide
  Seed: RLWGSIQSR (PRAME_HUMAN)
RAWGSIQSL

SEQ ID NO: 150485 - protein, 10 aa, Artificial Sequence
  Description of Artificial Sequence: Synthetic peptide
  Seed: SPSVSQLSVL (PRAME_HUMAN)
SRSVSQLSVW

SEQ ID NO: 150486 - protein, 10 aa, Artificial Sequence
  Description of Artificial Sequence: Synthetic peptide
  Seed: VMNPLETLSI (PRAME_HUMAN)
VLNPLETLSI

SEQ ID NO: 150487 - protein, 10 aa, Artificial Sequence
  Description of Artificial Sequence: Synthetic peptide
  Seed: ALYVDSLFFL (PRAME_HUMAN)
ALYVDSLFFW

SEQ ID NO: 150488 - protein, 10 aa, Artificial Sequence
  Description of Artificial Sequence: Synthetic peptide
  Seed: RLVELAGQSL (PRAME_HUMAN)
RLVELAGQSY

SEQ ID NO: 150489 - protein, 10 aa, Artificial Sequence
  Description of Artificial Sequence: Synthetic peptide
  Seed: IGLSNLTHVL (PRAME_HUMAN)
IVLSNLTHVL

SEQ ID NO: 150490 - protein, 9 aa, Artificial Sequence
  Description of Artificial Sequence: Synthetic peptide
  Seed: FPEPEAAQP (PRAME_HUMAN)
FPEPEAAQF

SEQ ID NO: 150491 - protein, 11 aa, Artificial Sequence
  Description of Artificial Sequence: Synthetic peptide
  Seed: KAVLDGLDVLL (PRAME_HUMAN)
KSVLDGLDVLW

SEQ ID NO: 150492 - protein, 9 aa, Artificial Sequence
  Description of Artificial Sequence: Synthetic peptide
  Seed: SATLQDLVF (PRAME_HUMAN)
SQTLQDLVW

SEQ ID NO: 150493 - protein, 9 aa, Artificial Sequence
  Description of Artificial Sequence: Synthetic peptide
  Seed: VLDGLDVLL (PRAME_HUMAN)
VGDGLDVLL

SEQ ID NO: 150494 - protein, 9 aa, Artificial Sequence
  Description of Artificial Sequence: Synthetic peptide
  Seed: YLHARLREL (PRAME_HUMAN)
YLHARLREI

SEQ ID NO: 150495 - protein, 9 aa, Artificial Sequence
  Description of Artificial Sequence: Synthetic peptide
  Seed: DGRHSQTLK (PRAME_HUMAN)
DLRHSQTLR

SEQ ID NO: 150496 - protein, 10 aa, Artificial Sequence
  Description of Artificial Sequence: Synthetic peptide
  Seed: FFLRGRLDQL (PRAME_HUMAN)
FMLRGRLDQI

SEQ ID NO: 150497 - protein, 10 aa, Artificial Sequence
  Description of Artificial Sequence: Synthetic peptide
  Seed: IGLSNLTHVL (PRAME_HUMAN)
IILSNLTHVI

SEQ ID NO: 150498 - protein, 10 aa, Artificial Sequence
  Description of Artificial Sequence: Synthetic peptide
  Seed: TLQDLVFDEC (PRAME_HUMAN)
TMQDLVFDEI

SEQ ID NO: 150499 - protein, 9 aa, Artificial Sequence
  Description of Artificial Sequence: Synthetic peptide
  Seed: SQSPSVSQL (PRAME_HUMAN)
SMSPSVSQF

SEQ ID NO: 150500 - protein, 9 aa, Artificial Sequence
  Description of Artificial Sequence: Synthetic peptide
  Seed: ALQSLLQHL (PRAME_HUMAN)
AFQSLLQHY

SEQ ID NO: 150501 - protein, 10 aa, Artificial Sequence
  Description of Artificial Sequence: Synthetic peptide
  Seed: KFSPYLGQMI (PRAME_HUMAN)
KYSPYLGQMW

SEQ ID NO: 150502 - protein, 9 aa, Artificial Sequence
  Description of Artificial Sequence: Synthetic peptide
  Seed: RPRRWKLQV (PRAME_HUMAN)
RPRRWKLQI

SEQ ID NO: 150503 - protein, 9 aa, Artificial Sequence
  Description of Artificial Sequence: Synthetic peptide
  Seed: SQFLSLQCL (PRAME_HUMAN)
SQFLSLQCV

SEQ ID NO: 150504 - protein, 9 aa, Artificial Sequence
  Description of Artificial Sequence: Synthetic peptide
  Seed: KEEQYIAQF (PRAME_HUMAN)
KREQYIAQM

SEQ ID NO: 150505 - protein, 9 aa, Artificial Sequence
  Description of Artificial Sequence: Synthetic peptide
  Seed: TLAKFSPYL (PRAME_HUMAN)
TMAKFSPYA

SEQ ID NO: 150506 - protein, 9 aa, Artificial Sequence
  Description of Artificial Sequence: Synthetic peptide
  Seed: YSFPEPEAA (PRAME_HUMAN)
YMFPEPEAW

SEQ ID NO: 150507 - protein, 9 aa, Artificial Sequence
  Description of Artificial Sequence: Synthetic peptide
  Seed: SALQSLLQH (PRAME_HUMAN)
SALQSLLQK

SEQ ID NO: 150508 - protein, 8 aa, Artificial Sequence
  Description of Artificial Sequence: Synthetic peptide
  Seed: LELLPREL (PRAME_HUMAN)
LQLLPREI

SEQ ID NO: 150509 - protein, 10 aa, Artificial Sequence
  Description of Artificial Sequence: Synthetic peptide
  Seed: MERRRLWGSI (PRAME_HUMAN)
MMRRRLWGSM

SEQ ID NO: 150510 - protein, 8 aa, Artificial Sequence
  Description of Artificial Sequence: Synthetic peptide
  Seed: FYDPEPIL (PRAME_HUMAN)
FLDPEPIV

SEQ ID NO: 150511 - protein, 9 aa, Artificial Sequence
  Description of Artificial Sequence: Synthetic peptide
  Seed: CSQLTTLSF (PRAME_HUMAN)
CTQLTTLSY

SEQ ID NO: 150512 - protein, 9 aa, Artificial Sequence
  Description of Artificial Sequence: Synthetic peptide
  Seed: MPMQDIKMI (PRAME_HUMAN)
MPMQDIKMM

SEQ ID NO: 150513 - protein, 10 aa, Artificial Sequence
  Description of Artificial Sequence: Synthetic peptide
  Seed: FIPVEVLVDL (PRAME_HUMAN)
FPPVEVLVDY

SEQ ID NO: 150514 - protein, 10 aa, Artificial Sequence
  Description of Artificial Sequence: Synthetic peptide
  Seed: FIPVEVLVDL (PRAME_HUMAN)
FDPVEVLVDY

SEQ ID NO: 150515 - protein, 10 aa, Artificial Sequence
  Description of Artificial Sequence: Synthetic peptide
  Seed: QSLLQHLIGL (PRAME_HUMAN)
QSLLQHLIGV

SEQ ID NO: 150516 - protein, 10 aa, Artificial Sequence
  Description of Artificial Sequence: Synthetic peptide
  Seed: DFWTVWSGNR (PRAME_HUMAN)
DYWTVWSGNR

SEQ ID NO: 150517 - protein, 9 aa, Artificial Sequence
  Description of Artificial Sequence: Synthetic peptide
  Seed: YSFPEPEAA (PRAME_HUMAN)
YGFPEPEAF

SEQ ID NO: 150518 - protein, 9 aa, Artificial Sequence
  Description of Artificial Sequence: Synthetic peptide
  Seed: HLETFKAVL (PRAME_HUMAN)
HLETFKAVY

SEQ ID NO: 150519 - protein, 9 aa, Artificial Sequence
  Description of Artificial Sequence: Synthetic peptide
  Seed: YGNSISISA (PRAME_HUMAN)
YGNSISISY

SEQ ID NO: 150520 - protein, 10 aa, Artificial Sequence
  Description of Artificial Sequence: Synthetic peptide
  Seed: LKAMVQAWPF (PRAME_HUMAN)
LAAMVQAWPY

SEQ ID NO: 150521 - protein, 10 aa, Artificial Sequence
  Description of Artificial Sequence: Synthetic peptide
  Seed: GLSNLTHVLY (PRAME_HUMAN)
GMSNLTHVLL

SEQ ID NO: 150522 - protein, 11 aa, Artificial Sequence
  Description of Artificial Sequence: Synthetic peptide
  Seed: FLSLQCLQALY (PRAME_HUMAN)
FISLQCLQALV

SEQ ID NO: 150523 - protein, 9 aa, Artificial Sequence
  Description of Artificial Sequence: Synthetic peptide
  Seed: RELFPPLFM (PRAME_HUMAN)
RELFPPLFL

SEQ ID NO: 150524 - protein, 9 aa, Artificial Sequence
  Description of Artificial Sequence: Synthetic peptide
  Seed: MSVWTSPRR (PRAME_HUMAN)
MSVWTSPRK

SEQ ID NO: 150525 - protein, 8 aa, Artificial Sequence
  Description of Artificial Sequence: Synthetic peptide
  Seed: DQLLRHVM (PRAME_HUMAN)
DGLLRHVL

SEQ ID NO: 150526 - protein, 9 aa, Artificial Sequence
  Description of Artificial Sequence: Synthetic peptide
  Seed: GLSNLTHVL (PRAME_HUMAN)
GMSNLTHVL

SEQ ID NO: 150527 - protein, 9 aa, Artificial Sequence
  Description of Artificial Sequence: Synthetic peptide
  Seed: GQHLHLETF (PRAME_HUMAN)
GEHLHLETI

SEQ ID NO: 150528 - protein, 9 aa, Artificial Sequence
  Description of Artificial Sequence: Synthetic peptide
  Seed: ISISALQSL (PRAME_HUMAN)
IPISALQSA

SEQ ID NO: 150529 - protein, 9 aa, Artificial Sequence
  Description of Artificial Sequence: Synthetic peptide
  Seed: KDEALAIAA (PRAME_HUMAN)
KEEALAIAP

SEQ ID NO: 150530 - protein, 9 aa, Artificial Sequence
  Description of Artificial Sequence: Synthetic peptide
  Seed: RGRLDQLLR (PRAME_HUMAN)
RSRLDQLLK

SEQ ID NO: 150531 - protein, 10 aa, Artificial Sequence
  Description of Artificial Sequence: Synthetic peptide
  Seed: AAFDGRHSQT (PRAME_HUMAN)
AMFDGRHSQM

SEQ ID NO: 150532 - protein, 11 aa, Artificial Sequence
  Description of Artificial Sequence: Synthetic peptide
  Seed: SNLTHVLYPVP (PRAME_HUMAN)
SMLTHVLYPVA

SEQ ID NO: 150533 - protein, 9 aa, Artificial Sequence
  Description of Artificial Sequence: Synthetic peptide
  Seed: LLKDEALAI (PRAME_HUMAN)
LSKDEALAY

SEQ ID NO: 150534 - protein, 8 aa, Artificial Sequence
  Description of Artificial Sequence: Synthetic peptide
  Seed: FYDPEPIL (PRAME_HUMAN)
FNDPEPIL

SEQ ID NO: 150535 - protein, 9 aa, Artificial Sequence
  Description of Artificial Sequence: Synthetic peptide
  Seed: YIAQFTSQF (PRAME_HUMAN)
YRAQFTSQV

SEQ ID NO: 150536 - protein, 11 aa, Artificial Sequence
  Description of Artificial Sequence: Synthetic peptide
  Seed: LLLSHIHASSY (PRAME_HUMAN)
LMLSHIHASSY

SEQ ID NO: 150537 - protein, 10 aa, Artificial Sequence
  Description of Artificial Sequence: Synthetic peptide
  Seed: SMSVWTSPRR (PRAME_HUMAN)
SLSVWTSPRR

SEQ ID NO: 150538 - protein, 9 aa, Artificial Sequence
  Description of Artificial Sequence: Synthetic peptide
  Seed: LTDVSPEPL (PRAME_HUMAN)
LYDVSPEPI

SEQ ID NO: 150539 - protein, 10 aa, Artificial Sequence
  Description of Artificial Sequence: Synthetic peptide
  Seed: FLKEGACDEL (PRAME_HUMAN)
FIKEGACDEV

SEQ ID NO: 150540 - protein, 10 aa, Artificial Sequence
  Description of Artificial Sequence: Synthetic peptide
  Seed: IGLSNLTHVL (PRAME_HUMAN)
IYLSNLTHVL

SEQ ID NO: 150541 - protein, 9 aa, Artificial Sequence
  Description of Artificial Sequence: Synthetic peptide
  Seed: QPFIPVEVL (PRAME_HUMAN)
QHFIPVEVA

SEQ ID NO: 150542 - protein, 11 aa, Artificial Sequence
  Description of Artificial Sequence: Synthetic peptide
  Seed: RASATLQDLVF (PRAME_HUMAN)
RDSATLQDLVW

SEQ ID NO: 150543 - protein, 11 aa, Artificial Sequence
  Description of Artificial Sequence: Synthetic peptide
  Seed: IAQFTSQFLSL (PRAME_HUMAN)
IMQFTSQFLSF

SEQ ID NO: 150544 - protein, 9 aa, Artificial Sequence
  Description of Artificial Sequence: Synthetic peptide
  Seed: SALQSLLQH (PRAME_HUMAN)
SALQSLLQF

SEQ ID NO: 150545 - protein, 9 aa, Artificial Sequence
  Description of Artificial Sequence: Synthetic peptide
  Seed: VLYPVPLES (PRAME_HUMAN)
VLYPVPLEC

SEQ ID NO: 150546 - protein, 10 aa, Artificial Sequence
  Description of Artificial Sequence: Synthetic peptide
  Seed: MPMQDIKMIL (PRAME_HUMAN)
MWMQDIKMIL

SEQ ID NO: 150547 - protein, 9 aa, Artificial Sequence
  Description of Artificial Sequence: Synthetic peptide
  Seed: SHIHASSYI (PRAME_HUMAN)
SHIHASSYL

SEQ ID NO: 150548 - protein, 8 aa, Artificial Sequence
  Description of Artificial Sequence: Synthetic peptide
  Seed: VLDGLDVL (PRAME_HUMAN)
VFDGLDVL

SEQ ID NO: 150549 - protein, 8 aa, Artificial Sequence
  Description of Artificial Sequence: Synthetic peptide
  Seed: YEDIHGTL (PRAME_HUMAN)
YIDIHGTV

SEQ ID NO: 150550 - protein, 10 aa, Artificial Sequence
  Description of Artificial Sequence: Synthetic peptide
  Seed: ASATLQDLVF (PRAME_HUMAN)
AGATLQDLVW

SEQ ID NO: 150551 - protein, 10 aa, Artificial Sequence
  Description of Artificial Sequence: Synthetic peptide
  Seed: SMSVWTSPRR (PRAME_HUMAN)
SQSVWTSPRR

SEQ ID NO: 150552 - protein, 9 aa, Artificial Sequence
  Description of Artificial Sequence: Synthetic peptide
  Seed: SFYGNSISI (PRAME_HUMAN)
SSYGNSISI

SEQ ID NO: 150553 - protein, 9 aa, Artificial Sequence
  Description of Artificial Sequence: Synthetic peptide
  Seed: YSFPEPEAA (PRAME_HUMAN)
YAFPEPEAW

SEQ ID NO: 150554 - protein, 10 aa, Artificial Sequence
  Description of Artificial Sequence: Synthetic peptide
  Seed: RELFPPLFMA (PRAME_HUMAN)
RVLFPPLFMA

SEQ ID NO: 150555 - protein, 9 aa, Artificial Sequence
  Description of Artificial Sequence: Synthetic peptide
  Seed: SQFLSLQCL (PRAME_HUMAN)
SHFLSLQCF

SEQ ID NO: 150556 - protein, 9 aa, Artificial Sequence
  Description of Artificial Sequence: Synthetic peptide
  Seed: ISPEKEEQY (PRAME_HUMAN)
ILPEKEEQF

SEQ ID NO: 150557 - protein, 9 aa, Artificial Sequence
  Description of Artificial Sequence: Synthetic peptide
  Seed: LSLQCLQAL (PRAME_HUMAN)
LLLQCLQAM

SEQ ID NO: 150558 - protein, 9 aa, Artificial Sequence
  Description of Artificial Sequence: Synthetic peptide
  Seed: SYEDIHGTL (PRAME_HUMAN)
SFEDIHGTF

SEQ ID NO: 150559 - protein, 10 aa, Artificial Sequence
  Description of Artificial Sequence: Synthetic peptide
  Seed: SPYLGQMINL (PRAME_HUMAN)
SFYLGQMINL

SEQ ID NO: 150560 - protein, 9 aa, Artificial Sequence
  Description of Artificial Sequence: Synthetic peptide
  Seed: SQSPSVSQL (PRAME_HUMAN)
SMSPSVSQI

SEQ ID NO: 150561 - protein, 10 aa, Artificial Sequence
  Description of Artificial Sequence: Synthetic peptide
  Seed: ITDDQLLALL (PRAME_HUMAN)
IQDDQLLALL

SEQ ID NO: 150562 - protein, 9 aa, Artificial Sequence
  Description of Artificial Sequence: Synthetic peptide
  Seed: NLTHVLYPV (PRAME_HUMAN)
NVTHVLYPL

SEQ ID NO: 150563 - protein, 10 aa, Artificial Sequence
  Description of Artificial Sequence: Synthetic peptide
  Seed: ESYEDIHGTL (PRAME_HUMAN)
EVYEDIHGTA

SEQ ID NO: 150564 - protein, 9 aa, Artificial Sequence
  Description of Artificial Sequence: Synthetic peptide
  Seed: SLQCLQALY (PRAME_HUMAN)
SWQCLQALY

SEQ ID NO: 150565 - protein, 9 aa, Artificial Sequence
  Description of Artificial Sequence: Synthetic peptide
  Seed: MSVWTSPRR (PRAME_HUMAN)
MVVWTSPRK

SEQ ID NO: 150566 - protein, 10 aa, Artificial Sequence
  Description of Artificial Sequence: Synthetic peptide
  Seed: LLPRELFPPL (PRAME_HUMAN)
LEPRELFPPV

SEQ ID NO: 150567 - protein, 10 aa, Artificial Sequence
  Description of Artificial Sequence: Synthetic peptide
  Seed: RWKLQVLDLR (PRAME_HUMAN)
RLKLQVLDLR

SEQ ID NO: 150568 - protein, 9 aa, Artificial Sequence
  Description of Artificial Sequence: Synthetic peptide
  Seed: ALAIAALEL (PRAME_HUMAN)
AQAIAALEW

SEQ ID NO: 150569 - protein, 9 aa, Artificial Sequence
  Description of Artificial Sequence: Synthetic peptide
  Seed: HVMNPLETL (PRAME_HUMAN)
HWMNPLETY

SEQ ID NO: 150570 - protein, 9 aa, Artificial Sequence
  Description of Artificial Sequence: Synthetic peptide
  Seed: EEQYIAQFT (PRAME_HUMAN)
EEQYIAQFA

SEQ ID NO: 150571 - protein, 10 aa, Artificial Sequence
  Description of Artificial Sequence: Synthetic peptide
  Seed: GQHLHLETFK (PRAME_HUMAN)
GMHLHLETFK

SEQ ID NO: 150572 - protein, 9 aa, Artificial Sequence
  Description of Artificial Sequence: Synthetic peptide
  Seed: LAYLHARLR (PRAME_HUMAN)
LTYLHARLK

SEQ ID NO: 150573 - protein, 9 aa, Artificial Sequence
  Description of Artificial Sequence: Synthetic peptide
  Seed: VLDGLDVLL (PRAME_HUMAN)
VQDGLDVLI

SEQ ID NO: 150574 - protein, 9 aa, Artificial Sequence
  Description of Artificial Sequence: Synthetic peptide
  Seed: LAIAALELL (PRAME_HUMAN)
LLIAALELA

SEQ ID NO: 150575 - protein, 10 aa, Artificial Sequence
  Description of Artificial Sequence: Synthetic peptide
  Seed: ALYVDSLFFL (PRAME_HUMAN)
AKYVDSLFFF

SEQ ID NO: 150576 - protein, 9 aa, Artificial Sequence
  Description of Artificial Sequence: Synthetic peptide
  Seed: LSLQCLQAL (PRAME_HUMAN)
LQLQCLQAA

SEQ ID NO: 150577 - protein, 10 aa, Artificial Sequence
  Description of Artificial Sequence: Synthetic peptide
  Seed: SLYSFPEPEA (PRAME_HUMAN)
SMYSFPEPEV

SEQ ID NO: 150578 - protein, 10 aa, Artificial Sequence
  Description of Artificial Sequence: Synthetic peptide
  Seed: RGRLDQLLRH (PRAME_HUMAN)
RKRLDQLLRM

SEQ ID NO: 150579 - protein, 11 aa, Artificial Sequence
  Description of Artificial Sequence: Synthetic peptide
  Seed: LPTLAKFSPYL (PRAME_HUMAN)
LMTLAKFSPYV

SEQ ID NO: 150580 - protein, 9 aa, Artificial Sequence
  Description of Artificial Sequence: Synthetic peptide
  Seed: AMPMQDIKM (PRAME_HUMAN)
AYPMQDIKM

SEQ ID NO: 150581 - protein, 9 aa, Artificial Sequence
  Description of Artificial Sequence: Synthetic peptide
  Seed: HVMNPLETL (PRAME_HUMAN)
HIMNPLETA

SEQ ID NO: 150582 - protein, 9 aa, Artificial Sequence
  Description of Artificial Sequence: Synthetic peptide
  Seed: VFDECGITD (PRAME_HUMAN)
VPDECGITL

SEQ ID NO: 150583 - protein, 10 aa, Artificial Sequence
  Description of Artificial Sequence: Synthetic peptide
  Seed: QSLLQHLIGL (PRAME_HUMAN)
QCLLQHLIGI

SEQ ID NO: 150584 - protein, 9 aa, Artificial Sequence
  Description of Artificial Sequence: Synthetic peptide
  Seed: YSFPEPEAA (PRAME_HUMAN)
YLFPEPEAA

SEQ ID NO: 150585 - protein, 10 aa, Artificial Sequence
  Description of Artificial Sequence: Synthetic peptide
  Seed: TLAKFSPYLG (PRAME_HUMAN)
TLAKFSPYLM

SEQ ID NO: 150586 - protein, 10 aa, Artificial Sequence
  Description of Artificial Sequence: Synthetic peptide
  Seed: QLDSIEDLEV (PRAME_HUMAN)
QADSIEDLEM

SEQ ID NO: 150587 - protein, 9 aa, Artificial Sequence
  Description of Artificial Sequence: Synthetic peptide
  Seed: ISISALQSL (PRAME_HUMAN)
ISISALQSY

SEQ ID NO: 150588 - protein, 9 aa, Artificial Sequence
  Description of Artificial Sequence: Synthetic peptide
  Seed: VWTSPRRLV (PRAME_HUMAN)
VYTSPRRLL

SEQ ID NO: 150589 - protein, 9 aa, Artificial Sequence
  Description of Artificial Sequence: Synthetic peptide
  Seed: RHSQTLKAM (PRAME_HUMAN)
RSSQTLKAY

SEQ ID NO: 150590 - protein, 11 aa, Artificial Sequence
  Description of Artificial Sequence: Synthetic peptide
  Seed: SHCSQLTTLSF (PRAME_HUMAN)
SQCSQLTTLSF

SEQ ID NO: 150591 - protein, 10 aa, Artificial Sequence
  Description of Artificial Sequence: Synthetic peptide
  Seed: VTCTWKLPTL (PRAME_HUMAN)
VVCTWKLPTL

SEQ ID NO: 150592 - protein, 9 aa, Artificial Sequence
  Description of Artificial Sequence: Synthetic peptide
  Seed: YISMSVWTS (PRAME_HUMAN)
YQSMSVWTM

SEQ ID NO: 150593 - protein, 10 aa, Artificial Sequence
  Description of Artificial Sequence: Synthetic peptide
  Seed: LQALYVDSLF (PRAME_HUMAN)
LWALYVDSLW

SEQ ID NO: 150594 - protein, 9 aa, Artificial Sequence
  Description of Artificial Sequence: Synthetic peptide
  Seed: ALYVDSLFF (PRAME_HUMAN)
ATYVDSLFM

SEQ ID NO: 150595 - protein, 9 aa, Artificial Sequence
  Description of Artificial Sequence: Synthetic peptide
  Seed: ELAGQSLLK (PRAME_HUMAN)
EIAGQSLLR

SEQ ID NO: 150596 - protein, 9 aa, Artificial Sequence
  Description of Artificial Sequence: Synthetic peptide
  Seed: ITDDQLLAL (PRAME_HUMAN)
IYDDQLLAY

SEQ ID NO: 150597 - protein, 10 aa, Artificial Sequence
  Description of Artificial Sequence: Synthetic peptide
  Seed: RLSEGDVMHL (PRAME_HUMAN)
RSSEGDVMHY

SEQ ID NO: 150598 - protein, 11 aa, Artificial Sequence
  Description of Artificial Sequence: Synthetic peptide
  Seed: GTLHLERLAYL (PRAME_HUMAN)
GMLHLERLAYV

SEQ ID NO: 150599 - protein, 9 aa, Artificial Sequence
  Description of Artificial Sequence: Synthetic peptide
  Seed: KAMVQAWPF (PRAME_HUMAN)
KMMVQAWPI

SEQ ID NO: 150600 - protein, 9 aa, Artificial Sequence
  Description of Artificial Sequence: Synthetic peptide
  Seed: MINLRRLLL (PRAME_HUMAN)
MINLRRLLM

SEQ ID NO: 150601 - protein, 9 aa, Artificial Sequence
  Description of Artificial Sequence: Synthetic peptide
  Seed: RTFYDPEPI (PRAME_HUMAN)
RIFYDPEPM

SEQ ID NO: 150602 - protein, 10 aa, Artificial Sequence
  Description of Artificial Sequence: Synthetic peptide
  Seed: RGRLDQLLRH (PRAME_HUMAN)
RERLDQLLRL

SEQ ID NO: 150603 - protein, 9 aa, Artificial Sequence
  Description of Artificial Sequence: Synthetic peptide
  Seed: RRWKLQVLD (PRAME_HUMAN)
RRWKLQVLH

SEQ ID NO: 150604 - protein, 9 aa, Artificial Sequence
  Description of Artificial Sequence: Synthetic peptide
  Seed: EQPFIPVEV (PRAME_HUMAN)
EIPFIPVEV

SEQ ID NO: 150605 - protein, 9 aa, Artificial Sequence
  Description of Artificial Sequence: Synthetic peptide
  Seed: NSISISALQ (PRAME_HUMAN)
NLISISALK

SEQ ID NO: 150606 - protein, 9 aa, Artificial Sequence
  Description of Artificial Sequence: Synthetic peptide
  Seed: ISISALQSL (PRAME_HUMAN)
IGISALQSY

SEQ ID NO: 150607 - protein, 10 aa, Artificial Sequence
  Description of Artificial Sequence: Synthetic peptide
  Seed: ITDDQLLALL (PRAME_HUMAN)
IFDDQLLALL

SEQ ID NO: 150608 - protein, 9 aa, Artificial Sequence
  Description of Artificial Sequence: Synthetic peptide
  Seed: VQAWPFTCL (PRAME_HUMAN)
VLAWPFTCM

SEQ ID NO: 150609 - protein, 9 aa, Artificial Sequence
  Description of Artificial Sequence: Synthetic peptide
  Seed: FYDPEPILC (PRAME_HUMAN)
FSDPEPILC

SEQ ID NO: 150610 - protein, 8 aa, Artificial Sequence
  Description of Artificial Sequence: Synthetic peptide
  Seed: QPFIPVEV (PRAME_HUMAN)
QHFIPVEV

SEQ ID NO: 150611 - protein, 11 aa, Artificial Sequence
  Description of Artificial Sequence: Synthetic peptide
  Seed: DVLLAQEVRPR (PRAME_HUMAN)
DTLLAQEVRPK

SEQ ID NO: 150612 - protein, 9 aa, Artificial Sequence
  Description of Artificial Sequence: Synthetic peptide
  Seed: KFSPYLGQM (PRAME_HUMAN)
KWSPYLGQI

SEQ ID NO: 150613 - protein, 10 aa, Artificial Sequence
  Description of Artificial Sequence: Synthetic peptide
  Seed: RLSEGDVMHL (PRAME_HUMAN)
RVSEGDVMHY

SEQ ID NO: 150614 - protein, 9 aa, Artificial Sequence
  Description of Artificial Sequence: Synthetic peptide
  Seed: EAAQPMTKK (PRAME_HUMAN)
EIAQPMTKR

SEQ ID NO: 150615 - protein, 8 aa, Artificial Sequence
  Description of Artificial Sequence: Synthetic peptide
  Seed: YEDIHGTL (PRAME_HUMAN)
YADIHGTI

SEQ ID NO: 150616 - protein, 9 aa, Artificial Sequence
  Description of Artificial Sequence: Synthetic peptide
  Seed: ITDDQLLAL (PRAME_HUMAN)
IMDDQLLAT

SEQ ID NO: 150617 - protein, 9 aa, Artificial Sequence
  Description of Artificial Sequence: Synthetic peptide
  Seed: LAYLHARLR (PRAME_HUMAN)
LVYLHARLR

SEQ ID NO: 150618 - protein, 9 aa, Artificial Sequence
  Description of Artificial Sequence: Synthetic peptide
  Seed: FLRGRLDQL (PRAME_HUMAN)
FSRGRLDQL

SEQ ID NO: 150619 - protein, 9 aa, Artificial Sequence
  Description of Artificial Sequence: Synthetic peptide
  Seed: VLSLSGVML (PRAME_HUMAN)
VMSLSGVMV

SEQ ID NO: 150620 - protein, 9 aa, Artificial Sequence
  Description of Artificial Sequence: Synthetic peptide
  Seed: ACDELFSYL (PRAME_HUMAN)
AFDELFSYM

SEQ ID NO: 150621 - protein, 9 aa, Artificial Sequence
  Description of Artificial Sequence: Synthetic peptide
  Seed: SQSPSVSQL (PRAME_HUMAN)
SESPSVSQS

SEQ ID NO: 150622 - protein, 9 aa, Artificial Sequence
  Description of Artificial Sequence: Synthetic peptide
  Seed: LLLSHIHAS (PRAME_HUMAN)
LVLSHIHAT

SEQ ID NO: 150623 - protein, 9 aa, Artificial Sequence
  Description of Artificial Sequence: Synthetic peptide
  Seed: HGTLHLERL (PRAME_HUMAN)
HRTLHLERY

SEQ ID NO: 150624 - protein, 10 aa, Artificial Sequence
  Description of Artificial Sequence: Synthetic peptide
  Seed: QSLLQHLIGL (PRAME_HUMAN)
QWLLQHLIGL

SEQ ID NO: 150625 - protein, 9 aa, Artificial Sequence
  Description of Artificial Sequence: Synthetic peptide
  Seed: MNPLETLSI (PRAME_HUMAN)
MRPLETLSY

SEQ ID NO: 150626 - protein, 9 aa, Artificial Sequence
  Description of Artificial Sequence: Synthetic peptide
  Seed: GNRASLYSF (PRAME_HUMAN)
GERASLYSY

SEQ ID NO: 150627 - protein, 11 aa, Artificial Sequence
  Description of Artificial Sequence: Synthetic peptide
  Seed: FKAVLDGLDVL (PRAME_HUMAN)
FLAVLDGLDVI

SEQ ID NO: 150628 - protein, 10 aa, Artificial Sequence
  Description of Artificial Sequence: Synthetic peptide
  Seed: EDLEVTCTWK (PRAME_HUMAN)
ETLEVTCTWK

SEQ ID NO: 150629 - protein, 10 aa, Artificial Sequence
  Description of Artificial Sequence: Synthetic peptide
  Seed: QSLLQHLIGL (PRAME_HUMAN)
QPLLQHLIGI

SEQ ID NO: 150630 - protein, 10 aa, Artificial Sequence
  Description of Artificial Sequence: Synthetic peptide
  Seed: FIPVEVLVDL (PRAME_HUMAN)
FQPVEVLVDV

SEQ ID NO: 150631 - protein, 10 aa, Artificial Sequence
  Description of Artificial Sequence: Synthetic peptide
  Seed: MPMQDIKMIL (PRAME_HUMAN)
MFMQDIKMIL

SEQ ID NO: 150632 - protein, 9 aa, Artificial Sequence
  Description of Artificial Sequence: Synthetic peptide
  Seed: SFYGNSISI (PRAME_HUMAN)
SAYGNSISA

SEQ ID NO: 150633 - protein, 9 aa, Artificial Sequence
  Description of Artificial Sequence: Synthetic peptide
  Seed: SRYISMSVW (PRAME_HUMAN)
SHYISMSVM

SEQ ID NO: 150634 - protein, 10 aa, Artificial Sequence
  Description of Artificial Sequence: Synthetic peptide
  Seed: RASATLQDLV (PRAME_HUMAN)
RHSATLQDLW

SEQ ID NO: 150635 - protein, 9 aa, Artificial Sequence
  Description of Artificial Sequence: Synthetic peptide
  Seed: VSPEPLQAL (PRAME_HUMAN)
VAPEPLQAI

SEQ ID NO: 150636 - protein, 10 aa, Artificial Sequence
  Description of Artificial Sequence: Synthetic peptide
  Seed: LPTLAKFSPY (PRAME_HUMAN)
LSTLAKFSPY

SEQ ID NO: 150637 - protein, 9 aa, Artificial Sequence
  Description of Artificial Sequence: Synthetic peptide
  Seed: QLLALLPSL (PRAME_HUMAN)
QTLALLPSW

SEQ ID NO: 150638 - protein, 10 aa, Artificial Sequence
  Description of Artificial Sequence: Synthetic peptide
  Seed: SALQSLLQHL (PRAME_HUMAN)
SMLQSLLQHA

SEQ ID NO: 150639 - protein, 10 aa, Artificial Sequence
  Description of Artificial Sequence: Synthetic peptide
  Seed: QAWPFTCLPL (PRAME_HUMAN)
QLWPFTCLPF

SEQ ID NO: 150640 - protein, 10 aa, Artificial Sequence
  Description of Artificial Sequence: Synthetic peptide
  Seed: GACDELFSYL (PRAME_HUMAN)
GMCDELFSYM

SEQ ID NO: 150641 - protein, 10 aa, Artificial Sequence
  Description of Artificial Sequence: Synthetic peptide
  Seed: AVLDGLDVLL (PRAME_HUMAN)
AILDGLDVLW

SEQ ID NO: 150642 - protein, 9 aa, Artificial Sequence
  Description of Artificial Sequence: Synthetic peptide
  Seed: RGRLDQLLR (PRAME_HUMAN)
RQRLDQLLR

SEQ ID NO: 150643 - protein, 10 aa, Artificial Sequence
  Description of Artificial Sequence: Synthetic peptide
  Seed: AQFTSQFLSL (PRAME_HUMAN)
AVFTSQFLSY

SEQ ID NO: 150644 - protein, 9 aa, Artificial Sequence
  Description of Artificial Sequence: Synthetic peptide
  Seed: MHLSQSPSV (PRAME_HUMAN)
MMLSQSPSY

SEQ ID NO: 150645 - protein, 9 aa, Artificial Sequence
  Description of Artificial Sequence: Synthetic peptide
  Seed: MSVWTSPRR (PRAME_HUMAN)
MAVWTSPRR

SEQ ID NO: 150646 - protein, 9 aa, Artificial Sequence
  Description of Artificial Sequence: Synthetic peptide
  Seed: YLIEKVKRK (PRAME_HUMAN)
YLIEKVKRR

SEQ ID NO: 150647 - protein, 10 aa, Artificial Sequence
  Description of Artificial Sequence: Synthetic peptide
  Seed: AEQPFIPVEV (PRAME_HUMAN)
AQQPFIPVEV

SEQ ID NO: 150648 - protein, 9 aa, Artificial Sequence
  Description of Artificial Sequence: Synthetic peptide
  Seed: YSFPEPEAA (PRAME_HUMAN)
YNFPEPEAL

SEQ ID NO: 150649 - protein, 11 aa, Artificial Sequence
  Description of Artificial Sequence: Synthetic peptide
  Seed: LPTLAKFSPYL (PRAME_HUMAN)
LATLAKFSPYL

SEQ ID NO: 150650 - protein, 9 aa, Artificial Sequence
  Description of Artificial Sequence: Synthetic peptide
  Seed: ALYVDSLFF (PRAME_HUMAN)
AIYVDSLFY

SEQ ID NO: 150651 - protein, 10 aa, Artificial Sequence
  Description of Artificial Sequence: Synthetic peptide
  Seed: TLQDLVFDEC (PRAME_HUMAN)
TLQDLVFDEL

SEQ ID NO: 150652 - protein, 9 aa, Artificial Sequence
  Description of Artificial Sequence: Synthetic peptide
  Seed: FTCLPLGVL (PRAME_HUMAN)
FMCLPLGVY

SEQ ID NO: 150653 - protein, 9 aa, Artificial Sequence
  Description of Artificial Sequence: Synthetic peptide
  Seed: ELFSYLIEK (PRAME_HUMAN)
EAFSYLIEK

SEQ ID NO: 150654 - protein, 9 aa, Artificial Sequence
  Description of Artificial Sequence: Synthetic peptide
  Seed: VSPEPLQAL (PRAME_HUMAN)
VPPEPLQAY

SEQ ID NO: 150655 - protein, 11 aa, Artificial Sequence
  Description of Artificial Sequence: Synthetic peptide
  Seed: SIQSRYISMSV (PRAME_HUMAN)
SMQSRYISMSK

SEQ ID NO: 150656 - protein, 10 aa, Artificial Sequence
  Description of Artificial Sequence: Synthetic peptide
  Seed: ELFPPLFMAA (PRAME_HUMAN)
EVFPPLFMAA

SEQ ID NO: 150657 - protein, 9 aa, Artificial Sequence
  Description of Artificial Sequence: Synthetic peptide
  Seed: ALQSLLQHL (PRAME_HUMAN)
ATQSLLQHF

SEQ ID NO: 150658 - protein, 10 aa, Artificial Sequence
  Description of Artificial Sequence: Synthetic peptide
  Seed: ISISALQSLL (PRAME_HUMAN)
IMISALQSLL

SEQ ID NO: 150659 - protein, 11 aa, Artificial Sequence
  Description of Artificial Sequence: Synthetic peptide
  Seed: QALYVDSLFFL (PRAME_HUMAN)
QGLYVDSLFFI

SEQ ID NO: 150660 - protein, 9 aa, Artificial Sequence
  Description of Artificial Sequence: Synthetic peptide
  Seed: CKKLKIFAM (PRAME_HUMAN)
CPKLKIFAF

SEQ ID NO: 150661 - protein, 10 aa, Artificial Sequence
  Description of Artificial Sequence: Synthetic peptide
  Seed: TSQFLSLQCL (PRAME_HUMAN)
THQFLSLQCY

SEQ ID NO: 150662 - protein, 9 aa, Artificial Sequence
  Description of Artificial Sequence: Synthetic peptide
  Seed: LPRELFPPL (PRAME_HUMAN)
LIRELFPPF

SEQ ID NO: 150663 - protein, 9 aa, Artificial Sequence
  Description of Artificial Sequence: Synthetic peptide
  Seed: FYDPEPILC (PRAME_HUMAN)
FTDPEPILC

SEQ ID NO: 150664 - protein, 9 aa, Artificial Sequence
  Description of Artificial Sequence: Synthetic peptide
  Seed: ISPEKEEQY (PRAME_HUMAN)
IAPEKEEQM

SEQ ID NO: 150665 - protein, 9 aa, Artificial Sequence
  Description of Artificial Sequence: Synthetic peptide
  Seed: LQDLVFDEC (PRAME_HUMAN)
LIDLVFDEM

SEQ ID NO: 150666 - protein, 9 aa, Artificial Sequence
  Description of Artificial Sequence: Synthetic peptide
  Seed: KLKIFAMPM (PRAME_HUMAN)
KVKIFAMPF

SEQ ID NO: 150667 - protein, 9 aa, Artificial Sequence
  Description of Artificial Sequence: Synthetic peptide
  Seed: HVMNPLETL (PRAME_HUMAN)
HHMNPLETA

SEQ ID NO: 150668 - protein, 9 aa, Artificial Sequence
  Description of Artificial Sequence: Synthetic peptide
  Seed: SQFLSLQCL (PRAME_HUMAN)
STFLSLQCF

SEQ ID NO: 150669 - protein, 8 aa, Artificial Sequence
  Description of Artificial Sequence: Synthetic peptide
  Seed: YSFPEPEA (PRAME_HUMAN)
YAFPEPEM

SEQ ID NO: 150670 - protein, 9 aa, Artificial Sequence
  Description of Artificial Sequence: Synthetic peptide
  Seed: QLLALLPSL (PRAME_HUMAN)
QQLALLPSF

SEQ ID NO: 150671 - protein, 10 aa, Artificial Sequence
  Description of Artificial Sequence: Synthetic peptide
  Seed: RGRLDQLLRH (PRAME_HUMAN)
RPRLDQLLRR

SEQ ID NO: 150672 - protein, 9 aa, Artificial Sequence
  Description of Artificial Sequence: Synthetic peptide
  Seed: FSPYLGQMI (PRAME_HUMAN)
FQPYLGQMV

SEQ ID NO: 150673 - protein, 10 aa, Artificial Sequence
  Description of Artificial Sequence: Synthetic peptide
  Seed: DVSPEPLQAL (PRAME_HUMAN)
DISPEPLQAK

SEQ ID NO: 150674 - protein, 9 aa, Artificial Sequence
  Description of Artificial Sequence: Synthetic peptide
  Seed: VLMKGQHLH (PRAME_HUMAN)
VMMKGQHLK

SEQ ID NO: 150675 - protein, 9 aa, Artificial Sequence
  Description of Artificial Sequence: Synthetic peptide
  Seed: KLKIFAMPM (PRAME_HUMAN)
KQKIFAMPY

SEQ ID NO: 150676 - protein, 10 aa, Artificial Sequence
  Description of Artificial Sequence: Synthetic peptide
  Seed: ITDDQLLALL (PRAME_HUMAN)
IADDQLLALY

SEQ ID NO: 150677 - protein, 9 aa, Artificial Sequence
  Description of Artificial Sequence: Synthetic peptide
  Seed: RLAYLHARL (PRAME_HUMAN)
RSAYLHARW

SEQ ID NO: 150678 - protein, 9 aa, Artificial Sequence
  Description of Artificial Sequence: Synthetic peptide
  Seed: THVLYPVPL (PRAME_HUMAN)
TFVLYPVPI

SEQ ID NO: 150679 - protein, 9 aa, Artificial Sequence
  Description of Artificial Sequence: Synthetic peptide
  Seed: LLLSHIHAS (PRAME_HUMAN)
LVLSHIHAL

SEQ ID NO: 150680 - protein, 9 aa, Artificial Sequence
  Description of Artificial Sequence: Synthetic peptide
  Seed: HLIGLSNLT (PRAME_HUMAN)
HIIGLSNLV

SEQ ID NO: 150681 - protein, 10 aa, Artificial Sequence
  Description of Artificial Sequence: Synthetic peptide
  Seed: AMVQAWPFTC (PRAME_HUMAN)
AVVQAWPFTV

SEQ ID NO: 150682 - protein, 10 aa, Artificial Sequence
  Description of Artificial Sequence: Synthetic peptide
  Seed: LLPRELFPPL (PRAME_HUMAN)
LNPRELFPPF

SEQ ID NO: 150683 - protein, 9 aa, Artificial Sequence
  Description of Artificial Sequence: Synthetic peptide
  Seed: YIAQFTSQF (PRAME_HUMAN)
YPAQFTSQF

SEQ ID NO: 150684 - protein, 11 aa, Artificial Sequence
  Description of Artificial Sequence: Synthetic peptide
  Seed: SLYSFPEPEAA (PRAME_HUMAN)
SMYSFPEPEAI

SEQ ID NO: 150685 - protein, 10 aa, Artificial Sequence
  Description of Artificial Sequence: Synthetic peptide
  Seed: SVLSLSGVML (PRAME_HUMAN)
SLLSLSGVMI

SEQ ID NO: 150686 - protein, 11 aa, Artificial Sequence
  Description of Artificial Sequence: Synthetic peptide
  Seed: LSLSGVMLTDV (PRAME_HUMAN)
LMLSGVMLTDV

SEQ ID NO: 150687 - protein, 9 aa, Artificial Sequence
  Description of Artificial Sequence: Synthetic peptide
  Seed: SRYISMSVW (PRAME_HUMAN)
SMYISMSVY

SEQ ID NO: 150688 - protein, 11 aa, Artificial Sequence
  Description of Artificial Sequence: Synthetic peptide
  Seed: YISPEKEEQYI (PRAME_HUMAN)
YQSPEKEEQYF

SEQ ID NO: 150689 - protein, 9 aa, Artificial Sequence
  Description of Artificial Sequence: Synthetic peptide
  Seed: AFDGRHSQT (PRAME_HUMAN)
AIDGRHSQM

SEQ ID NO: 150690 - protein, 8 aa, Artificial Sequence
  Description of Artificial Sequence: Synthetic peptide
  Seed: QHLHLETF (PRAME_HUMAN)
QHLHLETV

SEQ ID NO: 150691 - protein, 10 aa, Artificial Sequence
  Description of Artificial Sequence: Synthetic peptide
  Seed: VMNPLETLSI (PRAME_HUMAN)
VVNPLETLSY

SEQ ID NO: 150692 - protein, 10 aa, Artificial Sequence
  Description of Artificial Sequence: Synthetic peptide
  Seed: RELFPPLFMA (PRAME_HUMAN)
RLLFPPLFMT

SEQ ID NO: 150693 - protein, 11 aa, Artificial Sequence
  Description of Artificial Sequence: Synthetic peptide
  Seed: LTDVSPEPLQA (PRAME_HUMAN)
LADVSPEPLQL

SEQ ID NO: 150694 - protein, 9 aa, Artificial Sequence
  Description of Artificial Sequence: Synthetic peptide
  Seed: TFYDPEPIL (PRAME_HUMAN)
TLYDPEPIL

SEQ ID NO: 150695 - protein, 10 aa, Artificial Sequence
  Description of Artificial Sequence: Synthetic peptide
  Seed: MERRRLWGSI (PRAME_HUMAN)
MNRRRLWGSM

SEQ ID NO: 150696 - protein, 10 aa, Artificial Sequence
  Description of Artificial Sequence: Synthetic peptide
  Seed: ALAIAALELL (PRAME_HUMAN)
AVAIAALELV

SEQ ID NO: 150697 - protein, 9 aa, Artificial Sequence
  Description of Artificial Sequence: Synthetic peptide
  Seed: RRLLLSHIH (PRAME_HUMAN)
RKLLLSHIL

SEQ ID NO: 150698 - protein, 10 aa, Artificial Sequence
  Description of Artificial Sequence: Synthetic peptide
  Seed: FAMPMQDIKM (PRAME_HUMAN)
FPMPMQDIKL

SEQ ID NO: 150699 - protein, 9 aa, Artificial Sequence
  Description of Artificial Sequence: Synthetic peptide
  Seed: LCCKKLKIF (PRAME_HUMAN)
LACKKLKIW

SEQ ID NO: 150700 - protein, 10 aa, Artificial Sequence
  Description of Artificial Sequence: Synthetic peptide
  Seed: SEGDVMHLSQ (PRAME_HUMAN)
SEGDVMHLSV

SEQ ID NO: 150701 - protein, 10 aa, Artificial Sequence
  Description of Artificial Sequence: Synthetic peptide
  Seed: RGRLDQLLRH (PRAME_HUMAN)
RYRLDQLLRI

SEQ ID NO: 150702 - protein, 9 aa, Artificial Sequence
  Description of Artificial Sequence: Synthetic peptide
  Seed: KAMVQAWPF (PRAME_HUMAN)
KPMVQAWPV

SEQ ID NO: 150703 - protein, 9 aa, Artificial Sequence
  Description of Artificial Sequence: Synthetic peptide
  Seed: VSPEPLQAL (PRAME_HUMAN)
VWPEPLQAF

SEQ ID NO: 150704 - protein, 9 aa, Artificial Sequence
  Description of Artificial Sequence: Synthetic peptide
  Seed: HVMNPLETL (PRAME_HUMAN)
HEMNPLETA

SEQ ID NO: 150705 - protein, 9 aa, Artificial Sequence
  Description of Artificial Sequence: Synthetic peptide
  Seed: DEALAIAAL (PRAME_HUMAN)
DEALAIAAF

SEQ ID NO: 150706 - protein, 9 aa, Artificial Sequence
  Description of Artificial Sequence: Synthetic peptide
  Seed: SPEPLQALL (PRAME_HUMAN)
SPEPLQALM

SEQ ID NO: 150707 - protein, 9 aa, Artificial Sequence
  Description of Artificial Sequence: Synthetic peptide
  Seed: LSHIHASSY (PRAME_HUMAN)
LTHIHASSL

SEQ ID NO: 150708 - protein, 11 aa, Artificial Sequence
  Description of Artificial Sequence: Synthetic peptide
  Seed: RASATLQDLVF (PRAME_HUMAN)
RVSATLQDLVW

SEQ ID NO: 150709 - protein, 11 aa, Artificial Sequence
  Description of Artificial Sequence: Synthetic peptide
  Seed: QALYVDSLFFL (PRAME_HUMAN)
QMLYVDSLFFM

SEQ ID NO: 150710 - protein, 9 aa, Artificial Sequence
  Description of Artificial Sequence: Synthetic peptide
  Seed: FYDPEPILC (PRAME_HUMAN)
FADPEPILM

SEQ ID NO: 150711 - protein, 10 aa, Artificial Sequence
  Description of Artificial Sequence: Synthetic peptide
  Seed: RELFPPLFMA (PRAME_HUMAN)
RVLFPPLFMT

SEQ ID NO: 150712 - protein, 9 aa, Artificial Sequence
  Description of Artificial Sequence: Synthetic peptide
  Seed: LSLQCLQAL (PRAME_HUMAN)
LILQCLQAI

SEQ ID NO: 150713 - protein, 11 aa, Artificial Sequence
  Description of Artificial Sequence: Synthetic peptide
  Seed: RASATLQDLVF (PRAME_HUMAN)
RSSATLQDLVF

SEQ ID NO: 150714 - protein, 10 aa, Artificial Sequence
  Description of Artificial Sequence: Synthetic peptide
  Seed: KDEALAIAAL (PRAME_HUMAN)
KYEALAIAAL

SEQ ID NO: 150715 - protein, 9 aa, Artificial Sequence
  Description of Artificial Sequence: Synthetic peptide
  Seed: LSLQCLQAL (PRAME_HUMAN)
LLLQCLQAF

SEQ ID NO: 150716 - protein, 10 aa, Artificial Sequence
  Description of Artificial Sequence: Synthetic peptide
  Seed: LSVLSLSGVM (PRAME_HUMAN)
LLVLSLSGVF

SEQ ID NO: 150717 - protein, 9 aa, Artificial Sequence
  Description of Artificial Sequence: Synthetic peptide
  Seed: FLRGRLDQL (PRAME_HUMAN)
FIRGRLDQF

SEQ ID NO: 150718 - protein, 9 aa, Artificial Sequence
  Description of Artificial Sequence: Synthetic peptide
  Seed: LAIAALELL (PRAME_HUMAN)
LMIAALELY

SEQ ID NO: 150719 - protein, 9 aa, Artificial Sequence
  Description of Artificial Sequence: Synthetic peptide
  Seed: SPRRLVELA (PRAME_HUMAN)
SPRRLVELL

SEQ ID NO: 150720 - protein, 9 aa, Artificial Sequence
  Description of Artificial Sequence: Synthetic peptide
  Seed: ISISALQSL (PRAME_HUMAN)
ITISALQSM

SEQ ID NO: 150721 - protein, 10 aa, Artificial Sequence
  Description of Artificial Sequence: Synthetic peptide
  Seed: EDLEVTCTWK (PRAME_HUMAN)
EMLEVTCTWR

SEQ ID NO: 150722 - protein, 10 aa, Artificial Sequence
  Description of Artificial Sequence: Synthetic peptide
  Seed: LPTLAKFSPY (PRAME_HUMAN)
LATLAKFSPF

SEQ ID NO: 150723 - protein, 11 aa, Artificial Sequence
  Description of Artificial Sequence: Synthetic peptide
  Seed: RELFPPLFMAA (PRAME_HUMAN)
RELFPPLFMAL

SEQ ID NO: 150724 - protein, 10 aa, Artificial Sequence
  Description of Artificial Sequence: Synthetic peptide
  Seed: SPSVSQLSVL (PRAME_HUMAN)
SGSVSQLSVY

SEQ ID NO: 150725 - protein, 9 aa, Artificial Sequence
  Description of Artificial Sequence: Synthetic peptide
  Seed: ELFPPLFMA (PRAME_HUMAN)
EAFPPLFMV

SEQ ID NO: 150726 - protein, 10 aa, Artificial Sequence
  Description of Artificial Sequence: Synthetic peptide
  Seed: SVSQLSVLSL (PRAME_HUMAN)
SMSQLSVLSI

SEQ ID NO: 150727 - protein, 10 aa, Artificial Sequence
  Description of Artificial Sequence: Synthetic peptide
  Seed: LLSHIHASSY (PRAME_HUMAN)
LKSHIHASSM

SEQ ID NO: 150728 - protein, 9 aa, Artificial Sequence
  Description of Artificial Sequence: Synthetic peptide
  Seed: SLLQHLIGL (PRAME_HUMAN)
SMLQHLIGL

SEQ ID NO: 150729 - protein, 10 aa, Artificial Sequence
  Description of Artificial Sequence: Synthetic peptide
  Seed: FTCLPLGVLM (PRAME_HUMAN)
FACLPLGVLY

SEQ ID NO: 150730 - protein, 11 aa, Artificial Sequence
  Description of Artificial Sequence: Synthetic peptide
  Seed: SIEDLEVTCTW (PRAME_HUMAN)
SAEDLEVTCTY

SEQ ID NO: 150731 - protein, 11 aa, Artificial Sequence
  Description of Artificial Sequence: Synthetic peptide
  Seed: YISMSVWTSPR (PRAME_HUMAN)
YVSMSVWTSPR

SEQ ID NO: 150732 - protein, 9 aa, Artificial Sequence
  Description of Artificial Sequence: Synthetic peptide
  Seed: VLMKGQHLH (PRAME_HUMAN)
VAMKGQHLY

SEQ ID NO: 150733 - protein, 9 aa, Artificial Sequence
  Description of Artificial Sequence: Synthetic peptide
  Seed: SHIHASSYI (PRAME_HUMAN)
SKIHASSYY

SEQ ID NO: 150734 - protein, 9 aa, Artificial Sequence
  Description of Artificial Sequence: Synthetic peptide
  Seed: LSHIHASSY (PRAME_HUMAN)
LSHIHASSV

SEQ ID NO: 150735 - protein, 10 aa, Artificial Sequence
  Description of Artificial Sequence: Synthetic peptide
  Seed: MERRRLWGSI (PRAME_HUMAN)
MYRRRLWGSL

SEQ ID NO: 150736 - protein, 10 aa, Artificial Sequence
  Description of Artificial Sequence: Synthetic peptide
  Seed: SMVWLSANPC (PRAME_HUMAN)
SMVWLSANPA

SEQ ID NO: 150737 - protein, 9 aa, Artificial Sequence
  Description of Artificial Sequence: Synthetic peptide
  Seed: MINLRRLLL (PRAME_HUMAN)
MPNLRRLLC

SEQ ID NO: 150738 - protein, 9 aa, Artificial Sequence
  Description of Artificial Sequence: Synthetic peptide
  Seed: SMSVWTSPR (PRAME_HUMAN)
SYSVWTSPY

SEQ ID NO: 150739 - protein, 10 aa, Artificial Sequence
  Description of Artificial Sequence: Synthetic peptide
  Seed: LLLSHIHASS (PRAME_HUMAN)
LCLSHIHASI

SEQ ID NO: 150740 - protein, 10 aa, Artificial Sequence
  Description of Artificial Sequence: Synthetic peptide
  Seed: VTCTWKLPTL (PRAME_HUMAN)
VLCTWKLPTI

SEQ ID NO: 150741 - protein, 11 aa, Artificial Sequence
  Description of Artificial Sequence: Synthetic peptide
  Seed: YISMSVWTSPR (PRAME_HUMAN)
YTSMSVWTSPK

SEQ ID NO: 150742 - protein, 9 aa, Artificial Sequence
  Description of Artificial Sequence: Synthetic peptide
  Seed: FTCLPLGVL (PRAME_HUMAN)
FACLPLGVF

SEQ ID NO: 150743 - protein, 10 aa, Artificial Sequence
  Description of Artificial Sequence: Synthetic peptide
  Seed: RELFPPLFMA (PRAME_HUMAN)
RKLFPPLFMA

SEQ ID NO: 150744 - protein, 9 aa, Artificial Sequence
  Description of Artificial Sequence: Synthetic peptide
  Seed: ISPEKEEQY (PRAME_HUMAN)
IFPEKEEQL

SEQ ID NO: 150745 - protein, 9 aa, Artificial Sequence
  Description of Artificial Sequence: Synthetic peptide
  Seed: QDIKMILKM (PRAME_HUMAN)
QEIKMILKP

SEQ ID NO: 150746 - protein, 10 aa, Artificial Sequence
  Description of Artificial Sequence: Synthetic peptide
  Seed: ALQSLLQHLI (PRAME_HUMAN)
AMQSLLQHLV

SEQ ID NO: 150747 - protein, 9 aa, Artificial Sequence
  Description of Artificial Sequence: Synthetic peptide
  Seed: SMSVWTSPR (PRAME_HUMAN)
SFSVWTSPR

SEQ ID NO: 150748 - protein, 11 aa, Artificial Sequence
  Description of Artificial Sequence: Synthetic peptide
  Seed: SNLTHVLYPVP (PRAME_HUMAN)
SLLTHVLYPVL

SEQ ID NO: 150749 - protein, 9 aa, Artificial Sequence
  Description of Artificial Sequence: Synthetic peptide
  Seed: YIAQFTSQF (PRAME_HUMAN)
YRAQFTSQY

SEQ ID NO: 150750 - protein, 11 aa, Artificial Sequence
  Description of Artificial Sequence: Synthetic peptide
  Seed: VQAWPFTCLPL (PRAME_HUMAN)
VKAWPFTCLPY

SEQ ID NO: 150751 - protein, 9 aa, Artificial Sequence
  Description of Artificial Sequence: Synthetic peptide
  Seed: DEALAIAAL (PRAME_HUMAN)
DRALAIAAL

SEQ ID NO: 150752 - protein, 9 aa, Artificial Sequence
  Description of Artificial Sequence: Synthetic peptide
  Seed: LMKGQHLHL (PRAME_HUMAN)
LTKGQHLHY

SEQ ID NO: 150753 - protein, 10 aa, Artificial Sequence
  Description of Artificial Sequence: Synthetic peptide
  Seed: VLSLSGVMLT (PRAME_HUMAN)
VMSLSGVMLI

SEQ ID NO: 150754 - protein, 10 aa, Artificial Sequence
  Description of Artificial Sequence: Synthetic peptide
  Seed: LKAMVQAWPF (PRAME_HUMAN)
LAAMVQAWPW

SEQ ID NO: 150755 - protein, 9 aa, Artificial Sequence
  Description of Artificial Sequence: Synthetic peptide
  Seed: SVLSLSGVM (PRAME_HUMAN)
SILSLSGVY

SEQ ID NO: 150756 - protein, 11 aa, Artificial Sequence
  Description of Artificial Sequence: Synthetic peptide
  Seed: HVMNPLETLSI (PRAME_HUMAN)
HQMNPLETLSV

SEQ ID NO: 150757 - protein, 9 aa, Artificial Sequence
  Description of Artificial Sequence: Synthetic peptide
  Seed: KRKKNVLRL (PRAME_HUMAN)
KRKKNVLRM

SEQ ID NO: 150758 - protein, 9 aa, Artificial Sequence
  Description of Artificial Sequence: Synthetic peptide
  Seed: VSPEPLQAL (PRAME_HUMAN)
VYPEPLQAI

SEQ ID NO: 150759 - protein, 9 aa, Artificial Sequence
  Description of Artificial Sequence: Synthetic peptide
  Seed: SLQCLQALY (PRAME_HUMAN)
SMQCLQALF

SEQ ID NO: 150760 - protein, 9 aa, Artificial Sequence
  Description of Artificial Sequence: Synthetic peptide
  Seed: LLKDEALAI (PRAME_HUMAN)
LQKDEALAY

SEQ ID NO: 150761 - protein, 10 aa, Artificial Sequence
  Description of Artificial Sequence: Synthetic peptide
  Seed: FIPVEVLVDL (PRAME_HUMAN)
FFPVEVLVDM

SEQ ID NO: 150762 - protein, 9 aa, Artificial Sequence
  Description of Artificial Sequence: Synthetic peptide
  Seed: AMPMQDIKM (PRAME_HUMAN)
AMPMQDIKY

SEQ ID NO: 150763 - protein, 10 aa, Artificial Sequence
  Description of Artificial Sequence: Synthetic peptide
  Seed: IGLSNLTHVL (PRAME_HUMAN)
IMLSNLTHVM

SEQ ID NO: 150764 - protein, 9 aa, Artificial Sequence
  Description of Artificial Sequence: Synthetic peptide
  Seed: LLSHIHASS (PRAME_HUMAN)
LLSHIHASL

SEQ ID NO: 150765 - protein, 9 aa, Artificial Sequence
  Description of Artificial Sequence: Synthetic peptide
  Seed: LQDLVFDEC (PRAME_HUMAN)
LEDLVFDEV

SEQ ID NO: 150766 - protein, 9 aa, Artificial Sequence
  Description of Artificial Sequence: Synthetic peptide
  Seed: KLKIFAMPM (PRAME_HUMAN)
KVKIFAMPV

SEQ ID NO: 150767 - protein, 10 aa, Artificial Sequence
  Description of Artificial Sequence: Synthetic peptide
  Seed: LPRELFPPLF (PRAME_HUMAN)
LPRELFPPLM

SEQ ID NO: 150768 - protein, 10 aa, Artificial Sequence
  Description of Artificial Sequence: Synthetic peptide
  Seed: ALELLPRELF (PRAME_HUMAN)
AEELLPRELW

SEQ ID NO: 150769 - protein, 10 aa, Artificial Sequence
  Description of Artificial Sequence: Synthetic peptide
  Seed: RGRLDQLLRH (PRAME_HUMAN)
RDRLDQLLRF

SEQ ID NO: 150770 - protein, 8 aa, Artificial Sequence
  Description of Artificial Sequence: Synthetic peptide
  Seed: SPYLGQMI (PRAME_HUMAN)
SQYLGQMI

SEQ ID NO: 150771 - protein, 10 aa, Artificial Sequence
  Description of Artificial Sequence: Synthetic peptide
  Seed: LPSLSHCSQL (PRAME_HUMAN)
LPSLSHCSQM

SEQ ID NO: 150772 - protein, 9 aa, Artificial Sequence
  Description of Artificial Sequence: Synthetic peptide
  Seed: TLAKFSPYL (PRAME_HUMAN)
TTAKFSPYI

SEQ ID NO: 150773 - protein, 9 aa, Artificial Sequence
  Description of Artificial Sequence: Synthetic peptide
  Seed: KFSPYLGQM (PRAME_HUMAN)
KRSPYLGQL

SEQ ID NO: 150774 - protein, 10 aa, Artificial Sequence
  Description of Artificial Sequence: Synthetic peptide
  Seed: QAWPFTCLPL (PRAME_HUMAN)
QYWPFTCLPF

SEQ ID NO: 150775 - protein, 10 aa, Artificial Sequence
  Description of Artificial Sequence: Synthetic peptide
  Seed: FIPVEVLVDL (PRAME_HUMAN)
FMPVEVLVDY

SEQ ID NO: 150776 - protein, 9 aa, Artificial Sequence
  Description of Artificial Sequence: Synthetic peptide
  Seed: VSPEPLQAL (PRAME_HUMAN)
VSPEPLQAM

SEQ ID NO: 150777 - protein, 10 aa, Artificial Sequence
  Description of Artificial Sequence: Synthetic peptide
  Seed: ITDDQLLALL (PRAME_HUMAN)
IGDDQLLALM

SEQ ID NO: 150778 - protein, 9 aa, Artificial Sequence
  Description of Artificial Sequence: Synthetic peptide
  Seed: LVELAGQSL (PRAME_HUMAN)
LYELAGQSL

SEQ ID NO: 150779 - protein, 9 aa, Artificial Sequence
  Description of Artificial Sequence: Synthetic peptide
  Seed: HVMNPLETL (PRAME_HUMAN)
HMMNPLETI

SEQ ID NO: 150780 - protein, 10 aa, Artificial Sequence
  Description of Artificial Sequence: Synthetic peptide
  Seed: RELFPPLFMA (PRAME_HUMAN)
RILFPPLFMV

SEQ ID NO: 150781 - protein, 9 aa, Artificial Sequence
  Description of Artificial Sequence: Synthetic peptide
  Seed: SFYGNSISI (PRAME_HUMAN)
SNYGNSISM

SEQ ID NO: 150782 - protein, 9 aa, Artificial Sequence
  Description of Artificial Sequence: Synthetic peptide
  Seed: HVMNPLETL (PRAME_HUMAN)
HPMNPLETA

SEQ ID NO: 150783 - protein, 10 aa, Artificial Sequence
  Description of Artificial Sequence: Synthetic peptide
  Seed: HCSQLTTLSF (PRAME_HUMAN)
HFSQLTTLSF

SEQ ID NO: 150784 - protein, 10 aa, Artificial Sequence
  Description of Artificial Sequence: Synthetic peptide
  Seed: LLPRELFPPL (PRAME_HUMAN)
LDPRELFPPV

SEQ ID NO: 150785 - protein, 9 aa, Artificial Sequence
  Description of Artificial Sequence: Synthetic peptide
  Seed: QSRYISMSV (PRAME_HUMAN)
QVRYISMSL

SEQ ID NO: 150786 - protein, 9 aa, Artificial Sequence
  Description of Artificial Sequence: Synthetic peptide
  Seed: SFYGNSISI (PRAME_HUMAN)
SWYGNSISL

SEQ ID NO: 150787 - protein, 9 aa, Artificial Sequence
  Description of Artificial Sequence: Synthetic peptide
  Seed: KEEQYIAQF (PRAME_HUMAN)
KKEQYIAQF

SEQ ID NO: 150788 - protein, 10 aa, Artificial Sequence
  Description of Artificial Sequence: Synthetic peptide
  Seed: YEDIHGTLHL (PRAME_HUMAN)
YIDIHGTLHM

SEQ ID NO: 150789 - protein, 9 aa, Artificial Sequence
  Description of Artificial Sequence: Synthetic peptide
  Seed: ERLAYLHAR (PRAME_HUMAN)
ESLAYLHAK

SEQ ID NO: 150790 - protein, 10 aa, Artificial Sequence
  Description of Artificial Sequence: Synthetic peptide
  Seed: MERRRLWGSI (PRAME_HUMAN)
MQRRRLWGSF

SEQ ID NO: 150791 - protein, 9 aa, Artificial Sequence
  Description of Artificial Sequence: Synthetic peptide
  Seed: LSNLTHVLY (PRAME_HUMAN)
LINLTHVLW

SEQ ID NO: 150792 - protein, 11 aa, Artificial Sequence
  Description of Artificial Sequence: Synthetic peptide
  Seed: RRRLWGSIQSR (PRAME_HUMAN)
RRRLWGSIQSI

SEQ ID NO: 150793 - protein, 9 aa, Artificial Sequence
  Description of Artificial Sequence: Synthetic peptide
  Seed: RASATLQDL (PRAME_HUMAN)
RLSATLQDY

SEQ ID NO: 150794 - protein, 10 aa, Artificial Sequence
  Description of Artificial Sequence: Synthetic peptide
  Seed: IGLSNLTHVL (PRAME_HUMAN)
IYLSNLTHVM

SEQ ID NO: 150795 - protein, 10 aa, Artificial Sequence
  Description of Artificial Sequence: Synthetic peptide
  Seed: RHVMNPLETL (PRAME_HUMAN)
RPVMNPLETW

SEQ ID NO: 150796 - protein, 10 aa, Artificial Sequence
  Description of Artificial Sequence: Synthetic peptide
  Seed: PTLAKFSPYL (PRAME_HUMAN)
PSLAKFSPYI

SEQ ID NO: 150797 - protein, 10 aa, Artificial Sequence
  Description of Artificial Sequence: Synthetic peptide
  Seed: SALQSLLQHL (PRAME_HUMAN)
SRLQSLLQHV

SEQ ID NO: 150798 - protein, 10 aa, Artificial Sequence
  Description of Artificial Sequence: Synthetic peptide
  Seed: YIAQFTSQFL (PRAME_HUMAN)
YLAQFTSQFV

SEQ ID NO: 150799 - protein, 9 aa, Artificial Sequence
  Description of Artificial Sequence: Synthetic peptide
  Seed: LQALYVDSL (PRAME_HUMAN)
LMALYVDSY

SEQ ID NO: 150800 - protein, 10 aa, Artificial Sequence
  Description of Artificial Sequence: Synthetic peptide
  Seed: ETLSITNCRL (PRAME_HUMAN)
EFLSITNCRK

SEQ ID NO: 150801 - protein, 9 aa, Artificial Sequence
  Description of Artificial Sequence: Synthetic peptide
  Seed: SFPEPEAAQ (PRAME_HUMAN)
SAPEPEAAL

SEQ ID NO: 150802 - protein, 11 aa, Artificial Sequence
  Description of Artificial Sequence: Synthetic peptide
  Seed: LLAQEVRPRRW (PRAME_HUMAN)
LAAQEVRPRRW

SEQ ID NO: 150803 - protein, 10 aa, Artificial Sequence
  Description of Artificial Sequence: Synthetic peptide
  Seed: LYVDSLFFLR (PRAME_HUMAN)
LSVDSLFFLK

SEQ ID NO: 150804 - protein, 9 aa, Artificial Sequence
  Description of Artificial Sequence: Synthetic peptide
  Seed: FLSLQCLQA (PRAME_HUMAN)
FLSLQCLQV

SEQ ID NO: 150805 - protein, 9 aa, Artificial Sequence
  Description of Artificial Sequence: Synthetic peptide
  Seed: VFDECGITD (PRAME_HUMAN)
VFDECGITT

SEQ ID NO: 150806 - protein, 10 aa, Artificial Sequence
  Description of Artificial Sequence: Synthetic peptide
  Seed: ETLSITNCRL (PRAME_HUMAN)
EVLSITNCRF

SEQ ID NO: 150807 - protein, 9 aa, Artificial Sequence
  Description of Artificial Sequence: Synthetic peptide
  Seed: SVLSLSGVM (PRAME_HUMAN)
SVLSLSGVF

SEQ ID NO: 150808 - protein, 9 aa, Artificial Sequence
  Description of Artificial Sequence: Synthetic peptide
  Seed: VLYPVPLES (PRAME_HUMAN)
VVYPVPLEI

SEQ ID NO: 150809 - protein, 9 aa, Artificial Sequence
  Description of Artificial Sequence: Synthetic peptide
  Seed: ALQSLLQHL (PRAME_HUMAN)
AYQSLLQHY

SEQ ID NO: 150810 - protein, 10 aa, Artificial Sequence
  Description of Artificial Sequence: Synthetic peptide
  Seed: LQHLIGLSNL (PRAME_HUMAN)
LQHLIGLSNM

SEQ ID NO: 150811 - protein, 9 aa, Artificial Sequence
  Description of Artificial Sequence: Synthetic peptide
  Seed: SLLKDEALA (PRAME_HUMAN)
SMLKDEALL

SEQ ID NO: 150812 - protein, 10 aa, Artificial Sequence
  Description of Artificial Sequence: Synthetic peptide
  Seed: HCSQLTTLSF (PRAME_HUMAN)
HKSQLTTLSW

SEQ ID NO: 150813 - protein, 10 aa, Artificial Sequence
  Description of Artificial Sequence: Synthetic peptide
  Seed: LLLSHIHASS (PRAME_HUMAN)
LHLSHIHASI

SEQ ID NO: 150814 - protein, 9 aa, Artificial Sequence
  Description of Artificial Sequence: Synthetic peptide
  Seed: KAMVQAWPF (PRAME_HUMAN)
KSMVQAWPF

SEQ ID NO: 150815 - protein, 10 aa, Artificial Sequence
  Description of Artificial Sequence: Synthetic peptide
  Seed: HCSQLTTLSF (PRAME_HUMAN)
HRSQLTTLSF

SEQ ID NO: 150816 - protein, 9 aa, Artificial Sequence
  Description of Artificial Sequence: Synthetic peptide
  Seed: YIAQFTSQF (PRAME_HUMAN)
YQAQFTSQH

SEQ ID NO: 150817 - protein, 9 aa, Artificial Sequence
  Description of Artificial Sequence: Synthetic peptide
  Seed: FSPYLGQMI (PRAME_HUMAN)
FSPYLGQMW

SEQ ID NO: 150818 - protein, 9 aa, Artificial Sequence
  Description of Artificial Sequence: Synthetic peptide
  Seed: GACDELFSY (PRAME_HUMAN)
GSCDELFSF

SEQ ID NO: 150819 - protein, 10 aa, Artificial Sequence
  Description of Artificial Sequence: Synthetic peptide
  Seed: RLDQLLRHVM (PRAME_HUMAN)
RQDQLLRHVY

SEQ ID NO: 150820 - protein, 9 aa, Artificial Sequence
  Description of Artificial Sequence: Synthetic peptide
  Seed: AEQPFIPVE (PRAME_HUMAN)
AEQPFIPVI

SEQ ID NO: 150821 - protein, 9 aa, Artificial Sequence
  Description of Artificial Sequence: Synthetic peptide
  Seed: LQDLVFDEC (PRAME_HUMAN)
LGDLVFDEF

SEQ ID NO: 150822 - protein, 9 aa, Artificial Sequence
  Description of Artificial Sequence: Synthetic peptide
  Seed: LFPPLFMAA (PRAME_HUMAN)
LMPPLFMAY

SEQ ID NO: 150823 - protein, 9 aa, Artificial Sequence
  Description of Artificial Sequence: Synthetic peptide
  Seed: YIAQFTSQF (PRAME_HUMAN)
YLAQFTSQS

SEQ ID NO: 150824 - protein, 11 aa, Artificial Sequence
  Description of Artificial Sequence: Synthetic peptide
  Seed: ISALQSLLQHL (PRAME_HUMAN)
ISALQSLLQHW

SEQ ID NO: 150825 - protein, 11 aa, Artificial Sequence
  Description of Artificial Sequence: Synthetic peptide
  Seed: AAFDGRHSQTL (PRAME_HUMAN)
ARFDGRHSQTI

SEQ ID NO: 150826 - protein, 10 aa, Artificial Sequence
  Description of Artificial Sequence: Synthetic peptide
  Seed: FIPVEVLVDL (PRAME_HUMAN)
FHPVEVLVDF

SEQ ID NO: 150827 - protein, 9 aa, Artificial Sequence
  Description of Artificial Sequence: Synthetic peptide
  Seed: RTFYDPEPI (PRAME_HUMAN)
RMFYDPEPK

SEQ ID NO: 150828 - protein, 9 aa, Artificial Sequence
  Description of Artificial Sequence: Synthetic peptide
  Seed: RPRRWKLQV (PRAME_HUMAN)
RPRRWKLQC

SEQ ID NO: 150829 - protein, 9 aa, Artificial Sequence
  Description of Artificial Sequence: Synthetic peptide
  Seed: FYDPEPILC (PRAME_HUMAN)
FADPEPILI

SEQ ID NO: 150830 - protein, 10 aa, Artificial Sequence
  Description of Artificial Sequence: Synthetic peptide
  Seed: LQALYVDSLF (PRAME_HUMAN)
LKALYVDSLF

SEQ ID NO: 150831 - protein, 9 aa, Artificial Sequence
  Description of Artificial Sequence: Synthetic peptide
  Seed: LSNLTHVLY (PRAME_HUMAN)
LANLTHVLY

SEQ ID NO: 150832 - protein, 9 aa, Artificial Sequence
  Description of Artificial Sequence: Synthetic peptide
  Seed: RHSQTLKAM (PRAME_HUMAN)
RQSQTLKAM

SEQ ID NO: 150833 - protein, 9 aa, Artificial Sequence
  Description of Artificial Sequence: Synthetic peptide
  Seed: RLAYLHARL (PRAME_HUMAN)
RQAYLHARI

SEQ ID NO: 150834 - protein, 10 aa, Artificial Sequence
  Description of Artificial Sequence: Synthetic peptide
  Seed: SGNRASLYSF (PRAME_HUMAN)
STNRASLYSW

SEQ ID NO: 150835 - protein, 10 aa, Artificial Sequence
  Description of Artificial Sequence: Synthetic peptide
  Seed: ALYVDSLFFL (PRAME_HUMAN)
AFYVDSLFFW

SEQ ID NO: 150836 - protein, 10 aa, Artificial Sequence
  Description of Artificial Sequence: Synthetic peptide
  Seed: RYISMSVWTS (PRAME_HUMAN)
RHISMSVWTF

SEQ ID NO: 150837 - protein, 9 aa, Artificial Sequence
  Description of Artificial Sequence: Synthetic peptide
  Seed: RLLLSHIHA (PRAME_HUMAN)
RSLLSHIHV

SEQ ID NO: 150838 - protein, 10 aa, Artificial Sequence
  Description of Artificial Sequence: Synthetic peptide
  Seed: IQSRYISMSV (PRAME_HUMAN)
ISSRYISMSY

SEQ ID NO: 150839 - protein, 9 aa, Artificial Sequence
  Description of Artificial Sequence: Synthetic peptide
  Seed: RHSQTLKAM (PRAME_HUMAN)
RYSQTLKAL

SEQ ID NO: 150840 - protein, 10 aa, Artificial Sequence
  Description of Artificial Sequence: Synthetic peptide
  Seed: VRPRRWKLQV (PRAME_HUMAN)
VHPRRWKLQL

SEQ ID NO: 150841 - protein, 9 aa, Artificial Sequence
  Description of Artificial Sequence: Synthetic peptide
  Seed: TDDQLLALL (PRAME_HUMAN)
TWDQLLALV

SEQ ID NO: 150842 - protein, 9 aa, Artificial Sequence
  Description of Artificial Sequence: Synthetic peptide
  Seed: WPFTCLPLG (PRAME_HUMAN)
WPFTCLPLT

SEQ ID NO: 150843 - protein, 9 aa, Artificial Sequence
  Description of Artificial Sequence: Synthetic peptide
  Seed: KAMVQAWPF (PRAME_HUMAN)
KSMVQAWPI

SEQ ID NO: 150844 - protein, 9 aa, Artificial Sequence
  Description of Artificial Sequence: Synthetic peptide
  Seed: YIAQFTSQF (PRAME_HUMAN)
YMAQFTSQM

SEQ ID NO: 150845 - protein, 9 aa, Artificial Sequence
  Description of Artificial Sequence: Synthetic peptide
  Seed: YLHARLREL (PRAME_HUMAN)
YMHARLREI

SEQ ID NO: 150846 - protein, 9 aa, Artificial Sequence
  Description of Artificial Sequence: Synthetic peptide
  Seed: MHLSQSPSV (PRAME_HUMAN)
MGLSQSPSY

SEQ ID NO: 150847 - protein, 9 aa, Artificial Sequence
  Description of Artificial Sequence: Synthetic peptide
  Seed: SHIHASSYI (PRAME_HUMAN)
SWIHASSYY

SEQ ID NO: 150848 - protein, 9 aa, Artificial Sequence
  Description of Artificial Sequence: Synthetic peptide
  Seed: SQSPSVSQL (PRAME_HUMAN)
SFSPSVSQI

SEQ ID NO: 150849 - protein, 10 aa, Artificial Sequence
  Description of Artificial Sequence: Synthetic peptide
  Seed: SISISALQSL (PRAME_HUMAN)
SCSISALQSF

SEQ ID NO: 150850 - protein, 10 aa, Artificial Sequence
  Description of Artificial Sequence: Synthetic peptide
  Seed: IGLSNLTHVL (PRAME_HUMAN)
ILLSNLTHVC

SEQ ID NO: 150851 - protein, 9 aa, Artificial Sequence
  Description of Artificial Sequence: Synthetic peptide
  Seed: FTCLPLGVL (PRAME_HUMAN)
FTCLPLGVY

SEQ ID NO: 150852 - protein, 10 aa, Artificial Sequence
  Description of Artificial Sequence: Synthetic peptide
  Seed: RHVMNPLETL (PRAME_HUMAN)
RGVMNPLETV

SEQ ID NO: 150853 - protein, 10 aa, Artificial Sequence
  Description of Artificial Sequence: Synthetic peptide
  Seed: VLYPVPLESY (PRAME_HUMAN)
VVYPVPLESF

SEQ ID NO: 150854 - protein, 9 aa, Artificial Sequence
  Description of Artificial Sequence: Synthetic peptide
  Seed: LYVDSLFFL (PRAME_HUMAN)
LSVDSLFFV

SEQ ID NO: 150855 - protein, 10 aa, Artificial Sequence
  Description of Artificial Sequence: Synthetic peptide
  Seed: ITDDQLLALL (PRAME_HUMAN)
IGDDQLLALL

SEQ ID NO: 150856 - protein, 9 aa, Artificial Sequence
  Description of Artificial Sequence: Synthetic peptide
  Seed: TFYDPEPIL (PRAME_HUMAN)
TAYDPEPIL

SEQ ID NO: 150857 - protein, 10 aa, Artificial Sequence
  Description of Artificial Sequence: Synthetic peptide
  Seed: LSFYGNSISI (PRAME_HUMAN)
LNFYGNSISL

SEQ ID NO: 150858 - protein, 10 aa, Artificial Sequence
  Description of Artificial Sequence: Synthetic peptide
  Seed: AQFTSQFLSL (PRAME_HUMAN)
AQFTSQFLSY

SEQ ID NO: 150859 - protein, 11 aa, Artificial Sequence
  Description of Artificial Sequence: Synthetic peptide
  Seed: RRLWGSIQSRY (PRAME_HUMAN)
RRLWGSIQSRK

SEQ ID NO: 150860 - protein, 10 aa, Artificial Sequence
  Description of Artificial Sequence: Synthetic peptide
  Seed: YEDIHGTLHL (PRAME_HUMAN)
YLDIHGTLHI

SEQ ID NO: 150861 - protein, 8 aa, Artificial Sequence
  Description of Artificial Sequence: Synthetic peptide
  Seed: AMVQAWPF (PRAME_HUMAN)
AQVQAWPM

SEQ ID NO: 150862 - protein, 10 aa, Artificial Sequence
  Description of Artificial Sequence: Synthetic peptide
  Seed: SPYLGQMINL (PRAME_HUMAN)
SWYLGQMINI

SEQ ID NO: 150863 - protein, 9 aa, Artificial Sequence
  Description of Artificial Sequence: Synthetic peptide
  Seed: NSHQDFWTV (PRAME_HUMAN)
NQHQDFWTI

SEQ ID NO: 150864 - protein, 10 aa, Artificial Sequence
  Description of Artificial Sequence: Synthetic peptide
  Seed: ISMSVWTSPR (PRAME_HUMAN)
IVMSVWTSPK

SEQ ID NO: 150865 - protein, 10 aa, Artificial Sequence
  Description of Artificial Sequence: Synthetic peptide
  Seed: HASSYISPEK (PRAME_HUMAN)
HLSSYISPER

SEQ ID NO: 150866 - protein, 9 aa, Artificial Sequence
  Description of Artificial Sequence: Synthetic peptide
  Seed: SQSPSVSQL (PRAME_HUMAN)
SLSPSVSQM

SEQ ID NO: 150867 - protein, 9 aa, Artificial Sequence
  Description of Artificial Sequence: Synthetic peptide
  Seed: KLQVLDLRK (PRAME_HUMAN)
KTQVLDLRK

SEQ ID NO: 150868 - protein, 9 aa, Artificial Sequence
  Description of Artificial Sequence: Synthetic peptide
  Seed: VSPEPLQAL (PRAME_HUMAN)
VQPEPLQAY

SEQ ID NO: 150869 - protein, 9 aa, Artificial Sequence
  Description of Artificial Sequence: Synthetic peptide
  Seed: SVWTSPRRL (PRAME_HUMAN)
SAWTSPRRM

SEQ ID NO: 150870 - protein, 9 aa, Artificial Sequence
  Description of Artificial Sequence: Synthetic peptide
  Seed: YPVPLESYE (PRAME_HUMAN)
YPVPLESYM

SEQ ID NO: 150871 - protein, 10 aa, Artificial Sequence
  Description of Artificial Sequence: Synthetic peptide
  Seed: AIAALELLPR (PRAME_HUMAN)
AMAALELLPK

SEQ ID NO: 150872 - protein, 9 aa, Artificial Sequence
  Description of Artificial Sequence: Synthetic peptide
  Seed: AAFDGRHSQ (PRAME_HUMAN)
AQFDGRHSY

SEQ ID NO: 150873 - protein, 9 aa, Artificial Sequence
  Description of Artificial Sequence: Synthetic peptide
  Seed: TCLPLGVLM (PRAME_HUMAN)
TALPLGVLV

SEQ ID NO: 150874 - protein, 9 aa, Artificial Sequence
  Description of Artificial Sequence: Synthetic peptide
  Seed: QLLALLPSL (PRAME_HUMAN)
QLLALLPSF

SEQ ID NO: 150875 - protein, 9 aa, Artificial Sequence
  Description of Artificial Sequence: Synthetic peptide
  Seed: SLFFLRGRL (PRAME_HUMAN)
SMFFLRGRW

SEQ ID NO: 150876 - protein, 9 aa, Artificial Sequence
  Description of Artificial Sequence: Synthetic peptide
  Seed: SHIHASSYI (PRAME_HUMAN)
SNIHASSYY

SEQ ID NO: 150877 - protein, 10 aa, Artificial Sequence
  Description of Artificial Sequence: Synthetic peptide
  Seed: FIPVEVLVDL (PRAME_HUMAN)
FDPVEVLVDW

SEQ ID NO: 150878 - protein, 10 aa, Artificial Sequence
  Description of Artificial Sequence: Synthetic peptide
  Seed: DRTFYDPEPI (PRAME_HUMAN)
DPTFYDPEPV

SEQ ID NO: 150879 - protein, 9 aa, Artificial Sequence
  Description of Artificial Sequence: Synthetic peptide
  Seed: KLKIFAMPM (PRAME_HUMAN)
KAKIFAMPM

SEQ ID NO: 150880 - protein, 11 aa, Artificial Sequence
  Description of Artificial Sequence: Synthetic peptide
  Seed: AEQPFIPVEVL (PRAME_HUMAN)
AEQPFIPVEVW

SEQ ID NO: 150881 - protein, 9 aa, Artificial Sequence
  Description of Artificial Sequence: Synthetic peptide
  Seed: ITDDQLLAL (PRAME_HUMAN)
IYDDQLLAM

SEQ ID NO: 150882 - protein, 9 aa, Artificial Sequence
  Description of Artificial Sequence: Synthetic peptide
  Seed: AAFDGRHSQ (PRAME_HUMAN)
AVFDGRHSL

SEQ ID NO: 150883 - protein, 8 aa, Artificial Sequence
  Description of Artificial Sequence: Synthetic peptide
  Seed: TDDQLLAL (PRAME_HUMAN)
TFDQLLAF

SEQ ID NO: 150884 - protein, 10 aa, Artificial Sequence
  Description of Artificial Sequence: Synthetic peptide
  Seed: MVQAWPFTCL (PRAME_HUMAN)
MVQAWPFTCY

SEQ ID NO: 150885 - protein, 9 aa, Artificial Sequence
  Description of Artificial Sequence: Synthetic peptide
  Seed: IAQFTSQFL (PRAME_HUMAN)
IAQFTSQFW

SEQ ID NO: 150886 - protein, 10 aa, Artificial Sequence
  Description of Artificial Sequence: Synthetic peptide
  Seed: RLWGSIQSRY (PRAME_HUMAN)
RAWGSIQSRF

SEQ ID NO: 150887 - protein, 10 aa, Artificial Sequence
  Description of Artificial Sequence: Synthetic peptide
  Seed: ETFKAVLDGL (PRAME_HUMAN)
EVFKAVLDGI

SEQ ID NO: 150888 - protein, 9 aa, Artificial Sequence
  Description of Artificial Sequence: Synthetic peptide
  Seed: KAMVQAWPF (PRAME_HUMAN)
KPMVQAWPL

SEQ ID NO: 150889 - protein, 10 aa, Artificial Sequence
  Description of Artificial Sequence: Synthetic peptide
  Seed: LLPRELFPPL (PRAME_HUMAN)
LGPRELFPPI

SEQ ID NO: 150890 - protein, 11 aa, Artificial Sequence
  Description of Artificial Sequence: Synthetic peptide
  Seed: LTDVSPEPLQA (PRAME_HUMAN)
LTDVSPEPLQM

SEQ ID NO: 150891 - protein, 11 aa, Artificial Sequence
  Description of Artificial Sequence: Synthetic peptide
  Seed: FKAVLDGLDVL (PRAME_HUMAN)
FAAVLDGLDVV

SEQ ID NO: 150892 - protein, 9 aa, Artificial Sequence
  Description of Artificial Sequence: Synthetic peptide
  Seed: SQSPSVSQL (PRAME_HUMAN)
SQSPSVSQI

SEQ ID NO: 150893 - protein, 10 aa, Artificial Sequence
  Description of Artificial Sequence: Synthetic peptide
  Seed: KDEALAIAAL (PRAME_HUMAN)
KEEALAIAAA

SEQ ID NO: 150894 - protein, 9 aa, Artificial Sequence
  Description of Artificial Sequence: Synthetic peptide
  Seed: KMILKMVQL (PRAME_HUMAN)
KTILKMVQL

SEQ ID NO: 150895 - protein, 9 aa, Artificial Sequence
  Description of Artificial Sequence: Synthetic peptide
  Seed: RLWGSIQSR (PRAME_HUMAN)
RIWGSIQSI

SEQ ID NO: 150896 - protein, 10 aa, Artificial Sequence
  Description of Artificial Sequence: Synthetic peptide
  Seed: ALAIAALELL (PRAME_HUMAN)
AMAIAALELV

SEQ ID NO: 150897 - protein, 11 aa, Artificial Sequence
  Description of Artificial Sequence: Synthetic peptide
  Seed: RLWGSIQSRYI (PRAME_HUMAN)
RTWGSIQSRYF

SEQ ID NO: 150898 - protein, 8 aa, Artificial Sequence
  Description of Artificial Sequence: Synthetic peptide
  Seed: LTHVLYPV (PRAME_HUMAN)
LIHVLYPV

SEQ ID NO: 150899 - protein, 9 aa, Artificial Sequence
  Description of Artificial Sequence: Synthetic peptide
  Seed: EAAQPMTKK (PRAME_HUMAN)
EIAQPMTKL

SEQ ID NO: 150900 - protein, 10 aa, Artificial Sequence
  Description of Artificial Sequence: Synthetic peptide
  Seed: ALYVDSLFFL (PRAME_HUMAN)
APYVDSLFFW

SEQ ID NO: 150901 - protein, 9 aa, Artificial Sequence
  Description of Artificial Sequence: Synthetic peptide
  Seed: MQDIKMILK (PRAME_HUMAN)
MADIKMILK

SEQ ID NO: 150902 - protein, 10 aa, Artificial Sequence
  Description of Artificial Sequence: Synthetic peptide
  Seed: FIPVEVLVDL (PRAME_HUMAN)
FAPVEVLVDF

SEQ ID NO: 150903 - protein, 10 aa, Artificial Sequence
  Description of Artificial Sequence: Synthetic peptide
  Seed: SNLTHVLYPV (PRAME_HUMAN)
SWLTHVLYPV

SEQ ID NO: 150904 - protein, 9 aa, Artificial Sequence
  Description of Artificial Sequence: Synthetic peptide
  Seed: RLRELLCEL (PRAME_HUMAN)
RRRELLCEL

SEQ ID NO: 150905 - protein, 10 aa, Artificial Sequence
  Description of Artificial Sequence: Synthetic peptide
  Seed: SNLTHVLYPV (PRAME_HUMAN)
SQLTHVLYPA

SEQ ID NO: 150906 - protein, 9 aa, Artificial Sequence
  Description of Artificial Sequence: Synthetic peptide
  Seed: LGRPSMVWL (PRAME_HUMAN)
LTRPSMVWI

SEQ ID NO: 150907 - protein, 10 aa, Artificial Sequence
  Description of Artificial Sequence: Synthetic peptide
  Seed: RGRLDQLLRH (PRAME_HUMAN)
RFRLDQLLRF

SEQ ID NO: 150908 - protein, 9 aa, Artificial Sequence
  Description of Artificial Sequence: Synthetic peptide
  Seed: SIQSRYISM (PRAME_HUMAN)
STQSRYISV

SEQ ID NO: 150909 - protein, 9 aa, Artificial Sequence
  Description of Artificial Sequence: Synthetic peptide
  Seed: CKKLKIFAM (PRAME_HUMAN)
CAKLKIFAF

SEQ ID NO: 150910 - protein, 10 aa, Artificial Sequence
  Description of Artificial Sequence: Synthetic peptide
  Seed: ARLRELLCEL (PRAME_HUMAN)
AMLRELLCEL

SEQ ID NO: 150911 - protein, 9 aa, Artificial Sequence
  Description of Artificial Sequence: Synthetic peptide
  Seed: KAMVQAWPF (PRAME_HUMAN)
KRMVQAWPF

SEQ ID NO: 150912 - protein, 9 aa, Artificial Sequence
  Description of Artificial Sequence: Synthetic peptide
  Seed: LLLSHIHAS (PRAME_HUMAN)
LLLSHIHAM

SEQ ID NO: 150913 - protein, 9 aa, Artificial Sequence
  Description of Artificial Sequence: Synthetic peptide
  Seed: LQDLVFDEC (PRAME_HUMAN)
LYDLVFDEL

SEQ ID NO: 150914 - protein, 10 aa, Artificial Sequence
  Description of Artificial Sequence: Synthetic peptide
  Seed: KFSPYLGQMI (PRAME_HUMAN)
KWSPYLGQMW

SEQ ID NO: 150915 - protein, 10 aa, Artificial Sequence
  Description of Artificial Sequence: Synthetic peptide
  Seed: MERRRLWGSI (PRAME_HUMAN)
MVRRRLWGSI

SEQ ID NO: 150916 - protein, 9 aa, Artificial Sequence
  Description of Artificial Sequence: Synthetic peptide
  Seed: KAMVQAWPF (PRAME_HUMAN)
KEMVQAWPM

SEQ ID NO: 150917 - protein, 9 aa, Artificial Sequence
  Description of Artificial Sequence: Synthetic peptide
  Seed: KEEQYIAQF (PRAME_HUMAN)
KKEQYIAQY

SEQ ID NO: 150918 - protein, 9 aa, Artificial Sequence
  Description of Artificial Sequence: Synthetic peptide
  Seed: VSPEPLQAL (PRAME_HUMAN)
VNPEPLQAL

SEQ ID NO: 150919 - protein, 8 aa, Artificial Sequence
  Description of Artificial Sequence: Synthetic peptide
  Seed: RLAYLHAR (PRAME_HUMAN)
RTAYLHAR

SEQ ID NO: 150920 - protein, 10 aa, Artificial Sequence
  Description of Artificial Sequence: Synthetic peptide
  Seed: RYISMSVWTS (PRAME_HUMAN)
RFISMSVWTI

SEQ ID NO: 150921 - protein, 9 aa, Artificial Sequence
  Description of Artificial Sequence: Synthetic peptide
  Seed: TSPRRLVEL (PRAME_HUMAN)
TLPRRLVEI

SEQ ID NO: 150922 - protein, 10 aa, Artificial Sequence
  Description of Artificial Sequence: Synthetic peptide
  Seed: VSPEPLQALL (PRAME_HUMAN)
VIPEPLQALL

SEQ ID NO: 150923 - protein, 9 aa, Artificial Sequence
  Description of Artificial Sequence: Synthetic peptide
  Seed: SISALQSLL (PRAME_HUMAN)
SVSALQSLI

SEQ ID NO: 150924 - protein, 10 aa, Artificial Sequence
  Description of Artificial Sequence: Synthetic peptide
  Seed: SVLSLSGVML (PRAME_HUMAN)
SMLSLSGVMV

SEQ ID NO: 150925 - protein, 9 aa, Artificial Sequence
  Description of Artificial Sequence: Synthetic peptide
  Seed: ERLAYLHAR (PRAME_HUMAN)
EFLAYLHAR

SEQ ID NO: 150926 - protein, 11 aa, Artificial Sequence
  Description of Artificial Sequence: Synthetic peptide
  Seed: VQAWPFTCLPL (PRAME_HUMAN)
VMAWPFTCLPF

SEQ ID NO: 150927 - protein, 10 aa, Artificial Sequence
  Description of Artificial Sequence: Synthetic peptide
  Seed: KEEQYIAQFT (PRAME_HUMAN)
KEEQYIAQFM

SEQ ID NO: 150928 - protein, 11 aa, Artificial Sequence
  Description of Artificial Sequence: Synthetic peptide
  Seed: GTLHLERLAYL (PRAME_HUMAN)
GMLHLERLAYL

SEQ ID NO: 150929 - protein, 11 aa, Artificial Sequence
  Description of Artificial Sequence: Synthetic peptide
  Seed: AVLDGLDVLLA (PRAME_HUMAN)
ALLDGLDVLLM

SEQ ID NO: 150930 - protein, 9 aa, Artificial Sequence
  Description of Artificial Sequence: Synthetic peptide
  Seed: KVDGLSTEA (PRAME_HUMAN)
KTDGLSTEI

SEQ ID NO: 150931 - protein, 10 aa, Artificial Sequence
  Description of Artificial Sequence: Synthetic peptide
  Seed: AQFTSQFLSL (PRAME_HUMAN)
ARFTSQFLSV

SEQ ID NO: 150932 - protein, 10 aa, Artificial Sequence
  Description of Artificial Sequence: Synthetic peptide
  Seed: RRRLWGSIQS (PRAME_HUMAN)
RSRLWGSIQR

SEQ ID NO: 150933 - protein, 9 aa, Artificial Sequence
  Description of Artificial Sequence: Synthetic peptide
  Seed: LGQMINLRR (PRAME_HUMAN)
LYQMINLRR

SEQ ID NO: 150934 - protein, 10 aa, Artificial Sequence
  Description of Artificial Sequence: Synthetic peptide
  Seed: SALQSLLQHL (PRAME_HUMAN)
SMLQSLLQHI

SEQ ID NO: 150935 - protein, 9 aa, Artificial Sequence
  Description of Artificial Sequence: Synthetic peptide
  Seed: LQDLVFDEC (PRAME_HUMAN)
LGDLVFDEI

SEQ ID NO: 150936 - protein, 9 aa, Artificial Sequence
  Description of Artificial Sequence: Synthetic peptide
  Seed: RLDQLLRHV (PRAME_HUMAN)
RVDQLLRHM

SEQ ID NO: 150937 - protein, 10 aa, Artificial Sequence
  Description of Artificial Sequence: Synthetic peptide
  Seed: PTLAKFSPYL (PRAME_HUMAN)
PILAKFSPYI

SEQ ID NO: 150938 - protein, 9 aa, Artificial Sequence
  Description of Artificial Sequence: Synthetic peptide
  Seed: LLKDEALAI (PRAME_HUMAN)
LIKDEALAF

SEQ ID NO: 150939 - protein, 10 aa, Artificial Sequence
  Description of Artificial Sequence: Synthetic peptide
  Seed: MPMQDIKMIL (PRAME_HUMAN)
MLMQDIKMIV

SEQ ID NO: 150940 - protein, 9 aa, Artificial Sequence
  Description of Artificial Sequence: Synthetic peptide
  Seed: SLSHCSQLT (PRAME_HUMAN)
SMSHCSQLL

SEQ ID NO: 150941 - protein, 9 aa, Artificial Sequence
  Description of Artificial Sequence: Synthetic peptide
  Seed: MHLSQSPSV (PRAME_HUMAN)
MHLSQSPSY

SEQ ID NO: 150942 - protein, 10 aa, Artificial Sequence
  Description of Artificial Sequence: Synthetic peptide
  Seed: SLSGVMLTDV (PRAME_HUMAN)
SMSGVMLTDA

SEQ ID NO: 150943 - protein, 9 aa, Artificial Sequence
  Description of Artificial Sequence: Synthetic peptide
  Seed: KAMVQAWPF (PRAME_HUMAN)
KVMVQAWPL

SEQ ID NO: 150944 - protein, 9 aa, Artificial Sequence
  Description of Artificial Sequence: Synthetic peptide
  Seed: SMSVWTSPR (PRAME_HUMAN)
SYSVWTSPR

SEQ ID NO: 150945 - protein, 9 aa, Artificial Sequence
  Description of Artificial Sequence: Synthetic peptide
  Seed: SPEPLQALL (PRAME_HUMAN)
SSEPLQALL

SEQ ID NO: 150946 - protein, 10 aa, Artificial Sequence
  Description of Artificial Sequence: Synthetic peptide
  Seed: FTCLPLGVLM (PRAME_HUMAN)
FTCLPLGVLW

SEQ ID NO: 150947 - protein, 9 aa, Artificial Sequence
  Description of Artificial Sequence: Synthetic peptide
  Seed: AWPFTCLPL (PRAME_HUMAN)
AWPFTCLPM

SEQ ID NO: 150948 - protein, 9 aa, Artificial Sequence
  Description of Artificial Sequence: Synthetic peptide
  Seed: KMILKMVQL (PRAME_HUMAN)
KMILKMVQY

SEQ ID NO: 150949 - protein, 11 aa, Artificial Sequence
  Description of Artificial Sequence: Synthetic peptide
  Seed: LTDVSPEPLQA (PRAME_HUMAN)
LADVSPEPLQV

SEQ ID NO: 150950 - protein, 11 aa, Artificial Sequence
  Description of Artificial Sequence: Synthetic peptide
  Seed: KAVLDGLDVLL (PRAME_HUMAN)
KFVLDGLDVLV

SEQ ID NO: 150951 - protein, 11 aa, Artificial Sequence
  Description of Artificial Sequence: Synthetic peptide
  Seed: VQLDSIEDLEV (PRAME_HUMAN)
VQLDSIEDLEI

SEQ ID NO: 150952 - protein, 9 aa, Artificial Sequence
  Description of Artificial Sequence: Synthetic peptide
  Seed: KAMVQAWPF (PRAME_HUMAN)
KIMVQAWPF

SEQ ID NO: 150953 - protein, 9 aa, Artificial Sequence
  Description of Artificial Sequence: Synthetic peptide
  Seed: RLDQLLRHV (PRAME_HUMAN)
RIDQLLRHF

SEQ ID NO: 150954 - protein, 9 aa, Artificial Sequence
  Description of Artificial Sequence: Synthetic peptide
  Seed: ALLERASAT (PRAME_HUMAN)
AQLERASAL

SEQ ID NO: 150955 - protein, 9 aa, Artificial Sequence
  Description of Artificial Sequence: Synthetic peptide
  Seed: GLSNLTHVL (PRAME_HUMAN)
GQSNLTHVY

SEQ ID NO: 150956 - protein, 8 aa, Artificial Sequence
  Description of Artificial Sequence: Synthetic peptide
  Seed: YVDSLFFL (PRAME_HUMAN)
YMDSLFFL

SEQ ID NO: 150957 - protein, 10 aa, Artificial Sequence
  Description of Artificial Sequence: Synthetic peptide
  Seed: RELFPPLFMA (PRAME_HUMAN)
RQLFPPLFMI

SEQ ID NO: 150958 - protein, 10 aa, Artificial Sequence
  Description of Artificial Sequence: Synthetic peptide
  Seed: SNLTHVLYPV (PRAME_HUMAN)
SGLTHVLYPV

SEQ ID NO: 150959 - protein, 10 aa, Artificial Sequence
  Description of Artificial Sequence: Synthetic peptide
  Seed: LLPRELFPPL (PRAME_HUMAN)
LLPRELFPPA

SEQ ID NO: 150960 - protein, 9 aa, Artificial Sequence
  Description of Artificial Sequence: Synthetic peptide
  Seed: IGLSNLTHV (PRAME_HUMAN)
IILSNLTHL

SEQ ID NO: 150961 - protein, 10 aa, Artificial Sequence
  Description of Artificial Sequence: Synthetic peptide
  Seed: MVQAWPFTCL (PRAME_HUMAN)
MYQAWPFTCY

SEQ ID NO: 150962 - protein, 9 aa, Artificial Sequence
  Description of Artificial Sequence: Synthetic peptide
  Seed: LQSLLQHLI (PRAME_HUMAN)
LESLLQHLF

SEQ ID NO: 150963 - protein, 9 aa, Artificial Sequence
  Description of Artificial Sequence: Synthetic peptide
  Seed: YISMSVWTS (PRAME_HUMAN)
YISMSVWTL

SEQ ID NO: 150964 - protein, 9 aa, Artificial Sequence
  Description of Artificial Sequence: Synthetic peptide
  Seed: ALQSLLQHL (PRAME_HUMAN)
AAQSLLQHF

SEQ ID NO: 150965 - protein, 9 aa, Artificial Sequence
  Description of Artificial Sequence: Synthetic peptide
  Seed: ALYVDSLFF (PRAME_HUMAN)
AMYVDSLFL

SEQ ID NO: 150966 - protein, 10 aa, Artificial Sequence
  Description of Artificial Sequence: Synthetic peptide
  Seed: TSQFLSLQCL (PRAME_HUMAN)
TGQFLSLQCF

SEQ ID NO: 150967 - protein, 9 aa, Artificial Sequence
  Description of Artificial Sequence: Synthetic peptide
  Seed: ALQSLLQHL (PRAME_HUMAN)
ALQSLLQHA

SEQ ID NO: 150968 - protein, 8 aa, Artificial Sequence
  Description of Artificial Sequence: Synthetic peptide
  Seed: FAMPMQDI (PRAME_HUMAN)
FAMPMQDM

SEQ ID NO: 150969 - protein, 9 aa, Artificial Sequence
  Description of Artificial Sequence: Synthetic peptide
  Seed: GLSNLTHVL (PRAME_HUMAN)
GMSNLTHVI

SEQ ID NO: 150970 - protein, 9 aa, Artificial Sequence
  Description of Artificial Sequence: Synthetic peptide
  Seed: RHSQTLKAM (PRAME_HUMAN)
RQSQTLKAY

SEQ ID NO: 150971 - protein, 9 aa, Artificial Sequence
  Description of Artificial Sequence: Synthetic peptide
  Seed: GRHSQTLKA (PRAME_HUMAN)
GRHSQTLKF

SEQ ID NO: 150972 - protein, 9 aa, Artificial Sequence
  Description of Artificial Sequence: Synthetic peptide
  Seed: LLKDEALAI (PRAME_HUMAN)
LSKDEALAL

SEQ ID NO: 150973 - protein, 9 aa, Artificial Sequence
  Description of Artificial Sequence: Synthetic peptide
  Seed: YEDIHGTLH (PRAME_HUMAN)
YEDIHGTLV

SEQ ID NO: 150974 - protein, 9 aa, Artificial Sequence
  Description of Artificial Sequence: Synthetic peptide
  Seed: RRLWGSIQS (PRAME_HUMAN)
RQLWGSIQI

SEQ ID NO: 150975 - protein, 9 aa, Artificial Sequence
  Description of Artificial Sequence: Synthetic peptide
  Seed: YIAQFTSQF (PRAME_HUMAN)
YCAQFTSQY

SEQ ID NO: 150976 - protein, 10 aa, Artificial Sequence
  Description of Artificial Sequence: Synthetic peptide
  Seed: QAWPFTCLPL (PRAME_HUMAN)
QAWPFTCLPW

SEQ ID NO: 150977 - protein, 10 aa, Artificial Sequence
  Description of Artificial Sequence: Synthetic peptide
  Seed: QSLLQHLIGL (PRAME_HUMAN)
QRLLQHLIGL

SEQ ID NO: 150978 - protein, 9 aa, Artificial Sequence
  Description of Artificial Sequence: Synthetic peptide
  Seed: ASSYISPEK (PRAME_HUMAN)
AASYISPER

SEQ ID NO: 150979 - protein, 9 aa, Artificial Sequence
  Description of Artificial Sequence: Synthetic peptide
  Seed: ISPEKEEQY (PRAME_HUMAN)
IYPEKEEQI

SEQ ID NO: 150980 - protein, 9 aa, Artificial Sequence
  Description of Artificial Sequence: Synthetic peptide
  Seed: SIEDLEVTC (PRAME_HUMAN)
SAEDLEVTV

SEQ ID NO: 150981 - protein, 9 aa, Artificial Sequence
  Description of Artificial Sequence: Synthetic peptide
  Seed: YIAQFTSQF (PRAME_HUMAN)
YQAQFTSQT

SEQ ID NO: 150982 - protein, 9 aa, Artificial Sequence
  Description of Artificial Sequence: Synthetic peptide
  Seed: RRWKLQVLD (PRAME_HUMAN)
RRWKLQVLN

SEQ ID NO: 150983 - protein, 9 aa, Artificial Sequence
  Description of Artificial Sequence: Synthetic peptide
  Seed: LALLPSLSH (PRAME_HUMAN)
LALLPSLSY

SEQ ID NO: 150984 - protein, 10 aa, Artificial Sequence
  Description of Artificial Sequence: Synthetic peptide
  Seed: MVQAWPFTCL (PRAME_HUMAN)
MYQAWPFTCV

SEQ ID NO: 150985 - protein, 10 aa, Artificial Sequence
  Description of Artificial Sequence: Synthetic peptide
  Seed: VMNPLETLSI (PRAME_HUMAN)
VLNPLETLSF

SEQ ID NO: 150986 - protein, 10 aa, Artificial Sequence
  Description of Artificial Sequence: Synthetic peptide
  Seed: LSVLSLSGVM (PRAME_HUMAN)
LMVLSLSGVF

SEQ ID NO: 150987 - protein, 10 aa, Artificial Sequence
  Description of Artificial Sequence: Synthetic peptide
  Seed: SPSVSQLSVL (PRAME_HUMAN)
SHSVSQLSVF

SEQ ID NO: 150988 - protein, 10 aa, Artificial Sequence
  Description of Artificial Sequence: Synthetic peptide
  Seed: AALELLPREL (PRAME_HUMAN)
AVLELLPREL

SEQ ID NO: 150989 - protein, 9 aa, Artificial Sequence
  Description of Artificial Sequence: Synthetic peptide
  Seed: IAQFTSQFL (PRAME_HUMAN)
ISQFTSQFM

SEQ ID NO: 150990 - protein, 10 aa, Artificial Sequence
  Description of Artificial Sequence: Synthetic peptide
  Seed: YEDIHGTLHL (PRAME_HUMAN)
YLDIHGTLHF

SEQ ID NO: 150991 - protein, 10 aa, Artificial Sequence
  Description of Artificial Sequence: Synthetic peptide
  Seed: AQFTSQFLSL (PRAME_HUMAN)
AVFTSQFLSL

SEQ ID NO: 150992 - protein, 9 aa, Artificial Sequence
  Description of Artificial Sequence: Synthetic peptide
  Seed: THVLYPVPL (PRAME_HUMAN)
TQVLYPVPV

SEQ ID NO: 150993 - protein, 9 aa, Artificial Sequence
  Description of Artificial Sequence: Synthetic peptide
  Seed: LSHIHASSY (PRAME_HUMAN)
LSHIHASSK

SEQ ID NO: 150994 - protein, 11 aa, Artificial Sequence
  Description of Artificial Sequence: Synthetic peptide
  Seed: DVSPEPLQALL (PRAME_HUMAN)
DTSPEPLQALR

SEQ ID NO: 150995 - protein, 11 aa, Artificial Sequence
  Description of Artificial Sequence: Synthetic peptide
  Seed: SLLKDEALAIA (PRAME_HUMAN)
SQLKDEALAIV

SEQ ID NO: 150996 - protein, 9 aa, Artificial Sequence
  Description of Artificial Sequence: Synthetic peptide
  Seed: MINLRRLLL (PRAME_HUMAN)
MMNLRRLLK

SEQ ID NO: 150997 - protein, 10 aa, Artificial Sequence
  Description of Artificial Sequence: Synthetic peptide
  Seed: LSTEAEQPFI (PRAME_HUMAN)
LSTEAEQPFF

SEQ ID NO: 150998 - protein, 9 aa, Artificial Sequence
  Description of Artificial Sequence: Synthetic peptide
  Seed: DEALAIAAL (PRAME_HUMAN)
DHALAIAAL

SEQ ID NO: 150999 - protein, 9 aa, Artificial Sequence
  Description of Artificial Sequence: Synthetic peptide
  Seed: RLRELLCEL (PRAME_HUMAN)
RHRELLCEY

SEQ ID NO: 151000 - protein, 9 aa, Artificial Sequence
  Description of Artificial Sequence: Synthetic peptide
  Seed: LGRPSMVWL (PRAME_HUMAN)
LTRPSMVWW

SEQ ID NO: 151001 - protein, 9 aa, Artificial Sequence
  Description of Artificial Sequence: Synthetic peptide
  Seed: TLAKFSPYL (PRAME_HUMAN)
TQAKFSPYF

SEQ ID NO: 151002 - protein, 9 aa, Artificial Sequence
  Description of Artificial Sequence: Synthetic peptide
  Seed: TLKAMVQAW (PRAME_HUMAN)
TIKAMVQAY

SEQ ID NO: 151003 - protein, 10 aa, Artificial Sequence
  Description of Artificial Sequence: Synthetic peptide
  Seed: KKLKIFAMPM (PRAME_HUMAN)
KYLKIFAMPA

SEQ ID NO: 151004 - protein, 10 aa, Artificial Sequence
  Description of Artificial Sequence: Synthetic peptide
  Seed: VLYPVPLESY (PRAME_HUMAN)
VIYPVPLESY

SEQ ID NO: 151005 - protein, 9 aa, Artificial Sequence
  Description of Artificial Sequence: Synthetic peptide
  Seed: VSPEPLQAL (PRAME_HUMAN)
VAPEPLQAH

SEQ ID NO: 151006 - protein, 9 aa, Artificial Sequence
  Description of Artificial Sequence: Synthetic peptide
  Seed: SFYGNSISI (PRAME_HUMAN)
SIYGNSISM

SEQ ID NO: 151007 - protein, 10 aa, Artificial Sequence
  Description of Artificial Sequence: Synthetic peptide
  Seed: ISISALQSLL (PRAME_HUMAN)
ITISALQSLW

SEQ ID NO: 151008 - protein, 9 aa, Artificial Sequence
  Description of Artificial Sequence: Synthetic peptide
  Seed: RGRLDQLLR (PRAME_HUMAN)
RSRLDQLLR

SEQ ID NO: 151009 - protein, 10 aa, Artificial Sequence
  Description of Artificial Sequence: Synthetic peptide
  Seed: SNLTHVLYPV (PRAME_HUMAN)
SKLTHVLYPA

SEQ ID NO: 151010 - protein, 10 aa, Artificial Sequence
  Description of Artificial Sequence: Synthetic peptide
  Seed: LETLSITNCR (PRAME_HUMAN)
LATLSITNCR

SEQ ID NO: 151011 - protein, 9 aa, Artificial Sequence
  Description of Artificial Sequence: Synthetic peptide
  Seed: ISISALQSL (PRAME_HUMAN)
IIISALQSA

SEQ ID NO: 151012 - protein, 10 aa, Artificial Sequence
  Description of Artificial Sequence: Synthetic peptide
  Seed: IGLSNLTHVL (PRAME_HUMAN)
IYLSNLTHVI

SEQ ID NO: 151013 - protein, 10 aa, Artificial Sequence
  Description of Artificial Sequence: Synthetic peptide
  Seed: SALQSLLQHL (PRAME_HUMAN)
SYLQSLLQHL

SEQ ID NO: 151014 - protein, 10 aa, Artificial Sequence
  Description of Artificial Sequence: Synthetic peptide
  Seed: MTKKRKVDGL (PRAME_HUMAN)
MLKKRKVDGL

SEQ ID NO: 151015 - protein, 9 aa, Artificial Sequence
  Description of Artificial Sequence: Synthetic peptide
  Seed: SHIHASSYI (PRAME_HUMAN)
SGIHASSYY

SEQ ID NO: 151016 - protein, 9 aa, Artificial Sequence
  Description of Artificial Sequence: Synthetic peptide
  Seed: IPVEVLVDL (PRAME_HUMAN)
IAVEVLVDW

SEQ ID NO: 151017 - protein, 9 aa, Artificial Sequence
  Description of Artificial Sequence: Synthetic peptide
  Seed: RLAYLHARL (PRAME_HUMAN)
RTAYLHARI

SEQ ID NO: 151018 - protein, 9 aa, Artificial Sequence
  Description of Artificial Sequence: Synthetic peptide
  Seed: SQLTTLSFY (PRAME_HUMAN)
SQLTTLSFL

SEQ ID NO: 151019 - protein, 10 aa, Artificial Sequence
  Description of Artificial Sequence: Synthetic peptide
  Seed: YSFPEPEAAQ (PRAME_HUMAN)
YCFPEPEAAL

SEQ ID NO: 151020 - protein, 9 aa, Artificial Sequence
  Description of Artificial Sequence: Synthetic peptide
  Seed: ELFSYLIEK (PRAME_HUMAN)
EGFSYLIER

SEQ ID NO: 151021 - protein, 9 aa, Artificial Sequence
  Description of Artificial Sequence: Synthetic peptide
  Seed: AQFTSQFLS (PRAME_HUMAN)
ALFTSQFLI

SEQ ID NO: 151022 - protein, 9 aa, Artificial Sequence
  Description of Artificial Sequence: Synthetic peptide
  Seed: VQLDSIEDL (PRAME_HUMAN)
VQLDSIEDW

SEQ ID NO: 151023 - protein, 10 aa, Artificial Sequence
  Description of Artificial Sequence: Synthetic peptide
  Seed: RGRLDQLLRH (PRAME_HUMAN)
RIRLDQLLRL

SEQ ID NO: 151024 - protein, 10 aa, Artificial Sequence
  Description of Artificial Sequence: Synthetic peptide
  Seed: QALYVDSLFF (PRAME_HUMAN)
QKLYVDSLFF

SEQ ID NO: 151025 - protein, 9 aa, Artificial Sequence
  Description of Artificial Sequence: Synthetic peptide
  Seed: YLHARLREL (PRAME_HUMAN)
YTHARLREF

SEQ ID NO: 151026 - protein, 9 aa, Artificial Sequence
  Description of Artificial Sequence: Synthetic peptide
  Seed: GRLDQLLRH (PRAME_HUMAN)
GRLDQLLRL

SEQ ID NO: 151027 - protein, 11 aa, Artificial Sequence
  Description of Artificial Sequence: Synthetic peptide
  Seed: NSISISALQSL (PRAME_HUMAN)
NAISISALQSW

SEQ ID NO: 151028 - protein, 11 aa, Artificial Sequence
  Description of Artificial Sequence: Synthetic peptide
  Seed: QALYVDSLFFL (PRAME_HUMAN)
QRLYVDSLFFI

SEQ ID NO: 151029 - protein, 10 aa, Artificial Sequence
  Description of Artificial Sequence: Synthetic peptide
  Seed: QLLRHVMNPL (PRAME_HUMAN)
QYLRHVMNPI

SEQ ID NO: 151030 - protein, 11 aa, Artificial Sequence
  Description of Artificial Sequence: Synthetic peptide
  Seed: FLSLQCLQALY (PRAME_HUMAN)
FSSLQCLQALL

SEQ ID NO: 151031 - protein, 10 aa, Artificial Sequence
  Description of Artificial Sequence: Synthetic peptide
  Seed: LERLAYLHAR (PRAME_HUMAN)
LARLAYLHAK

SEQ ID NO: 151032 - protein, 9 aa, Artificial Sequence
  Description of Artificial Sequence: Synthetic peptide
  Seed: LLLSHIHAS (PRAME_HUMAN)
LILSHIHAI

SEQ ID NO: 151033 - protein, 10 aa, Artificial Sequence
  Description of Artificial Sequence: Synthetic peptide
  Seed: NLTHVLYPVP (PRAME_HUMAN)
NMTHVLYPVV

SEQ ID NO: 151034 - protein, 10 aa, Artificial Sequence
  Description of Artificial Sequence: Synthetic peptide
  Seed: ETFKAVLDGL (PRAME_HUMAN)
ETFKAVLDGK

SEQ ID NO: 151035 - protein, 9 aa, Artificial Sequence
  Description of Artificial Sequence: Synthetic peptide
  Seed: LYVDSLFFL (PRAME_HUMAN)
LMVDSLFFV

SEQ ID NO: 151036 - protein, 9 aa, Artificial Sequence
  Description of Artificial Sequence: Synthetic peptide
  Seed: TFYDPEPIL (PRAME_HUMAN)
TMYDPEPIL

SEQ ID NO: 151037 - protein, 9 aa, Artificial Sequence
  Description of Artificial Sequence: Synthetic peptide
  Seed: TWKLPTLAK (PRAME_HUMAN)
TTKLPTLAA

SEQ ID NO: 151038 - protein, 9 aa, Artificial Sequence
  Description of Artificial Sequence: Synthetic peptide
  Seed: TLAKFSPYL (PRAME_HUMAN)
TAAKFSPYF

SEQ ID NO: 151039 - protein, 8 aa, Artificial Sequence
  Description of Artificial Sequence: Synthetic peptide
  Seed: HARLRELL (PRAME_HUMAN)
HIRLRELL

SEQ ID NO: 151040 - protein, 10 aa, Artificial Sequence
  Description of Artificial Sequence: Synthetic peptide
  Seed: QLSVLSLSGV (PRAME_HUMAN)
QMSVLSLSGA

SEQ ID NO: 151041 - protein, 11 aa, Artificial Sequence
  Description of Artificial Sequence: Synthetic peptide
  Seed: SQSPSVSQLSV (PRAME_HUMAN)
SQSPSVSQLSL

SEQ ID NO: 151042 - protein, 9 aa, Artificial Sequence
  Description of Artificial Sequence: Synthetic peptide
  Seed: YLHARLREL (PRAME_HUMAN)
YAHARLREV

SEQ ID NO: 151043 - protein, 9 aa, Artificial Sequence
  Description of Artificial Sequence: Synthetic peptide
  Seed: GLSNLTHVL (PRAME_HUMAN)
GASNLTHVF

SEQ ID NO: 151044 - protein, 9 aa, Artificial Sequence
  Description of Artificial Sequence: Synthetic peptide
  Seed: MVQAWPFTC (PRAME_HUMAN)
MQQAWPFTT

SEQ ID NO: 151045 - protein, 9 aa, Artificial Sequence
  Description of Artificial Sequence: Synthetic peptide
  Seed: RLRELLCEL (PRAME_HUMAN)
RARELLCEA

SEQ ID NO: 151046 - protein, 10 aa, Artificial Sequence
  Description of Artificial Sequence: Synthetic peptide
  Seed: YIAQFTSQFL (PRAME_HUMAN)
YTAQFTSQFV

SEQ ID NO: 151047 - protein, 10 aa, Artificial Sequence
  Description of Artificial Sequence: Synthetic peptide
  Seed: SNLTHVLYPV (PRAME_HUMAN)
SILTHVLYPA

SEQ ID NO: 151048 - protein, 9 aa, Artificial Sequence
  Description of Artificial Sequence: Synthetic peptide
  Seed: ITDDQLLAL (PRAME_HUMAN)
IFDDQLLAV

SEQ ID NO: 151049 - protein, 9 aa, Artificial Sequence
  Description of Artificial Sequence: Synthetic peptide
  Seed: LMKGQHLHL (PRAME_HUMAN)
LIKGQHLHY

SEQ ID NO: 151050 - protein, 10 aa, Artificial Sequence
  Description of Artificial Sequence: Synthetic peptide
  Seed: RELFPPLFMA (PRAME_HUMAN)
RELFPPLFML

SEQ ID NO: 151051 - protein, 9 aa, Artificial Sequence
  Description of Artificial Sequence: Synthetic peptide
  Seed: SFYGNSISI (PRAME_HUMAN)
SFYGNSISM

SEQ ID NO: 151052 - protein, 10 aa, Artificial Sequence
  Description of Artificial Sequence: Synthetic peptide
  Seed: SALQSLLQHL (PRAME_HUMAN)
SVLQSLLQHL

SEQ ID NO: 151053 - protein, 9 aa, Artificial Sequence
  Description of Artificial Sequence: Synthetic peptide
  Seed: MINLRRLLL (PRAME_HUMAN)
MVNLRRLLW

SEQ ID NO: 151054 - protein, 9 aa, Artificial Sequence
  Description of Artificial Sequence: Synthetic peptide
  Seed: YIAQFTSQF (PRAME_HUMAN)
YIAQFTSQR

SEQ ID NO: 151055 - protein, 9 aa, Artificial Sequence
  Description of Artificial Sequence: Synthetic peptide
  Seed: LVELAGQSL (PRAME_HUMAN)
LTELAGQSM

SEQ ID NO: 151056 - protein, 10 aa, Artificial Sequence
  Description of Artificial Sequence: Synthetic peptide
  Seed: ESYEDIHGTL (PRAME_HUMAN)
EMYEDIHGTR

SEQ ID NO: 151057 - protein, 9 aa, Artificial Sequence
  Description of Artificial Sequence: Synthetic peptide
  Seed: KAMVQAWPF (PRAME_HUMAN)
KTMVQAWPF

SEQ ID NO: 151058 - protein, 9 aa, Artificial Sequence
  Description of Artificial Sequence: Synthetic peptide
  Seed: RLRELLCEL (PRAME_HUMAN)
RTRELLCEI

SEQ ID NO: 151059 - protein, 9 aa, Artificial Sequence
  Description of Artificial Sequence: Synthetic peptide
  Seed: LAQEVRPRR (PRAME_HUMAN)
LLQEVRPRR

SEQ ID NO: 151060 - protein, 9 aa, Artificial Sequence
  Description of Artificial Sequence: Synthetic peptide
  Seed: RRRLWGSIQ (PRAME_HUMAN)
RRRLWGSIR

SEQ ID NO: 151061 - protein, 9 aa, Artificial Sequence
  Description of Artificial Sequence: Synthetic peptide
  Seed: ALLPSLSHC (PRAME_HUMAN)
AMLPSLSHV

SEQ ID NO: 151062 - protein, 9 aa, Artificial Sequence
  Description of Artificial Sequence: Synthetic peptide
  Seed: HVMNPLETL (PRAME_HUMAN)
HMMNPLETM

SEQ ID NO: 151063 - protein, 10 aa, Artificial Sequence
  Description of Artificial Sequence: Synthetic peptide
  Seed: KGQHLHLETF (PRAME_HUMAN)
KTQHLHLETY

SEQ ID NO: 151064 - protein, 9 aa, Artificial Sequence
  Description of Artificial Sequence: Synthetic peptide
  Seed: QSRYISMSV (PRAME_HUMAN)
QTRYISMSK

SEQ ID NO: 151065 - protein, 10 aa, Artificial Sequence
  Description of Artificial Sequence: Synthetic peptide
  Seed: ALYVDSLFFL (PRAME_HUMAN)
ASYVDSLFFV

SEQ ID NO: 151066 - protein, 10 aa, Artificial Sequence
  Description of Artificial Sequence: Synthetic peptide
  Seed: AQFTSQFLSL (PRAME_HUMAN)
AAFTSQFLSY

SEQ ID NO: 151067 - protein, 10 aa, Artificial Sequence
  Description of Artificial Sequence: Synthetic peptide
  Seed: AVLDGLDVLL (PRAME_HUMAN)
ALLDGLDVLL

SEQ ID NO: 151068 - protein, 9 aa, Artificial Sequence
  Description of Artificial Sequence: Synthetic peptide
  Seed: RRLWGSIQS (PRAME_HUMAN)
RQLWGSIQM

SEQ ID NO: 151069 - protein, 9 aa, Artificial Sequence
  Description of Artificial Sequence: Synthetic peptide
  Seed: VWSGNRASL (PRAME_HUMAN)
VYSGNRASI

SEQ ID NO: 151070 - protein, 9 aa, Artificial Sequence
  Description of Artificial Sequence: Synthetic peptide
  Seed: SFYGNSISI (PRAME_HUMAN)
SGYGNSISV

SEQ ID NO: 151071 - protein, 10 aa, Artificial Sequence
  Description of Artificial Sequence: Synthetic peptide
  Seed: QALYVDSLFF (PRAME_HUMAN)
QALYVDSLFW

SEQ ID NO: 151072 - protein, 10 aa, Artificial Sequence
  Description of Artificial Sequence: Synthetic peptide
  Seed: VLYPVPLESY (PRAME_HUMAN)
VTYPVPLESR

SEQ ID NO: 151073 - protein, 10 aa, Artificial Sequence
  Description of Artificial Sequence: Synthetic peptide
  Seed: QEVRPRRWKL (PRAME_HUMAN)
QEVRPRRWKW

SEQ ID NO: 151074 - protein, 10 aa, Artificial Sequence
  Description of Artificial Sequence: Synthetic peptide
  Seed: AIAALELLPR (PRAME_HUMAN)
ATAALELLPY

SEQ ID NO: 151075 - protein, 9 aa, Artificial Sequence
  Description of Artificial Sequence: Synthetic peptide
  Seed: MINLRRLLL (PRAME_HUMAN)
MYNLRRLLL

SEQ ID NO: 151076 - protein, 8 aa, Artificial Sequence
  Description of Artificial Sequence: Synthetic peptide
  Seed: HGTLHLER (PRAME_HUMAN)
HATLHLEL

SEQ ID NO: 151077 - protein, 10 aa, Artificial Sequence
  Description of Artificial Sequence: Synthetic peptide
  Seed: KDEALAIAAL (PRAME_HUMAN)
KEEALAIAAT

SEQ ID NO: 151078 - protein, 10 aa, Artificial Sequence
  Description of Artificial Sequence: Synthetic peptide
  Seed: SISISALQSL (PRAME_HUMAN)
SLSISALQSF

SEQ ID NO: 151079 - protein, 9 aa, Artificial Sequence
  Description of Artificial Sequence: Synthetic peptide
  Seed: FYDPEPILC (PRAME_HUMAN)
FWDPEPILT

SEQ ID NO: 151080 - protein, 10 aa, Artificial Sequence
  Description of Artificial Sequence: Synthetic peptide
  Seed: AMVQAWPFTC (PRAME_HUMAN)
AMVQAWPFTL

SEQ ID NO: 151081 - protein, 11 aa, Artificial Sequence
  Description of Artificial Sequence: Synthetic peptide
  Seed: LPTLAKFSPYL (PRAME_HUMAN)
LLTLAKFSPYV

SEQ ID NO: 151082 - protein, 8 aa, Artificial Sequence
  Description of Artificial Sequence: Synthetic peptide
  Seed: RYISMSVW (PRAME_HUMAN)
RYISMSVI

SEQ ID NO: 151083 - protein, 9 aa, Artificial Sequence
  Description of Artificial Sequence: Synthetic peptide
  Seed: EPLQALLER (PRAME_HUMAN)
ENLQALLER

SEQ ID NO: 151084 - protein, 10 aa, Artificial Sequence
  Description of Artificial Sequence: Synthetic peptide
  Seed: HCSQLTTLSF (PRAME_HUMAN)
HMSQLTTLSY

SEQ ID NO: 151085 - protein, 10 aa, Artificial Sequence
  Description of Artificial Sequence: Synthetic peptide
  Seed: MERRRLWGSI (PRAME_HUMAN)
MLRRRLWGSV

SEQ ID NO: 151086 - protein, 9 aa, Artificial Sequence
  Description of Artificial Sequence: Synthetic peptide
  Seed: LFMAAFDGR (PRAME_HUMAN)
LQMAAFDGR

SEQ ID NO: 151087 - protein, 10 aa, Artificial Sequence
  Description of Artificial Sequence: Synthetic peptide
  Seed: ETFKAVLDGL (PRAME_HUMAN)
ETFKAVLDGY

SEQ ID NO: 151088 - protein, 10 aa, Artificial Sequence
  Description of Artificial Sequence: Synthetic peptide
  Seed: GRLDQLLRHV (PRAME_HUMAN)
GILDQLLRHV

SEQ ID NO: 151089 - protein, 10 aa, Artificial Sequence
  Description of Artificial Sequence: Synthetic peptide
  Seed: HCSQLTTLSF (PRAME_HUMAN)
HCSQLTTLSW

SEQ ID NO: 151090 - protein, 10 aa, Artificial Sequence
  Description of Artificial Sequence: Synthetic peptide
  Seed: SNLTHVLYPV (PRAME_HUMAN)
SLLTHVLYPV

SEQ ID NO: 151091 - protein, 10 aa, Artificial Sequence
  Description of Artificial Sequence: Synthetic peptide
  Seed: SISISALQSL (PRAME_HUMAN)
STSISALQSV

SEQ ID NO: 151092 - protein, 9 aa, Artificial Sequence
  Description of Artificial Sequence: Synthetic peptide
  Seed: SQSPSVSQL (PRAME_HUMAN)
SGSPSVSQM

SEQ ID NO: 151093 - protein, 9 aa, Artificial Sequence
  Description of Artificial Sequence: Synthetic peptide
  Seed: LQHLIGLSN (PRAME_HUMAN)
LQHLIGLSI

SEQ ID NO: 151094 - protein, 9 aa, Artificial Sequence
  Description of Artificial Sequence: Synthetic peptide
  Seed: LQHLIGLSN (PRAME_HUMAN)
LKHLIGLSL

SEQ ID NO: 151095 - protein, 9 aa, Artificial Sequence
  Description of Artificial Sequence: Synthetic peptide
  Seed: ALYVDSLFF (PRAME_HUMAN)
AMYVDSLFY

SEQ ID NO: 151096 - protein, 10 aa, Artificial Sequence
  Description of Artificial Sequence: Synthetic peptide
  Seed: RWKLQVLDLR (PRAME_HUMAN)
RYKLQVLDLR

SEQ ID NO: 151097 - protein, 9 aa, Artificial Sequence
  Description of Artificial Sequence: Synthetic peptide
  Seed: SFYGNSISI (PRAME_HUMAN)
SMYGNSISF

SEQ ID NO: 151098 - protein, 11 aa, Artificial Sequence
  Description of Artificial Sequence: Synthetic peptide
  Seed: AAFDGRHSQTL (PRAME_HUMAN)
ANFDGRHSQTW

SEQ ID NO: 151099 - protein, 9 aa, Artificial Sequence
  Description of Artificial Sequence: Synthetic peptide
  Seed: NLTHVLYPV (PRAME_HUMAN)
NTTHVLYPR

SEQ ID NO: 151100 - protein, 10 aa, Artificial Sequence
  Description of Artificial Sequence: Synthetic peptide
  Seed: LTHVLYPVPL (PRAME_HUMAN)
LTHVLYPVPF

SEQ ID NO: 151101 - protein, 9 aa, Artificial Sequence
  Description of Artificial Sequence: Synthetic peptide
  Seed: MHLSQSPSV (PRAME_HUMAN)
MRLSQSPSM

SEQ ID NO: 151102 - protein, 9 aa, Artificial Sequence
  Description of Artificial Sequence: Synthetic peptide
  Seed: RTFYDPEPI (PRAME_HUMAN)
RGFYDPEPF

SEQ ID NO: 151103 - protein, 9 aa, Artificial Sequence
  Description of Artificial Sequence: Synthetic peptide
  Seed: ITDDQLLAL (PRAME_HUMAN)
ISDDQLLAT

SEQ ID NO: 151104 - protein, 9 aa, Artificial Sequence
  Description of Artificial Sequence: Synthetic peptide
  Seed: YSFPEPEAA (PRAME_HUMAN)
YHFPEPEAT

SEQ ID NO: 151105 - protein, 9 aa, Artificial Sequence
  Description of Artificial Sequence: Synthetic peptide
  Seed: VQAWPFTCL (PRAME_HUMAN)
VSAWPFTCY

SEQ ID NO: 151106 - protein, 9 aa, Artificial Sequence
  Description of Artificial Sequence: Synthetic peptide
  Seed: VFDECGITD (PRAME_HUMAN)
VFDECGITY

SEQ ID NO: 151107 - protein, 9 aa, Artificial Sequence
  Description of Artificial Sequence: Synthetic peptide
  Seed: SRYISMSVW (PRAME_HUMAN)
SAYISMSVF

SEQ ID NO: 151108 - protein, 10 aa, Artificial Sequence
  Description of Artificial Sequence: Synthetic peptide
  Seed: VLYPVPLESY (PRAME_HUMAN)
VYYPVPLESL

SEQ ID NO: 151109 - protein, 9 aa, Artificial Sequence
  Description of Artificial Sequence: Synthetic peptide
  Seed: KLKIFAMPM (PRAME_HUMAN)
KSKIFAMPY

SEQ ID NO: 151110 - protein, 10 aa, Artificial Sequence
  Description of Artificial Sequence: Synthetic peptide
  Seed: RLAYLHARLR (PRAME_HUMAN)
RKAYLHARLK

SEQ ID NO: 151111 - protein, 10 aa, Artificial Sequence
  Description of Artificial Sequence: Synthetic peptide
  Seed: RGRLDQLLRH (PRAME_HUMAN)
RRRLDQLLRL

SEQ ID NO: 151112 - protein, 8 aa, Artificial Sequence
  Description of Artificial Sequence: Synthetic peptide
  Seed: QPFIPVEV (PRAME_HUMAN)
QQFIPVEI

SEQ ID NO: 151113 - protein, 10 aa, Artificial Sequence
  Description of Artificial Sequence: Synthetic peptide
  Seed: FWTVWSGNRA (PRAME_HUMAN)
FTTVWSGNRV

SEQ ID NO: 151114 - protein, 9 aa, Artificial Sequence
  Description of Artificial Sequence: Synthetic peptide
  Seed: PYLGQMINL (PRAME_HUMAN)
PYLGQMINF

SEQ ID NO: 151115 - protein, 9 aa, Artificial Sequence
  Description of Artificial Sequence: Synthetic peptide
  Seed: RRWKLQVLD (PRAME_HUMAN)
RQWKLQVLA

SEQ ID NO: 151116 - protein, 9 aa, Artificial Sequence
  Description of Artificial Sequence: Synthetic peptide
  Seed: FDGRHSQTL (PRAME_HUMAN)
FSGRHSQTL

SEQ ID NO: 151117 - protein, 8 aa, Artificial Sequence
  Description of Artificial Sequence: Synthetic peptide
  Seed: FYDPEPIL (PRAME_HUMAN)
FFDPEPIM

SEQ ID NO: 151118 - protein, 9 aa, Artificial Sequence
  Description of Artificial Sequence: Synthetic peptide
  Seed: ALLPSLSHC (PRAME_HUMAN)
AQLPSLSHA

SEQ ID NO: 151119 - protein, 10 aa, Artificial Sequence
  Description of Artificial Sequence: Synthetic peptide
  Seed: AQFTSQFLSL (PRAME_HUMAN)
AQFTSQFLSW

SEQ ID NO: 151120 - protein, 9 aa, Artificial Sequence
  Description of Artificial Sequence: Synthetic peptide
  Seed: AMVQAWPFT (PRAME_HUMAN)
AVVQAWPFV

SEQ ID NO: 151121 - protein, 10 aa, Artificial Sequence
  Description of Artificial Sequence: Synthetic peptide
  Seed: KKLKIFAMPM (PRAME_HUMAN)
KSLKIFAMPA

SEQ ID NO: 151122 - protein, 10 aa, Artificial Sequence
  Description of Artificial Sequence: Synthetic peptide
  Seed: LLLSHIHASS (PRAME_HUMAN)
LHLSHIHASV

SEQ ID NO: 151123 - protein, 10 aa, Artificial Sequence
  Description of Artificial Sequence: Synthetic peptide
  Seed: MSVWTSPRRL (PRAME_HUMAN)
MMVWTSPRRW

SEQ ID NO: 151124 - protein, 10 aa, Artificial Sequence
  Description of Artificial Sequence: Synthetic peptide
  Seed: PTLAKFSPYL (PRAME_HUMAN)
PNLAKFSPYV

SEQ ID NO: 151125 - protein, 9 aa, Artificial Sequence
  Description of Artificial Sequence: Synthetic peptide
  Seed: SISALQSLL (PRAME_HUMAN)
SSSALQSLV

SEQ ID NO: 151126 - protein, 11 aa, Artificial Sequence
  Description of Artificial Sequence: Synthetic peptide
  Seed: LLLSHIHASSY (PRAME_HUMAN)
LDLSHIHASSW

SEQ ID NO: 151127 - protein, 9 aa, Artificial Sequence
  Description of Artificial Sequence: Synthetic peptide
  Seed: QALYVDSLF (PRAME_HUMAN)
QMLYVDSLW

SEQ ID NO: 151128 - protein, 9 aa, Artificial Sequence
  Description of Artificial Sequence: Synthetic peptide
  Seed: KLKIFAMPM (PRAME_HUMAN)
KYKIFAMPR

SEQ ID NO: 151129 - protein, 9 aa, Artificial Sequence
  Description of Artificial Sequence: Synthetic peptide
  Seed: YIAQFTSQF (PRAME_HUMAN)
YMAQFTSQW

SEQ ID NO: 151130 - protein, 9 aa, Artificial Sequence
  Description of Artificial Sequence: Synthetic peptide
  Seed: FTCLPLGVL (PRAME_HUMAN)
FMCLPLGVF

SEQ ID NO: 151131 - protein, 10 aa, Artificial Sequence
  Description of Artificial Sequence: Synthetic peptide
  Seed: QSLLQHLIGL (PRAME_HUMAN)
QFLLQHLIGA

SEQ ID NO: 151132 - protein, 10 aa, Artificial Sequence
  Description of Artificial Sequence: Synthetic peptide
  Seed: SGNRASLYSF (PRAME_HUMAN)
SKNRASLYSY

SEQ ID NO: 151133 - protein, 8 aa, Artificial Sequence
  Description of Artificial Sequence: Synthetic peptide
  Seed: YEDIHGTL (PRAME_HUMAN)
YLDIHGTI

SEQ ID NO: 151134 - protein, 8 aa, Artificial Sequence
  Description of Artificial Sequence: Synthetic peptide
  Seed: YSFPEPEA (PRAME_HUMAN)
YTFPEPEM

SEQ ID NO: 151135 - protein, 9 aa, Artificial Sequence
  Description of Artificial Sequence: Synthetic peptide
  Seed: LALLPSLSH (PRAME_HUMAN)
LMLLPSLSY

SEQ ID NO: 151136 - protein, 11 aa, Artificial Sequence
  Description of Artificial Sequence: Synthetic peptide
  Seed: LYVDSLFFLRG (PRAME_HUMAN)
LMVDSLFFLRR

SEQ ID NO: 151137 - protein, 9 aa, Artificial Sequence
  Description of Artificial Sequence: Synthetic peptide
  Seed: LSHIHASSY (PRAME_HUMAN)
LSHIHASSL

SEQ ID NO: 151138 - protein, 11 aa, Artificial Sequence
  Description of Artificial Sequence: Synthetic peptide
  Seed: ESYEDIHGTLH (PRAME_HUMAN)
ESYEDIHGTLK

SEQ ID NO: 151139 - protein, 10 aa, Artificial Sequence
  Description of Artificial Sequence: Synthetic peptide
  Seed: ALQSLLQHLI (PRAME_HUMAN)
ALQSLLQHLV

SEQ ID NO: 151140 - protein, 10 aa, Artificial Sequence
  Description of Artificial Sequence: Synthetic peptide
  Seed: FFLRGRLDQL (PRAME_HUMAN)
FALRGRLDQI

SEQ ID NO: 151141 - protein, 10 aa, Artificial Sequence
  Description of Artificial Sequence: Synthetic peptide
  Seed: LSVLSLSGVM (PRAME_HUMAN)
LKVLSLSGVY

SEQ ID NO: 151142 - protein, 9 aa, Artificial Sequence
  Description of Artificial Sequence: Synthetic peptide
  Seed: TCLPLGVLM (PRAME_HUMAN)
TSLPLGVLY

SEQ ID NO: 151143 - protein, 10 aa, Artificial Sequence
  Description of Artificial Sequence: Synthetic peptide
  Seed: RLWGSIQSRY (PRAME_HUMAN)
RWWGSIQSRY

SEQ ID NO: 151144 - protein, 10 aa, Artificial Sequence
  Description of Artificial Sequence: Synthetic peptide
  Seed: RRRLWGSIQS (PRAME_HUMAN)
RRRLWGSIQM

SEQ ID NO: 151145 - protein, 10 aa, Artificial Sequence
  Description of Artificial Sequence: Synthetic peptide
  Seed: FFLRGRLDQL (PRAME_HUMAN)
FNLRGRLDQI

SEQ ID NO: 151146 - protein, 9 aa, Artificial Sequence
  Description of Artificial Sequence: Synthetic peptide
  Seed: TFYDPEPIL (PRAME_HUMAN)
TTYDPEPIY

SEQ ID NO: 151147 - protein, 10 aa, Artificial Sequence
  Description of Artificial Sequence: Synthetic peptide
  Seed: RLRELLCELG (PRAME_HUMAN)
RLRELLCELI

SEQ ID NO: 151148 - protein, 10 aa, Artificial Sequence
  Description of Artificial Sequence: Synthetic peptide
  Seed: SNLTHVLYPV (PRAME_HUMAN)
SDLTHVLYPL

SEQ ID NO: 151149 - protein, 10 aa, Artificial Sequence
  Description of Artificial Sequence: Synthetic peptide
  Seed: GRHSQTLKAM (PRAME_HUMAN)
GRHSQTLKAL

SEQ ID NO: 151150 - protein, 9 aa, Artificial Sequence
  Description of Artificial Sequence: Synthetic peptide
  Seed: RTFYDPEPI (PRAME_HUMAN)
RMFYDPEPC

SEQ ID NO: 151151 - protein, 9 aa, Artificial Sequence
  Description of Artificial Sequence: Synthetic peptide
  Seed: LSEGDVMHL (PRAME_HUMAN)
LMEGDVMHV

SEQ ID NO: 151152 - protein, 9 aa, Artificial Sequence
  Description of Artificial Sequence: Synthetic peptide
  Seed: SQFLSLQCL (PRAME_HUMAN)
SRFLSLQCF

SEQ ID NO: 151153 - protein, 9 aa, Artificial Sequence
  Description of Artificial Sequence: Synthetic peptide
  Seed: TCLPLGVLM (PRAME_HUMAN)
TALPLGVLF

SEQ ID NO: 151154 - protein, 10 aa, Artificial Sequence
  Description of Artificial Sequence: Synthetic peptide
  Seed: RELFPPLFMA (PRAME_HUMAN)
RYLFPPLFMT

SEQ ID NO: 151155 - protein, 9 aa, Artificial Sequence
  Description of Artificial Sequence: Synthetic peptide
  Seed: YIAQFTSQF (PRAME_HUMAN)
YWAQFTSQV

SEQ ID NO: 151156 - protein, 10 aa, Artificial Sequence
  Description of Artificial Sequence: Synthetic peptide
  Seed: MPMQDIKMIL (PRAME_HUMAN)
MPMQDIKMIA

SEQ ID NO: 151157 - protein, 9 aa, Artificial Sequence
  Description of Artificial Sequence: Synthetic peptide
  Seed: LQALYVDSL (PRAME_HUMAN)
LKALYVDSY

SEQ ID NO: 151158 - protein, 11 aa, Artificial Sequence
  Description of Artificial Sequence: Synthetic peptide
  Seed: AAFDGRHSQTL (PRAME_HUMAN)
ARFDGRHSQTL

SEQ ID NO: 151159 - protein, 11 aa, Artificial Sequence
  Description of Artificial Sequence: Synthetic peptide
  Seed: LTDVSPEPLQA (PRAME_HUMAN)
LTDVSPEPLQI

SEQ ID NO: 151160 - protein, 9 aa, Artificial Sequence
  Description of Artificial Sequence: Synthetic peptide
  Seed: LSLQCLQAL (PRAME_HUMAN)
LMLQCLQAT

SEQ ID NO: 151161 - protein, 8 aa, Artificial Sequence
  Description of Artificial Sequence: Synthetic peptide
  Seed: NSISISAL (PRAME_HUMAN)
NQISISAV

SEQ ID NO: 151162 - protein, 8 aa, Artificial Sequence
  Description of Artificial Sequence: Synthetic peptide
  Seed: TDDQLLAL (PRAME_HUMAN)
TTDQLLAV

SEQ ID NO: 151163 - protein, 9 aa, Artificial Sequence
  Description of Artificial Sequence: Synthetic peptide
  Seed: ACDELFSYL (PRAME_HUMAN)
AVDELFSYF

SEQ ID NO: 151164 - protein, 9 aa, Artificial Sequence
  Description of Artificial Sequence: Synthetic peptide
  Seed: SFYGNSISI (PRAME_HUMAN)
SAYGNSISY

SEQ ID NO: 151165 - protein, 9 aa, Artificial Sequence
  Description of Artificial Sequence: Synthetic peptide
  Seed: LSHIHASSY (PRAME_HUMAN)
LNHIHASSY

SEQ ID NO: 151166 - protein, 10 aa, Artificial Sequence
  Description of Artificial Sequence: Synthetic peptide
  Seed: ALYVDSLFFL (PRAME_HUMAN)
AMYVDSLFFS

SEQ ID NO: 151167 - protein, 10 aa, Artificial Sequence
  Description of Artificial Sequence: Synthetic peptide
  Seed: FYDPEPILCP (PRAME_HUMAN)
FIDPEPILCM

SEQ ID NO: 151168 - protein, 10 aa, Artificial Sequence
  Description of Artificial Sequence: Synthetic peptide
  Seed: ESYEDIHGTL (PRAME_HUMAN)
ETYEDIHGTA

SEQ ID NO: 151169 - protein, 10 aa, Artificial Sequence
  Description of Artificial Sequence: Synthetic peptide
  Seed: MERRRLWGSI (PRAME_HUMAN)
MQRRRLWGSI

SEQ ID NO: 151170 - protein, 9 aa, Artificial Sequence
  Description of Artificial Sequence: Synthetic peptide
  Seed: ALQSLLQHL (PRAME_HUMAN)
AMQSLLQHF

SEQ ID NO: 151171 - protein, 10 aa, Artificial Sequence
  Description of Artificial Sequence: Synthetic peptide
  Seed: LYVDSLFFLR (PRAME_HUMAN)
LAVDSLFFLR

SEQ ID NO: 151172 - protein, 8 aa, Artificial Sequence
  Description of Artificial Sequence: Synthetic peptide
  Seed: DQLLRHVM (PRAME_HUMAN)
DPLLRHVL

SEQ ID NO: 151173 - protein, 9 aa, Artificial Sequence
  Description of Artificial Sequence: Synthetic peptide
  Seed: ISISALQSL (PRAME_HUMAN)
ILISALQSF

SEQ ID NO: 151174 - protein, 10 aa, Artificial Sequence
  Description of Artificial Sequence: Synthetic peptide
  Seed: DQLLALLPSL (PRAME_HUMAN)
DFLLALLPSV

SEQ ID NO: 151175 - protein, 10 aa, Artificial Sequence
  Description of Artificial Sequence: Synthetic peptide
  Seed: ELFPPLFMAA (PRAME_HUMAN)
EIFPPLFMAV

SEQ ID NO: 151176 - protein, 9 aa, Artificial Sequence
  Description of Artificial Sequence: Synthetic peptide
  Seed: ITDDQLLAL (PRAME_HUMAN)
IADDQLLAV

SEQ ID NO: 151177 - protein, 9 aa, Artificial Sequence
  Description of Artificial Sequence: Synthetic peptide
  Seed: LSLQCLQAL (PRAME_HUMAN)
LVLQCLQAL

SEQ ID NO: 151178 - protein, 9 aa, Artificial Sequence
  Description of Artificial Sequence: Synthetic peptide
  Seed: KVDGLSTEA (PRAME_HUMAN)
KFDGLSTEI

SEQ ID NO: 151179 - protein, 9 aa, Artificial Sequence
  Description of Artificial Sequence: Synthetic peptide
  Seed: KLKIFAMPM (PRAME_HUMAN)
KSKIFAMPI

SEQ ID NO: 151180 - protein, 9 aa, Artificial Sequence
  Description of Artificial Sequence: Synthetic peptide
  Seed: KVDGLSTEA (PRAME_HUMAN)
KTDGLSTEL

SEQ ID NO: 151181 - protein, 10 aa, Artificial Sequence
  Description of Artificial Sequence: Synthetic peptide
  Seed: AFDGRHSQTL (PRAME_HUMAN)
ATDGRHSQTM

SEQ ID NO: 151182 - protein, 9 aa, Artificial Sequence
  Description of Artificial Sequence: Synthetic peptide
  Seed: GQHLHLETF (PRAME_HUMAN)
GRHLHLETY

SEQ ID NO: 151183 - protein, 10 aa, Artificial Sequence
  Description of Artificial Sequence: Synthetic peptide
  Seed: HLERLAYLHA (PRAME_HUMAN)
HVERLAYLHK

SEQ ID NO: 151184 - protein, 9 aa, Artificial Sequence
  Description of Artificial Sequence: Synthetic peptide
  Seed: TEAEQPFIP (PRAME_HUMAN)
TEAEQPFIA

SEQ ID NO: 151185 - protein, 9 aa, Artificial Sequence
  Description of Artificial Sequence: Synthetic peptide
  Seed: LSLQCLQAL (PRAME_HUMAN)
LMLQCLQAM

SEQ ID NO: 151186 - protein, 10 aa, Artificial Sequence
  Description of Artificial Sequence: Synthetic peptide
  Seed: WPFTCLPLGV (PRAME_HUMAN)
WPFTCLPLGL

SEQ ID NO: 151187 - protein, 9 aa, Artificial Sequence
  Description of Artificial Sequence: Synthetic peptide
  Seed: QPFIPVEVL (PRAME_HUMAN)
QHFIPVEVM

SEQ ID NO: 151188 - protein, 9 aa, Artificial Sequence
  Description of Artificial Sequence: Synthetic peptide
  Seed: LVELAGQSL (PRAME_HUMAN)
LAELAGQSL

SEQ ID NO: 151189 - protein, 9 aa, Artificial Sequence
  Description of Artificial Sequence: Synthetic peptide
  Seed: FDGRHSQTL (PRAME_HUMAN)
FEGRHSQTA

SEQ ID NO: 151190 - protein, 10 aa, Artificial Sequence
  Description of Artificial Sequence: Synthetic peptide
  Seed: RLSEGDVMHL (PRAME_HUMAN)
RLSEGDVMHW

SEQ ID NO: 151191 - protein, 9 aa, Artificial Sequence
  Description of Artificial Sequence: Synthetic peptide
  Seed: VFDECGITD (PRAME_HUMAN)
VQDECGITL

SEQ ID NO: 151192 - protein, 9 aa, Artificial Sequence
  Description of Artificial Sequence: Synthetic peptide
  Seed: VSPEPLQAL (PRAME_HUMAN)
VQPEPLQAL

SEQ ID NO: 151193 - protein, 9 aa, Artificial Sequence
  Description of Artificial Sequence: Synthetic peptide
  Seed: LFPPLFMAA (PRAME_HUMAN)
LFPPLFMAI

SEQ ID NO: 151194 - protein, 10 aa, Artificial Sequence
  Description of Artificial Sequence: Synthetic peptide
  Seed: GRLDQLLRHV (PRAME_HUMAN)
GLLDQLLRHL

SEQ ID NO: 151195 - protein, 9 aa, Artificial Sequence
  Description of Artificial Sequence: Synthetic peptide
  Seed: HARLRELLC (PRAME_HUMAN)
HVRLRELLM

SEQ ID NO: 151196 - protein, 11 aa, Artificial Sequence
  Description of Artificial Sequence: Synthetic peptide
  Seed: FKAVLDGLDVL (PRAME_HUMAN)
FIAVLDGLDVV

SEQ ID NO: 151197 - protein, 9 aa, Artificial Sequence
  Description of Artificial Sequence: Synthetic peptide
  Seed: VFDECGITD (PRAME_HUMAN)
VFDECGITM

SEQ ID NO: 151198 - protein, 9 aa, Artificial Sequence
  Description of Artificial Sequence: Synthetic peptide
  Seed: YSFPEPEAA (PRAME_HUMAN)
YNFPEPEAY

SEQ ID NO: 151199 - protein, 10 aa, Artificial Sequence
  Description of Artificial Sequence: Synthetic peptide
  Seed: TVWSGNRASL (PRAME_HUMAN)
TPWSGNRASF

SEQ ID NO: 151200 - protein, 9 aa, Artificial Sequence
  Description of Artificial Sequence: Synthetic peptide
  Seed: TDDQLLALL (PRAME_HUMAN)
TFDQLLALV

SEQ ID NO: 151201 - protein, 8 aa, Artificial Sequence
  Description of Artificial Sequence: Synthetic peptide
  Seed: TDDQLLAL (PRAME_HUMAN)
TIDQLLAI

SEQ ID NO: 151202 - protein, 10 aa, Artificial Sequence
  Description of Artificial Sequence: Synthetic peptide
  Seed: AALELLPREL (PRAME_HUMAN)
AILELLPREI

SEQ ID NO: 151203 - protein, 10 aa, Artificial Sequence
  Description of Artificial Sequence: Synthetic peptide
  Seed: LSLQCLQALY (PRAME_HUMAN)
LGLQCLQALW

SEQ ID NO: 151204 - protein, 9 aa, Artificial Sequence
  Description of Artificial Sequence: Synthetic peptide
  Seed: VSQLSVLSL (PRAME_HUMAN)
VEQLSVLSF

SEQ ID NO: 151205 - protein, 9 aa, Artificial Sequence
  Description of Artificial Sequence: Synthetic peptide
  Seed: MPMQDIKMI (PRAME_HUMAN)
MAMQDIKMM

SEQ ID NO: 151206 - protein, 9 aa, Artificial Sequence
  Description of Artificial Sequence: Synthetic peptide
  Seed: VSPEPLQAL (PRAME_HUMAN)
VIPEPLQAR

SEQ ID NO: 151207 - protein, 9 aa, Artificial Sequence
  Description of Artificial Sequence: Synthetic peptide
  Seed: VSQLSVLSL (PRAME_HUMAN)
VMQLSVLSY

SEQ ID NO: 151208 - protein, 10 aa, Artificial Sequence
  Description of Artificial Sequence: Synthetic peptide
  Seed: ESYEDIHGTL (PRAME_HUMAN)
EIYEDIHGTY

SEQ ID NO: 151209 - protein, 9 aa, Artificial Sequence
  Description of Artificial Sequence: Synthetic peptide
  Seed: FYDPEPILC (PRAME_HUMAN)
FIDPEPILT

SEQ ID NO: 151210 - protein, 10 aa, Artificial Sequence
  Description of Artificial Sequence: Synthetic peptide
  Seed: GACDELFSYL (PRAME_HUMAN)
GICDELFSYW

SEQ ID NO: 151211 - protein, 9 aa, Artificial Sequence
  Description of Artificial Sequence: Synthetic peptide
  Seed: TCTWKLPTL (PRAME_HUMAN)
TSTWKLPTV

SEQ ID NO: 151212 - protein, 10 aa, Artificial Sequence
  Description of Artificial Sequence: Synthetic peptide
  Seed: ISISALQSLL (PRAME_HUMAN)
IAISALQSLF

SEQ ID NO: 151213 - protein, 10 aa, Artificial Sequence
  Description of Artificial Sequence: Synthetic peptide
  Seed: RRWKLQVLDL (PRAME_HUMAN)
RKWKLQVLDL

SEQ ID NO: 151214 - protein, 9 aa, Artificial Sequence
  Description of Artificial Sequence: Synthetic peptide
  Seed: RGRLDQLLR (PRAME_HUMAN)
RARLDQLLR

SEQ ID NO: 151215 - protein, 10 aa, Artificial Sequence
  Description of Artificial Sequence: Synthetic peptide
  Seed: ESYEDIHGTL (PRAME_HUMAN)
EAYEDIHGTF

SEQ ID NO: 151216 - protein, 10 aa, Artificial Sequence
  Description of Artificial Sequence: Synthetic peptide
  Seed: ALAIAALELL (PRAME_HUMAN)
AQAIAALELW

SEQ ID NO: 151217 - protein, 9 aa, Artificial Sequence
  Description of Artificial Sequence: Synthetic peptide
  Seed: RHVMNPLET (PRAME_HUMAN)
RHVMNPLEA

SEQ ID NO: 151218 - protein, 10 aa, Artificial Sequence
  Description of Artificial Sequence: Synthetic peptide
  Seed: SQTLKAMVQA (PRAME_HUMAN)
SQTLKAMVQV

SEQ ID NO: 151219 - protein, 9 aa, Artificial Sequence
  Description of Artificial Sequence: Synthetic peptide
  Seed: HVMNPLETL (PRAME_HUMAN)
HFMNPLETM

SEQ ID NO: 151220 - protein, 10 aa, Artificial Sequence
  Description of Artificial Sequence: Synthetic peptide
  Seed: AYLHARLREL (PRAME_HUMAN)
ATLHARLREV

SEQ ID NO: 151221 - protein, 10 aa, Artificial Sequence
  Description of Artificial Sequence: Synthetic peptide
  Seed: SPYLGQMINL (PRAME_HUMAN)
SRYLGQMINL

SEQ ID NO: 151222 - protein, 11 aa, Artificial Sequence
  Description of Artificial Sequence: Synthetic peptide
  Seed: AAFDGRHSQTL (PRAME_HUMAN)
ATFDGRHSQTY

SEQ ID NO: 151223 - protein, 9 aa, Artificial Sequence
  Description of Artificial Sequence: Synthetic peptide
  Seed: IAALELLPR (PRAME_HUMAN)
IIALELLPK

SEQ ID NO: 151224 - protein, 10 aa, Artificial Sequence
  Description of Artificial Sequence: Synthetic peptide
  Seed: IQSRYISMSV (PRAME_HUMAN)
IFSRYISMSA

SEQ ID NO: 151225 - protein, 9 aa, Artificial Sequence
  Description of Artificial Sequence: Synthetic peptide
  Seed: KLKIFAMPM (PRAME_HUMAN)
KIKIFAMPK

SEQ ID NO: 151226 - protein, 9 aa, Artificial Sequence
  Description of Artificial Sequence: Synthetic peptide
  Seed: RLAYLHARL (PRAME_HUMAN)
RVAYLHARF

SEQ ID NO: 151227 - protein, 9 aa, Artificial Sequence
  Description of Artificial Sequence: Synthetic peptide
  Seed: ASATLQDLV (PRAME_HUMAN)
AVATLQDLV

SEQ ID NO: 151228 - protein, 9 aa, Artificial Sequence
  Description of Artificial Sequence: Synthetic peptide
  Seed: SQLSVLSLS (PRAME_HUMAN)
SMLSVLSLA

SEQ ID NO: 151229 - protein, 9 aa, Artificial Sequence
  Description of Artificial Sequence: Synthetic peptide
  Seed: HVMNPLETL (PRAME_HUMAN)
HTMNPLETK

SEQ ID NO: 151230 - protein, 9 aa, Artificial Sequence
  Description of Artificial Sequence: Synthetic peptide
  Seed: YLHARLREL (PRAME_HUMAN)
YSHARLREF

SEQ ID NO: 151231 - protein, 9 aa, Artificial Sequence
  Description of Artificial Sequence: Synthetic peptide
  Seed: LYVDSLFFL (PRAME_HUMAN)
LVVDSLFFT

SEQ ID NO: 151232 - protein, 8 aa, Artificial Sequence
  Description of Artificial Sequence: Synthetic peptide
  Seed: TDDQLLAL (PRAME_HUMAN)
TVDQLLAL

SEQ ID NO: 151233 - protein, 9 aa, Artificial Sequence
  Description of Artificial Sequence: Synthetic peptide
  Seed: AQFTSQFLS (PRAME_HUMAN)
ALFTSQFLV

SEQ ID NO: 151234 - protein, 9 aa, Artificial Sequence
  Description of Artificial Sequence: Synthetic peptide
  Seed: FTCLPLGVL (PRAME_HUMAN)
FQCLPLGVF

SEQ ID NO: 151235 - protein, 9 aa, Artificial Sequence
  Description of Artificial Sequence: Synthetic peptide
  Seed: RTFYDPEPI (PRAME_HUMAN)
RNFYDPEPF

SEQ ID NO: 151236 - protein, 9 aa, Artificial Sequence
  Description of Artificial Sequence: Synthetic peptide
  Seed: VQLDSIEDL (PRAME_HUMAN)
VVLDSIEDI

SEQ ID NO: 151237 - protein, 10 aa, Artificial Sequence
  Description of Artificial Sequence: Synthetic peptide
  Seed: LKAMVQAWPF (PRAME_HUMAN)
LLAMVQAWPY

SEQ ID NO: 151238 - protein, 9 aa, Artificial Sequence
  Description of Artificial Sequence: Synthetic peptide
  Seed: MHLSQSPSV (PRAME_HUMAN)
MALSQSPSF

SEQ ID NO: 151239 - protein, 9 aa, Artificial Sequence
  Description of Artificial Sequence: Synthetic peptide
  Seed: RLWGSIQSR (PRAME_HUMAN)
RMWGSIQSA

SEQ ID NO: 151240 - protein, 9 aa, Artificial Sequence
  Description of Artificial Sequence: Synthetic peptide
  Seed: ALELLPREL (PRAME_HUMAN)
AYELLPREF

SEQ ID NO: 151241 - protein, 10 aa, Artificial Sequence
  Description of Artificial Sequence: Synthetic peptide
  Seed: LLKDEALAIA (PRAME_HUMAN)
LIKDEALAIV

SEQ ID NO: 151242 - protein, 9 aa, Artificial Sequence
  Description of Artificial Sequence: Synthetic peptide
  Seed: MHLSQSPSV (PRAME_HUMAN)
MNLSQSPSY

SEQ ID NO: 151243 - protein, 9 aa, Artificial Sequence
  Description of Artificial Sequence: Synthetic peptide
  Seed: ISISALQSL (PRAME_HUMAN)
IMISALQSY

SEQ ID NO: 151244 - protein, 9 aa, Artificial Sequence
  Description of Artificial Sequence: Synthetic peptide
  Seed: SATLQDLVF (PRAME_HUMAN)
SATLQDLVM

SEQ ID NO: 151245 - protein, 9 aa, Artificial Sequence
  Description of Artificial Sequence: Synthetic peptide
  Seed: RLAYLHARL (PRAME_HUMAN)
RLAYLHARY

SEQ ID NO: 151246 - protein, 9 aa, Artificial Sequence
  Description of Artificial Sequence: Synthetic peptide
  Seed: VSQLSVLSL (PRAME_HUMAN)
VSQLSVLSM

SEQ ID NO: 151247 - protein, 10 aa, Artificial Sequence
  Description of Artificial Sequence: Synthetic peptide
  Seed: VLMKGQHLHL (PRAME_HUMAN)
VLMKGQHLHW

SEQ ID NO: 151248 - protein, 10 aa, Artificial Sequence
  Description of Artificial Sequence: Synthetic peptide
  Seed: AVLDGLDVLL (PRAME_HUMAN)
ASLDGLDVLL

SEQ ID NO: 151249 - protein, 9 aa, Artificial Sequence
  Description of Artificial Sequence: Synthetic peptide
  Seed: LQHLIGLSN (PRAME_HUMAN)
LMHLIGLSF

SEQ ID NO: 151250 - protein, 9 aa, Artificial Sequence
  Description of Artificial Sequence: Synthetic peptide
  Seed: HLHLETFKA (PRAME_HUMAN)
HVHLETFKV

SEQ ID NO: 151251 - protein, 8 aa, Artificial Sequence
  Description of Artificial Sequence: Synthetic peptide
  Seed: ITDDQLLA (PRAME_HUMAN)
ITDDQLLM

SEQ ID NO: 151252 - protein, 8 aa, Artificial Sequence
  Description of Artificial Sequence: Synthetic peptide
  Seed: DELFSYLI (PRAME_HUMAN)
DELFSYLY

SEQ ID NO: 151253 - protein, 9 aa, Artificial Sequence
  Description of Artificial Sequence: Synthetic peptide
  Seed: LQSLLQHLI (PRAME_HUMAN)
LQSLLQHLV

SEQ ID NO: 151254 - protein, 10 aa, Artificial Sequence
  Description of Artificial Sequence: Synthetic peptide
  Seed: MPMQDIKMIL (PRAME_HUMAN)
MIMQDIKMIY

SEQ ID NO: 151255 - protein, 10 aa, Artificial Sequence
  Description of Artificial Sequence: Synthetic peptide
  Seed: FFLRGRLDQL (PRAME_HUMAN)
FMLRGRLDQV

SEQ ID NO: 151256 - protein, 9 aa, Artificial Sequence
  Description of Artificial Sequence: Synthetic peptide
  Seed: HLIGLSNLT (PRAME_HUMAN)
HLIGLSNLM

SEQ ID NO: 151257 - protein, 9 aa, Artificial Sequence
  Description of Artificial Sequence: Synthetic peptide
  Seed: QSRYISMSV (PRAME_HUMAN)
QVRYISMSV

SEQ ID NO: 151258 - protein, 10 aa, Artificial Sequence
  Description of Artificial Sequence: Synthetic peptide
  Seed: DQLLALLPSL (PRAME_HUMAN)
DILLALLPSV

SEQ ID NO: 151259 - protein, 10 aa, Artificial Sequence
  Description of Artificial Sequence: Synthetic peptide
  Seed: ETLSITNCRL (PRAME_HUMAN)
ETLSITNCRK

SEQ ID NO: 151260 - protein, 10 aa, Artificial Sequence
  Description of Artificial Sequence: Synthetic peptide
  Seed: RLWGSIQSRY (PRAME_HUMAN)
RKWGSIQSRY

SEQ ID NO: 151261 - protein, 11 aa, Artificial Sequence
  Description of Artificial Sequence: Synthetic peptide
  Seed: RASATLQDLVF (PRAME_HUMAN)
RTSATLQDLVY

SEQ ID NO: 151262 - protein, 10 aa, Artificial Sequence
  Description of Artificial Sequence: Synthetic peptide
  Seed: RLWGSIQSRY (PRAME_HUMAN)
RTWGSIQSRM

SEQ ID NO: 151263 - protein, 9 aa, Artificial Sequence
  Description of Artificial Sequence: Synthetic peptide
  Seed: SVLSLSGVM (PRAME_HUMAN)
SMLSLSGVF

SEQ ID NO: 151264 - protein, 11 aa, Artificial Sequence
  Description of Artificial Sequence: Synthetic peptide
  Seed: EQYIAQFTSQF (PRAME_HUMAN)
EYYIAQFTSQW

SEQ ID NO: 151265 - protein, 9 aa, Artificial Sequence
  Description of Artificial Sequence: Synthetic peptide
  Seed: MINLRRLLL (PRAME_HUMAN)
MNNLRRLLM

SEQ ID NO: 151266 - protein, 11 aa, Artificial Sequence
  Description of Artificial Sequence: Synthetic peptide
  Seed: MKGQHLHLETF (PRAME_HUMAN)
MVGQHLHLETY

SEQ ID NO: 151267 - protein, 9 aa, Artificial Sequence
  Description of Artificial Sequence: Synthetic peptide
  Seed: GQHLHLETF (PRAME_HUMAN)
GFHLHLETF

SEQ ID NO: 151268 - protein, 10 aa, Artificial Sequence
  Description of Artificial Sequence: Synthetic peptide
  Seed: AYLHARLREL (PRAME_HUMAN)
AHLHARLREV

SEQ ID NO: 151269 - protein, 9 aa, Artificial Sequence
  Description of Artificial Sequence: Synthetic peptide
  Seed: GNRASLYSF (PRAME_HUMAN)
GSRASLYSY

SEQ ID NO: 151270 - protein, 10 aa, Artificial Sequence
  Description of Artificial Sequence: Synthetic peptide
  Seed: ALYVDSLFFL (PRAME_HUMAN)
ATYVDSLFFL

SEQ ID NO: 151271 - protein, 11 aa, Artificial Sequence
  Description of Artificial Sequence: Synthetic peptide
  Seed: MLTDVSPEPLQ (PRAME_HUMAN)
MLTDVSPEPLI

SEQ ID NO: 151272 - protein, 11 aa, Artificial Sequence
  Description of Artificial Sequence: Synthetic peptide
  Seed: RLSEGDVMHLS (PRAME_HUMAN)
RMSEGDVMHLV

SEQ ID NO: 151273 - protein, 8 aa, Artificial Sequence
  Description of Artificial Sequence: Synthetic peptide
  Seed: FYDPEPIL (PRAME_HUMAN)
FYDPEPII

SEQ ID NO: 151274 - protein, 9 aa, Artificial Sequence
  Description of Artificial Sequence: Synthetic peptide
  Seed: ITDDQLLAL (PRAME_HUMAN)
IFDDQLLAL

SEQ ID NO: 151275 - protein, 11 aa, Artificial Sequence
  Description of Artificial Sequence: Synthetic peptide
  Seed: FLSLQCLQALY (PRAME_HUMAN)
FLSLQCLQALM

SEQ ID NO: 151276 - protein, 9 aa, Artificial Sequence
  Description of Artificial Sequence: Synthetic peptide
  Seed: RASATLQDL (PRAME_HUMAN)
RASATLQDW

SEQ ID NO: 151277 - protein, 11 aa, Artificial Sequence
  Description of Artificial Sequence: Synthetic peptide
  Seed: RRLWGSIQSRY (PRAME_HUMAN)
RQLWGSIQSRY

SEQ ID NO: 151278 - protein, 9 aa, Artificial Sequence
  Description of Artificial Sequence: Synthetic peptide
  Seed: MINLRRLLL (PRAME_HUMAN)
MMNLRRLLV

SEQ ID NO: 151279 - protein, 9 aa, Artificial Sequence
  Description of Artificial Sequence: Synthetic peptide
  Seed: VSQLSVLSL (PRAME_HUMAN)
VSQLSVLSF

SEQ ID NO: 151280 - protein, 9 aa, Artificial Sequence
  Description of Artificial Sequence: Synthetic peptide
  Seed: FYDPEPILC (PRAME_HUMAN)
FFDPEPILS

SEQ ID NO: 151281 - protein, 9 aa, Artificial Sequence
  Description of Artificial Sequence: Synthetic peptide
  Seed: YLHARLREL (PRAME_HUMAN)
YHHARLREY

SEQ ID NO: 151282 - protein, 10 aa, Artificial Sequence
  Description of Artificial Sequence: Synthetic peptide
  Seed: IGLSNLTHVL (PRAME_HUMAN)
IWLSNLTHVL

SEQ ID NO: 151283 - protein, 9 aa, Artificial Sequence
  Description of Artificial Sequence: Synthetic peptide
  Seed: LSLQCLQAL (PRAME_HUMAN)
LLLQCLQAV

SEQ ID NO: 151284 - protein, 9 aa, Artificial Sequence
  Description of Artificial Sequence: Synthetic peptide
  Seed: QLLALLPSL (PRAME_HUMAN)
QYLALLPSY

SEQ ID NO: 151285 - protein, 10 aa, Artificial Sequence
  Description of Artificial Sequence: Synthetic peptide
  Seed: KKLKIFAMPM (PRAME_HUMAN)
KTLKIFAMPY

SEQ ID NO: 151286 - protein, 9 aa, Artificial Sequence
  Description of Artificial Sequence: Synthetic peptide
  Seed: LQHLIGLSN (PRAME_HUMAN)
LAHLIGLSF

SEQ ID NO: 151287 - protein, 11 aa, Artificial Sequence
  Description of Artificial Sequence: Synthetic peptide
  Seed: AALELLPRELF (PRAME_HUMAN)
ATLELLPRELW

SEQ ID NO: 151288 - protein, 10 aa, Artificial Sequence
  Description of Artificial Sequence: Synthetic peptide
  Seed: RELFPPLFMA (PRAME_HUMAN)
RILFPPLFML

SEQ ID NO: 151289 - protein, 10 aa, Artificial Sequence
  Description of Artificial Sequence: Synthetic peptide
  Seed: RGRLDQLLRH (PRAME_HUMAN)
RQRLDQLLRM

SEQ ID NO: 151290 - protein, 10 aa, Artificial Sequence
  Description of Artificial Sequence: Synthetic peptide
  Seed: VELAGQSLLK (PRAME_HUMAN)
VSLAGQSLLK

SEQ ID NO: 151291 - protein, 11 aa, Artificial Sequence
  Description of Artificial Sequence: Synthetic peptide
  Seed: EDIHGTLHLER (PRAME_HUMAN)
EYIHGTLHLER

SEQ ID NO: 151292 - protein, 9 aa, Artificial Sequence
  Description of Artificial Sequence: Synthetic peptide
  Seed: KLKIFAMPM (PRAME_HUMAN)
KTKIFAMPT

SEQ ID NO: 151293 - protein, 10 aa, Artificial Sequence
  Description of Artificial Sequence: Synthetic peptide
  Seed: ETFKAVLDGL (PRAME_HUMAN)
ETFKAVLDGM

SEQ ID NO: 151294 - protein, 9 aa, Artificial Sequence
  Description of Artificial Sequence: Synthetic peptide
  Seed: RLWGSIQSR (PRAME_HUMAN)
RLWGSIQSM

SEQ ID NO: 151295 - protein, 10 aa, Artificial Sequence
  Description of Artificial Sequence: Synthetic peptide
  Seed: NLTHVLYPVP (PRAME_HUMAN)
NLTHVLYPVI

SEQ ID NO: 151296 - protein, 10 aa, Artificial Sequence
  Description of Artificial Sequence: Synthetic peptide
  Seed: SLSHCSQLTT (PRAME_HUMAN)
SVSHCSQLTV

SEQ ID NO: 151297 - protein, 9 aa, Artificial Sequence
  Description of Artificial Sequence: Synthetic peptide
  Seed: FSPYLGQMI (PRAME_HUMAN)
FTPYLGQMW

SEQ ID NO: 151298 - protein, 9 aa, Artificial Sequence
  Description of Artificial Sequence: Synthetic peptide
  Seed: HVMNPLETL (PRAME_HUMAN)
HTMNPLETV

SEQ ID NO: 151299 - protein, 9 aa, Artificial Sequence
  Description of Artificial Sequence: Synthetic peptide
  Seed: LLLSHIHAS (PRAME_HUMAN)
LLLSHIHAC

SEQ ID NO: 151300 - protein, 9 aa, Artificial Sequence
  Description of Artificial Sequence: Synthetic peptide
  Seed: ITDDQLLAL (PRAME_HUMAN)
IEDDQLLAI

SEQ ID NO: 151301 - protein, 9 aa, Artificial Sequence
  Description of Artificial Sequence: Synthetic peptide
  Seed: LGRPSMVWL (PRAME_HUMAN)
LWRPSMVWK

SEQ ID NO: 151302 - protein, 10 aa, Artificial Sequence
  Description of Artificial Sequence: Synthetic peptide
  Seed: KVKRKKNVLR (PRAME_HUMAN)
KAKRKKNVLA

SEQ ID NO: 151303 - protein, 10 aa, Artificial Sequence
  Description of Artificial Sequence: Synthetic peptide
  Seed: MVQAWPFTCL (PRAME_HUMAN)
MDQAWPFTCV

SEQ ID NO: 151304 - protein, 9 aa, Artificial Sequence
  Description of Artificial Sequence: Synthetic peptide
  Seed: SIQSRYISM (PRAME_HUMAN)
SWQSRYISY

SEQ ID NO: 151305 - protein, 9 aa, Artificial Sequence
  Description of Artificial Sequence: Synthetic peptide
  Seed: YDPEPILCP (PRAME_HUMAN)
YEPEPILCA

SEQ ID NO: 151306 - protein, 10 aa, Artificial Sequence
  Description of Artificial Sequence: Synthetic peptide
  Seed: QSRYISMSVW (PRAME_HUMAN)
QTRYISMSVF

SEQ ID NO: 151307 - protein, 8 aa, Artificial Sequence
  Description of Artificial Sequence: Synthetic peptide
  Seed: FYDPEPIL (PRAME_HUMAN)
FSDPEPIV

SEQ ID NO: 151308 - protein, 9 aa, Artificial Sequence
  Description of Artificial Sequence: Synthetic peptide
  Seed: SVLSLSGVM (PRAME_HUMAN)
SSLSLSGVM

SEQ ID NO: 151309 - protein, 9 aa, Artificial Sequence
  Description of Artificial Sequence: Synthetic peptide
  Seed: LEVTCTWKL (PRAME_HUMAN)
LEVTCTWKF

SEQ ID NO: 151310 - protein, 9 aa, Artificial Sequence
  Description of Artificial Sequence: Synthetic peptide
  Seed: RLDQLLRHV (PRAME_HUMAN)
RYDQLLRHL

SEQ ID NO: 151311 - protein, 9 aa, Artificial Sequence
  Description of Artificial Sequence: Synthetic peptide
  Seed: SQSPSVSQL (PRAME_HUMAN)
SVSPSVSQF

SEQ ID NO: 151312 - protein, 10 aa, Artificial Sequence
  Description of Artificial Sequence: Synthetic peptide
  Seed: ESYEDIHGTL (PRAME_HUMAN)
ETYEDIHGTR

SEQ ID NO: 151313 - protein, 11 aa, Artificial Sequence
  Description of Artificial Sequence: Synthetic peptide
  Seed: LSVLSLSGVML (PRAME_HUMAN)
LTVLSLSGVMW

SEQ ID NO: 151314 - protein, 9 aa, Artificial Sequence
  Description of Artificial Sequence: Synthetic peptide
  Seed: YSFPEPEAA (PRAME_HUMAN)
YNFPEPEAF

SEQ ID NO: 151315 - protein, 10 aa, Artificial Sequence
  Description of Artificial Sequence: Synthetic peptide
  Seed: RASATLQDLV (PRAME_HUMAN)
RESATLQDLF

SEQ ID NO: 151316 - protein, 8 aa, Artificial Sequence
  Description of Artificial Sequence: Synthetic peptide
  Seed: FYDPEPIL (PRAME_HUMAN)
FMDPEPIF

SEQ ID NO: 151317 - protein, 9 aa, Artificial Sequence
  Description of Artificial Sequence: Synthetic peptide
  Seed: WLSANPCPH (PRAME_HUMAN)
WISANPCPY

SEQ ID NO: 151318 - protein, 10 aa, Artificial Sequence
  Description of Artificial Sequence: Synthetic peptide
  Seed: LLLSHIHASS (PRAME_HUMAN)
LPLSHIHASV

SEQ ID NO: 151319 - protein, 9 aa, Artificial Sequence
  Description of Artificial Sequence: Synthetic peptide
  Seed: VQAWPFTCL (PRAME_HUMAN)
VIAWPFTCV

SEQ ID NO: 151320 - protein, 9 aa, Artificial Sequence
  Description of Artificial Sequence: Synthetic peptide
  Seed: KVDGLSTEA (PRAME_HUMAN)
KLDGLSTEL

SEQ ID NO: 151321 - protein, 9 aa, Artificial Sequence
  Description of Artificial Sequence: Synthetic peptide
  Seed: YEDIHGTLH (PRAME_HUMAN)
YGDIHGTLY

SEQ ID NO: 151322 - protein, 10 aa, Artificial Sequence
  Description of Artificial Sequence: Synthetic peptide
  Seed: QMINLRRLLL (PRAME_HUMAN)
QLINLRRLLV

SEQ ID NO: 151323 - protein, 9 aa, Artificial Sequence
  Description of Artificial Sequence: Synthetic peptide
  Seed: ALLPSLSHC (PRAME_HUMAN)
AVLPSLSHL

SEQ ID NO: 151324 - protein, 10 aa, Artificial Sequence
  Description of Artificial Sequence: Synthetic peptide
  Seed: MVQLDSIEDL (PRAME_HUMAN)
MLQLDSIEDV

SEQ ID NO: 151325 - protein, 10 aa, Artificial Sequence
  Description of Artificial Sequence: Synthetic peptide
  Seed: QTLKAMVQAW (PRAME_HUMAN)
QSLKAMVQAW

SEQ ID NO: 151326 - protein, 10 aa, Artificial Sequence
  Description of Artificial Sequence: Synthetic peptide
  Seed: YIAQFTSQFL (PRAME_HUMAN)
YAAQFTSQFM

SEQ ID NO: 151327 - protein, 9 aa, Artificial Sequence
  Description of Artificial Sequence: Synthetic peptide
  Seed: NSISISALQ (PRAME_HUMAN)
NSISISALK

SEQ ID NO: 151328 - protein, 10 aa, Artificial Sequence
  Description of Artificial Sequence: Synthetic peptide
  Seed: ESYEDIHGTL (PRAME_HUMAN)
ETYEDIHGTK

SEQ ID NO: 151329 - protein, 9 aa, Artificial Sequence
  Description of Artificial Sequence: Synthetic peptide
  Seed: LAIAALELL (PRAME_HUMAN)
LIIAALELY

SEQ ID NO: 151330 - protein, 10 aa, Artificial Sequence
  Description of Artificial Sequence: Synthetic peptide
  Seed: LQALYVDSLF (PRAME_HUMAN)
LNALYVDSLW

SEQ ID NO: 151331 - protein, 9 aa, Artificial Sequence
  Description of Artificial Sequence: Synthetic peptide
  Seed: VWSGNRASL (PRAME_HUMAN)
VYSGNRASL

SEQ ID NO: 151332 - protein, 10 aa, Artificial Sequence
  Description of Artificial Sequence: Synthetic peptide
  Seed: DVSPEPLQAL (PRAME_HUMAN)
DLSPEPLQAR

SEQ ID NO: 151333 - protein, 10 aa, Artificial Sequence
  Description of Artificial Sequence: Synthetic peptide
  Seed: LSVLSLSGVM (PRAME_HUMAN)
LQVLSLSGVM

SEQ ID NO: 151334 - protein, 9 aa, Artificial Sequence
  Description of Artificial Sequence: Synthetic peptide
  Seed: QALYVDSLF (PRAME_HUMAN)
QSLYVDSLM

SEQ ID NO: 151335 - protein, 9 aa, Artificial Sequence
  Description of Artificial Sequence: Synthetic peptide
  Seed: FYDPEPILC (PRAME_HUMAN)
FGDPEPILL

SEQ ID NO: 151336 - protein, 9 aa, Artificial Sequence
  Description of Artificial Sequence: Synthetic peptide
  Seed: KVDGLSTEA (PRAME_HUMAN)
KGDGLSTEM

SEQ ID NO: 151337 - protein, 9 aa, Artificial Sequence
  Description of Artificial Sequence: Synthetic peptide
  Seed: VFDECGITD (PRAME_HUMAN)
VIDECGITF

SEQ ID NO: 151338 - protein, 11 aa, Artificial Sequence
  Description of Artificial Sequence: Synthetic peptide
  Seed: HVLYPVPLESY (PRAME_HUMAN)
HMLYPVPLESY

SEQ ID NO: 151339 - protein, 9 aa, Artificial Sequence
  Description of Artificial Sequence: Synthetic peptide
  Seed: LQALYVDSL (PRAME_HUMAN)
LRALYVDSY

SEQ ID NO: 151340 - protein, 10 aa, Artificial Sequence
  Description of Artificial Sequence: Synthetic peptide
  Seed: SALQSLLQHL (PRAME_HUMAN)
SGLQSLLQHV

SEQ ID NO: 151341 - protein, 9 aa, Artificial Sequence
  Description of Artificial Sequence: Synthetic peptide
  Seed: SHCSQLTTL (PRAME_HUMAN)
SMCSQLTTF

SEQ ID NO: 151342 - protein, 9 aa, Artificial Sequence
  Description of Artificial Sequence: Synthetic peptide
  Seed: VQLDSIEDL (PRAME_HUMAN)
VLLDSIEDV

SEQ ID NO: 151343 - protein, 9 aa, Artificial Sequence
  Description of Artificial Sequence: Synthetic peptide
  Seed: YIAQFTSQF (PRAME_HUMAN)
YWAQFTSQW

SEQ ID NO: 151344 - protein, 10 aa, Artificial Sequence
  Description of Artificial Sequence: Synthetic peptide
  Seed: FLSLQCLQAL (PRAME_HUMAN)
FMSLQCLQAL

SEQ ID NO: 151345 - protein, 10 aa, Artificial Sequence
  Description of Artificial Sequence: Synthetic peptide
  Seed: AQFTSQFLSL (PRAME_HUMAN)
AEFTSQFLSF

SEQ ID NO: 151346 - protein, 9 aa, Artificial Sequence
  Description of Artificial Sequence: Synthetic peptide
  Seed: AVLDGLDVL (PRAME_HUMAN)
AILDGLDVL

SEQ ID NO: 151347 - protein, 9 aa, Artificial Sequence
  Description of Artificial Sequence: Synthetic peptide
  Seed: ALLERASAT (PRAME_HUMAN)
AILERASAL

SEQ ID NO: 151348 - protein, 9 aa, Artificial Sequence
  Description of Artificial Sequence: Synthetic peptide
  Seed: LQDLVFDEC (PRAME_HUMAN)
LTDLVFDEM

SEQ ID NO: 151349 - protein, 10 aa, Artificial Sequence
  Description of Artificial Sequence: Synthetic peptide
  Seed: RELFPPLFMA (PRAME_HUMAN)
RGLFPPLFMM

SEQ ID NO: 151350 - protein, 9 aa, Artificial Sequence
  Description of Artificial Sequence: Synthetic peptide
  Seed: MINLRRLLL (PRAME_HUMAN)
MMNLRRLLY

SEQ ID NO: 151351 - protein, 10 aa, Artificial Sequence
  Description of Artificial Sequence: Synthetic peptide
  Seed: MVQAWPFTCL (PRAME_HUMAN)
MKQAWPFTCV

SEQ ID NO: 151352 - protein, 9 aa, Artificial Sequence
  Description of Artificial Sequence: Synthetic peptide
  Seed: VLDGLDVLL (PRAME_HUMAN)
VVDGLDVLY

SEQ ID NO: 151353 - protein, 10 aa, Artificial Sequence
  Description of Artificial Sequence: Synthetic peptide
  Seed: RASATLQDLV (PRAME_HUMAN)
RHSATLQDLF

SEQ ID NO: 151354 - protein, 9 aa, Artificial Sequence
  Description of Artificial Sequence: Synthetic peptide
  Seed: GQHLHLETF (PRAME_HUMAN)
GTHLHLETL

SEQ ID NO: 151355 - protein, 9 aa, Artificial Sequence
  Description of Artificial Sequence: Synthetic peptide
  Seed: LSVLSLSGV (PRAME_HUMAN)
LSVLSLSGW

SEQ ID NO: 151356 - protein, 10 aa, Artificial Sequence
  Description of Artificial Sequence: Synthetic peptide
  Seed: VLYPVPLESY (PRAME_HUMAN)
VFYPVPLESY

SEQ ID NO: 151357 - protein, 10 aa, Artificial Sequence
  Description of Artificial Sequence: Synthetic peptide
  Seed: LSFYGNSISI (PRAME_HUMAN)
LWFYGNSISY

SEQ ID NO: 151358 - protein, 10 aa, Artificial Sequence
  Description of Artificial Sequence: Synthetic peptide
  Seed: KDEALAIAAL (PRAME_HUMAN)
KTEALAIAAL

SEQ ID NO: 151359 - protein, 9 aa, Artificial Sequence
  Description of Artificial Sequence: Synthetic peptide
  Seed: HVMNPLETL (PRAME_HUMAN)
HNMNPLETY

SEQ ID NO: 151360 - protein, 10 aa, Artificial Sequence
  Description of Artificial Sequence: Synthetic peptide
  Seed: DQLLALLPSL (PRAME_HUMAN)
DILLALLPSL

SEQ ID NO: 151361 - protein, 9 aa, Artificial Sequence
  Description of Artificial Sequence: Synthetic peptide
  Seed: LALLPSLSH (PRAME_HUMAN)
LLLLPSLSF

SEQ ID NO: 151362 - protein, 9 aa, Artificial Sequence
  Description of Artificial Sequence: Synthetic peptide
  Seed: RTFYDPEPI (PRAME_HUMAN)
RMFYDPEPM

SEQ ID NO: 151363 - protein, 9 aa, Artificial Sequence
  Description of Artificial Sequence: Synthetic peptide
  Seed: LLKDEALAI (PRAME_HUMAN)
LIKDEALAL

SEQ ID NO: 151364 - protein, 8 aa, Artificial Sequence
  Description of Artificial Sequence: Synthetic peptide
  Seed: TDDQLLAL (PRAME_HUMAN)
TADQLLAL

SEQ ID NO: 151365 - protein, 9 aa, Artificial Sequence
  Description of Artificial Sequence: Synthetic peptide
  Seed: YIAQFTSQF (PRAME_HUMAN)
YQAQFTSQR

SEQ ID NO: 151366 - protein, 9 aa, Artificial Sequence
  Description of Artificial Sequence: Synthetic peptide
  Seed: SYLIEKVKR (PRAME_HUMAN)
STLIEKVKR

SEQ ID NO: 151367 - protein, 11 aa, Artificial Sequence
  Description of Artificial Sequence: Synthetic peptide
  Seed: KMVQLDSIEDL (PRAME_HUMAN)
KQVQLDSIEDF

SEQ ID NO: 151368 - protein, 10 aa, Artificial Sequence
  Description of Artificial Sequence: Synthetic peptide
  Seed: KDEALAIAAL (PRAME_HUMAN)
KPEALAIAAA

SEQ ID NO: 151369 - protein, 10 aa, Artificial Sequence
  Description of Artificial Sequence: Synthetic peptide
  Seed: SALQSLLQHL (PRAME_HUMAN)
SLLQSLLQHA

SEQ ID NO: 151370 - protein, 9 aa, Artificial Sequence
  Description of Artificial Sequence: Synthetic peptide
  Seed: AAFDGRHSQ (PRAME_HUMAN)
AVFDGRHSI

SEQ ID NO: 151371 - protein, 9 aa, Artificial Sequence
  Description of Artificial Sequence: Synthetic peptide
  Seed: SQLSVLSLS (PRAME_HUMAN)
SSLSVLSLV

SEQ ID NO: 151372 - protein, 10 aa, Artificial Sequence
  Description of Artificial Sequence: Synthetic peptide
  Seed: KEEQYIAQFT (PRAME_HUMAN)
KEEQYIAQFI

SEQ ID NO: 151373 - protein, 9 aa, Artificial Sequence
  Description of Artificial Sequence: Synthetic peptide
  Seed: KLKIFAMPM (PRAME_HUMAN)
KVKIFAMPR

SEQ ID NO: 151374 - protein, 11 aa, Artificial Sequence
  Description of Artificial Sequence: Synthetic peptide
  Seed: QALYVDSLFFL (PRAME_HUMAN)
QKLYVDSLFFF

SEQ ID NO: 151375 - protein, 9 aa, Artificial Sequence
  Description of Artificial Sequence: Synthetic peptide
  Seed: SALQSLLQH (PRAME_HUMAN)
STLQSLLQH

SEQ ID NO: 151376 - protein, 9 aa, Artificial Sequence
  Description of Artificial Sequence: Synthetic peptide
  Seed: NLTHVLYPV (PRAME_HUMAN)
NTTHVLYPI

SEQ ID NO: 151377 - protein, 9 aa, Artificial Sequence
  Description of Artificial Sequence: Synthetic peptide
  Seed: VLSLSGVML (PRAME_HUMAN)
VASLSGVMY

SEQ ID NO: 151378 - protein, 9 aa, Artificial Sequence
  Description of Artificial Sequence: Synthetic peptide
  Seed: AAFDGRHSQ (PRAME_HUMAN)
AAFDGRHSV

SEQ ID NO: 151379 - protein, 10 aa, Artificial Sequence
  Description of Artificial Sequence: Synthetic peptide
  Seed: LSHIHASSYI (PRAME_HUMAN)
LAHIHASSYF

SEQ ID NO: 151380 - protein, 8 aa, Artificial Sequence
  Description of Artificial Sequence: Synthetic peptide
  Seed: AQFTSQFL (PRAME_HUMAN)
AMFTSQFF

SEQ ID NO: 151381 - protein, 10 aa, Artificial Sequence
  Description of Artificial Sequence: Synthetic peptide
  Seed: LLPRELFPPL (PRAME_HUMAN)
LIPRELFPPL

SEQ ID NO: 151382 - protein, 9 aa, Artificial Sequence
  Description of Artificial Sequence: Synthetic peptide
  Seed: SIQSRYISM (PRAME_HUMAN)
SSQSRYISI

SEQ ID NO: 151383 - protein, 9 aa, Artificial Sequence
  Description of Artificial Sequence: Synthetic peptide
  Seed: GQHLHLETF (PRAME_HUMAN)
GMHLHLETI

SEQ ID NO: 151384 - protein, 9 aa, Artificial Sequence
  Description of Artificial Sequence: Synthetic peptide
  Seed: YLHARLREL (PRAME_HUMAN)
YPHARLREL

SEQ ID NO: 151385 - protein, 9 aa, Artificial Sequence
  Description of Artificial Sequence: Synthetic peptide
  Seed: YGNSISISA (PRAME_HUMAN)
YLNSISISM

SEQ ID NO: 151386 - protein, 9 aa, Artificial Sequence
  Description of Artificial Sequence: Synthetic peptide
  Seed: AFDGRHSQT (PRAME_HUMAN)
AYDGRHSQV

SEQ ID NO: 151387 - protein, 10 aa, Artificial Sequence
  Description of Artificial Sequence: Synthetic peptide
  Seed: SALQSLLQHL (PRAME_HUMAN)
SLLQSLLQHL

SEQ ID NO: 151388 - protein, 10 aa, Artificial Sequence
  Description of Artificial Sequence: Synthetic peptide
  Seed: MVQAWPFTCL (PRAME_HUMAN)
MNQAWPFTCV

SEQ ID NO: 151389 - protein, 9 aa, Artificial Sequence
  Description of Artificial Sequence: Synthetic peptide
  Seed: ALQSLLQHL (PRAME_HUMAN)
AQQSLLQHL

SEQ ID NO: 151390 - protein, 10 aa, Artificial Sequence
  Description of Artificial Sequence: Synthetic peptide
  Seed: RLDQLLRHVM (PRAME_HUMAN)
RQDQLLRHVV

SEQ ID NO: 151391 - protein, 9 aa, Artificial Sequence
  Description of Artificial Sequence: Synthetic peptide
  Seed: FLRGRLDQL (PRAME_HUMAN)
FFRGRLDQY

SEQ ID NO: 151392 - protein, 10 aa, Artificial Sequence
  Description of Artificial Sequence: Synthetic peptide
  Seed: RLWGSIQSRY (PRAME_HUMAN)
RTWGSIQSRK

SEQ ID NO: 151393 - protein, 10 aa, Artificial Sequence
  Description of Artificial Sequence: Synthetic peptide
  Seed: YLGQMINLRR (PRAME_HUMAN)
YFGQMINLRR

SEQ ID NO: 151394 - protein, 9 aa, Artificial Sequence
  Description of Artificial Sequence: Synthetic peptide
  Seed: SISALQSLL (PRAME_HUMAN)
SLSALQSLY

SEQ ID NO: 151395 - protein, 11 aa, Artificial Sequence
  Description of Artificial Sequence: Synthetic peptide
  Seed: IAQFTSQFLSL (PRAME_HUMAN)
IYQFTSQFLSM

SEQ ID NO: 151396 - protein, 10 aa, Artificial Sequence
  Description of Artificial Sequence: Synthetic peptide
  Seed: FLSLQCLQAL (PRAME_HUMAN)
FMSLQCLQAV

SEQ ID NO: 151397 - protein, 10 aa, Artificial Sequence
  Description of Artificial Sequence: Synthetic peptide
  Seed: RGRLDQLLRH (PRAME_HUMAN)
RQRLDQLLRK

SEQ ID NO: 151398 - protein, 10 aa, Artificial Sequence
  Description of Artificial Sequence: Synthetic peptide
  Seed: VLYPVPLESY (PRAME_HUMAN)
VRYPVPLESL

SEQ ID NO: 151399 - protein, 9 aa, Artificial Sequence
  Description of Artificial Sequence: Synthetic peptide
  Seed: ASATLQDLV (PRAME_HUMAN)
AMATLQDLV

SEQ ID NO: 151400 - protein, 9 aa, Artificial Sequence
  Description of Artificial Sequence: Synthetic peptide
  Seed: KDEALAIAA (PRAME_HUMAN)
KEEALAIAL

SEQ ID NO: 151401 - protein, 9 aa, Artificial Sequence
  Description of Artificial Sequence: Synthetic peptide
  Seed: ITDDQLLAL (PRAME_HUMAN)
IFDDQLLAA

SEQ ID NO: 151402 - protein, 9 aa, Artificial Sequence
  Description of Artificial Sequence: Synthetic peptide
  Seed: ISISALQSL (PRAME_HUMAN)
IWISALQSM

SEQ ID NO: 151403 - protein, 9 aa, Artificial Sequence
  Description of Artificial Sequence: Synthetic peptide
  Seed: YGNSISISA (PRAME_HUMAN)
YANSISISV

SEQ ID NO: 151404 - protein, 9 aa, Artificial Sequence
  Description of Artificial Sequence: Synthetic peptide
  Seed: HVMNPLETL (PRAME_HUMAN)
HQMNPLETI

SEQ ID NO: 151405 - protein, 9 aa, Artificial Sequence
  Description of Artificial Sequence: Synthetic peptide
  Seed: LHLERLAYL (PRAME_HUMAN)
LFLERLAYM

SEQ ID NO: 151406 - protein, 9 aa, Artificial Sequence
  Description of Artificial Sequence: Synthetic peptide
  Seed: YSFPEPEAA (PRAME_HUMAN)
YNFPEPEAV

SEQ ID NO: 151407 - protein, 10 aa, Artificial Sequence
  Description of Artificial Sequence: Synthetic peptide
  Seed: RLWGSIQSRY (PRAME_HUMAN)
RAWGSIQSRY

SEQ ID NO: 151408 - protein, 10 aa, Artificial Sequence
  Description of Artificial Sequence: Synthetic peptide
  Seed: MSVWTSPRRL (PRAME_HUMAN)
MTVWTSPRRF

SEQ ID NO: 151409 - protein, 9 aa, Artificial Sequence
  Description of Artificial Sequence: Synthetic peptide
  Seed: RLCCKKLKI (PRAME_HUMAN)
RVCCKKLKW

SEQ ID NO: 151410 - protein, 9 aa, Artificial Sequence
  Description of Artificial Sequence: Synthetic peptide
  Seed: KVDGLSTEA (PRAME_HUMAN)
KADGLSTEI

SEQ ID NO: 151411 - protein, 10 aa, Artificial Sequence
  Description of Artificial Sequence: Synthetic peptide
  Seed: SPYLGQMINL (PRAME_HUMAN)
SGYLGQMINI

SEQ ID NO: 151412 - protein, 9 aa, Artificial Sequence
  Description of Artificial Sequence: Synthetic peptide
  Seed: VLDGLDVLL (PRAME_HUMAN)
VLDGLDVLM

SEQ ID NO: 151413 - protein, 11 aa, Artificial Sequence
  Description of Artificial Sequence: Synthetic peptide
  Seed: VQLDSIEDLEV (PRAME_HUMAN)
VMLDSIEDLEF

SEQ ID NO: 151414 - protein, 11 aa, Artificial Sequence
  Description of Artificial Sequence: Synthetic peptide
  Seed: FLSLQCLQALY (PRAME_HUMAN)
FLSLQCLQALA

SEQ ID NO: 151415 - protein, 9 aa, Artificial Sequence
  Description of Artificial Sequence: Synthetic peptide
  Seed: ALLPSLSHC (PRAME_HUMAN)
ASLPSLSHV

SEQ ID NO: 151416 - protein, 9 aa, Artificial Sequence
  Description of Artificial Sequence: Synthetic peptide
  Seed: YLHARLREL (PRAME_HUMAN)
YLHARLREY

SEQ ID NO: 151417 - protein, 9 aa, Artificial Sequence
  Description of Artificial Sequence: Synthetic peptide
  Seed: TEAEQPFIP (PRAME_HUMAN)
TEAEQPFIT

SEQ ID NO: 151418 - protein, 9 aa, Artificial Sequence
  Description of Artificial Sequence: Synthetic peptide
  Seed: WLSANPCPH (PRAME_HUMAN)
WASANPCPY

SEQ ID NO: 151419 - protein, 8 aa, Artificial Sequence
  Description of Artificial Sequence: Synthetic peptide
  Seed: FYDPEPIL (PRAME_HUMAN)
FYDPEPIM

SEQ ID NO: 151420 - protein, 9 aa, Artificial Sequence
  Description of Artificial Sequence: Synthetic peptide
  Seed: YIAQFTSQF (PRAME_HUMAN)
YPAQFTSQL

SEQ ID NO: 151421 - protein, 10 aa, Artificial Sequence
  Description of Artificial Sequence: Synthetic peptide
  Seed: ESYEDIHGTL (PRAME_HUMAN)
ETYEDIHGTV

SEQ ID NO: 151422 - protein, 10 aa, Artificial Sequence
  Description of Artificial Sequence: Synthetic peptide
  Seed: RLVELAGQSL (PRAME_HUMAN)
RQVELAGQSY

SEQ ID NO: 151423 - protein, 10 aa, Artificial Sequence
  Description of Artificial Sequence: Synthetic peptide
  Seed: RLWGSIQSRY (PRAME_HUMAN)
RIWGSIQSRF

SEQ ID NO: 151424 - protein, 9 aa, Artificial Sequence
  Description of Artificial Sequence: Synthetic peptide
  Seed: GQSLLKDEA (PRAME_HUMAN)
GESLLKDEI

SEQ ID NO: 151425 - protein, 11 aa, Artificial Sequence
  Description of Artificial Sequence: Synthetic peptide
  Seed: FLSLQCLQALY (PRAME_HUMAN)
FMSLQCLQALA

SEQ ID NO: 151426 - protein, 9 aa, Artificial Sequence
  Description of Artificial Sequence: Synthetic peptide
  Seed: CSQLTTLSF (PRAME_HUMAN)
CLQLTTLSY

SEQ ID NO: 151427 - protein, 10 aa, Artificial Sequence
  Description of Artificial Sequence: Synthetic peptide
  Seed: FLSLQCLQAL (PRAME_HUMAN)
FLSLQCLQAA

SEQ ID NO: 151428 - protein, 9 aa, Artificial Sequence
  Description of Artificial Sequence: Synthetic peptide
  Seed: GACDELFSY (PRAME_HUMAN)
GKCDELFSY

SEQ ID NO: 151429 - protein, 10 aa, Artificial Sequence
  Description of Artificial Sequence: Synthetic peptide
  Seed: RGRLDQLLRH (PRAME_HUMAN)
RSRLDQLLRK

SEQ ID NO: 151430 - protein, 10 aa, Artificial Sequence
  Description of Artificial Sequence: Synthetic peptide
  Seed: YSFPEPEAAQ (PRAME_HUMAN)
YAFPEPEAAL

SEQ ID NO: 151431 - protein, 10 aa, Artificial Sequence
  Description of Artificial Sequence: Synthetic peptide
  Seed: LFPPLFMAAF (PRAME_HUMAN)
LPPPLFMAAY

SEQ ID NO: 151432 - protein, 9 aa, Artificial Sequence
  Description of Artificial Sequence: Synthetic peptide
  Seed: ISPEKEEQY (PRAME_HUMAN)
IWPEKEEQL

SEQ ID NO: 151433 - protein, 11 aa, Artificial Sequence
  Description of Artificial Sequence: Synthetic peptide
  Seed: CRLSEGDVMHL (PRAME_HUMAN)
CMLSEGDVMHV

SEQ ID NO: 151434 - protein, 9 aa, Artificial Sequence
  Description of Artificial Sequence: Synthetic peptide
  Seed: RLAYLHARL (PRAME_HUMAN)
RMAYLHARM

SEQ ID NO: 151435 - protein, 9 aa, Artificial Sequence
  Description of Artificial Sequence: Synthetic peptide
  Seed: LTDVSPEPL (PRAME_HUMAN)
LSDVSPEPV

SEQ ID NO: 151436 - protein, 8 aa, Artificial Sequence
  Description of Artificial Sequence: Synthetic peptide
  Seed: YEDIHGTL (PRAME_HUMAN)
YNDIHGTL

SEQ ID NO: 151437 - protein, 10 aa, Artificial Sequence
  Description of Artificial Sequence: Synthetic peptide
  Seed: MPMQDIKMIL (PRAME_HUMAN)
MSMQDIKMIY

SEQ ID NO: 151438 - protein, 9 aa, Artificial Sequence
  Description of Artificial Sequence: Synthetic peptide
  Seed: QSRYISMSV (PRAME_HUMAN)
QARYISMSL

SEQ ID NO: 151439 - protein, 9 aa, Artificial Sequence
  Description of Artificial Sequence: Synthetic peptide
  Seed: SLLQHLIGL (PRAME_HUMAN)
SILQHLIGY

SEQ ID NO: 151440 - protein, 9 aa, Artificial Sequence
  Description of Artificial Sequence: Synthetic peptide
  Seed: FLRGRLDQL (PRAME_HUMAN)
FRRGRLDQL

SEQ ID NO: 151441 - protein, 9 aa, Artificial Sequence
  Description of Artificial Sequence: Synthetic peptide
  Seed: MHLSQSPSV (PRAME_HUMAN)
MLLSQSPSM

SEQ ID NO: 151442 - protein, 9 aa, Artificial Sequence
  Description of Artificial Sequence: Synthetic peptide
  Seed: ASATLQDLV (PRAME_HUMAN)
AIATLQDLW

SEQ ID NO: 151443 - protein, 9 aa, Artificial Sequence
  Description of Artificial Sequence: Synthetic peptide
  Seed: QSLLKDEAL (PRAME_HUMAN)
QQLLKDEAY

SEQ ID NO: 151444 - protein, 9 aa, Artificial Sequence
  Description of Artificial Sequence: Synthetic peptide
  Seed: YLIEKVKRK (PRAME_HUMAN)
YLIEKVKRV

SEQ ID NO: 151445 - protein, 10 aa, Artificial Sequence
  Description of Artificial Sequence: Synthetic peptide
  Seed: LSHIHASSYI (PRAME_HUMAN)
LSHIHASSYL

SEQ ID NO: 151446 - protein, 9 aa, Artificial Sequence
  Description of Artificial Sequence: Synthetic peptide
  Seed: RLCCKKLKI (PRAME_HUMAN)
RTCCKKLKF

SEQ ID NO: 151447 - protein, 9 aa, Artificial Sequence
  Description of Artificial Sequence: Synthetic peptide
  Seed: WPFTCLPLG (PRAME_HUMAN)
WAFTCLPLM

SEQ ID NO: 151448 - protein, 10 aa, Artificial Sequence
  Description of Artificial Sequence: Synthetic peptide
  Seed: SVSQLSVLSL (PRAME_HUMAN)
SMSQLSVLSL

SEQ ID NO: 151449 - protein, 9 aa, Artificial Sequence
  Description of Artificial Sequence: Synthetic peptide
  Seed: LSVLSLSGV (PRAME_HUMAN)
LMVLSLSGM

SEQ ID NO: 151450 - protein, 9 aa, Artificial Sequence
  Description of Artificial Sequence: Synthetic peptide
  Seed: RGRLDQLLR (PRAME_HUMAN)
RMRLDQLLA

SEQ ID NO: 151451 - protein, 9 aa, Artificial Sequence
  Description of Artificial Sequence: Synthetic peptide
  Seed: IAQFTSQFL (PRAME_HUMAN)
IVQFTSQFV

SEQ ID NO: 151452 - protein, 10 aa, Artificial Sequence
  Description of Artificial Sequence: Synthetic peptide
  Seed: SQLTTLSFYG (PRAME_HUMAN)
SMLTTLSFYF

SEQ ID NO: 151453 - protein, 9 aa, Artificial Sequence
  Description of Artificial Sequence: Synthetic peptide
  Seed: VLYPVPLES (PRAME_HUMAN)
VAYPVPLEL

SEQ ID NO: 151454 - protein, 9 aa, Artificial Sequence
  Description of Artificial Sequence: Synthetic peptide
  Seed: RLWGSIQSR (PRAME_HUMAN)
RFWGSIQSK

SEQ ID NO: 151455 - protein, 9 aa, Artificial Sequence
  Description of Artificial Sequence: Synthetic peptide
  Seed: RHSQTLKAM (PRAME_HUMAN)
RQSQTLKAH

SEQ ID NO: 151456 - protein, 9 aa, Artificial Sequence
  Description of Artificial Sequence: Synthetic peptide
  Seed: YIAQFTSQF (PRAME_HUMAN)
YGAQFTSQM

SEQ ID NO: 151457 - protein, 10 aa, Artificial Sequence
  Description of Artificial Sequence: Synthetic peptide
  Seed: ELFPPLFMAA (PRAME_HUMAN)
EVFPPLFMAV

SEQ ID NO: 151458 - protein, 9 aa, Artificial Sequence
  Description of Artificial Sequence: Synthetic peptide
  Seed: FMAAFDGRH (PRAME_HUMAN)
FMAAFDGRF

SEQ ID NO: 151459 - protein, 10 aa, Artificial Sequence
  Description of Artificial Sequence: Synthetic peptide
  Seed: RGRLDQLLRH (PRAME_HUMAN)
RYRLDQLLRL

SEQ ID NO: 151460 - protein, 11 aa, Artificial Sequence
  Description of Artificial Sequence: Synthetic peptide
  Seed: QALYVDSLFFL (PRAME_HUMAN)
QGLYVDSLFFL

SEQ ID NO: 151461 - protein, 10 aa, Artificial Sequence
  Description of Artificial Sequence: Synthetic peptide
  Seed: DQLLALLPSL (PRAME_HUMAN)
DALLALLPSV

SEQ ID NO: 151462 - protein, 9 aa, Artificial Sequence
  Description of Artificial Sequence: Synthetic peptide
  Seed: VLMKGQHLH (PRAME_HUMAN)
VAMKGQHLF

SEQ ID NO: 151463 - protein, 10 aa, Artificial Sequence
  Description of Artificial Sequence: Synthetic peptide
  Seed: RLRELLCELG (PRAME_HUMAN)
RMRELLCELI

SEQ ID NO: 151464 - protein, 10 aa, Artificial Sequence
  Description of Artificial Sequence: Synthetic peptide
  Seed: KGQHLHLETF (PRAME_HUMAN)
KAQHLHLETY

SEQ ID NO: 151465 - protein, 9 aa, Artificial Sequence
  Description of Artificial Sequence: Synthetic peptide
  Seed: FLRGRLDQL (PRAME_HUMAN)
FPRGRLDQM

SEQ ID NO: 151466 - protein, 10 aa, Artificial Sequence
  Description of Artificial Sequence: Synthetic peptide
  Seed: GITDDQLLAL (PRAME_HUMAN)
GQTDDQLLAL

SEQ ID NO: 151467 - protein, 9 aa, Artificial Sequence
  Description of Artificial Sequence: Synthetic peptide
  Seed: TLHLERLAY (PRAME_HUMAN)
TLHLERLAF

SEQ ID NO: 151468 - protein, 10 aa, Artificial Sequence
  Description of Artificial Sequence: Synthetic peptide
  Seed: YIAQFTSQFL (PRAME_HUMAN)
YMAQFTSQFA

SEQ ID NO: 151469 - protein, 11 aa, Artificial Sequence
  Description of Artificial Sequence: Synthetic peptide
  Seed: YPVPLESYEDI (PRAME_HUMAN)
YPVPLESYEDW

SEQ ID NO: 151470 - protein, 9 aa, Artificial Sequence
  Description of Artificial Sequence: Synthetic peptide
  Seed: LMKGQHLHL (PRAME_HUMAN)
LAKGQHLHK

SEQ ID NO: 151471 - protein, 9 aa, Artificial Sequence
  Description of Artificial Sequence: Synthetic peptide
  Seed: FTCLPLGVL (PRAME_HUMAN)
FSCLPLGVM

SEQ ID NO: 151472 - protein, 8 aa, Artificial Sequence
  Description of Artificial Sequence: Synthetic peptide
  Seed: TDDQLLAL (PRAME_HUMAN)
TVDQLLAM

SEQ ID NO: 151473 - protein, 10 aa, Artificial Sequence
  Description of Artificial Sequence: Synthetic peptide
  Seed: SNLTHVLYPV (PRAME_HUMAN)
SPLTHVLYPV

SEQ ID NO: 151474 - protein, 9 aa, Artificial Sequence
  Description of Artificial Sequence: Synthetic peptide
  Seed: RRLWGSIQS (PRAME_HUMAN)
RQLWGSIQV

SEQ ID NO: 151475 - protein, 10 aa, Artificial Sequence
  Description of Artificial Sequence: Synthetic peptide
  Seed: LSVLSLSGVM (PRAME_HUMAN)
LKVLSLSGVM

SEQ ID NO: 151476 - protein, 9 aa, Artificial Sequence
  Description of Artificial Sequence: Synthetic peptide
  Seed: KFSPYLGQM (PRAME_HUMAN)
KRSPYLGQM

SEQ ID NO: 151477 - protein, 9 aa, Artificial Sequence
  Description of Artificial Sequence: Synthetic peptide
  Seed: MVQAWPFTC (PRAME_HUMAN)
MIQAWPFTT

SEQ ID NO: 151478 - protein, 9 aa, Artificial Sequence
  Description of Artificial Sequence: Synthetic peptide
  Seed: LSANPCPHC (PRAME_HUMAN)
LVANPCPHW

SEQ ID NO: 151479 - protein, 11 aa, Artificial Sequence
  Description of Artificial Sequence: Synthetic peptide
  Seed: ALYVDSLFFLR (PRAME_HUMAN)
ALYVDSLFFLW

SEQ ID NO: 151480 - protein, 9 aa, Artificial Sequence
  Description of Artificial Sequence: Synthetic peptide
  Seed: LMKGQHLHL (PRAME_HUMAN)
LMKGQHLHK

SEQ ID NO: 151481 - protein, 9 aa, Artificial Sequence
  Description of Artificial Sequence: Synthetic peptide
  Seed: MNPLETLSI (PRAME_HUMAN)
MAPLETLSY

SEQ ID NO: 151482 - protein, 11 aa, Artificial Sequence
  Description of Artificial Sequence: Synthetic peptide
  Seed: IAQFTSQFLSL (PRAME_HUMAN)
IVQFTSQFLSY

SEQ ID NO: 151483 - protein, 8 aa, Artificial Sequence
  Description of Artificial Sequence: Synthetic peptide
  Seed: TDDQLLAL (PRAME_HUMAN)
TLDQLLAM

SEQ ID NO: 151484 - protein, 9 aa, Artificial Sequence
  Description of Artificial Sequence: Synthetic peptide
  Seed: TCLPLGVLM (PRAME_HUMAN)
TSLPLGVLM

SEQ ID NO: 151485 - protein, 10 aa, Artificial Sequence
  Description of Artificial Sequence: Synthetic peptide
  Seed: YEDIHGTLHL (PRAME_HUMAN)
YSDIHGTLHM

SEQ ID NO: 151486 - protein, 9 aa, Artificial Sequence
  Description of Artificial Sequence: Synthetic peptide
  Seed: IAQFTSQFL (PRAME_HUMAN)
IQQFTSQFV

SEQ ID NO: 151487 - protein, 10 aa, Artificial Sequence
  Description of Artificial Sequence: Synthetic peptide
  Seed: ESYEDIHGTL (PRAME_HUMAN)
ETYEDIHGTI

SEQ ID NO: 151488 - protein, 10 aa, Artificial Sequence
  Description of Artificial Sequence: Synthetic peptide
  Seed: CSQLTTLSFY (PRAME_HUMAN)
CAQLTTLSFY

SEQ ID NO: 151489 - protein, 9 aa, Artificial Sequence
  Description of Artificial Sequence: Synthetic peptide
  Seed: RASATLQDL (PRAME_HUMAN)
RVSATLQDW

SEQ ID NO: 151490 - protein, 10 aa, Artificial Sequence
  Description of Artificial Sequence: Synthetic peptide
  Seed: AQFTSQFLSL (PRAME_HUMAN)
AKFTSQFLSM

SEQ ID NO: 151491 - protein, 9 aa, Artificial Sequence
  Description of Artificial Sequence: Synthetic peptide
  Seed: KLKIFAMPM (PRAME_HUMAN)
KVKIFAMPS

SEQ ID NO: 151492 - protein, 10 aa, Artificial Sequence
  Description of Artificial Sequence: Synthetic peptide
  Seed: VLYPVPLESY (PRAME_HUMAN)
VTYPVPLESK

SEQ ID NO: 151493 - protein, 9 aa, Artificial Sequence
  Description of Artificial Sequence: Synthetic peptide
  Seed: LLKDEALAI (PRAME_HUMAN)
LMKDEALAV

SEQ ID NO: 151494 - protein, 8 aa, Artificial Sequence
  Description of Artificial Sequence: Synthetic peptide
  Seed: DEALAIAA (PRAME_HUMAN)
DEALAIAY

SEQ ID NO: 151495 - protein, 10 aa, Artificial Sequence
  Description of Artificial Sequence: Synthetic peptide
  Seed: IKMILKMVQL (PRAME_HUMAN)
ITMILKMVQV

SEQ ID NO: 151496 - protein, 10 aa, Artificial Sequence
  Description of Artificial Sequence: Synthetic peptide
  Seed: GQMINLRRLL (PRAME_HUMAN)
GLMINLRRLV

SEQ ID NO: 151497 - protein, 10 aa, Artificial Sequence
  Description of Artificial Sequence: Synthetic peptide
  Seed: PTLAKFSPYL (PRAME_HUMAN)
PGLAKFSPYV

SEQ ID NO: 151498 - protein, 10 aa, Artificial Sequence
  Description of Artificial Sequence: Synthetic peptide
  Seed: RELFPPLFMA (PRAME_HUMAN)
RGLFPPLFML

SEQ ID NO: 151499 - protein, 11 aa, Artificial Sequence
  Description of Artificial Sequence: Synthetic peptide
  Seed: LLSHIHASSYI (PRAME_HUMAN)
LMSHIHASSYV

SEQ ID NO: 151500 - protein, 9 aa, Artificial Sequence
  Description of Artificial Sequence: Synthetic peptide
  Seed: LPRELFPPL (PRAME_HUMAN)
LMRELFPPF

SEQ ID NO: 151501 - protein, 10 aa, Artificial Sequence
  Description of Artificial Sequence: Synthetic peptide
  Seed: LQALYVDSLF (PRAME_HUMAN)
LSALYVDSLY

SEQ ID NO: 151502 - protein, 9 aa, Artificial Sequence
  Description of Artificial Sequence: Synthetic peptide
  Seed: YEDIHGTLH (PRAME_HUMAN)
YLDIHGTLY

SEQ ID NO: 151503 - protein, 10 aa, Artificial Sequence
  Description of Artificial Sequence: Synthetic peptide
  Seed: QYIAQFTSQF (PRAME_HUMAN)
QSIAQFTSQY

SEQ ID NO: 151504 - protein, 11 aa, Artificial Sequence
  Description of Artificial Sequence: Synthetic peptide
  Seed: YISMSVWTSPR (PRAME_HUMAN)
YGSMSVWTSPR

SEQ ID NO: 151505 - protein, 10 aa, Artificial Sequence
  Description of Artificial Sequence: Synthetic peptide
  Seed: IQSRYISMSV (PRAME_HUMAN)
IHSRYISMSY

SEQ ID NO: 151506 - protein, 10 aa, Artificial Sequence
  Description of Artificial Sequence: Synthetic peptide
  Seed: AQFTSQFLSL (PRAME_HUMAN)
ASFTSQFLSY

SEQ ID NO: 151507 - protein, 10 aa, Artificial Sequence
  Description of Artificial Sequence: Synthetic peptide
  Seed: AEQPFIPVEV (PRAME_HUMAN)
AEQPFIPVEY

SEQ ID NO: 151508 - protein, 9 aa, Artificial Sequence
  Description of Artificial Sequence: Synthetic peptide
  Seed: RLRELLCEL (PRAME_HUMAN)
RTRELLCEL

SEQ ID NO: 151509 - protein, 9 aa, Artificial Sequence
  Description of Artificial Sequence: Synthetic peptide
  Seed: ISPEKEEQY (PRAME_HUMAN)
ILPEKEEQM

SEQ ID NO: 151510 - protein, 10 aa, Artificial Sequence
  Description of Artificial Sequence: Synthetic peptide
  Seed: VLYPVPLESY (PRAME_HUMAN)
VQYPVPLESM

SEQ ID NO: 151511 - protein, 9 aa, Artificial Sequence
  Description of Artificial Sequence: Synthetic peptide
  Seed: SQSPSVSQL (PRAME_HUMAN)
SLSPSVSQT

SEQ ID NO: 151512 - protein, 10 aa, Artificial Sequence
  Description of Artificial Sequence: Synthetic peptide
  Seed: IQSRYISMSV (PRAME_HUMAN)
IRSRYISMSI

SEQ ID NO: 151513 - protein, 10 aa, Artificial Sequence
  Description of Artificial Sequence: Synthetic peptide
  Seed: ESYEDIHGTL (PRAME_HUMAN)
EIYEDIHGTF

SEQ ID NO: 151514 - protein, 10 aa, Artificial Sequence
  Description of Artificial Sequence: Synthetic peptide
  Seed: FAMPMQDIKM (PRAME_HUMAN)
FIMPMQDIKA

SEQ ID NO: 151515 - protein, 9 aa, Artificial Sequence
  Description of Artificial Sequence: Synthetic peptide
  Seed: HARLRELLC (PRAME_HUMAN)
HMRLRELLI

SEQ ID NO: 151516 - protein, 11 aa, Artificial Sequence
  Description of Artificial Sequence: Synthetic peptide
  Seed: LLLSHIHASSY (PRAME_HUMAN)
LHLSHIHASSW

SEQ ID NO: 151517 - protein, 9 aa, Artificial Sequence
  Description of Artificial Sequence: Synthetic peptide
  Seed: YLHARLREL (PRAME_HUMAN)
YIHARLREF

SEQ ID NO: 151518 - protein, 11 aa, Artificial Sequence
  Description of Artificial Sequence: Synthetic peptide
  Seed: FYDPEPILCPC (PRAME_HUMAN)
FYDPEPILCPL

SEQ ID NO: 151519 - protein, 9 aa, Artificial Sequence
  Description of Artificial Sequence: Synthetic peptide
  Seed: GLSNLTHVL (PRAME_HUMAN)
GVSNLTHVL

SEQ ID NO: 151520 - protein, 10 aa, Artificial Sequence
  Description of Artificial Sequence: Synthetic peptide
  Seed: FIPVEVLVDL (PRAME_HUMAN)
FMPVEVLVDF

SEQ ID NO: 151521 - protein, 10 aa, Artificial Sequence
  Description of Artificial Sequence: Synthetic peptide
  Seed: LAQEVRPRRW (PRAME_HUMAN)
LVQEVRPRRW

SEQ ID NO: 151522 - protein, 9 aa, Artificial Sequence
  Description of Artificial Sequence: Synthetic peptide
  Seed: SLQCLQALY (PRAME_HUMAN)
SVQCLQALK

SEQ ID NO: 151523 - protein, 9 aa, Artificial Sequence
  Description of Artificial Sequence: Synthetic peptide
  Seed: EAAQPMTKK (PRAME_HUMAN)
EQAQPMTKR

SEQ ID NO: 151524 - protein, 11 aa, Artificial Sequence
  Description of Artificial Sequence: Synthetic peptide
  Seed: AAFDGRHSQTL (PRAME_HUMAN)
AIFDGRHSQTV

SEQ ID NO: 151525 - protein, 10 aa, Artificial Sequence
  Description of Artificial Sequence: Synthetic peptide
  Seed: KKLKIFAMPM (PRAME_HUMAN)
KTLKIFAMPA

SEQ ID NO: 151526 - protein, 9 aa, Artificial Sequence
  Description of Artificial Sequence: Synthetic peptide
  Seed: MINLRRLLL (PRAME_HUMAN)
MMNLRRLLL

SEQ ID NO: 151527 - protein, 9 aa, Artificial Sequence
  Description of Artificial Sequence: Synthetic peptide
  Seed: YSFPEPEAA (PRAME_HUMAN)
YHFPEPEAA

SEQ ID NO: 151528 - protein, 9 aa, Artificial Sequence
  Description of Artificial Sequence: Synthetic peptide
  Seed: RELFPPLFM (PRAME_HUMAN)
RMLFPPLFY

SEQ ID NO: 151529 - protein, 10 aa, Artificial Sequence
  Description of Artificial Sequence: Synthetic peptide
  Seed: TLHLERLAYL (PRAME_HUMAN)
TMHLERLAYM

SEQ ID NO: 151530 - protein, 9 aa, Artificial Sequence
  Description of Artificial Sequence: Synthetic peptide
  Seed: THVLYPVPL (PRAME_HUMAN)
TYVLYPVPL

SEQ ID NO: 151531 - protein, 10 aa, Artificial Sequence
  Description of Artificial Sequence: Synthetic peptide
  Seed: VLYPVPLESY (PRAME_HUMAN)
VWYPVPLESY

SEQ ID NO: 151532 - protein, 10 aa, Artificial Sequence
  Description of Artificial Sequence: Synthetic peptide
  Seed: KDEALAIAAL (PRAME_HUMAN)
KEEALAIAAM

SEQ ID NO: 151533 - protein, 9 aa, Artificial Sequence
  Description of Artificial Sequence: Synthetic peptide
  Seed: WPFTCLPLG (PRAME_HUMAN)
WAFTCLPLY

SEQ ID NO: 151534 - protein, 9 aa, Artificial Sequence
  Description of Artificial Sequence: Synthetic peptide
  Seed: RLRELLCEL (PRAME_HUMAN)
RVRELLCEK

SEQ ID NO: 151535 - protein, 9 aa, Artificial Sequence
  Description of Artificial Sequence: Synthetic peptide
  Seed: FSPYLGQMI (PRAME_HUMAN)
FSPYLGQML

SEQ ID NO: 151536 - protein, 11 aa, Artificial Sequence
  Description of Artificial Sequence: Synthetic peptide
  Seed: AAFDGRHSQTL (PRAME_HUMAN)
AMFDGRHSQTR

SEQ ID NO: 151537 - protein, 10 aa, Artificial Sequence
  Description of Artificial Sequence: Synthetic peptide
  Seed: ASATLQDLVF (PRAME_HUMAN)
AKATLQDLVW

SEQ ID NO: 151538 - protein, 10 aa, Artificial Sequence
  Description of Artificial Sequence: Synthetic peptide
  Seed: MINLRRLLLS (PRAME_HUMAN)
MLNLRRLLLL

SEQ ID NO: 151539 - protein, 11 aa, Artificial Sequence
  Description of Artificial Sequence: Synthetic peptide
  Seed: HVMNPLETLSI (PRAME_HUMAN)
HQMNPLETLSM

SEQ ID NO: 151540 - protein, 10 aa, Artificial Sequence
  Description of Artificial Sequence: Synthetic peptide
  Seed: KKLKIFAMPM (PRAME_HUMAN)
KHLKIFAMPY

SEQ ID NO: 151541 - protein, 9 aa, Artificial Sequence
  Description of Artificial Sequence: Synthetic peptide
  Seed: ALLPSLSHC (PRAME_HUMAN)
AALPSLSHA

SEQ ID NO: 151542 - protein, 9 aa, Artificial Sequence
  Description of Artificial Sequence: Synthetic peptide
  Seed: KMILKMVQL (PRAME_HUMAN)
KAILKMVQF

SEQ ID NO: 151543 - protein, 11 aa, Artificial Sequence
  Description of Artificial Sequence: Synthetic peptide
  Seed: RLWGSIQSRYI (PRAME_HUMAN)
RMWGSIQSRYF

SEQ ID NO: 151544 - protein, 9 aa, Artificial Sequence
  Description of Artificial Sequence: Synthetic peptide
  Seed: RLRELLCEL (PRAME_HUMAN)
RARELLCEF

SEQ ID NO: 151545 - protein, 10 aa, Artificial Sequence
  Description of Artificial Sequence: Synthetic peptide
  Seed: MVQAWPFTCL (PRAME_HUMAN)
MSQAWPFTCV

SEQ ID NO: 151546 - protein, 10 aa, Artificial Sequence
  Description of Artificial Sequence: Synthetic peptide
  Seed: TFYDPEPILC (PRAME_HUMAN)
TQYDPEPILY

SEQ ID NO: 151547 - protein, 9 aa, Artificial Sequence
  Description of Artificial Sequence: Synthetic peptide
  Seed: VQAWPFTCL (PRAME_HUMAN)
VIAWPFTCI

SEQ ID NO: 151548 - protein, 9 aa, Artificial Sequence
  Description of Artificial Sequence: Synthetic peptide
  Seed: ALYVDSLFF (PRAME_HUMAN)
AKYVDSLFL

SEQ ID NO: 151549 - protein, 11 aa, Artificial Sequence
  Description of Artificial Sequence: Synthetic peptide
  Seed: SNLTHVLYPVP (PRAME_HUMAN)
SMLTHVLYPVF

SEQ ID NO: 151550 - protein, 8 aa, Artificial Sequence
  Description of Artificial Sequence: Synthetic peptide
  Seed: WPFTCLPL (PRAME_HUMAN)
WPFTCLPM

SEQ ID NO: 151551 - protein, 9 aa, Artificial Sequence
  Description of Artificial Sequence: Synthetic peptide
  Seed: QPFIPVEVL (PRAME_HUMAN)
QLFIPVEVF

SEQ ID NO: 151552 - protein, 9 aa, Artificial Sequence
  Description of Artificial Sequence: Synthetic peptide
  Seed: SPEPLQALL (PRAME_HUMAN)
SAEPLQALW

SEQ ID NO: 151553 - protein, 10 aa, Artificial Sequence
  Description of Artificial Sequence: Synthetic peptide
  Seed: KVKRKKNVLR (PRAME_HUMAN)
KIKRKKNVLR

SEQ ID NO: 151554 - protein, 9 aa, Artificial Sequence
  Description of Artificial Sequence: Synthetic peptide
  Seed: VSQLSVLSL (PRAME_HUMAN)
VAQLSVLSV

SEQ ID NO: 151555 - protein, 9 aa, Artificial Sequence
  Description of Artificial Sequence: Synthetic peptide
  Seed: QSRYISMSV (PRAME_HUMAN)
QTRYISMSY

SEQ ID NO: 151556 - protein, 9 aa, Artificial Sequence
  Description of Artificial Sequence: Synthetic peptide
  Seed: ASSYISPEK (PRAME_HUMAN)
ALSYISPER

SEQ ID NO: 151557 - protein, 9 aa, Artificial Sequence
  Description of Artificial Sequence: Synthetic peptide
  Seed: SHIHASSYI (PRAME_HUMAN)
SSIHASSYY

SEQ ID NO: 151558 - protein, 10 aa, Artificial Sequence
  Description of Artificial Sequence: Synthetic peptide
  Seed: SNLTHVLYPV (PRAME_HUMAN)
SSLTHVLYPV

SEQ ID NO: 151559 - protein, 9 aa, Artificial Sequence
  Description of Artificial Sequence: Synthetic peptide
  Seed: LHLETFKAV (PRAME_HUMAN)
LHLETFKAY

SEQ ID NO: 151560 - protein, 10 aa, Artificial Sequence
  Description of Artificial Sequence: Synthetic peptide
  Seed: ALELLPRELF (PRAME_HUMAN)
ARELLPRELW

SEQ ID NO: 151561 - protein, 9 aa, Artificial Sequence
  Description of Artificial Sequence: Synthetic peptide
  Seed: RELLCELGR (PRAME_HUMAN)
RVLLCELGK

SEQ ID NO: 151562 - protein, 9 aa, Artificial Sequence
  Description of Artificial Sequence: Synthetic peptide
  Seed: YLHARLREL (PRAME_HUMAN)
YRHARLREV

SEQ ID NO: 151563 - protein, 10 aa, Artificial Sequence
  Description of Artificial Sequence: Synthetic peptide
  Seed: IGLSNLTHVL (PRAME_HUMAN)
IRLSNLTHVV

SEQ ID NO: 151564 - protein, 9 aa, Artificial Sequence
  Description of Artificial Sequence: Synthetic peptide
  Seed: YIAQFTSQF (PRAME_HUMAN)
YCAQFTSQL

SEQ ID NO: 151565 - protein, 9 aa, Artificial Sequence
  Description of Artificial Sequence: Synthetic peptide
  Seed: SRYISMSVW (PRAME_HUMAN)
SQYISMSVF

SEQ ID NO: 151566 - protein, 9 aa, Artificial Sequence
  Description of Artificial Sequence: Synthetic peptide
  Seed: ASATLQDLV (PRAME_HUMAN)
AQATLQDLL

SEQ ID NO: 151567 - protein, 9 aa, Artificial Sequence
  Description of Artificial Sequence: Synthetic peptide
  Seed: ELFSYLIEK (PRAME_HUMAN)
EAFSYLIEH

SEQ ID NO: 151568 - protein, 11 aa, Artificial Sequence
  Description of Artificial Sequence: Synthetic peptide
  Seed: YISMSVWTSPR (PRAME_HUMAN)
YQSMSVWTSPR

SEQ ID NO: 151569 - protein, 9 aa, Artificial Sequence
  Description of Artificial Sequence: Synthetic peptide
  Seed: KLKIFAMPM (PRAME_HUMAN)
KSKIFAMPN

SEQ ID NO: 151570 - protein, 9 aa, Artificial Sequence
  Description of Artificial Sequence: Synthetic peptide
  Seed: LSHIHASSY (PRAME_HUMAN)
LIHIHASSM

SEQ ID NO: 151571 - protein, 11 aa, Artificial Sequence
  Description of Artificial Sequence: Synthetic peptide
  Seed: QYIAQFTSQFL (PRAME_HUMAN)
QYIAQFTSQFI

SEQ ID NO: 151572 - protein, 9 aa, Artificial Sequence
  Description of Artificial Sequence: Synthetic peptide
  Seed: HVMNPLETL (PRAME_HUMAN)
HDMNPLETI

SEQ ID NO: 151573 - protein, 11 aa, Artificial Sequence
  Description of Artificial Sequence: Synthetic peptide
  Seed: MKGQHLHLETF (PRAME_HUMAN)
MDGQHLHLETY

SEQ ID NO: 151574 - protein, 10 aa, Artificial Sequence
  Description of Artificial Sequence: Synthetic peptide
  Seed: TSQFLSLQCL (PRAME_HUMAN)
TAQFLSLQCY

SEQ ID NO: 151575 - protein, 9 aa, Artificial Sequence
  Description of Artificial Sequence: Synthetic peptide
  Seed: VSPEPLQAL (PRAME_HUMAN)
VGPEPLQAM

SEQ ID NO: 151576 - protein, 9 aa, Artificial Sequence
  Description of Artificial Sequence: Synthetic peptide
  Seed: ACDELFSYL (PRAME_HUMAN)
ARDELFSYM

SEQ ID NO: 151577 - protein, 9 aa, Artificial Sequence
  Description of Artificial Sequence: Synthetic peptide
  Seed: AAFDGRHSQ (PRAME_HUMAN)
ATFDGRHSV

SEQ ID NO: 151578 - protein, 11 aa, Artificial Sequence
  Description of Artificial Sequence: Synthetic peptide
  Seed: SNLTHVLYPVP (PRAME_HUMAN)
SLLTHVLYPVD

SEQ ID NO: 151579 - protein, 10 aa, Artificial Sequence
  Description of Artificial Sequence: Synthetic peptide
  Seed: GSIQSRYISM (PRAME_HUMAN)
GTIQSRYISW

SEQ ID NO: 151580 - protein, 9 aa, Artificial Sequence
  Description of Artificial Sequence: Synthetic peptide
  Seed: RLWGSIQSR (PRAME_HUMAN)
RYWGSIQSY

SEQ ID NO: 151581 - protein, 9 aa, Artificial Sequence
  Description of Artificial Sequence: Synthetic peptide
  Seed: YLHARLREL (PRAME_HUMAN)
YRHARLREL

SEQ ID NO: 151582 - protein, 8 aa, Artificial Sequence
  Description of Artificial Sequence: Synthetic peptide
  Seed: MINLRRLL (PRAME_HUMAN)
MMNLRRLV

SEQ ID NO: 151583 - protein, 9 aa, Artificial Sequence
  Description of Artificial Sequence: Synthetic peptide
  Seed: MQDIKMILK (PRAME_HUMAN)
MTDIKMILM

SEQ ID NO: 151584 - protein, 10 aa, Artificial Sequence
  Description of Artificial Sequence: Synthetic peptide
  Seed: YIAQFTSQFL (PRAME_HUMAN)
YTAQFTSQFY

SEQ ID NO: 151585 - protein, 9 aa, Artificial Sequence
  Description of Artificial Sequence: Synthetic peptide
  Seed: EQPFIPVEV (PRAME_HUMAN)
EVPFIPVEL

SEQ ID NO: 151586 - protein, 10 aa, Artificial Sequence
  Description of Artificial Sequence: Synthetic peptide
  Seed: FIPVEVLVDL (PRAME_HUMAN)
FRPVEVLVDY

SEQ ID NO: 151587 - protein, 10 aa, Artificial Sequence
  Description of Artificial Sequence: Synthetic peptide
  Seed: TEAEQPFIPV (PRAME_HUMAN)
TEAEQPFIPA

SEQ ID NO: 151588 - protein, 10 aa, Artificial Sequence
  Description of Artificial Sequence: Synthetic peptide
  Seed: ELFSYLIEKV (PRAME_HUMAN)
ESFSYLIEKV

SEQ ID NO: 151589 - protein, 9 aa, Artificial Sequence
  Description of Artificial Sequence: Synthetic peptide
  Seed: TSPRRLVEL (PRAME_HUMAN)
TLPRRLVEY

SEQ ID NO: 151590 - protein, 11 aa, Artificial Sequence
  Description of Artificial Sequence: Synthetic peptide
  Seed: RELFPPLFMAA (PRAME_HUMAN)
RLLFPPLFMAV

SEQ ID NO: 151591 - protein, 9 aa, Artificial Sequence
  Description of Artificial Sequence: Synthetic peptide
  Seed: SHIHASSYI (PRAME_HUMAN)
SQIHASSYL

SEQ ID NO: 151592 - protein, 9 aa, Artificial Sequence
  Description of Artificial Sequence: Synthetic peptide
  Seed: AAFDGRHSQ (PRAME_HUMAN)
AGFDGRHSM

SEQ ID NO: 151593 - protein, 10 aa, Artificial Sequence
  Description of Artificial Sequence: Synthetic peptide
  Seed: LLPRELFPPL (PRAME_HUMAN)
LTPRELFPPV

SEQ ID NO: 151594 - protein, 10 aa, Artificial Sequence
  Description of Artificial Sequence: Synthetic peptide
  Seed: ASATLQDLVF (PRAME_HUMAN)
AMATLQDLVY

SEQ ID NO: 151595 - protein, 9 aa, Artificial Sequence
  Description of Artificial Sequence: Synthetic peptide
  Seed: DEALAIAAL (PRAME_HUMAN)
DEALAIAAV

SEQ ID NO: 151596 - protein, 10 aa, Artificial Sequence
  Description of Artificial Sequence: Synthetic peptide
  Seed: KDEALAIAAL (PRAME_HUMAN)
KNEALAIAAL

SEQ ID NO: 151597 - protein, 10 aa, Artificial Sequence
  Description of Artificial Sequence: Synthetic peptide
  Seed: AMVQAWPFTC (PRAME_HUMAN)
AQVQAWPFTV

SEQ ID NO: 151598 - protein, 9 aa, Artificial Sequence
  Description of Artificial Sequence: Synthetic peptide
  Seed: SVLSLSGVM (PRAME_HUMAN)
SSLSLSGVF

SEQ ID NO: 151599 - protein, 10 aa, Artificial Sequence
  Description of Artificial Sequence: Synthetic peptide
  Seed: VLDGLDVLLA (PRAME_HUMAN)
VMDGLDVLLV

SEQ ID NO: 151600 - protein, 10 aa, Artificial Sequence
  Description of Artificial Sequence: Synthetic peptide
  Seed: ARLRELLCEL (PRAME_HUMAN)
AILRELLCEL

SEQ ID NO: 151601 - protein, 9 aa, Artificial Sequence
  Description of Artificial Sequence: Synthetic peptide
  Seed: RLCCKKLKI (PRAME_HUMAN)
RQCCKKLKY

SEQ ID NO: 151602 - protein, 10 aa, Artificial Sequence
  Description of Artificial Sequence: Synthetic peptide
  Seed: LLPRELFPPL (PRAME_HUMAN)
LMPRELFPPA

SEQ ID NO: 151603 - protein, 9 aa, Artificial Sequence
  Description of Artificial Sequence: Synthetic peptide
  Seed: KAMVQAWPF (PRAME_HUMAN)
KYMVQAWPW

SEQ ID NO: 151604 - protein, 10 aa, Artificial Sequence
  Description of Artificial Sequence: Synthetic peptide
  Seed: SALQSLLQHL (PRAME_HUMAN)
SHLQSLLQHV

SEQ ID NO: 151605 - protein, 10 aa, Artificial Sequence
  Description of Artificial Sequence: Synthetic peptide
  Seed: MERRRLWGSI (PRAME_HUMAN)
MARRRLWGSF

SEQ ID NO: 151606 - protein, 9 aa, Artificial Sequence
  Description of Artificial Sequence: Synthetic peptide
  Seed: VELAGQSLL (PRAME_HUMAN)
VQLAGQSLL

SEQ ID NO: 151607 - protein, 9 aa, Artificial Sequence
  Description of Artificial Sequence: Synthetic peptide
  Seed: SFYGNSISI (PRAME_HUMAN)
SWYGNSISI

SEQ ID NO: 151608 - protein, 11 aa, Artificial Sequence
  Description of Artificial Sequence: Synthetic peptide
  Seed: QALYVDSLFFL (PRAME_HUMAN)
QHLYVDSLFFL

SEQ ID NO: 151609 - protein, 9 aa, Artificial Sequence
  Description of Artificial Sequence: Synthetic peptide
  Seed: ITDDQLLAL (PRAME_HUMAN)
IPDDQLLAI

SEQ ID NO: 151610 - protein, 9 aa, Artificial Sequence
  Description of Artificial Sequence: Synthetic peptide
  Seed: SRYISMSVW (PRAME_HUMAN)
SQYISMSVL

SEQ ID NO: 151611 - protein, 9 aa, Artificial Sequence
  Description of Artificial Sequence: Synthetic peptide
  Seed: FPPLFMAAF (PRAME_HUMAN)
FQPLFMAAY

SEQ ID NO: 151612 - protein, 10 aa, Artificial Sequence
  Description of Artificial Sequence: Synthetic peptide
  Seed: LLCELGRPSM (PRAME_HUMAN)
LMCELGRPSY

SEQ ID NO: 151613 - protein, 10 aa, Artificial Sequence
  Description of Artificial Sequence: Synthetic peptide
  Seed: QSRYISMSVW (PRAME_HUMAN)
QTRYISMSVW

SEQ ID NO: 151614 - protein, 9 aa, Artificial Sequence
  Description of Artificial Sequence: Synthetic peptide
  Seed: LSNLTHVLY (PRAME_HUMAN)
LRNLTHVLF

SEQ ID NO: 151615 - protein, 9 aa, Artificial Sequence
  Description of Artificial Sequence: Synthetic peptide
  Seed: VSPEPLQAL (PRAME_HUMAN)
VTPEPLQAY

SEQ ID NO: 151616 - protein, 10 aa, Artificial Sequence
  Description of Artificial Sequence: Synthetic peptide
  Seed: IKMILKMVQL (PRAME_HUMAN)
IKMILKMVQV

SEQ ID NO: 151617 - protein, 9 aa, Artificial Sequence
  Description of Artificial Sequence: Synthetic peptide
  Seed: VLDGLDVLL (PRAME_HUMAN)
VYDGLDVLV

SEQ ID NO: 151618 - protein, 9 aa, Artificial Sequence
  Description of Artificial Sequence: Synthetic peptide
  Seed: KLKIFAMPM (PRAME_HUMAN)
KTKIFAMPW

SEQ ID NO: 151619 - protein, 10 aa, Artificial Sequence
  Description of Artificial Sequence: Synthetic peptide
  Seed: FTCLPLGVLM (PRAME_HUMAN)
FQCLPLGVLV

SEQ ID NO: 151620 - protein, 9 aa, Artificial Sequence
  Description of Artificial Sequence: Synthetic peptide
  Seed: YSFPEPEAA (PRAME_HUMAN)
YVFPEPEAI

SEQ ID NO: 151621 - protein, 10 aa, Artificial Sequence
  Description of Artificial Sequence: Synthetic peptide
  Seed: FIPVEVLVDL (PRAME_HUMAN)
FLPVEVLVDY

SEQ ID NO: 151622 - protein, 9 aa, Artificial Sequence
  Description of Artificial Sequence: Synthetic peptide
  Seed: TFKAVLDGL (PRAME_HUMAN)
TWKAVLDGF

SEQ ID NO: 151623 - protein, 9 aa, Artificial Sequence
  Description of Artificial Sequence: Synthetic peptide
  Seed: QSLLKDEAL (PRAME_HUMAN)
QTLLKDEAW

SEQ ID NO: 151624 - protein, 9 aa, Artificial Sequence
  Description of Artificial Sequence: Synthetic peptide
  Seed: TLAKFSPYL (PRAME_HUMAN)
TVAKFSPYA

SEQ ID NO: 151625 - protein, 9 aa, Artificial Sequence
  Description of Artificial Sequence: Synthetic peptide
  Seed: FMAAFDGRH (PRAME_HUMAN)
FLAAFDGRY

SEQ ID NO: 151626 - protein, 10 aa, Artificial Sequence
  Description of Artificial Sequence: Synthetic peptide
  Seed: RGRLDQLLRH (PRAME_HUMAN)
RHRLDQLLRM

SEQ ID NO: 151627 - protein, 9 aa, Artificial Sequence
  Description of Artificial Sequence: Synthetic peptide
  Seed: SATLQDLVF (PRAME_HUMAN)
SQTLQDLVF

SEQ ID NO: 151628 - protein, 9 aa, Artificial Sequence
  Description of Artificial Sequence: Synthetic peptide
  Seed: AVLDGLDVL (PRAME_HUMAN)
AMLDGLDVF

SEQ ID NO: 151629 - protein, 10 aa, Artificial Sequence
  Description of Artificial Sequence: Synthetic peptide
  Seed: YISPEKEEQY (PRAME_HUMAN)
YQSPEKEEQM

SEQ ID NO: 151630 - protein, 9 aa, Artificial Sequence
  Description of Artificial Sequence: Synthetic peptide
  Seed: CSQLTTLSF (PRAME_HUMAN)
CTQLTTLSW

SEQ ID NO: 151631 - protein, 9 aa, Artificial Sequence
  Description of Artificial Sequence: Synthetic peptide
  Seed: LLRHVMNPL (PRAME_HUMAN)
LLRHVMNPF

SEQ ID NO: 151632 - protein, 10 aa, Artificial Sequence
  Description of Artificial Sequence: Synthetic peptide
  Seed: SMSVWTSPRR (PRAME_HUMAN)
SASVWTSPRK

SEQ ID NO: 151633 - protein, 10 aa, Artificial Sequence
  Description of Artificial Sequence: Synthetic peptide
  Seed: RASATLQDLV (PRAME_HUMAN)
RGSATLQDLF

SEQ ID NO: 151634 - protein, 10 aa, Artificial Sequence
  Description of Artificial Sequence: Synthetic peptide
  Seed: ALYVDSLFFL (PRAME_HUMAN)
AMYVDSLFFR

SEQ ID NO: 151635 - protein, 9 aa, Artificial Sequence
  Description of Artificial Sequence: Synthetic peptide
  Seed: FLRGRLDQL (PRAME_HUMAN)
FLRGRLDQA

SEQ ID NO: 151636 - protein, 9 aa, Artificial Sequence
  Description of Artificial Sequence: Synthetic peptide
  Seed: GLSNLTHVL (PRAME_HUMAN)
GLSNLTHVV

SEQ ID NO: 151637 - protein, 9 aa, Artificial Sequence
  Description of Artificial Sequence: Synthetic peptide
  Seed: RLLLSHIHA (PRAME_HUMAN)
RMLLSHIHK

SEQ ID NO: 151638 - protein, 9 aa, Artificial Sequence
  Description of Artificial Sequence: Synthetic peptide
  Seed: FTCLPLGVL (PRAME_HUMAN)
FSCLPLGVF

SEQ ID NO: 151639 - protein, 10 aa, Artificial Sequence
  Description of Artificial Sequence: Synthetic peptide
  Seed: LSHIHASSYI (PRAME_HUMAN)
LSHIHASSYW

SEQ ID NO: 151640 - protein, 9 aa, Artificial Sequence
  Description of Artificial Sequence: Synthetic peptide
  Seed: VQAWPFTCL (PRAME_HUMAN)
VRAWPFTCF

SEQ ID NO: 151641 - protein, 9 aa, Artificial Sequence
  Description of Artificial Sequence: Synthetic peptide
  Seed: VFDECGITD (PRAME_HUMAN)
VWDECGITY

SEQ ID NO: 151642 - protein, 9 aa, Artificial Sequence
  Description of Artificial Sequence: Synthetic peptide
  Seed: TLHLERLAY (PRAME_HUMAN)
TSHLERLAY

SEQ ID NO: 151643 - protein, 10 aa, Artificial Sequence
  Description of Artificial Sequence: Synthetic peptide
  Seed: IKMILKMVQL (PRAME_HUMAN)
IMMILKMVQA

SEQ ID NO: 151644 - protein, 10 aa, Artificial Sequence
  Description of Artificial Sequence: Synthetic peptide
  Seed: QALYVDSLFF (PRAME_HUMAN)
QTLYVDSLFF

SEQ ID NO: 151645 - protein, 11 aa, Artificial Sequence
  Description of Artificial Sequence: Synthetic peptide
  Seed: RLVELAGQSLL (PRAME_HUMAN)
RVVELAGQSLW

SEQ ID NO: 151646 - protein, 9 aa, Artificial Sequence
  Description of Artificial Sequence: Synthetic peptide
  Seed: LAIAALELL (PRAME_HUMAN)
LLIAALELV

SEQ ID NO: 151647 - protein, 9 aa, Artificial Sequence
  Description of Artificial Sequence: Synthetic peptide
  Seed: CSQLTTLSF (PRAME_HUMAN)
CRQLTTLSF

SEQ ID NO: 151648 - protein, 9 aa, Artificial Sequence
  Description of Artificial Sequence: Synthetic peptide
  Seed: ELFSYLIEK (PRAME_HUMAN)
EYFSYLIER

SEQ ID NO: 151649 - protein, 10 aa, Artificial Sequence
  Description of Artificial Sequence: Synthetic peptide
  Seed: RLAYLHARLR (PRAME_HUMAN)
RCAYLHARLR

SEQ ID NO: 151650 - protein, 9 aa, Artificial Sequence
  Description of Artificial Sequence: Synthetic peptide
  Seed: MVQAWPFTC (PRAME_HUMAN)
MMQAWPFTI

SEQ ID NO: 151651 - protein, 9 aa, Artificial Sequence
  Description of Artificial Sequence: Synthetic peptide
  Seed: RASATLQDL (PRAME_HUMAN)
RTSATLQDL

SEQ ID NO: 151652 - protein, 9 aa, Artificial Sequence
  Description of Artificial Sequence: Synthetic peptide
  Seed: HVMNPLETL (PRAME_HUMAN)
HPMNPLETP

SEQ ID NO: 151653 - protein, 9 aa, Artificial Sequence
  Description of Artificial Sequence: Synthetic peptide
  Seed: ITDDQLLAL (PRAME_HUMAN)
ILDDQLLAF

SEQ ID NO: 151654 - protein, 10 aa, Artificial Sequence
  Description of Artificial Sequence: Synthetic peptide
  Seed: LLCELGRPSM (PRAME_HUMAN)
LMCELGRPSV

SEQ ID NO: 151655 - protein, 9 aa, Artificial Sequence
  Description of Artificial Sequence: Synthetic peptide
  Seed: RLDQLLRHV (PRAME_HUMAN)
RQDQLLRHV

SEQ ID NO: 151656 - protein, 9 aa, Artificial Sequence
  Description of Artificial Sequence: Synthetic peptide
  Seed: SLQCLQALY (PRAME_HUMAN)
SQQCLQALY

SEQ ID NO: 151657 - protein, 9 aa, Artificial Sequence
  Description of Artificial Sequence: Synthetic peptide
  Seed: SFYGNSISI (PRAME_HUMAN)
SSYGNSISY

SEQ ID NO: 151658 - protein, 9 aa, Artificial Sequence
  Description of Artificial Sequence: Synthetic peptide
  Seed: FAMPMQDIK (PRAME_HUMAN)
FVMPMQDIL

SEQ ID NO: 151659 - protein, 9 aa, Artificial Sequence
  Description of Artificial Sequence: Synthetic peptide
  Seed: FPPLFMAAF (PRAME_HUMAN)
FMPLFMAAY

SEQ ID NO: 151660 - protein, 10 aa, Artificial Sequence
  Description of Artificial Sequence: Synthetic peptide
  Seed: PTLAKFSPYL (PRAME_HUMAN)
PQLAKFSPYV

SEQ ID NO: 151661 - protein, 9 aa, Artificial Sequence
  Description of Artificial Sequence: Synthetic peptide
  Seed: LMKGQHLHL (PRAME_HUMAN)
LRKGQHLHF

SEQ ID NO: 151662 - protein, 10 aa, Artificial Sequence
  Description of Artificial Sequence: Synthetic peptide
  Seed: IGLSNLTHVL (PRAME_HUMAN)
ILLSNLTHVP

SEQ ID NO: 151663 - protein, 10 aa, Artificial Sequence
  Description of Artificial Sequence: Synthetic peptide
  Seed: LSHIHASSYI (PRAME_HUMAN)
LTHIHASSYW

SEQ ID NO: 151664 - protein, 9 aa, Artificial Sequence
  Description of Artificial Sequence: Synthetic peptide
  Seed: RRLLLSHIH (PRAME_HUMAN)
RRLLLSHIF

SEQ ID NO: 151665 - protein, 10 aa, Artificial Sequence
  Description of Artificial Sequence: Synthetic peptide
  Seed: RHVMNPLETL (PRAME_HUMAN)
RTVMNPLETY

SEQ ID NO: 151666 - protein, 10 aa, Artificial Sequence
  Description of Artificial Sequence: Synthetic peptide
  Seed: TLAKFSPYLG (PRAME_HUMAN)
TMAKFSPYLI

SEQ ID NO: 151667 - protein, 9 aa, Artificial Sequence
  Description of Artificial Sequence: Synthetic peptide
  Seed: DEALAIAAL (PRAME_HUMAN)
DRALAIAAM

SEQ ID NO: 151668 - protein, 11 aa, Artificial Sequence
  Description of Artificial Sequence: Synthetic peptide
  Seed: RELFPPLFMAA (PRAME_HUMAN)
RYLFPPLFMAL

SEQ ID NO: 151669 - protein, 10 aa, Artificial Sequence
  Description of Artificial Sequence: Synthetic peptide
  Seed: RGRLDQLLRH (PRAME_HUMAN)
RYRLDQLLRK

SEQ ID NO: 151670 - protein, 10 aa, Artificial Sequence
  Description of Artificial Sequence: Synthetic peptide
  Seed: SVSQLSVLSL (PRAME_HUMAN)
STSQLSVLSW

SEQ ID NO: 151671 - protein, 10 aa, Artificial Sequence
  Description of Artificial Sequence: Synthetic peptide
  Seed: DFWTVWSGNR (PRAME_HUMAN)
DTWTVWSGNK

SEQ ID NO: 151672 - protein, 9 aa, Artificial Sequence
  Description of Artificial Sequence: Synthetic peptide
  Seed: FSPYLGQMI (PRAME_HUMAN)
FGPYLGQML

SEQ ID NO: 151673 - protein, 9 aa, Artificial Sequence
  Description of Artificial Sequence: Synthetic peptide
  Seed: YLIEKVKRK (PRAME_HUMAN)
YSIEKVKRR

SEQ ID NO: 151674 - protein, 10 aa, Artificial Sequence
  Description of Artificial Sequence: Synthetic peptide
  Seed: ITDDQLLALL (PRAME_HUMAN)
ISDDQLLALF

SEQ ID NO: 151675 - protein, 10 aa, Artificial Sequence
  Description of Artificial Sequence: Synthetic peptide
  Seed: MVQAWPFTCL (PRAME_HUMAN)
MCQAWPFTCM

SEQ ID NO: 151676 - protein, 10 aa, Artificial Sequence
  Description of Artificial Sequence: Synthetic peptide
  Seed: TLHLERLAYL (PRAME_HUMAN)
TLHLERLAYM

SEQ ID NO: 151677 - protein, 10 aa, Artificial Sequence
  Description of Artificial Sequence: Synthetic peptide
  Seed: YIAQFTSQFL (PRAME_HUMAN)
YKAQFTSQFF

SEQ ID NO: 151678 - protein, 10 aa, Artificial Sequence
  Description of Artificial Sequence: Synthetic peptide
  Seed: RLAYLHARLR (PRAME_HUMAN)
RDAYLHARLK

SEQ ID NO: 151679 - protein, 10 aa, Artificial Sequence
  Description of Artificial Sequence: Synthetic peptide
  Seed: SVSQLSVLSL (PRAME_HUMAN)
SVSQLSVLSF

SEQ ID NO: 151680 - protein, 9 aa, Artificial Sequence
  Description of Artificial Sequence: Synthetic peptide
  Seed: ISISALQSL (PRAME_HUMAN)
IYISALQSI

SEQ ID NO: 151681 - protein, 11 aa, Artificial Sequence
  Description of Artificial Sequence: Synthetic peptide
  Seed: LSLQCLQALYV (PRAME_HUMAN)
LYLQCLQALYV

SEQ ID NO: 151682 - protein, 9 aa, Artificial Sequence
  Description of Artificial Sequence: Synthetic peptide
  Seed: THVLYPVPL (PRAME_HUMAN)
TYVLYPVPI

SEQ ID NO: 151683 - protein, 9 aa, Artificial Sequence
  Description of Artificial Sequence: Synthetic peptide
  Seed: FLRGRLDQL (PRAME_HUMAN)
FYRGRLDQF

SEQ ID NO: 151684 - protein, 10 aa, Artificial Sequence
  Description of Artificial Sequence: Synthetic peptide
  Seed: SPYLGQMINL (PRAME_HUMAN)
SLYLGQMINI

SEQ ID NO: 151685 - protein, 10 aa, Artificial Sequence
  Description of Artificial Sequence: Synthetic peptide
  Seed: LSQSPSVSQL (PRAME_HUMAN)
LVQSPSVSQF

SEQ ID NO: 151686 - protein, 9 aa, Artificial Sequence
  Description of Artificial Sequence: Synthetic peptide
  Seed: DEALAIAAL (PRAME_HUMAN)
DHALAIAAV

SEQ ID NO: 151687 - protein, 9 aa, Artificial Sequence
  Description of Artificial Sequence: Synthetic peptide
  Seed: QDIKMILKM (PRAME_HUMAN)
QDIKMILKF

SEQ ID NO: 151688 - protein, 9 aa, Artificial Sequence
  Description of Artificial Sequence: Synthetic peptide
  Seed: LMKGQHLHL (PRAME_HUMAN)
LTKGQHLHK

SEQ ID NO: 151689 - protein, 10 aa, Artificial Sequence
  Description of Artificial Sequence: Synthetic peptide
  Seed: RASATLQDLV (PRAME_HUMAN)
RLSATLQDLW

SEQ ID NO: 151690 - protein, 9 aa, Artificial Sequence
  Description of Artificial Sequence: Synthetic peptide
  Seed: SFYGNSISI (PRAME_HUMAN)
SQYGNSISH

SEQ ID NO: 151691 - protein, 9 aa, Artificial Sequence
  Description of Artificial Sequence: Synthetic peptide
  Seed: RTFYDPEPI (PRAME_HUMAN)
RIFYDPEPW

SEQ ID NO: 151692 - protein, 9 aa, Artificial Sequence
  Description of Artificial Sequence: Synthetic peptide
  Seed: LTDVSPEPL (PRAME_HUMAN)
LGDVSPEPM

SEQ ID NO: 151693 - protein, 9 aa, Artificial Sequence
  Description of Artificial Sequence: Synthetic peptide
  Seed: LYVDSLFFL (PRAME_HUMAN)
LYVDSLFFI

SEQ ID NO: 151694 - protein, 9 aa, Artificial Sequence
  Description of Artificial Sequence: Synthetic peptide
  Seed: SRYISMSVW (PRAME_HUMAN)
SQYISMSVH

SEQ ID NO: 151695 - protein, 9 aa, Artificial Sequence
  Description of Artificial Sequence: Synthetic peptide
  Seed: LSHIHASSY (PRAME_HUMAN)
LTHIHASSM

SEQ ID NO: 151696 - protein, 11 aa, Artificial Sequence
  Description of Artificial Sequence: Synthetic peptide
  Seed: LPRELFPPLFM (PRAME_HUMAN)
LPRELFPPLFL

SEQ ID NO: 151697 - protein, 9 aa, Artificial Sequence
  Description of Artificial Sequence: Synthetic peptide
  Seed: VFDECGITD (PRAME_HUMAN)
VLDECGITI

SEQ ID NO: 151698 - protein, 8 aa, Artificial Sequence
  Description of Artificial Sequence: Synthetic peptide
  Seed: HARLRELL (PRAME_HUMAN)
HQRLRELL

SEQ ID NO: 151699 - protein, 9 aa, Artificial Sequence
  Description of Artificial Sequence: Synthetic peptide
  Seed: LSHIHASSY (PRAME_HUMAN)
LRHIHASSM

SEQ ID NO: 151700 - protein, 9 aa, Artificial Sequence
  Description of Artificial Sequence: Synthetic peptide
  Seed: AAFDGRHSQ (PRAME_HUMAN)
AAFDGRHSW

SEQ ID NO: 151701 - protein, 9 aa, Artificial Sequence
  Description of Artificial Sequence: Synthetic peptide
  Seed: LSVLSLSGV (PRAME_HUMAN)
LVVLSLSGI

SEQ ID NO: 151702 - protein, 9 aa, Artificial Sequence
  Description of Artificial Sequence: Synthetic peptide
  Seed: SVLSLSGVM (PRAME_HUMAN)
SALSLSGVF

SEQ ID NO: 151703 - protein, 9 aa, Artificial Sequence
  Description of Artificial Sequence: Synthetic peptide
  Seed: SQSPSVSQL (PRAME_HUMAN)
SSSPSVSQY

SEQ ID NO: 151704 - protein, 10 aa, Artificial Sequence
  Description of Artificial Sequence: Synthetic peptide
  Seed: SISISALQSL (PRAME_HUMAN)
STSISALQSY

SEQ ID NO: 151705 - protein, 9 aa, Artificial Sequence
  Description of Artificial Sequence: Synthetic peptide
  Seed: EQPFIPVEV (PRAME_HUMAN)
EEPFIPVEV

SEQ ID NO: 151706 - protein, 10 aa, Artificial Sequence
  Description of Artificial Sequence: Synthetic peptide
  Seed: RLWGSIQSRY (PRAME_HUMAN)
RFWGSIQSRR

SEQ ID NO: 151707 - protein, 9 aa, Artificial Sequence
  Description of Artificial Sequence: Synthetic peptide
  Seed: FYDPEPILC (PRAME_HUMAN)
FHDPEPILV

SEQ ID NO: 151708 - protein, 9 aa, Artificial Sequence
  Description of Artificial Sequence: Synthetic peptide
  Seed: LYVDSLFFL (PRAME_HUMAN)
LNVDSLFFV

SEQ ID NO: 151709 - protein, 9 aa, Artificial Sequence
  Description of Artificial Sequence: Synthetic peptide
  Seed: RTFYDPEPI (PRAME_HUMAN)
RQFYDPEPF

SEQ ID NO: 151710 - protein, 11 aa, Artificial Sequence
  Description of Artificial Sequence: Synthetic peptide
  Seed: QALLERASATL (PRAME_HUMAN)
QFLLERASATV

SEQ ID NO: 151711 - protein, 9 aa, Artificial Sequence
  Description of Artificial Sequence: Synthetic peptide
  Seed: KAMVQAWPF (PRAME_HUMAN)
KKMVQAWPF

SEQ ID NO: 151712 - protein, 11 aa, Artificial Sequence
  Description of Artificial Sequence: Synthetic peptide
  Seed: RRWKLQVLDLR (PRAME_HUMAN)
RRWKLQVLDLC

SEQ ID NO: 151713 - protein, 9 aa, Artificial Sequence
  Description of Artificial Sequence: Synthetic peptide
  Seed: VWSGNRASL (PRAME_HUMAN)
VWSGNRASY

SEQ ID NO: 151714 - protein, 9 aa, Artificial Sequence
  Description of Artificial Sequence: Synthetic peptide
  Seed: MINLRRLLL (PRAME_HUMAN)
MQNLRRLLL

SEQ ID NO: 151715 - protein, 9 aa, Artificial Sequence
  Description of Artificial Sequence: Synthetic peptide
  Seed: TLAKFSPYL (PRAME_HUMAN)
TTAKFSPYM

SEQ ID NO: 151716 - protein, 10 aa, Artificial Sequence
  Description of Artificial Sequence: Synthetic peptide
  Seed: LSFYGNSISI (PRAME_HUMAN)
LTFYGNSISL

SEQ ID NO: 151717 - protein, 9 aa, Artificial Sequence
  Description of Artificial Sequence: Synthetic peptide
  Seed: SYEDIHGTL (PRAME_HUMAN)
SMEDIHGTM

SEQ ID NO: 151718 - protein, 9 aa, Artificial Sequence
  Description of Artificial Sequence: Synthetic peptide
  Seed: LGRPSMVWL (PRAME_HUMAN)
LSRPSMVWL

SEQ ID NO: 151719 - protein, 9 aa, Artificial Sequence
  Description of Artificial Sequence: Synthetic peptide
  Seed: SFYGNSISI (PRAME_HUMAN)
SQYGNSISI

SEQ ID NO: 151720 - protein, 9 aa, Artificial Sequence
  Description of Artificial Sequence: Synthetic peptide
  Seed: CRLSEGDVM (PRAME_HUMAN)
CKLSEGDVY

SEQ ID NO: 151721 - protein, 9 aa, Artificial Sequence
  Description of Artificial Sequence: Synthetic peptide
  Seed: THVLYPVPL (PRAME_HUMAN)
TQVLYPVPW

SEQ ID NO: 151722 - protein, 10 aa, Artificial Sequence
  Description of Artificial Sequence: Synthetic peptide
  Seed: RGRLDQLLRH (PRAME_HUMAN)
RRRLDQLLRF

SEQ ID NO: 151723 - protein, 9 aa, Artificial Sequence
  Description of Artificial Sequence: Synthetic peptide
  Seed: FSPYLGQMI (PRAME_HUMAN)
FMPYLGQMI

SEQ ID NO: 151724 - protein, 9 aa, Artificial Sequence
  Description of Artificial Sequence: Synthetic peptide
  Seed: HLHLETFKA (PRAME_HUMAN)
HIHLETFKV

SEQ ID NO: 151725 - protein, 10 aa, Artificial Sequence
  Description of Artificial Sequence: Synthetic peptide
  Seed: RELFPPLFMA (PRAME_HUMAN)
RWLFPPLFMA

SEQ ID NO: 151726 - protein, 9 aa, Artificial Sequence
  Description of Artificial Sequence: Synthetic peptide
  Seed: RHSQTLKAM (PRAME_HUMAN)
RLSQTLKAM

SEQ ID NO: 151727 - protein, 9 aa, Artificial Sequence
  Description of Artificial Sequence: Synthetic peptide
  Seed: VLYPVPLES (PRAME_HUMAN)
VMYPVPLEI

SEQ ID NO: 151728 - protein, 9 aa, Artificial Sequence
  Description of Artificial Sequence: Synthetic peptide
  Seed: AAFDGRHSQ (PRAME_HUMAN)
AMFDGRHSY

SEQ ID NO: 151729 - protein, 9 aa, Artificial Sequence
  Description of Artificial Sequence: Synthetic peptide
  Seed: ASATLQDLV (PRAME_HUMAN)
AVATLQDLL

SEQ ID NO: 151730 - protein, 9 aa, Artificial Sequence
  Description of Artificial Sequence: Synthetic peptide
  Seed: MNPLETLSI (PRAME_HUMAN)
MTPLETLSV

SEQ ID NO: 151731 - protein, 9 aa, Artificial Sequence
  Description of Artificial Sequence: Synthetic peptide
  Seed: KLKIFAMPM (PRAME_HUMAN)
KGKIFAMPL

SEQ ID NO: 151732 - protein, 9 aa, Artificial Sequence
  Description of Artificial Sequence: Synthetic peptide
  Seed: RLLLSHIHA (PRAME_HUMAN)
RSLLSHIHK

SEQ ID NO: 151733 - protein, 9 aa, Artificial Sequence
  Description of Artificial Sequence: Synthetic peptide
  Seed: IGLSNLTHV (PRAME_HUMAN)
ITLSNLTHV

SEQ ID NO: 151734 - protein, 10 aa, Artificial Sequence
  Description of Artificial Sequence: Synthetic peptide
  Seed: RHVMNPLETL (PRAME_HUMAN)
RTVMNPLETI

SEQ ID NO: 151735 - protein, 11 aa, Artificial Sequence
  Description of Artificial Sequence: Synthetic peptide
  Seed: KMVQLDSIEDL (PRAME_HUMAN)
KQVQLDSIEDW

SEQ ID NO: 151736 - protein, 10 aa, Artificial Sequence
  Description of Artificial Sequence: Synthetic peptide
  Seed: LFPPLFMAAF (PRAME_HUMAN)
LFPPLFMAAW

SEQ ID NO: 151737 - protein, 10 aa, Artificial Sequence
  Description of Artificial Sequence: Synthetic peptide
  Seed: VLSLSGVMLT (PRAME_HUMAN)
VMSLSGVMLV

SEQ ID NO: 151738 - protein, 9 aa, Artificial Sequence
  Description of Artificial Sequence: Synthetic peptide
  Seed: ITDDQLLAL (PRAME_HUMAN)
INDDQLLAI

SEQ ID NO: 151739 - protein, 11 aa, Artificial Sequence
  Description of Artificial Sequence: Synthetic peptide
  Seed: QALYVDSLFFL (PRAME_HUMAN)
QILYVDSLFFI

SEQ ID NO: 151740 - protein, 9 aa, Artificial Sequence
  Description of Artificial Sequence: Synthetic peptide
  Seed: LALLPSLSH (PRAME_HUMAN)
LGLLPSLSF

SEQ ID NO: 151741 - protein, 10 aa, Artificial Sequence
  Description of Artificial Sequence: Synthetic peptide
  Seed: GRPSMVWLSA (PRAME_HUMAN)
GMPSMVWLSA

SEQ ID NO: 151742 - protein, 9 aa, Artificial Sequence
  Description of Artificial Sequence: Synthetic peptide
  Seed: SQFLSLQCL (PRAME_HUMAN)
SEFLSLQCP

SEQ ID NO: 151743 - protein, 9 aa, Artificial Sequence
  Description of Artificial Sequence: Synthetic peptide
  Seed: MVQAWPFTC (PRAME_HUMAN)
MQQAWPFTV

SEQ ID NO: 151744 - protein, 10 aa, Artificial Sequence
  Description of Artificial Sequence: Synthetic peptide
  Seed: SMSVWTSPRR (PRAME_HUMAN)
SYSVWTSPRR

SEQ ID NO: 151745 - protein, 9 aa, Artificial Sequence
  Description of Artificial Sequence: Synthetic peptide
  Seed: VLYPVPLES (PRAME_HUMAN)
VMYPVPLEA

SEQ ID NO: 151746 - protein, 11 aa, Artificial Sequence
  Description of Artificial Sequence: Synthetic peptide
  Seed: LLLSHIHASSY (PRAME_HUMAN)
LKLSHIHASSF

SEQ ID NO: 151747 - protein, 9 aa, Artificial Sequence
  Description of Artificial Sequence: Synthetic peptide
  Seed: SIEDLEVTC (PRAME_HUMAN)
SAEDLEVTF

SEQ ID NO: 151748 - protein, 10 aa, Artificial Sequence
  Description of Artificial Sequence: Synthetic peptide
  Seed: FIPVEVLVDL (PRAME_HUMAN)
FGPVEVLVDF

SEQ ID NO: 151749 - protein, 9 aa, Artificial Sequence
  Description of Artificial Sequence: Synthetic peptide
  Seed: LSVLSLSGV (PRAME_HUMAN)
LMVLSLSGT

SEQ ID NO: 151750 - protein, 11 aa, Artificial Sequence
  Description of Artificial Sequence: Synthetic peptide
  Seed: FKAVLDGLDVL (PRAME_HUMAN)
FNAVLDGLDVV

SEQ ID NO: 151751 - protein, 10 aa, Artificial Sequence
  Description of Artificial Sequence: Synthetic peptide
  Seed: ESYEDIHGTL (PRAME_HUMAN)
ETYEDIHGTY

SEQ ID NO: 151752 - protein, 11 aa, Artificial Sequence
  Description of Artificial Sequence: Synthetic peptide
  Seed: FKAVLDGLDVL (PRAME_HUMAN)
FSAVLDGLDVV

SEQ ID NO: 151753 - protein, 9 aa, Artificial Sequence
  Description of Artificial Sequence: Synthetic peptide
  Seed: KLKIFAMPM (PRAME_HUMAN)
KTKIFAMPK

SEQ ID NO: 151754 - protein, 11 aa, Artificial Sequence
  Description of Artificial Sequence: Synthetic peptide
  Seed: YISMSVWTSPR (PRAME_HUMAN)
YRSMSVWTSPR

SEQ ID NO: 151755 - protein, 9 aa, Artificial Sequence
  Description of Artificial Sequence: Synthetic peptide
  Seed: RELFPPLFM (PRAME_HUMAN)
RALFPPLFF

SEQ ID NO: 151756 - protein, 11 aa, Artificial Sequence
  Description of Artificial Sequence: Synthetic peptide
  Seed: LQSLLQHLIGL (PRAME_HUMAN)
LPSLLQHLIGV

SEQ ID NO: 151757 - protein, 10 aa, Artificial Sequence
  Description of Artificial Sequence: Synthetic peptide
  Seed: KKLKIFAMPM (PRAME_HUMAN)
KRLKIFAMPI

SEQ ID NO: 151758 - protein, 10 aa, Artificial Sequence
  Description of Artificial Sequence: Synthetic peptide
  Seed: LSQSPSVSQL (PRAME_HUMAN)
LGQSPSVSQY

SEQ ID NO: 151759 - protein, 9 aa, Artificial Sequence
  Description of Artificial Sequence: Synthetic peptide
  Seed: RLAYLHARL (PRAME_HUMAN)
RLAYLHARW

SEQ ID NO: 151760 - protein, 11 aa, Artificial Sequence
  Description of Artificial Sequence: Synthetic peptide
  Seed: VQAWPFTCLPL (PRAME_HUMAN)
VKAWPFTCLPF

SEQ ID NO: 151761 - protein, 10 aa, Artificial Sequence
  Description of Artificial Sequence: Synthetic peptide
  Seed: MVQLDSIEDL (PRAME_HUMAN)
MMQLDSIEDV

SEQ ID NO: 151762 - protein, 8 aa, Artificial Sequence
  Description of Artificial Sequence: Synthetic peptide
  Seed: LAKFSPYL (PRAME_HUMAN)
LMKFSPYV

SEQ ID NO: 151763 - protein, 11 aa, Artificial Sequence
  Description of Artificial Sequence: Synthetic peptide
  Seed: QALYVDSLFFL (PRAME_HUMAN)
QLLYVDSLFFM

SEQ ID NO: 151764 - protein, 11 aa, Artificial Sequence
  Description of Artificial Sequence: Synthetic peptide
  Seed: RRRLWGSIQSR (PRAME_HUMAN)
RFRLWGSIQSR

SEQ ID NO: 151765 - protein, 9 aa, Artificial Sequence
  Description of Artificial Sequence: Synthetic peptide
  Seed: VLDGLDVLL (PRAME_HUMAN)
VADGLDVLM

SEQ ID NO: 151766 - protein, 9 aa, Artificial Sequence
  Description of Artificial Sequence: Synthetic peptide
  Seed: RTFYDPEPI (PRAME_HUMAN)
RRFYDPEPM

SEQ ID NO: 151767 - protein, 9 aa, Artificial Sequence
  Description of Artificial Sequence: Synthetic peptide
  Seed: KMILKMVQL (PRAME_HUMAN)
KRILKMVQM

SEQ ID NO: 151768 - protein, 8 aa, Artificial Sequence
  Description of Artificial Sequence: Synthetic peptide
  Seed: YEDIHGTL (PRAME_HUMAN)
YMDIHGTV

SEQ ID NO: 151769 - protein, 9 aa, Artificial Sequence
  Description of Artificial Sequence: Synthetic peptide
  Seed: KFSPYLGQM (PRAME_HUMAN)
KASPYLGQL

SEQ ID NO: 151770 - protein, 10 aa, Artificial Sequence
  Description of Artificial Sequence: Synthetic peptide
  Seed: VELAGQSLLK (PRAME_HUMAN)
VYLAGQSLLK

SEQ ID NO: 151771 - protein, 9 aa, Artificial Sequence
  Description of Artificial Sequence: Synthetic peptide
  Seed: FPPLFMAAF (PRAME_HUMAN)
FPPLFMAAM

SEQ ID NO: 151772 - protein, 9 aa, Artificial Sequence
  Description of Artificial Sequence: Synthetic peptide
  Seed: GLSNLTHVL (PRAME_HUMAN)
GLSNLTHVF

SEQ ID NO: 151773 - protein, 9 aa, Artificial Sequence
  Description of Artificial Sequence: Synthetic peptide
  Seed: SVLSLSGVM (PRAME_HUMAN)
SSLSLSGVW

SEQ ID NO: 151774 - protein, 10 aa, Artificial Sequence
  Description of Artificial Sequence: Synthetic peptide
  Seed: AALELLPREL (PRAME_HUMAN)
AQLELLPREI

SEQ ID NO: 151775 - protein, 9 aa, Artificial Sequence
  Description of Artificial Sequence: Synthetic peptide
  Seed: RTFYDPEPI (PRAME_HUMAN)
RFFYDPEPF

SEQ ID NO: 151776 - protein, 10 aa, Artificial Sequence
  Description of Artificial Sequence: Synthetic peptide
  Seed: RGRLDQLLRH (PRAME_HUMAN)
RSRLDQLLRR

SEQ ID NO: 151777 - protein, 9 aa, Artificial Sequence
  Description of Artificial Sequence: Synthetic peptide
  Seed: RTFYDPEPI (PRAME_HUMAN)
RCFYDPEPW

SEQ ID NO: 151778 - protein, 9 aa, Artificial Sequence
  Description of Artificial Sequence: Synthetic peptide
  Seed: FLRGRLDQL (PRAME_HUMAN)
FGRGRLDQY

SEQ ID NO: 151779 - protein, 10 aa, Artificial Sequence
  Description of Artificial Sequence: Synthetic peptide
  Seed: LLSHIHASSY (PRAME_HUMAN)
LGSHIHASSY

SEQ ID NO: 151780 - protein, 9 aa, Artificial Sequence
  Description of Artificial Sequence: Synthetic peptide
  Seed: YISMSVWTS (PRAME_HUMAN)
YSSMSVWTL

SEQ ID NO: 151781 - protein, 9 aa, Artificial Sequence
  Description of Artificial Sequence: Synthetic peptide
  Seed: VQAWPFTCL (PRAME_HUMAN)
VAAWPFTCL

SEQ ID NO: 151782 - protein, 10 aa, Artificial Sequence
  Description of Artificial Sequence: Synthetic peptide
  Seed: DQLLALLPSL (PRAME_HUMAN)
DGLLALLPSV

SEQ ID NO: 151783 - protein, 9 aa, Artificial Sequence
  Description of Artificial Sequence: Synthetic peptide
  Seed: ISISALQSL (PRAME_HUMAN)
IVISALQSW

SEQ ID NO: 151784 - protein, 10 aa, Artificial Sequence
  Description of Artificial Sequence: Synthetic peptide
  Seed: KKLKIFAMPM (PRAME_HUMAN)
KQLKIFAMPM

SEQ ID NO: 151785 - protein, 11 aa, Artificial Sequence
  Description of Artificial Sequence: Synthetic peptide
  Seed: SNLTHVLYPVP (PRAME_HUMAN)
SLLTHVLYPVA

SEQ ID NO: 151786 - protein, 11 aa, Artificial Sequence
  Description of Artificial Sequence: Synthetic peptide
  Seed: RASATLQDLVF (PRAME_HUMAN)
RNSATLQDLVW

SEQ ID NO: 151787 - protein, 10 aa, Artificial Sequence
  Description of Artificial Sequence: Synthetic peptide
  Seed: AVLDGLDVLL (PRAME_HUMAN)
AILDGLDVLF

SEQ ID NO: 151788 - protein, 11 aa, Artificial Sequence
  Description of Artificial Sequence: Synthetic peptide
  Seed: VQLDSIEDLEV (PRAME_HUMAN)
VQLDSIEDLEM

SEQ ID NO: 151789 - protein, 9 aa, Artificial Sequence
  Description of Artificial Sequence: Synthetic peptide
  Seed: YPVPLESYE (PRAME_HUMAN)
YTVPLESYY

SEQ ID NO: 151790 - protein, 11 aa, Artificial Sequence
  Description of Artificial Sequence: Synthetic peptide
  Seed: LPTLAKFSPYL (PRAME_HUMAN)
LTTLAKFSPYI

SEQ ID NO: 151791 - protein, 9 aa, Artificial Sequence
  Description of Artificial Sequence: Synthetic peptide
  Seed: RLWGSIQSR (PRAME_HUMAN)
RMWGSIQSL

SEQ ID NO: 151792 - protein, 10 aa, Artificial Sequence
  Description of Artificial Sequence: Synthetic peptide
  Seed: MNPLETLSIT (PRAME_HUMAN)
MDPLETLSIV

SEQ ID NO: 151793 - protein, 9 aa, Artificial Sequence
  Description of Artificial Sequence: Synthetic peptide
  Seed: SLLKDEALA (PRAME_HUMAN)
SILKDEALV

SEQ ID NO: 151794 - protein, 10 aa, Artificial Sequence
  Description of Artificial Sequence: Synthetic peptide
  Seed: RRLWGSIQSR (PRAME_HUMAN)
RDLWGSIQSK

SEQ ID NO: 151795 - protein, 9 aa, Artificial Sequence
  Description of Artificial Sequence: Synthetic peptide
  Seed: VSQLSVLSL (PRAME_HUMAN)
VTQLSVLSF

SEQ ID NO: 151796 - protein, 9 aa, Artificial Sequence
  Description of Artificial Sequence: Synthetic peptide
  Seed: FLRGRLDQL (PRAME_HUMAN)
FRRGRLDQF

SEQ ID NO: 151797 - protein, 10 aa, Artificial Sequence
  Description of Artificial Sequence: Synthetic peptide
  Seed: DQLLALLPSL (PRAME_HUMAN)
DYLLALLPSI

SEQ ID NO: 151798 - protein, 9 aa, Artificial Sequence
  Description of Artificial Sequence: Synthetic peptide
  Seed: YSFPEPEAA (PRAME_HUMAN)
YAFPEPEAC

SEQ ID NO: 151799 - protein, 9 aa, Artificial Sequence
  Description of Artificial Sequence: Synthetic peptide
  Seed: TSPRRLVEL (PRAME_HUMAN)
TYPRRLVEI

SEQ ID NO: 151800 - protein, 9 aa, Artificial Sequence
  Description of Artificial Sequence: Synthetic peptide
  Seed: RLRELLCEL (PRAME_HUMAN)
RERELLCEM

SEQ ID NO: 151801 - protein, 9 aa, Artificial Sequence
  Description of Artificial Sequence: Synthetic peptide
  Seed: DSLFFLRGR (PRAME_HUMAN)
DWLFFLRGR

SEQ ID NO: 151802 - protein, 10 aa, Artificial Sequence
  Description of Artificial Sequence: Synthetic peptide
  Seed: LYVDSLFFLR (PRAME_HUMAN)
LSVDSLFFLR

SEQ ID NO: 151803 - protein, 10 aa, Artificial Sequence
  Description of Artificial Sequence: Synthetic peptide
  Seed: LSQSPSVSQL (PRAME_HUMAN)
LSQSPSVSQY

SEQ ID NO: 151804 - protein, 10 aa, Artificial Sequence
  Description of Artificial Sequence: Synthetic peptide
  Seed: DELFSYLIEK (PRAME_HUMAN)
DHLFSYLIER

SEQ ID NO: 151805 - protein, 9 aa, Artificial Sequence
  Description of Artificial Sequence: Synthetic peptide
  Seed: ASSYISPEK (PRAME_HUMAN)
AVSYISPEK

SEQ ID NO: 151806 - protein, 9 aa, Artificial Sequence
  Description of Artificial Sequence: Synthetic peptide
  Seed: VWTSPRRLV (PRAME_HUMAN)
VFTSPRRLF

SEQ ID NO: 151807 - protein, 9 aa, Artificial Sequence
  Description of Artificial Sequence: Synthetic peptide
  Seed: RLRELLCEL (PRAME_HUMAN)
RLRELLCEV

SEQ ID NO: 151808 - protein, 8 aa, Artificial Sequence
  Description of Artificial Sequence: Synthetic peptide
  Seed: SQFLSLQC (PRAME_HUMAN)
SQFLSLQI

SEQ ID NO: 151809 - protein, 10 aa, Artificial Sequence
  Description of Artificial Sequence: Synthetic peptide
  Seed: DELFSYLIEK (PRAME_HUMAN)
DQLFSYLIER

SEQ ID NO: 151810 - protein, 9 aa, Artificial Sequence
  Description of Artificial Sequence: Synthetic peptide
  Seed: HARLRELLC (PRAME_HUMAN)
HMRLRELLL

SEQ ID NO: 151811 - protein, 9 aa, Artificial Sequence
  Description of Artificial Sequence: Synthetic peptide
  Seed: KVDGLSTEA (PRAME_HUMAN)
KCDGLSTEI

SEQ ID NO: 151812 - protein, 9 aa, Artificial Sequence
  Description of Artificial Sequence: Synthetic peptide
  Seed: LYVDSLFFL (PRAME_HUMAN)
LLVDSLFFF

SEQ ID NO: 151813 - protein, 10 aa, Artificial Sequence
  Description of Artificial Sequence: Synthetic peptide
  Seed: VSPEPLQALL (PRAME_HUMAN)
VSPEPLQALW

SEQ ID NO: 151814 - protein, 10 aa, Artificial Sequence
  Description of Artificial Sequence: Synthetic peptide
  Seed: QALYVDSLFF (PRAME_HUMAN)
QQLYVDSLFF

SEQ ID NO: 151815 - protein, 9 aa, Artificial Sequence
  Description of Artificial Sequence: Synthetic peptide
  Seed: TDDQLLALL (PRAME_HUMAN)
TYDQLLALF

SEQ ID NO: 151816 - protein, 11 aa, Artificial Sequence
  Description of Artificial Sequence: Synthetic peptide
  Seed: LSNLTHVLYPV (PRAME_HUMAN)
LNNLTHVLYPV

SEQ ID NO: 151817 - protein, 9 aa, Artificial Sequence
  Description of Artificial Sequence: Synthetic peptide
  Seed: SLQCLQALY (PRAME_HUMAN)
SYQCLQALY

SEQ ID NO: 151818 - protein, 9 aa, Artificial Sequence
  Description of Artificial Sequence: Synthetic peptide
  Seed: MINLRRLLL (PRAME_HUMAN)
MGNLRRLLK

SEQ ID NO: 151819 - protein, 9 aa, Artificial Sequence
  Description of Artificial Sequence: Synthetic peptide
  Seed: SYEDIHGTL (PRAME_HUMAN)
SAEDIHGTW

SEQ ID NO: 151820 - protein, 10 aa, Artificial Sequence
  Description of Artificial Sequence: Synthetic peptide
  Seed: FSYLIEKVKR (PRAME_HUMAN)
FIYLIEKVKR

SEQ ID NO: 151821 - protein, 10 aa, Artificial Sequence
  Description of Artificial Sequence: Synthetic peptide
  Seed: LERLAYLHAR (PRAME_HUMAN)
LDRLAYLHAK

SEQ ID NO: 151822 - protein, 10 aa, Artificial Sequence
  Description of Artificial Sequence: Synthetic peptide
  Seed: GLSNLTHVLY (PRAME_HUMAN)
GISNLTHVLK

SEQ ID NO: 151823 - protein, 9 aa, Artificial Sequence
  Description of Artificial Sequence: Synthetic peptide
  Seed: SQFLSLQCL (PRAME_HUMAN)
SEFLSLQCV

SEQ ID NO: 151824 - protein, 9 aa, Artificial Sequence
  Description of Artificial Sequence: Synthetic peptide
  Seed: SVWTSPRRL (PRAME_HUMAN)
SAWTSPRRW

SEQ ID NO: 151825 - protein, 9 aa, Artificial Sequence
  Description of Artificial Sequence: Synthetic peptide
  Seed: YVDSLFFLR (PRAME_HUMAN)
YSDSLFFLK

SEQ ID NO: 151826 - protein, 9 aa, Artificial Sequence
  Description of Artificial Sequence: Synthetic peptide
  Seed: SISALQSLL (PRAME_HUMAN)
SISALQSLW

SEQ ID NO: 151827 - protein, 10 aa, Artificial Sequence
  Description of Artificial Sequence: Synthetic peptide
  Seed: QSLLQHLIGL (PRAME_HUMAN)
QLLLQHLIGI

SEQ ID NO: 151828 - protein, 9 aa, Artificial Sequence
  Description of Artificial Sequence: Synthetic peptide
  Seed: DSLFFLRGR (PRAME_HUMAN)
DTLFFLRGK

SEQ ID NO: 151829 - protein, 11 aa, Artificial Sequence
  Description of Artificial Sequence: Synthetic peptide
  Seed: LLLSHIHASSY (PRAME_HUMAN)
LKLSHIHASSW

SEQ ID NO: 151830 - protein, 9 aa, Artificial Sequence
  Description of Artificial Sequence: Synthetic peptide
  Seed: IFAMPMQDI (PRAME_HUMAN)
IFAMPMQDM

SEQ ID NO: 151831 - protein, 9 aa, Artificial Sequence
  Description of Artificial Sequence: Synthetic peptide
  Seed: QFTSQFLSL (PRAME_HUMAN)
QRTSQFLSF

SEQ ID NO: 151832 - protein, 10 aa, Artificial Sequence
  Description of Artificial Sequence: Synthetic peptide
  Seed: SPSVSQLSVL (PRAME_HUMAN)
SKSVSQLSVF

SEQ ID NO: 151833 - protein, 10 aa, Artificial Sequence
  Description of Artificial Sequence: Synthetic peptide
  Seed: KKLKIFAMPM (PRAME_HUMAN)
KKLKIFAMPK

SEQ ID NO: 151834 - protein, 11 aa, Artificial Sequence
  Description of Artificial Sequence: Synthetic peptide
  Seed: LLLSHIHASSY (PRAME_HUMAN)
LTLSHIHASSF

SEQ ID NO: 151835 - protein, 9 aa, Artificial Sequence
  Description of Artificial Sequence: Synthetic peptide
  Seed: NSHQDFWTV (PRAME_HUMAN)
NTHQDFWTI

SEQ ID NO: 151836 - protein, 9 aa, Artificial Sequence
  Description of Artificial Sequence: Synthetic peptide
  Seed: YGNSISISA (PRAME_HUMAN)
YPNSISISC

SEQ ID NO: 151837 - protein, 9 aa, Artificial Sequence
  Description of Artificial Sequence: Synthetic peptide
  Seed: AEQPFIPVE (PRAME_HUMAN)
AEQPFIPVG

SEQ ID NO: 151838 - protein, 11 aa, Artificial Sequence
  Description of Artificial Sequence: Synthetic peptide
  Seed: FLSLQCLQALY (PRAME_HUMAN)
FFSLQCLQALY

SEQ ID NO: 151839 - protein, 9 aa, Artificial Sequence
  Description of Artificial Sequence: Synthetic peptide
  Seed: ITDDQLLAL (PRAME_HUMAN)
INDDQLLAF

SEQ ID NO: 151840 - protein, 10 aa, Artificial Sequence
  Description of Artificial Sequence: Synthetic peptide
  Seed: RRRLWGSIQS (PRAME_HUMAN)
RKRLWGSIQK

SEQ ID NO: 151841 - protein, 9 aa, Artificial Sequence
  Description of Artificial Sequence: Synthetic peptide
  Seed: ALQSLLQHL (PRAME_HUMAN)
AMQSLLQHA

SEQ ID NO: 151842 - protein, 11 aa, Artificial Sequence
  Description of Artificial Sequence: Synthetic peptide
  Seed: IAQFTSQFLSL (PRAME_HUMAN)
IWQFTSQFLSF

SEQ ID NO: 151843 - protein, 9 aa, Artificial Sequence
  Description of Artificial Sequence: Synthetic peptide
  Seed: GITDDQLLA (PRAME_HUMAN)
GMTDDQLLV

SEQ ID NO: 151844 - protein, 11 aa, Artificial Sequence
  Description of Artificial Sequence: Synthetic peptide
  Seed: LTDVSPEPLQA (PRAME_HUMAN)
LADVSPEPLQF

SEQ ID NO: 151845 - protein, 11 aa, Artificial Sequence
  Description of Artificial Sequence: Synthetic peptide
  Seed: SQTLKAMVQAW (PRAME_HUMAN)
SETLKAMVQAY

SEQ ID NO: 151846 - protein, 10 aa, Artificial Sequence
  Description of Artificial Sequence: Synthetic peptide
  Seed: ALQSLLQHLI (PRAME_HUMAN)
AQQSLLQHLF

SEQ ID NO: 151847 - protein, 10 aa, Artificial Sequence
  Description of Artificial Sequence: Synthetic peptide
  Seed: ESYEDIHGTL (PRAME_HUMAN)
EMYEDIHGTV

SEQ ID NO: 151848 - protein, 9 aa, Artificial Sequence
  Description of Artificial Sequence: Synthetic peptide
  Seed: MNPLETLSI (PRAME_HUMAN)
MSPLETLSY

SEQ ID NO: 151849 - protein, 10 aa, Artificial Sequence
  Description of Artificial Sequence: Synthetic peptide
  Seed: RTFYDPEPIL (PRAME_HUMAN)
RVFYDPEPIW

SEQ ID NO: 151850 - protein, 9 aa, Artificial Sequence
  Description of Artificial Sequence: Synthetic peptide
  Seed: SFYGNSISI (PRAME_HUMAN)
SMYGNSISV

SEQ ID NO: 151851 - protein, 10 aa, Artificial Sequence
  Description of Artificial Sequence: Synthetic peptide
  Seed: VLYPVPLESY (PRAME_HUMAN)
VYYPVPLESY

SEQ ID NO: 151852 - protein, 10 aa, Artificial Sequence
  Description of Artificial Sequence: Synthetic peptide
  Seed: KAVLDGLDVL (PRAME_HUMAN)
KMVLDGLDVF

SEQ ID NO: 151853 - protein, 9 aa, Artificial Sequence
  Description of Artificial Sequence: Synthetic peptide
  Seed: LKMVQLDSI (PRAME_HUMAN)
LQMVQLDSL

SEQ ID NO: 151854 - protein, 10 aa, Artificial Sequence
  Description of Artificial Sequence: Synthetic peptide
  Seed: FFLRGRLDQL (PRAME_HUMAN)
FQLRGRLDQL

SEQ ID NO: 151855 - protein, 9 aa, Artificial Sequence
  Description of Artificial Sequence: Synthetic peptide
  Seed: LFPPLFMAA (PRAME_HUMAN)
LYPPLFMAI

SEQ ID NO: 151856 - protein, 9 aa, Artificial Sequence
  Description of Artificial Sequence: Synthetic peptide
  Seed: LLRHVMNPL (PRAME_HUMAN)
LLRHVMNPA

SEQ ID NO: 151857 - protein, 10 aa, Artificial Sequence
  Description of Artificial Sequence: Synthetic peptide
  Seed: DQLLALLPSL (PRAME_HUMAN)
DRLLALLPSL

SEQ ID NO: 151858 - protein, 9 aa, Artificial Sequence
  Description of Artificial Sequence: Synthetic peptide
  Seed: HVMNPLETL (PRAME_HUMAN)
HPMNPLETC

SEQ ID NO: 151859 - protein, 9 aa, Artificial Sequence
  Description of Artificial Sequence: Synthetic peptide
  Seed: VQLDSIEDL (PRAME_HUMAN)
VTLDSIEDL

SEQ ID NO: 151860 - protein, 11 aa, Artificial Sequence
  Description of Artificial Sequence: Synthetic peptide
  Seed: RRLWGSIQSRY (PRAME_HUMAN)
RQLWGSIQSRF

SEQ ID NO: 151861 - protein, 10 aa, Artificial Sequence
  Description of Artificial Sequence: Synthetic peptide
  Seed: AQFTSQFLSL (PRAME_HUMAN)
AMFTSQFLSY

SEQ ID NO: 151862 - protein, 9 aa, Artificial Sequence
  Description of Artificial Sequence: Synthetic peptide
  Seed: TDDQLLALL (PRAME_HUMAN)
TQDQLLALL

SEQ ID NO: 151863 - protein, 9 aa, Artificial Sequence
  Description of Artificial Sequence: Synthetic peptide
  Seed: SVWTSPRRL (PRAME_HUMAN)
SSWTSPRRL

SEQ ID NO: 151864 - protein, 10 aa, Artificial Sequence
  Description of Artificial Sequence: Synthetic peptide
  Seed: ARLRELLCEL (PRAME_HUMAN)
AGLRELLCEL

SEQ ID NO: 151865 - protein, 10 aa, Artificial Sequence
  Description of Artificial Sequence: Synthetic peptide
  Seed: LSFYGNSISI (PRAME_HUMAN)
LQFYGNSISV

SEQ ID NO: 151866 - protein, 9 aa, Artificial Sequence
  Description of Artificial Sequence: Synthetic peptide
  Seed: ALLPSLSHC (PRAME_HUMAN)
AVLPSLSHM

SEQ ID NO: 151867 - protein, 9 aa, Artificial Sequence
  Description of Artificial Sequence: Synthetic peptide
  Seed: SQSPSVSQL (PRAME_HUMAN)
SRSPSVSQY

SEQ ID NO: 151868 - protein, 10 aa, Artificial Sequence
  Description of Artificial Sequence: Synthetic peptide
  Seed: SQLTTLSFYG (PRAME_HUMAN)
SKLTTLSFYY

SEQ ID NO: 151869 - protein, 9 aa, Artificial Sequence
  Description of Artificial Sequence: Synthetic peptide
  Seed: ISPEKEEQY (PRAME_HUMAN)
IAPEKEEQV

SEQ ID NO: 151870 - protein, 10 aa, Artificial Sequence
  Description of Artificial Sequence: Synthetic peptide
  Seed: QLLRHVMNPL (PRAME_HUMAN)
QFLRHVMNPV

SEQ ID NO: 151871 - protein, 9 aa, Artificial Sequence
  Description of Artificial Sequence: Synthetic peptide
  Seed: YLIEKVKRK (PRAME_HUMAN)
YIIEKVKRR

SEQ ID NO: 151872 - protein, 9 aa, Artificial Sequence
  Description of Artificial Sequence: Synthetic peptide
  Seed: LGRPSMVWL (PRAME_HUMAN)
LVRPSMVWA

SEQ ID NO: 151873 - protein, 10 aa, Artificial Sequence
  Description of Artificial Sequence: Synthetic peptide
  Seed: FFLRGRLDQL (PRAME_HUMAN)
FSLRGRLDQV

SEQ ID NO: 151874 - protein, 9 aa, Artificial Sequence
  Description of Artificial Sequence: Synthetic peptide
  Seed: KLKIFAMPM (PRAME_HUMAN)
KRKIFAMPF

SEQ ID NO: 151875 - protein, 10 aa, Artificial Sequence
  Description of Artificial Sequence: Synthetic peptide
  Seed: LLPRELFPPL (PRAME_HUMAN)
LCPRELFPPM

SEQ ID NO: 151876 - protein, 9 aa, Artificial Sequence
  Description of Artificial Sequence: Synthetic peptide
  Seed: GRHSQTLKA (PRAME_HUMAN)
GYHSQTLKF

SEQ ID NO: 151877 - protein, 10 aa, Artificial Sequence
  Description of Artificial Sequence: Synthetic peptide
  Seed: RLWGSIQSRY (PRAME_HUMAN)
RMWGSIQSRM

SEQ ID NO: 151878 - protein, 9 aa, Artificial Sequence
  Description of Artificial Sequence: Synthetic peptide
  Seed: SLLQHLIGL (PRAME_HUMAN)
STLQHLIGY

SEQ ID NO: 151879 - protein, 9 aa, Artificial Sequence
  Description of Artificial Sequence: Synthetic peptide
  Seed: ITDDQLLAL (PRAME_HUMAN)
IYDDQLLAV

SEQ ID NO: 151880 - protein, 9 aa, Artificial Sequence
  Description of Artificial Sequence: Synthetic peptide
  Seed: SALQSLLQH (PRAME_HUMAN)
SALQSLLQI

SEQ ID NO: 151881 - protein, 9 aa, Artificial Sequence
  Description of Artificial Sequence: Synthetic peptide
  Seed: FPEPEAAQP (PRAME_HUMAN)
FAEPEAAQF

SEQ ID NO: 151882 - protein, 11 aa, Artificial Sequence
  Description of Artificial Sequence: Synthetic peptide
  Seed: YISPEKEEQYI (PRAME_HUMAN)
YMSPEKEEQYL

SEQ ID NO: 151883 - protein, 9 aa, Artificial Sequence
  Description of Artificial Sequence: Synthetic peptide
  Seed: HARLRELLC (PRAME_HUMAN)
HPRLRELLA

SEQ ID NO: 151884 - protein, 10 aa, Artificial Sequence
  Description of Artificial Sequence: Synthetic peptide
  Seed: ALYVDSLFFL (PRAME_HUMAN)
AQYVDSLFFT

SEQ ID NO: 151885 - protein, 10 aa, Artificial Sequence
  Description of Artificial Sequence: Synthetic peptide
  Seed: MLTDVSPEPL (PRAME_HUMAN)
MVTDVSPEPY

SEQ ID NO: 151886 - protein, 10 aa, Artificial Sequence
  Description of Artificial Sequence: Synthetic peptide
  Seed: MLTDVSPEPL (PRAME_HUMAN)
MTTDVSPEPA

SEQ ID NO: 151887 - protein, 9 aa, Artificial Sequence
  Description of Artificial Sequence: Synthetic peptide
  Seed: IAQFTSQFL (PRAME_HUMAN)
IMQFTSQFW

SEQ ID NO: 151888 - protein, 9 aa, Artificial Sequence
  Description of Artificial Sequence: Synthetic peptide
  Seed: EAAQPMTKK (PRAME_HUMAN)
ETAQPMTKY

SEQ ID NO: 151889 - protein, 9 aa, Artificial Sequence
  Description of Artificial Sequence: Synthetic peptide
  Seed: KAMVQAWPF (PRAME_HUMAN)
KNMVQAWPW

SEQ ID NO: 151890 - protein, 9 aa, Artificial Sequence
  Description of Artificial Sequence: Synthetic peptide
  Seed: GQHLHLETF (PRAME_HUMAN)
GTHLHLETY

SEQ ID NO: 151891 - protein, 9 aa, Artificial Sequence
  Description of Artificial Sequence: Synthetic peptide
  Seed: CSQLTTLSF (PRAME_HUMAN)
CSQLTTLSL

SEQ ID NO: 151892 - protein, 9 aa, Artificial Sequence
  Description of Artificial Sequence: Synthetic peptide
  Seed: SQLTTLSFY (PRAME_HUMAN)
SFLTTLSFY

SEQ ID NO: 151893 - protein, 9 aa, Artificial Sequence
  Description of Artificial Sequence: Synthetic peptide
  Seed: AWPFTCLPL (PRAME_HUMAN)
AIPFTCLPL

SEQ ID NO: 151894 - protein, 10 aa, Artificial Sequence
  Description of Artificial Sequence: Synthetic peptide
  Seed: LIGLSNLTHV (PRAME_HUMAN)
LLGLSNLTHI

SEQ ID NO: 151895 - protein, 10 aa, Artificial Sequence
  Description of Artificial Sequence: Synthetic peptide
  Seed: LLPRELFPPL (PRAME_HUMAN)
LTPRELFPPF

SEQ ID NO: 151896 - protein, 10 aa, Artificial Sequence
  Description of Artificial Sequence: Synthetic peptide
  Seed: LLPRELFPPL (PRAME_HUMAN)
LAPRELFPPV

SEQ ID NO: 151897 - protein, 10 aa, Artificial Sequence
  Description of Artificial Sequence: Synthetic peptide
  Seed: RHVMNPLETL (PRAME_HUMAN)
RQVMNPLETL

SEQ ID NO: 151898 - protein, 9 aa, Artificial Sequence
  Description of Artificial Sequence: Synthetic peptide
  Seed: FYDPEPILC (PRAME_HUMAN)
FMDPEPILA

SEQ ID NO: 151899 - protein, 9 aa, Artificial Sequence
  Description of Artificial Sequence: Synthetic peptide
  Seed: SIEDLEVTC (PRAME_HUMAN)
SIEDLEVTI

SEQ ID NO: 151900 - protein, 9 aa, Artificial Sequence
  Description of Artificial Sequence: Synthetic peptide
  Seed: ETLSITNCR (PRAME_HUMAN)
EILSITNCK

SEQ ID NO: 151901 - protein, 11 aa, Artificial Sequence
  Description of Artificial Sequence: Synthetic peptide
  Seed: KNSHQDFWTVW (PRAME_HUMAN)
KTSHQDFWTVF

SEQ ID NO: 151902 - protein, 10 aa, Artificial Sequence
  Description of Artificial Sequence: Synthetic peptide
  Seed: LLLSHIHASS (PRAME_HUMAN)
LTLSHIHASV

SEQ ID NO: 151903 - protein, 10 aa, Artificial Sequence
  Description of Artificial Sequence: Synthetic peptide
  Seed: ALLERASATL (PRAME_HUMAN)
AMLERASATA

SEQ ID NO: 151904 - protein, 9 aa, Artificial Sequence
  Description of Artificial Sequence: Synthetic peptide
  Seed: LSTEAEQPF (PRAME_HUMAN)
LGTEAEQPW

SEQ ID NO: 151905 - protein, 11 aa, Artificial Sequence
  Description of Artificial Sequence: Synthetic peptide
  Seed: LLLSHIHASSY (PRAME_HUMAN)
LKLSHIHASSY

SEQ ID NO: 151906 - protein, 10 aa, Artificial Sequence
  Description of Artificial Sequence: Synthetic peptide
  Seed: MVQAWPFTCL (PRAME_HUMAN)
MMQAWPFTCA

SEQ ID NO: 151907 - protein, 9 aa, Artificial Sequence
  Description of Artificial Sequence: Synthetic peptide
  Seed: ISISALQSL (PRAME_HUMAN)
IFISALQSL

SEQ ID NO: 151908 - protein, 9 aa, Artificial Sequence
  Description of Artificial Sequence: Synthetic peptide
  Seed: SMVWLSANP (PRAME_HUMAN)
SVVWLSANV

SEQ ID NO: 151909 - protein, 10 aa, Artificial Sequence
  Description of Artificial Sequence: Synthetic peptide
  Seed: GACDELFSYL (PRAME_HUMAN)
GQCDELFSYL

SEQ ID NO: 151910 - protein, 10 aa, Artificial Sequence
  Description of Artificial Sequence: Synthetic peptide
  Seed: ITDDQLLALL (PRAME_HUMAN)
IYDDQLLALM

SEQ ID NO: 151911 - protein, 9 aa, Artificial Sequence
  Description of Artificial Sequence: Synthetic peptide
  Seed: TSPRRLVEL (PRAME_HUMAN)
TIPRRLVEI

SEQ ID NO: 151912 - protein, 9 aa, Artificial Sequence
  Description of Artificial Sequence: Synthetic peptide
  Seed: LSNLTHVLY (PRAME_HUMAN)
LANLTHVLM

SEQ ID NO: 151913 - protein, 10 aa, Artificial Sequence
  Description of Artificial Sequence: Synthetic peptide
  Seed: ALYVDSLFFL (PRAME_HUMAN)
AAYVDSLFFV

SEQ ID NO: 151914 - protein, 10 aa, Artificial Sequence
  Description of Artificial Sequence: Synthetic peptide
  Seed: ISISALQSLL (PRAME_HUMAN)
ISISALQSLI

SEQ ID NO: 151915 - protein, 9 aa, Artificial Sequence
  Description of Artificial Sequence: Synthetic peptide
  Seed: TWKLPTLAK (PRAME_HUMAN)
TFKLPTLAR

SEQ ID NO: 151916 - protein, 10 aa, Artificial Sequence
  Description of Artificial Sequence: Synthetic peptide
  Seed: VDSLFFLRGR (PRAME_HUMAN)
VYSLFFLRGR

SEQ ID NO: 151917 - protein, 11 aa, Artificial Sequence
  Description of Artificial Sequence: Synthetic peptide
  Seed: LPTLAKFSPYL (PRAME_HUMAN)
LYTLAKFSPYV

SEQ ID NO: 151918 - protein, 8 aa, Artificial Sequence
  Description of Artificial Sequence: Synthetic peptide
  Seed: YEDIHGTL (PRAME_HUMAN)
YGDIHGTV

SEQ ID NO: 151919 - protein, 9 aa, Artificial Sequence
  Description of Artificial Sequence: Synthetic peptide
  Seed: QALYVDSLF (PRAME_HUMAN)
QPLYVDSLW

SEQ ID NO: 151920 - protein, 11 aa, Artificial Sequence
  Description of Artificial Sequence: Synthetic peptide
  Seed: RLSEGDVMHLS (PRAME_HUMAN)
RLSEGDVMHLI

SEQ ID NO: 151921 - protein, 9 aa, Artificial Sequence
  Description of Artificial Sequence: Synthetic peptide
  Seed: KLKIFAMPM (PRAME_HUMAN)
KTKIFAMPY

SEQ ID NO: 151922 - protein, 9 aa, Artificial Sequence
  Description of Artificial Sequence: Synthetic peptide
  Seed: LSLQCLQAL (PRAME_HUMAN)
LGLQCLQAW

SEQ ID NO: 151923 - protein, 9 aa, Artificial Sequence
  Description of Artificial Sequence: Synthetic peptide
  Seed: RTFYDPEPI (PRAME_HUMAN)
RAFYDPEPV

SEQ ID NO: 151924 - protein, 10 aa, Artificial Sequence
  Description of Artificial Sequence: Synthetic peptide
  Seed: LSFYGNSISI (PRAME_HUMAN)
LTFYGNSISI

SEQ ID NO: 151925 - protein, 9 aa, Artificial Sequence
  Description of Artificial Sequence: Synthetic peptide
  Seed: FYDPEPILC (PRAME_HUMAN)
FADPEPILF

SEQ ID NO: 151926 - protein, 10 aa, Artificial Sequence
  Description of Artificial Sequence: Synthetic peptide
  Seed: YSFPEPEAAQ (PRAME_HUMAN)
YMFPEPEAAL

SEQ ID NO: 151927 - protein, 10 aa, Artificial Sequence
  Description of Artificial Sequence: Synthetic peptide
  Seed: SNLTHVLYPV (PRAME_HUMAN)
SQLTHVLYPM

SEQ ID NO: 151928 - protein, 10 aa, Artificial Sequence
  Description of Artificial Sequence: Synthetic peptide
  Seed: KAVLDGLDVL (PRAME_HUMAN)
KQVLDGLDVI

SEQ ID NO: 151929 - protein, 9 aa, Artificial Sequence
  Description of Artificial Sequence: Synthetic peptide
  Seed: TCLPLGVLM (PRAME_HUMAN)
TTLPLGVLF

SEQ ID NO: 151930 - protein, 9 aa, Artificial Sequence
  Description of Artificial Sequence: Synthetic peptide
  Seed: YIAQFTSQF (PRAME_HUMAN)
YSAQFTSQI

SEQ ID NO: 151931 - protein, 10 aa, Artificial Sequence
  Description of Artificial Sequence: Synthetic peptide
  Seed: CTWKLPTLAK (PRAME_HUMAN)
CFWKLPTLAR

SEQ ID NO: 151932 - protein, 9 aa, Artificial Sequence
  Description of Artificial Sequence: Synthetic peptide
  Seed: TFYDPEPIL (PRAME_HUMAN)
TYYDPEPIY

SEQ ID NO: 151933 - protein, 9 aa, Artificial Sequence
  Description of Artificial Sequence: Synthetic peptide
  Seed: LSEGDVMHL (PRAME_HUMAN)
LAEGDVMHW

SEQ ID NO: 151934 - protein, 10 aa, Artificial Sequence
  Description of Artificial Sequence: Synthetic peptide
  Seed: FLSLQCLQAL (PRAME_HUMAN)
FQSLQCLQAV

SEQ ID NO: 151935 - protein, 9 aa, Artificial Sequence
  Description of Artificial Sequence: Synthetic peptide
  Seed: SLQCLQALY (PRAME_HUMAN)
SVQCLQALY

SEQ ID NO: 151936 - protein, 9 aa, Artificial Sequence
  Description of Artificial Sequence: Synthetic peptide
  Seed: DSLFFLRGR (PRAME_HUMAN)
DSLFFLRGK

SEQ ID NO: 151937 - protein, 9 aa, Artificial Sequence
  Description of Artificial Sequence: Synthetic peptide
  Seed: YLGQMINLR (PRAME_HUMAN)
YIGQMINLR

SEQ ID NO: 151938 - protein, 9 aa, Artificial Sequence
  Description of Artificial Sequence: Synthetic peptide
  Seed: VSPEPLQAL (PRAME_HUMAN)
VEPEPLQAV

SEQ ID NO: 151939 - protein, 10 aa, Artificial Sequence
  Description of Artificial Sequence: Synthetic peptide
  Seed: QAWPFTCLPL (PRAME_HUMAN)
QTWPFTCLPM

SEQ ID NO: 151940 - protein, 9 aa, Artificial Sequence
  Description of Artificial Sequence: Synthetic peptide
  Seed: LAYLHARLR (PRAME_HUMAN)
LIYLHARLR

SEQ ID NO: 151941 - protein, 9 aa, Artificial Sequence
  Description of Artificial Sequence: Synthetic peptide
  Seed: RWKLQVLDL (PRAME_HUMAN)
RTKLQVLDM

SEQ ID NO: 151942 - protein, 10 aa, Artificial Sequence
  Description of Artificial Sequence: Synthetic peptide
  Seed: LLSHIHASSY (PRAME_HUMAN)
LSSHIHASSY

SEQ ID NO: 151943 - protein, 9 aa, Artificial Sequence
  Description of Artificial Sequence: Synthetic peptide
  Seed: LCELGRPSM (PRAME_HUMAN)
LAELGRPSL

SEQ ID NO: 151944 - protein, 9 aa, Artificial Sequence
  Description of Artificial Sequence: Synthetic peptide
  Seed: VSPEPLQAL (PRAME_HUMAN)
VLPEPLQAR

SEQ ID NO: 151945 - protein, 9 aa, Artificial Sequence
  Description of Artificial Sequence: Synthetic peptide
  Seed: MVQAWPFTC (PRAME_HUMAN)
MFQAWPFTV

SEQ ID NO: 151946 - protein, 10 aa, Artificial Sequence
  Description of Artificial Sequence: Synthetic peptide
  Seed: ESYEDIHGTL (PRAME_HUMAN)
EAYEDIHGTV

SEQ ID NO: 151947 - protein, 10 aa, Artificial Sequence
  Description of Artificial Sequence: Synthetic peptide
  Seed: FFLRGRLDQL (PRAME_HUMAN)
FGLRGRLDQI

SEQ ID NO: 151948 - protein, 9 aa, Artificial Sequence
  Description of Artificial Sequence: Synthetic peptide
  Seed: SIQSRYISM (PRAME_HUMAN)
SFQSRYISL

SEQ ID NO: 151949 - protein, 10 aa, Artificial Sequence
  Description of Artificial Sequence: Synthetic peptide
  Seed: RRRLWGSIQS (PRAME_HUMAN)
RCRLWGSIQK

SEQ ID NO: 151950 - protein, 11 aa, Artificial Sequence
  Description of Artificial Sequence: Synthetic peptide
  Seed: LPTLAKFSPYL (PRAME_HUMAN)
LGTLAKFSPYI

SEQ ID NO: 151951 - protein, 9 aa, Artificial Sequence
  Description of Artificial Sequence: Synthetic peptide
  Seed: VLYPVPLES (PRAME_HUMAN)
VMYPVPLEM

SEQ ID NO: 151952 - protein, 11 aa, Artificial Sequence
  Description of Artificial Sequence: Synthetic peptide
  Seed: MKGQHLHLETF (PRAME_HUMAN)
MEGQHLHLETY

SEQ ID NO: 151953 - protein, 9 aa, Artificial Sequence
  Description of Artificial Sequence: Synthetic peptide
  Seed: SHCSQLTTL (PRAME_HUMAN)
SYCSQLTTL

SEQ ID NO: 151954 - protein, 9 aa, Artificial Sequence
  Description of Artificial Sequence: Synthetic peptide
  Seed: YISMSVWTS (PRAME_HUMAN)
YVSMSVWTI

SEQ ID NO: 151955 - protein, 9 aa, Artificial Sequence
  Description of Artificial Sequence: Synthetic peptide
  Seed: QLLALLPSL (PRAME_HUMAN)
QQLALLPSV

SEQ ID NO: 151956 - protein, 9 aa, Artificial Sequence
  Description of Artificial Sequence: Synthetic peptide
  Seed: ACDELFSYL (PRAME_HUMAN)
AQDELFSYA

SEQ ID NO: 151957 - protein, 9 aa, Artificial Sequence
  Description of Artificial Sequence: Synthetic peptide
  Seed: ISPEKEEQY (PRAME_HUMAN)
IMPEKEEQF

SEQ ID NO: 151958 - protein, 9 aa, Artificial Sequence
  Description of Artificial Sequence: Synthetic peptide
  Seed: ISISALQSL (PRAME_HUMAN)
IPISALQSF

SEQ ID NO: 151959 - protein, 10 aa, Artificial Sequence
  Description of Artificial Sequence: Synthetic peptide
  Seed: GLSNLTHVLY (PRAME_HUMAN)
GVSNLTHVLY

SEQ ID NO: 151960 - protein, 9 aa, Artificial Sequence
  Description of Artificial Sequence: Synthetic peptide
  Seed: TLAKFSPYL (PRAME_HUMAN)
TVAKFSPYL

SEQ ID NO: 151961 - protein, 9 aa, Artificial Sequence
  Description of Artificial Sequence: Synthetic peptide
  Seed: TDDQLLALL (PRAME_HUMAN)
TEDQLLALA

SEQ ID NO: 151962 - protein, 10 aa, Artificial Sequence
  Description of Artificial Sequence: Synthetic peptide
  Seed: LLPRELFPPL (PRAME_HUMAN)
LHPRELFPPI

SEQ ID NO: 151963 - protein, 9 aa, Artificial Sequence
  Description of Artificial Sequence: Synthetic peptide
  Seed: TLHLERLAY (PRAME_HUMAN)
TMHLERLAF

SEQ ID NO: 151964 - protein, 10 aa, Artificial Sequence
  Description of Artificial Sequence: Synthetic peptide
  Seed: QAWPFTCLPL (PRAME_HUMAN)
QIWPFTCLPV

SEQ ID NO: 151965 - protein, 9 aa, Artificial Sequence
  Description of Artificial Sequence: Synthetic peptide
  Seed: ITDDQLLAL (PRAME_HUMAN)
IHDDQLLAL

SEQ ID NO: 151966 - protein, 9 aa, Artificial Sequence
  Description of Artificial Sequence: Synthetic peptide
  Seed: ASSYISPEK (PRAME_HUMAN)
AMSYISPER

SEQ ID NO: 151967 - protein, 10 aa, Artificial Sequence
  Description of Artificial Sequence: Synthetic peptide
  Seed: QAWPFTCLPL (PRAME_HUMAN)
QSWPFTCLPY

SEQ ID NO: 151968 - protein, 10 aa, Artificial Sequence
  Description of Artificial Sequence: Synthetic peptide
  Seed: RHVMNPLETL (PRAME_HUMAN)
RLVMNPLETA

SEQ ID NO: 151969 - protein, 9 aa, Artificial Sequence
  Description of Artificial Sequence: Synthetic peptide
  Seed: LSTEAEQPF (PRAME_HUMAN)
LSTEAEQPW

SEQ ID NO: 151970 - protein, 9 aa, Artificial Sequence
  Description of Artificial Sequence: Synthetic peptide
  Seed: SIQSRYISM (PRAME_HUMAN)
SFQSRYISM

SEQ ID NO: 151971 - protein, 9 aa, Artificial Sequence
  Description of Artificial Sequence: Synthetic peptide
  Seed: IGLSNLTHV (PRAME_HUMAN)
IVLSNLTHL

SEQ ID NO: 151972 - protein, 10 aa, Artificial Sequence
  Description of Artificial Sequence: Synthetic peptide
  Seed: FFLRGRLDQL (PRAME_HUMAN)
FNLRGRLDQA

SEQ ID NO: 151973 - protein, 10 aa, Artificial Sequence
  Description of Artificial Sequence: Synthetic peptide
  Seed: IGLSNLTHVL (PRAME_HUMAN)
ILLSNLTHVQ

SEQ ID NO: 151974 - protein, 10 aa, Artificial Sequence
  Description of Artificial Sequence: Synthetic peptide
  Seed: ESYEDIHGTL (PRAME_HUMAN)
EAYEDIHGTR

SEQ ID NO: 151975 - protein, 9 aa, Artificial Sequence
  Description of Artificial Sequence: Synthetic peptide
  Seed: SLLQHLIGL (PRAME_HUMAN)
SVLQHLIGK

SEQ ID NO: 151976 - protein, 9 aa, Artificial Sequence
  Description of Artificial Sequence: Synthetic peptide
  Seed: VLYPVPLES (PRAME_HUMAN)
VTYPVPLEL

SEQ ID NO: 151977 - protein, 9 aa, Artificial Sequence
  Description of Artificial Sequence: Synthetic peptide
  Seed: TLAKFSPYL (PRAME_HUMAN)
TMAKFSPYF

SEQ ID NO: 151978 - protein, 9 aa, Artificial Sequence
  Description of Artificial Sequence: Synthetic peptide
  Seed: ALLPSLSHC (PRAME_HUMAN)
AQLPSLSHV

SEQ ID NO: 151979 - protein, 8 aa, Artificial Sequence
  Description of Artificial Sequence: Synthetic peptide
  Seed: VLDGLDVL (PRAME_HUMAN)
VVDGLDVL

SEQ ID NO: 151980 - protein, 10 aa, Artificial Sequence
  Description of Artificial Sequence: Synthetic peptide
  Seed: QLLALLPSLS (PRAME_HUMAN)
QQLALLPSLL

SEQ ID NO: 151981 - protein, 11 aa, Artificial Sequence
  Description of Artificial Sequence: Synthetic peptide
  Seed: IAQFTSQFLSL (PRAME_HUMAN)
IMQFTSQFLSY

SEQ ID NO: 151982 - protein, 9 aa, Artificial Sequence
  Description of Artificial Sequence: Synthetic peptide
  Seed: RLLLSHIHA (PRAME_HUMAN)
RSLLSHIHA

SEQ ID NO: 151983 - protein, 8 aa, Artificial Sequence
  Description of Artificial Sequence: Synthetic peptide
  Seed: RRWKLQVL (PRAME_HUMAN)
RRWKLQVF

SEQ ID NO: 151984 - protein, 10 aa, Artificial Sequence
  Description of Artificial Sequence: Synthetic peptide
  Seed: QSLLQHLIGL (PRAME_HUMAN)
QHLLQHLIGV

SEQ ID NO: 151985 - protein, 9 aa, Artificial Sequence
  Description of Artificial Sequence: Synthetic peptide
  Seed: YGNSISISA (PRAME_HUMAN)
YINSISISF

SEQ ID NO: 151986 - protein, 9 aa, Artificial Sequence
  Description of Artificial Sequence: Synthetic peptide
  Seed: LSTEAEQPF (PRAME_HUMAN)
LMTEAEQPY

SEQ ID NO: 151987 - protein, 9 aa, Artificial Sequence
  Description of Artificial Sequence: Synthetic peptide
  Seed: SLLQHLIGL (PRAME_HUMAN)
STLQHLIGM

SEQ ID NO: 151988 - protein, 9 aa, Artificial Sequence
  Description of Artificial Sequence: Synthetic peptide
  Seed: FYDPEPILC (PRAME_HUMAN)
FMDPEPILV

SEQ ID NO: 151989 - protein, 9 aa, Artificial Sequence
  Description of Artificial Sequence: Synthetic peptide
  Seed: RTFYDPEPI (PRAME_HUMAN)
RSFYDPEPW

SEQ ID NO: 151990 - protein, 9 aa, Artificial Sequence
  Description of Artificial Sequence: Synthetic peptide
  Seed: SHIHASSYI (PRAME_HUMAN)
SHIHASSYA

SEQ ID NO: 151991 - protein, 9 aa, Artificial Sequence
  Description of Artificial Sequence: Synthetic peptide
  Seed: YGNSISISA (PRAME_HUMAN)
YANSISISL

SEQ ID NO: 151992 - protein, 9 aa, Artificial Sequence
  Description of Artificial Sequence: Synthetic peptide
  Seed: RLWGSIQSR (PRAME_HUMAN)
RIWGSIQSL

SEQ ID NO: 151993 - protein, 9 aa, Artificial Sequence
  Description of Artificial Sequence: Synthetic peptide
  Seed: KAMVQAWPF (PRAME_HUMAN)
KWMVQAWPI

SEQ ID NO: 151994 - protein, 9 aa, Artificial Sequence
  Description of Artificial Sequence: Synthetic peptide
  Seed: EDLEVTCTW (PRAME_HUMAN)
EVLEVTCTF

SEQ ID NO: 151995 - protein, 9 aa, Artificial Sequence
  Description of Artificial Sequence: Synthetic peptide
  Seed: VFDECGITD (PRAME_HUMAN)
VSDECGITF

SEQ ID NO: 151996 - protein, 9 aa, Artificial Sequence
  Description of Artificial Sequence: Synthetic peptide
  Seed: MSVWTSPRR (PRAME_HUMAN)
MMVWTSPRR

SEQ ID NO: 151997 - protein, 10 aa, Artificial Sequence
  Description of Artificial Sequence: Synthetic peptide
  Seed: FAMPMQDIKM (PRAME_HUMAN)
FAMPMQDIKW

SEQ ID NO: 151998 - protein, 9 aa, Artificial Sequence
  Description of Artificial Sequence: Synthetic peptide
  Seed: SPRRLVELA (PRAME_HUMAN)
SPRRLVELM

SEQ ID NO: 151999 - protein, 9 aa, Artificial Sequence
  Description of Artificial Sequence: Synthetic peptide
  Seed: RGRLDQLLR (PRAME_HUMAN)
RIRLDQLLK

SEQ ID NO: 152000 - protein, 10 aa, Artificial Sequence
  Description of Artificial Sequence: Synthetic peptide
  Seed: ARLRELLCEL (PRAME_HUMAN)
ARLRELLCEI

SEQ ID NO: 152001 - protein, 10 aa, Artificial Sequence
  Description of Artificial Sequence: Synthetic peptide
  Seed: SALQSLLQHL (PRAME_HUMAN)
SSLQSLLQHY

SEQ ID NO: 152002 - protein, 9 aa, Artificial Sequence
  Description of Artificial Sequence: Synthetic peptide
  Seed: MNPLETLSI (PRAME_HUMAN)
MGPLETLSM

SEQ ID NO: 152003 - protein, 10 aa, Artificial Sequence
  Description of Artificial Sequence: Synthetic peptide
  Seed: SPSVSQLSVL (PRAME_HUMAN)
SPSVSQLSVA

SEQ ID NO: 152004 - protein, 9 aa, Artificial Sequence
  Description of Artificial Sequence: Synthetic peptide
  Seed: YISMSVWTS (PRAME_HUMAN)
YLSMSVWTC

SEQ ID NO: 152005 - protein, 9 aa, Artificial Sequence
  Description of Artificial Sequence: Synthetic peptide
  Seed: RWKLQVLDL (PRAME_HUMAN)
RYKLQVLDK

SEQ ID NO: 152006 - protein, 10 aa, Artificial Sequence
  Description of Artificial Sequence: Synthetic peptide
  Seed: GQHLHLETFK (PRAME_HUMAN)
GSHLHLETFR

SEQ ID NO: 152007 - protein, 9 aa, Artificial Sequence
  Description of Artificial Sequence: Synthetic peptide
  Seed: RTFYDPEPI (PRAME_HUMAN)
RKFYDPEPM

SEQ ID NO: 152008 - protein, 9 aa, Artificial Sequence
  Description of Artificial Sequence: Synthetic peptide
  Seed: TWKLPTLAK (PRAME_HUMAN)
TTKLPTLAR

SEQ ID NO: 152009 - protein, 9 aa, Artificial Sequence
  Description of Artificial Sequence: Synthetic peptide
  Seed: AFDGRHSQT (PRAME_HUMAN)
AADGRHSQL

SEQ ID NO: 152010 - protein, 10 aa, Artificial Sequence
  Description of Artificial Sequence: Synthetic peptide
  Seed: AVLDGLDVLL (PRAME_HUMAN)
AMLDGLDVLK

SEQ ID NO: 152011 - protein, 10 aa, Artificial Sequence
  Description of Artificial Sequence: Synthetic peptide
  Seed: YGNSISISAL (PRAME_HUMAN)
YANSISISAL

SEQ ID NO: 152012 - protein, 9 aa, Artificial Sequence
  Description of Artificial Sequence: Synthetic peptide
  Seed: LYVDSLFFL (PRAME_HUMAN)
LGVDSLFFV

SEQ ID NO: 152013 - protein, 9 aa, Artificial Sequence
  Description of Artificial Sequence: Synthetic peptide
  Seed: ISISALQSL (PRAME_HUMAN)
IVISALQSY

SEQ ID NO: 152014 - protein, 10 aa, Artificial Sequence
  Description of Artificial Sequence: Synthetic peptide
  Seed: LLLSHIHASS (PRAME_HUMAN)
LFLSHIHASA

SEQ ID NO: 152015 - protein, 9 aa, Artificial Sequence
  Description of Artificial Sequence: Synthetic peptide
  Seed: VSPEPLQAL (PRAME_HUMAN)
VIPEPLQAL

SEQ ID NO: 152016 - protein, 8 aa, Artificial Sequence
  Description of Artificial Sequence: Synthetic peptide
  Seed: YPVPLESY (PRAME_HUMAN)
YPVPLESA

SEQ ID NO: 152017 - protein, 10 aa, Artificial Sequence
  Description of Artificial Sequence: Synthetic peptide
  Seed: LLPRELFPPL (PRAME_HUMAN)
LRPRELFPPI

SEQ ID NO: 152018 - protein, 10 aa, Artificial Sequence
  Description of Artificial Sequence: Synthetic peptide
  Seed: TVWSGNRASL (PRAME_HUMAN)
TPWSGNRASV

SEQ ID NO: 152019 - protein, 10 aa, Artificial Sequence
  Description of Artificial Sequence: Synthetic peptide
  Seed: FAMPMQDIKM (PRAME_HUMAN)
FVMPMQDIKA

SEQ ID NO: 152020 - protein, 10 aa, Artificial Sequence
  Description of Artificial Sequence: Synthetic peptide
  Seed: ITDDQLLALL (PRAME_HUMAN)
IGDDQLLALF

SEQ ID NO: 152021 - protein, 10 aa, Artificial Sequence
  Description of Artificial Sequence: Synthetic peptide
  Seed: RLSEGDVMHL (PRAME_HUMAN)
RQSEGDVMHF

SEQ ID NO: 152022 - protein, 9 aa, Artificial Sequence
  Description of Artificial Sequence: Synthetic peptide
  Seed: YIAQFTSQF (PRAME_HUMAN)
YEAQFTSQY

SEQ ID NO: 152023 - protein, 9 aa, Artificial Sequence
  Description of Artificial Sequence: Synthetic peptide
  Seed: VSQLSVLSL (PRAME_HUMAN)
VAQLSVLSY

SEQ ID NO: 152024 - protein, 10 aa, Artificial Sequence
  Description of Artificial Sequence: Synthetic peptide
  Seed: SALQSLLQHL (PRAME_HUMAN)
SILQSLLQHI

SEQ ID NO: 152025 - protein, 9 aa, Artificial Sequence
  Description of Artificial Sequence: Synthetic peptide
  Seed: ISISALQSL (PRAME_HUMAN)
ILISALQSY

SEQ ID NO: 152026 - protein, 11 aa, Artificial Sequence
  Description of Artificial Sequence: Synthetic peptide
  Seed: CTWKLPTLAKF (PRAME_HUMAN)
CAWKLPTLAKW

SEQ ID NO: 152027 - protein, 10 aa, Artificial Sequence
  Description of Artificial Sequence: Synthetic peptide
  Seed: RELFPPLFMA (PRAME_HUMAN)
RDLFPPLFMM

SEQ ID NO: 152028 - protein, 9 aa, Artificial Sequence
  Description of Artificial Sequence: Synthetic peptide
  Seed: YLIEKVKRK (PRAME_HUMAN)
YMIEKVKRL

SEQ ID NO: 152029 - protein, 8 aa, Artificial Sequence
  Description of Artificial Sequence: Synthetic peptide
  Seed: ITDDQLLA (PRAME_HUMAN)
IVDDQLLF

SEQ ID NO: 152030 - protein, 9 aa, Artificial Sequence
  Description of Artificial Sequence: Synthetic peptide
  Seed: LSANPCPHC (PRAME_HUMAN)
LAANPCPHF

SEQ ID NO: 152031 - protein, 9 aa, Artificial Sequence
  Description of Artificial Sequence: Synthetic peptide
  Seed: YLHARLREL (PRAME_HUMAN)
YEHARLREY

SEQ ID NO: 152032 - protein, 10 aa, Artificial Sequence
  Description of Artificial Sequence: Synthetic peptide
  Seed: FFLRGRLDQL (PRAME_HUMAN)
FMLRGRLDQM

SEQ ID NO: 152033 - protein, 8 aa, Artificial Sequence
  Description of Artificial Sequence: Synthetic peptide
  Seed: YEDIHGTL (PRAME_HUMAN)
YVDIHGTM

SEQ ID NO: 152034 - protein, 9 aa, Artificial Sequence
  Description of Artificial Sequence: Synthetic peptide
  Seed: LPRELFPPL (PRAME_HUMAN)
LARELFPPL

SEQ ID NO: 152035 - protein, 9 aa, Artificial Sequence
  Description of Artificial Sequence: Synthetic peptide
  Seed: LQSLLQHLI (PRAME_HUMAN)
LQSLLQHLM

SEQ ID NO: 152036 - protein, 10 aa, Artificial Sequence
  Description of Artificial Sequence: Synthetic peptide
  Seed: ARLRELLCEL (PRAME_HUMAN)
ARLRELLCEA

SEQ ID NO: 152037 - protein, 10 aa, Artificial Sequence
  Description of Artificial Sequence: Synthetic peptide
  Seed: HASSYISPEK (PRAME_HUMAN)
HVSSYISPEK

SEQ ID NO: 152038 - protein, 9 aa, Artificial Sequence
  Description of Artificial Sequence: Synthetic peptide
  Seed: QSRYISMSV (PRAME_HUMAN)
QARYISMSA

SEQ ID NO: 152039 - protein, 9 aa, Artificial Sequence
  Description of Artificial Sequence: Synthetic peptide
  Seed: THVLYPVPL (PRAME_HUMAN)
TRVLYPVPF

SEQ ID NO: 152040 - protein, 10 aa, Artificial Sequence
  Description of Artificial Sequence: Synthetic peptide
  Seed: ALELLPRELF (PRAME_HUMAN)
APELLPRELW

SEQ ID NO: 152041 - protein, 8 aa, Artificial Sequence
  Description of Artificial Sequence: Synthetic peptide
  Seed: LFPPLFMA (PRAME_HUMAN)
LWPPLFMV

SEQ ID NO: 152042 - protein, 10 aa, Artificial Sequence
  Description of Artificial Sequence: Synthetic peptide
  Seed: TTLSFYGNSI (PRAME_HUMAN)
TYLSFYGNSV

SEQ ID NO: 152043 - protein, 11 aa, Artificial Sequence
  Description of Artificial Sequence: Synthetic peptide
  Seed: YISMSVWTSPR (PRAME_HUMAN)
YCSMSVWTSPR

SEQ ID NO: 152044 - protein, 9 aa, Artificial Sequence
  Description of Artificial Sequence: Synthetic peptide
  Seed: KLKIFAMPM (PRAME_HUMAN)
KVKIFAMPM

SEQ ID NO: 152045 - protein, 10 aa, Artificial Sequence
  Description of Artificial Sequence: Synthetic peptide
  Seed: YIAQFTSQFL (PRAME_HUMAN)
YMAQFTSQFV

SEQ ID NO: 152046 - protein, 10 aa, Artificial Sequence
  Description of Artificial Sequence: Synthetic peptide
  Seed: DVSPEPLQAL (PRAME_HUMAN)
DVSPEPLQAY

SEQ ID NO: 152047 - protein, 9 aa, Artificial Sequence
  Description of Artificial Sequence: Synthetic peptide
  Seed: EAAQPMTKK (PRAME_HUMAN)
ENAQPMTKR

SEQ ID NO: 152048 - protein, 9 aa, Artificial Sequence
  Description of Artificial Sequence: Synthetic peptide
  Seed: SFYGNSISI (PRAME_HUMAN)
SCYGNSISL

SEQ ID NO: 152049 - protein, 10 aa, Artificial Sequence
  Description of Artificial Sequence: Synthetic peptide
  Seed: YISPEKEEQY (PRAME_HUMAN)
YQSPEKEEQF

SEQ ID NO: 152050 - protein, 9 aa, Artificial Sequence
  Description of Artificial Sequence: Synthetic peptide
  Seed: GQHLHLETF (PRAME_HUMAN)
GHHLHLETL

SEQ ID NO: 152051 - protein, 10 aa, Artificial Sequence
  Description of Artificial Sequence: Synthetic peptide
  Seed: GITDDQLLAL (PRAME_HUMAN)
GQTDDQLLAI

SEQ ID NO: 152052 - protein, 8 aa, Artificial Sequence
  Description of Artificial Sequence: Synthetic peptide
  Seed: SQLTTLSF (PRAME_HUMAN)
SQLTTLSL

SEQ ID NO: 152053 - protein, 9 aa, Artificial Sequence
  Description of Artificial Sequence: Synthetic peptide
  Seed: ALQSLLQHL (PRAME_HUMAN)
ALQSLLQHY

SEQ ID NO: 152054 - protein, 9 aa, Artificial Sequence
  Description of Artificial Sequence: Synthetic peptide
  Seed: SRYISMSVW (PRAME_HUMAN)
SMYISMSVM

SEQ ID NO: 152055 - protein, 9 aa, Artificial Sequence
  Description of Artificial Sequence: Synthetic peptide
  Seed: LSNLTHVLY (PRAME_HUMAN)
LINLTHVLY

SEQ ID NO: 152056 - protein, 9 aa, Artificial Sequence
  Description of Artificial Sequence: Synthetic peptide
  Seed: LFPPLFMAA (PRAME_HUMAN)
LWPPLFMAL

SEQ ID NO: 152057 - protein, 9 aa, Artificial Sequence
  Description of Artificial Sequence: Synthetic peptide
  Seed: EDLEVTCTW (PRAME_HUMAN)
EVLEVTCTI

SEQ ID NO: 152058 - protein, 9 aa, Artificial Sequence
  Description of Artificial Sequence: Synthetic peptide
  Seed: EPLQALLER (PRAME_HUMAN)
EYLQALLEK

SEQ ID NO: 152059 - protein, 9 aa, Artificial Sequence
  Description of Artificial Sequence: Synthetic peptide
  Seed: ITDDQLLAL (PRAME_HUMAN)
ILDDQLLAM

SEQ ID NO: 152060 - protein, 9 aa, Artificial Sequence
  Description of Artificial Sequence: Synthetic peptide
  Seed: WLSANPCPH (PRAME_HUMAN)
WLSANPCPY

SEQ ID NO: 152061 - protein, 9 aa, Artificial Sequence
  Description of Artificial Sequence: Synthetic peptide
  Seed: LVELAGQSL (PRAME_HUMAN)
LWELAGQSL

SEQ ID NO: 152062 - protein, 9 aa, Artificial Sequence
  Description of Artificial Sequence: Synthetic peptide
  Seed: LSTEAEQPF (PRAME_HUMAN)
LVTEAEQPF

SEQ ID NO: 152063 - protein, 9 aa, Artificial Sequence
  Description of Artificial Sequence: Synthetic peptide
  Seed: ALYVDSLFF (PRAME_HUMAN)
ATYVDSLFL

SEQ ID NO: 152064 - protein, 9 aa, Artificial Sequence
  Description of Artificial Sequence: Synthetic peptide
  Seed: ASATLQDLV (PRAME_HUMAN)
ALATLQDLA

SEQ ID NO: 152065 - protein, 11 aa, Artificial Sequence
  Description of Artificial Sequence: Synthetic peptide
  Seed: GTLHLERLAYL (PRAME_HUMAN)
GRLHLERLAYV

SEQ ID NO: 152066 - protein, 8 aa, Artificial Sequence
  Description of Artificial Sequence: Synthetic peptide
  Seed: LGRPSMVW (PRAME_HUMAN)
LSRPSMVW

SEQ ID NO: 152067 - protein, 9 aa, Artificial Sequence
  Description of Artificial Sequence: Synthetic peptide
  Seed: SLLQHLIGL (PRAME_HUMAN)
SQLQHLIGA

SEQ ID NO: 152068 - protein, 9 aa, Artificial Sequence
  Description of Artificial Sequence: Synthetic peptide
  Seed: SEGDVMHLS (PRAME_HUMAN)
SEGDVMHLT

SEQ ID NO: 152069 - protein, 9 aa, Artificial Sequence
  Description of Artificial Sequence: Synthetic peptide
  Seed: SFYGNSISI (PRAME_HUMAN)
SFYGNSISF

SEQ ID NO: 152070 - protein, 10 aa, Artificial Sequence
  Description of Artificial Sequence: Synthetic peptide
  Seed: DELFSYLIEK (PRAME_HUMAN)
DCLFSYLIER

SEQ ID NO: 152071 - protein, 9 aa, Artificial Sequence
  Description of Artificial Sequence: Synthetic peptide
  Seed: GLSNLTHVL (PRAME_HUMAN)
GVSNLTHVW

SEQ ID NO: 152072 - protein, 10 aa, Artificial Sequence
  Description of Artificial Sequence: Synthetic peptide
  Seed: SMVWLSANPC (PRAME_HUMAN)
SLVWLSANPL

SEQ ID NO: 152073 - protein, 10 aa, Artificial Sequence
  Description of Artificial Sequence: Synthetic peptide
  Seed: ERLAYLHARL (PRAME_HUMAN)
EMLAYLHARV

SEQ ID NO: 152074 - protein, 10 aa, Artificial Sequence
  Description of Artificial Sequence: Synthetic peptide
  Seed: ALYVDSLFFL (PRAME_HUMAN)
AWYVDSLFFI

SEQ ID NO: 152075 - protein, 9 aa, Artificial Sequence
  Description of Artificial Sequence: Synthetic peptide
  Seed: TLHLERLAY (PRAME_HUMAN)
TRHLERLAF

SEQ ID NO: 152076 - protein, 9 aa, Artificial Sequence
  Description of Artificial Sequence: Synthetic peptide
  Seed: AVLDGLDVL (PRAME_HUMAN)
ATLDGLDVY

SEQ ID NO: 152077 - protein, 8 aa, Artificial Sequence
  Description of Artificial Sequence: Synthetic peptide
  Seed: VLDGLDVL (PRAME_HUMAN)
VIDGLDVL

SEQ ID NO: 152078 - protein, 11 aa, Artificial Sequence
  Description of Artificial Sequence: Synthetic peptide
  Seed: PRELFPPLFMA (PRAME_HUMAN)
PFELFPPLFML

SEQ ID NO: 152079 - protein, 9 aa, Artificial Sequence
  Description of Artificial Sequence: Synthetic peptide
  Seed: FPPLFMAAF (PRAME_HUMAN)
FLPLFMAAY

SEQ ID NO: 152080 - protein, 9 aa, Artificial Sequence
  Description of Artificial Sequence: Synthetic peptide
  Seed: SHIHASSYI (PRAME_HUMAN)
STIHASSYF

SEQ ID NO: 152081 - protein, 11 aa, Artificial Sequence
  Description of Artificial Sequence: Synthetic peptide
  Seed: SNLTHVLYPVP (PRAME_HUMAN)
SLLTHVLYPVK

SEQ ID NO: 152082 - protein, 9 aa, Artificial Sequence
  Description of Artificial Sequence: Synthetic peptide
  Seed: FYDPEPILC (PRAME_HUMAN)
FRDPEPILL

SEQ ID NO: 152083 - protein, 10 aa, Artificial Sequence
  Description of Artificial Sequence: Synthetic peptide
  Seed: GTLHLERLAY (PRAME_HUMAN)
GQLHLERLAF

SEQ ID NO: 152084 - protein, 10 aa, Artificial Sequence
  Description of Artificial Sequence: Synthetic peptide
  Seed: RHVMNPLETL (PRAME_HUMAN)
RLVMNPLETM

SEQ ID NO: 152085 - protein, 10 aa, Artificial Sequence
  Description of Artificial Sequence: Synthetic peptide
  Seed: SPYLGQMINL (PRAME_HUMAN)
STYLGQMINF

SEQ ID NO: 152086 - protein, 10 aa, Artificial Sequence
  Description of Artificial Sequence: Synthetic peptide
  Seed: LQALYVDSLF (PRAME_HUMAN)
LAALYVDSLY

SEQ ID NO: 152087 - protein, 9 aa, Artificial Sequence
  Description of Artificial Sequence: Synthetic peptide
  Seed: KVKRKKNVL (PRAME_HUMAN)
KTKRKKNVK

SEQ ID NO: 152088 - protein, 9 aa, Artificial Sequence
  Description of Artificial Sequence: Synthetic peptide
  Seed: WSGNRASLY (PRAME_HUMAN)
WFGNRASLY

SEQ ID NO: 152089 - protein, 11 aa, Artificial Sequence
  Description of Artificial Sequence: Synthetic peptide
  Seed: RRWKLQVLDLR (PRAME_HUMAN)
RRWKLQVLDLM

SEQ ID NO: 152090 - protein, 10 aa, Artificial Sequence
  Description of Artificial Sequence: Synthetic peptide
  Seed: HCSQLTTLSF (PRAME_HUMAN)
HSSQLTTLSF

SEQ ID NO: 152091 - protein, 9 aa, Artificial Sequence
  Description of Artificial Sequence: Synthetic peptide
  Seed: LSHIHASSY (PRAME_HUMAN)
LQHIHASSM

SEQ ID NO: 152092 - protein, 10 aa, Artificial Sequence
  Description of Artificial Sequence: Synthetic peptide
  Seed: LIGLSNLTHV (PRAME_HUMAN)
LLGLSNLTHA

SEQ ID NO: 152093 - protein, 9 aa, Artificial Sequence
  Description of Artificial Sequence: Synthetic peptide
  Seed: KEEQYIAQF (PRAME_HUMAN)
KREQYIAQY

SEQ ID NO: 152094 - protein, 9 aa, Artificial Sequence
  Description of Artificial Sequence: Synthetic peptide
  Seed: TDDQLLALL (PRAME_HUMAN)
TEDQLLALV

SEQ ID NO: 152095 - protein, 9 aa, Artificial Sequence
  Description of Artificial Sequence: Synthetic peptide
  Seed: LQHLIGLSN (PRAME_HUMAN)
LGHLIGLSF

SEQ ID NO: 152096 - protein, 9 aa, Artificial Sequence
  Description of Artificial Sequence: Synthetic peptide
  Seed: KLKIFAMPM (PRAME_HUMAN)
KMKIFAMPI

SEQ ID NO: 152097 - protein, 10 aa, Artificial Sequence
  Description of Artificial Sequence: Synthetic peptide
  Seed: SPYLGQMINL (PRAME_HUMAN)
SYYLGQMINM

SEQ ID NO: 152098 - protein, 8 aa, Artificial Sequence
  Description of Artificial Sequence: Synthetic peptide
  Seed: YEDIHGTL (PRAME_HUMAN)
YVDIHGTI

SEQ ID NO: 152099 - protein, 10 aa, Artificial Sequence
  Description of Artificial Sequence: Synthetic peptide
  Seed: KGQHLHLETF (PRAME_HUMAN)
KRQHLHLETY

SEQ ID NO: 152100 - protein, 9 aa, Artificial Sequence
  Description of Artificial Sequence: Synthetic peptide
  Seed: LLKDEALAI (PRAME_HUMAN)
LVKDEALAY

SEQ ID NO: 152101 - protein, 8 aa, Artificial Sequence
  Description of Artificial Sequence: Synthetic peptide
  Seed: YSFPEPEA (PRAME_HUMAN)
YSFPEPEM

SEQ ID NO: 152102 - protein, 9 aa, Artificial Sequence
  Description of Artificial Sequence: Synthetic peptide
  Seed: ALQSLLQHL (PRAME_HUMAN)
AIQSLLQHA

SEQ ID NO: 152103 - protein, 10 aa, Artificial Sequence
  Description of Artificial Sequence: Synthetic peptide
  Seed: LLPRELFPPL (PRAME_HUMAN)
LSPRELFPPI

SEQ ID NO: 152104 - protein, 9 aa, Artificial Sequence
  Description of Artificial Sequence: Synthetic peptide
  Seed: FYDPEPILC (PRAME_HUMAN)
FRDPEPILI

SEQ ID NO: 152105 - protein, 10 aa, Artificial Sequence
  Description of Artificial Sequence: Synthetic peptide
  Seed: IKMILKMVQL (PRAME_HUMAN)
ILMILKMVQI

SEQ ID NO: 152106 - protein, 9 aa, Artificial Sequence
  Description of Artificial Sequence: Synthetic peptide
  Seed: VQAWPFTCL (PRAME_HUMAN)
VVAWPFTCY

SEQ ID NO: 152107 - protein, 9 aa, Artificial Sequence
  Description of Artificial Sequence: Synthetic peptide
  Seed: YIAQFTSQF (PRAME_HUMAN)
YTAQFTSQM

SEQ ID NO: 152108 - protein, 11 aa, Artificial Sequence
  Description of Artificial Sequence: Synthetic peptide
  Seed: AVLDGLDVLLA (PRAME_HUMAN)
AMLDGLDVLLL

SEQ ID NO: 152109 - protein, 9 aa, Artificial Sequence
  Description of Artificial Sequence: Synthetic peptide
  Seed: LQALYVDSL (PRAME_HUMAN)
LQALYVDSI

SEQ ID NO: 152110 - protein, 9 aa, Artificial Sequence
  Description of Artificial Sequence: Synthetic peptide
  Seed: ALQSLLQHL (PRAME_HUMAN)
AVQSLLQHI

SEQ ID NO: 152111 - protein, 9 aa, Artificial Sequence
  Description of Artificial Sequence: Synthetic peptide
  Seed: ITDDQLLAL (PRAME_HUMAN)
IWDDQLLAC

SEQ ID NO: 152112 - protein, 11 aa, Artificial Sequence
  Description of Artificial Sequence: Synthetic peptide
  Seed: GTLHLERLAYL (PRAME_HUMAN)
GFLHLERLAYI

SEQ ID NO: 152113 - protein, 9 aa, Artificial Sequence
  Description of Artificial Sequence: Synthetic peptide
  Seed: KAMVQAWPF (PRAME_HUMAN)
KIMVQAWPY

SEQ ID NO: 152114 - protein, 9 aa, Artificial Sequence
  Description of Artificial Sequence: Synthetic peptide
  Seed: SIQSRYISM (PRAME_HUMAN)
SRQSRYISF

SEQ ID NO: 152115 - protein, 9 aa, Artificial Sequence
  Description of Artificial Sequence: Synthetic peptide
  Seed: LSTEAEQPF (PRAME_HUMAN)
LQTEAEQPM

SEQ ID NO: 152116 - protein, 11 aa, Artificial Sequence
  Description of Artificial Sequence: Synthetic peptide
  Seed: AEQPFIPVEVL (PRAME_HUMAN)
AEQPFIPVEVI

SEQ ID NO: 152117 - protein, 9 aa, Artificial Sequence
  Description of Artificial Sequence: Synthetic peptide
  Seed: YLHARLREL (PRAME_HUMAN)
YSHARLREI

SEQ ID NO: 152118 - protein, 9 aa, Artificial Sequence
  Description of Artificial Sequence: Synthetic peptide
  Seed: KVDGLSTEA (PRAME_HUMAN)
KIDGLSTEF

SEQ ID NO: 152119 - protein, 9 aa, Artificial Sequence
  Description of Artificial Sequence: Synthetic peptide
  Seed: RLLLSHIHA (PRAME_HUMAN)
RLLLSHIHV

SEQ ID NO: 152120 - protein, 10 aa, Artificial Sequence
  Description of Artificial Sequence: Synthetic peptide
  Seed: ITDDQLLALL (PRAME_HUMAN)
ISDDQLLALI

SEQ ID NO: 152121 - protein, 10 aa, Artificial Sequence
  Description of Artificial Sequence: Synthetic peptide
  Seed: QYIAQFTSQF (PRAME_HUMAN)
QIIAQFTSQY

SEQ ID NO: 152122 - protein, 9 aa, Artificial Sequence
  Description of Artificial Sequence: Synthetic peptide
  Seed: MPMQDIKMI (PRAME_HUMAN)
MPMQDIKMV

SEQ ID NO: 152123 - protein, 9 aa, Artificial Sequence
  Description of Artificial Sequence: Synthetic peptide
  Seed: ISPEKEEQY (PRAME_HUMAN)
IGPEKEEQM

SEQ ID NO: 152124 - protein, 10 aa, Artificial Sequence
  Description of Artificial Sequence: Synthetic peptide
  Seed: IKMILKMVQL (PRAME_HUMAN)
IDMILKMVQV

SEQ ID NO: 152125 - protein, 9 aa, Artificial Sequence
  Description of Artificial Sequence: Synthetic peptide
  Seed: ITDDQLLAL (PRAME_HUMAN)
IQDDQLLAM

SEQ ID NO: 152126 - protein, 9 aa, Artificial Sequence
  Description of Artificial Sequence: Synthetic peptide
  Seed: SLLQHLIGL (PRAME_HUMAN)
SRLQHLIGM

SEQ ID NO: 152127 - protein, 10 aa, Artificial Sequence
  Description of Artificial Sequence: Synthetic peptide
  Seed: KGQHLHLETF (PRAME_HUMAN)
KVQHLHLETY

SEQ ID NO: 152128 - protein, 10 aa, Artificial Sequence
  Description of Artificial Sequence: Synthetic peptide
  Seed: IQSRYISMSV (PRAME_HUMAN)
IMSRYISMSF

SEQ ID NO: 152129 - protein, 9 aa, Artificial Sequence
  Description of Artificial Sequence: Synthetic peptide
  Seed: TDDQLLALL (PRAME_HUMAN)
TGDQLLALM

SEQ ID NO: 152130 - protein, 9 aa, Artificial Sequence
  Description of Artificial Sequence: Synthetic peptide
  Seed: LSHIHASSY (PRAME_HUMAN)
LYHIHASSY

SEQ ID NO: 152131 - protein, 11 aa, Artificial Sequence
  Description of Artificial Sequence: Synthetic peptide
  Seed: RTFYDPEPILC (PRAME_HUMAN)
RAFYDPEPILF

SEQ ID NO: 152132 - protein, 9 aa, Artificial Sequence
  Description of Artificial Sequence: Synthetic peptide
  Seed: HLETFKAVL (PRAME_HUMAN)
HVETFKAVY

SEQ ID NO: 152133 - protein, 9 aa, Artificial Sequence
  Description of Artificial Sequence: Synthetic peptide
  Seed: EVLVDLFLK (PRAME_HUMAN)
EGLVDLFLR

SEQ ID NO: 152134 - protein, 9 aa, Artificial Sequence
  Description of Artificial Sequence: Synthetic peptide
  Seed: VLYPVPLES (PRAME_HUMAN)
VMYPVPLET

SEQ ID NO: 152135 - protein, 9 aa, Artificial Sequence
  Description of Artificial Sequence: Synthetic peptide
  Seed: VQLDSIEDL (PRAME_HUMAN)
VYLDSIEDY

SEQ ID NO: 152136 - protein, 11 aa, Artificial Sequence
  Description of Artificial Sequence: Synthetic peptide
  Seed: KMVQLDSIEDL (PRAME_HUMAN)
KLVQLDSIEDF

SEQ ID NO: 152137 - protein, 9 aa, Artificial Sequence
  Description of Artificial Sequence: Synthetic peptide
  Seed: LGQMINLRR (PRAME_HUMAN)
LTQMINLRR

SEQ ID NO: 152138 - protein, 9 aa, Artificial Sequence
  Description of Artificial Sequence: Synthetic peptide
  Seed: ACDELFSYL (PRAME_HUMAN)
AFDELFSYV

SEQ ID NO: 152139 - protein, 9 aa, Artificial Sequence
  Description of Artificial Sequence: Synthetic peptide
  Seed: IGLSNLTHV (PRAME_HUMAN)
ITLSNLTHI

SEQ ID NO: 152140 - protein, 9 aa, Artificial Sequence
  Description of Artificial Sequence: Synthetic peptide
  Seed: RELFPPLFM (PRAME_HUMAN)
RMLFPPLFL

SEQ ID NO: 152141 - protein, 9 aa, Artificial Sequence
  Description of Artificial Sequence: Synthetic peptide
  Seed: WKLPTLAKF (PRAME_HUMAN)
WKLPTLAKY

SEQ ID NO: 152142 - protein, 9 aa, Artificial Sequence
  Description of Artificial Sequence: Synthetic peptide
  Seed: LHLETFKAV (PRAME_HUMAN)
LHLETFKAI

SEQ ID NO: 152143 - protein, 9 aa, Artificial Sequence
  Description of Artificial Sequence: Synthetic peptide
  Seed: GACDELFSY (PRAME_HUMAN)
GACDELFSW

SEQ ID NO: 152144 - protein, 11 aa, Artificial Sequence
  Description of Artificial Sequence: Synthetic peptide
  Seed: SYEDIHGTLHL (PRAME_HUMAN)
SYEDIHGTLHF

SEQ ID NO: 152145 - protein, 10 aa, Artificial Sequence
  Description of Artificial Sequence: Synthetic peptide
  Seed: FIPVEVLVDL (PRAME_HUMAN)
FCPVEVLVDF

SEQ ID NO: 152146 - protein, 9 aa, Artificial Sequence
  Description of Artificial Sequence: Synthetic peptide
  Seed: KAMVQAWPF (PRAME_HUMAN)
KMMVQAWPL

SEQ ID NO: 152147 - protein, 10 aa, Artificial Sequence
  Description of Artificial Sequence: Synthetic peptide
  Seed: FFLRGRLDQL (PRAME_HUMAN)
FCLRGRLDQI

SEQ ID NO: 152148 - protein, 10 aa, Artificial Sequence
  Description of Artificial Sequence: Synthetic peptide
  Seed: ALYVDSLFFL (PRAME_HUMAN)
AIYVDSLFFA

SEQ ID NO: 152149 - protein, 10 aa, Artificial Sequence
  Description of Artificial Sequence: Synthetic peptide
  Seed: LLLSHIHASS (PRAME_HUMAN)
LFLSHIHASL

SEQ ID NO: 152150 - protein, 10 aa, Artificial Sequence
  Description of Artificial Sequence: Synthetic peptide
  Seed: MVQAWPFTCL (PRAME_HUMAN)
MSQAWPFTCY

SEQ ID NO: 152151 - protein, 9 aa, Artificial Sequence
  Description of Artificial Sequence: Synthetic peptide
  Seed: QLLALLPSL (PRAME_HUMAN)
QTLALLPSV

SEQ ID NO: 152152 - protein, 10 aa, Artificial Sequence
  Description of Artificial Sequence: Synthetic peptide
  Seed: RASATLQDLV (PRAME_HUMAN)
RWSATLQDLW

SEQ ID NO: 152153 - protein, 10 aa, Artificial Sequence
  Description of Artificial Sequence: Synthetic peptide
  Seed: HCSQLTTLSF (PRAME_HUMAN)
HTSQLTTLSF

SEQ ID NO: 152154 - protein, 9 aa, Artificial Sequence
  Description of Artificial Sequence: Synthetic peptide
  Seed: YSFPEPEAA (PRAME_HUMAN)
YAFPEPEAV

SEQ ID NO: 152155 - protein, 9 aa, Artificial Sequence
  Description of Artificial Sequence: Synthetic peptide
  Seed: VFDECGITD (PRAME_HUMAN)
VYDECGITI

SEQ ID NO: 152156 - protein, 9 aa, Artificial Sequence
  Description of Artificial Sequence: Synthetic peptide
  Seed: NSHQDFWTV (PRAME_HUMAN)
NLHQDFWTM

SEQ ID NO: 152157 - protein, 9 aa, Artificial Sequence
  Description of Artificial Sequence: Synthetic peptide
  Seed: KAMVQAWPF (PRAME_HUMAN)
KRMVQAWPL

SEQ ID NO: 152158 - protein, 9 aa, Artificial Sequence
  Description of Artificial Sequence: Synthetic peptide
  Seed: FTCLPLGVL (PRAME_HUMAN)
FICLPLGVV

SEQ ID NO: 152159 - protein, 10 aa, Artificial Sequence
  Description of Artificial Sequence: Synthetic peptide
  Seed: LSLQCLQALY (PRAME_HUMAN)
LQLQCLQALF

SEQ ID NO: 152160 - protein, 9 aa, Artificial Sequence
  Description of Artificial Sequence: Synthetic peptide
  Seed: SISALQSLL (PRAME_HUMAN)
SLSALQSLW

SEQ ID NO: 152161 - protein, 10 aa, Artificial Sequence
  Description of Artificial Sequence: Synthetic peptide
  Seed: LLPRELFPPL (PRAME_HUMAN)
LGPRELFPPM

SEQ ID NO: 152162 - protein, 9 aa, Artificial Sequence
  Description of Artificial Sequence: Synthetic peptide
  Seed: LELLPRELF (PRAME_HUMAN)
LQLLPRELL

SEQ ID NO: 152163 - protein, 9 aa, Artificial Sequence
  Description of Artificial Sequence: Synthetic peptide
  Seed: SFYGNSISI (PRAME_HUMAN)
SKYGNSISM

SEQ ID NO: 152164 - protein, 10 aa, Artificial Sequence
  Description of Artificial Sequence: Synthetic peptide
  Seed: QSLLQHLIGL (PRAME_HUMAN)
QALLQHLIGV

SEQ ID NO: 152165 - protein, 10 aa, Artificial Sequence
  Description of Artificial Sequence: Synthetic peptide
  Seed: RELFPPLFMA (PRAME_HUMAN)
RELFPPLFMF

SEQ ID NO: 152166 - protein, 11 aa, Artificial Sequence
  Description of Artificial Sequence: Synthetic peptide
  Seed: LPTLAKFSPYL (PRAME_HUMAN)
LNTLAKFSPYL

SEQ ID NO: 152167 - protein, 10 aa, Artificial Sequence
  Description of Artificial Sequence: Synthetic peptide
  Seed: RLAYLHARLR (PRAME_HUMAN)
RTAYLHARLR

SEQ ID NO: 152168 - protein, 11 aa, Artificial Sequence
  Description of Artificial Sequence: Synthetic peptide
  Seed: HLSQSPSVSQL (PRAME_HUMAN)
HLSQSPSVSQF

SEQ ID NO: 152169 - protein, 8 aa, Artificial Sequence
  Description of Artificial Sequence: Synthetic peptide
  Seed: YEDIHGTL (PRAME_HUMAN)
YIDIHGTL

SEQ ID NO: 152170 - protein, 9 aa, Artificial Sequence
  Description of Artificial Sequence: Synthetic peptide
  Seed: ELFSYLIEK (PRAME_HUMAN)
EFFSYLIEK

SEQ ID NO: 152171 - protein, 10 aa, Artificial Sequence
  Description of Artificial Sequence: Synthetic peptide
  Seed: VELAGQSLLK (PRAME_HUMAN)
VTLAGQSLLR

SEQ ID NO: 152172 - protein, 9 aa, Artificial Sequence
  Description of Artificial Sequence: Synthetic peptide
  Seed: RTFYDPEPI (PRAME_HUMAN)
RSFYDPEPF

SEQ ID NO: 152173 - protein, 9 aa, Artificial Sequence
  Description of Artificial Sequence: Synthetic peptide
  Seed: SVWTSPRRL (PRAME_HUMAN)
SLWTSPRRI

SEQ ID NO: 152174 - protein, 9 aa, Artificial Sequence
  Description of Artificial Sequence: Synthetic peptide
  Seed: ALLPSLSHC (PRAME_HUMAN)
ALLPSLSHT

SEQ ID NO: 152175 - protein, 9 aa, Artificial Sequence
  Description of Artificial Sequence: Synthetic peptide
  Seed: AVLDGLDVL (PRAME_HUMAN)
AMLDGLDVL

SEQ ID NO: 152176 - protein, 10 aa, Artificial Sequence
  Description of Artificial Sequence: Synthetic peptide
  Seed: RLSEGDVMHL (PRAME_HUMAN)
RSSEGDVMHR

SEQ ID NO: 152177 - protein, 10 aa, Artificial Sequence
  Description of Artificial Sequence: Synthetic peptide
  Seed: NLTHVLYPVP (PRAME_HUMAN)
NMTHVLYPVI

SEQ ID NO: 152178 - protein, 9 aa, Artificial Sequence
  Description of Artificial Sequence: Synthetic peptide
  Seed: YEDIHGTLH (PRAME_HUMAN)
YSDIHGTLK

SEQ ID NO: 152179 - protein, 9 aa, Artificial Sequence
  Description of Artificial Sequence: Synthetic peptide
  Seed: SQSPSVSQL (PRAME_HUMAN)
STSPSVSQY

SEQ ID NO: 152180 - protein, 9 aa, Artificial Sequence
  Description of Artificial Sequence: Synthetic peptide
  Seed: SHIHASSYI (PRAME_HUMAN)
SKIHASSYM

SEQ ID NO: 152181 - protein, 10 aa, Artificial Sequence
  Description of Artificial Sequence: Synthetic peptide
  Seed: LLSHIHASSY (PRAME_HUMAN)
LASHIHASSY

SEQ ID NO: 152182 - protein, 11 aa, Artificial Sequence
  Description of Artificial Sequence: Synthetic peptide
  Seed: VQLDSIEDLEV (PRAME_HUMAN)
VMLDSIEDLEL

SEQ ID NO: 152183 - protein, 9 aa, Artificial Sequence
  Description of Artificial Sequence: Synthetic peptide
  Seed: VSPEPLQAL (PRAME_HUMAN)
VYPEPLQAY

SEQ ID NO: 152184 - protein, 11 aa, Artificial Sequence
  Description of Artificial Sequence: Synthetic peptide
  Seed: FLSLQCLQALY (PRAME_HUMAN)
FLSLQCLQALV

SEQ ID NO: 152185 - protein, 10 aa, Artificial Sequence
  Description of Artificial Sequence: Synthetic peptide
  Seed: LSHCSQLTTL (PRAME_HUMAN)
LTHCSQLTTW

SEQ ID NO: 152186 - protein, 9 aa, Artificial Sequence
  Description of Artificial Sequence: Synthetic peptide
  Seed: SFYGNSISI (PRAME_HUMAN)
SLYGNSISY

SEQ ID NO: 152187 - protein, 10 aa, Artificial Sequence
  Description of Artificial Sequence: Synthetic peptide
  Seed: LLSHIHASSY (PRAME_HUMAN)
LWSHIHASSY

SEQ ID NO: 152188 - protein, 9 aa, Artificial Sequence
  Description of Artificial Sequence: Synthetic peptide
  Seed: SRYISMSVW (PRAME_HUMAN)
SQYISMSVM

SEQ ID NO: 152189 - protein, 11 aa, Artificial Sequence
  Description of Artificial Sequence: Synthetic peptide
  Seed: AAFDGRHSQTL (PRAME_HUMAN)
APFDGRHSQTF

SEQ ID NO: 152190 - protein, 9 aa, Artificial Sequence
  Description of Artificial Sequence: Synthetic peptide
  Seed: HLIGLSNLT (PRAME_HUMAN)
HLIGLSNLI

SEQ ID NO: 152191 - protein, 9 aa, Artificial Sequence
  Description of Artificial Sequence: Synthetic peptide
  Seed: GLSNLTHVL (PRAME_HUMAN)
GQSNLTHVV

SEQ ID NO: 152192 - protein, 9 aa, Artificial Sequence
  Description of Artificial Sequence: Synthetic peptide
  Seed: QLLALLPSL (PRAME_HUMAN)
QVLALLPSV

SEQ ID NO: 152193 - protein, 9 aa, Artificial Sequence
  Description of Artificial Sequence: Synthetic peptide
  Seed: RHSQTLKAM (PRAME_HUMAN)
RWSQTLKAL

SEQ ID NO: 152194 - protein, 9 aa, Artificial Sequence
  Description of Artificial Sequence: Synthetic peptide
  Seed: FYDPEPILC (PRAME_HUMAN)
FWDPEPILY

SEQ ID NO: 152195 - protein, 9 aa, Artificial Sequence
  Description of Artificial Sequence: Synthetic peptide
  Seed: RLRELLCEL (PRAME_HUMAN)
RARELLCER

SEQ ID NO: 152196 - protein, 9 aa, Artificial Sequence
  Description of Artificial Sequence: Synthetic peptide
  Seed: SMSVWTSPR (PRAME_HUMAN)
SASVWTSPR

SEQ ID NO: 152197 - protein, 10 aa, Artificial Sequence
  Description of Artificial Sequence: Synthetic peptide
  Seed: QSLLQHLIGL (PRAME_HUMAN)
QFLLQHLIGL

SEQ ID NO: 152198 - protein, 8 aa, Artificial Sequence
  Description of Artificial Sequence: Synthetic peptide
  Seed: SQLTTLSF (PRAME_HUMAN)
SQLTTLSM

SEQ ID NO: 152199 - protein, 8 aa, Artificial Sequence
  Description of Artificial Sequence: Synthetic peptide
  Seed: ITDDQLLA (PRAME_HUMAN)
ITDDQLLI

SEQ ID NO: 152200 - protein, 9 aa, Artificial Sequence
  Description of Artificial Sequence: Synthetic peptide
  Seed: LTDVSPEPL (PRAME_HUMAN)
LSDVSPEPI

SEQ ID NO: 152201 - protein, 9 aa, Artificial Sequence
  Description of Artificial Sequence: Synthetic peptide
  Seed: ACDELFSYL (PRAME_HUMAN)
AIDELFSYV

SEQ ID NO: 152202 - protein, 10 aa, Artificial Sequence
  Description of Artificial Sequence: Synthetic peptide
  Seed: FAMPMQDIKM (PRAME_HUMAN)
FTMPMQDIKM

SEQ ID NO: 152203 - protein, 10 aa, Artificial Sequence
  Description of Artificial Sequence: Synthetic peptide
  Seed: FSYLIEKVKR (PRAME_HUMAN)
FTYLIEKVKR

SEQ ID NO: 152204 - protein, 9 aa, Artificial Sequence
  Description of Artificial Sequence: Synthetic peptide
  Seed: LFPPLFMAA (PRAME_HUMAN)
LYPPLFMAL

SEQ ID NO: 152205 - protein, 9 aa, Artificial Sequence
  Description of Artificial Sequence: Synthetic peptide
  Seed: RTFYDPEPI (PRAME_HUMAN)
RFFYDPEPY

SEQ ID NO: 152206 - protein, 9 aa, Artificial Sequence
  Description of Artificial Sequence: Synthetic peptide
  Seed: YVDSLFFLR (PRAME_HUMAN)
YADSLFFLK

SEQ ID NO: 152207 - protein, 10 aa, Artificial Sequence
  Description of Artificial Sequence: Synthetic peptide
  Seed: YSFPEPEAAQ (PRAME_HUMAN)
YGFPEPEAAL

SEQ ID NO: 152208 - protein, 10 aa, Artificial Sequence
  Description of Artificial Sequence: Synthetic peptide
  Seed: ISISALQSLL (PRAME_HUMAN)
IMISALQSLA

SEQ ID NO: 152209 - protein, 11 aa, Artificial Sequence
  Description of Artificial Sequence: Synthetic peptide
  Seed: AAFDGRHSQTL (PRAME_HUMAN)
ATFDGRHSQTL

SEQ ID NO: 152210 - protein, 9 aa, Artificial Sequence
  Description of Artificial Sequence: Synthetic peptide
  Seed: ASATLQDLV (PRAME_HUMAN)
AVATLQDLW

SEQ ID NO: 152211 - protein, 9 aa, Artificial Sequence
  Description of Artificial Sequence: Synthetic peptide
  Seed: ITDDQLLAL (PRAME_HUMAN)
ICDDQLLAM

SEQ ID NO: 152212 - protein, 10 aa, Artificial Sequence
  Description of Artificial Sequence: Synthetic peptide
  Seed: MPMQDIKMIL (PRAME_HUMAN)
MNMQDIKMIL

SEQ ID NO: 152213 - protein, 9 aa, Artificial Sequence
  Description of Artificial Sequence: Synthetic peptide
  Seed: TLSFYGNSI (PRAME_HUMAN)
TMSFYGNSA

SEQ ID NO: 152214 - protein, 10 aa, Artificial Sequence
  Description of Artificial Sequence: Synthetic peptide
  Seed: SLLKDEALAI (PRAME_HUMAN)
SCLKDEALAV

SEQ ID NO: 152215 - protein, 9 aa, Artificial Sequence
  Description of Artificial Sequence: Synthetic peptide
  Seed: LMKGQHLHL (PRAME_HUMAN)
LLKGQHLHF

SEQ ID NO: 152216 - protein, 9 aa, Artificial Sequence
  Description of Artificial Sequence: Synthetic peptide
  Seed: ESYEDIHGT (PRAME_HUMAN)
EVYEDIHGI

SEQ ID NO: 152217 - protein, 9 aa, Artificial Sequence
  Description of Artificial Sequence: Synthetic peptide
  Seed: YSFPEPEAA (PRAME_HUMAN)
YNFPEPEAM

SEQ ID NO: 152218 - protein, 10 aa, Artificial Sequence
  Description of Artificial Sequence: Synthetic peptide
  Seed: LSFYGNSISI (PRAME_HUMAN)
LSFYGNSISF

SEQ ID NO: 152219 - protein, 9 aa, Artificial Sequence
  Description of Artificial Sequence: Synthetic peptide
  Seed: SIQSRYISM (PRAME_HUMAN)
SMQSRYISL

SEQ ID NO: 152220 - protein, 11 aa, Artificial Sequence
  Description of Artificial Sequence: Synthetic peptide
  Seed: KAVLDGLDVLL (PRAME_HUMAN)
KTVLDGLDVLW

SEQ ID NO: 152221 - protein, 9 aa, Artificial Sequence
  Description of Artificial Sequence: Synthetic peptide
  Seed: LSEGDVMHL (PRAME_HUMAN)
LIEGDVMHL

SEQ ID NO: 152222 - protein, 8 aa, Artificial Sequence
  Description of Artificial Sequence: Synthetic peptide
  Seed: FYGNSISI (PRAME_HUMAN)
FYGNSISF

SEQ ID NO: 152223 - protein, 10 aa, Artificial Sequence
  Description of Artificial Sequence: Synthetic peptide
  Seed: FIPVEVLVDL (PRAME_HUMAN)
FWPVEVLVDF

SEQ ID NO: 152224 - protein, 10 aa, Artificial Sequence
  Description of Artificial Sequence: Synthetic peptide
  Seed: KFSPYLGQMI (PRAME_HUMAN)
KYSPYLGQML

SEQ ID NO: 152225 - protein, 9 aa, Artificial Sequence
  Description of Artificial Sequence: Synthetic peptide
  Seed: LSTEAEQPF (PRAME_HUMAN)
LMTEAEQPM

SEQ ID NO: 152226 - protein, 9 aa, Artificial Sequence
  Description of Artificial Sequence: Synthetic peptide
  Seed: VSPEPLQAL (PRAME_HUMAN)
VMPEPLQAY

SEQ ID NO: 152227 - protein, 10 aa, Artificial Sequence
  Description of Artificial Sequence: Synthetic peptide
  Seed: SISISALQSL (PRAME_HUMAN)
SESISALQSY

SEQ ID NO: 152228 - protein, 9 aa, Artificial Sequence
  Description of Artificial Sequence: Synthetic peptide
  Seed: KLKIFAMPM (PRAME_HUMAN)
KMKIFAMPM

SEQ ID NO: 152229 - protein, 10 aa, Artificial Sequence
  Description of Artificial Sequence: Synthetic peptide
  Seed: RELFPPLFMA (PRAME_HUMAN)
RPLFPPLFML

SEQ ID NO: 152230 - protein, 10 aa, Artificial Sequence
  Description of Artificial Sequence: Synthetic peptide
  Seed: EALAIAALEL (PRAME_HUMAN)
EFLAIAALEV

SEQ ID NO: 152231 - protein, 10 aa, Artificial Sequence
  Description of Artificial Sequence: Synthetic peptide
  Seed: FFLRGRLDQL (PRAME_HUMAN)
FYLRGRLDQV

SEQ ID NO: 152232 - protein, 9 aa, Artificial Sequence
  Description of Artificial Sequence: Synthetic peptide
  Seed: TLKAMVQAW (PRAME_HUMAN)
TSKAMVQAW

SEQ ID NO: 152233 - protein, 9 aa, Artificial Sequence
  Description of Artificial Sequence: Synthetic peptide
  Seed: RRLWGSIQS (PRAME_HUMAN)
RRLWGSIQM

SEQ ID NO: 152234 - protein, 10 aa, Artificial Sequence
  Description of Artificial Sequence: Synthetic peptide
  Seed: LLPRELFPPL (PRAME_HUMAN)
LHPRELFPPL

SEQ ID NO: 152235 - protein, 9 aa, Artificial Sequence
  Description of Artificial Sequence: Synthetic peptide
  Seed: RHSQTLKAM (PRAME_HUMAN)
RYSQTLKAY

SEQ ID NO: 152236 - protein, 9 aa, Artificial Sequence
  Description of Artificial Sequence: Synthetic peptide
  Seed: MVQAWPFTC (PRAME_HUMAN)
MLQAWPFTF

SEQ ID NO: 152237 - protein, 9 aa, Artificial Sequence
  Description of Artificial Sequence: Synthetic peptide
  Seed: YLHARLREL (PRAME_HUMAN)
YIHARLREY

SEQ ID NO: 152238 - protein, 10 aa, Artificial Sequence
  Description of Artificial Sequence: Synthetic peptide
  Seed: QSLLQHLIGL (PRAME_HUMAN)
QGLLQHLIGI

SEQ ID NO: 152239 - protein, 10 aa, Artificial Sequence
  Description of Artificial Sequence: Synthetic peptide
  Seed: RLAYLHARLR (PRAME_HUMAN)
RWAYLHARLK

SEQ ID NO: 152240 - protein, 9 aa, Artificial Sequence
  Description of Artificial Sequence: Synthetic peptide
  Seed: TSPRRLVEL (PRAME_HUMAN)
TTPRRLVEY

SEQ ID NO: 152241 - protein, 10 aa, Artificial Sequence
  Description of Artificial Sequence: Synthetic peptide
  Seed: LLPRELFPPL (PRAME_HUMAN)
LYPRELFPPV

SEQ ID NO: 152242 - protein, 9 aa, Artificial Sequence
  Description of Artificial Sequence: Synthetic peptide
  Seed: LLRHVMNPL (PRAME_HUMAN)
LMRHVMNPL

SEQ ID NO: 152243 - protein, 10 aa, Artificial Sequence
  Description of Artificial Sequence: Synthetic peptide
  Seed: AKFSPYLGQM (PRAME_HUMAN)
ARFSPYLGQM

SEQ ID NO: 152244 - protein, 10 aa, Artificial Sequence
  Description of Artificial Sequence: Synthetic peptide
  Seed: RHVMNPLETL (PRAME_HUMAN)
RRVMNPLETM

SEQ ID NO: 152245 - protein, 10 aa, Artificial Sequence
  Description of Artificial Sequence: Synthetic peptide
  Seed: IQSRYISMSV (PRAME_HUMAN)
IWSRYISMSK

SEQ ID NO: 152246 - protein, 10 aa, Artificial Sequence
  Description of Artificial Sequence: Synthetic peptide
  Seed: PTLAKFSPYL (PRAME_HUMAN)
PSLAKFSPYV

SEQ ID NO: 152247 - protein, 9 aa, Artificial Sequence
  Description of Artificial Sequence: Synthetic peptide
  Seed: LSEGDVMHL (PRAME_HUMAN)
LQEGDVMHF

SEQ ID NO: 152248 - protein, 9 aa, Artificial Sequence
  Description of Artificial Sequence: Synthetic peptide
  Seed: AEQPFIPVE (PRAME_HUMAN)
ADQPFIPVM

SEQ ID NO: 152249 - protein, 9 aa, Artificial Sequence
  Description of Artificial Sequence: Synthetic peptide
  Seed: THVLYPVPL (PRAME_HUMAN)
TFVLYPVPM

SEQ ID NO: 152250 - protein, 9 aa, Artificial Sequence
  Description of Artificial Sequence: Synthetic peptide
  Seed: SQSPSVSQL (PRAME_HUMAN)
SESPSVSQF

SEQ ID NO: 152251 - protein, 9 aa, Artificial Sequence
  Description of Artificial Sequence: Synthetic peptide
  Seed: KMILKMVQL (PRAME_HUMAN)
KQILKMVQW

SEQ ID NO: 152252 - protein, 9 aa, Artificial Sequence
  Description of Artificial Sequence: Synthetic peptide
  Seed: DGRHSQTLK (PRAME_HUMAN)
DTRHSQTLR

SEQ ID NO: 152253 - protein, 9 aa, Artificial Sequence
  Description of Artificial Sequence: Synthetic peptide
  Seed: KLKIFAMPM (PRAME_HUMAN)
KQKIFAMPV

SEQ ID NO: 152254 - protein, 9 aa, Artificial Sequence
  Description of Artificial Sequence: Synthetic peptide
  Seed: WKLPTLAKF (PRAME_HUMAN)
WMLPTLAKM

SEQ ID NO: 152255 - protein, 10 aa, Artificial Sequence
  Description of Artificial Sequence: Synthetic peptide
  Seed: FIPVEVLVDL (PRAME_HUMAN)
FVPVEVLVDF

SEQ ID NO: 152256 - protein, 10 aa, Artificial Sequence
  Description of Artificial Sequence: Synthetic peptide
  Seed: ITDDQLLALL (PRAME_HUMAN)
IFDDQLLALM

SEQ ID NO: 152257 - protein, 10 aa, Artificial Sequence
  Description of Artificial Sequence: Synthetic peptide
  Seed: LLPRELFPPL (PRAME_HUMAN)
LKPRELFPPL

SEQ ID NO: 152258 - protein, 10 aa, Artificial Sequence
  Description of Artificial Sequence: Synthetic peptide
  Seed: FFLRGRLDQL (PRAME_HUMAN)
FYLRGRLDQM

SEQ ID NO: 152259 - protein, 9 aa, Artificial Sequence
  Description of Artificial Sequence: Synthetic peptide
  Seed: VLYPVPLES (PRAME_HUMAN)
VQYPVPLEV

SEQ ID NO: 152260 - protein, 11 aa, Artificial Sequence
  Description of Artificial Sequence: Synthetic peptide
  Seed: SIQSRYISMSV (PRAME_HUMAN)
SDQSRYISMSK

SEQ ID NO: 152261 - protein, 10 aa, Artificial Sequence
  Description of Artificial Sequence: Synthetic peptide
  Seed: KNVLRLCCKK (PRAME_HUMAN)
KAVLRLCCKR

SEQ ID NO: 152262 - protein, 9 aa, Artificial Sequence
  Description of Artificial Sequence: Synthetic peptide
  Seed: LQHLIGLSN (PRAME_HUMAN)
LHHLIGLSM

SEQ ID NO: 152263 - protein, 9 aa, Artificial Sequence
  Description of Artificial Sequence: Synthetic peptide
  Seed: SQLTTLSFY (PRAME_HUMAN)
SMLTTLSFW

SEQ ID NO: 152264 - protein, 9 aa, Artificial Sequence
  Description of Artificial Sequence: Synthetic peptide
  Seed: HLIGLSNLT (PRAME_HUMAN)
HLIGLSNLA

SEQ ID NO: 152265 - protein, 9 aa, Artificial Sequence
  Description of Artificial Sequence: Synthetic peptide
  Seed: KAMVQAWPF (PRAME_HUMAN)
KLMVQAWPM

SEQ ID NO: 152266 - protein, 9 aa, Artificial Sequence
  Description of Artificial Sequence: Synthetic peptide
  Seed: AFDGRHSQT (PRAME_HUMAN)
AMDGRHSQM

SEQ ID NO: 152267 - protein, 9 aa, Artificial Sequence
  Description of Artificial Sequence: Synthetic peptide
  Seed: YVDSLFFLR (PRAME_HUMAN)
YGDSLFFLY

SEQ ID NO: 152268 - protein, 9 aa, Artificial Sequence
  Description of Artificial Sequence: Synthetic peptide
  Seed: SQSPSVSQL (PRAME_HUMAN)
SASPSVSQL

SEQ ID NO: 152269 - protein, 9 aa, Artificial Sequence
  Description of Artificial Sequence: Synthetic peptide
  Seed: FPPLFMAAF (PRAME_HUMAN)
FFPLFMAAY

SEQ ID NO: 152270 - protein, 9 aa, Artificial Sequence
  Description of Artificial Sequence: Synthetic peptide
  Seed: SALQSLLQH (PRAME_HUMAN)
SALQSLLQV

SEQ ID NO: 152271 - protein, 9 aa, Artificial Sequence
  Description of Artificial Sequence: Synthetic peptide
  Seed: ASSYISPEK (PRAME_HUMAN)
AFSYISPER

SEQ ID NO: 152272 - protein, 10 aa, Artificial Sequence
  Description of Artificial Sequence: Synthetic peptide
  Seed: TSQFLSLQCL (PRAME_HUMAN)
TVQFLSLQCF

SEQ ID NO: 152273 - protein, 9 aa, Artificial Sequence
  Description of Artificial Sequence: Synthetic peptide
  Seed: YSFPEPEAA (PRAME_HUMAN)
YSFPEPEAY

SEQ ID NO: 152274 - protein, 9 aa, Artificial Sequence
  Description of Artificial Sequence: Synthetic peptide
  Seed: GACDELFSY (PRAME_HUMAN)
GTCDELFSY

SEQ ID NO: 152275 - protein, 11 aa, Artificial Sequence
  Description of Artificial Sequence: Synthetic peptide
  Seed: KIFAMPMQDIK (PRAME_HUMAN)
KWFAMPMQDIR

SEQ ID NO: 152276 - protein, 9 aa, Artificial Sequence
  Description of Artificial Sequence: Synthetic peptide
  Seed: RTFYDPEPI (PRAME_HUMAN)
RSFYDPEPL

SEQ ID NO: 152277 - protein, 10 aa, Artificial Sequence
  Description of Artificial Sequence: Synthetic peptide
  Seed: AMVQAWPFTC (PRAME_HUMAN)
ALVQAWPFTI

SEQ ID NO: 152278 - protein, 9 aa, Artificial Sequence
  Description of Artificial Sequence: Synthetic peptide
  Seed: SIQSRYISM (PRAME_HUMAN)
SGQSRYISL

SEQ ID NO: 152279 - protein, 9 aa, Artificial Sequence
  Description of Artificial Sequence: Synthetic peptide
  Seed: YIAQFTSQF (PRAME_HUMAN)
YFAQFTSQI

SEQ ID NO: 152280 - protein, 10 aa, Artificial Sequence
  Description of Artificial Sequence: Synthetic peptide
  Seed: PTLAKFSPYL (PRAME_HUMAN)
PYLAKFSPYI

SEQ ID NO: 152281 - protein, 9 aa, Artificial Sequence
  Description of Artificial Sequence: Synthetic peptide
  Seed: NSISISALQ (PRAME_HUMAN)
NNISISALK

SEQ ID NO: 152282 - protein, 9 aa, Artificial Sequence
  Description of Artificial Sequence: Synthetic peptide
  Seed: YSFPEPEAA (PRAME_HUMAN)
YRFPEPEAI

SEQ ID NO: 152283 - protein, 9 aa, Artificial Sequence
  Description of Artificial Sequence: Synthetic peptide
  Seed: VQAWPFTCL (PRAME_HUMAN)
VIAWPFTCF

SEQ ID NO: 152284 - protein, 9 aa, Artificial Sequence
  Description of Artificial Sequence: Synthetic peptide
  Seed: ACDELFSYL (PRAME_HUMAN)
AYDELFSYI

SEQ ID NO: 152285 - protein, 9 aa, Artificial Sequence
  Description of Artificial Sequence: Synthetic peptide
  Seed: ISISALQSL (PRAME_HUMAN)
IAISALQSM

SEQ ID NO: 152286 - protein, 9 aa, Artificial Sequence
  Description of Artificial Sequence: Synthetic peptide
  Seed: MVQAWPFTC (PRAME_HUMAN)
MMQAWPFTP

SEQ ID NO: 152287 - protein, 10 aa, Artificial Sequence
  Description of Artificial Sequence: Synthetic peptide
  Seed: FIPVEVLVDL (PRAME_HUMAN)
FVPVEVLVDY

SEQ ID NO: 152288 - protein, 10 aa, Artificial Sequence
  Description of Artificial Sequence: Synthetic peptide
  Seed: FTCLPLGVLM (PRAME_HUMAN)
FSCLPLGVLF

SEQ ID NO: 152289 - protein, 10 aa, Artificial Sequence
  Description of Artificial Sequence: Synthetic peptide
  Seed: ETLSITNCRL (PRAME_HUMAN)
EWLSITNCRR

SEQ ID NO: 152290 - protein, 10 aa, Artificial Sequence
  Description of Artificial Sequence: Synthetic peptide
  Seed: LSTEAEQPFI (PRAME_HUMAN)
LSTEAEQPFW

SEQ ID NO: 152291 - protein, 9 aa, Artificial Sequence
  Description of Artificial Sequence: Synthetic peptide
  Seed: SQSPSVSQL (PRAME_HUMAN)
SISPSVSQI

SEQ ID NO: 152292 - protein, 9 aa, Artificial Sequence
  Description of Artificial Sequence: Synthetic peptide
  Seed: VSPEPLQAL (PRAME_HUMAN)
VSPEPLQAK

SEQ ID NO: 152293 - protein, 10 aa, Artificial Sequence
  Description of Artificial Sequence: Synthetic peptide
  Seed: LLPRELFPPL (PRAME_HUMAN)
LGPRELFPPL

SEQ ID NO: 152294 - protein, 10 aa, Artificial Sequence
  Description of Artificial Sequence: Synthetic peptide
  Seed: LLSHIHASSY (PRAME_HUMAN)
LPSHIHASSW

SEQ ID NO: 152295 - protein, 9 aa, Artificial Sequence
  Description of Artificial Sequence: Synthetic peptide
  Seed: LAIAALELL (PRAME_HUMAN)
LTIAALELF

SEQ ID NO: 152296 - protein, 9 aa, Artificial Sequence
  Description of Artificial Sequence: Synthetic peptide
  Seed: AAFDGRHSQ (PRAME_HUMAN)
AVFDGRHSM

SEQ ID NO: 152297 - protein, 9 aa, Artificial Sequence
  Description of Artificial Sequence: Synthetic peptide
  Seed: ISISALQSL (PRAME_HUMAN)
IVISALQSF

SEQ ID NO: 152298 - protein, 9 aa, Artificial Sequence
  Description of Artificial Sequence: Synthetic peptide
  Seed: RTFYDPEPI (PRAME_HUMAN)
RIFYDPEPK

SEQ ID NO: 152299 - protein, 9 aa, Artificial Sequence
  Description of Artificial Sequence: Synthetic peptide
  Seed: ISISALQSL (PRAME_HUMAN)
IMISALQSL

SEQ ID NO: 152300 - protein, 10 aa, Artificial Sequence
  Description of Artificial Sequence: Synthetic peptide
  Seed: MERRRLWGSI (PRAME_HUMAN)
MMRRRLWGSL

SEQ ID NO: 152301 - protein, 9 aa, Artificial Sequence
  Description of Artificial Sequence: Synthetic peptide
  Seed: LSHIHASSY (PRAME_HUMAN)
LKHIHASSF

SEQ ID NO: 152302 - protein, 9 aa, Artificial Sequence
  Description of Artificial Sequence: Synthetic peptide
  Seed: LLKDEALAI (PRAME_HUMAN)
LVKDEALAM

SEQ ID NO: 152303 - protein, 10 aa, Artificial Sequence
  Description of Artificial Sequence: Synthetic peptide
  Seed: VELAGQSLLK (PRAME_HUMAN)
VDLAGQSLLK

SEQ ID NO: 152304 - protein, 9 aa, Artificial Sequence
  Description of Artificial Sequence: Synthetic peptide
  Seed: SQSPSVSQL (PRAME_HUMAN)
SVSPSVSQA

SEQ ID NO: 152305 - protein, 9 aa, Artificial Sequence
  Description of Artificial Sequence: Synthetic peptide
  Seed: HVMNPLETL (PRAME_HUMAN)
HAMNPLETR

SEQ ID NO: 152306 - protein, 9 aa, Artificial Sequence
  Description of Artificial Sequence: Synthetic peptide
  Seed: ESYEDIHGT (PRAME_HUMAN)
EAYEDIHGI

SEQ ID NO: 152307 - protein, 8 aa, Artificial Sequence
  Description of Artificial Sequence: Synthetic peptide
  Seed: FSYLIEKV (PRAME_HUMAN)
FQYLIEKV

SEQ ID NO: 152308 - protein, 10 aa, Artificial Sequence
  Description of Artificial Sequence: Synthetic peptide
  Seed: IKMILKMVQL (PRAME_HUMAN)
IYMILKMVQV

SEQ ID NO: 152309 - protein, 10 aa, Artificial Sequence
  Description of Artificial Sequence: Synthetic peptide
  Seed: MVQAWPFTCL (PRAME_HUMAN)
MMQAWPFTCV

SEQ ID NO: 152310 - protein, 9 aa, Artificial Sequence
  Description of Artificial Sequence: Synthetic peptide
  Seed: EQPFIPVEV (PRAME_HUMAN)
EIPFIPVEI

SEQ ID NO: 152311 - protein, 9 aa, Artificial Sequence
  Description of Artificial Sequence: Synthetic peptide
  Seed: SRYISMSVW (PRAME_HUMAN)
SVYISMSVF

SEQ ID NO: 152312 - protein, 10 aa, Artificial Sequence
  Description of Artificial Sequence: Synthetic peptide
  Seed: YIAQFTSQFL (PRAME_HUMAN)
YYAQFTSQFF

SEQ ID NO: 152313 - protein, 11 aa, Artificial Sequence
  Description of Artificial Sequence: Synthetic peptide
  Seed: RLAYLHARLRE (PRAME_HUMAN)
RVAYLHARLRR

SEQ ID NO: 152314 - protein, 9 aa, Artificial Sequence
  Description of Artificial Sequence: Synthetic peptide
  Seed: EAAQPMTKK (PRAME_HUMAN)
ESAQPMTKK

SEQ ID NO: 152315 - protein, 9 aa, Artificial Sequence
  Description of Artificial Sequence: Synthetic peptide
  Seed: YSFPEPEAA (PRAME_HUMAN)
YAFPEPEAR

SEQ ID NO: 152316 - protein, 9 aa, Artificial Sequence
  Description of Artificial Sequence: Synthetic peptide
  Seed: FLRGRLDQL (PRAME_HUMAN)
FMRGRLDQV

SEQ ID NO: 152317 - protein, 9 aa, Artificial Sequence
  Description of Artificial Sequence: Synthetic peptide
  Seed: LAIAALELL (PRAME_HUMAN)
LRIAALELF

SEQ ID NO: 152318 - protein, 11 aa, Artificial Sequence
  Description of Artificial Sequence: Synthetic peptide
  Seed: ALYVDSLFFLR (PRAME_HUMAN)
ATYVDSLFFLR

SEQ ID NO: 152319 - protein, 9 aa, Artificial Sequence
  Description of Artificial Sequence: Synthetic peptide
  Seed: KLKIFAMPM (PRAME_HUMAN)
KSKIFAMPS

SEQ ID NO: 152320 - protein, 10 aa, Artificial Sequence
  Description of Artificial Sequence: Synthetic peptide
  Seed: KAVLDGLDVL (PRAME_HUMAN)
KTVLDGLDVV

SEQ ID NO: 152321 - protein, 9 aa, Artificial Sequence
  Description of Artificial Sequence: Synthetic peptide
  Seed: KAMVQAWPF (PRAME_HUMAN)
KQMVQAWPV

SEQ ID NO: 152322 - protein, 9 aa, Artificial Sequence
  Description of Artificial Sequence: Synthetic peptide
  Seed: ITDDQLLAL (PRAME_HUMAN)
IYDDQLLAT

SEQ ID NO: 152323 - protein, 8 aa, Artificial Sequence
  Description of Artificial Sequence: Synthetic peptide
  Seed: DEALAIAA (PRAME_HUMAN)
DEALAIAL

SEQ ID NO: 152324 - protein, 9 aa, Artificial Sequence
  Description of Artificial Sequence: Synthetic peptide
  Seed: ELFPPLFMA (PRAME_HUMAN)
ELFPPLFMM

SEQ ID NO: 152325 - protein, 8 aa, Artificial Sequence
  Description of Artificial Sequence: Synthetic peptide
  Seed: YEDIHGTL (PRAME_HUMAN)
YTDIHGTI

SEQ ID NO: 152326 - protein, 10 aa, Artificial Sequence
  Description of Artificial Sequence: Synthetic peptide
  Seed: ITDDQLLALL (PRAME_HUMAN)
IYDDQLLALL

SEQ ID NO: 152327 - protein, 10 aa, Artificial Sequence
  Description of Artificial Sequence: Synthetic peptide
  Seed: FLKEGACDEL (PRAME_HUMAN)
FMKEGACDEY

SEQ ID NO: 152328 - protein, 10 aa, Artificial Sequence
  Description of Artificial Sequence: Synthetic peptide
  Seed: DELFSYLIEK (PRAME_HUMAN)
DSLFSYLIEK

SEQ ID NO: 152329 - protein, 9 aa, Artificial Sequence
  Description of Artificial Sequence: Synthetic peptide
  Seed: YLHARLREL (PRAME_HUMAN)
YAHARLREA

SEQ ID NO: 152330 - protein, 9 aa, Artificial Sequence
  Description of Artificial Sequence: Synthetic peptide
  Seed: TLAKFSPYL (PRAME_HUMAN)
TTAKFSPYR

SEQ ID NO: 152331 - protein, 9 aa, Artificial Sequence
  Description of Artificial Sequence: Synthetic peptide
  Seed: QHLIGLSNL (PRAME_HUMAN)
QHLIGLSNI

SEQ ID NO: 152332 - protein, 9 aa, Artificial Sequence
  Description of Artificial Sequence: Synthetic peptide
  Seed: RLDQLLRHV (PRAME_HUMAN)
RFDQLLRHL

SEQ ID NO: 152333 - protein, 9 aa, Artificial Sequence
  Description of Artificial Sequence: Synthetic peptide
  Seed: VSQLSVLSL (PRAME_HUMAN)
VVQLSVLSY

SEQ ID NO: 152334 - protein, 11 aa, Artificial Sequence
  Description of Artificial Sequence: Synthetic peptide
  Seed: CTWKLPTLAKF (PRAME_HUMAN)
CSWKLPTLAKW

SEQ ID NO: 152335 - protein, 9 aa, Artificial Sequence
  Description of Artificial Sequence: Synthetic peptide
  Seed: LMKGQHLHL (PRAME_HUMAN)
LFKGQHLHF

SEQ ID NO: 152336 - protein, 9 aa, Artificial Sequence
  Description of Artificial Sequence: Synthetic peptide
  Seed: LFPPLFMAA (PRAME_HUMAN)
LFPPLFMAL

SEQ ID NO: 152337 - protein, 9 aa, Artificial Sequence
  Description of Artificial Sequence: Synthetic peptide
  Seed: QLLALLPSL (PRAME_HUMAN)
QQLALLPSL

SEQ ID NO: 152338 - protein, 11 aa, Artificial Sequence
  Description of Artificial Sequence: Synthetic peptide
  Seed: FLKEGACDELF (PRAME_HUMAN)
FLKEGACDELV

SEQ ID NO: 152339 - protein, 10 aa, Artificial Sequence
  Description of Artificial Sequence: Synthetic peptide
  Seed: LSQSPSVSQL (PRAME_HUMAN)
LQQSPSVSQM

SEQ ID NO: 152340 - protein, 9 aa, Artificial Sequence
  Description of Artificial Sequence: Synthetic peptide
  Seed: LSHIHASSY (PRAME_HUMAN)
LKHIHASSI

SEQ ID NO: 152341 - protein, 10 aa, Artificial Sequence
  Description of Artificial Sequence: Synthetic peptide
  Seed: MNPLETLSIT (PRAME_HUMAN)
MCPLETLSIV

SEQ ID NO: 152342 - protein, 10 aa, Artificial Sequence
  Description of Artificial Sequence: Synthetic peptide
  Seed: LSQSPSVSQL (PRAME_HUMAN)
LKQSPSVSQF

SEQ ID NO: 152343 - protein, 10 aa, Artificial Sequence
  Description of Artificial Sequence: Synthetic peptide
  Seed: MERRRLWGSI (PRAME_HUMAN)
MVRRRLWGSV

SEQ ID NO: 152344 - protein, 9 aa, Artificial Sequence
  Description of Artificial Sequence: Synthetic peptide
  Seed: RWKLQVLDL (PRAME_HUMAN)
RSKLQVLDV

SEQ ID NO: 152345 - protein, 10 aa, Artificial Sequence
  Description of Artificial Sequence: Synthetic peptide
  Seed: RLSEGDVMHL (PRAME_HUMAN)
RTSEGDVMHR

SEQ ID NO: 152346 - protein, 10 aa, Artificial Sequence
  Description of Artificial Sequence: Synthetic peptide
  Seed: DFWTVWSGNR (PRAME_HUMAN)
DVWTVWSGNK

SEQ ID NO: 152347 - protein, 10 aa, Artificial Sequence
  Description of Artificial Sequence: Synthetic peptide
  Seed: RELFPPLFMA (PRAME_HUMAN)
RILFPPLFMI

SEQ ID NO: 152348 - protein, 10 aa, Artificial Sequence
  Description of Artificial Sequence: Synthetic peptide
  Seed: SPYLGQMINL (PRAME_HUMAN)
SAYLGQMINF

SEQ ID NO: 152349 - protein, 8 aa, Artificial Sequence
  Description of Artificial Sequence: Synthetic peptide
  Seed: LTHVLYPV (PRAME_HUMAN)
LFHVLYPV

SEQ ID NO: 152350 - protein, 11 aa, Artificial Sequence
  Description of Artificial Sequence: Synthetic peptide
  Seed: ISALQSLLQHL (PRAME_HUMAN)
ITALQSLLQHW

SEQ ID NO: 152351 - protein, 9 aa, Artificial Sequence
  Description of Artificial Sequence: Synthetic peptide
  Seed: MINLRRLLL (PRAME_HUMAN)
MPNLRRLLA

SEQ ID NO: 152352 - protein, 9 aa, Artificial Sequence
  Description of Artificial Sequence: Synthetic peptide
  Seed: SIQSRYISM (PRAME_HUMAN)
SVQSRYISL

SEQ ID NO: 152353 - protein, 9 aa, Artificial Sequence
  Description of Artificial Sequence: Synthetic peptide
  Seed: ALQSLLQHL (PRAME_HUMAN)
ALQSLLQHI

SEQ ID NO: 152354 - protein, 9 aa, Artificial Sequence
  Description of Artificial Sequence: Synthetic peptide
  Seed: SIQSRYISM (PRAME_HUMAN)
SYQSRYISF

SEQ ID NO: 152355 - protein, 9 aa, Artificial Sequence
  Description of Artificial Sequence: Synthetic peptide
  Seed: SHCSQLTTL (PRAME_HUMAN)
SLCSQLTTL

SEQ ID NO: 152356 - protein, 11 aa, Artificial Sequence
  Description of Artificial Sequence: Synthetic peptide
  Seed: FLSLQCLQALY (PRAME_HUMAN)
FNSLQCLQALL

SEQ ID NO: 152357 - protein, 10 aa, Artificial Sequence
  Description of Artificial Sequence: Synthetic peptide
  Seed: IGLSNLTHVL (PRAME_HUMAN)
ITLSNLTHVL

SEQ ID NO: 152358 - protein, 10 aa, Artificial Sequence
  Description of Artificial Sequence: Synthetic peptide
  Seed: LSFYGNSISI (PRAME_HUMAN)
LVFYGNSISL

SEQ ID NO: 152359 - protein, 9 aa, Artificial Sequence
  Description of Artificial Sequence: Synthetic peptide
  Seed: NLTHVLYPV (PRAME_HUMAN)
NITHVLYPL

SEQ ID NO: 152360 - protein, 9 aa, Artificial Sequence
  Description of Artificial Sequence: Synthetic peptide
  Seed: RGRLDQLLR (PRAME_HUMAN)
RSRLDQLLA

SEQ ID NO: 152361 - protein, 9 aa, Artificial Sequence
  Description of Artificial Sequence: Synthetic peptide
  Seed: LGRPSMVWL (PRAME_HUMAN)
LYRPSMVWK

SEQ ID NO: 152362 - protein, 10 aa, Artificial Sequence
  Description of Artificial Sequence: Synthetic peptide
  Seed: LLLSHIHASS (PRAME_HUMAN)
LPLSHIHASA

SEQ ID NO: 152363 - protein, 9 aa, Artificial Sequence
  Description of Artificial Sequence: Synthetic peptide
  Seed: SRYISMSVW (PRAME_HUMAN)
SKYISMSVW

SEQ ID NO: 152364 - protein, 10 aa, Artificial Sequence
  Description of Artificial Sequence: Synthetic peptide
  Seed: GLSNLTHVLY (PRAME_HUMAN)
GYSNLTHVLY

SEQ ID NO: 152365 - protein, 9 aa, Artificial Sequence
  Description of Artificial Sequence: Synthetic peptide
  Seed: VLMKGQHLH (PRAME_HUMAN)
VFMKGQHLY

SEQ ID NO: 152366 - protein, 10 aa, Artificial Sequence
  Description of Artificial Sequence: Synthetic peptide
  Seed: HASSYISPEK (PRAME_HUMAN)
HTSSYISPER

SEQ ID NO: 152367 - protein, 10 aa, Artificial Sequence
  Description of Artificial Sequence: Synthetic peptide
  Seed: DVSPEPLQAL (PRAME_HUMAN)
DVSPEPLQAV

SEQ ID NO: 152368 - protein, 11 aa, Artificial Sequence
  Description of Artificial Sequence: Synthetic peptide
  Seed: AAFDGRHSQTL (PRAME_HUMAN)
AMFDGRHSQTY

SEQ ID NO: 152369 - protein, 11 aa, Artificial Sequence
  Description of Artificial Sequence: Synthetic peptide
  Seed: RLSEGDVMHLS (PRAME_HUMAN)
RMSEGDVMHLI

SEQ ID NO: 152370 - protein, 10 aa, Artificial Sequence
  Description of Artificial Sequence: Synthetic peptide
  Seed: SNLTHVLYPV (PRAME_HUMAN)
SYLTHVLYPV

SEQ ID NO: 152371 - protein, 8 aa, Artificial Sequence
  Description of Artificial Sequence: Synthetic peptide
  Seed: WPFTCLPL (PRAME_HUMAN)
WAFTCLPY

SEQ ID NO: 152372 - protein, 9 aa, Artificial Sequence
  Description of Artificial Sequence: Synthetic peptide
  Seed: SQSPSVSQL (PRAME_HUMAN)
SPSPSVSQF

SEQ ID NO: 152373 - protein, 10 aa, Artificial Sequence
  Description of Artificial Sequence: Synthetic peptide
  Seed: AVLDGLDVLL (PRAME_HUMAN)
AMLDGLDVLW

SEQ ID NO: 152374 - protein, 9 aa, Artificial Sequence
  Description of Artificial Sequence: Synthetic peptide
  Seed: SIEDLEVTC (PRAME_HUMAN)
SVEDLEVTF

SEQ ID NO: 152375 - protein, 9 aa, Artificial Sequence
  Description of Artificial Sequence: Synthetic peptide
  Seed: ELFPPLFMA (PRAME_HUMAN)
EIFPPLFMA

SEQ ID NO: 152376 - protein, 10 aa, Artificial Sequence
  Description of Artificial Sequence: Synthetic peptide
  Seed: TLAKFSPYLG (PRAME_HUMAN)
TLAKFSPYLI

SEQ ID NO: 152377 - protein, 9 aa, Artificial Sequence
  Description of Artificial Sequence: Synthetic peptide
  Seed: LLKDEALAI (PRAME_HUMAN)
LAKDEALAH

SEQ ID NO: 152378 - protein, 9 aa, Artificial Sequence
  Description of Artificial Sequence: Synthetic peptide
  Seed: VFDECGITD (PRAME_HUMAN)
VYDECGITY

SEQ ID NO: 152379 - protein, 10 aa, Artificial Sequence
  Description of Artificial Sequence: Synthetic peptide
  Seed: ELFPPLFMAA (PRAME_HUMAN)
ESFPPLFMAA

SEQ ID NO: 152380 - protein, 9 aa, Artificial Sequence
  Description of Artificial Sequence: Synthetic peptide
  Seed: RWKLQVLDL (PRAME_HUMAN)
RMKLQVLDK

SEQ ID NO: 152381 - protein, 9 aa, Artificial Sequence
  Description of Artificial Sequence: Synthetic peptide
  Seed: SQLTTLSFY (PRAME_HUMAN)
SMLTTLSFY

SEQ ID NO: 152382 - protein, 9 aa, Artificial Sequence
  Description of Artificial Sequence: Synthetic peptide
  Seed: LQDLVFDEC (PRAME_HUMAN)
LADLVFDEM

SEQ ID NO: 152383 - protein, 10 aa, Artificial Sequence
  Description of Artificial Sequence: Synthetic peptide
  Seed: LSLQCLQALY (PRAME_HUMAN)
LTLQCLQALW

SEQ ID NO: 152384 - protein, 9 aa, Artificial Sequence
  Description of Artificial Sequence: Synthetic peptide
  Seed: FYDPEPILC (PRAME_HUMAN)
FSDPEPILF

SEQ ID NO: 152385 - protein, 9 aa, Artificial Sequence
  Description of Artificial Sequence: Synthetic peptide
  Seed: FYDPEPILC (PRAME_HUMAN)
FWDPEPILL

SEQ ID NO: 152386 - protein, 9 aa, Artificial Sequence
  Description of Artificial Sequence: Synthetic peptide
  Seed: YIAQFTSQF (PRAME_HUMAN)
YVAQFTSQW

SEQ ID NO: 152387 - protein, 9 aa, Artificial Sequence
  Description of Artificial Sequence: Synthetic peptide
  Seed: GLSNLTHVL (PRAME_HUMAN)
GMSNLTHVY

SEQ ID NO: 152388 - protein, 9 aa, Artificial Sequence
  Description of Artificial Sequence: Synthetic peptide
  Seed: LQDLVFDEC (PRAME_HUMAN)
LVDLVFDEV

SEQ ID NO: 152389 - protein, 10 aa, Artificial Sequence
  Description of Artificial Sequence: Synthetic peptide
  Seed: CCKKLKIFAM (PRAME_HUMAN)
CMKKLKIFAM

SEQ ID NO: 152390 - protein, 9 aa, Artificial Sequence
  Description of Artificial Sequence: Synthetic peptide
  Seed: ITDDQLLAL (PRAME_HUMAN)
IQDDQLLAL

SEQ ID NO: 152391 - protein, 10 aa, Artificial Sequence
  Description of Artificial Sequence: Synthetic peptide
  Seed: GQHLHLETFK (PRAME_HUMAN)
GFHLHLETFR

SEQ ID NO: 152392 - protein, 10 aa, Artificial Sequence
  Description of Artificial Sequence: Synthetic peptide
  Seed: TLHLERLAYL (PRAME_HUMAN)
TQHLERLAYV

SEQ ID NO: 152393 - protein, 9 aa, Artificial Sequence
  Description of Artificial Sequence: Synthetic peptide
  Seed: HVMNPLETL (PRAME_HUMAN)
HEMNPLETV

SEQ ID NO: 152394 - protein, 9 aa, Artificial Sequence
  Description of Artificial Sequence: Synthetic peptide
  Seed: CKKLKIFAM (PRAME_HUMAN)
CVKLKIFAA

SEQ ID NO: 152395 - protein, 9 aa, Artificial Sequence
  Description of Artificial Sequence: Synthetic peptide
  Seed: RLCCKKLKI (PRAME_HUMAN)
RYCCKKLKY

SEQ ID NO: 152396 - protein, 10 aa, Artificial Sequence
  Description of Artificial Sequence: Synthetic peptide
  Seed: AVLDGLDVLL (PRAME_HUMAN)
ALLDGLDVLM

SEQ ID NO: 152397 - protein, 9 aa, Artificial Sequence
  Description of Artificial Sequence: Synthetic peptide
  Seed: YIAQFTSQF (PRAME_HUMAN)
YLAQFTSQM

SEQ ID NO: 152398 - protein, 9 aa, Artificial Sequence
  Description of Artificial Sequence: Synthetic peptide
  Seed: WLSANPCPH (PRAME_HUMAN)
WSSANPCPY

SEQ ID NO: 152399 - protein, 9 aa, Artificial Sequence
  Description of Artificial Sequence: Synthetic peptide
  Seed: ESYEDIHGT (PRAME_HUMAN)
EIYEDIHGL

SEQ ID NO: 152400 - protein, 11 aa, Artificial Sequence
  Description of Artificial Sequence: Synthetic peptide
  Seed: RRWKLQVLDLR (PRAME_HUMAN)
RQWKLQVLDLR

SEQ ID NO: 152401 - protein, 9 aa, Artificial Sequence
  Description of Artificial Sequence: Synthetic peptide
  Seed: KLKIFAMPM (PRAME_HUMAN)
KVKIFAMPA

SEQ ID NO: 152402 - protein, 9 aa, Artificial Sequence
  Description of Artificial Sequence: Synthetic peptide
  Seed: KLKIFAMPM (PRAME_HUMAN)
KNKIFAMPK

SEQ ID NO: 152403 - protein, 8 aa, Artificial Sequence
  Description of Artificial Sequence: Synthetic peptide
  Seed: YVDSLFFL (PRAME_HUMAN)
YTDSLFFV

SEQ ID NO: 152404 - protein, 9 aa, Artificial Sequence
  Description of Artificial Sequence: Synthetic peptide
  Seed: AVLDGLDVL (PRAME_HUMAN)
AILDGLDVM

SEQ ID NO: 152405 - protein, 9 aa, Artificial Sequence
  Description of Artificial Sequence: Synthetic peptide
  Seed: RLCCKKLKI (PRAME_HUMAN)
RMCCKKLKF

SEQ ID NO: 152406 - protein, 9 aa, Artificial Sequence
  Description of Artificial Sequence: Synthetic peptide
  Seed: FMAAFDGRH (PRAME_HUMAN)
FQAAFDGRM

SEQ ID NO: 152407 - protein, 9 aa, Artificial Sequence
  Description of Artificial Sequence: Synthetic peptide
  Seed: LTDVSPEPL (PRAME_HUMAN)
LCDVSPEPM

SEQ ID NO: 152408 - protein, 10 aa, Artificial Sequence
  Description of Artificial Sequence: Synthetic peptide
  Seed: ISISALQSLL (PRAME_HUMAN)
IWISALQSLW

SEQ ID NO: 152409 - protein, 9 aa, Artificial Sequence
  Description of Artificial Sequence: Synthetic peptide
  Seed: LMKGQHLHL (PRAME_HUMAN)
LPKGQHLHV

SEQ ID NO: 152410 - protein, 10 aa, Artificial Sequence
  Description of Artificial Sequence: Synthetic peptide
  Seed: YVDSLFFLRG (PRAME_HUMAN)
YMDSLFFLRK

SEQ ID NO: 152411 - protein, 9 aa, Artificial Sequence
  Description of Artificial Sequence: Synthetic peptide
  Seed: LPRELFPPL (PRAME_HUMAN)
LVRELFPPY

SEQ ID NO: 152412 - protein, 9 aa, Artificial Sequence
  Description of Artificial Sequence: Synthetic peptide
  Seed: FYDPEPILC (PRAME_HUMAN)
FNDPEPILF

SEQ ID NO: 152413 - protein, 9 aa, Artificial Sequence
  Description of Artificial Sequence: Synthetic peptide
  Seed: GQHLHLETF (PRAME_HUMAN)
GMHLHLETW

SEQ ID NO: 152414 - protein, 9 aa, Artificial Sequence
  Description of Artificial Sequence: Synthetic peptide
  Seed: LGQMINLRR (PRAME_HUMAN)
LVQMINLRR

SEQ ID NO: 152415 - protein, 8 aa, Artificial Sequence
  Description of Artificial Sequence: Synthetic peptide
  Seed: HARLRELL (PRAME_HUMAN)
HSRLRELL

SEQ ID NO: 152416 - protein, 10 aa, Artificial Sequence
  Description of Artificial Sequence: Synthetic peptide
  Seed: LSFYGNSISI (PRAME_HUMAN)
LNFYGNSISF

SEQ ID NO: 152417 - protein, 10 aa, Artificial Sequence
  Description of Artificial Sequence: Synthetic peptide
  Seed: QLLRHVMNPL (PRAME_HUMAN)
QNLRHVMNPV

SEQ ID NO: 152418 - protein, 9 aa, Artificial Sequence
  Description of Artificial Sequence: Synthetic peptide
  Seed: QPFIPVEVL (PRAME_HUMAN)
QPFIPVEVA

SEQ ID NO: 152419 - protein, 10 aa, Artificial Sequence
  Description of Artificial Sequence: Synthetic peptide
  Seed: LKAMVQAWPF (PRAME_HUMAN)
LQAMVQAWPM

SEQ ID NO: 152420 - protein, 9 aa, Artificial Sequence
  Description of Artificial Sequence: Synthetic peptide
  Seed: ELFPPLFMA (PRAME_HUMAN)
ESFPPLFMV

SEQ ID NO: 152421 - protein, 9 aa, Artificial Sequence
  Description of Artificial Sequence: Synthetic peptide
  Seed: KLKIFAMPM (PRAME_HUMAN)
KYKIFAMPT

SEQ ID NO: 152422 - protein, 10 aa, Artificial Sequence
  Description of Artificial Sequence: Synthetic peptide
  Seed: MVQAWPFTCL (PRAME_HUMAN)
MQQAWPFTCV

SEQ ID NO: 152423 - protein, 9 aa, Artificial Sequence
  Description of Artificial Sequence: Synthetic peptide
  Seed: EPLQALLER (PRAME_HUMAN)
EYLQALLER

SEQ ID NO: 152424 - protein, 9 aa, Artificial Sequence
  Description of Artificial Sequence: Synthetic peptide
  Seed: VLDGLDVLL (PRAME_HUMAN)
VADGLDVLV

SEQ ID NO: 152425 - protein, 9 aa, Artificial Sequence
  Description of Artificial Sequence: Synthetic peptide
  Seed: GQHLHLETF (PRAME_HUMAN)
GNHLHLETY

SEQ ID NO: 152426 - protein, 11 aa, Artificial Sequence
  Description of Artificial Sequence: Synthetic peptide
  Seed: VQLDSIEDLEV (PRAME_HUMAN)
VQLDSIEDLEL

SEQ ID NO: 152427 - protein, 10 aa, Artificial Sequence
  Description of Artificial Sequence: Synthetic peptide
  Seed: DVSPEPLQAL (PRAME_HUMAN)
DSSPEPLQAR

SEQ ID NO: 152428 - protein, 9 aa, Artificial Sequence
  Description of Artificial Sequence: Synthetic peptide
  Seed: SFYGNSISI (PRAME_HUMAN)
SEYGNSISL

SEQ ID NO: 152429 - protein, 9 aa, Artificial Sequence
  Description of Artificial Sequence: Synthetic peptide
  Seed: LGRPSMVWL (PRAME_HUMAN)
LTRPSMVWF

SEQ ID NO: 152430 - protein, 9 aa, Artificial Sequence
  Description of Artificial Sequence: Synthetic peptide
  Seed: MINLRRLLL (PRAME_HUMAN)
MANLRRLLV

SEQ ID NO: 152431 - protein, 9 aa, Artificial Sequence
  Description of Artificial Sequence: Synthetic peptide
  Seed: YEDIHGTLH (PRAME_HUMAN)
YEDIHGTLM

SEQ ID NO: 152432 - protein, 11 aa, Artificial Sequence
  Description of Artificial Sequence: Synthetic peptide
  Seed: RELFPPLFMAA (PRAME_HUMAN)
RTLFPPLFMAV

SEQ ID NO: 152433 - protein, 9 aa, Artificial Sequence
  Description of Artificial Sequence: Synthetic peptide
  Seed: RLWGSIQSR (PRAME_HUMAN)
RYWGSIQSK

SEQ ID NO: 152434 - protein, 10 aa, Artificial Sequence
  Description of Artificial Sequence: Synthetic peptide
  Seed: AALELLPREL (PRAME_HUMAN)
ATLELLPREF

SEQ ID NO: 152435 - protein, 9 aa, Artificial Sequence
  Description of Artificial Sequence: Synthetic peptide
  Seed: VLYPVPLES (PRAME_HUMAN)
VQYPVPLEI

SEQ ID NO: 152436 - protein, 10 aa, Artificial Sequence
  Description of Artificial Sequence: Synthetic peptide
  Seed: IPVEVLVDLF (PRAME_HUMAN)
IPVEVLVDLY

SEQ ID NO: 152437 - protein, 9 aa, Artificial Sequence
  Description of Artificial Sequence: Synthetic peptide
  Seed: ALLPSLSHC (PRAME_HUMAN)
ALLPSLSHI

SEQ ID NO: 152438 - protein, 9 aa, Artificial Sequence
  Description of Artificial Sequence: Synthetic peptide
  Seed: FAMPMQDIK (PRAME_HUMAN)
FAMPMQDIY

SEQ ID NO: 152439 - protein, 10 aa, Artificial Sequence
  Description of Artificial Sequence: Synthetic peptide
  Seed: LSQSPSVSQL (PRAME_HUMAN)
LNQSPSVSQM

SEQ ID NO: 152440 - protein, 9 aa, Artificial Sequence
  Description of Artificial Sequence: Synthetic peptide
  Seed: LLRHVMNPL (PRAME_HUMAN)
LVRHVMNPY

SEQ ID NO: 152441 - protein, 9 aa, Artificial Sequence
  Description of Artificial Sequence: Synthetic peptide
  Seed: YIAQFTSQF (PRAME_HUMAN)
YFAQFTSQW

SEQ ID NO: 152442 - protein, 9 aa, Artificial Sequence
  Description of Artificial Sequence: Synthetic peptide
  Seed: LLRHVMNPL (PRAME_HUMAN)
LTRHVMNPY

SEQ ID NO: 152443 - protein, 10 aa, Artificial Sequence
  Description of Artificial Sequence: Synthetic peptide
  Seed: SEGDVMHLSQ (PRAME_HUMAN)
SEGDVMHLSI

SEQ ID NO: 152444 - protein, 10 aa, Artificial Sequence
  Description of Artificial Sequence: Synthetic peptide
  Seed: ALYVDSLFFL (PRAME_HUMAN)
AFYVDSLFFF

SEQ ID NO: 152445 - protein, 9 aa, Artificial Sequence
  Description of Artificial Sequence: Synthetic peptide
  Seed: VLDGLDVLL (PRAME_HUMAN)
VSDGLDVLY

SEQ ID NO: 152446 - protein, 11 aa, Artificial Sequence
  Description of Artificial Sequence: Synthetic peptide
  Seed: LTDVSPEPLQA (PRAME_HUMAN)
LSDVSPEPLQL

SEQ ID NO: 152447 - protein, 9 aa, Artificial Sequence
  Description of Artificial Sequence: Synthetic peptide
  Seed: KLKIFAMPM (PRAME_HUMAN)
KKKIFAMPK

SEQ ID NO: 152448 - protein, 9 aa, Artificial Sequence
  Description of Artificial Sequence: Synthetic peptide
  Seed: IAALELLPR (PRAME_HUMAN)
IVALELLPK

SEQ ID NO: 152449 - protein, 9 aa, Artificial Sequence
  Description of Artificial Sequence: Synthetic peptide
  Seed: VELAGQSLL (PRAME_HUMAN)
VQLAGQSLI

SEQ ID NO: 152450 - protein, 10 aa, Artificial Sequence
  Description of Artificial Sequence: Synthetic peptide
  Seed: LLPRELFPPL (PRAME_HUMAN)
LPPRELFPPM

SEQ ID NO: 152451 - protein, 10 aa, Artificial Sequence
  Description of Artificial Sequence: Synthetic peptide
  Seed: KDEALAIAAL (PRAME_HUMAN)
KEEALAIAAL

SEQ ID NO: 152452 - protein, 10 aa, Artificial Sequence
  Description of Artificial Sequence: Synthetic peptide
  Seed: SNLTHVLYPV (PRAME_HUMAN)
SYLTHVLYPM

SEQ ID NO: 152453 - protein, 10 aa, Artificial Sequence
  Description of Artificial Sequence: Synthetic peptide
  Seed: AYLHARLREL (PRAME_HUMAN)
ASLHARLREV

SEQ ID NO: 152454 - protein, 10 aa, Artificial Sequence
  Description of Artificial Sequence: Synthetic peptide
  Seed: ISMSVWTSPR (PRAME_HUMAN)
IEMSVWTSPK

SEQ ID NO: 152455 - protein, 9 aa, Artificial Sequence
  Description of Artificial Sequence: Synthetic peptide
  Seed: VSQLSVLSL (PRAME_HUMAN)
VTQLSVLSL

SEQ ID NO: 152456 - protein, 10 aa, Artificial Sequence
  Description of Artificial Sequence: Synthetic peptide
  Seed: ALYVDSLFFL (PRAME_HUMAN)
AFYVDSLFFI

SEQ ID NO: 152457 - protein, 9 aa, Artificial Sequence
  Description of Artificial Sequence: Synthetic peptide
  Seed: KAMVQAWPF (PRAME_HUMAN)
KSMVQAWPV

SEQ ID NO: 152458 - protein, 10 aa, Artificial Sequence
  Description of Artificial Sequence: Synthetic peptide
  Seed: FYDPEPILCP (PRAME_HUMAN)
FYDPEPILCV

SEQ ID NO: 152459 - protein, 9 aa, Artificial Sequence
  Description of Artificial Sequence: Synthetic peptide
  Seed: FWTVWSGNR (PRAME_HUMAN)
FFTVWSGNR

SEQ ID NO: 152460 - protein, 9 aa, Artificial Sequence
  Description of Artificial Sequence: Synthetic peptide
  Seed: QSLLKDEAL (PRAME_HUMAN)
QLLLKDEAY

SEQ ID NO: 152461 - protein, 10 aa, Artificial Sequence
  Description of Artificial Sequence: Synthetic peptide
  Seed: RLSEGDVMHL (PRAME_HUMAN)
RLSEGDVMHY

SEQ ID NO: 152462 - protein, 9 aa, Artificial Sequence
  Description of Artificial Sequence: Synthetic peptide
  Seed: LSNLTHVLY (PRAME_HUMAN)
LQNLTHVLL

SEQ ID NO: 152463 - protein, 9 aa, Artificial Sequence
  Description of Artificial Sequence: Synthetic peptide
  Seed: AAFDGRHSQ (PRAME_HUMAN)
AAFDGRHSF

SEQ ID NO: 152464 - protein, 10 aa, Artificial Sequence
  Description of Artificial Sequence: Synthetic peptide
  Seed: FLRGRLDQLL (PRAME_HUMAN)
FLRGRLDQLA

SEQ ID NO: 152465 - protein, 10 aa, Artificial Sequence
  Description of Artificial Sequence: Synthetic peptide
  Seed: PTLAKFSPYL (PRAME_HUMAN)
PTLAKFSPYV

SEQ ID NO: 152466 - protein, 9 aa, Artificial Sequence
  Description of Artificial Sequence: Synthetic peptide
  Seed: ALYVDSLFF (PRAME_HUMAN)
ANYVDSLFY

SEQ ID NO: 152467 - protein, 10 aa, Artificial Sequence
  Description of Artificial Sequence: Synthetic peptide
  Seed: RYISMSVWTS (PRAME_HUMAN)
RFISMSVWTW

SEQ ID NO: 152468 - protein, 9 aa, Artificial Sequence
  Description of Artificial Sequence: Synthetic peptide
  Seed: FYDPEPILC (PRAME_HUMAN)
FFDPEPILW

SEQ ID NO: 152469 - protein, 9 aa, Artificial Sequence
  Description of Artificial Sequence: Synthetic peptide
  Seed: SLQCLQALY (PRAME_HUMAN)
SLQCLQALK

SEQ ID NO: 152470 - protein, 9 aa, Artificial Sequence
  Description of Artificial Sequence: Synthetic peptide
  Seed: SISALQSLL (PRAME_HUMAN)
SMSALQSLY

SEQ ID NO: 152471 - protein, 9 aa, Artificial Sequence
  Description of Artificial Sequence: Synthetic peptide
  Seed: YSFPEPEAA (PRAME_HUMAN)
YPFPEPEAY

SEQ ID NO: 152472 - protein, 9 aa, Artificial Sequence
  Description of Artificial Sequence: Synthetic peptide
  Seed: YLHARLREL (PRAME_HUMAN)
YSHARLREY

SEQ ID NO: 152473 - protein, 10 aa, Artificial Sequence
  Description of Artificial Sequence: Synthetic peptide
  Seed: FIPVEVLVDL (PRAME_HUMAN)
FYPVEVLVDM

SEQ ID NO: 152474 - protein, 11 aa, Artificial Sequence
  Description of Artificial Sequence: Synthetic peptide
  Seed: GTLHLERLAYL (PRAME_HUMAN)
GMLHLERLAYI

SEQ ID NO: 152475 - protein, 10 aa, Artificial Sequence
  Description of Artificial Sequence: Synthetic peptide
  Seed: FIPVEVLVDL (PRAME_HUMAN)
FIPVEVLVDW

SEQ ID NO: 152476 - protein, 9 aa, Artificial Sequence
  Description of Artificial Sequence: Synthetic peptide
  Seed: AEQPFIPVE (PRAME_HUMAN)
AEQPFIPVP

SEQ ID NO: 152477 - protein, 9 aa, Artificial Sequence
  Description of Artificial Sequence: Synthetic peptide
  Seed: HVMNPLETL (PRAME_HUMAN)
HAMNPLETA

SEQ ID NO: 152478 - protein, 9 aa, Artificial Sequence
  Description of Artificial Sequence: Synthetic peptide
  Seed: SIEDLEVTC (PRAME_HUMAN)
SLEDLEVTM

SEQ ID NO: 152479 - protein, 11 aa, Artificial Sequence
  Description of Artificial Sequence: Synthetic peptide
  Seed: IAQFTSQFLSL (PRAME_HUMAN)
IYQFTSQFLSF

SEQ ID NO: 152480 - protein, 9 aa, Artificial Sequence
  Description of Artificial Sequence: Synthetic peptide
  Seed: ISISALQSL (PRAME_HUMAN)
IQISALQSA

SEQ ID NO: 152481 - protein, 10 aa, Artificial Sequence
  Description of Artificial Sequence: Synthetic peptide
  Seed: RASATLQDLV (PRAME_HUMAN)
RDSATLQDLF

SEQ ID NO: 152482 - protein, 11 aa, Artificial Sequence
  Description of Artificial Sequence: Synthetic peptide
  Seed: HVMNPLETLSI (PRAME_HUMAN)
HMMNPLETLSV

SEQ ID NO: 152483 - protein, 10 aa, Artificial Sequence
  Description of Artificial Sequence: Synthetic peptide
  Seed: RGRLDQLLRH (PRAME_HUMAN)
RGRLDQLLRL

SEQ ID NO: 152484 - protein, 10 aa, Artificial Sequence
  Description of Artificial Sequence: Synthetic peptide
  Seed: SPSVSQLSVL (PRAME_HUMAN)
STSVSQLSVF

SEQ ID NO: 152485 - protein, 10 aa, Artificial Sequence
  Description of Artificial Sequence: Synthetic peptide
  Seed: FFLRGRLDQL (PRAME_HUMAN)
FELRGRLDQA

SEQ ID NO: 152486 - protein, 9 aa, Artificial Sequence
  Description of Artificial Sequence: Synthetic peptide
  Seed: SYEDIHGTL (PRAME_HUMAN)
SSEDIHGTW

SEQ ID NO: 152487 - protein, 9 aa, Artificial Sequence
  Description of Artificial Sequence: Synthetic peptide
  Seed: KAMVQAWPF (PRAME_HUMAN)
KNMVQAWPF

SEQ ID NO: 152488 - protein, 10 aa, Artificial Sequence
  Description of Artificial Sequence: Synthetic peptide
  Seed: MVQAWPFTCL (PRAME_HUMAN)
MDQAWPFTCM

SEQ ID NO: 152489 - protein, 9 aa, Artificial Sequence
  Description of Artificial Sequence: Synthetic peptide
  Seed: GNRASLYSF (PRAME_HUMAN)
GQRASLYSF

SEQ ID NO: 152490 - protein, 10 aa, Artificial Sequence
  Description of Artificial Sequence: Synthetic peptide
  Seed: LSHCSQLTTL (PRAME_HUMAN)
LSHCSQLTTM

SEQ ID NO: 152491 - protein, 10 aa, Artificial Sequence
  Description of Artificial Sequence: Synthetic peptide
  Seed: MERRRLWGSI (PRAME_HUMAN)
MMRRRLWGSC

SEQ ID NO: 152492 - protein, 10 aa, Artificial Sequence
  Description of Artificial Sequence: Synthetic peptide
  Seed: YIAQFTSQFL (PRAME_HUMAN)
YIAQFTSQFA

SEQ ID NO: 152493 - protein, 10 aa, Artificial Sequence
  Description of Artificial Sequence: Synthetic peptide
  Seed: CSQLTTLSFY (PRAME_HUMAN)
CAQLTTLSFF

SEQ ID NO: 152494 - protein, 9 aa, Artificial Sequence
  Description of Artificial Sequence: Synthetic peptide
  Seed: ALAIAALEL (PRAME_HUMAN)
AVAIAALEV

SEQ ID NO: 152495 - protein, 10 aa, Artificial Sequence
  Description of Artificial Sequence: Synthetic peptide
  Seed: SPYLGQMINL (PRAME_HUMAN)
SRYLGQMINI

SEQ ID NO: 152496 - protein, 9 aa, Artificial Sequence
  Description of Artificial Sequence: Synthetic peptide
  Seed: LLLSHIHAS (PRAME_HUMAN)
LALSHIHAV

SEQ ID NO: 152497 - protein, 9 aa, Artificial Sequence
  Description of Artificial Sequence: Synthetic peptide
  Seed: SLSHCSQLT (PRAME_HUMAN)
SASHCSQLV

SEQ ID NO: 152498 - protein, 9 aa, Artificial Sequence
  Description of Artificial Sequence: Synthetic peptide
  Seed: EAAQPMTKK (PRAME_HUMAN)
EAAQPMTKY

SEQ ID NO: 152499 - protein, 8 aa, Artificial Sequence
  Description of Artificial Sequence: Synthetic peptide
  Seed: ITDDQLLA (PRAME_HUMAN)
IVDDQLLV

SEQ ID NO: 152500 - protein, 9 aa, Artificial Sequence
  Description of Artificial Sequence: Synthetic peptide
  Seed: SHIHASSYI (PRAME_HUMAN)
SFIHASSYI

SEQ ID NO: 152501 - protein, 10 aa, Artificial Sequence
  Description of Artificial Sequence: Synthetic peptide
  Seed: VLRLCCKKLK (PRAME_HUMAN)
VMRLCCKKLR

SEQ ID NO: 152502 - protein, 10 aa, Artificial Sequence
  Description of Artificial Sequence: Synthetic peptide
  Seed: LKAMVQAWPF (PRAME_HUMAN)
LMAMVQAWPM

SEQ ID NO: 152503 - protein, 10 aa, Artificial Sequence
  Description of Artificial Sequence: Synthetic peptide
  Seed: QALYVDSLFF (PRAME_HUMAN)
QGLYVDSLFW

SEQ ID NO: 152504 - protein, 9 aa, Artificial Sequence
  Description of Artificial Sequence: Synthetic peptide
  Seed: GQSLLKDEA (PRAME_HUMAN)
GESLLKDEA

SEQ ID NO: 152505 - protein, 9 aa, Artificial Sequence
  Description of Artificial Sequence: Synthetic peptide
  Seed: YISMSVWTS (PRAME_HUMAN)
YSSMSVWTA

SEQ ID NO: 152506 - protein, 10 aa, Artificial Sequence
  Description of Artificial Sequence: Synthetic peptide
  Seed: LLLSHIHASS (PRAME_HUMAN)
LNLSHIHASV

SEQ ID NO: 152507 - protein, 9 aa, Artificial Sequence
  Description of Artificial Sequence: Synthetic peptide
  Seed: LGRPSMVWL (PRAME_HUMAN)
LNRPSMVWK

SEQ ID NO: 152508 - protein, 10 aa, Artificial Sequence
  Description of Artificial Sequence: Synthetic peptide
  Seed: VRPRRWKLQV (PRAME_HUMAN)
VVPRRWKLQL

SEQ ID NO: 152509 - protein, 10 aa, Artificial Sequence
  Description of Artificial Sequence: Synthetic peptide
  Seed: QSLLQHLIGL (PRAME_HUMAN)
QSLLQHLIGI

SEQ ID NO: 152510 - protein, 9 aa, Artificial Sequence
  Description of Artificial Sequence: Synthetic peptide
  Seed: AAFDGRHSQ (PRAME_HUMAN)
ATFDGRHSY

SEQ ID NO: 152511 - protein, 10 aa, Artificial Sequence
  Description of Artificial Sequence: Synthetic peptide
  Seed: IGLSNLTHVL (PRAME_HUMAN)
ITLSNLTHVI

SEQ ID NO: 152512 - protein, 9 aa, Artificial Sequence
  Description of Artificial Sequence: Synthetic peptide
  Seed: SHQDFWTVW (PRAME_HUMAN)
SYQDFWTVW

SEQ ID NO: 152513 - protein, 10 aa, Artificial Sequence
  Description of Artificial Sequence: Synthetic peptide
  Seed: LLPRELFPPL (PRAME_HUMAN)
LMPRELFPPL

SEQ ID NO: 152514 - protein, 11 aa, Artificial Sequence
  Description of Artificial Sequence: Synthetic peptide
  Seed: AAFDGRHSQTL (PRAME_HUMAN)
ACFDGRHSQTW

SEQ ID NO: 152515 - protein, 9 aa, Artificial Sequence
  Description of Artificial Sequence: Synthetic peptide
  Seed: SFYGNSISI (PRAME_HUMAN)
SQYGNSISV

SEQ ID NO: 152516 - protein, 9 aa, Artificial Sequence
  Description of Artificial Sequence: Synthetic peptide
  Seed: EPLQALLER (PRAME_HUMAN)
ESLQALLEK

SEQ ID NO: 152517 - protein, 9 aa, Artificial Sequence
  Description of Artificial Sequence: Synthetic peptide
  Seed: ALYVDSLFF (PRAME_HUMAN)
ATYVDSLFW

SEQ ID NO: 152518 - protein, 8 aa, Artificial Sequence
  Description of Artificial Sequence: Synthetic peptide
  Seed: SQLSVLSL (PRAME_HUMAN)
SMLSVLSY

SEQ ID NO: 152519 - protein, 9 aa, Artificial Sequence
  Description of Artificial Sequence: Synthetic peptide
  Seed: SYEDIHGTL (PRAME_HUMAN)
SHEDIHGTL

SEQ ID NO: 152520 - protein, 9 aa, Artificial Sequence
  Description of Artificial Sequence: Synthetic peptide
  Seed: SYEDIHGTL (PRAME_HUMAN)
SREDIHGTF

SEQ ID NO: 152521 - protein, 11 aa, Artificial Sequence
  Description of Artificial Sequence: Synthetic peptide
  Seed: RLVELAGQSLL (PRAME_HUMAN)
RMVELAGQSLF

SEQ ID NO: 152522 - protein, 9 aa, Artificial Sequence
  Description of Artificial Sequence: Synthetic peptide
  Seed: RLRELLCEL (PRAME_HUMAN)
RSRELLCEM

SEQ ID NO: 152523 - protein, 9 aa, Artificial Sequence
  Description of Artificial Sequence: Synthetic peptide
  Seed: FYDPEPILC (PRAME_HUMAN)
FVDPEPILM

SEQ ID NO: 152524 - protein, 11 aa, Artificial Sequence
  Description of Artificial Sequence: Synthetic peptide
  Seed: FLSLQCLQALY (PRAME_HUMAN)
FWSLQCLQALL

SEQ ID NO: 152525 - protein, 9 aa, Artificial Sequence
  Description of Artificial Sequence: Synthetic peptide
  Seed: RLRELLCEL (PRAME_HUMAN)
RLRELLCEF

SEQ ID NO: 152526 - protein, 9 aa, Artificial Sequence
  Description of Artificial Sequence: Synthetic peptide
  Seed: QSRYISMSV (PRAME_HUMAN)
QFRYISMSK

SEQ ID NO: 152527 - protein, 10 aa, Artificial Sequence
  Description of Artificial Sequence: Synthetic peptide
  Seed: SLLQHLIGLS (PRAME_HUMAN)
SYLQHLIGLV

SEQ ID NO: 152528 - protein, 9 aa, Artificial Sequence
  Description of Artificial Sequence: Synthetic peptide
  Seed: RLCCKKLKI (PRAME_HUMAN)
RVCCKKLKY

SEQ ID NO: 152529 - protein, 9 aa, Artificial Sequence
  Description of Artificial Sequence: Synthetic peptide
  Seed: ALQSLLQHL (PRAME_HUMAN)
ATQSLLQHI

SEQ ID NO: 152530 - protein, 9 aa, Artificial Sequence
  Description of Artificial Sequence: Synthetic peptide
  Seed: TLHLERLAY (PRAME_HUMAN)
TVHLERLAF

SEQ ID NO: 152531 - protein, 9 aa, Artificial Sequence
  Description of Artificial Sequence: Synthetic peptide
  Seed: YLHARLREL (PRAME_HUMAN)
YQHARLREW

SEQ ID NO: 152532 - protein, 9 aa, Artificial Sequence
  Description of Artificial Sequence: Synthetic peptide
  Seed: VLYPVPLES (PRAME_HUMAN)
VLYPVPLEA

SEQ ID NO: 152533 - protein, 11 aa, Artificial Sequence
  Description of Artificial Sequence: Synthetic peptide
  Seed: EDIHGTLHLER (PRAME_HUMAN)
EMIHGTLHLER

SEQ ID NO: 152534 - protein, 9 aa, Artificial Sequence
  Description of Artificial Sequence: Synthetic peptide
  Seed: LSLQCLQAL (PRAME_HUMAN)
LKLQCLQAL

SEQ ID NO: 152535 - protein, 9 aa, Artificial Sequence
  Description of Artificial Sequence: Synthetic peptide
  Seed: YISMSVWTS (PRAME_HUMAN)
YISMSVWTA

SEQ ID NO: 152536 - protein, 10 aa, Artificial Sequence
  Description of Artificial Sequence: Synthetic peptide
  Seed: IGLSNLTHVL (PRAME_HUMAN)
ICLSNLTHVV

SEQ ID NO: 152537 - protein, 9 aa, Artificial Sequence
  Description of Artificial Sequence: Synthetic peptide
  Seed: LQALYVDSL (PRAME_HUMAN)
LMALYVDSA

SEQ ID NO: 152538 - protein, 10 aa, Artificial Sequence
  Description of Artificial Sequence: Synthetic peptide
  Seed: QLSVLSLSGV (PRAME_HUMAN)
QLSVLSLSGL

SEQ ID NO: 152539 - protein, 9 aa, Artificial Sequence
  Description of Artificial Sequence: Synthetic peptide
  Seed: ISISALQSL (PRAME_HUMAN)
IRISALQSM

SEQ ID NO: 152540 - protein, 11 aa, Artificial Sequence
  Description of Artificial Sequence: Synthetic peptide
  Seed: LPTLAKFSPYL (PRAME_HUMAN)
LWTLAKFSPYI

SEQ ID NO: 152541 - protein, 9 aa, Artificial Sequence
  Description of Artificial Sequence: Synthetic peptide
  Seed: RTFYDPEPI (PRAME_HUMAN)
RVFYDPEPI

SEQ ID NO: 152542 - protein, 9 aa, Artificial Sequence
  Description of Artificial Sequence: Synthetic peptide
  Seed: ERLAYLHAR (PRAME_HUMAN)
EALAYLHAR

SEQ ID NO: 152543 - protein, 10 aa, Artificial Sequence
  Description of Artificial Sequence: Synthetic peptide
  Seed: AVLDGLDVLL (PRAME_HUMAN)
ALLDGLDVLR

SEQ ID NO: 152544 - protein, 9 aa, Artificial Sequence
  Description of Artificial Sequence: Synthetic peptide
  Seed: LYVDSLFFL (PRAME_HUMAN)
LAVDSLFFV

SEQ ID NO: 152545 - protein, 9 aa, Artificial Sequence
  Description of Artificial Sequence: Synthetic peptide
  Seed: ESYEDIHGT (PRAME_HUMAN)
EMYEDIHGL

SEQ ID NO: 152546 - protein, 11 aa, Artificial Sequence
  Description of Artificial Sequence: Synthetic peptide
  Seed: RRRLWGSIQSR (PRAME_HUMAN)
RARLWGSIQSR

SEQ ID NO: 152547 - protein, 10 aa, Artificial Sequence
  Description of Artificial Sequence: Synthetic peptide
  Seed: RHVMNPLETL (PRAME_HUMAN)
RMVMNPLETV

SEQ ID NO: 152548 - protein, 9 aa, Artificial Sequence
  Description of Artificial Sequence: Synthetic peptide
  Seed: LQSLLQHLI (PRAME_HUMAN)
LQSLLQHLF

SEQ ID NO: 152549 - protein, 9 aa, Artificial Sequence
  Description of Artificial Sequence: Synthetic peptide
  Seed: ESYEDIHGT (PRAME_HUMAN)
ELYEDIHGI

SEQ ID NO: 152550 - protein, 9 aa, Artificial Sequence
  Description of Artificial Sequence: Synthetic peptide
  Seed: SHIHASSYI (PRAME_HUMAN)
SFIHASSYF

SEQ ID NO: 152551 - protein, 9 aa, Artificial Sequence
  Description of Artificial Sequence: Synthetic peptide
  Seed: ACDELFSYL (PRAME_HUMAN)
ATDELFSYM

SEQ ID NO: 152552 - protein, 9 aa, Artificial Sequence
  Description of Artificial Sequence: Synthetic peptide
  Seed: YIAQFTSQF (PRAME_HUMAN)
YRAQFTSQF

SEQ ID NO: 152553 - protein, 10 aa, Artificial Sequence
  Description of Artificial Sequence: Synthetic peptide
  Seed: LSFYGNSISI (PRAME_HUMAN)
LNFYGNSISM

SEQ ID NO: 152554 - protein, 9 aa, Artificial Sequence
  Description of Artificial Sequence: Synthetic peptide
  Seed: YLHARLREL (PRAME_HUMAN)
YQHARLREF

SEQ ID NO: 152555 - protein, 9 aa, Artificial Sequence
  Description of Artificial Sequence: Synthetic peptide
  Seed: LSLQCLQAL (PRAME_HUMAN)
LQLQCLQAW

SEQ ID NO: 152556 - protein, 9 aa, Artificial Sequence
  Description of Artificial Sequence: Synthetic peptide
  Seed: QFTSQFLSL (PRAME_HUMAN)
QFTSQFLSW

SEQ ID NO: 152557 - protein, 10 aa, Artificial Sequence
  Description of Artificial Sequence: Synthetic peptide
  Seed: CSQLTTLSFY (PRAME_HUMAN)
CRQLTTLSFF

SEQ ID NO: 152558 - protein, 9 aa, Artificial Sequence
  Description of Artificial Sequence: Synthetic peptide
  Seed: MSVWTSPRR (PRAME_HUMAN)
MVVWTSPRR

SEQ ID NO: 152559 - protein, 11 aa, Artificial Sequence
  Description of Artificial Sequence: Synthetic peptide
  Seed: ALYVDSLFFLR (PRAME_HUMAN)
AMYVDSLFFLR

SEQ ID NO: 152560 - protein, 9 aa, Artificial Sequence
  Description of Artificial Sequence: Synthetic peptide
  Seed: ACDELFSYL (PRAME_HUMAN)
ASDELFSYL

SEQ ID NO: 152561 - protein, 9 aa, Artificial Sequence
  Description of Artificial Sequence: Synthetic peptide
  Seed: LRKNSHQDF (PRAME_HUMAN)
LQKNSHQDM

SEQ ID NO: 152562 - protein, 9 aa, Artificial Sequence
  Description of Artificial Sequence: Synthetic peptide
  Seed: RLAYLHARL (PRAME_HUMAN)
RMAYLHARA

SEQ ID NO: 152563 - protein, 9 aa, Artificial Sequence
  Description of Artificial Sequence: Synthetic peptide
  Seed: SRYISMSVW (PRAME_HUMAN)
SQYISMSVW

SEQ ID NO: 152564 - protein, 10 aa, Artificial Sequence
  Description of Artificial Sequence: Synthetic peptide
  Seed: RGRLDQLLRH (PRAME_HUMAN)
RVRLDQLLRI

SEQ ID NO: 152565 - protein, 11 aa, Artificial Sequence
  Description of Artificial Sequence: Synthetic peptide
  Seed: IAQFTSQFLSL (PRAME_HUMAN)
IHQFTSQFLSY

SEQ ID NO: 152566 - protein, 10 aa, Artificial Sequence
  Description of Artificial Sequence: Synthetic peptide
  Seed: TWKLPTLAKF (PRAME_HUMAN)
TMKLPTLAKF

SEQ ID NO: 152567 - protein, 10 aa, Artificial Sequence
  Description of Artificial Sequence: Synthetic peptide
  Seed: YIAQFTSQFL (PRAME_HUMAN)
YIAQFTSQFI

SEQ ID NO: 152568 - protein, 9 aa, Artificial Sequence
  Description of Artificial Sequence: Synthetic peptide
  Seed: VSPEPLQAL (PRAME_HUMAN)
VAPEPLQAA

SEQ ID NO: 152569 - protein, 10 aa, Artificial Sequence
  Description of Artificial Sequence: Synthetic peptide
  Seed: SISISALQSL (PRAME_HUMAN)
SQSISALQSI

SEQ ID NO: 152570 - protein, 10 aa, Artificial Sequence
  Description of Artificial Sequence: Synthetic peptide
  Seed: RLSEGDVMHL (PRAME_HUMAN)
RESEGDVMHL

SEQ ID NO: 152571 - protein, 9 aa, Artificial Sequence
  Description of Artificial Sequence: Synthetic peptide
  Seed: EDLEVTCTW (PRAME_HUMAN)
ETLEVTCTM

SEQ ID NO: 152572 - protein, 9 aa, Artificial Sequence
  Description of Artificial Sequence: Synthetic peptide
  Seed: SQFLSLQCL (PRAME_HUMAN)
SMFLSLQCF

SEQ ID NO: 152573 - protein, 9 aa, Artificial Sequence
  Description of Artificial Sequence: Synthetic peptide
  Seed: KLKIFAMPM (PRAME_HUMAN)
KEKIFAMPM

SEQ ID NO: 152574 - protein, 10 aa, Artificial Sequence
  Description of Artificial Sequence: Synthetic peptide
  Seed: HCSQLTTLSF (PRAME_HUMAN)
HKSQLTTLSY

SEQ ID NO: 152575 - protein, 10 aa, Artificial Sequence
  Description of Artificial Sequence: Synthetic peptide
  Seed: ALLERASATL (PRAME_HUMAN)
AVLERASATV

SEQ ID NO: 152576 - protein, 10 aa, Artificial Sequence
  Description of Artificial Sequence: Synthetic peptide
  Seed: YSFPEPEAAQ (PRAME_HUMAN)
YQFPEPEAAY

SEQ ID NO: 152577 - protein, 9 aa, Artificial Sequence
  Description of Artificial Sequence: Synthetic peptide
  Seed: LSHIHASSY (PRAME_HUMAN)
LGHIHASSY

SEQ ID NO: 152578 - protein, 10 aa, Artificial Sequence
  Description of Artificial Sequence: Synthetic peptide
  Seed: IQSRYISMSV (PRAME_HUMAN)
IRSRYISMSA

SEQ ID NO: 152579 - protein, 11 aa, Artificial Sequence
  Description of Artificial Sequence: Synthetic peptide
  Seed: ISALQSLLQHL (PRAME_HUMAN)
ISALQSLLQHY

SEQ ID NO: 152580 - protein, 9 aa, Artificial Sequence
  Description of Artificial Sequence: Synthetic peptide
  Seed: ALAIAALEL (PRAME_HUMAN)
ALAIAALEA

SEQ ID NO: 152581 - protein, 10 aa, Artificial Sequence
  Description of Artificial Sequence: Synthetic peptide
  Seed: VWSGNRASLY (PRAME_HUMAN)
VTSGNRASLY

SEQ ID NO: 152582 - protein, 9 aa, Artificial Sequence
  Description of Artificial Sequence: Synthetic peptide
  Seed: NSISISALQ (PRAME_HUMAN)
NMISISALK

SEQ ID NO: 152583 - protein, 10 aa, Artificial Sequence
  Description of Artificial Sequence: Synthetic peptide
  Seed: IQSRYISMSV (PRAME_HUMAN)
IISRYISMSK

SEQ ID NO: 152584 - protein, 8 aa, Artificial Sequence
  Description of Artificial Sequence: Synthetic peptide
  Seed: TDDQLLAL (PRAME_HUMAN)
TMDQLLAL

SEQ ID NO: 152585 - protein, 9 aa, Artificial Sequence
  Description of Artificial Sequence: Synthetic peptide
  Seed: LALLPSLSH (PRAME_HUMAN)
LKLLPSLSI

SEQ ID NO: 152586 - protein, 10 aa, Artificial Sequence
  Description of Artificial Sequence: Synthetic peptide
  Seed: EALAIAALEL (PRAME_HUMAN)
EFLAIAALEL

SEQ ID NO: 152587 - protein, 9 aa, Artificial Sequence
  Description of Artificial Sequence: Synthetic peptide
  Seed: AVLDGLDVL (PRAME_HUMAN)
AVLDGLDVY

SEQ ID NO: 152588 - protein, 9 aa, Artificial Sequence
  Description of Artificial Sequence: Synthetic peptide
  Seed: THVLYPVPL (PRAME_HUMAN)
TLVLYPVPF

SEQ ID NO: 152589 - protein, 9 aa, Artificial Sequence
  Description of Artificial Sequence: Synthetic peptide
  Seed: QLLALLPSL (PRAME_HUMAN)
QMLALLPSW

SEQ ID NO: 152590 - protein, 10 aa, Artificial Sequence
  Description of Artificial Sequence: Synthetic peptide
  Seed: YISPEKEEQY (PRAME_HUMAN)
YLSPEKEEQL

SEQ ID NO: 152591 - protein, 9 aa, Artificial Sequence
  Description of Artificial Sequence: Synthetic peptide
  Seed: RLLLSHIHA (PRAME_HUMAN)
RLLLSHIHL

SEQ ID NO: 152592 - protein, 10 aa, Artificial Sequence
  Description of Artificial Sequence: Synthetic peptide
  Seed: GSIQSRYISM (PRAME_HUMAN)
GSIQSRYISF

SEQ ID NO: 152593 - protein, 9 aa, Artificial Sequence
  Description of Artificial Sequence: Synthetic peptide
  Seed: SVLSLSGVM (PRAME_HUMAN)
SQLSLSGVI

SEQ ID NO: 152594 - protein, 10 aa, Artificial Sequence
  Description of Artificial Sequence: Synthetic peptide
  Seed: SLLKDEALAI (PRAME_HUMAN)
SLLKDEALAV

SEQ ID NO: 152595 - protein, 9 aa, Artificial Sequence
  Description of Artificial Sequence: Synthetic peptide
  Seed: RTFYDPEPI (PRAME_HUMAN)
RIFYDPEPV

SEQ ID NO: 152596 - protein, 10 aa, Artificial Sequence
  Description of Artificial Sequence: Synthetic peptide
  Seed: AVLDGLDVLL (PRAME_HUMAN)
AVLDGLDVLK

SEQ ID NO: 152597 - protein, 9 aa, Artificial Sequence
  Description of Artificial Sequence: Synthetic peptide
  Seed: LQSLLQHLI (PRAME_HUMAN)
LISLLQHLI

SEQ ID NO: 152598 - protein, 9 aa, Artificial Sequence
  Description of Artificial Sequence: Synthetic peptide
  Seed: THVLYPVPL (PRAME_HUMAN)
TYVLYPVPM

SEQ ID NO: 152599 - protein, 10 aa, Artificial Sequence
  Description of Artificial Sequence: Synthetic peptide
  Seed: FAMPMQDIKM (PRAME_HUMAN)
FSMPMQDIKM

SEQ ID NO: 152600 - protein, 10 aa, Artificial Sequence
  Description of Artificial Sequence: Synthetic peptide
  Seed: MERRRLWGSI (PRAME_HUMAN)
MARRRLWGSL

SEQ ID NO: 152601 - protein, 11 aa, Artificial Sequence
  Description of Artificial Sequence: Synthetic peptide
  Seed: RLRELLCELGR (PRAME_HUMAN)
RMRELLCELGR

SEQ ID NO: 152602 - protein, 9 aa, Artificial Sequence
  Description of Artificial Sequence: Synthetic peptide
  Seed: LYVDSLFFL (PRAME_HUMAN)
LIVDSLFFI

SEQ ID NO: 152603 - protein, 10 aa, Artificial Sequence
  Description of Artificial Sequence: Synthetic peptide
  Seed: ALYVDSLFFL (PRAME_HUMAN)
AAYVDSLFFF

SEQ ID NO: 152604 - protein, 10 aa, Artificial Sequence
  Description of Artificial Sequence: Synthetic peptide
  Seed: MERRRLWGSI (PRAME_HUMAN)
MRRRRLWGSM

SEQ ID NO: 152605 - protein, 9 aa, Artificial Sequence
  Description of Artificial Sequence: Synthetic peptide
  Seed: ALELLPREL (PRAME_HUMAN)
AYELLPREY

SEQ ID NO: 152606 - protein, 10 aa, Artificial Sequence
  Description of Artificial Sequence: Synthetic peptide
  Seed: MPMQDIKMIL (PRAME_HUMAN)
MPMQDIKMIW

SEQ ID NO: 152607 - protein, 10 aa, Artificial Sequence
  Description of Artificial Sequence: Synthetic peptide
  Seed: SISISALQSL (PRAME_HUMAN)
SGSISALQSY

SEQ ID NO: 152608 - protein, 10 aa, Artificial Sequence
  Description of Artificial Sequence: Synthetic peptide
  Seed: RELFPPLFMA (PRAME_HUMAN)
RGLFPPLFMI

SEQ ID NO: 152609 - protein, 9 aa, Artificial Sequence
  Description of Artificial Sequence: Synthetic peptide
  Seed: FLSLQCLQA (PRAME_HUMAN)
FVSLQCLQI

SEQ ID NO: 152610 - protein, 9 aa, Artificial Sequence
  Description of Artificial Sequence: Synthetic peptide
  Seed: KAMVQAWPF (PRAME_HUMAN)
KRMVQAWPM

SEQ ID NO: 152611 - protein, 10 aa, Artificial Sequence
  Description of Artificial Sequence: Synthetic peptide
  Seed: RLSEGDVMHL (PRAME_HUMAN)
RTSEGDVMHY

SEQ ID NO: 152612 - protein, 10 aa, Artificial Sequence
  Description of Artificial Sequence: Synthetic peptide
  Seed: MNPLETLSIT (PRAME_HUMAN)
MFPLETLSIA

SEQ ID NO: 152613 - protein, 9 aa, Artificial Sequence
  Description of Artificial Sequence: Synthetic peptide
  Seed: YISMSVWTS (PRAME_HUMAN)
YMSMSVWTA

SEQ ID NO: 152614 - protein, 9 aa, Artificial Sequence
  Description of Artificial Sequence: Synthetic peptide
  Seed: QLLALLPSL (PRAME_HUMAN)
QTLALLPSI

SEQ ID NO: 152615 - protein, 9 aa, Artificial Sequence
  Description of Artificial Sequence: Synthetic peptide
  Seed: FTCLPLGVL (PRAME_HUMAN)
FQCLPLGVY

SEQ ID NO: 152616 - protein, 10 aa, Artificial Sequence
  Description of Artificial Sequence: Synthetic peptide
  Seed: LSFYGNSISI (PRAME_HUMAN)
LKFYGNSISL

SEQ ID NO: 152617 - protein, 10 aa, Artificial Sequence
  Description of Artificial Sequence: Synthetic peptide
  Seed: YISPEKEEQY (PRAME_HUMAN)
YYSPEKEEQY

SEQ ID NO: 152618 - protein, 10 aa, Artificial Sequence
  Description of Artificial Sequence: Synthetic peptide
  Seed: SPYLGQMINL (PRAME_HUMAN)
SSYLGQMINI

SEQ ID NO: 152619 - protein, 9 aa, Artificial Sequence
  Description of Artificial Sequence: Synthetic peptide
  Seed: CSQLTTLSF (PRAME_HUMAN)
CAQLTTLSL

SEQ ID NO: 152620 - protein, 10 aa, Artificial Sequence
  Description of Artificial Sequence: Synthetic peptide
  Seed: VTCTWKLPTL (PRAME_HUMAN)
VSCTWKLPTW

SEQ ID NO: 152621 - protein, 9 aa, Artificial Sequence
  Description of Artificial Sequence: Synthetic peptide
  Seed: RLRELLCEL (PRAME_HUMAN)
RARELLCEW

SEQ ID NO: 152622 - protein, 9 aa, Artificial Sequence
  Description of Artificial Sequence: Synthetic peptide
  Seed: SISALQSLL (PRAME_HUMAN)
SMSALQSLW

SEQ ID NO: 152623 - protein, 10 aa, Artificial Sequence
  Description of Artificial Sequence: Synthetic peptide
  Seed: DELFSYLIEK (PRAME_HUMAN)
DVLFSYLIEK

SEQ ID NO: 152624 - protein, 9 aa, Artificial Sequence
  Description of Artificial Sequence: Synthetic peptide
  Seed: EPLQALLER (PRAME_HUMAN)
EILQALLEK

SEQ ID NO: 152625 - protein, 10 aa, Artificial Sequence
  Description of Artificial Sequence: Synthetic peptide
  Seed: RTFYDPEPIL (PRAME_HUMAN)
RQFYDPEPIL

SEQ ID NO: 152626 - protein, 9 aa, Artificial Sequence
  Description of Artificial Sequence: Synthetic peptide
  Seed: RLWGSIQSR (PRAME_HUMAN)
RVWGSIQSK

SEQ ID NO: 152627 - protein, 10 aa, Artificial Sequence
  Description of Artificial Sequence: Synthetic peptide
  Seed: NLTHVLYPVP (PRAME_HUMAN)
NMTHVLYPVL

SEQ ID NO: 152628 - protein, 9 aa, Artificial Sequence
  Description of Artificial Sequence: Synthetic peptide
  Seed: RTFYDPEPI (PRAME_HUMAN)
RMFYDPEPL

SEQ ID NO: 152629 - protein, 10 aa, Artificial Sequence
  Description of Artificial Sequence: Synthetic peptide
  Seed: RASATLQDLV (PRAME_HUMAN)
RFSATLQDLF

SEQ ID NO: 152630 - protein, 9 aa, Artificial Sequence
  Description of Artificial Sequence: Synthetic peptide
  Seed: ITDDQLLAL (PRAME_HUMAN)
IIDDQLLAF

SEQ ID NO: 152631 - protein, 10 aa, Artificial Sequence
  Description of Artificial Sequence: Synthetic peptide
  Seed: RHVMNPLETL (PRAME_HUMAN)
RHVMNPLETV

SEQ ID NO: 152632 - protein, 9 aa, Artificial Sequence
  Description of Artificial Sequence: Synthetic peptide
  Seed: MHLSQSPSV (PRAME_HUMAN)
MMLSQSPSM

SEQ ID NO: 152633 - protein, 8 aa, Artificial Sequence
  Description of Artificial Sequence: Synthetic peptide
  Seed: YEDIHGTL (PRAME_HUMAN)
YFDIHGTF

SEQ ID NO: 152634 - protein, 10 aa, Artificial Sequence
  Description of Artificial Sequence: Synthetic peptide
  Seed: ALYVDSLFFL (PRAME_HUMAN)
ATYVDSLFFA

SEQ ID NO: 152635 - protein, 9 aa, Artificial Sequence
  Description of Artificial Sequence: Synthetic peptide
  Seed: ISISALQSL (PRAME_HUMAN)
IPISALQSV

SEQ ID NO: 152636 - protein, 11 aa, Artificial Sequence
  Description of Artificial Sequence: Synthetic peptide
  Seed: LTDVSPEPLQA (PRAME_HUMAN)
LIDVSPEPLQM

SEQ ID NO: 152637 - protein, 9 aa, Artificial Sequence
  Description of Artificial Sequence: Synthetic peptide
  Seed: RLDQLLRHV (PRAME_HUMAN)
RADQLLRHL

SEQ ID NO: 152638 - protein, 10 aa, Artificial Sequence
  Description of Artificial Sequence: Synthetic peptide
  Seed: RRWKLQVLDL (PRAME_HUMAN)
RRWKLQVLDR

SEQ ID NO: 152639 - protein, 9 aa, Artificial Sequence
  Description of Artificial Sequence: Synthetic peptide
  Seed: RLWGSIQSR (PRAME_HUMAN)
RIWGSIQSY

SEQ ID NO: 152640 - protein, 9 aa, Artificial Sequence
  Description of Artificial Sequence: Synthetic peptide
  Seed: YISMSVWTS (PRAME_HUMAN)
YMSMSVWTT

SEQ ID NO: 152641 - protein, 10 aa, Artificial Sequence
  Description of Artificial Sequence: Synthetic peptide
  Seed: RGRLDQLLRH (PRAME_HUMAN)
RPRLDQLLRL

SEQ ID NO: 152642 - protein, 11 aa, Artificial Sequence
  Description of Artificial Sequence: Synthetic peptide
  Seed: RRLLLSHIHAS (PRAME_HUMAN)
RRLLLSHIHAF

SEQ ID NO: 152643 - protein, 10 aa, Artificial Sequence
  Description of Artificial Sequence: Synthetic peptide
  Seed: IKMILKMVQL (PRAME_HUMAN)
ICMILKMVQV

SEQ ID NO: 152644 - protein, 10 aa, Artificial Sequence
  Description of Artificial Sequence: Synthetic peptide
  Seed: LKAMVQAWPF (PRAME_HUMAN)
LEAMVQAWPW

SEQ ID NO: 152645 - protein, 9 aa, Artificial Sequence
  Description of Artificial Sequence: Synthetic peptide
  Seed: RLDQLLRHV (PRAME_HUMAN)
RLDQLLRHM

SEQ ID NO: 152646 - protein, 9 aa, Artificial Sequence
  Description of Artificial Sequence: Synthetic peptide
  Seed: YPVPLESYE (PRAME_HUMAN)
YMVPLESYY

SEQ ID NO: 152647 - protein, 9 aa, Artificial Sequence
  Description of Artificial Sequence: Synthetic peptide
  Seed: TSPRRLVEL (PRAME_HUMAN)
TWPRRLVEM

SEQ ID NO: 152648 - protein, 8 aa, Artificial Sequence
  Description of Artificial Sequence: Synthetic peptide
  Seed: FYDPEPIL (PRAME_HUMAN)
FWDPEPII

SEQ ID NO: 152649 - protein, 9 aa, Artificial Sequence
  Description of Artificial Sequence: Synthetic peptide
  Seed: SQSPSVSQL (PRAME_HUMAN)
SLSPSVSQY

SEQ ID NO: 152650 - protein, 11 aa, Artificial Sequence
  Description of Artificial Sequence: Synthetic peptide
  Seed: AAFDGRHSQTL (PRAME_HUMAN)
ALFDGRHSQTF

SEQ ID NO: 152651 - protein, 10 aa, Artificial Sequence
  Description of Artificial Sequence: Synthetic peptide
  Seed: EAAQPMTKKR (PRAME_HUMAN)
EAAQPMTKKK

SEQ ID NO: 152652 - protein, 10 aa, Artificial Sequence
  Description of Artificial Sequence: Synthetic peptide
  Seed: LPTLAKFSPY (PRAME_HUMAN)
LTTLAKFSPW

SEQ ID NO: 152653 - protein, 10 aa, Artificial Sequence
  Description of Artificial Sequence: Synthetic peptide
  Seed: MERRRLWGSI (PRAME_HUMAN)
MKRRRLWGSM

SEQ ID NO: 152654 - protein, 9 aa, Artificial Sequence
  Description of Artificial Sequence: Synthetic peptide
  Seed: YPVPLESYE (PRAME_HUMAN)
YPVPLESYL

SEQ ID NO: 152655 - protein, 9 aa, Artificial Sequence
  Description of Artificial Sequence: Synthetic peptide
  Seed: EPLQALLER (PRAME_HUMAN)
EMLQALLER

SEQ ID NO: 152656 - protein, 8 aa, Artificial Sequence
  Description of Artificial Sequence: Synthetic peptide
  Seed: LTHVLYPV (PRAME_HUMAN)
LLHVLYPI

SEQ ID NO: 152657 - protein, 8 aa, Artificial Sequence
  Description of Artificial Sequence: Synthetic peptide
  Seed: VSPEPLQA (PRAME_HUMAN)
VGPEPLQL

SEQ ID NO: 152658 - protein, 9 aa, Artificial Sequence
  Description of Artificial Sequence: Synthetic peptide
  Seed: ISPEKEEQY (PRAME_HUMAN)
ICPEKEEQL

SEQ ID NO: 152659 - protein, 9 aa, Artificial Sequence
  Description of Artificial Sequence: Synthetic peptide
  Seed: RASATLQDL (PRAME_HUMAN)
RTSATLQDW

SEQ ID NO: 152660 - protein, 9 aa, Artificial Sequence
  Description of Artificial Sequence: Synthetic peptide
  Seed: AVLDGLDVL (PRAME_HUMAN)
AALDGLDVI

SEQ ID NO: 152661 - protein, 9 aa, Artificial Sequence
  Description of Artificial Sequence: Synthetic peptide
  Seed: KLKIFAMPM (PRAME_HUMAN)
KMKIFAMPY

SEQ ID NO: 152662 - protein, 9 aa, Artificial Sequence
  Description of Artificial Sequence: Synthetic peptide
  Seed: KDEALAIAA (PRAME_HUMAN)
KEEALAIAM

SEQ ID NO: 152663 - protein, 11 aa, Artificial Sequence
  Description of Artificial Sequence: Synthetic peptide
  Seed: ALYVDSLFFLR (PRAME_HUMAN)
AIYVDSLFFLR

SEQ ID NO: 152664 - protein, 9 aa, Artificial Sequence
  Description of Artificial Sequence: Synthetic peptide
  Seed: EQPFIPVEV (PRAME_HUMAN)
EHPFIPVEI

SEQ ID NO: 152665 - protein, 10 aa, Artificial Sequence
  Description of Artificial Sequence: Synthetic peptide
  Seed: LSFYGNSISI (PRAME_HUMAN)
LLFYGNSISF

SEQ ID NO: 152666 - protein, 10 aa, Artificial Sequence
  Description of Artificial Sequence: Synthetic peptide
  Seed: LLPRELFPPL (PRAME_HUMAN)
LKPRELFPPF

SEQ ID NO: 152667 - protein, 10 aa, Artificial Sequence
  Description of Artificial Sequence: Synthetic peptide
  Seed: KDEALAIAAL (PRAME_HUMAN)
KEEALAIAAI

SEQ ID NO: 152668 - protein, 11 aa, Artificial Sequence
  Description of Artificial Sequence: Synthetic peptide
  Seed: RLWGSIQSRYI (PRAME_HUMAN)
RVWGSIQSRYV

SEQ ID NO: 152669 - protein, 11 aa, Artificial Sequence
  Description of Artificial Sequence: Synthetic peptide
  Seed: RRLLLSHIHAS (PRAME_HUMAN)
RRLLLSHIHAK

SEQ ID NO: 152670 - protein, 9 aa, Artificial Sequence
  Description of Artificial Sequence: Synthetic peptide
  Seed: ITDDQLLAL (PRAME_HUMAN)
ISDDQLLAC

SEQ ID NO: 152671 - protein, 10 aa, Artificial Sequence
  Description of Artificial Sequence: Synthetic peptide
  Seed: AALELLPREL (PRAME_HUMAN)
AQLELLPREV

SEQ ID NO: 152672 - protein, 9 aa, Artificial Sequence
  Description of Artificial Sequence: Synthetic peptide
  Seed: YLHARLREL (PRAME_HUMAN)
YWHARLREY

SEQ ID NO: 152673 - protein, 10 aa, Artificial Sequence
  Description of Artificial Sequence: Synthetic peptide
  Seed: AALELLPREL (PRAME_HUMAN)
AMLELLPREV

SEQ ID NO: 152674 - protein, 10 aa, Artificial Sequence
  Description of Artificial Sequence: Synthetic peptide
  Seed: KGQHLHLETF (PRAME_HUMAN)
KNQHLHLETF

SEQ ID NO: 152675 - protein, 9 aa, Artificial Sequence
  Description of Artificial Sequence: Synthetic peptide
  Seed: MQDIKMILK (PRAME_HUMAN)
MSDIKMILY

SEQ ID NO: 152676 - protein, 9 aa, Artificial Sequence
  Description of Artificial Sequence: Synthetic peptide
  Seed: SLLQHLIGL (PRAME_HUMAN)
SILQHLIGL

SEQ ID NO: 152677 - protein, 9 aa, Artificial Sequence
  Description of Artificial Sequence: Synthetic peptide
  Seed: QSRYISMSV (PRAME_HUMAN)
QSRYISMST

SEQ ID NO: 152678 - protein, 9 aa, Artificial Sequence
  Description of Artificial Sequence: Synthetic peptide
  Seed: ASATLQDLV (PRAME_HUMAN)
ASATLQDLF

SEQ ID NO: 152679 - protein, 10 aa, Artificial Sequence
  Description of Artificial Sequence: Synthetic peptide
  Seed: LSFYGNSISI (PRAME_HUMAN)
LMFYGNSISI

SEQ ID NO: 152680 - protein, 10 aa, Artificial Sequence
  Description of Artificial Sequence: Synthetic peptide
  Seed: TTLSFYGNSI (PRAME_HUMAN)
THLSFYGNSV

SEQ ID NO: 152681 - protein, 10 aa, Artificial Sequence
  Description of Artificial Sequence: Synthetic peptide
  Seed: QYIAQFTSQF (PRAME_HUMAN)
QKIAQFTSQF

SEQ ID NO: 152682 - protein, 10 aa, Artificial Sequence
  Description of Artificial Sequence: Synthetic peptide
  Seed: ALLERASATL (PRAME_HUMAN)
AQLERASATF

SEQ ID NO: 152683 - protein, 9 aa, Artificial Sequence
  Description of Artificial Sequence: Synthetic peptide
  Seed: RLRELLCEL (PRAME_HUMAN)
RGRELLCEY

SEQ ID NO: 152684 - protein, 9 aa, Artificial Sequence
  Description of Artificial Sequence: Synthetic peptide
  Seed: SHCSQLTTL (PRAME_HUMAN)
SACSQLTTL

SEQ ID NO: 152685 - protein, 10 aa, Artificial Sequence
  Description of Artificial Sequence: Synthetic peptide
  Seed: ISISALQSLL (PRAME_HUMAN)
ILISALQSLW

SEQ ID NO: 152686 - protein, 9 aa, Artificial Sequence
  Description of Artificial Sequence: Synthetic peptide
  Seed: SEGDVMHLS (PRAME_HUMAN)
SEGDVMHLP

SEQ ID NO: 152687 - protein, 11 aa, Artificial Sequence
  Description of Artificial Sequence: Synthetic peptide
  Seed: RLVELAGQSLL (PRAME_HUMAN)
RLVELAGQSLW

SEQ ID NO: 152688 - protein, 9 aa, Artificial Sequence
  Description of Artificial Sequence: Synthetic peptide
  Seed: TWKLPTLAK (PRAME_HUMAN)
TVKLPTLAK

SEQ ID NO: 152689 - protein, 11 aa, Artificial Sequence
  Description of Artificial Sequence: Synthetic peptide
  Seed: RELFPPLFMAA (PRAME_HUMAN)
RLLFPPLFMAI

SEQ ID NO: 152690 - protein, 9 aa, Artificial Sequence
  Description of Artificial Sequence: Synthetic peptide
  Seed: ASATLQDLV (PRAME_HUMAN)
AQATLQDLI

SEQ ID NO: 152691 - protein, 10 aa, Artificial Sequence
  Description of Artificial Sequence: Synthetic peptide
  Seed: FIPVEVLVDL (PRAME_HUMAN)
FTPVEVLVDY

SEQ ID NO: 152692 - protein, 11 aa, Artificial Sequence
  Description of Artificial Sequence: Synthetic peptide
  Seed: QALYVDSLFFL (PRAME_HUMAN)
QYLYVDSLFFA

SEQ ID NO: 152693 - protein, 9 aa, Artificial Sequence
  Description of Artificial Sequence: Synthetic peptide
  Seed: FLRGRLDQL (PRAME_HUMAN)
FSRGRLDQM

SEQ ID NO: 152694 - protein, 10 aa, Artificial Sequence
  Description of Artificial Sequence: Synthetic peptide
  Seed: RRLWGSIQSR (PRAME_HUMAN)
RHLWGSIQSK

SEQ ID NO: 152695 - protein, 9 aa, Artificial Sequence
  Description of Artificial Sequence: Synthetic peptide
  Seed: KEEQYIAQF (PRAME_HUMAN)
KMEQYIAQM

SEQ ID NO: 152696 - protein, 10 aa, Artificial Sequence
  Description of Artificial Sequence: Synthetic peptide
  Seed: RRRLWGSIQS (PRAME_HUMAN)
RWRLWGSIQK

SEQ ID NO: 152697 - protein, 10 aa, Artificial Sequence
  Description of Artificial Sequence: Synthetic peptide
  Seed: LPSLSHCSQL (PRAME_HUMAN)
LPSLSHCSQI

SEQ ID NO: 152698 - protein, 10 aa, Artificial Sequence
  Description of Artificial Sequence: Synthetic peptide
  Seed: VLYPVPLESY (PRAME_HUMAN)
VMYPVPLESR

SEQ ID NO: 152699 - protein, 9 aa, Artificial Sequence
  Description of Artificial Sequence: Synthetic peptide
  Seed: RLDQLLRHV (PRAME_HUMAN)
RWDQLLRHL

SEQ ID NO: 152700 - protein, 9 aa, Artificial Sequence
  Description of Artificial Sequence: Synthetic peptide
  Seed: QSRYISMSV (PRAME_HUMAN)
QPRYISMSI

SEQ ID NO: 152701 - protein, 9 aa, Artificial Sequence
  Description of Artificial Sequence: Synthetic peptide
  Seed: SLLQHLIGL (PRAME_HUMAN)
SILQHLIGA

SEQ ID NO: 152702 - protein, 10 aa, Artificial Sequence
  Description of Artificial Sequence: Synthetic peptide
  Seed: VEVLVDLFLK (PRAME_HUMAN)
VRVLVDLFLR

SEQ ID NO: 152703 - protein, 9 aa, Artificial Sequence
  Description of Artificial Sequence: Synthetic peptide
  Seed: LGRPSMVWL (PRAME_HUMAN)
LQRPSMVWK

SEQ ID NO: 152704 - protein, 10 aa, Artificial Sequence
  Description of Artificial Sequence: Synthetic peptide
  Seed: ISMSVWTSPR (PRAME_HUMAN)
IRMSVWTSPK

SEQ ID NO: 152705 - protein, 10 aa, Artificial Sequence
  Description of Artificial Sequence: Synthetic peptide
  Seed: RHVMNPLETL (PRAME_HUMAN)
RRVMNPLETF

SEQ ID NO: 152706 - protein, 9 aa, Artificial Sequence
  Description of Artificial Sequence: Synthetic peptide
  Seed: LQSLLQHLI (PRAME_HUMAN)
LVSLLQHLI

SEQ ID NO: 152707 - protein, 9 aa, Artificial Sequence
  Description of Artificial Sequence: Synthetic peptide
  Seed: LLLSHIHAS (PRAME_HUMAN)
LILSHIHAM

SEQ ID NO: 152708 - protein, 10 aa, Artificial Sequence
  Description of Artificial Sequence: Synthetic peptide
  Seed: LLLSHIHASS (PRAME_HUMAN)
LKLSHIHASA

SEQ ID NO: 152709 - protein, 10 aa, Artificial Sequence
  Description of Artificial Sequence: Synthetic peptide
  Seed: ARLRELLCEL (PRAME_HUMAN)
ATLRELLCEV

SEQ ID NO: 152710 - protein, 10 aa, Artificial Sequence
  Description of Artificial Sequence: Synthetic peptide
  Seed: IQSRYISMSV (PRAME_HUMAN)
IMSRYISMSA

SEQ ID NO: 152711 - protein, 10 aa, Artificial Sequence
  Description of Artificial Sequence: Synthetic peptide
  Seed: ETLSITNCRL (PRAME_HUMAN)
ETLSITNCRM

SEQ ID NO: 152712 - protein, 11 aa, Artificial Sequence
  Description of Artificial Sequence: Synthetic peptide
  Seed: LSLSGVMLTDV (PRAME_HUMAN)
LYLSGVMLTDV

SEQ ID NO: 152713 - protein, 10 aa, Artificial Sequence
  Description of Artificial Sequence: Synthetic peptide
  Seed: ALELLPRELF (PRAME_HUMAN)
ASELLPRELW

SEQ ID NO: 152714 - protein, 9 aa, Artificial Sequence
  Description of Artificial Sequence: Synthetic peptide
  Seed: LALLPSLSH (PRAME_HUMAN)
LVLLPSLSY

SEQ ID NO: 152715 - protein, 10 aa, Artificial Sequence
  Description of Artificial Sequence: Synthetic peptide
  Seed: QSLLQHLIGL (PRAME_HUMAN)
QCLLQHLIGV

SEQ ID NO: 152716 - protein, 11 aa, Artificial Sequence
  Description of Artificial Sequence: Synthetic peptide
  Seed: AAFDGRHSQTL (PRAME_HUMAN)
AWFDGRHSQTF

SEQ ID NO: 152717 - protein, 10 aa, Artificial Sequence
  Description of Artificial Sequence: Synthetic peptide
  Seed: ALYVDSLFFL (PRAME_HUMAN)
AEYVDSLFFI

SEQ ID NO: 152718 - protein, 9 aa, Artificial Sequence
  Description of Artificial Sequence: Synthetic peptide
  Seed: MINLRRLLL (PRAME_HUMAN)
MQNLRRLLV

SEQ ID NO: 152719 - protein, 9 aa, Artificial Sequence
  Description of Artificial Sequence: Synthetic peptide
  Seed: FLSLQCLQA (PRAME_HUMAN)
FMSLQCLQI

SEQ ID NO: 152720 - protein, 10 aa, Artificial Sequence
  Description of Artificial Sequence: Synthetic peptide
  Seed: ARLRELLCEL (PRAME_HUMAN)
AGLRELLCEV

SEQ ID NO: 152721 - protein, 9 aa, Artificial Sequence
  Description of Artificial Sequence: Synthetic peptide
  Seed: LTDVSPEPL (PRAME_HUMAN)
LFDVSPEPM

SEQ ID NO: 152722 - protein, 9 aa, Artificial Sequence
  Description of Artificial Sequence: Synthetic peptide
  Seed: LLKDEALAI (PRAME_HUMAN)
LMKDEALAM

SEQ ID NO: 152723 - protein, 10 aa, Artificial Sequence
  Description of Artificial Sequence: Synthetic peptide
  Seed: MNPLETLSIT (PRAME_HUMAN)
MQPLETLSIA

SEQ ID NO: 152724 - protein, 9 aa, Artificial Sequence
  Description of Artificial Sequence: Synthetic peptide
  Seed: KFSPYLGQM (PRAME_HUMAN)
KASPYLGQI

SEQ ID NO: 152725 - protein, 10 aa, Artificial Sequence
  Description of Artificial Sequence: Synthetic peptide
  Seed: LQALYVDSLF (PRAME_HUMAN)
LSALYVDSLW

SEQ ID NO: 152726 - protein, 9 aa, Artificial Sequence
  Description of Artificial Sequence: Synthetic peptide
  Seed: RTFYDPEPI (PRAME_HUMAN)
RMFYDPEPH

SEQ ID NO: 152727 - protein, 9 aa, Artificial Sequence
  Description of Artificial Sequence: Synthetic peptide
  Seed: AWPFTCLPL (PRAME_HUMAN)
AWPFTCLPF

SEQ ID NO: 152728 - protein, 10 aa, Artificial Sequence
  Description of Artificial Sequence: Synthetic peptide
  Seed: YIAQFTSQFL (PRAME_HUMAN)
YVAQFTSQFA

SEQ ID NO: 152729 - protein, 10 aa, Artificial Sequence
  Description of Artificial Sequence: Synthetic peptide
  Seed: LLPRELFPPL (PRAME_HUMAN)
LEPRELFPPF

SEQ ID NO: 152730 - protein, 9 aa, Artificial Sequence
  Description of Artificial Sequence: Synthetic peptide
  Seed: NSHQDFWTV (PRAME_HUMAN)
NIHQDFWTV

SEQ ID NO: 152731 - protein, 10 aa, Artificial Sequence
  Description of Artificial Sequence: Synthetic peptide
  Seed: YEDIHGTLHL (PRAME_HUMAN)
YMDIHGTLHL

SEQ ID NO: 152732 - protein, 9 aa, Artificial Sequence
  Description of Artificial Sequence: Synthetic peptide
  Seed: ALYVDSLFF (PRAME_HUMAN)
AMYVDSLFF

SEQ ID NO: 152733 - protein, 10 aa, Artificial Sequence
  Description of Artificial Sequence: Synthetic peptide
  Seed: SALQSLLQHL (PRAME_HUMAN)
STLQSLLQHI

SEQ ID NO: 152734 - protein, 11 aa, Artificial Sequence
  Description of Artificial Sequence: Synthetic peptide
  Seed: KIFAMPMQDIK (PRAME_HUMAN)
KMFAMPMQDIR

SEQ ID NO: 152735 - protein, 9 aa, Artificial Sequence
  Description of Artificial Sequence: Synthetic peptide
  Seed: SQSPSVSQL (PRAME_HUMAN)
SISPSVSQR

SEQ ID NO: 152736 - protein, 10 aa, Artificial Sequence
  Description of Artificial Sequence: Synthetic peptide
  Seed: IGLSNLTHVL (PRAME_HUMAN)
ISLSNLTHVV

SEQ ID NO: 152737 - protein, 11 aa, Artificial Sequence
  Description of Artificial Sequence: Synthetic peptide
  Seed: DVSPEPLQALL (PRAME_HUMAN)
DISPEPLQALK

SEQ ID NO: 152738 - protein, 9 aa, Artificial Sequence
  Description of Artificial Sequence: Synthetic peptide
  Seed: IAQFTSQFL (PRAME_HUMAN)
IMQFTSQFV

SEQ ID NO: 152739 - protein, 10 aa, Artificial Sequence
  Description of Artificial Sequence: Synthetic peptide
  Seed: TSQFLSLQCL (PRAME_HUMAN)
TPQFLSLQCY

SEQ ID NO: 152740 - protein, 10 aa, Artificial Sequence
  Description of Artificial Sequence: Synthetic peptide
  Seed: KVKRKKNVLR (PRAME_HUMAN)
KTKRKKNVLS

SEQ ID NO: 152741 - protein, 11 aa, Artificial Sequence
  Description of Artificial Sequence: Synthetic peptide
  Seed: AAFDGRHSQTL (PRAME_HUMAN)
ALFDGRHSQTW

SEQ ID NO: 152742 - protein, 8 aa, Artificial Sequence
  Description of Artificial Sequence: Synthetic peptide
  Seed: FSYLIEKV (PRAME_HUMAN)
FPYLIEKV

SEQ ID NO: 152743 - protein, 9 aa, Artificial Sequence
  Description of Artificial Sequence: Synthetic peptide
  Seed: KAMVQAWPF (PRAME_HUMAN)
KEMVQAWPF

SEQ ID NO: 152744 - protein, 9 aa, Artificial Sequence
  Description of Artificial Sequence: Synthetic peptide
  Seed: KLKIFAMPM (PRAME_HUMAN)
KNKIFAMPV

SEQ ID NO: 152745 - protein, 9 aa, Artificial Sequence
  Description of Artificial Sequence: Synthetic peptide
  Seed: VSPEPLQAL (PRAME_HUMAN)
VVPEPLQAF

SEQ ID NO: 152746 - protein, 9 aa, Artificial Sequence
  Description of Artificial Sequence: Synthetic peptide
  Seed: HVMNPLETL (PRAME_HUMAN)
HLMNPLETL

SEQ ID NO: 152747 - protein, 9 aa, Artificial Sequence
  Description of Artificial Sequence: Synthetic peptide
  Seed: LTDVSPEPL (PRAME_HUMAN)
LFDVSPEPF

SEQ ID NO: 152748 - protein, 9 aa, Artificial Sequence
  Description of Artificial Sequence: Synthetic peptide
  Seed: QSRYISMSV (PRAME_HUMAN)
QMRYISMSW

SEQ ID NO: 152749 - protein, 9 aa, Artificial Sequence
  Description of Artificial Sequence: Synthetic peptide
  Seed: VQAWPFTCL (PRAME_HUMAN)
VQAWPFTCY

SEQ ID NO: 152750 - protein, 11 aa, Artificial Sequence
  Description of Artificial Sequence: Synthetic peptide
  Seed: LPTLAKFSPYL (PRAME_HUMAN)
LATLAKFSPYV

SEQ ID NO: 152751 - protein, 8 aa, Artificial Sequence
  Description of Artificial Sequence: Synthetic peptide
  Seed: LTHVLYPV (PRAME_HUMAN)
LMHVLYPL

SEQ ID NO: 152752 - protein, 9 aa, Artificial Sequence
  Description of Artificial Sequence: Synthetic peptide
  Seed: IGLSNLTHV (PRAME_HUMAN)
ILLSNLTHM

SEQ ID NO: 152753 - protein, 9 aa, Artificial Sequence
  Description of Artificial Sequence: Synthetic peptide
  Seed: SMSVWTSPR (PRAME_HUMAN)
STSVWTSPK

SEQ ID NO: 152754 - protein, 9 aa, Artificial Sequence
  Description of Artificial Sequence: Synthetic peptide
  Seed: LHLERLAYL (PRAME_HUMAN)
LFLERLAYF

SEQ ID NO: 152755 - protein, 9 aa, Artificial Sequence
  Description of Artificial Sequence: Synthetic peptide
  Seed: RRWKLQVLD (PRAME_HUMAN)
RRWKLQVLI

SEQ ID NO: 152756 - protein, 9 aa, Artificial Sequence
  Description of Artificial Sequence: Synthetic peptide
  Seed: TLAKFSPYL (PRAME_HUMAN)
TMAKFSPYL

SEQ ID NO: 152757 - protein, 9 aa, Artificial Sequence
  Description of Artificial Sequence: Synthetic peptide
  Seed: LSHIHASSY (PRAME_HUMAN)
LAHIHASSL

SEQ ID NO: 152758 - protein, 10 aa, Artificial Sequence
  Description of Artificial Sequence: Synthetic peptide
  Seed: FFLRGRLDQL (PRAME_HUMAN)
FDLRGRLDQI

SEQ ID NO: 152759 - protein, 9 aa, Artificial Sequence
  Description of Artificial Sequence: Synthetic peptide
  Seed: CKKLKIFAM (PRAME_HUMAN)
CAKLKIFAM

SEQ ID NO: 152760 - protein, 9 aa, Artificial Sequence
  Description of Artificial Sequence: Synthetic peptide
  Seed: SLLQHLIGL (PRAME_HUMAN)
SLLQHLIGT

SEQ ID NO: 152761 - protein, 9 aa, Artificial Sequence
  Description of Artificial Sequence: Synthetic peptide
  Seed: RLWGSIQSR (PRAME_HUMAN)
RIWGSIQSV

SEQ ID NO: 152762 - protein, 10 aa, Artificial Sequence
  Description of Artificial Sequence: Synthetic peptide
  Seed: MNPLETLSIT (PRAME_HUMAN)
MCPLETLSIA

SEQ ID NO: 152763 - protein, 9 aa, Artificial Sequence
  Description of Artificial Sequence: Synthetic peptide
  Seed: YIAQFTSQF (PRAME_HUMAN)
YSAQFTSQW

SEQ ID NO: 152764 - protein, 9 aa, Artificial Sequence
  Description of Artificial Sequence: Synthetic peptide
  Seed: FYDPEPILC (PRAME_HUMAN)
FFDPEPILV

SEQ ID NO: 152765 - protein, 9 aa, Artificial Sequence
  Description of Artificial Sequence: Synthetic peptide
  Seed: TDDQLLALL (PRAME_HUMAN)
TGDQLLALV

SEQ ID NO: 152766 - protein, 8 aa, Artificial Sequence
  Description of Artificial Sequence: Synthetic peptide
  Seed: FYGNSISI (PRAME_HUMAN)
FFGNSISL

SEQ ID NO: 152767 - protein, 9 aa, Artificial Sequence
  Description of Artificial Sequence: Synthetic peptide
  Seed: SLLQHLIGL (PRAME_HUMAN)
SQLQHLIGV

SEQ ID NO: 152768 - protein, 9 aa, Artificial Sequence
  Description of Artificial Sequence: Synthetic peptide
  Seed: WPFTCLPLG (PRAME_HUMAN)
WPFTCLPLY

SEQ ID NO: 152769 - protein, 10 aa, Artificial Sequence
  Description of Artificial Sequence: Synthetic peptide
  Seed: FAMPMQDIKM (PRAME_HUMAN)
FVMPMQDIKL

SEQ ID NO: 152770 - protein, 10 aa, Artificial Sequence
  Description of Artificial Sequence: Synthetic peptide
  Seed: QALYVDSLFF (PRAME_HUMAN)
QMLYVDSLFF

SEQ ID NO: 152771 - protein, 9 aa, Artificial Sequence
  Description of Artificial Sequence: Synthetic peptide
  Seed: LSVLSLSGV (PRAME_HUMAN)
LTVLSLSGM

SEQ ID NO: 152772 - protein, 10 aa, Artificial Sequence
  Description of Artificial Sequence: Synthetic peptide
  Seed: LLLSHIHASS (PRAME_HUMAN)
LSLSHIHASA

SEQ ID NO: 152773 - protein, 10 aa, Artificial Sequence
  Description of Artificial Sequence: Synthetic peptide
  Seed: RHVMNPLETL (PRAME_HUMAN)
RTVMNPLETF

SEQ ID NO: 152774 - protein, 9 aa, Artificial Sequence
  Description of Artificial Sequence: Synthetic peptide
  Seed: ERLAYLHAR (PRAME_HUMAN)
ETLAYLHAK

SEQ ID NO: 152775 - protein, 9 aa, Artificial Sequence
  Description of Artificial Sequence: Synthetic peptide
  Seed: YLHARLREL (PRAME_HUMAN)
YTHARLREM

SEQ ID NO: 152776 - protein, 9 aa, Artificial Sequence
  Description of Artificial Sequence: Synthetic peptide
  Seed: CKKLKIFAM (PRAME_HUMAN)
CVKLKIFAV

SEQ ID NO: 152777 - protein, 10 aa, Artificial Sequence
  Description of Artificial Sequence: Synthetic peptide
  Seed: LSQSPSVSQL (PRAME_HUMAN)
LDQSPSVSQF

SEQ ID NO: 152778 - protein, 10 aa, Artificial Sequence
  Description of Artificial Sequence: Synthetic peptide
  Seed: IGLSNLTHVL (PRAME_HUMAN)
ITLSNLTHVV

SEQ ID NO: 152779 - protein, 9 aa, Artificial Sequence
  Description of Artificial Sequence: Synthetic peptide
  Seed: RLRELLCEL (PRAME_HUMAN)
RMRELLCEW

SEQ ID NO: 152780 - protein, 10 aa, Artificial Sequence
  Description of Artificial Sequence: Synthetic peptide
  Seed: FIPVEVLVDL (PRAME_HUMAN)
FLPVEVLVDI

SEQ ID NO: 152781 - protein, 10 aa, Artificial Sequence
  Description of Artificial Sequence: Synthetic peptide
  Seed: LLPRELFPPL (PRAME_HUMAN)
LYPRELFPPF

SEQ ID NO: 152782 - protein, 9 aa, Artificial Sequence
  Description of Artificial Sequence: Synthetic peptide
  Seed: HVMNPLETL (PRAME_HUMAN)
HRMNPLETM

SEQ ID NO: 152783 - protein, 9 aa, Artificial Sequence
  Description of Artificial Sequence: Synthetic peptide
  Seed: SLSHCSQLT (PRAME_HUMAN)
SVSHCSQLV

SEQ ID NO: 152784 - protein, 9 aa, Artificial Sequence
  Description of Artificial Sequence: Synthetic peptide
  Seed: LLALLPSLS (PRAME_HUMAN)
LVALLPSLV

SEQ ID NO: 152785 - protein, 9 aa, Artificial Sequence
  Description of Artificial Sequence: Synthetic peptide
  Seed: NSISISALQ (PRAME_HUMAN)
NFISISALR

SEQ ID NO: 152786 - protein, 9 aa, Artificial Sequence
  Description of Artificial Sequence: Synthetic peptide
  Seed: AAFDGRHSQ (PRAME_HUMAN)
AAFDGRHSH

SEQ ID NO: 152787 - protein, 10 aa, Artificial Sequence
  Description of Artificial Sequence: Synthetic peptide
  Seed: AIAALELLPR (PRAME_HUMAN)
ATAALELLPR

SEQ ID NO: 152788 - protein, 10 aa, Artificial Sequence
  Description of Artificial Sequence: Synthetic peptide
  Seed: ERLAYLHARL (PRAME_HUMAN)
ETLAYLHARI

SEQ ID NO: 152789 - protein, 9 aa, Artificial Sequence
  Description of Artificial Sequence: Synthetic peptide
  Seed: FTCLPLGVL (PRAME_HUMAN)
FACLPLGVY

SEQ ID NO: 152790 - protein, 9 aa, Artificial Sequence
  Description of Artificial Sequence: Synthetic peptide
  Seed: SISALQSLL (PRAME_HUMAN)
SVSALQSLY

SEQ ID NO: 152791 - protein, 9 aa, Artificial Sequence
  Description of Artificial Sequence: Synthetic peptide
  Seed: LLKDEALAI (PRAME_HUMAN)
LLKDEALAL

SEQ ID NO: 152792 - protein, 9 aa, Artificial Sequence
  Description of Artificial Sequence: Synthetic peptide
  Seed: LSNLTHVLY (PRAME_HUMAN)
LPNLTHVLF

SEQ ID NO: 152793 - protein, 8 aa, Artificial Sequence
  Description of Artificial Sequence: Synthetic peptide
  Seed: FSYLIEKV (PRAME_HUMAN)
FQYLIEKL

SEQ ID NO: 152794 - protein, 10 aa, Artificial Sequence
  Description of Artificial Sequence: Synthetic peptide
  Seed: GQSLLKDEAL (PRAME_HUMAN)
GESLLKDEAM

SEQ ID NO: 152795 - protein, 9 aa, Artificial Sequence
  Description of Artificial Sequence: Synthetic peptide
  Seed: KLKIFAMPM (PRAME_HUMAN)
KVKIFAMPQ

SEQ ID NO: 152796 - protein, 10 aa, Artificial Sequence
  Description of Artificial Sequence: Synthetic peptide
  Seed: LSFYGNSISI (PRAME_HUMAN)
LFFYGNSISL

SEQ ID NO: 152797 - protein, 9 aa, Artificial Sequence
  Description of Artificial Sequence: Synthetic peptide
  Seed: QSRYISMSV (PRAME_HUMAN)
QPRYISMSV

SEQ ID NO: 152798 - protein, 9 aa, Artificial Sequence
  Description of Artificial Sequence: Synthetic peptide
  Seed: KVDGLSTEA (PRAME_HUMAN)
KVDGLSTEI

SEQ ID NO: 152799 - protein, 9 aa, Artificial Sequence
  Description of Artificial Sequence: Synthetic peptide
  Seed: RLRELLCEL (PRAME_HUMAN)
RWRELLCEA

SEQ ID NO: 152800 - protein, 9 aa, Artificial Sequence
  Description of Artificial Sequence: Synthetic peptide
  Seed: SRYISMSVW (PRAME_HUMAN)
SYYISMSVF

SEQ ID NO: 152801 - protein, 9 aa, Artificial Sequence
  Description of Artificial Sequence: Synthetic peptide
  Seed: VSQLSVLSL (PRAME_HUMAN)
VYQLSVLSV

SEQ ID NO: 152802 - protein, 9 aa, Artificial Sequence
  Description of Artificial Sequence: Synthetic peptide
  Seed: TSPRRLVEL (PRAME_HUMAN)
TMPRRLVEF

SEQ ID NO: 152803 - protein, 10 aa, Artificial Sequence
  Description of Artificial Sequence: Synthetic peptide
  Seed: RPRRWKLQVL (PRAME_HUMAN)
RPRRWKLQVI

SEQ ID NO: 152804 - protein, 9 aa, Artificial Sequence
  Description of Artificial Sequence: Synthetic peptide
  Seed: YIAQFTSQF (PRAME_HUMAN)
YYAQFTSQM

SEQ ID NO: 152805 - protein, 10 aa, Artificial Sequence
  Description of Artificial Sequence: Synthetic peptide
  Seed: LLSHIHASSY (PRAME_HUMAN)
LASHIHASSF

SEQ ID NO: 152806 - protein, 9 aa, Artificial Sequence
  Description of Artificial Sequence: Synthetic peptide
  Seed: FYDPEPILC (PRAME_HUMAN)
FCDPEPILL

SEQ ID NO: 152807 - protein, 9 aa, Artificial Sequence
  Description of Artificial Sequence: Synthetic peptide
  Seed: KMILKMVQL (PRAME_HUMAN)
KQILKMVQL

SEQ ID NO: 152808 - protein, 10 aa, Artificial Sequence
  Description of Artificial Sequence: Synthetic peptide
  Seed: MTKKRKVDGL (PRAME_HUMAN)
MLKKRKVDGM

SEQ ID NO: 152809 - protein, 9 aa, Artificial Sequence
  Description of Artificial Sequence: Synthetic peptide
  Seed: CPHCGDRTF (PRAME_HUMAN)
CPHCGDRTY

SEQ ID NO: 152810 - protein, 9 aa, Artificial Sequence
  Description of Artificial Sequence: Synthetic peptide
  Seed: YGNSISISA (PRAME_HUMAN)
YNNSISISL

SEQ ID NO: 152811 - protein, 11 aa, Artificial Sequence
  Description of Artificial Sequence: Synthetic peptide
  Seed: FKAVLDGLDVL (PRAME_HUMAN)
FTAVLDGLDVV

SEQ ID NO: 152812 - protein, 10 aa, Artificial Sequence
  Description of Artificial Sequence: Synthetic peptide
  Seed: GACDELFSYL (PRAME_HUMAN)
GLCDELFSYV

SEQ ID NO: 152813 - protein, 11 aa, Artificial Sequence
  Description of Artificial Sequence: Synthetic peptide
  Seed: QALYVDSLFFL (PRAME_HUMAN)
QSLYVDSLFFF

SEQ ID NO: 152814 - protein, 9 aa, Artificial Sequence
  Description of Artificial Sequence: Synthetic peptide
  Seed: YLHARLREL (PRAME_HUMAN)
YEHARLREF

SEQ ID NO: 152815 - protein, 9 aa, Artificial Sequence
  Description of Artificial Sequence: Synthetic peptide
  Seed: LSHIHASSY (PRAME_HUMAN)
LVHIHASSF

SEQ ID NO: 152816 - protein, 9 aa, Artificial Sequence
  Description of Artificial Sequence: Synthetic peptide
  Seed: KDEALAIAA (PRAME_HUMAN)
KEEALAIAI

SEQ ID NO: 152817 - protein, 9 aa, Artificial Sequence
  Description of Artificial Sequence: Synthetic peptide
  Seed: VSPEPLQAL (PRAME_HUMAN)
VTPEPLQAV

SEQ ID NO: 152818 - protein, 9 aa, Artificial Sequence
  Description of Artificial Sequence: Synthetic peptide
  Seed: SIQSRYISM (PRAME_HUMAN)
SPQSRYIST

SEQ ID NO: 152819 - protein, 9 aa, Artificial Sequence
  Description of Artificial Sequence: Synthetic peptide
  Seed: YLHARLREL (PRAME_HUMAN)
YGHARLREF

SEQ ID NO: 152820 - protein, 10 aa, Artificial Sequence
  Description of Artificial Sequence: Synthetic peptide
  Seed: VLMKGQHLHL (PRAME_HUMAN)
VIMKGQHLHW

SEQ ID NO: 152821 - protein, 9 aa, Artificial Sequence
  Description of Artificial Sequence: Synthetic peptide
  Seed: RTFYDPEPI (PRAME_HUMAN)
RVFYDPEPF

SEQ ID NO: 152822 - protein, 10 aa, Artificial Sequence
  Description of Artificial Sequence: Synthetic peptide
  Seed: ISISALQSLL (PRAME_HUMAN)
IKISALQSLW

SEQ ID NO: 152823 - protein, 9 aa, Artificial Sequence
  Description of Artificial Sequence: Synthetic peptide
  Seed: HLIGLSNLT (PRAME_HUMAN)
HVIGLSNLV

SEQ ID NO: 152824 - protein, 9 aa, Artificial Sequence
  Description of Artificial Sequence: Synthetic peptide
  Seed: VSQLSVLSL (PRAME_HUMAN)
VRQLSVLSL

SEQ ID NO: 152825 - protein, 10 aa, Artificial Sequence
  Description of Artificial Sequence: Synthetic peptide
  Seed: ETLSITNCRL (PRAME_HUMAN)
EALSITNCRR

SEQ ID NO: 152826 - protein, 9 aa, Artificial Sequence
  Description of Artificial Sequence: Synthetic peptide
  Seed: RTFYDPEPI (PRAME_HUMAN)
RSFYDPEPY

SEQ ID NO: 152827 - protein, 9 aa, Artificial Sequence
  Description of Artificial Sequence: Synthetic peptide
  Seed: VSQLSVLSL (PRAME_HUMAN)
VVQLSVLSW

SEQ ID NO: 152828 - protein, 10 aa, Artificial Sequence
  Description of Artificial Sequence: Synthetic peptide
  Seed: SLSGVMLTDV (PRAME_HUMAN)
SQSGVMLTDV

SEQ ID NO: 152829 - protein, 9 aa, Artificial Sequence
  Description of Artificial Sequence: Synthetic peptide
  Seed: NSISISALQ (PRAME_HUMAN)
NSISISALY

SEQ ID NO: 152830 - protein, 9 aa, Artificial Sequence
  Description of Artificial Sequence: Synthetic peptide
  Seed: RLLLSHIHA (PRAME_HUMAN)
RLLLSHIHK

SEQ ID NO: 152831 - protein, 10 aa, Artificial Sequence
  Description of Artificial Sequence: Synthetic peptide
  Seed: ALYVDSLFFL (PRAME_HUMAN)
AHYVDSLFFL

SEQ ID NO: 152832 - protein, 10 aa, Artificial Sequence
  Description of Artificial Sequence: Synthetic peptide
  Seed: RLRELLCELG (PRAME_HUMAN)
RMRELLCELA

SEQ ID NO: 152833 - protein, 9 aa, Artificial Sequence
  Description of Artificial Sequence: Synthetic peptide
  Seed: EQPFIPVEV (PRAME_HUMAN)
EHPFIPVEF

SEQ ID NO: 152834 - protein, 9 aa, Artificial Sequence
  Description of Artificial Sequence: Synthetic peptide
  Seed: ISISALQSL (PRAME_HUMAN)
IFISALQSY

SEQ ID NO: 152835 - protein, 10 aa, Artificial Sequence
  Description of Artificial Sequence: Synthetic peptide
  Seed: CLQALYVDSL (PRAME_HUMAN)
CFQALYVDSV

SEQ ID NO: 152836 - protein, 10 aa, Artificial Sequence
  Description of Artificial Sequence: Synthetic peptide
  Seed: MNPLETLSIT (PRAME_HUMAN)
MYPLETLSIV

SEQ ID NO: 152837 - protein, 10 aa, Artificial Sequence
  Description of Artificial Sequence: Synthetic peptide
  Seed: VLYPVPLESY (PRAME_HUMAN)
VVYPVPLESK

SEQ ID NO: 152838 - protein, 10 aa, Artificial Sequence
  Description of Artificial Sequence: Synthetic peptide
  Seed: RASATLQDLV (PRAME_HUMAN)
RCSATLQDLW

SEQ ID NO: 152839 - protein, 10 aa, Artificial Sequence
  Description of Artificial Sequence: Synthetic peptide
  Seed: TLHLERLAYL (PRAME_HUMAN)
TLHLERLAYA

SEQ ID NO: 152840 - protein, 11 aa, Artificial Sequence
  Description of Artificial Sequence: Synthetic peptide
  Seed: LQSLLQHLIGL (PRAME_HUMAN)
LHSLLQHLIGV

SEQ ID NO: 152841 - protein, 9 aa, Artificial Sequence
  Description of Artificial Sequence: Synthetic peptide
  Seed: DVLLAQEVR (PRAME_HUMAN)
DMLLAQEVR

SEQ ID NO: 152842 - protein, 9 aa, Artificial Sequence
  Description of Artificial Sequence: Synthetic peptide
  Seed: QALYVDSLF (PRAME_HUMAN)
QMLYVDSLY

SEQ ID NO: 152843 - protein, 9 aa, Artificial Sequence
  Description of Artificial Sequence: Synthetic peptide
  Seed: ALAIAALEL (PRAME_HUMAN)
AAAIAALEH

SEQ ID NO: 152844 - protein, 9 aa, Artificial Sequence
  Description of Artificial Sequence: Synthetic peptide
  Seed: RGRLDQLLR (PRAME_HUMAN)
RARLDQLLI

SEQ ID NO: 152845 - protein, 10 aa, Artificial Sequence
  Description of Artificial Sequence: Synthetic peptide
  Seed: ETLSITNCRL (PRAME_HUMAN)
EVLSITNCRK

SEQ ID NO: 152846 - protein, 9 aa, Artificial Sequence
  Description of Artificial Sequence: Synthetic peptide
  Seed: MNPLETLSI (PRAME_HUMAN)
MTPLETLSF

SEQ ID NO: 152847 - protein, 9 aa, Artificial Sequence
  Description of Artificial Sequence: Synthetic peptide
  Seed: SIEDLEVTC (PRAME_HUMAN)
SLEDLEVTF

SEQ ID NO: 152848 - protein, 10 aa, Artificial Sequence
  Description of Artificial Sequence: Synthetic peptide
  Seed: GACDELFSYL (PRAME_HUMAN)
GMCDELFSYL

SEQ ID NO: 152849 - protein, 10 aa, Artificial Sequence
  Description of Artificial Sequence: Synthetic peptide
  Seed: AYLHARLREL (PRAME_HUMAN)
AYLHARLREW

SEQ ID NO: 152850 - protein, 9 aa, Artificial Sequence
  Description of Artificial Sequence: Synthetic peptide
  Seed: HARLRELLC (PRAME_HUMAN)
HPRLRELLI

SEQ ID NO: 152851 - protein, 10 aa, Artificial Sequence
  Description of Artificial Sequence: Synthetic peptide
  Seed: AFDGRHSQTL (PRAME_HUMAN)
AIDGRHSQTL

SEQ ID NO: 152852 - protein, 9 aa, Artificial Sequence
  Description of Artificial Sequence: Synthetic peptide
  Seed: VELAGQSLL (PRAME_HUMAN)
VELAGQSLM

SEQ ID NO: 152853 - protein, 10 aa, Artificial Sequence
  Description of Artificial Sequence: Synthetic peptide
  Seed: GRLDQLLRHV (PRAME_HUMAN)
GMLDQLLRHA

SEQ ID NO: 152854 - protein, 11 aa, Artificial Sequence
  Description of Artificial Sequence: Synthetic peptide
  Seed: LLLSHIHASSY (PRAME_HUMAN)
LQLSHIHASSW

SEQ ID NO: 152855 - protein, 9 aa, Artificial Sequence
  Description of Artificial Sequence: Synthetic peptide
  Seed: FSPYLGQMI (PRAME_HUMAN)
FVPYLGQMV

SEQ ID NO: 152856 - protein, 10 aa, Artificial Sequence
  Description of Artificial Sequence: Synthetic peptide
  Seed: FFLRGRLDQL (PRAME_HUMAN)
FLLRGRLDQA

SEQ ID NO: 152857 - protein, 9 aa, Artificial Sequence
  Description of Artificial Sequence: Synthetic peptide
  Seed: LQDLVFDEC (PRAME_HUMAN)
LIDLVFDEF

SEQ ID NO: 152858 - protein, 10 aa, Artificial Sequence
  Description of Artificial Sequence: Synthetic peptide
  Seed: TSQFLSLQCL (PRAME_HUMAN)
TRQFLSLQCM

SEQ ID NO: 152859 - protein, 11 aa, Artificial Sequence
  Description of Artificial Sequence: Synthetic peptide
  Seed: MKGQHLHLETF (PRAME_HUMAN)
MAGQHLHLETF

SEQ ID NO: 152860 - protein, 10 aa, Artificial Sequence
  Description of Artificial Sequence: Synthetic peptide
  Seed: AAFDGRHSQT (PRAME_HUMAN)
ASFDGRHSQI

SEQ ID NO: 152861 - protein, 10 aa, Artificial Sequence
  Description of Artificial Sequence: Synthetic peptide
  Seed: AYLHARLREL (PRAME_HUMAN)
AGLHARLREV

SEQ ID NO: 152862 - protein, 9 aa, Artificial Sequence
  Description of Artificial Sequence: Synthetic peptide
  Seed: SYEDIHGTL (PRAME_HUMAN)
SFEDIHGTL

SEQ ID NO: 152863 - protein, 9 aa, Artificial Sequence
  Description of Artificial Sequence: Synthetic peptide
  Seed: RLAYLHARL (PRAME_HUMAN)
RIAYLHARV

SEQ ID NO: 152864 - protein, 9 aa, Artificial Sequence
  Description of Artificial Sequence: Synthetic peptide
  Seed: FYDPEPILC (PRAME_HUMAN)
FWDPEPILW

SEQ ID NO: 152865 - protein, 9 aa, Artificial Sequence
  Description of Artificial Sequence: Synthetic peptide
  Seed: RRWKLQVLD (PRAME_HUMAN)
RRWKLQVLM

SEQ ID NO: 152866 - protein, 9 aa, Artificial Sequence
  Description of Artificial Sequence: Synthetic peptide
  Seed: SQSPSVSQL (PRAME_HUMAN)
SASPSVSQV

SEQ ID NO: 152867 - protein, 9 aa, Artificial Sequence
  Description of Artificial Sequence: Synthetic peptide
  Seed: LSHIHASSY (PRAME_HUMAN)
LSHIHASSW

SEQ ID NO: 152868 - protein, 8 aa, Artificial Sequence
  Description of Artificial Sequence: Synthetic peptide
  Seed: LQSLLQHL (PRAME_HUMAN)
LESLLQHL

SEQ ID NO: 152869 - protein, 10 aa, Artificial Sequence
  Description of Artificial Sequence: Synthetic peptide
  Seed: SVSQLSVLSL (PRAME_HUMAN)
SISQLSVLSV

SEQ ID NO: 152870 - protein, 9 aa, Artificial Sequence
  Description of Artificial Sequence: Synthetic peptide
  Seed: LSHIHASSY (PRAME_HUMAN)
LMHIHASSI

SEQ ID NO: 152871 - protein, 9 aa, Artificial Sequence
  Description of Artificial Sequence: Synthetic peptide
  Seed: YIAQFTSQF (PRAME_HUMAN)
YVAQFTSQI

SEQ ID NO: 152872 - protein, 10 aa, Artificial Sequence
  Description of Artificial Sequence: Synthetic peptide
  Seed: RLDQLLRHVM (PRAME_HUMAN)
REDQLLRHVM

SEQ ID NO: 152873 - protein, 10 aa, Artificial Sequence
  Description of Artificial Sequence: Synthetic peptide
  Seed: LSFYGNSISI (PRAME_HUMAN)
LEFYGNSISM

SEQ ID NO: 152874 - protein, 10 aa, Artificial Sequence
  Description of Artificial Sequence: Synthetic peptide
  Seed: MLTDVSPEPL (PRAME_HUMAN)
MLTDVSPEPA

SEQ ID NO: 152875 - protein, 8 aa, Artificial Sequence
  Description of Artificial Sequence: Synthetic peptide
  Seed: FTSQFLSL (PRAME_HUMAN)
FASQFLSY

SEQ ID NO: 152876 - protein, 9 aa, Artificial Sequence
  Description of Artificial Sequence: Synthetic peptide
  Seed: ALAIAALEL (PRAME_HUMAN)
AMAIAALEL

SEQ ID NO: 152877 - protein, 10 aa, Artificial Sequence
  Description of Artificial Sequence: Synthetic peptide
  Seed: MLTDVSPEPL (PRAME_HUMAN)
MMTDVSPEPA

SEQ ID NO: 152878 - protein, 9 aa, Artificial Sequence
  Description of Artificial Sequence: Synthetic peptide
  Seed: MNPLETLSI (PRAME_HUMAN)
MYPLETLSL

SEQ ID NO: 152879 - protein, 10 aa, Artificial Sequence
  Description of Artificial Sequence: Synthetic peptide
  Seed: VLYPVPLESY (PRAME_HUMAN)
VSYPVPLESW

SEQ ID NO: 152880 - protein, 10 aa, Artificial Sequence
  Description of Artificial Sequence: Synthetic peptide
  Seed: SPYLGQMINL (PRAME_HUMAN)
SRYLGQMINF

SEQ ID NO: 152881 - protein, 9 aa, Artificial Sequence
  Description of Artificial Sequence: Synthetic peptide
  Seed: YIAQFTSQF (PRAME_HUMAN)
YIAQFTSQL

SEQ ID NO: 152882 - protein, 10 aa, Artificial Sequence
  Description of Artificial Sequence: Synthetic peptide
  Seed: RYISMSVWTS (PRAME_HUMAN)
RSISMSVWTF

SEQ ID NO: 152883 - protein, 9 aa, Artificial Sequence
  Description of Artificial Sequence: Synthetic peptide
  Seed: LSTEAEQPF (PRAME_HUMAN)
LKTEAEQPF

SEQ ID NO: 152884 - protein, 9 aa, Artificial Sequence
  Description of Artificial Sequence: Synthetic peptide
  Seed: LALLPSLSH (PRAME_HUMAN)
LQLLPSLSI

SEQ ID NO: 152885 - protein, 10 aa, Artificial Sequence
  Description of Artificial Sequence: Synthetic peptide
  Seed: MERRRLWGSI (PRAME_HUMAN)
MIRRRLWGSI

SEQ ID NO: 152886 - protein, 10 aa, Artificial Sequence
  Description of Artificial Sequence: Synthetic peptide
  Seed: LKAMVQAWPF (PRAME_HUMAN)
LVAMVQAWPY

SEQ ID NO: 152887 - protein, 9 aa, Artificial Sequence
  Description of Artificial Sequence: Synthetic peptide
  Seed: KFSPYLGQM (PRAME_HUMAN)
KWSPYLGQW

SEQ ID NO: 152888 - protein, 9 aa, Artificial Sequence
  Description of Artificial Sequence: Synthetic peptide
  Seed: KVDGLSTEA (PRAME_HUMAN)
KVDGLSTEL

SEQ ID NO: 152889 - protein, 8 aa, Artificial Sequence
  Description of Artificial Sequence: Synthetic peptide
  Seed: FAMPMQDI (PRAME_HUMAN)
FAMPMQDL

SEQ ID NO: 152890 - protein, 9 aa, Artificial Sequence
  Description of Artificial Sequence: Synthetic peptide
  Seed: ALAIAALEL (PRAME_HUMAN)
AQAIAALEI

SEQ ID NO: 152891 - protein, 9 aa, Artificial Sequence
  Description of Artificial Sequence: Synthetic peptide
  Seed: YSFPEPEAA (PRAME_HUMAN)
YRFPEPEAW

SEQ ID NO: 152892 - protein, 9 aa, Artificial Sequence
  Description of Artificial Sequence: Synthetic peptide
  Seed: SYEDIHGTL (PRAME_HUMAN)
SGEDIHGTL

SEQ ID NO: 152893 - protein, 9 aa, Artificial Sequence
  Description of Artificial Sequence: Synthetic peptide
  Seed: HVMNPLETL (PRAME_HUMAN)
HFMNPLETY

SEQ ID NO: 152894 - protein, 9 aa, Artificial Sequence
  Description of Artificial Sequence: Synthetic peptide
  Seed: SVLSLSGVM (PRAME_HUMAN)
SNLSLSGVY

SEQ ID NO: 152895 - protein, 9 aa, Artificial Sequence
  Description of Artificial Sequence: Synthetic peptide
  Seed: TLAKFSPYL (PRAME_HUMAN)
TYAKFSPYI

SEQ ID NO: 152896 - protein, 9 aa, Artificial Sequence
  Description of Artificial Sequence: Synthetic peptide
  Seed: HARLRELLC (PRAME_HUMAN)
HGRLRELLL

SEQ ID NO: 152897 - protein, 9 aa, Artificial Sequence
  Description of Artificial Sequence: Synthetic peptide
  Seed: LTDVSPEPL (PRAME_HUMAN)
LWDVSPEPI

SEQ ID NO: 152898 - protein, 9 aa, Artificial Sequence
  Description of Artificial Sequence: Synthetic peptide
  Seed: KLKIFAMPM (PRAME_HUMAN)
KIKIFAMPM

SEQ ID NO: 152899 - protein, 9 aa, Artificial Sequence
  Description of Artificial Sequence: Synthetic peptide
  Seed: FAMPMQDIK (PRAME_HUMAN)
FSMPMQDIR

SEQ ID NO: 152900 - protein, 9 aa, Artificial Sequence
  Description of Artificial Sequence: Synthetic peptide
  Seed: LSHIHASSY (PRAME_HUMAN)
LFHIHASSV

SEQ ID NO: 152901 - protein, 10 aa, Artificial Sequence
  Description of Artificial Sequence: Synthetic peptide
  Seed: LTHVLYPVPL (PRAME_HUMAN)
LSHVLYPVPY

SEQ ID NO: 152902 - protein, 11 aa, Artificial Sequence
  Description of Artificial Sequence: Synthetic peptide
  Seed: SIQSRYISMSV (PRAME_HUMAN)
SLQSRYISMSV

SEQ ID NO: 152903 - protein, 10 aa, Artificial Sequence
  Description of Artificial Sequence: Synthetic peptide
  Seed: FIPVEVLVDL (PRAME_HUMAN)
FRPVEVLVDW

SEQ ID NO: 152904 - protein, 9 aa, Artificial Sequence
  Description of Artificial Sequence: Synthetic peptide
  Seed: VQAWPFTCL (PRAME_HUMAN)
VQAWPFTCM

SEQ ID NO: 152905 - protein, 10 aa, Artificial Sequence
  Description of Artificial Sequence: Synthetic peptide
  Seed: LSQSPSVSQL (PRAME_HUMAN)
LFQSPSVSQY

SEQ ID NO: 152906 - protein, 9 aa, Artificial Sequence
  Description of Artificial Sequence: Synthetic peptide
  Seed: LLAQEVRPR (PRAME_HUMAN)
LVAQEVRPR

SEQ ID NO: 152907 - protein, 9 aa, Artificial Sequence
  Description of Artificial Sequence: Synthetic peptide
  Seed: TDDQLLALL (PRAME_HUMAN)
TGDQLLALL

SEQ ID NO: 152908 - protein, 8 aa, Artificial Sequence
  Description of Artificial Sequence: Synthetic peptide
  Seed: LTHVLYPV (PRAME_HUMAN)
LAHVLYPV

SEQ ID NO: 152909 - protein, 10 aa, Artificial Sequence
  Description of Artificial Sequence: Synthetic peptide
  Seed: SISISALQSL (PRAME_HUMAN)
SKSISALQSF

SEQ ID NO: 152910 - protein, 9 aa, Artificial Sequence
  Description of Artificial Sequence: Synthetic peptide
  Seed: LTDVSPEPL (PRAME_HUMAN)
LTDVSPEPV

SEQ ID NO: 152911 - protein, 9 aa, Artificial Sequence
  Description of Artificial Sequence: Synthetic peptide
  Seed: QLLALLPSL (PRAME_HUMAN)
QILALLPSR

SEQ ID NO: 152912 - protein, 10 aa, Artificial Sequence
  Description of Artificial Sequence: Synthetic peptide
  Seed: HASSYISPEK (PRAME_HUMAN)
HWSSYISPER

SEQ ID NO: 152913 - protein, 11 aa, Artificial Sequence
  Description of Artificial Sequence: Synthetic peptide
  Seed: RTFYDPEPILC (PRAME_HUMAN)
RTFYDPEPILW

SEQ ID NO: 152914 - protein, 10 aa, Artificial Sequence
  Description of Artificial Sequence: Synthetic peptide
  Seed: MPMQDIKMIL (PRAME_HUMAN)
MSMQDIKMIL

SEQ ID NO: 152915 - protein, 9 aa, Artificial Sequence
  Description of Artificial Sequence: Synthetic peptide
  Seed: VSQLSVLSL (PRAME_HUMAN)
VPQLSVLSY

SEQ ID NO: 152916 - protein, 10 aa, Artificial Sequence
  Description of Artificial Sequence: Synthetic peptide
  Seed: DVSPEPLQAL (PRAME_HUMAN)
DISPEPLQAF

SEQ ID NO: 152917 - protein, 11 aa, Artificial Sequence
  Description of Artificial Sequence: Synthetic peptide
  Seed: PRELFPPLFMA (PRAME_HUMAN)
PMELFPPLFMV

SEQ ID NO: 152918 - protein, 9 aa, Artificial Sequence
  Description of Artificial Sequence: Synthetic peptide
  Seed: NLTHVLYPV (PRAME_HUMAN)
NSTHVLYPI

SEQ ID NO: 152919 - protein, 9 aa, Artificial Sequence
  Description of Artificial Sequence: Synthetic peptide
  Seed: SHCSQLTTL (PRAME_HUMAN)
SLCSQLTTI

SEQ ID NO: 152920 - protein, 10 aa, Artificial Sequence
  Description of Artificial Sequence: Synthetic peptide
  Seed: HCSQLTTLSF (PRAME_HUMAN)
HASQLTTLSF

SEQ ID NO: 152921 - protein, 9 aa, Artificial Sequence
  Description of Artificial Sequence: Synthetic peptide
  Seed: MQDIKMILK (PRAME_HUMAN)
MMDIKMILK

SEQ ID NO: 152922 - protein, 10 aa, Artificial Sequence
  Description of Artificial Sequence: Synthetic peptide
  Seed: SISISALQSL (PRAME_HUMAN)
STSISALQSW

SEQ ID NO: 152923 - protein, 9 aa, Artificial Sequence
  Description of Artificial Sequence: Synthetic peptide
  Seed: SFYGNSISI (PRAME_HUMAN)
SMYGNSISA

SEQ ID NO: 152924 - protein, 9 aa, Artificial Sequence
  Description of Artificial Sequence: Synthetic peptide
  Seed: LSHIHASSY (PRAME_HUMAN)
LRHIHASSL

SEQ ID NO: 152925 - protein, 10 aa, Artificial Sequence
  Description of Artificial Sequence: Synthetic peptide
  Seed: RYISMSVWTS (PRAME_HUMAN)
RYISMSVWTI

SEQ ID NO: 152926 - protein, 9 aa, Artificial Sequence
  Description of Artificial Sequence: Synthetic peptide
  Seed: KVKRKKNVL (PRAME_HUMAN)
KSKRKKNVK

SEQ ID NO: 152927 - protein, 11 aa, Artificial Sequence
  Description of Artificial Sequence: Synthetic peptide
  Seed: AAFDGRHSQTL (PRAME_HUMAN)
AIFDGRHSQTW

SEQ ID NO: 152928 - protein, 8 aa, Artificial Sequence
  Description of Artificial Sequence: Synthetic peptide
  Seed: SHIHASSY (PRAME_HUMAN)
SMIHASSF

SEQ ID NO: 152929 - protein, 9 aa, Artificial Sequence
  Description of Artificial Sequence: Synthetic peptide
  Seed: FLRGRLDQL (PRAME_HUMAN)
FTRGRLDQV

SEQ ID NO: 152930 - protein, 9 aa, Artificial Sequence
  Description of Artificial Sequence: Synthetic peptide
  Seed: LSLQCLQAL (PRAME_HUMAN)
LALQCLQAY

SEQ ID NO: 152931 - protein, 9 aa, Artificial Sequence
  Description of Artificial Sequence: Synthetic peptide
  Seed: ELFPPLFMA (PRAME_HUMAN)
EAFPPLFMI

SEQ ID NO: 152932 - protein, 9 aa, Artificial Sequence
  Description of Artificial Sequence: Synthetic peptide
  Seed: KAMVQAWPF (PRAME_HUMAN)
KPMVQAWPY

SEQ ID NO: 152933 - protein, 10 aa, Artificial Sequence
  Description of Artificial Sequence: Synthetic peptide
  Seed: LPTLAKFSPY (PRAME_HUMAN)
LYTLAKFSPY

SEQ ID NO: 152934 - protein, 9 aa, Artificial Sequence
  Description of Artificial Sequence: Synthetic peptide
  Seed: THVLYPVPL (PRAME_HUMAN)
TYVLYPVPY

SEQ ID NO: 152935 - protein, 9 aa, Artificial Sequence
  Description of Artificial Sequence: Synthetic peptide
  Seed: YLHARLREL (PRAME_HUMAN)
YGHARLREM

SEQ ID NO: 152936 - protein, 10 aa, Artificial Sequence
  Description of Artificial Sequence: Synthetic peptide
  Seed: SPSVSQLSVL (PRAME_HUMAN)
SDSVSQLSVY

SEQ ID NO: 152937 - protein, 11 aa, Artificial Sequence
  Description of Artificial Sequence: Synthetic peptide
  Seed: HVMNPLETLSI (PRAME_HUMAN)
HQMNPLETLSI

SEQ ID NO: 152938 - protein, 9 aa, Artificial Sequence
  Description of Artificial Sequence: Synthetic peptide
  Seed: KFSPYLGQM (PRAME_HUMAN)
KGSPYLGQY

SEQ ID NO: 152939 - protein, 11 aa, Artificial Sequence
  Description of Artificial Sequence: Synthetic peptide
  Seed: AAFDGRHSQTL (PRAME_HUMAN)
APFDGRHSQTL

SEQ ID NO: 152940 - protein, 10 aa, Artificial Sequence
  Description of Artificial Sequence: Synthetic peptide
  Seed: MVQAWPFTCL (PRAME_HUMAN)
MHQAWPFTCF

SEQ ID NO: 152941 - protein, 11 aa, Artificial Sequence
  Description of Artificial Sequence: Synthetic peptide
  Seed: AAFDGRHSQTL (PRAME_HUMAN)
AVFDGRHSQTR

SEQ ID NO: 152942 - protein, 9 aa, Artificial Sequence
  Description of Artificial Sequence: Synthetic peptide
  Seed: SQSPSVSQL (PRAME_HUMAN)
SASPSVSQA

SEQ ID NO: 152943 - protein, 9 aa, Artificial Sequence
  Description of Artificial Sequence: Synthetic peptide
  Seed: TCTWKLPTL (PRAME_HUMAN)
TSTWKLPTL

SEQ ID NO: 152944 - protein, 9 aa, Artificial Sequence
  Description of Artificial Sequence: Synthetic peptide
  Seed: VELAGQSLL (PRAME_HUMAN)
VQLAGQSLW

SEQ ID NO: 152945 - protein, 9 aa, Artificial Sequence
  Description of Artificial Sequence: Synthetic peptide
  Seed: RLDQLLRHV (PRAME_HUMAN)
RADQLLRHV

SEQ ID NO: 152946 - protein, 9 aa, Artificial Sequence
  Description of Artificial Sequence: Synthetic peptide
  Seed: MHLSQSPSV (PRAME_HUMAN)
MHLSQSPSM

SEQ ID NO: 152947 - protein, 10 aa, Artificial Sequence
  Description of Artificial Sequence: Synthetic peptide
  Seed: RLAYLHARLR (PRAME_HUMAN)
RTAYLHARLK

SEQ ID NO: 152948 - protein, 9 aa, Artificial Sequence
  Description of Artificial Sequence: Synthetic peptide
  Seed: HARLRELLC (PRAME_HUMAN)
HIRLRELLM

SEQ ID NO: 152949 - protein, 10 aa, Artificial Sequence
  Description of Artificial Sequence: Synthetic peptide
  Seed: ALYVDSLFFL (PRAME_HUMAN)
AVYVDSLFFV

SEQ ID NO: 152950 - protein, 9 aa, Artificial Sequence
  Description of Artificial Sequence: Synthetic peptide
  Seed: YIAQFTSQF (PRAME_HUMAN)
YVAQFTSQV

SEQ ID NO: 152951 - protein, 9 aa, Artificial Sequence
  Description of Artificial Sequence: Synthetic peptide
  Seed: LMKGQHLHL (PRAME_HUMAN)
LMKGQHLHR

SEQ ID NO: 152952 - protein, 9 aa, Artificial Sequence
  Description of Artificial Sequence: Synthetic peptide
  Seed: LLLSHIHAS (PRAME_HUMAN)
LSLSHIHAL

SEQ ID NO: 152953 - protein, 9 aa, Artificial Sequence
  Description of Artificial Sequence: Synthetic peptide
  Seed: ISISALQSL (PRAME_HUMAN)
ILISALQSM

SEQ ID NO: 152954 - protein, 11 aa, Artificial Sequence
  Description of Artificial Sequence: Synthetic peptide
  Seed: QALYVDSLFFL (PRAME_HUMAN)
QPLYVDSLFFF

SEQ ID NO: 152955 - protein, 9 aa, Artificial Sequence
  Description of Artificial Sequence: Synthetic peptide
  Seed: SVLSLSGVM (PRAME_HUMAN)
SQLSLSGVY

SEQ ID NO: 152956 - protein, 9 aa, Artificial Sequence
  Description of Artificial Sequence: Synthetic peptide
  Seed: LSTEAEQPF (PRAME_HUMAN)
LATEAEQPF

SEQ ID NO: 152957 - protein, 9 aa, Artificial Sequence
  Description of Artificial Sequence: Synthetic peptide
  Seed: LHLERLAYL (PRAME_HUMAN)
LYLERLAYL

SEQ ID NO: 152958 - protein, 9 aa, Artificial Sequence
  Description of Artificial Sequence: Synthetic peptide
  Seed: DEALAIAAL (PRAME_HUMAN)
DEALAIAAW

SEQ ID NO: 152959 - protein, 9 aa, Artificial Sequence
  Description of Artificial Sequence: Synthetic peptide
  Seed: LLKDEALAI (PRAME_HUMAN)
LAKDEALAM

SEQ ID NO: 152960 - protein, 10 aa, Artificial Sequence
  Description of Artificial Sequence: Synthetic peptide
  Seed: AVLDGLDVLL (PRAME_HUMAN)
ALLDGLDVLV

SEQ ID NO: 152961 - protein, 9 aa, Artificial Sequence
  Description of Artificial Sequence: Synthetic peptide
  Seed: IAQFTSQFL (PRAME_HUMAN)
IAQFTSQFM

SEQ ID NO: 152962 - protein, 9 aa, Artificial Sequence
  Description of Artificial Sequence: Synthetic peptide
  Seed: MPMQDIKMI (PRAME_HUMAN)
MVMQDIKMY

SEQ ID NO: 152963 - protein, 9 aa, Artificial Sequence
  Description of Artificial Sequence: Synthetic peptide
  Seed: YGNSISISA (PRAME_HUMAN)
YSNSISISL

SEQ ID NO: 152964 - protein, 9 aa, Artificial Sequence
  Description of Artificial Sequence: Synthetic peptide
  Seed: TLKAMVQAW (PRAME_HUMAN)
TMKAMVQAM

SEQ ID NO: 152965 - protein, 9 aa, Artificial Sequence
  Description of Artificial Sequence: Synthetic peptide
  Seed: GQHLHLETF (PRAME_HUMAN)
GEHLHLETM

SEQ ID NO: 152966 - protein, 9 aa, Artificial Sequence
  Description of Artificial Sequence: Synthetic peptide
  Seed: LVELAGQSL (PRAME_HUMAN)
LPELAGQSM

SEQ ID NO: 152967 - protein, 9 aa, Artificial Sequence
  Description of Artificial Sequence: Synthetic peptide
  Seed: RGRLDQLLR (PRAME_HUMAN)
RFRLDQLLA

SEQ ID NO: 152968 - protein, 9 aa, Artificial Sequence
  Description of Artificial Sequence: Synthetic peptide
  Seed: RGRLDQLLR (PRAME_HUMAN)
RVRLDQLLI

SEQ ID NO: 152969 - protein, 9 aa, Artificial Sequence
  Description of Artificial Sequence: Synthetic peptide
  Seed: LQDLVFDEC (PRAME_HUMAN)
LEDLVFDEA

SEQ ID NO: 152970 - protein, 9 aa, Artificial Sequence
  Description of Artificial Sequence: Synthetic peptide
  Seed: YLIEKVKRK (PRAME_HUMAN)
YLIEKVKRY

SEQ ID NO: 152971 - protein, 10 aa, Artificial Sequence
  Description of Artificial Sequence: Synthetic peptide
  Seed: RELFPPLFMA (PRAME_HUMAN)
RKLFPPLFML

SEQ ID NO: 152972 - protein, 9 aa, Artificial Sequence
  Description of Artificial Sequence: Synthetic peptide
  Seed: RGRLDQLLR (PRAME_HUMAN)
RFRLDQLLK

SEQ ID NO: 152973 - protein, 9 aa, Artificial Sequence
  Description of Artificial Sequence: Synthetic peptide
  Seed: RASATLQDL (PRAME_HUMAN)
RTSATLQDF

SEQ ID NO: 152974 - protein, 9 aa, Artificial Sequence
  Description of Artificial Sequence: Synthetic peptide
  Seed: TCLPLGVLM (PRAME_HUMAN)
TMLPLGVLW

SEQ ID NO: 152975 - protein, 11 aa, Artificial Sequence
  Description of Artificial Sequence: Synthetic peptide
  Seed: EQYIAQFTSQF (PRAME_HUMAN)
ERYIAQFTSQF

SEQ ID NO: 152976 - protein, 11 aa, Artificial Sequence
  Description of Artificial Sequence: Synthetic peptide
  Seed: LPTLAKFSPYL (PRAME_HUMAN)
LTTLAKFSPYV

SEQ ID NO: 152977 - protein, 9 aa, Artificial Sequence
  Description of Artificial Sequence: Synthetic peptide
  Seed: RTFYDPEPI (PRAME_HUMAN)
RTFYDPEPM

SEQ ID NO: 152978 - protein, 10 aa, Artificial Sequence
  Description of Artificial Sequence: Synthetic peptide
  Seed: KDEALAIAAL (PRAME_HUMAN)
KCEALAIAAL

SEQ ID NO: 152979 - protein, 10 aa, Artificial Sequence
  Description of Artificial Sequence: Synthetic peptide
  Seed: LLPRELFPPL (PRAME_HUMAN)
LDPRELFPPF

SEQ ID NO: 152980 - protein, 10 aa, Artificial Sequence
  Description of Artificial Sequence: Synthetic peptide
  Seed: RRWKLQVLDL (PRAME_HUMAN)
RRWKLQVLDQ

SEQ ID NO: 152981 - protein, 10 aa, Artificial Sequence
  Description of Artificial Sequence: Synthetic peptide
  Seed: SGNRASLYSF (PRAME_HUMAN)
SHNRASLYSY

SEQ ID NO: 152982 - protein, 9 aa, Artificial Sequence
  Description of Artificial Sequence: Synthetic peptide
  Seed: ISISALQSL (PRAME_HUMAN)
IYISALQSM

SEQ ID NO: 152983 - protein, 10 aa, Artificial Sequence
  Description of Artificial Sequence: Synthetic peptide
  Seed: QLLRHVMNPL (PRAME_HUMAN)
QVLRHVMNPV

SEQ ID NO: 152984 - protein, 10 aa, Artificial Sequence
  Description of Artificial Sequence: Synthetic peptide
  Seed: SISISALQSL (PRAME_HUMAN)
SQSISALQSW

SEQ ID NO: 152985 - protein, 10 aa, Artificial Sequence
  Description of Artificial Sequence: Synthetic peptide
  Seed: HCSQLTTLSF (PRAME_HUMAN)
HKSQLTTLSF

SEQ ID NO: 152986 - protein, 10 aa, Artificial Sequence
  Description of Artificial Sequence: Synthetic peptide
  Seed: ALAIAALELL (PRAME_HUMAN)
ALAIAALELA

SEQ ID NO: 152987 - protein, 9 aa, Artificial Sequence
  Description of Artificial Sequence: Synthetic peptide
  Seed: QFTSQFLSL (PRAME_HUMAN)
QYTSQFLSM

SEQ ID NO: 152988 - protein, 9 aa, Artificial Sequence
  Description of Artificial Sequence: Synthetic peptide
  Seed: RLRELLCEL (PRAME_HUMAN)
RTRELLCEV

SEQ ID NO: 152989 - protein, 9 aa, Artificial Sequence
  Description of Artificial Sequence: Synthetic peptide
  Seed: KVDGLSTEA (PRAME_HUMAN)
KFDGLSTEL

SEQ ID NO: 152990 - protein, 10 aa, Artificial Sequence
  Description of Artificial Sequence: Synthetic peptide
  Seed: ISISALQSLL (PRAME_HUMAN)
IRISALQSLW

SEQ ID NO: 152991 - protein, 9 aa, Artificial Sequence
  Description of Artificial Sequence: Synthetic peptide
  Seed: GQHLHLETF (PRAME_HUMAN)
GAHLHLETV

SEQ ID NO: 152992 - protein, 9 aa, Artificial Sequence
  Description of Artificial Sequence: Synthetic peptide
  Seed: KLKIFAMPM (PRAME_HUMAN)
KGKIFAMPI

SEQ ID NO: 152993 - protein, 10 aa, Artificial Sequence
  Description of Artificial Sequence: Synthetic peptide
  Seed: PTLAKFSPYL (PRAME_HUMAN)
PLLAKFSPYL

SEQ ID NO: 152994 - protein, 9 aa, Artificial Sequence
  Description of Artificial Sequence: Synthetic peptide
  Seed: VLDGLDVLL (PRAME_HUMAN)
VWDGLDVLV

SEQ ID NO: 152995 - protein, 11 aa, Artificial Sequence
  Description of Artificial Sequence: Synthetic peptide
  Seed: SLLKDEALAIA (PRAME_HUMAN)
SMLKDEALAIV

SEQ ID NO: 152996 - protein, 11 aa, Artificial Sequence
  Description of Artificial Sequence: Synthetic peptide
  Seed: AAFDGRHSQTL (PRAME_HUMAN)
AQFDGRHSQTY

SEQ ID NO: 152997 - protein, 9 aa, Artificial Sequence
  Description of Artificial Sequence: Synthetic peptide
  Seed: RPSMVWLSA (PRAME_HUMAN)
RPSMVWLSV

SEQ ID NO: 152998 - protein, 9 aa, Artificial Sequence
  Description of Artificial Sequence: Synthetic peptide
  Seed: SHIHASSYI (PRAME_HUMAN)
SYIHASSYA

SEQ ID NO: 152999 - protein, 10 aa, Artificial Sequence
  Description of Artificial Sequence: Synthetic peptide
  Seed: RRRLWGSIQS (PRAME_HUMAN)
RSRLWGSIQK

SEQ ID NO: 153000 - protein, 11 aa, Artificial Sequence
  Description of Artificial Sequence: Synthetic peptide
  Seed: LPTLAKFSPYL (PRAME_HUMAN)
LRTLAKFSPYV

SEQ ID NO: 153001 - protein, 9 aa, Artificial Sequence
  Description of Artificial Sequence: Synthetic peptide
  Seed: ALLPSLSHC (PRAME_HUMAN)
ALLPSLSHA

SEQ ID NO: 153002 - protein, 10 aa, Artificial Sequence
  Description of Artificial Sequence: Synthetic peptide
  Seed: LSQSPSVSQL (PRAME_HUMAN)
LFQSPSVSQF

SEQ ID NO: 153003 - protein, 9 aa, Artificial Sequence
  Description of Artificial Sequence: Synthetic peptide
  Seed: YSFPEPEAA (PRAME_HUMAN)
YQFPEPEAY

SEQ ID NO: 153004 - protein, 10 aa, Artificial Sequence
  Description of Artificial Sequence: Synthetic peptide
  Seed: AYLHARLREL (PRAME_HUMAN)
ALLHARLREV

SEQ ID NO: 153005 - protein, 9 aa, Artificial Sequence
  Description of Artificial Sequence: Synthetic peptide
  Seed: AAFDGRHSQ (PRAME_HUMAN)
ATFDGRHSM

SEQ ID NO: 153006 - protein, 9 aa, Artificial Sequence
  Description of Artificial Sequence: Synthetic peptide
  Seed: MINLRRLLL (PRAME_HUMAN)
MLNLRRLLW

SEQ ID NO: 153007 - protein, 9 aa, Artificial Sequence
  Description of Artificial Sequence: Synthetic peptide
  Seed: ACDELFSYL (PRAME_HUMAN)
AGDELFSYI

SEQ ID NO: 153008 - protein, 10 aa, Artificial Sequence
  Description of Artificial Sequence: Synthetic peptide
  Seed: KVKRKKNVLR (PRAME_HUMAN)
KMKRKKNVLK

SEQ ID NO: 153009 - protein, 9 aa, Artificial Sequence
  Description of Artificial Sequence: Synthetic peptide
  Seed: SQFLSLQCL (PRAME_HUMAN)
SQFLSLQCW

SEQ ID NO: 153010 - protein, 9 aa, Artificial Sequence
  Description of Artificial Sequence: Synthetic peptide
  Seed: MQDIKMILK (PRAME_HUMAN)
MADIKMILM

SEQ ID NO: 153011 - protein, 10 aa, Artificial Sequence
  Description of Artificial Sequence: Synthetic peptide
  Seed: SPSVSQLSVL (PRAME_HUMAN)
SVSVSQLSVF

SEQ ID NO: 153012 - protein, 10 aa, Artificial Sequence
  Description of Artificial Sequence: Synthetic peptide
  Seed: SVLSLSGVML (PRAME_HUMAN)
SLLSLSGVMV

SEQ ID NO: 153013 - protein, 9 aa, Artificial Sequence
  Description of Artificial Sequence: Synthetic peptide
  Seed: SQLSVLSLS (PRAME_HUMAN)
SILSVLSLI

SEQ ID NO: 153014 - protein, 9 aa, Artificial Sequence
  Description of Artificial Sequence: Synthetic peptide
  Seed: ALQSLLQHL (PRAME_HUMAN)
AVQSLLQHY

SEQ ID NO: 153015 - protein, 8 aa, Artificial Sequence
  Description of Artificial Sequence: Synthetic peptide
  Seed: MSVWTSPR (PRAME_HUMAN)
MTVWTSPK

SEQ ID NO: 153016 - protein, 8 aa, Artificial Sequence
  Description of Artificial Sequence: Synthetic peptide
  Seed: FYDPEPIL (PRAME_HUMAN)
FQDPEPIM

SEQ ID NO: 153017 - protein, 10 aa, Artificial Sequence
  Description of Artificial Sequence: Synthetic peptide
  Seed: LSLQCLQALY (PRAME_HUMAN)
LSLQCLQALF

SEQ ID NO: 153018 - protein, 10 aa, Artificial Sequence
  Description of Artificial Sequence: Synthetic peptide
  Seed: LFPPLFMAAF (PRAME_HUMAN)
LWPPLFMAAI

SEQ ID NO: 153019 - protein, 9 aa, Artificial Sequence
  Description of Artificial Sequence: Synthetic peptide
  Seed: SLLQHLIGL (PRAME_HUMAN)
SSLQHLIGF

SEQ ID NO: 153020 - protein, 8 aa, Artificial Sequence
  Description of Artificial Sequence: Synthetic peptide
  Seed: SQLTTLSF (PRAME_HUMAN)
SQLTTLSY

SEQ ID NO: 153021 - protein, 10 aa, Artificial Sequence
  Description of Artificial Sequence: Synthetic peptide
  Seed: GQSLLKDEAL (PRAME_HUMAN)
GESLLKDEAI

SEQ ID NO: 153022 - protein, 10 aa, Artificial Sequence
  Description of Artificial Sequence: Synthetic peptide
  Seed: RGRLDQLLRH (PRAME_HUMAN)
RRRLDQLLRR

SEQ ID NO: 153023 - protein, 10 aa, Artificial Sequence
  Description of Artificial Sequence: Synthetic peptide
  Seed: GRHSQTLKAM (PRAME_HUMAN)
GRHSQTLKAF

SEQ ID NO: 153024 - protein, 9 aa, Artificial Sequence
  Description of Artificial Sequence: Synthetic peptide
  Seed: KAMVQAWPF (PRAME_HUMAN)
KHMVQAWPY

SEQ ID NO: 153025 - protein, 10 aa, Artificial Sequence
  Description of Artificial Sequence: Synthetic peptide
  Seed: RLDQLLRHVM (PRAME_HUMAN)
RQDQLLRHVM

SEQ ID NO: 153026 - protein, 10 aa, Artificial Sequence
  Description of Artificial Sequence: Synthetic peptide
  Seed: RGRLDQLLRH (PRAME_HUMAN)
RVRLDQLLRK

SEQ ID NO: 153027 - protein, 9 aa, Artificial Sequence
  Description of Artificial Sequence: Synthetic peptide
  Seed: SPSVSQLSV (PRAME_HUMAN)
SPSVSQLSM

SEQ ID NO: 153028 - protein, 9 aa, Artificial Sequence
  Description of Artificial Sequence: Synthetic peptide
  Seed: KVDGLSTEA (PRAME_HUMAN)
KADGLSTEV

SEQ ID NO: 153029 - protein, 9 aa, Artificial Sequence
  Description of Artificial Sequence: Synthetic peptide
  Seed: YSFPEPEAA (PRAME_HUMAN)
YAFPEPEAH

SEQ ID NO: 153030 - protein, 9 aa, Artificial Sequence
  Description of Artificial Sequence: Synthetic peptide
  Seed: SFYGNSISI (PRAME_HUMAN)
SQYGNSISL

SEQ ID NO: 153031 - protein, 10 aa, Artificial Sequence
  Description of Artificial Sequence: Synthetic peptide
  Seed: RLSEGDVMHL (PRAME_HUMAN)
RVSEGDVMHK

SEQ ID NO: 153032 - protein, 9 aa, Artificial Sequence
  Description of Artificial Sequence: Synthetic peptide
  Seed: LFPPLFMAA (PRAME_HUMAN)
LFPPLFMAM

SEQ ID NO: 153033 - protein, 10 aa, Artificial Sequence
  Description of Artificial Sequence: Synthetic peptide
  Seed: AKFSPYLGQM (PRAME_HUMAN)
AQFSPYLGQM

SEQ ID NO: 153034 - protein, 9 aa, Artificial Sequence
  Description of Artificial Sequence: Synthetic peptide
  Seed: LAYLHARLR (PRAME_HUMAN)
LYYLHARLR

SEQ ID NO: 153035 - protein, 10 aa, Artificial Sequence
  Description of Artificial Sequence: Synthetic peptide
  Seed: LLSHIHASSY (PRAME_HUMAN)
LSSHIHASSF

SEQ ID NO: 153036 - protein, 10 aa, Artificial Sequence
  Description of Artificial Sequence: Synthetic peptide
  Seed: RELFPPLFMA (PRAME_HUMAN)
RFLFPPLFMM

SEQ ID NO: 153037 - protein, 10 aa, Artificial Sequence
  Description of Artificial Sequence: Synthetic peptide
  Seed: RGRLDQLLRH (PRAME_HUMAN)
RPRLDQLLRI

SEQ ID NO: 153038 - protein, 9 aa, Artificial Sequence
  Description of Artificial Sequence: Synthetic peptide
  Seed: AAQPMTKKR (PRAME_HUMAN)
ATQPMTKKK

SEQ ID NO: 153039 - protein, 10 aa, Artificial Sequence
  Description of Artificial Sequence: Synthetic peptide
  Seed: FYDPEPILCP (PRAME_HUMAN)
FIDPEPILCL

SEQ ID NO: 153040 - protein, 9 aa, Artificial Sequence
  Description of Artificial Sequence: Synthetic peptide
  Seed: SQSPSVSQL (PRAME_HUMAN)
SYSPSVSQY

SEQ ID NO: 153041 - protein, 10 aa, Artificial Sequence
  Description of Artificial Sequence: Synthetic peptide
  Seed: FFLRGRLDQL (PRAME_HUMAN)
FKLRGRLDQA

SEQ ID NO: 153042 - protein, 9 aa, Artificial Sequence
  Description of Artificial Sequence: Synthetic peptide
  Seed: LQSLLQHLI (PRAME_HUMAN)
LISLLQHLV

SEQ ID NO: 153043 - protein, 8 aa, Artificial Sequence
  Description of Artificial Sequence: Synthetic peptide
  Seed: FYDPEPIL (PRAME_HUMAN)
FCDPEPIL

SEQ ID NO: 153044 - protein, 9 aa, Artificial Sequence
  Description of Artificial Sequence: Synthetic peptide
  Seed: RLWGSIQSR (PRAME_HUMAN)
RTWGSIQSF

SEQ ID NO: 153045 - protein, 9 aa, Artificial Sequence
  Description of Artificial Sequence: Synthetic peptide
  Seed: SIQSRYISM (PRAME_HUMAN)
SLQSRYISY

SEQ ID NO: 153046 - protein, 9 aa, Artificial Sequence
  Description of Artificial Sequence: Synthetic peptide
  Seed: VLDGLDVLL (PRAME_HUMAN)
VGDGLDVLM

SEQ ID NO: 153047 - protein, 10 aa, Artificial Sequence
  Description of Artificial Sequence: Synthetic peptide
  Seed: DIHGTLHLER (PRAME_HUMAN)
DTHGTLHLER

SEQ ID NO: 153048 - protein, 9 aa, Artificial Sequence
  Description of Artificial Sequence: Synthetic peptide
  Seed: ISISALQSL (PRAME_HUMAN)
IIISALQSW

SEQ ID NO: 153049 - protein, 10 aa, Artificial Sequence
  Description of Artificial Sequence: Synthetic peptide
  Seed: ITDDQLLALL (PRAME_HUMAN)
IFDDQLLALI

SEQ ID NO: 153050 - protein, 9 aa, Artificial Sequence
  Description of Artificial Sequence: Synthetic peptide
  Seed: ALQSLLQHL (PRAME_HUMAN)
ALQSLLQHM

SEQ ID NO: 153051 - protein, 9 aa, Artificial Sequence
  Description of Artificial Sequence: Synthetic peptide
  Seed: FYDPEPILC (PRAME_HUMAN)
FIDPEPILC

SEQ ID NO: 153052 - protein, 9 aa, Artificial Sequence
  Description of Artificial Sequence: Synthetic peptide
  Seed: TWKLPTLAK (PRAME_HUMAN)
TNKLPTLAR

SEQ ID NO: 153053 - protein, 9 aa, Artificial Sequence
  Description of Artificial Sequence: Synthetic peptide
  Seed: RGRLDQLLR (PRAME_HUMAN)
RNRLDQLLK

SEQ ID NO: 153054 - protein, 10 aa, Artificial Sequence
  Description of Artificial Sequence: Synthetic peptide
  Seed: IEDLEVTCTW (PRAME_HUMAN)
ITDLEVTCTW

SEQ ID NO: 153055 - protein, 9 aa, Artificial Sequence
  Description of Artificial Sequence: Synthetic peptide
  Seed: LYVDSLFFL (PRAME_HUMAN)
LIVDSLFFA

SEQ ID NO: 153056 - protein, 9 aa, Artificial Sequence
  Description of Artificial Sequence: Synthetic peptide
  Seed: RLAYLHARL (PRAME_HUMAN)
RTAYLHARR

SEQ ID NO: 153057 - protein, 10 aa, Artificial Sequence
  Description of Artificial Sequence: Synthetic peptide
  Seed: PTLAKFSPYL (PRAME_HUMAN)
PMLAKFSPYV

SEQ ID NO: 153058 - protein, 9 aa, Artificial Sequence
  Description of Artificial Sequence: Synthetic peptide
  Seed: RLRELLCEL (PRAME_HUMAN)
RTRELLCEF

SEQ ID NO: 153059 - protein, 9 aa, Artificial Sequence
  Description of Artificial Sequence: Synthetic peptide
  Seed: SFYGNSISI (PRAME_HUMAN)
SIYGNSISF

SEQ ID NO: 153060 - protein, 10 aa, Artificial Sequence
  Description of Artificial Sequence: Synthetic peptide
  Seed: SNLTHVLYPV (PRAME_HUMAN)
SMLTHVLYPM

SEQ ID NO: 153061 - protein, 10 aa, Artificial Sequence
  Description of Artificial Sequence: Synthetic peptide
  Seed: SPSVSQLSVL (PRAME_HUMAN)
SPSVSQLSVM

SEQ ID NO: 153062 - protein, 9 aa, Artificial Sequence
  Description of Artificial Sequence: Synthetic peptide
  Seed: YSFPEPEAA (PRAME_HUMAN)
YTFPEPEAL

SEQ ID NO: 153063 - protein, 10 aa, Artificial Sequence
  Description of Artificial Sequence: Synthetic peptide
  Seed: YEDIHGTLHL (PRAME_HUMAN)
YYDIHGTLHL

SEQ ID NO: 153064 - protein, 10 aa, Artificial Sequence
  Description of Artificial Sequence: Synthetic peptide
  Seed: SISISALQSL (PRAME_HUMAN)
SLSISALQSA

SEQ ID NO: 153065 - protein, 10 aa, Artificial Sequence
  Description of Artificial Sequence: Synthetic peptide
  Seed: MINLRRLLLS (PRAME_HUMAN)
MPNLRRLLLL

SEQ ID NO: 153066 - protein, 9 aa, Artificial Sequence
  Description of Artificial Sequence: Synthetic peptide
  Seed: SYEDIHGTL (PRAME_HUMAN)
SYEDIHGTW

SEQ ID NO: 153067 - protein, 9 aa, Artificial Sequence
  Description of Artificial Sequence: Synthetic peptide
  Seed: LSHIHASSY (PRAME_HUMAN)
LQHIHASSV

SEQ ID NO: 153068 - protein, 9 aa, Artificial Sequence
  Description of Artificial Sequence: Synthetic peptide
  Seed: LYVDSLFFL (PRAME_HUMAN)
LLVDSLFFV

SEQ ID NO: 153069 - protein, 9 aa, Artificial Sequence
  Description of Artificial Sequence: Synthetic peptide
  Seed: YSFPEPEAA (PRAME_HUMAN)
YHFPEPEAI

SEQ ID NO: 153070 - protein, 10 aa, Artificial Sequence
  Description of Artificial Sequence: Synthetic peptide
  Seed: TFYDPEPILC (PRAME_HUMAN)
THYDPEPILY

SEQ ID NO: 153071 - protein, 9 aa, Artificial Sequence
  Description of Artificial Sequence: Synthetic peptide
  Seed: HVMNPLETL (PRAME_HUMAN)
HQMNPLETV

SEQ ID NO: 153072 - protein, 10 aa, Artificial Sequence
  Description of Artificial Sequence: Synthetic peptide
  Seed: FIPVEVLVDL (PRAME_HUMAN)
FHPVEVLVDM

SEQ ID NO: 153073 - protein, 10 aa, Artificial Sequence
  Description of Artificial Sequence: Synthetic peptide
  Seed: AFDGRHSQTL (PRAME_HUMAN)
AADGRHSQTV

SEQ ID NO: 153074 - protein, 8 aa, Artificial Sequence
  Description of Artificial Sequence: Synthetic peptide
  Seed: TDDQLLAL (PRAME_HUMAN)
TSDQLLAI

SEQ ID NO: 153075 - protein, 9 aa, Artificial Sequence
  Description of Artificial Sequence: Synthetic peptide
  Seed: LQSLLQHLI (PRAME_HUMAN)
LLSLLQHLV

SEQ ID NO: 153076 - protein, 10 aa, Artificial Sequence
  Description of Artificial Sequence: Synthetic peptide
  Seed: EALAIAALEL (PRAME_HUMAN)
ETLAIAALEL

SEQ ID NO: 153077 - protein, 9 aa, Artificial Sequence
  Description of Artificial Sequence: Synthetic peptide
  Seed: RLRELLCEL (PRAME_HUMAN)
RQRELLCEI

SEQ ID NO: 153078 - protein, 9 aa, Artificial Sequence
  Description of Artificial Sequence: Synthetic peptide
  Seed: SHQDFWTVW (PRAME_HUMAN)
SYQDFWTVL

SEQ ID NO: 153079 - protein, 9 aa, Artificial Sequence
  Description of Artificial Sequence: Synthetic peptide
  Seed: RLRELLCEL (PRAME_HUMAN)
RGRELLCEW

SEQ ID NO: 153080 - protein, 10 aa, Artificial Sequence
  Description of Artificial Sequence: Synthetic peptide
  Seed: LSHIHASSYI (PRAME_HUMAN)
LTHIHASSYV

SEQ ID NO: 153081 - protein, 9 aa, Artificial Sequence
  Description of Artificial Sequence: Synthetic peptide
  Seed: VFDECGITD (PRAME_HUMAN)
VWDECGITA

SEQ ID NO: 153082 - protein, 10 aa, Artificial Sequence
  Description of Artificial Sequence: Synthetic peptide
  Seed: ALAIAALELL (PRAME_HUMAN)
AQAIAALELL

SEQ ID NO: 153083 - protein, 9 aa, Artificial Sequence
  Description of Artificial Sequence: Synthetic peptide
  Seed: YGNSISISA (PRAME_HUMAN)
YRNSISISI

SEQ ID NO: 153084 - protein, 10 aa, Artificial Sequence
  Description of Artificial Sequence: Synthetic peptide
  Seed: TLQDLVFDEC (PRAME_HUMAN)
TLQDLVFDEA

SEQ ID NO: 153085 - protein, 9 aa, Artificial Sequence
  Description of Artificial Sequence: Synthetic peptide
  Seed: TSPRRLVEL (PRAME_HUMAN)
TSPRRLVEY

SEQ ID NO: 153086 - protein, 10 aa, Artificial Sequence
  Description of Artificial Sequence: Synthetic peptide
  Seed: ARLRELLCEL (PRAME_HUMAN)
AGLRELLCEA

SEQ ID NO: 153087 - protein, 10 aa, Artificial Sequence
  Description of Artificial Sequence: Synthetic peptide
  Seed: RHVMNPLETL (PRAME_HUMAN)
REVMNPLETF

SEQ ID NO: 153088 - protein, 10 aa, Artificial Sequence
  Description of Artificial Sequence: Synthetic peptide
  Seed: RHVMNPLETL (PRAME_HUMAN)
RKVMNPLETW

SEQ ID NO: 153089 - protein, 9 aa, Artificial Sequence
  Description of Artificial Sequence: Synthetic peptide
  Seed: WLSANPCPH (PRAME_HUMAN)
WQSANPCPY

SEQ ID NO: 153090 - protein, 10 aa, Artificial Sequence
  Description of Artificial Sequence: Synthetic peptide
  Seed: ELFPPLFMAA (PRAME_HUMAN)
ETFPPLFMAA

SEQ ID NO: 153091 - protein, 9 aa, Artificial Sequence
  Description of Artificial Sequence: Synthetic peptide
  Seed: SIQSRYISM (PRAME_HUMAN)
SFQSRYISI

SEQ ID NO: 153092 - protein, 11 aa, Artificial Sequence
  Description of Artificial Sequence: Synthetic peptide
  Seed: QALYVDSLFFL (PRAME_HUMAN)
QKLYVDSLFFI

SEQ ID NO: 153093 - protein, 9 aa, Artificial Sequence
  Description of Artificial Sequence: Synthetic peptide
  Seed: ALQSLLQHL (PRAME_HUMAN)
ATQSLLQHY

SEQ ID NO: 153094 - protein, 10 aa, Artificial Sequence
  Description of Artificial Sequence: Synthetic peptide
  Seed: LSHCSQLTTL (PRAME_HUMAN)
LAHCSQLTTY

SEQ ID NO: 153095 - protein, 9 aa, Artificial Sequence
  Description of Artificial Sequence: Synthetic peptide
  Seed: RLAYLHARL (PRAME_HUMAN)
RQAYLHARF

SEQ ID NO: 153096 - protein, 10 aa, Artificial Sequence
  Description of Artificial Sequence: Synthetic peptide
  Seed: RGRLDQLLRH (PRAME_HUMAN)
RPRLDQLLRF

SEQ ID NO: 153097 - protein, 10 aa, Artificial Sequence
  Description of Artificial Sequence: Synthetic peptide
  Seed: SISISALQSL (PRAME_HUMAN)
SLSISALQSV

SEQ ID NO: 153098 - protein, 11 aa, Artificial Sequence
  Description of Artificial Sequence: Synthetic peptide
  Seed: RELFPPLFMAA (PRAME_HUMAN)
RFLFPPLFMAI

SEQ ID NO: 153099 - protein, 10 aa, Artificial Sequence
  Description of Artificial Sequence: Synthetic peptide
  Seed: SMVWLSANPC (PRAME_HUMAN)
SLVWLSANPV

SEQ ID NO: 153100 - protein, 9 aa, Artificial Sequence
  Description of Artificial Sequence: Synthetic peptide
  Seed: FLRGRLDQL (PRAME_HUMAN)
FIRGRLDQY

SEQ ID NO: 153101 - protein, 9 aa, Artificial Sequence
  Description of Artificial Sequence: Synthetic peptide
  Seed: VSPEPLQAL (PRAME_HUMAN)
VVPEPLQAR

SEQ ID NO: 153102 - protein, 10 aa, Artificial Sequence
  Description of Artificial Sequence: Synthetic peptide
  Seed: FLKEGACDEL (PRAME_HUMAN)
FMKEGACDEL

SEQ ID NO: 153103 - protein, 9 aa, Artificial Sequence
  Description of Artificial Sequence: Synthetic peptide
  Seed: SVLSLSGVM (PRAME_HUMAN)
STLSLSGVL

SEQ ID NO: 153104 - protein, 10 aa, Artificial Sequence
  Description of Artificial Sequence: Synthetic peptide
  Seed: RPSMVWLSAN (PRAME_HUMAN)
RPSMVWLSAL

SEQ ID NO: 153105 - protein, 11 aa, Artificial Sequence
  Description of Artificial Sequence: Synthetic peptide
  Seed: FLSLQCLQALY (PRAME_HUMAN)
FQSLQCLQALV

SEQ ID NO: 153106 - protein, 10 aa, Artificial Sequence
  Description of Artificial Sequence: Synthetic peptide
  Seed: QAWPFTCLPL (PRAME_HUMAN)
QLWPFTCLPV

SEQ ID NO: 153107 - protein, 10 aa, Artificial Sequence
  Description of Artificial Sequence: Synthetic peptide
  Seed: DVSPEPLQAL (PRAME_HUMAN)
DISPEPLQAY

SEQ ID NO: 153108 - protein, 9 aa, Artificial Sequence
  Description of Artificial Sequence: Synthetic peptide
  Seed: TDDQLLALL (PRAME_HUMAN)
TIDQLLALM

SEQ ID NO: 153109 - protein, 10 aa, Artificial Sequence
  Description of Artificial Sequence: Synthetic peptide
  Seed: FLKEGACDEL (PRAME_HUMAN)
FMKEGACDEI

SEQ ID NO: 153110 - protein, 10 aa, Artificial Sequence
  Description of Artificial Sequence: Synthetic peptide
  Seed: YGNSISISAL (PRAME_HUMAN)
YANSISISAM

SEQ ID NO: 153111 - protein, 10 aa, Artificial Sequence
  Description of Artificial Sequence: Synthetic peptide
  Seed: LQHLIGLSNL (PRAME_HUMAN)
LQHLIGLSNY

SEQ ID NO: 153112 - protein, 10 aa, Artificial Sequence
  Description of Artificial Sequence: Synthetic peptide
  Seed: MVQAWPFTCL (PRAME_HUMAN)
MCQAWPFTCY

SEQ ID NO: 153113 - protein, 9 aa, Artificial Sequence
  Description of Artificial Sequence: Synthetic peptide
  Seed: RTFYDPEPI (PRAME_HUMAN)
RQFYDPEPA

SEQ ID NO: 153114 - protein, 10 aa, Artificial Sequence
  Description of Artificial Sequence: Synthetic peptide
  Seed: SPSVSQLSVL (PRAME_HUMAN)
SFSVSQLSVW

SEQ ID NO: 153115 - protein, 9 aa, Artificial Sequence
  Description of Artificial Sequence: Synthetic peptide
  Seed: SQFLSLQCL (PRAME_HUMAN)
SAFLSLQCY

SEQ ID NO: 153116 - protein, 11 aa, Artificial Sequence
  Description of Artificial Sequence: Synthetic peptide
  Seed: SIQSRYISMSV (PRAME_HUMAN)
SYQSRYISMSK

SEQ ID NO: 153117 - protein, 10 aa, Artificial Sequence
  Description of Artificial Sequence: Synthetic peptide
  Seed: TLAKFSPYLG (PRAME_HUMAN)
TMAKFSPYLL

SEQ ID NO: 153118 - protein, 9 aa, Artificial Sequence
  Description of Artificial Sequence: Synthetic peptide
  Seed: AAFDGRHSQ (PRAME_HUMAN)
AQFDGRHSF

SEQ ID NO: 153119 - protein, 9 aa, Artificial Sequence
  Description of Artificial Sequence: Synthetic peptide
  Seed: VFDECGITD (PRAME_HUMAN)
VVDECGITL

SEQ ID NO: 153120 - protein, 10 aa, Artificial Sequence
  Description of Artificial Sequence: Synthetic peptide
  Seed: GACDELFSYL (PRAME_HUMAN)
GACDELFSYW

SEQ ID NO: 153121 - protein, 11 aa, Artificial Sequence
  Description of Artificial Sequence: Synthetic peptide
  Seed: SNLTHVLYPVP (PRAME_HUMAN)
SLLTHVLYPVV

SEQ ID NO: 153122 - protein, 10 aa, Artificial Sequence
  Description of Artificial Sequence: Synthetic peptide
  Seed: AYLHARLREL (PRAME_HUMAN)
AKLHARLREV

SEQ ID NO: 153123 - protein, 11 aa, Artificial Sequence
  Description of Artificial Sequence: Synthetic peptide
  Seed: NSISISALQSL (PRAME_HUMAN)
NTISISALQSF

SEQ ID NO: 153124 - protein, 10 aa, Artificial Sequence
  Description of Artificial Sequence: Synthetic peptide
  Seed: MPMQDIKMIL (PRAME_HUMAN)
MTMQDIKMIV

SEQ ID NO: 153125 - protein, 9 aa, Artificial Sequence
  Description of Artificial Sequence: Synthetic peptide
  Seed: MVQAWPFTC (PRAME_HUMAN)
MMQAWPFTM

SEQ ID NO: 153126 - protein, 9 aa, Artificial Sequence
  Description of Artificial Sequence: Synthetic peptide
  Seed: SFYGNSISI (PRAME_HUMAN)
SMYGNSISI

SEQ ID NO: 153127 - protein, 10 aa, Artificial Sequence
  Description of Artificial Sequence: Synthetic peptide
  Seed: ETFKAVLDGL (PRAME_HUMAN)
EIFKAVLDGR

SEQ ID NO: 153128 - protein, 8 aa, Artificial Sequence
  Description of Artificial Sequence: Synthetic peptide
  Seed: FSYLIEKV (PRAME_HUMAN)
FPYLIEKL

SEQ ID NO: 153129 - protein, 9 aa, Artificial Sequence
  Description of Artificial Sequence: Synthetic peptide
  Seed: LMKGQHLHL (PRAME_HUMAN)
LPKGQHLHI

SEQ ID NO: 153130 - protein, 9 aa, Artificial Sequence
  Description of Artificial Sequence: Synthetic peptide
  Seed: VFDECGITD (PRAME_HUMAN)
VWDECGITV

SEQ ID NO: 153131 - protein, 9 aa, Artificial Sequence
  Description of Artificial Sequence: Synthetic peptide
  Seed: YIAQFTSQF (PRAME_HUMAN)
YCAQFTSQM

SEQ ID NO: 153132 - protein, 10 aa, Artificial Sequence
  Description of Artificial Sequence: Synthetic peptide
  Seed: RGRLDQLLRH (PRAME_HUMAN)
RIRLDQLLRK

SEQ ID NO: 153133 - protein, 9 aa, Artificial Sequence
  Description of Artificial Sequence: Synthetic peptide
  Seed: SPEPLQALL (PRAME_HUMAN)
SAEPLQALY

SEQ ID NO: 153134 - protein, 11 aa, Artificial Sequence
  Description of Artificial Sequence: Synthetic peptide
  Seed: FSPYLGQMINL (PRAME_HUMAN)
FVPYLGQMINF

SEQ ID NO: 153135 - protein, 9 aa, Artificial Sequence
  Description of Artificial Sequence: Synthetic peptide
  Seed: WKLPTLAKF (PRAME_HUMAN)
WMLPTLAKF

SEQ ID NO: 153136 - protein, 10 aa, Artificial Sequence
  Description of Artificial Sequence: Synthetic peptide
  Seed: HCSQLTTLSF (PRAME_HUMAN)
HDSQLTTLSW

SEQ ID NO: 153137 - protein, 10 aa, Artificial Sequence
  Description of Artificial Sequence: Synthetic peptide
  Seed: FAMPMQDIKM (PRAME_HUMAN)
FMMPMQDIKM

SEQ ID NO: 153138 - protein, 9 aa, Artificial Sequence
  Description of Artificial Sequence: Synthetic peptide
  Seed: SQSPSVSQL (PRAME_HUMAN)
SGSPSVSQY

SEQ ID NO: 153139 - protein, 10 aa, Artificial Sequence
  Description of Artificial Sequence: Synthetic peptide
  Seed: LSFYGNSISI (PRAME_HUMAN)
LCFYGNSISF

SEQ ID NO: 153140 - protein, 10 aa, Artificial Sequence
  Description of Artificial Sequence: Synthetic peptide
  Seed: RTFYDPEPIL (PRAME_HUMAN)
RQFYDPEPIW

SEQ ID NO: 153141 - protein, 9 aa, Artificial Sequence
  Description of Artificial Sequence: Synthetic peptide
  Seed: VQAWPFTCL (PRAME_HUMAN)
VTAWPFTCV

SEQ ID NO: 153142 - protein, 9 aa, Artificial Sequence
  Description of Artificial Sequence: Synthetic peptide
  Seed: RASATLQDL (PRAME_HUMAN)
RSSATLQDW

SEQ ID NO: 153143 - protein, 11 aa, Artificial Sequence
  Description of Artificial Sequence: Synthetic peptide
  Seed: FLSLQCLQALY (PRAME_HUMAN)
FLSLQCLQALL

SEQ ID NO: 153144 - protein, 10 aa, Artificial Sequence
  Description of Artificial Sequence: Synthetic peptide
  Seed: LLLSHIHASS (PRAME_HUMAN)
LGLSHIHASA

SEQ ID NO: 153145 - protein, 10 aa, Artificial Sequence
  Description of Artificial Sequence: Synthetic peptide
  Seed: FFLRGRLDQL (PRAME_HUMAN)
FWLRGRLDQV

SEQ ID NO: 153146 - protein, 10 aa, Artificial Sequence
  Description of Artificial Sequence: Synthetic peptide
  Seed: KKLKIFAMPM (PRAME_HUMAN)
KILKIFAMPF

SEQ ID NO: 153147 - protein, 9 aa, Artificial Sequence
  Description of Artificial Sequence: Synthetic peptide
  Seed: PYLGQMINL (PRAME_HUMAN)
PWLGQMINF

SEQ ID NO: 153148 - protein, 10 aa, Artificial Sequence
  Description of Artificial Sequence: Synthetic peptide
  Seed: QLLRHVMNPL (PRAME_HUMAN)
QMLRHVMNPI

SEQ ID NO: 153149 - protein, 9 aa, Artificial Sequence
  Description of Artificial Sequence: Synthetic peptide
  Seed: LALLPSLSH (PRAME_HUMAN)
LHLLPSLSY

SEQ ID NO: 153150 - protein, 9 aa, Artificial Sequence
  Description of Artificial Sequence: Synthetic peptide
  Seed: LYVDSLFFL (PRAME_HUMAN)
LMVDSLFFA

SEQ ID NO: 153151 - protein, 9 aa, Artificial Sequence
  Description of Artificial Sequence: Synthetic peptide
  Seed: HVMNPLETL (PRAME_HUMAN)
HVMNPLETF

SEQ ID NO: 153152 - protein, 9 aa, Artificial Sequence
  Description of Artificial Sequence: Synthetic peptide
  Seed: SRYISMSVW (PRAME_HUMAN)
SRYISMSVY

SEQ ID NO: 153153 - protein, 11 aa, Artificial Sequence
  Description of Artificial Sequence: Synthetic peptide
  Seed: FLSLQCLQALY (PRAME_HUMAN)
FQSLQCLQALL

SEQ ID NO: 153154 - protein, 11 aa, Artificial Sequence
  Description of Artificial Sequence: Synthetic peptide
  Seed: QALLERASATL (PRAME_HUMAN)
QMLLERASATV

SEQ ID NO: 153155 - protein, 10 aa, Artificial Sequence
  Description of Artificial Sequence: Synthetic peptide
  Seed: YSFPEPEAAQ (PRAME_HUMAN)
YAFPEPEAAM

SEQ ID NO: 153156 - protein, 10 aa, Artificial Sequence
  Description of Artificial Sequence: Synthetic peptide
  Seed: SNLTHVLYPV (PRAME_HUMAN)
SSLTHVLYPL

SEQ ID NO: 153157 - protein, 9 aa, Artificial Sequence
  Description of Artificial Sequence: Synthetic peptide
  Seed: LYVDSLFFL (PRAME_HUMAN)
LQVDSLFFL

SEQ ID NO: 153158 - protein, 10 aa, Artificial Sequence
  Description of Artificial Sequence: Synthetic peptide
  Seed: ISISALQSLL (PRAME_HUMAN)
IIISALQSLV

SEQ ID NO: 153159 - protein, 10 aa, Artificial Sequence
  Description of Artificial Sequence: Synthetic peptide
  Seed: SISISALQSL (PRAME_HUMAN)
SPSISALQSF

SEQ ID NO: 153160 - protein, 11 aa, Artificial Sequence
  Description of Artificial Sequence: Synthetic peptide
  Seed: ALYVDSLFFLR (PRAME_HUMAN)
AMYVDSLFFLS

SEQ ID NO: 153161 - protein, 10 aa, Artificial Sequence
  Description of Artificial Sequence: Synthetic peptide
  Seed: LSHCSQLTTL (PRAME_HUMAN)
LVHCSQLTTW

SEQ ID NO: 153162 - protein, 11 aa, Artificial Sequence
  Description of Artificial Sequence: Synthetic peptide
  Seed: LLLSHIHASSY (PRAME_HUMAN)
LQLSHIHASSF

SEQ ID NO: 153163 - protein, 10 aa, Artificial Sequence
  Description of Artificial Sequence: Synthetic peptide
  Seed: MVQAWPFTCL (PRAME_HUMAN)
MAQAWPFTCF

SEQ ID NO: 153164 - protein, 10 aa, Artificial Sequence
  Description of Artificial Sequence: Synthetic peptide
  Seed: ESYEDIHGTL (PRAME_HUMAN)
ETYEDIHGTT

SEQ ID NO: 153165 - protein, 10 aa, Artificial Sequence
  Description of Artificial Sequence: Synthetic peptide
  Seed: LSQSPSVSQL (PRAME_HUMAN)
LHQSPSVSQM

SEQ ID NO: 153166 - protein, 9 aa, Artificial Sequence
  Description of Artificial Sequence: Synthetic peptide
  Seed: SMSVWTSPR (PRAME_HUMAN)
SQSVWTSPK

SEQ ID NO: 153167 - protein, 9 aa, Artificial Sequence
  Description of Artificial Sequence: Synthetic peptide
  Seed: YPVPLESYE (PRAME_HUMAN)
YVVPLESYY

SEQ ID NO: 153168 - protein, 9 aa, Artificial Sequence
  Description of Artificial Sequence: Synthetic peptide
  Seed: NLTHVLYPV (PRAME_HUMAN)
NQTHVLYPV

SEQ ID NO: 153169 - protein, 11 aa, Artificial Sequence
  Description of Artificial Sequence: Synthetic peptide
  Seed: AVLDGLDVLLA (PRAME_HUMAN)
ALLDGLDVLLA

SEQ ID NO: 153170 - protein, 9 aa, Artificial Sequence
  Description of Artificial Sequence: Synthetic peptide
  Seed: RTFYDPEPI (PRAME_HUMAN)
RVFYDPEPV

SEQ ID NO: 153171 - protein, 10 aa, Artificial Sequence
  Description of Artificial Sequence: Synthetic peptide
  Seed: EAAQPMTKKR (PRAME_HUMAN)
EIAQPMTKKR

SEQ ID NO: 153172 - protein, 9 aa, Artificial Sequence
  Description of Artificial Sequence: Synthetic peptide
  Seed: SVLSLSGVM (PRAME_HUMAN)
SKLSLSGVM

SEQ ID NO: 153173 - protein, 11 aa, Artificial Sequence
  Description of Artificial Sequence: Synthetic peptide
  Seed: RRWKLQVLDLR (PRAME_HUMAN)
RRWKLQVLDLG

SEQ ID NO: 153174 - protein, 9 aa, Artificial Sequence
  Description of Artificial Sequence: Synthetic peptide
  Seed: LLAQEVRPR (PRAME_HUMAN)
LVAQEVRPK

SEQ ID NO: 153175 - protein, 10 aa, Artificial Sequence
  Description of Artificial Sequence: Synthetic peptide
  Seed: LQALYVDSLF (PRAME_HUMAN)
LAALYVDSLW

SEQ ID NO: 153176 - protein, 10 aa, Artificial Sequence
  Description of Artificial Sequence: Synthetic peptide
  Seed: YIAQFTSQFL (PRAME_HUMAN)
YKAQFTSQFY

SEQ ID NO: 153177 - protein, 9 aa, Artificial Sequence
  Description of Artificial Sequence: Synthetic peptide
  Seed: YLHARLREL (PRAME_HUMAN)
YTHARLREL

SEQ ID NO: 153178 - protein, 8 aa, Artificial Sequence
  Description of Artificial Sequence: Synthetic peptide
  Seed: YSFPEPEA (PRAME_HUMAN)
YAFPEPEV

SEQ ID NO: 153179 - protein, 10 aa, Artificial Sequence
  Description of Artificial Sequence: Synthetic peptide
  Seed: LLSHIHASSY (PRAME_HUMAN)
LGSHIHASSW

SEQ ID NO: 153180 - protein, 9 aa, Artificial Sequence
  Description of Artificial Sequence: Synthetic peptide
  Seed: LAIAALELL (PRAME_HUMAN)
LSIAALELM

SEQ ID NO: 153181 - protein, 10 aa, Artificial Sequence
  Description of Artificial Sequence: Synthetic peptide
  Seed: KKLKIFAMPM (PRAME_HUMAN)
KTLKIFAMPT

SEQ ID NO: 153182 - protein, 10 aa, Artificial Sequence
  Description of Artificial Sequence: Synthetic peptide
  Seed: LLSHIHASSY (PRAME_HUMAN)
LISHIHASSF

SEQ ID NO: 153183 - protein, 10 aa, Artificial Sequence
  Description of Artificial Sequence: Synthetic peptide
  Seed: TSQFLSLQCL (PRAME_HUMAN)
THQFLSLQCF

SEQ ID NO: 153184 - protein, 9 aa, Artificial Sequence
  Description of Artificial Sequence: Synthetic peptide
  Seed: IGLSNLTHV (PRAME_HUMAN)
IMLSNLTHV

SEQ ID NO: 153185 - protein, 11 aa, Artificial Sequence
  Description of Artificial Sequence: Synthetic peptide
  Seed: MKGQHLHLETF (PRAME_HUMAN)
MTGQHLHLETY

SEQ ID NO: 153186 - protein, 11 aa, Artificial Sequence
  Description of Artificial Sequence: Synthetic peptide
  Seed: RRRLWGSIQSR (PRAME_HUMAN)
RRRLWGSIQSL

SEQ ID NO: 153187 - protein, 11 aa, Artificial Sequence
  Description of Artificial Sequence: Synthetic peptide
  Seed: SYISPEKEEQY (PRAME_HUMAN)
SMISPEKEEQF

SEQ ID NO: 153188 - protein, 10 aa, Artificial Sequence
  Description of Artificial Sequence: Synthetic peptide
  Seed: SALQSLLQHL (PRAME_HUMAN)
SILQSLLQHV

SEQ ID NO: 153189 - protein, 9 aa, Artificial Sequence
  Description of Artificial Sequence: Synthetic peptide
  Seed: HVMNPLETL (PRAME_HUMAN)
HEMNPLETF

SEQ ID NO: 153190 - protein, 10 aa, Artificial Sequence
  Description of Artificial Sequence: Synthetic peptide
  Seed: ALAIAALELL (PRAME_HUMAN)
AMAIAALELI

SEQ ID NO: 153191 - protein, 8 aa, Artificial Sequence
  Description of Artificial Sequence: Synthetic peptide
  Seed: DELFSYLI (PRAME_HUMAN)
DELFSYLM

SEQ ID NO: 153192 - protein, 10 aa, Artificial Sequence
  Description of Artificial Sequence: Synthetic peptide
  Seed: HASSYISPEK (PRAME_HUMAN)
HTSSYISPEK

SEQ ID NO: 153193 - protein, 10 aa, Artificial Sequence
  Description of Artificial Sequence: Synthetic peptide
  Seed: LLPRELFPPL (PRAME_HUMAN)
LMPRELFPPI

SEQ ID NO: 153194 - protein, 10 aa, Artificial Sequence
  Description of Artificial Sequence: Synthetic peptide
  Seed: RELFPPLFMA (PRAME_HUMAN)
RPLFPPLFMA

SEQ ID NO: 153195 - protein, 9 aa, Artificial Sequence
  Description of Artificial Sequence: Synthetic peptide
  Seed: SQFLSLQCL (PRAME_HUMAN)
SVFLSLQCV

SEQ ID NO: 153196 - protein, 10 aa, Artificial Sequence
  Description of Artificial Sequence: Synthetic peptide
  Seed: KIFAMPMQDI (PRAME_HUMAN)
KLFAMPMQDV

SEQ ID NO: 153197 - protein, 10 aa, Artificial Sequence
  Description of Artificial Sequence: Synthetic peptide
  Seed: MVQAWPFTCL (PRAME_HUMAN)
MVQAWPFTCF

SEQ ID NO: 153198 - protein, 9 aa, Artificial Sequence
  Description of Artificial Sequence: Synthetic peptide
  Seed: TFYDPEPIL (PRAME_HUMAN)
TIYDPEPIL

SEQ ID NO: 153199 - protein, 10 aa, Artificial Sequence
  Description of Artificial Sequence: Synthetic peptide
  Seed: VSPEPLQALL (PRAME_HUMAN)
VVPEPLQALL

SEQ ID NO: 153200 - protein, 9 aa, Artificial Sequence
  Description of Artificial Sequence: Synthetic peptide
  Seed: FPEPEAAQP (PRAME_HUMAN)
FPEPEAAQL

SEQ ID NO: 153201 - protein, 9 aa, Artificial Sequence
  Description of Artificial Sequence: Synthetic peptide
  Seed: AVLDGLDVL (PRAME_HUMAN)
AQLDGLDVA

SEQ ID NO: 153202 - protein, 10 aa, Artificial Sequence
  Description of Artificial Sequence: Synthetic peptide
  Seed: AFDGRHSQTL (PRAME_HUMAN)
AIDGRHSQTM

SEQ ID NO: 153203 - protein, 9 aa, Artificial Sequence
  Description of Artificial Sequence: Synthetic peptide
  Seed: TSPRRLVEL (PRAME_HUMAN)
TLPRRLVEM

SEQ ID NO: 153204 - protein, 10 aa, Artificial Sequence
  Description of Artificial Sequence: Synthetic peptide
  Seed: QLLRHVMNPL (PRAME_HUMAN)
QELRHVMNPV

SEQ ID NO: 153205 - protein, 9 aa, Artificial Sequence
  Description of Artificial Sequence: Synthetic peptide
  Seed: TLKAMVQAW (PRAME_HUMAN)
TQKAMVQAY

SEQ ID NO: 153206 - protein, 10 aa, Artificial Sequence
  Description of Artificial Sequence: Synthetic peptide
  Seed: PTLAKFSPYL (PRAME_HUMAN)
PVLAKFSPYV

SEQ ID NO: 153207 - protein, 10 aa, Artificial Sequence
  Description of Artificial Sequence: Synthetic peptide
  Seed: ELFSYLIEKV (PRAME_HUMAN)
EIFSYLIEKI

SEQ ID NO: 153208 - protein, 10 aa, Artificial Sequence
  Description of Artificial Sequence: Synthetic peptide
  Seed: MVQAWPFTCL (PRAME_HUMAN)
MIQAWPFTCI

SEQ ID NO: 153209 - protein, 10 aa, Artificial Sequence
  Description of Artificial Sequence: Synthetic peptide
  Seed: MQDIKMILKM (PRAME_HUMAN)
MQDIKMILKV

SEQ ID NO: 153210 - protein, 9 aa, Artificial Sequence
  Description of Artificial Sequence: Synthetic peptide
  Seed: EDIHGTLHL (PRAME_HUMAN)
EEIHGTLHA

SEQ ID NO: 153211 - protein, 10 aa, Artificial Sequence
  Description of Artificial Sequence: Synthetic peptide
  Seed: TFYDPEPILC (PRAME_HUMAN)
TFYDPEPILL

SEQ ID NO: 153212 - protein, 9 aa, Artificial Sequence
  Description of Artificial Sequence: Synthetic peptide
  Seed: QSRYISMSV (PRAME_HUMAN)
QMRYISMSK

SEQ ID NO: 153213 - protein, 11 aa, Artificial Sequence
  Description of Artificial Sequence: Synthetic peptide
  Seed: RLWGSIQSRYI (PRAME_HUMAN)
RQWGSIQSRYM

SEQ ID NO: 153214 - protein, 9 aa, Artificial Sequence
  Description of Artificial Sequence: Synthetic peptide
  Seed: KFSPYLGQM (PRAME_HUMAN)
KYSPYLGQV

SEQ ID NO: 153215 - protein, 9 aa, Artificial Sequence
  Description of Artificial Sequence: Synthetic peptide
  Seed: RGRLDQLLR (PRAME_HUMAN)
RSRLDQLLV

SEQ ID NO: 153216 - protein, 9 aa, Artificial Sequence
  Description of Artificial Sequence: Synthetic peptide
  Seed: THVLYPVPL (PRAME_HUMAN)
TQVLYPVPH

SEQ ID NO: 153217 - protein, 9 aa, Artificial Sequence
  Description of Artificial Sequence: Synthetic peptide
  Seed: LQSLLQHLI (PRAME_HUMAN)
LKSLLQHLF

SEQ ID NO: 153218 - protein, 9 aa, Artificial Sequence
  Description of Artificial Sequence: Synthetic peptide
  Seed: ACDELFSYL (PRAME_HUMAN)
AADELFSYV

SEQ ID NO: 153219 - protein, 9 aa, Artificial Sequence
  Description of Artificial Sequence: Synthetic peptide
  Seed: LWGSIQSRY (PRAME_HUMAN)
LSGSIQSRY

SEQ ID NO: 153220 - protein, 9 aa, Artificial Sequence
  Description of Artificial Sequence: Synthetic peptide
  Seed: ITDDQLLAL (PRAME_HUMAN)
IIDDQLLAL

SEQ ID NO: 153221 - protein, 9 aa, Artificial Sequence
  Description of Artificial Sequence: Synthetic peptide
  Seed: LALLPSLSH (PRAME_HUMAN)
LILLPSLSY

SEQ ID NO: 153222 - protein, 10 aa, Artificial Sequence
  Description of Artificial Sequence: Synthetic peptide
  Seed: RELFPPLFMA (PRAME_HUMAN)
RQLFPPLFMV

SEQ ID NO: 153223 - protein, 9 aa, Artificial Sequence
  Description of Artificial Sequence: Synthetic peptide
  Seed: VSQLSVLSL (PRAME_HUMAN)
VKQLSVLSY

SEQ ID NO: 153224 - protein, 10 aa, Artificial Sequence
  Description of Artificial Sequence: Synthetic peptide
  Seed: VLSLSGVMLT (PRAME_HUMAN)
VLSLSGVMLA

SEQ ID NO: 153225 - protein, 9 aa, Artificial Sequence
  Description of Artificial Sequence: Synthetic peptide
  Seed: GRLDQLLRH (PRAME_HUMAN)
GRLDQLLRI

SEQ ID NO: 153226 - protein, 9 aa, Artificial Sequence
  Description of Artificial Sequence: Synthetic peptide
  Seed: NSISISALQ (PRAME_HUMAN)
NFISISALK

SEQ ID NO: 153227 - protein, 9 aa, Artificial Sequence
  Description of Artificial Sequence: Synthetic peptide
  Seed: KLKIFAMPM (PRAME_HUMAN)
KFKIFAMPG

SEQ ID NO: 153228 - protein, 10 aa, Artificial Sequence
  Description of Artificial Sequence: Synthetic peptide
  Seed: HCSQLTTLSF (PRAME_HUMAN)
HYSQLTTLSW

SEQ ID NO: 153229 - protein, 9 aa, Artificial Sequence
  Description of Artificial Sequence: Synthetic peptide
  Seed: SATLQDLVF (PRAME_HUMAN)
SMTLQDLVF

SEQ ID NO: 153230 - protein, 9 aa, Artificial Sequence
  Description of Artificial Sequence: Synthetic peptide
  Seed: YLHARLREL (PRAME_HUMAN)
YGHARLREY

SEQ ID NO: 153231 - protein, 9 aa, Artificial Sequence
  Description of Artificial Sequence: Synthetic peptide
  Seed: VWSGNRASL (PRAME_HUMAN)
VFSGNRASY

SEQ ID NO: 153232 - protein, 9 aa, Artificial Sequence
  Description of Artificial Sequence: Synthetic peptide
  Seed: EPLQALLER (PRAME_HUMAN)
ESLQALLER

SEQ ID NO: 153233 - protein, 9 aa, Artificial Sequence
  Description of Artificial Sequence: Synthetic peptide
  Seed: RASATLQDL (PRAME_HUMAN)
RPSATLQDL

SEQ ID NO: 153234 - protein, 9 aa, Artificial Sequence
  Description of Artificial Sequence: Synthetic peptide
  Seed: RLRELLCEL (PRAME_HUMAN)
RTRELLCEY

SEQ ID NO: 153235 - protein, 9 aa, Artificial Sequence
  Description of Artificial Sequence: Synthetic peptide
  Seed: SQLTTLSFY (PRAME_HUMAN)
STLTTLSFK

SEQ ID NO: 153236 - protein, 10 aa, Artificial Sequence
  Description of Artificial Sequence: Synthetic peptide
  Seed: ALYVDSLFFL (PRAME_HUMAN)
ASYVDSLFFI

SEQ ID NO: 153237 - protein, 10 aa, Artificial Sequence
  Description of Artificial Sequence: Synthetic peptide
  Seed: LSFYGNSISI (PRAME_HUMAN)
LYFYGNSISF

SEQ ID NO: 153238 - protein, 9 aa, Artificial Sequence
  Description of Artificial Sequence: Synthetic peptide
  Seed: RASATLQDL (PRAME_HUMAN)
RRSATLQDF

SEQ ID NO: 153239 - protein, 10 aa, Artificial Sequence
  Description of Artificial Sequence: Synthetic peptide
  Seed: KEEQYIAQFT (PRAME_HUMAN)
KEEQYIAQFA

SEQ ID NO: 153240 - protein, 9 aa, Artificial Sequence
  Description of Artificial Sequence: Synthetic peptide
  Seed: ACDELFSYL (PRAME_HUMAN)
AMDELFSYI

SEQ ID NO: 153241 - protein, 10 aa, Artificial Sequence
  Description of Artificial Sequence: Synthetic peptide
  Seed: SISISALQSL (PRAME_HUMAN)
SISISALQSY

SEQ ID NO: 153242 - protein, 9 aa, Artificial Sequence
  Description of Artificial Sequence: Synthetic peptide
  Seed: YISMSVWTS (PRAME_HUMAN)
YISMSVWTT

SEQ ID NO: 153243 - protein, 10 aa, Artificial Sequence
  Description of Artificial Sequence: Synthetic peptide
  Seed: CTWKLPTLAK (PRAME_HUMAN)
CMWKLPTLAR

SEQ ID NO: 153244 - protein, 9 aa, Artificial Sequence
  Description of Artificial Sequence: Synthetic peptide
  Seed: ALAIAALEL (PRAME_HUMAN)
ATAIAALEV

SEQ ID NO: 153245 - protein, 9 aa, Artificial Sequence
  Description of Artificial Sequence: Synthetic peptide
  Seed: ETLSITNCR (PRAME_HUMAN)
EWLSITNCR

SEQ ID NO: 153246 - protein, 10 aa, Artificial Sequence
  Description of Artificial Sequence: Synthetic peptide
  Seed: LIGLSNLTHV (PRAME_HUMAN)
LQGLSNLTHV

SEQ ID NO: 153247 - protein, 9 aa, Artificial Sequence
  Description of Artificial Sequence: Synthetic peptide
  Seed: LSNLTHVLY (PRAME_HUMAN)
LKNLTHVLF

SEQ ID NO: 153248 - protein, 9 aa, Artificial Sequence
  Description of Artificial Sequence: Synthetic peptide
  Seed: YSFPEPEAA (PRAME_HUMAN)
YWFPEPEAM

SEQ ID NO: 153249 - protein, 10 aa, Artificial Sequence
  Description of Artificial Sequence: Synthetic peptide
  Seed: FFLRGRLDQL (PRAME_HUMAN)
FLLRGRLDQI

SEQ ID NO: 153250 - protein, 9 aa, Artificial Sequence
  Description of Artificial Sequence: Synthetic peptide
  Seed: ASATLQDLV (PRAME_HUMAN)
AMATLQDLI

SEQ ID NO: 153251 - protein, 9 aa, Artificial Sequence
  Description of Artificial Sequence: Synthetic peptide
  Seed: ITDDQLLAL (PRAME_HUMAN)
IDDDQLLAV

SEQ ID NO: 153252 - protein, 10 aa, Artificial Sequence
  Description of Artificial Sequence: Synthetic peptide
  Seed: VLSLSGVMLT (PRAME_HUMAN)
VLSLSGVMLM

SEQ ID NO: 153253 - protein, 9 aa, Artificial Sequence
  Description of Artificial Sequence: Synthetic peptide
  Seed: SQSPSVSQL (PRAME_HUMAN)
SESPSVSQC

SEQ ID NO: 153254 - protein, 9 aa, Artificial Sequence
  Description of Artificial Sequence: Synthetic peptide
  Seed: TWKLPTLAK (PRAME_HUMAN)
TLKLPTLAR

SEQ ID NO: 153255 - protein, 10 aa, Artificial Sequence
  Description of Artificial Sequence: Synthetic peptide
  Seed: AVLDGLDVLL (PRAME_HUMAN)
AQLDGLDVLM

SEQ ID NO: 153256 - protein, 9 aa, Artificial Sequence
  Description of Artificial Sequence: Synthetic peptide
  Seed: DSLFFLRGR (PRAME_HUMAN)
DMLFFLRGR

SEQ ID NO: 153257 - protein, 10 aa, Artificial Sequence
  Description of Artificial Sequence: Synthetic peptide
  Seed: AKFSPYLGQM (PRAME_HUMAN)
AHFSPYLGQY

SEQ ID NO: 153258 - protein, 10 aa, Artificial Sequence
  Description of Artificial Sequence: Synthetic peptide
  Seed: FIPVEVLVDL (PRAME_HUMAN)
FVPVEVLVDV

SEQ ID NO: 153259 - protein, 9 aa, Artificial Sequence
  Description of Artificial Sequence: Synthetic peptide
  Seed: ALQSLLQHL (PRAME_HUMAN)
AIQSLLQHY

SEQ ID NO: 153260 - protein, 9 aa, Artificial Sequence
  Description of Artificial Sequence: Synthetic peptide
  Seed: LLRHVMNPL (PRAME_HUMAN)
LPRHVMNPT

SEQ ID NO: 153261 - protein, 9 aa, Artificial Sequence
  Description of Artificial Sequence: Synthetic peptide
  Seed: TSPRRLVEL (PRAME_HUMAN)
TYPRRLVEF

SEQ ID NO: 153262 - protein, 9 aa, Artificial Sequence
  Description of Artificial Sequence: Synthetic peptide
  Seed: SFYGNSISI (PRAME_HUMAN)
SPYGNSISY

SEQ ID NO: 153263 - protein, 9 aa, Artificial Sequence
  Description of Artificial Sequence: Synthetic peptide
  Seed: ETLSITNCR (PRAME_HUMAN)
EVLSITNCR

SEQ ID NO: 153264 - protein, 9 aa, Artificial Sequence
  Description of Artificial Sequence: Synthetic peptide
  Seed: KMILKMVQL (PRAME_HUMAN)
KTILKMVQW

SEQ ID NO: 153265 - protein, 10 aa, Artificial Sequence
  Description of Artificial Sequence: Synthetic peptide
  Seed: KKLKIFAMPM (PRAME_HUMAN)
KYLKIFAMPK

SEQ ID NO: 153266 - protein, 9 aa, Artificial Sequence
  Description of Artificial Sequence: Synthetic peptide
  Seed: MPMQDIKMI (PRAME_HUMAN)
MAMQDIKMY

SEQ ID NO: 153267 - protein, 9 aa, Artificial Sequence
  Description of Artificial Sequence: Synthetic peptide
  Seed: MVQAWPFTC (PRAME_HUMAN)
MIQAWPFTV

SEQ ID NO: 153268 - protein, 9 aa, Artificial Sequence
  Description of Artificial Sequence: Synthetic peptide
  Seed: LSHIHASSY (PRAME_HUMAN)
LAHIHASSH

SEQ ID NO: 153269 - protein, 9 aa, Artificial Sequence
  Description of Artificial Sequence: Synthetic peptide
  Seed: NSHQDFWTV (PRAME_HUMAN)
NTHQDFWTF

SEQ ID NO: 153270 - protein, 9 aa, Artificial Sequence
  Description of Artificial Sequence: Synthetic peptide
  Seed: RLRELLCEL (PRAME_HUMAN)
RNRELLCEF

SEQ ID NO: 153271 - protein, 8 aa, Artificial Sequence
  Description of Artificial Sequence: Synthetic peptide
  Seed: VSPEPLQA (PRAME_HUMAN)
VSPEPLQL

SEQ ID NO: 153272 - protein, 11 aa, Artificial Sequence
  Description of Artificial Sequence: Synthetic peptide
  Seed: QALYVDSLFFL (PRAME_HUMAN)
QGLYVDSLFFF

SEQ ID NO: 153273 - protein, 9 aa, Artificial Sequence
  Description of Artificial Sequence: Synthetic peptide
  Seed: ACDELFSYL (PRAME_HUMAN)
ATDELFSYF

SEQ ID NO: 153274 - protein, 9 aa, Artificial Sequence
  Description of Artificial Sequence: Synthetic peptide
  Seed: SQLTTLSFY (PRAME_HUMAN)
SVLTTLSFR

SEQ ID NO: 153275 - protein, 10 aa, Artificial Sequence
  Description of Artificial Sequence: Synthetic peptide
  Seed: ITDDQLLALL (PRAME_HUMAN)
ISDDQLLALL

SEQ ID NO: 153276 - protein, 10 aa, Artificial Sequence
  Description of Artificial Sequence: Synthetic peptide
  Seed: RPRRWKLQVL (PRAME_HUMAN)
RPRRWKLQVF

SEQ ID NO: 153277 - protein, 9 aa, Artificial Sequence
  Description of Artificial Sequence: Synthetic peptide
  Seed: FYDPEPILC (PRAME_HUMAN)
FQDPEPILL

SEQ ID NO: 153278 - protein, 10 aa, Artificial Sequence
  Description of Artificial Sequence: Synthetic peptide
  Seed: LSVLSLSGVM (PRAME_HUMAN)
LSVLSLSGVY

SEQ ID NO: 153279 - protein, 9 aa, Artificial Sequence
  Description of Artificial Sequence: Synthetic peptide
  Seed: LQDLVFDEC (PRAME_HUMAN)
LADLVFDEI

SEQ ID NO: 153280 - protein, 9 aa, Artificial Sequence
  Description of Artificial Sequence: Synthetic peptide
  Seed: RTFYDPEPI (PRAME_HUMAN)
RWFYDPEPY

SEQ ID NO: 153281 - protein, 9 aa, Artificial Sequence
  Description of Artificial Sequence: Synthetic peptide
  Seed: SQSPSVSQL (PRAME_HUMAN)
STSPSVSQM

SEQ ID NO: 153282 - protein, 8 aa, Artificial Sequence
  Description of Artificial Sequence: Synthetic peptide
  Seed: TDDQLLAL (PRAME_HUMAN)
TSDQLLAM

SEQ ID NO: 153283 - protein, 9 aa, Artificial Sequence
  Description of Artificial Sequence: Synthetic peptide
  Seed: VFDECGITD (PRAME_HUMAN)
VGDECGITF

SEQ ID NO: 153284 - protein, 9 aa, Artificial Sequence
  Description of Artificial Sequence: Synthetic peptide
  Seed: YLHARLREL (PRAME_HUMAN)
YVHARLREV

SEQ ID NO: 153285 - protein, 10 aa, Artificial Sequence
  Description of Artificial Sequence: Synthetic peptide
  Seed: KKLKIFAMPM (PRAME_HUMAN)
KILKIFAMPY

SEQ ID NO: 153286 - protein, 9 aa, Artificial Sequence
  Description of Artificial Sequence: Synthetic peptide
  Seed: SFYGNSISI (PRAME_HUMAN)
SWYGNSISM

SEQ ID NO: 153287 - protein, 9 aa, Artificial Sequence
  Description of Artificial Sequence: Synthetic peptide
  Seed: SQSPSVSQL (PRAME_HUMAN)
SHSPSVSQI

SEQ ID NO: 153288 - protein, 10 aa, Artificial Sequence
  Description of Artificial Sequence: Synthetic peptide
  Seed: SALQSLLQHL (PRAME_HUMAN)
SQLQSLLQHV

SEQ ID NO: 153289 - protein, 11 aa, Artificial Sequence
  Description of Artificial Sequence: Synthetic peptide
  Seed: GTLHLERLAYL (PRAME_HUMAN)
GMLHLERLAYA

SEQ ID NO: 153290 - protein, 10 aa, Artificial Sequence
  Description of Artificial Sequence: Synthetic peptide
  Seed: SPSVSQLSVL (PRAME_HUMAN)
SDSVSQLSVW

SEQ ID NO: 153291 - protein, 9 aa, Artificial Sequence
  Description of Artificial Sequence: Synthetic peptide
  Seed: SHIHASSYI (PRAME_HUMAN)
SLIHASSYY

SEQ ID NO: 153292 - protein, 9 aa, Artificial Sequence
  Description of Artificial Sequence: Synthetic peptide
  Seed: GACDELFSY (PRAME_HUMAN)
GVCDELFSK

SEQ ID NO: 153293 - protein, 10 aa, Artificial Sequence
  Description of Artificial Sequence: Synthetic peptide
  Seed: YIAQFTSQFL (PRAME_HUMAN)
YIAQFTSQFV

SEQ ID NO: 153294 - protein, 9 aa, Artificial Sequence
  Description of Artificial Sequence: Synthetic peptide
  Seed: FLSLQCLQA (PRAME_HUMAN)
FTSLQCLQV

SEQ ID NO: 153295 - protein, 10 aa, Artificial Sequence
  Description of Artificial Sequence: Synthetic peptide
  Seed: AFDGRHSQTL (PRAME_HUMAN)
ALDGRHSQTM

SEQ ID NO: 153296 - protein, 10 aa, Artificial Sequence
  Description of Artificial Sequence: Synthetic peptide
  Seed: LLKDEALAIA (PRAME_HUMAN)
LLKDEALAII

SEQ ID NO: 153297 - protein, 10 aa, Artificial Sequence
  Description of Artificial Sequence: Synthetic peptide
  Seed: CSQLTTLSFY (PRAME_HUMAN)
CLQLTTLSFY

SEQ ID NO: 153298 - protein, 9 aa, Artificial Sequence
  Description of Artificial Sequence: Synthetic peptide
  Seed: LLRHVMNPL (PRAME_HUMAN)
LVRHVMNPV

SEQ ID NO: 153299 - protein, 10 aa, Artificial Sequence
  Description of Artificial Sequence: Synthetic peptide
  Seed: PTLAKFSPYL (PRAME_HUMAN)
PVLAKFSPYL

SEQ ID NO: 153300 - protein, 9 aa, Artificial Sequence
  Description of Artificial Sequence: Synthetic peptide
  Seed: IGLSNLTHV (PRAME_HUMAN)
IALSNLTHL

SEQ ID NO: 153301 - protein, 10 aa, Artificial Sequence
  Description of Artificial Sequence: Synthetic peptide
  Seed: ELFPPLFMAA (PRAME_HUMAN)
ETFPPLFMAL

SEQ ID NO: 153302 - protein, 9 aa, Artificial Sequence
  Description of Artificial Sequence: Synthetic peptide
  Seed: TLAKFSPYL (PRAME_HUMAN)
TIAKFSPYM

SEQ ID NO: 153303 - protein, 9 aa, Artificial Sequence
  Description of Artificial Sequence: Synthetic peptide
  Seed: LSLQCLQAL (PRAME_HUMAN)
LMLQCLQAV

SEQ ID NO: 153304 - protein, 9 aa, Artificial Sequence
  Description of Artificial Sequence: Synthetic peptide
  Seed: SISALQSLL (PRAME_HUMAN)
SLSALQSLI

SEQ ID NO: 153305 - protein, 10 aa, Artificial Sequence
  Description of Artificial Sequence: Synthetic peptide
  Seed: SISISALQSL (PRAME_HUMAN)
SRSISALQSW

SEQ ID NO: 153306 - protein, 10 aa, Artificial Sequence
  Description of Artificial Sequence: Synthetic peptide
  Seed: LERLAYLHAR (PRAME_HUMAN)
LRRLAYLHAK

SEQ ID NO: 153307 - protein, 9 aa, Artificial Sequence
  Description of Artificial Sequence: Synthetic peptide
  Seed: YEDIHGTLH (PRAME_HUMAN)
YEDIHGTLP

SEQ ID NO: 153308 - protein, 9 aa, Artificial Sequence
  Description of Artificial Sequence: Synthetic peptide
  Seed: LLSHIHASS (PRAME_HUMAN)
LMSHIHASV

SEQ ID NO: 153309 - protein, 10 aa, Artificial Sequence
  Description of Artificial Sequence: Synthetic peptide
  Seed: YEDIHGTLHL (PRAME_HUMAN)
YMDIHGTLHM

SEQ ID NO: 153310 - protein, 9 aa, Artificial Sequence
  Description of Artificial Sequence: Synthetic peptide
  Seed: KVDGLSTEA (PRAME_HUMAN)
KMDGLSTEF

SEQ ID NO: 153311 - protein, 10 aa, Artificial Sequence
  Description of Artificial Sequence: Synthetic peptide
  Seed: PTLAKFSPYL (PRAME_HUMAN)
PMLAKFSPYI

SEQ ID NO: 153312 - protein, 10 aa, Artificial Sequence
  Description of Artificial Sequence: Synthetic peptide
  Seed: QAWPFTCLPL (PRAME_HUMAN)
QSWPFTCLPM

SEQ ID NO: 153313 - protein, 10 aa, Artificial Sequence
  Description of Artificial Sequence: Synthetic peptide
  Seed: MPMQDIKMIL (PRAME_HUMAN)
MDMQDIKMIV

SEQ ID NO: 153314 - protein, 10 aa, Artificial Sequence
  Description of Artificial Sequence: Synthetic peptide
  Seed: KVKRKKNVLR (PRAME_HUMAN)
KTKRKKNVLV

SEQ ID NO: 153315 - protein, 11 aa, Artificial Sequence
  Description of Artificial Sequence: Synthetic peptide
  Seed: AAFDGRHSQTL (PRAME_HUMAN)
AQFDGRHSQTV

SEQ ID NO: 153316 - protein, 9 aa, Artificial Sequence
  Description of Artificial Sequence: Synthetic peptide
  Seed: ELFPPLFMA (PRAME_HUMAN)
ETFPPLFMI

SEQ ID NO: 153317 - protein, 10 aa, Artificial Sequence
  Description of Artificial Sequence: Synthetic peptide
  Seed: VTCTWKLPTL (PRAME_HUMAN)
VMCTWKLPTA

SEQ ID NO: 153318 - protein, 10 aa, Artificial Sequence
  Description of Artificial Sequence: Synthetic peptide
  Seed: ALYVDSLFFL (PRAME_HUMAN)
ACYVDSLFFF

SEQ ID NO: 153319 - protein, 10 aa, Artificial Sequence
  Description of Artificial Sequence: Synthetic peptide
  Seed: MVQAWPFTCL (PRAME_HUMAN)
MNQAWPFTCY

SEQ ID NO: 153320 - protein, 10 aa, Artificial Sequence
  Description of Artificial Sequence: Synthetic peptide
  Seed: LLPRELFPPL (PRAME_HUMAN)
LFPRELFPPV

SEQ ID NO: 153321 - protein, 10 aa, Artificial Sequence
  Description of Artificial Sequence: Synthetic peptide
  Seed: LPRELFPPLF (PRAME_HUMAN)
LPRELFPPLY

SEQ ID NO: 153322 - protein, 9 aa, Artificial Sequence
  Description of Artificial Sequence: Synthetic peptide
  Seed: FYDPEPILC (PRAME_HUMAN)
FADPEPILV

SEQ ID NO: 153323 - protein, 10 aa, Artificial Sequence
  Description of Artificial Sequence: Synthetic peptide
  Seed: RGRLDQLLRH (PRAME_HUMAN)
RVRLDQLLRF

SEQ ID NO: 153324 - protein, 9 aa, Artificial Sequence
  Description of Artificial Sequence: Synthetic peptide
  Seed: FAMPMQDIK (PRAME_HUMAN)
FTMPMQDIY

SEQ ID NO: 153325 - protein, 9 aa, Artificial Sequence
  Description of Artificial Sequence: Synthetic peptide
  Seed: KMILKMVQL (PRAME_HUMAN)
KRILKMVQY

SEQ ID NO: 153326 - protein, 10 aa, Artificial Sequence
  Description of Artificial Sequence: Synthetic peptide
  Seed: RELFPPLFMA (PRAME_HUMAN)
RVLFPPLFMV

SEQ ID NO: 153327 - protein, 9 aa, Artificial Sequence
  Description of Artificial Sequence: Synthetic peptide
  Seed: SLLQHLIGL (PRAME_HUMAN)
SVLQHLIGF

SEQ ID NO: 153328 - protein, 10 aa, Artificial Sequence
  Description of Artificial Sequence: Synthetic peptide
  Seed: QAWPFTCLPL (PRAME_HUMAN)
QMWPFTCLPV

SEQ ID NO: 153329 - protein, 9 aa, Artificial Sequence
  Description of Artificial Sequence: Synthetic peptide
  Seed: LAIAALELL (PRAME_HUMAN)
LPIAALELM

SEQ ID NO: 153330 - protein, 9 aa, Artificial Sequence
  Description of Artificial Sequence: Synthetic peptide
  Seed: LLALLPSLS (PRAME_HUMAN)
LLALLPSLI

SEQ ID NO: 153331 - protein, 9 aa, Artificial Sequence
  Description of Artificial Sequence: Synthetic peptide
  Seed: LSNLTHVLY (PRAME_HUMAN)
LVNLTHVLF

SEQ ID NO: 153332 - protein, 9 aa, Artificial Sequence
  Description of Artificial Sequence: Synthetic peptide
  Seed: GLSNLTHVL (PRAME_HUMAN)
GMSNLTHVV

SEQ ID NO: 153333 - protein, 9 aa, Artificial Sequence
  Description of Artificial Sequence: Synthetic peptide
  Seed: VQAWPFTCL (PRAME_HUMAN)
VVAWPFTCF

SEQ ID NO: 153334 - protein, 10 aa, Artificial Sequence
  Description of Artificial Sequence: Synthetic peptide
  Seed: WTSPRRLVEL (PRAME_HUMAN)
WASPRRLVEF

SEQ ID NO: 153335 - protein, 11 aa, Artificial Sequence
  Description of Artificial Sequence: Synthetic peptide
  Seed: QALYVDSLFFL (PRAME_HUMAN)
QVLYVDSLFFF

SEQ ID NO: 153336 - protein, 10 aa, Artificial Sequence
  Description of Artificial Sequence: Synthetic peptide
  Seed: RELFPPLFMA (PRAME_HUMAN)
RQLFPPLFMM

SEQ ID NO: 153337 - protein, 9 aa, Artificial Sequence
  Description of Artificial Sequence: Synthetic peptide
  Seed: QTLKAMVQA (PRAME_HUMAN)
QLLKAMVQL

SEQ ID NO: 153338 - protein, 10 aa, Artificial Sequence
  Description of Artificial Sequence: Synthetic peptide
  Seed: RGRLDQLLRH (PRAME_HUMAN)
RSRLDQLLRL

SEQ ID NO: 153339 - protein, 9 aa, Artificial Sequence
  Description of Artificial Sequence: Synthetic peptide
  Seed: MNPLETLSI (PRAME_HUMAN)
MSPLETLSM

SEQ ID NO: 153340 - protein, 10 aa, Artificial Sequence
  Description of Artificial Sequence: Synthetic peptide
  Seed: IGLSNLTHVL (PRAME_HUMAN)
IVLSNLTHVV

SEQ ID NO: 153341 - protein, 9 aa, Artificial Sequence
  Description of Artificial Sequence: Synthetic peptide
  Seed: SVLSLSGVM (PRAME_HUMAN)
SLLSLSGVY

SEQ ID NO: 153342 - protein, 9 aa, Artificial Sequence
  Description of Artificial Sequence: Synthetic peptide
  Seed: DSLFFLRGR (PRAME_HUMAN)
DILFFLRGR

SEQ ID NO: 153343 - protein, 9 aa, Artificial Sequence
  Description of Artificial Sequence: Synthetic peptide
  Seed: RGRLDQLLR (PRAME_HUMAN)
RIRLDQLLV

SEQ ID NO: 153344 - protein, 9 aa, Artificial Sequence
  Description of Artificial Sequence: Synthetic peptide
  Seed: ALQSLLQHL (PRAME_HUMAN)
ASQSLLQHI

SEQ ID NO: 153345 - protein, 8 aa, Artificial Sequence
  Description of Artificial Sequence: Synthetic peptide
  Seed: YSFPEPEA (PRAME_HUMAN)
YSFPEPEF

SEQ ID NO: 153346 - protein, 11 aa, Artificial Sequence
  Description of Artificial Sequence: Synthetic peptide
  Seed: IAQFTSQFLSL (PRAME_HUMAN)
IQQFTSQFLSM

SEQ ID NO: 153347 - protein, 10 aa, Artificial Sequence
  Description of Artificial Sequence: Synthetic peptide
  Seed: DVSPEPLQAL (PRAME_HUMAN)
DVSPEPLQAF

SEQ ID NO: 153348 - protein, 9 aa, Artificial Sequence
  Description of Artificial Sequence: Synthetic peptide
  Seed: SYLIEKVKR (PRAME_HUMAN)
SMLIEKVKR

SEQ ID NO: 153349 - protein, 10 aa, Artificial Sequence
  Description of Artificial Sequence: Synthetic peptide
  Seed: CLQALYVDSL (PRAME_HUMAN)
CLQALYVDSV

SEQ ID NO: 153350 - protein, 9 aa, Artificial Sequence
  Description of Artificial Sequence: Synthetic peptide
  Seed: LSLQCLQAL (PRAME_HUMAN)
LVLQCLQAY

SEQ ID NO: 153351 - protein, 11 aa, Artificial Sequence
  Description of Artificial Sequence: Synthetic peptide
  Seed: FLSLQCLQALY (PRAME_HUMAN)
FRSLQCLQALL

SEQ ID NO: 153352 - protein, 10 aa, Artificial Sequence
  Description of Artificial Sequence: Synthetic peptide
  Seed: VLYPVPLESY (PRAME_HUMAN)
VKYPVPLESM

SEQ ID NO: 153353 - protein, 9 aa, Artificial Sequence
  Description of Artificial Sequence: Synthetic peptide
  Seed: SVWTSPRRL (PRAME_HUMAN)
SVWTSPRRW

SEQ ID NO: 153354 - protein, 10 aa, Artificial Sequence
  Description of Artificial Sequence: Synthetic peptide
  Seed: IQSRYISMSV (PRAME_HUMAN)
ITSRYISMSA

SEQ ID NO: 153355 - protein, 10 aa, Artificial Sequence
  Description of Artificial Sequence: Synthetic peptide
  Seed: DQLLALLPSL (PRAME_HUMAN)
DMLLALLPSV

SEQ ID NO: 153356 - protein, 10 aa, Artificial Sequence
  Description of Artificial Sequence: Synthetic peptide
  Seed: FFLRGRLDQL (PRAME_HUMAN)
FYLRGRLDQI

SEQ ID NO: 153357 - protein, 9 aa, Artificial Sequence
  Description of Artificial Sequence: Synthetic peptide
  Seed: SQLTTLSFY (PRAME_HUMAN)
SMLTTLSFM

SEQ ID NO: 153358 - protein, 10 aa, Artificial Sequence
  Description of Artificial Sequence: Synthetic peptide
  Seed: KGQHLHLETF (PRAME_HUMAN)
KMQHLHLETM

SEQ ID NO: 153359 - protein, 9 aa, Artificial Sequence
  Description of Artificial Sequence: Synthetic peptide
  Seed: LYPVPLESY (PRAME_HUMAN)
LAPVPLESY

SEQ ID NO: 153360 - protein, 10 aa, Artificial Sequence
  Description of Artificial Sequence: Synthetic peptide
  Seed: DIHGTLHLER (PRAME_HUMAN)
DMHGTLHLER

SEQ ID NO: 153361 - protein, 9 aa, Artificial Sequence
  Description of Artificial Sequence: Synthetic peptide
  Seed: TSPRRLVEL (PRAME_HUMAN)
TQPRRLVEL

SEQ ID NO: 153362 - protein, 10 aa, Artificial Sequence
  Description of Artificial Sequence: Synthetic peptide
  Seed: LLPRELFPPL (PRAME_HUMAN)
LHPRELFPPM

SEQ ID NO: 153363 - protein, 9 aa, Artificial Sequence
  Description of Artificial Sequence: Synthetic peptide
  Seed: LSHIHASSY (PRAME_HUMAN)
LFHIHASSF

SEQ ID NO: 153364 - protein, 9 aa, Artificial Sequence
  Description of Artificial Sequence: Synthetic peptide
  Seed: VQLDSIEDL (PRAME_HUMAN)
VMLDSIEDI

SEQ ID NO: 153365 - protein, 9 aa, Artificial Sequence
  Description of Artificial Sequence: Synthetic peptide
  Seed: YEDIHGTLH (PRAME_HUMAN)
YQDIHGTLY

SEQ ID NO: 153366 - protein, 9 aa, Artificial Sequence
  Description of Artificial Sequence: Synthetic peptide
  Seed: YPVPLESYE (PRAME_HUMAN)
YPVPLESYW

SEQ ID NO: 153367 - protein, 9 aa, Artificial Sequence
  Description of Artificial Sequence: Synthetic peptide
  Seed: KVDGLSTEA (PRAME_HUMAN)
KCDGLSTEV

SEQ ID NO: 153368 - protein, 10 aa, Artificial Sequence
  Description of Artificial Sequence: Synthetic peptide
  Seed: ESYEDIHGTL (PRAME_HUMAN)
EIYEDIHGTV

SEQ ID NO: 153369 - protein, 9 aa, Artificial Sequence
  Description of Artificial Sequence: Synthetic peptide
  Seed: HVMNPLETL (PRAME_HUMAN)
HYMNPLETL

SEQ ID NO: 153370 - protein, 9 aa, Artificial Sequence
  Description of Artificial Sequence: Synthetic peptide
  Seed: RLRELLCEL (PRAME_HUMAN)
RMRELLCEK

SEQ ID NO: 153371 - protein, 10 aa, Artificial Sequence
  Description of Artificial Sequence: Synthetic peptide
  Seed: RGRLDQLLRH (PRAME_HUMAN)
RNRLDQLLRM

SEQ ID NO: 153372 - protein, 11 aa, Artificial Sequence
  Description of Artificial Sequence: Synthetic peptide
  Seed: ALYVDSLFFLR (PRAME_HUMAN)
AYYVDSLFFLR

SEQ ID NO: 153373 - protein, 10 aa, Artificial Sequence
  Description of Artificial Sequence: Synthetic peptide
  Seed: SPYLGQMINL (PRAME_HUMAN)
SPYLGQMINI

SEQ ID NO: 153374 - protein, 9 aa, Artificial Sequence
  Description of Artificial Sequence: Synthetic peptide
  Seed: TLAKFSPYL (PRAME_HUMAN)
TQAKFSPYY

SEQ ID NO: 153375 - protein, 10 aa, Artificial Sequence
  Description of Artificial Sequence: Synthetic peptide
  Seed: SPYLGQMINL (PRAME_HUMAN)
SGYLGQMINW

SEQ ID NO: 153376 - protein, 10 aa, Artificial Sequence
  Description of Artificial Sequence: Synthetic peptide
  Seed: QLLRHVMNPL (PRAME_HUMAN)
QQLRHVMNPV

SEQ ID NO: 153377 - protein, 10 aa, Artificial Sequence
  Description of Artificial Sequence: Synthetic peptide
  Seed: LPTLAKFSPY (PRAME_HUMAN)
LDTLAKFSPY

SEQ ID NO: 153378 - protein, 9 aa, Artificial Sequence
  Description of Artificial Sequence: Synthetic peptide
  Seed: AQFTSQFLS (PRAME_HUMAN)
AAFTSQFLV

SEQ ID NO: 153379 - protein, 8 aa, Artificial Sequence
  Description of Artificial Sequence: Synthetic peptide
  Seed: LTHVLYPV (PRAME_HUMAN)
LNHVLYPV

SEQ ID NO: 153380 - protein, 10 aa, Artificial Sequence
  Description of Artificial Sequence: Synthetic peptide
  Seed: HASSYISPEK (PRAME_HUMAN)
HSSSYISPEK

SEQ ID NO: 153381 - protein, 9 aa, Artificial Sequence
  Description of Artificial Sequence: Synthetic peptide
  Seed: NSISISALQ (PRAME_HUMAN)
NTISISALH

SEQ ID NO: 153382 - protein, 9 aa, Artificial Sequence
  Description of Artificial Sequence: Synthetic peptide
  Seed: LSNLTHVLY (PRAME_HUMAN)
LQNLTHVLM

SEQ ID NO: 153383 - protein, 10 aa, Artificial Sequence
  Description of Artificial Sequence: Synthetic peptide
  Seed: DELFSYLIEK (PRAME_HUMAN)
DWLFSYLIER

SEQ ID NO: 153384 - protein, 9 aa, Artificial Sequence
  Description of Artificial Sequence: Synthetic peptide
  Seed: THVLYPVPL (PRAME_HUMAN)
TKVLYPVPL

SEQ ID NO: 153385 - protein, 9 aa, Artificial Sequence
  Description of Artificial Sequence: Synthetic peptide
  Seed: YIAQFTSQF (PRAME_HUMAN)
YHAQFTSQM

SEQ ID NO: 153386 - protein, 10 aa, Artificial Sequence
  Description of Artificial Sequence: Synthetic peptide
  Seed: SVSQLSVLSL (PRAME_HUMAN)
SVSQLSVLSI

SEQ ID NO: 153387 - protein, 9 aa, Artificial Sequence
  Description of Artificial Sequence: Synthetic peptide
  Seed: THVLYPVPL (PRAME_HUMAN)
TKVLYPVPF

SEQ ID NO: 153388 - protein, 9 aa, Artificial Sequence
  Description of Artificial Sequence: Synthetic peptide
  Seed: FDGRHSQTL (PRAME_HUMAN)
FHGRHSQTM

SEQ ID NO: 153389 - protein, 9 aa, Artificial Sequence
  Description of Artificial Sequence: Synthetic peptide
  Seed: RLWGSIQSR (PRAME_HUMAN)
RTWGSIQSV

SEQ ID NO: 153390 - protein, 9 aa, Artificial Sequence
  Description of Artificial Sequence: Synthetic peptide
  Seed: LQDLVFDEC (PRAME_HUMAN)
LTDLVFDEF

SEQ ID NO: 153391 - protein, 10 aa, Artificial Sequence
  Description of Artificial Sequence: Synthetic peptide
  Seed: RGRLDQLLRH (PRAME_HUMAN)
RRRLDQLLRM

SEQ ID NO: 153392 - protein, 10 aa, Artificial Sequence
  Description of Artificial Sequence: Synthetic peptide
  Seed: GACDELFSYL (PRAME_HUMAN)
GICDELFSYV

SEQ ID NO: 153393 - protein, 10 aa, Artificial Sequence
  Description of Artificial Sequence: Synthetic peptide
  Seed: AMVQAWPFTC (PRAME_HUMAN)
ACVQAWPFTV

SEQ ID NO: 153394 - protein, 9 aa, Artificial Sequence
  Description of Artificial Sequence: Synthetic peptide
  Seed: LSLQCLQAL (PRAME_HUMAN)
LLLQCLQAI

SEQ ID NO: 153395 - protein, 10 aa, Artificial Sequence
  Description of Artificial Sequence: Synthetic peptide
  Seed: AQFTSQFLSL (PRAME_HUMAN)
AEFTSQFLSY

SEQ ID NO: 153396 - protein, 9 aa, Artificial Sequence
  Description of Artificial Sequence: Synthetic peptide
  Seed: LAYLHARLR (PRAME_HUMAN)
LVYLHARLK

SEQ ID NO: 153397 - protein, 9 aa, Artificial Sequence
  Description of Artificial Sequence: Synthetic peptide
  Seed: YLHARLREL (PRAME_HUMAN)
YFHARLREI

SEQ ID NO: 153398 - protein, 9 aa, Artificial Sequence
  Description of Artificial Sequence: Synthetic peptide
  Seed: TLAKFSPYL (PRAME_HUMAN)
TTAKFSPYA

SEQ ID NO: 153399 - protein, 9 aa, Artificial Sequence
  Description of Artificial Sequence: Synthetic peptide
  Seed: ISPEKEEQY (PRAME_HUMAN)
IWPEKEEQY

SEQ ID NO: 153400 - protein, 9 aa, Artificial Sequence
  Description of Artificial Sequence: Synthetic peptide
  Seed: AWPFTCLPL (PRAME_HUMAN)
AYPFTCLPY

SEQ ID NO: 153401 - protein, 8 aa, Artificial Sequence
  Description of Artificial Sequence: Synthetic peptide
  Seed: WPFTCLPL (PRAME_HUMAN)
WPFTCLPY

SEQ ID NO: 153402 - protein, 10 aa, Artificial Sequence
  Description of Artificial Sequence: Synthetic peptide
  Seed: TSQFLSLQCL (PRAME_HUMAN)
TSQFLSLQCF

SEQ ID NO: 153403 - protein, 10 aa, Artificial Sequence
  Description of Artificial Sequence: Synthetic peptide
  Seed: LLPRELFPPL (PRAME_HUMAN)
LDPRELFPPI

SEQ ID NO: 153404 - protein, 9 aa, Artificial Sequence
  Description of Artificial Sequence: Synthetic peptide
  Seed: RRRLWGSIQ (PRAME_HUMAN)
RRRLWGSIK

SEQ ID NO: 153405 - protein, 10 aa, Artificial Sequence
  Description of Artificial Sequence: Synthetic peptide
  Seed: SPSVSQLSVL (PRAME_HUMAN)
SGSVSQLSVF

SEQ ID NO: 153406 - protein, 10 aa, Artificial Sequence
  Description of Artificial Sequence: Synthetic peptide
  Seed: DQLLALLPSL (PRAME_HUMAN)
DYLLALLPSM

SEQ ID NO: 153407 - protein, 9 aa, Artificial Sequence
  Description of Artificial Sequence: Synthetic peptide
  Seed: KMILKMVQL (PRAME_HUMAN)
KAILKMVQK

SEQ ID NO: 153408 - protein, 11 aa, Artificial Sequence
  Description of Artificial Sequence: Synthetic peptide
  Seed: LPTLAKFSPYL (PRAME_HUMAN)
LCTLAKFSPYV

SEQ ID NO: 153409 - protein, 9 aa, Artificial Sequence
  Description of Artificial Sequence: Synthetic peptide
  Seed: MHLSQSPSV (PRAME_HUMAN)
MVLSQSPSF

SEQ ID NO: 153410 - protein, 9 aa, Artificial Sequence
  Description of Artificial Sequence: Synthetic peptide
  Seed: EPLQALLER (PRAME_HUMAN)
ETLQALLER

SEQ ID NO: 153411 - protein, 8 aa, Artificial Sequence
  Description of Artificial Sequence: Synthetic peptide
  Seed: VMNPLETL (PRAME_HUMAN)
VQNPLETY

SEQ ID NO: 153412 - protein, 10 aa, Artificial Sequence
  Description of Artificial Sequence: Synthetic peptide
  Seed: LLLSHIHASS (PRAME_HUMAN)
LMLSHIHASI

SEQ ID NO: 153413 - protein, 11 aa, Artificial Sequence
  Description of Artificial Sequence: Synthetic peptide
  Seed: AALELLPRELF (PRAME_HUMAN)
ASLELLPRELW

SEQ ID NO: 153414 - protein, 10 aa, Artificial Sequence
  Description of Artificial Sequence: Synthetic peptide
  Seed: QSLLQHLIGL (PRAME_HUMAN)
QMLLQHLIGI

SEQ ID NO: 153415 - protein, 9 aa, Artificial Sequence
  Description of Artificial Sequence: Synthetic peptide
  Seed: KFSPYLGQM (PRAME_HUMAN)
KVSPYLGQL

SEQ ID NO: 153416 - protein, 9 aa, Artificial Sequence
  Description of Artificial Sequence: Synthetic peptide
  Seed: LQDLVFDEC (PRAME_HUMAN)
LEDLVFDEL

SEQ ID NO: 153417 - protein, 9 aa, Artificial Sequence
  Description of Artificial Sequence: Synthetic peptide
  Seed: QDIKMILKM (PRAME_HUMAN)
QEIKMILKY

SEQ ID NO: 153418 - protein, 9 aa, Artificial Sequence
  Description of Artificial Sequence: Synthetic peptide
  Seed: DSLFFLRGR (PRAME_HUMAN)
DTLFFLRGR

SEQ ID NO: 153419 - protein, 9 aa, Artificial Sequence
  Description of Artificial Sequence: Synthetic peptide
  Seed: SALQSLLQH (PRAME_HUMAN)
SALQSLLQR

SEQ ID NO: 153420 - protein, 10 aa, Artificial Sequence
  Description of Artificial Sequence: Synthetic peptide
  Seed: VTCTWKLPTL (PRAME_HUMAN)
VMCTWKLPTI

SEQ ID NO: 153421 - protein, 10 aa, Artificial Sequence
  Description of Artificial Sequence: Synthetic peptide
  Seed: RRRLWGSIQS (PRAME_HUMAN)
RCRLWGSIQR

SEQ ID NO: 153422 - protein, 10 aa, Artificial Sequence
  Description of Artificial Sequence: Synthetic peptide
  Seed: TFYDPEPILC (PRAME_HUMAN)
TMYDPEPILF

SEQ ID NO: 153423 - protein, 10 aa, Artificial Sequence
  Description of Artificial Sequence: Synthetic peptide
  Seed: ARLRELLCEL (PRAME_HUMAN)
AKLRELLCEL

SEQ ID NO: 153424 - protein, 9 aa, Artificial Sequence
  Description of Artificial Sequence: Synthetic peptide
  Seed: LLALLPSLS (PRAME_HUMAN)
LLALLPSLL

SEQ ID NO: 153425 - protein, 10 aa, Artificial Sequence
  Description of Artificial Sequence: Synthetic peptide
  Seed: RELFPPLFMA (PRAME_HUMAN)
RHLFPPLFMV

SEQ ID NO: 153426 - protein, 9 aa, Artificial Sequence
  Description of Artificial Sequence: Synthetic peptide
  Seed: LGRPSMVWL (PRAME_HUMAN)
LTRPSMVWV

SEQ ID NO: 153427 - protein, 10 aa, Artificial Sequence
  Description of Artificial Sequence: Synthetic peptide
  Seed: KKLKIFAMPM (PRAME_HUMAN)
KVLKIFAMPK

SEQ ID NO: 153428 - protein, 10 aa, Artificial Sequence
  Description of Artificial Sequence: Synthetic peptide
  Seed: MVQAWPFTCL (PRAME_HUMAN)
MWQAWPFTCY

SEQ ID NO: 153429 - protein, 10 aa, Artificial Sequence
  Description of Artificial Sequence: Synthetic peptide
  Seed: GLSNLTHVLY (PRAME_HUMAN)
GFSNLTHVLY

SEQ ID NO: 153430 - protein, 9 aa, Artificial Sequence
  Description of Artificial Sequence: Synthetic peptide
  Seed: MINLRRLLL (PRAME_HUMAN)
MYNLRRLLM

SEQ ID NO: 153431 - protein, 10 aa, Artificial Sequence
  Description of Artificial Sequence: Synthetic peptide
  Seed: LLPRELFPPL (PRAME_HUMAN)
LPPRELFPPV

SEQ ID NO: 153432 - protein, 10 aa, Artificial Sequence
  Description of Artificial Sequence: Synthetic peptide
  Seed: SNLTHVLYPV (PRAME_HUMAN)
SILTHVLYPL

SEQ ID NO: 153433 - protein, 9 aa, Artificial Sequence
  Description of Artificial Sequence: Synthetic peptide
  Seed: TLHLERLAY (PRAME_HUMAN)
TFHLERLAY

SEQ ID NO: 153434 - protein, 9 aa, Artificial Sequence
  Description of Artificial Sequence: Synthetic peptide
  Seed: YGNSISISA (PRAME_HUMAN)
YVNSISISI

SEQ ID NO: 153435 - protein, 11 aa, Artificial Sequence
  Description of Artificial Sequence: Synthetic peptide
  Seed: KAVLDGLDVLL (PRAME_HUMAN)
KIVLDGLDVLW

SEQ ID NO: 153436 - protein, 10 aa, Artificial Sequence
  Description of Artificial Sequence: Synthetic peptide
  Seed: LSQSPSVSQL (PRAME_HUMAN)
LPQSPSVSQM

SEQ ID NO: 153437 - protein, 9 aa, Artificial Sequence
  Description of Artificial Sequence: Synthetic peptide
  Seed: GNRASLYSF (PRAME_HUMAN)
GKRASLYSY

SEQ ID NO: 153438 - protein, 10 aa, Artificial Sequence
  Description of Artificial Sequence: Synthetic peptide
  Seed: IGLSNLTHVL (PRAME_HUMAN)
ILLSNLTHVY

SEQ ID NO: 153439 - protein, 11 aa, Artificial Sequence
  Description of Artificial Sequence: Synthetic peptide
  Seed: ALYVDSLFFLR (PRAME_HUMAN)
AFYVDSLFFLR

SEQ ID NO: 153440 - protein, 11 aa, Artificial Sequence
  Description of Artificial Sequence: Synthetic peptide
  Seed: RELFPPLFMAA (PRAME_HUMAN)
RYLFPPLFMAA

SEQ ID NO: 153441 - protein, 10 aa, Artificial Sequence
  Description of Artificial Sequence: Synthetic peptide
  Seed: SMSVWTSPRR (PRAME_HUMAN)
SSSVWTSPRK

SEQ ID NO: 153442 - protein, 9 aa, Artificial Sequence
  Description of Artificial Sequence: Synthetic peptide
  Seed: KLKIFAMPM (PRAME_HUMAN)
KSKIFAMPP

SEQ ID NO: 153443 - protein, 9 aa, Artificial Sequence
  Description of Artificial Sequence: Synthetic peptide
  Seed: HLETFKAVL (PRAME_HUMAN)
HMETFKAVF

SEQ ID NO: 153444 - protein, 9 aa, Artificial Sequence
  Description of Artificial Sequence: Synthetic peptide
  Seed: ETLSITNCR (PRAME_HUMAN)
ETLSITNCK

SEQ ID NO: 153445 - protein, 8 aa, Artificial Sequence
  Description of Artificial Sequence: Synthetic peptide
  Seed: HGTLHLER (PRAME_HUMAN)
HSTLHLEL

SEQ ID NO: 153446 - protein, 11 aa, Artificial Sequence
  Description of Artificial Sequence: Synthetic peptide
  Seed: LGRPSMVWLSA (PRAME_HUMAN)
LPRPSMVWLSA

SEQ ID NO: 153447 - protein, 10 aa, Artificial Sequence
  Description of Artificial Sequence: Synthetic peptide
  Seed: MLTDVSPEPL (PRAME_HUMAN)
MQTDVSPEPI

SEQ ID NO: 153448 - protein, 9 aa, Artificial Sequence
  Description of Artificial Sequence: Synthetic peptide
  Seed: IFAMPMQDI (PRAME_HUMAN)
IYAMPMQDM

SEQ ID NO: 153449 - protein, 10 aa, Artificial Sequence
  Description of Artificial Sequence: Synthetic peptide
  Seed: KVKRKKNVLR (PRAME_HUMAN)
KLKRKKNVLR

SEQ ID NO: 153450 - protein, 9 aa, Artificial Sequence
  Description of Artificial Sequence: Synthetic peptide
  Seed: HVMNPLETL (PRAME_HUMAN)
HEMNPLETC

SEQ ID NO: 153451 - protein, 9 aa, Artificial Sequence
  Description of Artificial Sequence: Synthetic peptide
  Seed: MQDIKMILK (PRAME_HUMAN)
MMDIKMILR

SEQ ID NO: 153452 - protein, 9 aa, Artificial Sequence
  Description of Artificial Sequence: Synthetic peptide
  Seed: FYDPEPILC (PRAME_HUMAN)
FSDPEPILA

SEQ ID NO: 153453 - protein, 11 aa, Artificial Sequence
  Description of Artificial Sequence: Synthetic peptide
  Seed: RASATLQDLVF (PRAME_HUMAN)
RMSATLQDLVY

SEQ ID NO: 153454 - protein, 9 aa, Artificial Sequence
  Description of Artificial Sequence: Synthetic peptide
  Seed: SYEDIHGTL (PRAME_HUMAN)
SMEDIHGTF

SEQ ID NO: 153455 - protein, 9 aa, Artificial Sequence
  Description of Artificial Sequence: Synthetic peptide
  Seed: LDQLLRHVM (PRAME_HUMAN)
LEQLLRHVP

SEQ ID NO: 153456 - protein, 10 aa, Artificial Sequence
  Description of Artificial Sequence: Synthetic peptide
  Seed: LLLSHIHASS (PRAME_HUMAN)
LCLSHIHASL

SEQ ID NO: 153457 - protein, 11 aa, Artificial Sequence
  Description of Artificial Sequence: Synthetic peptide
  Seed: RASATLQDLVF (PRAME_HUMAN)
RQSATLQDLVL

SEQ ID NO: 153458 - protein, 9 aa, Artificial Sequence
  Description of Artificial Sequence: Synthetic peptide
  Seed: FYDPEPILC (PRAME_HUMAN)
FSDPEPILL

SEQ ID NO: 153459 - protein, 9 aa, Artificial Sequence
  Description of Artificial Sequence: Synthetic peptide
  Seed: ISPEKEEQY (PRAME_HUMAN)
IPPEKEEQY

SEQ ID NO: 153460 - protein, 10 aa, Artificial Sequence
  Description of Artificial Sequence: Synthetic peptide
  Seed: TWKLPTLAKF (PRAME_HUMAN)
TYKLPTLAKL

SEQ ID NO: 153461 - protein, 9 aa, Artificial Sequence
  Description of Artificial Sequence: Synthetic peptide
  Seed: HLHLETFKA (PRAME_HUMAN)
HLHLETFKV

SEQ ID NO: 153462 - protein, 10 aa, Artificial Sequence
  Description of Artificial Sequence: Synthetic peptide
  Seed: KDEALAIAAL (PRAME_HUMAN)
KFEALAIAAA

SEQ ID NO: 153463 - protein, 9 aa, Artificial Sequence
  Description of Artificial Sequence: Synthetic peptide
  Seed: RLRELLCEL (PRAME_HUMAN)
RARELLCEV

SEQ ID NO: 153464 - protein, 9 aa, Artificial Sequence
  Description of Artificial Sequence: Synthetic peptide
  Seed: EDLEVTCTW (PRAME_HUMAN)
EALEVTCTY

SEQ ID NO: 153465 - protein, 9 aa, Artificial Sequence
  Description of Artificial Sequence: Synthetic peptide
  Seed: LAIAALELL (PRAME_HUMAN)
LLIAALELY

SEQ ID NO: 153466 - protein, 10 aa, Artificial Sequence
  Description of Artificial Sequence: Synthetic peptide
  Seed: LLSHIHASSY (PRAME_HUMAN)
LFSHIHASSF

SEQ ID NO: 153467 - protein, 9 aa, Artificial Sequence
  Description of Artificial Sequence: Synthetic peptide
  Seed: HVMNPLETL (PRAME_HUMAN)
HKMNPLETY

SEQ ID NO: 153468 - protein, 10 aa, Artificial Sequence
  Description of Artificial Sequence: Synthetic peptide
  Seed: SPSVSQLSVL (PRAME_HUMAN)
SMSVSQLSVW

SEQ ID NO: 153469 - protein, 8 aa, Artificial Sequence
  Description of Artificial Sequence: Synthetic peptide
  Seed: VMNPLETL (PRAME_HUMAN)
VANPLETL

SEQ ID NO: 153470 - protein, 10 aa, Artificial Sequence
  Description of Artificial Sequence: Synthetic peptide
  Seed: SYEDIHGTLH (PRAME_HUMAN)
SYEDIHGTLY

SEQ ID NO: 153471 - protein, 9 aa, Artificial Sequence
  Description of Artificial Sequence: Synthetic peptide
  Seed: FYDPEPILC (PRAME_HUMAN)
FADPEPILS

SEQ ID NO: 153472 - protein, 9 aa, Artificial Sequence
  Description of Artificial Sequence: Synthetic peptide
  Seed: NSHQDFWTV (PRAME_HUMAN)
NPHQDFWTI

SEQ ID NO: 153473 - protein, 10 aa, Artificial Sequence
  Description of Artificial Sequence: Synthetic peptide
  Seed: RWKLQVLDLR (PRAME_HUMAN)
RFKLQVLDLR

SEQ ID NO: 153474 - protein, 9 aa, Artificial Sequence
  Description of Artificial Sequence: Synthetic peptide
  Seed: SALQSLLQH (PRAME_HUMAN)
SSLQSLLQM

SEQ ID NO: 153475 - protein, 9 aa, Artificial Sequence
  Description of Artificial Sequence: Synthetic peptide
  Seed: KEEQYIAQF (PRAME_HUMAN)
KDEQYIAQF

SEQ ID NO: 153476 - protein, 9 aa, Artificial Sequence
  Description of Artificial Sequence: Synthetic peptide
  Seed: VSPEPLQAL (PRAME_HUMAN)
VQPEPLQAM

SEQ ID NO: 153477 - protein, 10 aa, Artificial Sequence
  Description of Artificial Sequence: Synthetic peptide
  Seed: AALELLPREL (PRAME_HUMAN)
ALLELLPREL

SEQ ID NO: 153478 - protein, 10 aa, Artificial Sequence
  Description of Artificial Sequence: Synthetic peptide
  Seed: LPTLAKFSPY (PRAME_HUMAN)
LPTLAKFSPM

SEQ ID NO: 153479 - protein, 9 aa, Artificial Sequence
  Description of Artificial Sequence: Synthetic peptide
  Seed: LELLPRELF (PRAME_HUMAN)
LKLLPRELY

SEQ ID NO: 153480 - protein, 10 aa, Artificial Sequence
  Description of Artificial Sequence: Synthetic peptide
  Seed: MVQAWPFTCL (PRAME_HUMAN)
MIQAWPFTCV

SEQ ID NO: 153481 - protein, 10 aa, Artificial Sequence
  Description of Artificial Sequence: Synthetic peptide
  Seed: MPMQDIKMIL (PRAME_HUMAN)
MVMQDIKMIV

SEQ ID NO: 153482 - protein, 9 aa, Artificial Sequence
  Description of Artificial Sequence: Synthetic peptide
  Seed: RLWGSIQSR (PRAME_HUMAN)
RLWGSIQSK

SEQ ID NO: 153483 - protein, 10 aa, Artificial Sequence
  Description of Artificial Sequence: Synthetic peptide
  Seed: SISISALQSL (PRAME_HUMAN)
SFSISALQSY

SEQ ID NO: 153484 - protein, 9 aa, Artificial Sequence
  Description of Artificial Sequence: Synthetic peptide
  Seed: KAMVQAWPF (PRAME_HUMAN)
KQMVQAWPA

SEQ ID NO: 153485 - protein, 9 aa, Artificial Sequence
  Description of Artificial Sequence: Synthetic peptide
  Seed: RASATLQDL (PRAME_HUMAN)
RVSATLQDF

SEQ ID NO: 153486 - protein, 11 aa, Artificial Sequence
  Description of Artificial Sequence: Synthetic peptide
  Seed: SLYSFPEPEAA (PRAME_HUMAN)
SLYSFPEPEAV

SEQ ID NO: 153487 - protein, 9 aa, Artificial Sequence
  Description of Artificial Sequence: Synthetic peptide
  Seed: AAFDGRHSQ (PRAME_HUMAN)
ASFDGRHSF

SEQ ID NO: 153488 - protein, 9 aa, Artificial Sequence
  Description of Artificial Sequence: Synthetic peptide
  Seed: LQDLVFDEC (PRAME_HUMAN)
LFDLVFDEL

SEQ ID NO: 153489 - protein, 10 aa, Artificial Sequence
  Description of Artificial Sequence: Synthetic peptide
  Seed: LLLSHIHASS (PRAME_HUMAN)
LALSHIHASV

SEQ ID NO: 153490 - protein, 11 aa, Artificial Sequence
  Description of Artificial Sequence: Synthetic peptide
  Seed: RRLLLSHIHAS (PRAME_HUMAN)
RRLLLSHIHAR

SEQ ID NO: 153491 - protein, 10 aa, Artificial Sequence
  Description of Artificial Sequence: Synthetic peptide
  Seed: CSQLTTLSFY (PRAME_HUMAN)
CSQLTTLSFF

SEQ ID NO: 153492 - protein, 10 aa, Artificial Sequence
  Description of Artificial Sequence: Synthetic peptide
  Seed: TTLSFYGNSI (PRAME_HUMAN)
TTLSFYGNSV

SEQ ID NO: 153493 - protein, 9 aa, Artificial Sequence
  Description of Artificial Sequence: Synthetic peptide
  Seed: KLKIFAMPM (PRAME_HUMAN)
KMKIFAMPA

SEQ ID NO: 153494 - protein, 9 aa, Artificial Sequence
  Description of Artificial Sequence: Synthetic peptide
  Seed: LSNLTHVLY (PRAME_HUMAN)
LSNLTHVLM

SEQ ID NO: 153495 - protein, 9 aa, Artificial Sequence
  Description of Artificial Sequence: Synthetic peptide
  Seed: MNPLETLSI (PRAME_HUMAN)
MRPLETLSL

SEQ ID NO: 153496 - protein, 9 aa, Artificial Sequence
  Description of Artificial Sequence: Synthetic peptide
  Seed: SPEPLQALL (PRAME_HUMAN)
SWEPLQALM

SEQ ID NO: 153497 - protein, 9 aa, Artificial Sequence
  Description of Artificial Sequence: Synthetic peptide
  Seed: VLMKGQHLH (PRAME_HUMAN)
VIMKGQHLR

SEQ ID NO: 153498 - protein, 11 aa, Artificial Sequence
  Description of Artificial Sequence: Synthetic peptide
  Seed: VQLDSIEDLEV (PRAME_HUMAN)
VLLDSIEDLEL

SEQ ID NO: 153499 - protein, 11 aa, Artificial Sequence
  Description of Artificial Sequence: Synthetic peptide
  Seed: HLSQSPSVSQL (PRAME_HUMAN)
HVSQSPSVSQY

SEQ ID NO: 153500 - protein, 10 aa, Artificial Sequence
  Description of Artificial Sequence: Synthetic peptide
  Seed: RLWGSIQSRY (PRAME_HUMAN)
RIWGSIQSRR

SEQ ID NO: 153501 - protein, 9 aa, Artificial Sequence
  Description of Artificial Sequence: Synthetic peptide
  Seed: LDVLLAQEV (PRAME_HUMAN)
LEVLLAQEM

SEQ ID NO: 153502 - protein, 10 aa, Artificial Sequence
  Description of Artificial Sequence: Synthetic peptide
  Seed: ARLRELLCEL (PRAME_HUMAN)
AILRELLCEV

SEQ ID NO: 153503 - protein, 9 aa, Artificial Sequence
  Description of Artificial Sequence: Synthetic peptide
  Seed: SATLQDLVF (PRAME_HUMAN)
SQTLQDLVL

SEQ ID NO: 153504 - protein, 9 aa, Artificial Sequence
  Description of Artificial Sequence: Synthetic peptide
  Seed: KVKRKKNVL (PRAME_HUMAN)
KTKRKKNVA

SEQ ID NO: 153505 - protein, 10 aa, Artificial Sequence
  Description of Artificial Sequence: Synthetic peptide
  Seed: RPSMVWLSAN (PRAME_HUMAN)
RPSMVWLSAF

SEQ ID NO: 153506 - protein, 10 aa, Artificial Sequence
  Description of Artificial Sequence: Synthetic peptide
  Seed: KGQHLHLETF (PRAME_HUMAN)
KWQHLHLETF

SEQ ID NO: 153507 - protein, 10 aa, Artificial Sequence
  Description of Artificial Sequence: Synthetic peptide
  Seed: ELFPPLFMAA (PRAME_HUMAN)
EVFPPLFMAI

SEQ ID NO: 153508 - protein, 9 aa, Artificial Sequence
  Description of Artificial Sequence: Synthetic peptide
  Seed: SQLTTLSFY (PRAME_HUMAN)
SWLTTLSFY

SEQ ID NO: 153509 - protein, 9 aa, Artificial Sequence
  Description of Artificial Sequence: Synthetic peptide
  Seed: ALYVDSLFF (PRAME_HUMAN)
AQYVDSLFW

SEQ ID NO: 153510 - protein, 10 aa, Artificial Sequence
  Description of Artificial Sequence: Synthetic peptide
  Seed: KGQHLHLETF (PRAME_HUMAN)
KKQHLHLETF

SEQ ID NO: 153511 - protein, 9 aa, Artificial Sequence
  Description of Artificial Sequence: Synthetic peptide
  Seed: VFDECGITD (PRAME_HUMAN)
VSDECGITM

SEQ ID NO: 153512 - protein, 9 aa, Artificial Sequence
  Description of Artificial Sequence: Synthetic peptide
  Seed: LLALLPSLS (PRAME_HUMAN)
LMALLPSLV

SEQ ID NO: 153513 - protein, 10 aa, Artificial Sequence
  Description of Artificial Sequence: Synthetic peptide
  Seed: RLWGSIQSRY (PRAME_HUMAN)
RSWGSIQSRY

SEQ ID NO: 153514 - protein, 11 aa, Artificial Sequence
  Description of Artificial Sequence: Synthetic peptide
  Seed: LVELAGQSLLK (PRAME_HUMAN)
LAELAGQSLLY

SEQ ID NO: 153515 - protein, 8 aa, Artificial Sequence
  Description of Artificial Sequence: Synthetic peptide
  Seed: LELLPREL (PRAME_HUMAN)
LELLPREV

SEQ ID NO: 153516 - protein, 8 aa, Artificial Sequence
  Description of Artificial Sequence: Synthetic peptide
  Seed: MQDIKMIL (PRAME_HUMAN)
MYDIKMIL

SEQ ID NO: 153517 - protein, 9 aa, Artificial Sequence
  Description of Artificial Sequence: Synthetic peptide
  Seed: YIAQFTSQF (PRAME_HUMAN)
YQAQFTSQY

SEQ ID NO: 153518 - protein, 10 aa, Artificial Sequence
  Description of Artificial Sequence: Synthetic peptide
  Seed: TTLSFYGNSI (PRAME_HUMAN)
TMLSFYGNSI

SEQ ID NO: 153519 - protein, 9 aa, Artificial Sequence
  Description of Artificial Sequence: Synthetic peptide
  Seed: ALAIAALEL (PRAME_HUMAN)
ATAIAALEY

SEQ ID NO: 153520 - protein, 9 aa, Artificial Sequence
  Description of Artificial Sequence: Synthetic peptide
  Seed: LALLPSLSH (PRAME_HUMAN)
LHLLPSLSM

SEQ ID NO: 153521 - protein, 9 aa, Artificial Sequence
  Description of Artificial Sequence: Synthetic peptide
  Seed: FYDPEPILC (PRAME_HUMAN)
FMDPEPILM

SEQ ID NO: 153522 - protein, 9 aa, Artificial Sequence
  Description of Artificial Sequence: Synthetic peptide
  Seed: LLRHVMNPL (PRAME_HUMAN)
LIRHVMNPV

SEQ ID NO: 153523 - protein, 9 aa, Artificial Sequence
  Description of Artificial Sequence: Synthetic peptide
  Seed: RASATLQDL (PRAME_HUMAN)
RISATLQDV

SEQ ID NO: 153524 - protein, 10 aa, Artificial Sequence
  Description of Artificial Sequence: Synthetic peptide
  Seed: QLSVLSLSGV (PRAME_HUMAN)
QLSVLSLSGI

SEQ ID NO: 153525 - protein, 11 aa, Artificial Sequence
  Description of Artificial Sequence: Synthetic peptide
  Seed: AAFDGRHSQTL (PRAME_HUMAN)
AEFDGRHSQTL

SEQ ID NO: 153526 - protein, 9 aa, Artificial Sequence
  Description of Artificial Sequence: Synthetic peptide
  Seed: VSPEPLQAL (PRAME_HUMAN)
VVPEPLQAA

SEQ ID NO: 153527 - protein, 9 aa, Artificial Sequence
  Description of Artificial Sequence: Synthetic peptide
  Seed: SRYISMSVW (PRAME_HUMAN)
SKYISMSVM

SEQ ID NO: 153528 - protein, 11 aa, Artificial Sequence
  Description of Artificial Sequence: Synthetic peptide
  Seed: LQSLLQHLIGL (PRAME_HUMAN)
LVSLLQHLIGV

SEQ ID NO: 153529 - protein, 9 aa, Artificial Sequence
  Description of Artificial Sequence: Synthetic peptide
  Seed: CKKLKIFAM (PRAME_HUMAN)
CNKLKIFAL

SEQ ID NO: 153530 - protein, 9 aa, Artificial Sequence
  Description of Artificial Sequence: Synthetic peptide
  Seed: LMKGQHLHL (PRAME_HUMAN)
LAKGQHLHL

SEQ ID NO: 153531 - protein, 9 aa, Artificial Sequence
  Description of Artificial Sequence: Synthetic peptide
  Seed: ALYVDSLFF (PRAME_HUMAN)
AVYVDSLFY

SEQ ID NO: 153532 - protein, 10 aa, Artificial Sequence
  Description of Artificial Sequence: Synthetic peptide
  Seed: SALQSLLQHL (PRAME_HUMAN)
SLLQSLLQHM

SEQ ID NO: 153533 - protein, 10 aa, Artificial Sequence
  Description of Artificial Sequence: Synthetic peptide
  Seed: QSLLQHLIGL (PRAME_HUMAN)
QWLLQHLIGI

SEQ ID NO: 153534 - protein, 9 aa, Artificial Sequence
  Description of Artificial Sequence: Synthetic peptide
  Seed: SQFLSLQCL (PRAME_HUMAN)
SKFLSLQCY

SEQ ID NO: 153535 - protein, 10 aa, Artificial Sequence
  Description of Artificial Sequence: Synthetic peptide
  Seed: SLQCLQALYV (PRAME_HUMAN)
SMQCLQALYV

SEQ ID NO: 153536 - protein, 9 aa, Artificial Sequence
  Description of Artificial Sequence: Synthetic peptide
  Seed: SFYGNSISI (PRAME_HUMAN)
SRYGNSISI

SEQ ID NO: 153537 - protein, 9 aa, Artificial Sequence
  Description of Artificial Sequence: Synthetic peptide
  Seed: LSHIHASSY (PRAME_HUMAN)
LAHIHASSV

SEQ ID NO: 153538 - protein, 10 aa, Artificial Sequence
  Description of Artificial Sequence: Synthetic peptide
  Seed: GACDELFSYL (PRAME_HUMAN)
GLCDELFSYF

SEQ ID NO: 153539 - protein, 9 aa, Artificial Sequence
  Description of Artificial Sequence: Synthetic peptide
  Seed: NSHQDFWTV (PRAME_HUMAN)
NVHQDFWTW

SEQ ID NO: 153540 - protein, 10 aa, Artificial Sequence
  Description of Artificial Sequence: Synthetic peptide
  Seed: SLLKDEALAI (PRAME_HUMAN)
SMLKDEALAL

SEQ ID NO: 153541 - protein, 9 aa, Artificial Sequence
  Description of Artificial Sequence: Synthetic peptide
  Seed: SQLTTLSFY (PRAME_HUMAN)
SQLTTLSFF

SEQ ID NO: 153542 - protein, 9 aa, Artificial Sequence
  Description of Artificial Sequence: Synthetic peptide
  Seed: VLDGLDVLL (PRAME_HUMAN)
VYDGLDVLL

SEQ ID NO: 153543 - protein, 10 aa, Artificial Sequence
  Description of Artificial Sequence: Synthetic peptide
  Seed: SMVWLSANPC (PRAME_HUMAN)
SMVWLSANPL

SEQ ID NO: 153544 - protein, 9 aa, Artificial Sequence
  Description of Artificial Sequence: Synthetic peptide
  Seed: GNRASLYSF (PRAME_HUMAN)
GMRASLYSM

SEQ ID NO: 153545 - protein, 10 aa, Artificial Sequence
  Description of Artificial Sequence: Synthetic peptide
  Seed: HASSYISPEK (PRAME_HUMAN)
HVSSYISPER

SEQ ID NO: 153546 - protein, 9 aa, Artificial Sequence
  Description of Artificial Sequence: Synthetic peptide
  Seed: EQPFIPVEV (PRAME_HUMAN)
EHPFIPVEA

SEQ ID NO: 153547 - protein, 10 aa, Artificial Sequence
  Description of Artificial Sequence: Synthetic peptide
  Seed: AVLDGLDVLL (PRAME_HUMAN)
AMLDGLDVLA

SEQ ID NO: 153548 - protein, 9 aa, Artificial Sequence
  Description of Artificial Sequence: Synthetic peptide
  Seed: ITDDQLLAL (PRAME_HUMAN)
IADDQLLAA

SEQ ID NO: 153549 - protein, 9 aa, Artificial Sequence
  Description of Artificial Sequence: Synthetic peptide
  Seed: LYVDSLFFL (PRAME_HUMAN)
LLVDSLFFM

SEQ ID NO: 153550 - protein, 10 aa, Artificial Sequence
  Description of Artificial Sequence: Synthetic peptide
  Seed: ISPEKEEQYI (PRAME_HUMAN)
IVPEKEEQYL

SEQ ID NO: 153551 - protein, 10 aa, Artificial Sequence
  Description of Artificial Sequence: Synthetic peptide
  Seed: LERLAYLHAR (PRAME_HUMAN)
LMRLAYLHAK

SEQ ID NO: 153552 - protein, 10 aa, Artificial Sequence
  Description of Artificial Sequence: Synthetic peptide
  Seed: RELFPPLFMA (PRAME_HUMAN)
RLLFPPLFMM

SEQ ID NO: 153553 - protein, 10 aa, Artificial Sequence
  Description of Artificial Sequence: Synthetic peptide
  Seed: SNLTHVLYPV (PRAME_HUMAN)
SQLTHVLYPI

SEQ ID NO: 153554 - protein, 9 aa, Artificial Sequence
  Description of Artificial Sequence: Synthetic peptide
  Seed: GACDELFSY (PRAME_HUMAN)
GTCDELFSK

SEQ ID NO: 153555 - protein, 9 aa, Artificial Sequence
  Description of Artificial Sequence: Synthetic peptide
  Seed: LALLPSLSH (PRAME_HUMAN)
LKLLPSLSY

SEQ ID NO: 153556 - protein, 10 aa, Artificial Sequence
  Description of Artificial Sequence: Synthetic peptide
  Seed: RTFYDPEPIL (PRAME_HUMAN)
RQFYDPEPIV

SEQ ID NO: 153557 - protein, 9 aa, Artificial Sequence
  Description of Artificial Sequence: Synthetic peptide
  Seed: KAMVQAWPF (PRAME_HUMAN)
KIMVQAWPM

SEQ ID NO: 153558 - protein, 9 aa, Artificial Sequence
  Description of Artificial Sequence: Synthetic peptide
  Seed: FPPLFMAAF (PRAME_HUMAN)
FVPLFMAAL

SEQ ID NO: 153559 - protein, 10 aa, Artificial Sequence
  Description of Artificial Sequence: Synthetic peptide
  Seed: KGQHLHLETF (PRAME_HUMAN)
KMQHLHLETY

SEQ ID NO: 153560 - protein, 9 aa, Artificial Sequence
  Description of Artificial Sequence: Synthetic peptide
  Seed: TLHLERLAY (PRAME_HUMAN)
TQHLERLAF

SEQ ID NO: 153561 - protein, 11 aa, Artificial Sequence
  Description of Artificial Sequence: Synthetic peptide
  Seed: ALYVDSLFFLR (PRAME_HUMAN)
AQYVDSLFFLK

SEQ ID NO: 153562 - protein, 11 aa, Artificial Sequence
  Description of Artificial Sequence: Synthetic peptide
  Seed: FTSQFLSLQCL (PRAME_HUMAN)
FQSQFLSLQCV

SEQ ID NO: 153563 - protein, 11 aa, Artificial Sequence
  Description of Artificial Sequence: Synthetic peptide
  Seed: FLSLQCLQALY (PRAME_HUMAN)
FDSLQCLQALL

SEQ ID NO: 153564 - protein, 11 aa, Artificial Sequence
  Description of Artificial Sequence: Synthetic peptide
  Seed: ALYVDSLFFLR (PRAME_HUMAN)
ALYVDSLFFLQ

SEQ ID NO: 153565 - protein, 9 aa, Artificial Sequence
  Description of Artificial Sequence: Synthetic peptide
  Seed: ELAGQSLLK (PRAME_HUMAN)
EGAGQSLLR

SEQ ID NO: 153566 - protein, 10 aa, Artificial Sequence
  Description of Artificial Sequence: Synthetic peptide
  Seed: ELFSYLIEKV (PRAME_HUMAN)
EVFSYLIEKA

SEQ ID NO: 153567 - protein, 11 aa, Artificial Sequence
  Description of Artificial Sequence: Synthetic peptide
  Seed: ELFSYLIEKVK (PRAME_HUMAN)
ETFSYLIEKVR

SEQ ID NO: 153568 - protein, 9 aa, Artificial Sequence
  Description of Artificial Sequence: Synthetic peptide
  Seed: FLRGRLDQL (PRAME_HUMAN)
FMRGRLDQM

SEQ ID NO: 153569 - protein, 11 aa, Artificial Sequence
  Description of Artificial Sequence: Synthetic peptide
  Seed: LSLQCLQALYV (PRAME_HUMAN)
LMLQCLQALYV

SEQ ID NO: 153570 - protein, 9 aa, Artificial Sequence
  Description of Artificial Sequence: Synthetic peptide
  Seed: SRYISMSVW (PRAME_HUMAN)
SLYISMSVF

SEQ ID NO: 153571 - protein, 9 aa, Artificial Sequence
  Description of Artificial Sequence: Synthetic peptide
  Seed: FYDPEPILC (PRAME_HUMAN)
FEDPEPILI

SEQ ID NO: 153572 - protein, 10 aa, Artificial Sequence
  Description of Artificial Sequence: Synthetic peptide
  Seed: GACDELFSYL (PRAME_HUMAN)
GTCDELFSYV

SEQ ID NO: 153573 - protein, 10 aa, Artificial Sequence
  Description of Artificial Sequence: Synthetic peptide
  Seed: KIFAMPMQDI (PRAME_HUMAN)
KMFAMPMQDL

SEQ ID NO: 153574 - protein, 9 aa, Artificial Sequence
  Description of Artificial Sequence: Synthetic peptide
  Seed: SQSPSVSQL (PRAME_HUMAN)
SMSPSVSQR

SEQ ID NO: 153575 - protein, 9 aa, Artificial Sequence
  Description of Artificial Sequence: Synthetic peptide
  Seed: LAIAALELL (PRAME_HUMAN)
LPIAALELI

SEQ ID NO: 153576 - protein, 10 aa, Artificial Sequence
  Description of Artificial Sequence: Synthetic peptide
  Seed: DELFSYLIEK (PRAME_HUMAN)
DVLFSYLIER

SEQ ID NO: 153577 - protein, 9 aa, Artificial Sequence
  Description of Artificial Sequence: Synthetic peptide
  Seed: YLHARLREL (PRAME_HUMAN)
YRHARLREI

SEQ ID NO: 153578 - protein, 9 aa, Artificial Sequence
  Description of Artificial Sequence: Synthetic peptide
  Seed: EPLQALLER (PRAME_HUMAN)
EMLQALLEK

SEQ ID NO: 153579 - protein, 11 aa, Artificial Sequence
  Description of Artificial Sequence: Synthetic peptide
  Seed: KLPTLAKFSPY (PRAME_HUMAN)
KQPTLAKFSPY

SEQ ID NO: 153580 - protein, 9 aa, Artificial Sequence
  Description of Artificial Sequence: Synthetic peptide
  Seed: ALQSLLQHL (PRAME_HUMAN)
ATQSLLQHV

SEQ ID NO: 153581 - protein, 10 aa, Artificial Sequence
  Description of Artificial Sequence: Synthetic peptide
  Seed: SPSVSQLSVL (PRAME_HUMAN)
SSSVSQLSVF

SEQ ID NO: 153582 - protein, 10 aa, Artificial Sequence
  Description of Artificial Sequence: Synthetic peptide
  Seed: IQSRYISMSV (PRAME_HUMAN)
INSRYISMSA

SEQ ID NO: 153583 - protein, 10 aa, Artificial Sequence
  Description of Artificial Sequence: Synthetic peptide
  Seed: ALELLPRELF (PRAME_HUMAN)
AYELLPRELW

SEQ ID NO: 153584 - protein, 9 aa, Artificial Sequence
  Description of Artificial Sequence: Synthetic peptide
  Seed: LSNLTHVLY (PRAME_HUMAN)
LPNLTHVLL

SEQ ID NO: 153585 - protein, 10 aa, Artificial Sequence
  Description of Artificial Sequence: Synthetic peptide
  Seed: MVQAWPFTCL (PRAME_HUMAN)
MLQAWPFTCI

SEQ ID NO: 153586 - protein, 10 aa, Artificial Sequence
  Description of Artificial Sequence: Synthetic peptide
  Seed: LPTLAKFSPY (PRAME_HUMAN)
LWTLAKFSPF

SEQ ID NO: 153587 - protein, 9 aa, Artificial Sequence
  Description of Artificial Sequence: Synthetic peptide
  Seed: MINLRRLLL (PRAME_HUMAN)
MPNLRRLLF

SEQ ID NO: 153588 - protein, 11 aa, Artificial Sequence
  Description of Artificial Sequence: Synthetic peptide
  Seed: RELFPPLFMAA (PRAME_HUMAN)
RFLFPPLFMAL

SEQ ID NO: 153589 - protein, 9 aa, Artificial Sequence
  Description of Artificial Sequence: Synthetic peptide
  Seed: VQLDSIEDL (PRAME_HUMAN)
VLLDSIEDY

SEQ ID NO: 153590 - protein, 9 aa, Artificial Sequence
  Description of Artificial Sequence: Synthetic peptide
  Seed: EDLEVTCTW (PRAME_HUMAN)
EILEVTCTL

SEQ ID NO: 153591 - protein, 10 aa, Artificial Sequence
  Description of Artificial Sequence: Synthetic peptide
  Seed: AALELLPREL (PRAME_HUMAN)
AMLELLPREL

SEQ ID NO: 153592 - protein, 11 aa, Artificial Sequence
  Description of Artificial Sequence: Synthetic peptide
  Seed: FSPYLGQMINL (PRAME_HUMAN)
FDPYLGQMINF

SEQ ID NO: 153593 - protein, 9 aa, Artificial Sequence
  Description of Artificial Sequence: Synthetic peptide
  Seed: SQLTTLSFY (PRAME_HUMAN)
STLTTLSFY

SEQ ID NO: 153594 - protein, 11 aa, Artificial Sequence
  Description of Artificial Sequence: Synthetic peptide
  Seed: LPTLAKFSPYL (PRAME_HUMAN)
LRTLAKFSPYI

SEQ ID NO: 153595 - protein, 10 aa, Artificial Sequence
  Description of Artificial Sequence: Synthetic peptide
  Seed: AVLDGLDVLL (PRAME_HUMAN)
ATLDGLDVLF

SEQ ID NO: 153596 - protein, 10 aa, Artificial Sequence
  Description of Artificial Sequence: Synthetic peptide
  Seed: LTHVLYPVPL (PRAME_HUMAN)
LTHVLYPVPY

SEQ ID NO: 153597 - protein, 11 aa, Artificial Sequence
  Description of Artificial Sequence: Synthetic peptide
  Seed: RASATLQDLVF (PRAME_HUMAN)
RLSATLQDLVY

SEQ ID NO: 153598 - protein, 10 aa, Artificial Sequence
  Description of Artificial Sequence: Synthetic peptide
  Seed: LSQSPSVSQL (PRAME_HUMAN)
LTQSPSVSQF

SEQ ID NO: 153599 - protein, 9 aa, Artificial Sequence
  Description of Artificial Sequence: Synthetic peptide
  Seed: KAMVQAWPF (PRAME_HUMAN)
KIMVQAWPW

SEQ ID NO: 153600 - protein, 11 aa, Artificial Sequence
  Description of Artificial Sequence: Synthetic peptide
  Seed: RASATLQDLVF (PRAME_HUMAN)
RSSATLQDLVY

SEQ ID NO: 153601 - protein, 10 aa, Artificial Sequence
  Description of Artificial Sequence: Synthetic peptide
  Seed: SPRRLVELAG (PRAME_HUMAN)
SPRRLVELAL

SEQ ID NO: 153602 - protein, 10 aa, Artificial Sequence
  Description of Artificial Sequence: Synthetic peptide
  Seed: SALQSLLQHL (PRAME_HUMAN)
SMLQSLLQHV

SEQ ID NO: 153603 - protein, 11 aa, Artificial Sequence
  Description of Artificial Sequence: Synthetic peptide
  Seed: FKAVLDGLDVL (PRAME_HUMAN)
FLAVLDGLDVL

SEQ ID NO: 153604 - protein, 11 aa, Artificial Sequence
  Description of Artificial Sequence: Synthetic peptide
  Seed: IAQFTSQFLSL (PRAME_HUMAN)
ITQFTSQFLSY

SEQ ID NO: 153605 - protein, 11 aa, Artificial Sequence
  Description of Artificial Sequence: Synthetic peptide
  Seed: LQSLLQHLIGL (PRAME_HUMAN)
LLSLLQHLIGV

SEQ ID NO: 153606 - protein, 9 aa, Artificial Sequence
  Description of Artificial Sequence: Synthetic peptide
  Seed: THVLYPVPL (PRAME_HUMAN)
TRVLYPVPL

SEQ ID NO: 153607 - protein, 9 aa, Artificial Sequence
  Description of Artificial Sequence: Synthetic peptide
  Seed: TLKAMVQAW (PRAME_HUMAN)
TIKAMVQAF

SEQ ID NO: 153608 - protein, 10 aa, Artificial Sequence
  Description of Artificial Sequence: Synthetic peptide
  Seed: RASATLQDLV (PRAME_HUMAN)
RPSATLQDLW

SEQ ID NO: 153609 - protein, 10 aa, Artificial Sequence
  Description of Artificial Sequence: Synthetic peptide
  Seed: MNPLETLSIT (PRAME_HUMAN)
MHPLETLSIV

SEQ ID NO: 153610 - protein, 8 aa, Artificial Sequence
  Description of Artificial Sequence: Synthetic peptide
  Seed: QPFIPVEV (PRAME_HUMAN)
QQFIPVEL

SEQ ID NO: 153611 - protein, 9 aa, Artificial Sequence
  Description of Artificial Sequence: Synthetic peptide
  Seed: VSPEPLQAL (PRAME_HUMAN)
VVPEPLQAK

SEQ ID NO: 153612 - protein, 9 aa, Artificial Sequence
  Description of Artificial Sequence: Synthetic peptide
  Seed: FLRGRLDQL (PRAME_HUMAN)
FVRGRLDQI

SEQ ID NO: 153613 - protein, 11 aa, Artificial Sequence
  Description of Artificial Sequence: Synthetic peptide
  Seed: RRRLWGSIQSR (PRAME_HUMAN)
RVRLWGSIQSR

SEQ ID NO: 153614 - protein, 9 aa, Artificial Sequence
  Description of Artificial Sequence: Synthetic peptide
  Seed: SISALQSLL (PRAME_HUMAN)
SMSALQSLI

SEQ ID NO: 153615 - protein, 9 aa, Artificial Sequence
  Description of Artificial Sequence: Synthetic peptide
  Seed: HVMNPLETL (PRAME_HUMAN)
HRMNPLETY

SEQ ID NO: 153616 - protein, 9 aa, Artificial Sequence
  Description of Artificial Sequence: Synthetic peptide
  Seed: LMKGQHLHL (PRAME_HUMAN)
LIKGQHLHK

SEQ ID NO: 153617 - protein, 11 aa, Artificial Sequence
  Description of Artificial Sequence: Synthetic peptide
  Seed: RASATLQDLVF (PRAME_HUMAN)
RSSATLQDLVW

SEQ ID NO: 153618 - protein, 9 aa, Artificial Sequence
  Description of Artificial Sequence: Synthetic peptide
  Seed: LLLSHIHAS (PRAME_HUMAN)
LQLSHIHAL

SEQ ID NO: 153619 - protein, 10 aa, Artificial Sequence
  Description of Artificial Sequence: Synthetic peptide
  Seed: LLSHIHASSY (PRAME_HUMAN)
LDSHIHASSF

SEQ ID NO: 153620 - protein, 10 aa, Artificial Sequence
  Description of Artificial Sequence: Synthetic peptide
  Seed: RRRLWGSIQS (PRAME_HUMAN)
RDRLWGSIQR

SEQ ID NO: 153621 - protein, 9 aa, Artificial Sequence
  Description of Artificial Sequence: Synthetic peptide
  Seed: KLKIFAMPM (PRAME_HUMAN)
KAKIFAMPK

SEQ ID NO: 153622 - protein, 9 aa, Artificial Sequence
  Description of Artificial Sequence: Synthetic peptide
  Seed: RELFPPLFM (PRAME_HUMAN)
RMLFPPLFM

SEQ ID NO: 153623 - protein, 9 aa, Artificial Sequence
  Description of Artificial Sequence: Synthetic peptide
  Seed: GLSNLTHVL (PRAME_HUMAN)
GLSNLTHVM

SEQ ID NO: 153624 - protein, 9 aa, Artificial Sequence
  Description of Artificial Sequence: Synthetic peptide
  Seed: NLTHVLYPV (PRAME_HUMAN)
NSTHVLYPV

SEQ ID NO: 153625 - protein, 10 aa, Artificial Sequence
  Description of Artificial Sequence: Synthetic peptide
  Seed: RASATLQDLV (PRAME_HUMAN)
RCSATLQDLF

SEQ ID NO: 153626 - protein, 11 aa, Artificial Sequence
  Description of Artificial Sequence: Synthetic peptide
  Seed: AMVQAWPFTCL (PRAME_HUMAN)
AMVQAWPFTCV

SEQ ID NO: 153627 - protein, 10 aa, Artificial Sequence
  Description of Artificial Sequence: Synthetic peptide
  Seed: DQLLALLPSL (PRAME_HUMAN)
DWLLALLPSI

SEQ ID NO: 153628 - protein, 9 aa, Artificial Sequence
  Description of Artificial Sequence: Synthetic peptide
  Seed: CKKLKIFAM (PRAME_HUMAN)
CSKLKIFAM

SEQ ID NO: 153629 - protein, 10 aa, Artificial Sequence
  Description of Artificial Sequence: Synthetic peptide
  Seed: LYVDSLFFLR (PRAME_HUMAN)
LRVDSLFFLR

SEQ ID NO: 153630 - protein, 10 aa, Artificial Sequence
  Description of Artificial Sequence: Synthetic peptide
  Seed: KDEALAIAAL (PRAME_HUMAN)
KWEALAIAAL

SEQ ID NO: 153631 - protein, 9 aa, Artificial Sequence
  Description of Artificial Sequence: Synthetic peptide
  Seed: LAIAALELL (PRAME_HUMAN)
LKIAALELY

SEQ ID NO: 153632 - protein, 10 aa, Artificial Sequence
  Description of Artificial Sequence: Synthetic peptide
  Seed: FIPVEVLVDL (PRAME_HUMAN)
FMPVEVLVDI

SEQ ID NO: 153633 - protein, 9 aa, Artificial Sequence
  Description of Artificial Sequence: Synthetic peptide
  Seed: EPLQALLER (PRAME_HUMAN)
ETLQALLEH

SEQ ID NO: 153634 - protein, 9 aa, Artificial Sequence
  Description of Artificial Sequence: Synthetic peptide
  Seed: VLDGLDVLL (PRAME_HUMAN)
VLDGLDVLW

SEQ ID NO: 153635 - protein, 9 aa, Artificial Sequence
  Description of Artificial Sequence: Synthetic peptide
  Seed: SFYGNSISI (PRAME_HUMAN)
SWYGNSISV

SEQ ID NO: 153636 - protein, 9 aa, Artificial Sequence
  Description of Artificial Sequence: Synthetic peptide
  Seed: VLDGLDVLL (PRAME_HUMAN)
VIDGLDVLI

SEQ ID NO: 153637 - protein, 10 aa, Artificial Sequence
  Description of Artificial Sequence: Synthetic peptide
  Seed: KGQHLHLETF (PRAME_HUMAN)
KFQHLHLETY

SEQ ID NO: 153638 - protein, 11 aa, Artificial Sequence
  Description of Artificial Sequence: Synthetic peptide
  Seed: SIQSRYISMSV (PRAME_HUMAN)
SKQSRYISMSK

SEQ ID NO: 153639 - protein, 10 aa, Artificial Sequence
  Description of Artificial Sequence: Synthetic peptide
  Seed: YIAQFTSQFL (PRAME_HUMAN)
YMAQFTSQFT

SEQ ID NO: 153640 - protein, 11 aa, Artificial Sequence
  Description of Artificial Sequence: Synthetic peptide
  Seed: RLRELLCELGR (PRAME_HUMAN)
RFRELLCELGR

SEQ ID NO: 153641 - protein, 11 aa, Artificial Sequence
  Description of Artificial Sequence: Synthetic peptide
  Seed: FAMPMQDIKMI (PRAME_HUMAN)
FTMPMQDIKMW

SEQ ID NO: 153642 - protein, 9 aa, Artificial Sequence
  Description of Artificial Sequence: Synthetic peptide
  Seed: LTDVSPEPL (PRAME_HUMAN)
LLDVSPEPM

SEQ ID NO: 153643 - protein, 11 aa, Artificial Sequence
  Description of Artificial Sequence: Synthetic peptide
  Seed: RELFPPLFMAA (PRAME_HUMAN)
RQLFPPLFMAV

SEQ ID NO: 153644 - protein, 10 aa, Artificial Sequence
  Description of Artificial Sequence: Synthetic peptide
  Seed: ALYVDSLFFL (PRAME_HUMAN)
ALYVDSLFFA

SEQ ID NO: 153645 - protein, 10 aa, Artificial Sequence
  Description of Artificial Sequence: Synthetic peptide
  Seed: RRRLWGSIQS (PRAME_HUMAN)
RERLWGSIQR

SEQ ID NO: 153646 - protein, 10 aa, Artificial Sequence
  Description of Artificial Sequence: Synthetic peptide
  Seed: KKLKIFAMPM (PRAME_HUMAN)
KTLKIFAMPG

SEQ ID NO: 153647 - protein, 9 aa, Artificial Sequence
  Description of Artificial Sequence: Synthetic peptide
  Seed: LYPVPLESY (PRAME_HUMAN)
LWPVPLESW

SEQ ID NO: 153648 - protein, 9 aa, Artificial Sequence
  Description of Artificial Sequence: Synthetic peptide
  Seed: YGNSISISA (PRAME_HUMAN)
YTNSISISH

SEQ ID NO: 153649 - protein, 9 aa, Artificial Sequence
  Description of Artificial Sequence: Synthetic peptide
  Seed: LSHIHASSY (PRAME_HUMAN)
LIHIHASSW

SEQ ID NO: 153650 - protein, 10 aa, Artificial Sequence
  Description of Artificial Sequence: Synthetic peptide
  Seed: RLWGSIQSRY (PRAME_HUMAN)
RNWGSIQSRY

SEQ ID NO: 153651 - protein, 9 aa, Artificial Sequence
  Description of Artificial Sequence: Synthetic peptide
  Seed: ISISALQSL (PRAME_HUMAN)
IIISALQSI

SEQ ID NO: 153652 - protein, 9 aa, Artificial Sequence
  Description of Artificial Sequence: Synthetic peptide
  Seed: RTFYDPEPI (PRAME_HUMAN)
RGFYDPEPW

SEQ ID NO: 153653 - protein, 9 aa, Artificial Sequence
  Description of Artificial Sequence: Synthetic peptide
  Seed: AAFDGRHSQ (PRAME_HUMAN)
ALFDGRHSM

SEQ ID NO: 153654 - protein, 9 aa, Artificial Sequence
  Description of Artificial Sequence: Synthetic peptide
  Seed: NLTHVLYPV (PRAME_HUMAN)
NVTHVLYPR

SEQ ID NO: 153655 - protein, 9 aa, Artificial Sequence
  Description of Artificial Sequence: Synthetic peptide
  Seed: KLKIFAMPM (PRAME_HUMAN)
KSKIFAMPF

SEQ ID NO: 153656 - protein, 9 aa, Artificial Sequence
  Description of Artificial Sequence: Synthetic peptide
  Seed: LSNLTHVLY (PRAME_HUMAN)
LKNLTHVLY

SEQ ID NO: 153657 - protein, 9 aa, Artificial Sequence
  Description of Artificial Sequence: Synthetic peptide
  Seed: LSVLSLSGV (PRAME_HUMAN)
LTVLSLSGY

SEQ ID NO: 153658 - protein, 9 aa, Artificial Sequence
  Description of Artificial Sequence: Synthetic peptide
  Seed: MHLSQSPSV (PRAME_HUMAN)
MELSQSPSM

SEQ ID NO: 153659 - protein, 11 aa, Artificial Sequence
  Description of Artificial Sequence: Synthetic peptide
  Seed: FLSLQCLQALY (PRAME_HUMAN)
FMSLQCLQALI

SEQ ID NO: 153660 - protein, 9 aa, Artificial Sequence
  Description of Artificial Sequence: Synthetic peptide
  Seed: WSGNRASLY (PRAME_HUMAN)
WKGNRASLY

SEQ ID NO: 153661 - protein, 8 aa, Artificial Sequence
  Description of Artificial Sequence: Synthetic peptide
  Seed: YVDSLFFL (PRAME_HUMAN)
YGDSLFFL

SEQ ID NO: 153662 - protein, 10 aa, Artificial Sequence
  Description of Artificial Sequence: Synthetic peptide
  Seed: RLWGSIQSRY (PRAME_HUMAN)
RSWGSIQSRL

SEQ ID NO: 153663 - protein, 11 aa, Artificial Sequence
  Description of Artificial Sequence: Synthetic peptide
  Seed: SIEDLEVTCTW (PRAME_HUMAN)
STEDLEVTCTY

SEQ ID NO: 153664 - protein, 9 aa, Artificial Sequence
  Description of Artificial Sequence: Synthetic peptide
  Seed: NVLRLCCKK (PRAME_HUMAN)
NFLRLCCKR

SEQ ID NO: 153665 - protein, 9 aa, Artificial Sequence
  Description of Artificial Sequence: Synthetic peptide
  Seed: FLRGRLDQL (PRAME_HUMAN)
FTRGRLDQF

SEQ ID NO: 153666 - protein, 10 aa, Artificial Sequence
  Description of Artificial Sequence: Synthetic peptide
  Seed: MVQAWPFTCL (PRAME_HUMAN)
MDQAWPFTCY

SEQ ID NO: 153667 - protein, 9 aa, Artificial Sequence
  Description of Artificial Sequence: Synthetic peptide
  Seed: TSPRRLVEL (PRAME_HUMAN)
TRPRRLVEY

SEQ ID NO: 153668 - protein, 9 aa, Artificial Sequence
  Description of Artificial Sequence: Synthetic peptide
  Seed: FYDPEPILC (PRAME_HUMAN)
FWDPEPILM

SEQ ID NO: 153669 - protein, 11 aa, Artificial Sequence
  Description of Artificial Sequence: Synthetic peptide
  Seed: AVLDGLDVLLA (PRAME_HUMAN)
AMLDGLDVLLV

SEQ ID NO: 153670 - protein, 9 aa, Artificial Sequence
  Description of Artificial Sequence: Synthetic peptide
  Seed: LHLERLAYL (PRAME_HUMAN)
LYLERLAYM

SEQ ID NO: 153671 - protein, 9 aa, Artificial Sequence
  Description of Artificial Sequence: Synthetic peptide
  Seed: YIAQFTSQF (PRAME_HUMAN)
YVAQFTSQK

SEQ ID NO: 153672 - protein, 9 aa, Artificial Sequence
  Description of Artificial Sequence: Synthetic peptide
  Seed: AVLDGLDVL (PRAME_HUMAN)
AMLDGLDVV

SEQ ID NO: 153673 - protein, 11 aa, Artificial Sequence
  Description of Artificial Sequence: Synthetic peptide
  Seed: QALYVDSLFFL (PRAME_HUMAN)
QFLYVDSLFFM

SEQ ID NO: 153674 - protein, 10 aa, Artificial Sequence
  Description of Artificial Sequence: Synthetic peptide
  Seed: AMVQAWPFTC (PRAME_HUMAN)
ATVQAWPFTV

SEQ ID NO: 153675 - protein, 10 aa, Artificial Sequence
  Description of Artificial Sequence: Synthetic peptide
  Seed: LSHIHASSYI (PRAME_HUMAN)
LTHIHASSYI

SEQ ID NO: 153676 - protein, 9 aa, Artificial Sequence
  Description of Artificial Sequence: Synthetic peptide
  Seed: YLHARLREL (PRAME_HUMAN)
YHHARLREM

SEQ ID NO: 153677 - protein, 9 aa, Artificial Sequence
  Description of Artificial Sequence: Synthetic peptide
  Seed: TLKAMVQAW (PRAME_HUMAN)
TVKAMVQAF

SEQ ID NO: 153678 - protein, 9 aa, Artificial Sequence
  Description of Artificial Sequence: Synthetic peptide
  Seed: TLAKFSPYL (PRAME_HUMAN)
TAAKFSPYY

SEQ ID NO: 153679 - protein, 9 aa, Artificial Sequence
  Description of Artificial Sequence: Synthetic peptide
  Seed: FDGRHSQTL (PRAME_HUMAN)
FEGRHSQTV

SEQ ID NO: 153680 - protein, 10 aa, Artificial Sequence
  Description of Artificial Sequence: Synthetic peptide
  Seed: YISPEKEEQY (PRAME_HUMAN)
YASPEKEEQF

SEQ ID NO: 153681 - protein, 11 aa, Artificial Sequence
  Description of Artificial Sequence: Synthetic peptide
  Seed: GTLHLERLAYL (PRAME_HUMAN)
GILHLERLAYV

SEQ ID NO: 153682 - protein, 10 aa, Artificial Sequence
  Description of Artificial Sequence: Synthetic peptide
  Seed: SVSQLSVLSL (PRAME_HUMAN)
SFSQLSVLSW

SEQ ID NO: 153683 - protein, 10 aa, Artificial Sequence
  Description of Artificial Sequence: Synthetic peptide
  Seed: AVLDGLDVLL (PRAME_HUMAN)
ATLDGLDVLR

SEQ ID NO: 153684 - protein, 9 aa, Artificial Sequence
  Description of Artificial Sequence: Synthetic peptide
  Seed: YISMSVWTS (PRAME_HUMAN)
YLSMSVWTS

SEQ ID NO: 153685 - protein, 9 aa, Artificial Sequence
  Description of Artificial Sequence: Synthetic peptide
  Seed: NSHQDFWTV (PRAME_HUMAN)
NAHQDFWTW

SEQ ID NO: 153686 - protein, 9 aa, Artificial Sequence
  Description of Artificial Sequence: Synthetic peptide
  Seed: TDDQLLALL (PRAME_HUMAN)
TMDQLLALL

SEQ ID NO: 153687 - protein, 10 aa, Artificial Sequence
  Description of Artificial Sequence: Synthetic peptide
  Seed: MQDIKMILKM (PRAME_HUMAN)
MMDIKMILKF

SEQ ID NO: 153688 - protein, 9 aa, Artificial Sequence
  Description of Artificial Sequence: Synthetic peptide
  Seed: ASATLQDLV (PRAME_HUMAN)
AIATLQDLL

SEQ ID NO: 153689 - protein, 10 aa, Artificial Sequence
  Description of Artificial Sequence: Synthetic peptide
  Seed: YEDIHGTLHL (PRAME_HUMAN)
YIDIHGTLHI

SEQ ID NO: 153690 - protein, 9 aa, Artificial Sequence
  Description of Artificial Sequence: Synthetic peptide
  Seed: QFTSQFLSL (PRAME_HUMAN)
QFTSQFLSF

SEQ ID NO: 153691 - protein, 9 aa, Artificial Sequence
  Description of Artificial Sequence: Synthetic peptide
  Seed: SFYGNSISI (PRAME_HUMAN)
SKYGNSISY

SEQ ID NO: 153692 - protein, 9 aa, Artificial Sequence
  Description of Artificial Sequence: Synthetic peptide
  Seed: LFMAAFDGR (PRAME_HUMAN)
LSMAAFDGR

SEQ ID NO: 153693 - protein, 11 aa, Artificial Sequence
  Description of Artificial Sequence: Synthetic peptide
  Seed: RELFPPLFMAA (PRAME_HUMAN)
RELFPPLFMAI

SEQ ID NO: 153694 - protein, 9 aa, Artificial Sequence
  Description of Artificial Sequence: Synthetic peptide
  Seed: SRYISMSVW (PRAME_HUMAN)
SEYISMSVF

SEQ ID NO: 153695 - protein, 8 aa, Artificial Sequence
  Description of Artificial Sequence: Synthetic peptide
  Seed: FSYLIEKV (PRAME_HUMAN)
FEYLIEKV

SEQ ID NO: 153696 - protein, 9 aa, Artificial Sequence
  Description of Artificial Sequence: Synthetic peptide
  Seed: VQAWPFTCL (PRAME_HUMAN)
VLAWPFTCL

SEQ ID NO: 153697 - protein, 9 aa, Artificial Sequence
  Description of Artificial Sequence: Synthetic peptide
  Seed: SIQSRYISM (PRAME_HUMAN)
SAQSRYISY

SEQ ID NO: 153698 - protein, 10 aa, Artificial Sequence
  Description of Artificial Sequence: Synthetic peptide
  Seed: RHVMNPLETL (PRAME_HUMAN)
RKVMNPLETV

SEQ ID NO: 153699 - protein, 9 aa, Artificial Sequence
  Description of Artificial Sequence: Synthetic peptide
  Seed: ALYVDSLFF (PRAME_HUMAN)
AQYVDSLFH

SEQ ID NO: 153700 - protein, 10 aa, Artificial Sequence
  Description of Artificial Sequence: Synthetic peptide
  Seed: SISISALQSL (PRAME_HUMAN)
SCSISALQSW

SEQ ID NO: 153701 - protein, 9 aa, Artificial Sequence
  Description of Artificial Sequence: Synthetic peptide
  Seed: YPVPLESYE (PRAME_HUMAN)
YAVPLESYF

SEQ ID NO: 153702 - protein, 10 aa, Artificial Sequence
  Description of Artificial Sequence: Synthetic peptide
  Seed: ETFKAVLDGL (PRAME_HUMAN)
EVFKAVLDGK

SEQ ID NO: 153703 - protein, 11 aa, Artificial Sequence
  Description of Artificial Sequence: Synthetic peptide
  Seed: GTLHLERLAYL (PRAME_HUMAN)
GVLHLERLAYV

SEQ ID NO: 153704 - protein, 10 aa, Artificial Sequence
  Description of Artificial Sequence: Synthetic peptide
  Seed: LIGLSNLTHV (PRAME_HUMAN)
LMGLSNLTHV

SEQ ID NO: 153705 - protein, 10 aa, Artificial Sequence
  Description of Artificial Sequence: Synthetic peptide
  Seed: IQSRYISMSV (PRAME_HUMAN)
IRSRYISMSY

SEQ ID NO: 153706 - protein, 9 aa, Artificial Sequence
  Description of Artificial Sequence: Synthetic peptide
  Seed: AVLDGLDVL (PRAME_HUMAN)
AQLDGLDVM

SEQ ID NO: 153707 - protein, 10 aa, Artificial Sequence
  Description of Artificial Sequence: Synthetic peptide
  Seed: KKLKIFAMPM (PRAME_HUMAN)
KQLKIFAMPL

SEQ ID NO: 153708 - protein, 10 aa, Artificial Sequence
  Description of Artificial Sequence: Synthetic peptide
  Seed: AQFTSQFLSL (PRAME_HUMAN)
AQFTSQFLSI

SEQ ID NO: 153709 - protein, 9 aa, Artificial Sequence
  Description of Artificial Sequence: Synthetic peptide
  Seed: AFDGRHSQT (PRAME_HUMAN)
AFDGRHSQM

SEQ ID NO: 153710 - protein, 10 aa, Artificial Sequence
  Description of Artificial Sequence: Synthetic peptide
  Seed: SPYLGQMINL (PRAME_HUMAN)
SIYLGQMINI

SEQ ID NO: 153711 - protein, 9 aa, Artificial Sequence
  Description of Artificial Sequence: Synthetic peptide
  Seed: RHSQTLKAM (PRAME_HUMAN)
RKSQTLKAL

SEQ ID NO: 153712 - protein, 11 aa, Artificial Sequence
  Description of Artificial Sequence: Synthetic peptide
  Seed: CRLSEGDVMHL (PRAME_HUMAN)
CHLSEGDVMHL

SEQ ID NO: 153713 - protein, 11 aa, Artificial Sequence
  Description of Artificial Sequence: Synthetic peptide
  Seed: SNLTHVLYPVP (PRAME_HUMAN)
SMLTHVLYPVY

SEQ ID NO: 153714 - protein, 9 aa, Artificial Sequence
  Description of Artificial Sequence: Synthetic peptide
  Seed: KLQVLDLRK (PRAME_HUMAN)
KMQVLDLRR

SEQ ID NO: 153715 - protein, 9 aa, Artificial Sequence
  Description of Artificial Sequence: Synthetic peptide
  Seed: LKMVQLDSI (PRAME_HUMAN)
LQMVQLDSM

SEQ ID NO: 153716 - protein, 9 aa, Artificial Sequence
  Description of Artificial Sequence: Synthetic peptide
  Seed: WPFTCLPLG (PRAME_HUMAN)
WPFTCLPLF

SEQ ID NO: 153717 - protein, 11 aa, Artificial Sequence
  Description of Artificial Sequence: Synthetic peptide
  Seed: IAQFTSQFLSL (PRAME_HUMAN)
IRQFTSQFLSM

SEQ ID NO: 153718 - protein, 9 aa, Artificial Sequence
  Description of Artificial Sequence: Synthetic peptide
  Seed: SIQSRYISM (PRAME_HUMAN)
SFQSRYISV

SEQ ID NO: 153719 - protein, 9 aa, Artificial Sequence
  Description of Artificial Sequence: Synthetic peptide
  Seed: LTDVSPEPL (PRAME_HUMAN)
LSDVSPEPY

SEQ ID NO: 153720 - protein, 9 aa, Artificial Sequence
  Description of Artificial Sequence: Synthetic peptide
  Seed: LDQLLRHVM (PRAME_HUMAN)
LDQLLRHVF

SEQ ID NO: 153721 - protein, 9 aa, Artificial Sequence
  Description of Artificial Sequence: Synthetic peptide
  Seed: SLSHCSQLT (PRAME_HUMAN)
SLSHCSQLA

SEQ ID NO: 153722 - protein, 9 aa, Artificial Sequence
  Description of Artificial Sequence: Synthetic peptide
  Seed: HVMNPLETL (PRAME_HUMAN)
HAMNPLETF

SEQ ID NO: 153723 - protein, 9 aa, Artificial Sequence
  Description of Artificial Sequence: Synthetic peptide
  Seed: YIAQFTSQF (PRAME_HUMAN)
YAAQFTSQR

SEQ ID NO: 153724 - protein, 10 aa, Artificial Sequence
  Description of Artificial Sequence: Synthetic peptide
  Seed: SVSQLSVLSL (PRAME_HUMAN)
SQSQLSVLSW

SEQ ID NO: 153725 - protein, 10 aa, Artificial Sequence
  Description of Artificial Sequence: Synthetic peptide
  Seed: RLSEGDVMHL (PRAME_HUMAN)
RMSEGDVMHL

SEQ ID NO: 153726 - protein, 9 aa, Artificial Sequence
  Description of Artificial Sequence: Synthetic peptide
  Seed: SMSVWTSPR (PRAME_HUMAN)
SISVWTSPR

SEQ ID NO: 153727 - protein, 9 aa, Artificial Sequence
  Description of Artificial Sequence: Synthetic peptide
  Seed: IFAMPMQDI (PRAME_HUMAN)
IFAMPMQDF

SEQ ID NO: 153728 - protein, 10 aa, Artificial Sequence
  Description of Artificial Sequence: Synthetic peptide
  Seed: LLKDEALAIA (PRAME_HUMAN)
LMKDEALAIA

SEQ ID NO: 153729 - protein, 9 aa, Artificial Sequence
  Description of Artificial Sequence: Synthetic peptide
  Seed: TSPRRLVEL (PRAME_HUMAN)
TMPRRLVEM

SEQ ID NO: 153730 - protein, 9 aa, Artificial Sequence
  Description of Artificial Sequence: Synthetic peptide
  Seed: ALQSLLQHL (PRAME_HUMAN)
AVQSLLQHL

SEQ ID NO: 153731 - protein, 10 aa, Artificial Sequence
  Description of Artificial Sequence: Synthetic peptide
  Seed: FFLRGRLDQL (PRAME_HUMAN)
FILRGRLDQL

SEQ ID NO: 153732 - protein, 9 aa, Artificial Sequence
  Description of Artificial Sequence: Synthetic peptide
  Seed: EAAQPMTKK (PRAME_HUMAN)
EGAQPMTKK

SEQ ID NO: 153733 - protein, 10 aa, Artificial Sequence
  Description of Artificial Sequence: Synthetic peptide
  Seed: GSIQSRYISM (PRAME_HUMAN)
GSIQSRYISY

SEQ ID NO: 153734 - protein, 11 aa, Artificial Sequence
  Description of Artificial Sequence: Synthetic peptide
  Seed: MKGQHLHLETF (PRAME_HUMAN)
MWGQHLHLETF

SEQ ID NO: 153735 - protein, 9 aa, Artificial Sequence
  Description of Artificial Sequence: Synthetic peptide
  Seed: YEDIHGTLH (PRAME_HUMAN)
YTDIHGTLF

SEQ ID NO: 153736 - protein, 9 aa, Artificial Sequence
  Description of Artificial Sequence: Synthetic peptide
  Seed: LQDLVFDEC (PRAME_HUMAN)
LGDLVFDEV

SEQ ID NO: 153737 - protein, 9 aa, Artificial Sequence
  Description of Artificial Sequence: Synthetic peptide
  Seed: RLWGSIQSR (PRAME_HUMAN)
RGWGSIQSR

SEQ ID NO: 153738 - protein, 9 aa, Artificial Sequence
  Description of Artificial Sequence: Synthetic peptide
  Seed: VELAGQSLL (PRAME_HUMAN)
VELAGQSLY

SEQ ID NO: 153739 - protein, 9 aa, Artificial Sequence
  Description of Artificial Sequence: Synthetic peptide
  Seed: LSEGDVMHL (PRAME_HUMAN)
LAEGDVMHI

SEQ ID NO: 153740 - protein, 9 aa, Artificial Sequence
  Description of Artificial Sequence: Synthetic peptide
  Seed: SVLSLSGVM (PRAME_HUMAN)
SKLSLSGVY

SEQ ID NO: 153741 - protein, 9 aa, Artificial Sequence
  Description of Artificial Sequence: Synthetic peptide
  Seed: SFYGNSISI (PRAME_HUMAN)
SLYGNSISF

SEQ ID NO: 153742 - protein, 9 aa, Artificial Sequence
  Description of Artificial Sequence: Synthetic peptide
  Seed: FLRGRLDQL (PRAME_HUMAN)
FFRGRLDQF

SEQ ID NO: 153743 - protein, 11 aa, Artificial Sequence
  Description of Artificial Sequence: Synthetic peptide
  Seed: FLKEGACDELF (PRAME_HUMAN)
FMKEGACDELL

SEQ ID NO: 153744 - protein, 10 aa, Artificial Sequence
  Description of Artificial Sequence: Synthetic peptide
  Seed: LSFYGNSISI (PRAME_HUMAN)
LQFYGNSISF

SEQ ID NO: 153745 - protein, 10 aa, Artificial Sequence
  Description of Artificial Sequence: Synthetic peptide
  Seed: FAMPMQDIKM (PRAME_HUMAN)
FIMPMQDIKI

SEQ ID NO: 153746 - protein, 11 aa, Artificial Sequence
  Description of Artificial Sequence: Synthetic peptide
  Seed: ALYVDSLFFLR (PRAME_HUMAN)
ASYVDSLFFLK

SEQ ID NO: 153747 - protein, 9 aa, Artificial Sequence
  Description of Artificial Sequence: Synthetic peptide
  Seed: LAIAALELL (PRAME_HUMAN)
LSIAALELF

SEQ ID NO: 153748 - protein, 10 aa, Artificial Sequence
  Description of Artificial Sequence: Synthetic peptide
  Seed: RRRLWGSIQS (PRAME_HUMAN)
RDRLWGSIQK

SEQ ID NO: 153749 - protein, 9 aa, Artificial Sequence
  Description of Artificial Sequence: Synthetic peptide
  Seed: YLIEKVKRK (PRAME_HUMAN)
YIIEKVKRK

SEQ ID NO: 153750 - protein, 10 aa, Artificial Sequence
  Description of Artificial Sequence: Synthetic peptide
  Seed: LSLQCLQALY (PRAME_HUMAN)
LKLQCLQALF

SEQ ID NO: 153751 - protein, 9 aa, Artificial Sequence
  Description of Artificial Sequence: Synthetic peptide
  Seed: LALLPSLSH (PRAME_HUMAN)
LKLLPSLSL

SEQ ID NO: 153752 - protein, 9 aa, Artificial Sequence
  Description of Artificial Sequence: Synthetic peptide
  Seed: KMILKMVQL (PRAME_HUMAN)
KTILKMVQR

SEQ ID NO: 153753 - protein, 9 aa, Artificial Sequence
  Description of Artificial Sequence: Synthetic peptide
  Seed: RGRLDQLLR (PRAME_HUMAN)
RTRLDQLLR

SEQ ID NO: 153754 - protein, 9 aa, Artificial Sequence
  Description of Artificial Sequence: Synthetic peptide
  Seed: KVKRKKNVL (PRAME_HUMAN)
KPKRKKNVM

SEQ ID NO: 153755 - protein, 10 aa, Artificial Sequence
  Description of Artificial Sequence: Synthetic peptide
  Seed: KGQHLHLETF (PRAME_HUMAN)
KIQHLHLETF

SEQ ID NO: 153756 - protein, 9 aa, Artificial Sequence
  Description of Artificial Sequence: Synthetic peptide
  Seed: ITDDQLLAL (PRAME_HUMAN)
IADDQLLAW

SEQ ID NO: 153757 - protein, 9 aa, Artificial Sequence
  Description of Artificial Sequence: Synthetic peptide
  Seed: AMVQAWPFT (PRAME_HUMAN)
AVVQAWPFI

SEQ ID NO: 153758 - protein, 9 aa, Artificial Sequence
  Description of Artificial Sequence: Synthetic peptide
  Seed: SYEDIHGTL (PRAME_HUMAN)
SHEDIHGTF

SEQ ID NO: 153759 - protein, 9 aa, Artificial Sequence
  Description of Artificial Sequence: Synthetic peptide
  Seed: LGRPSMVWL (PRAME_HUMAN)
LGRPSMVWK

SEQ ID NO: 153760 - protein, 11 aa, Artificial Sequence
  Description of Artificial Sequence: Synthetic peptide
  Seed: LSNLTHVLYPV (PRAME_HUMAN)
LHNLTHVLYPV

SEQ ID NO: 153761 - protein, 9 aa, Artificial Sequence
  Description of Artificial Sequence: Synthetic peptide
  Seed: RTFYDPEPI (PRAME_HUMAN)
RNFYDPEPY

SEQ ID NO: 153762 - protein, 9 aa, Artificial Sequence
  Description of Artificial Sequence: Synthetic peptide
  Seed: SIQSRYISM (PRAME_HUMAN)
SVQSRYISM

SEQ ID NO: 153763 - protein, 10 aa, Artificial Sequence
  Description of Artificial Sequence: Synthetic peptide
  Seed: RELFPPLFMA (PRAME_HUMAN)
RYLFPPLFML

SEQ ID NO: 153764 - protein, 9 aa, Artificial Sequence
  Description of Artificial Sequence: Synthetic peptide
  Seed: EDLEVTCTW (PRAME_HUMAN)
EILEVTCTF

SEQ ID NO: 153765 - protein, 9 aa, Artificial Sequence
  Description of Artificial Sequence: Synthetic peptide
  Seed: SQSPSVSQL (PRAME_HUMAN)
SDSPSVSQL

SEQ ID NO: 153766 - protein, 9 aa, Artificial Sequence
  Description of Artificial Sequence: Synthetic peptide
  Seed: AFDGRHSQT (PRAME_HUMAN)
ALDGRHSQL

SEQ ID NO: 153767 - protein, 9 aa, Artificial Sequence
  Description of Artificial Sequence: Synthetic peptide
  Seed: YLIEKVKRK (PRAME_HUMAN)
YAIEKVKRR

SEQ ID NO: 153768 - protein, 9 aa, Artificial Sequence
  Description of Artificial Sequence: Synthetic peptide
  Seed: SIQSRYISM (PRAME_HUMAN)
SIQSRYISL

SEQ ID NO: 153769 - protein, 9 aa, Artificial Sequence
  Description of Artificial Sequence: Synthetic peptide
  Seed: VSQLSVLSL (PRAME_HUMAN)
VVQLSVLSF

SEQ ID NO: 153770 - protein, 9 aa, Artificial Sequence
  Description of Artificial Sequence: Synthetic peptide
  Seed: NLTHVLYPV (PRAME_HUMAN)
NSTHVLYPL

SEQ ID NO: 153771 - protein, 9 aa, Artificial Sequence
  Description of Artificial Sequence: Synthetic peptide
  Seed: AMVQAWPFT (PRAME_HUMAN)
AMVQAWPFM

SEQ ID NO: 153772 - protein, 9 aa, Artificial Sequence
  Description of Artificial Sequence: Synthetic peptide
  Seed: LSTEAEQPF (PRAME_HUMAN)
LRTEAEQPF

SEQ ID NO: 153773 - protein, 11 aa, Artificial Sequence
  Description of Artificial Sequence: Synthetic peptide
  Seed: AAFDGRHSQTL (PRAME_HUMAN)
AAFDGRHSQTF

SEQ ID NO: 153774 - protein, 9 aa, Artificial Sequence
  Description of Artificial Sequence: Synthetic peptide
  Seed: EQPFIPVEV (PRAME_HUMAN)
EVPFIPVEV

SEQ ID NO: 153775 - protein, 11 aa, Artificial Sequence
  Description of Artificial Sequence: Synthetic peptide
  Seed: KIFAMPMQDIK (PRAME_HUMAN)
KFFAMPMQDIR

SEQ ID NO: 153776 - protein, 8 aa, Artificial Sequence
  Description of Artificial Sequence: Synthetic peptide
  Seed: VKRKKNVL (PRAME_HUMAN)
VPRKKNVL

SEQ ID NO: 153777 - protein, 9 aa, Artificial Sequence
  Description of Artificial Sequence: Synthetic peptide
  Seed: LMKGQHLHL (PRAME_HUMAN)
LQKGQHLHK

SEQ ID NO: 153778 - protein, 9 aa, Artificial Sequence
  Description of Artificial Sequence: Synthetic peptide
  Seed: SIEDLEVTC (PRAME_HUMAN)
SVEDLEVTL

SEQ ID NO: 153779 - protein, 9 aa, Artificial Sequence
  Description of Artificial Sequence: Synthetic peptide
  Seed: TFYDPEPIL (PRAME_HUMAN)
TRYDPEPII

SEQ ID NO: 153780 - protein, 10 aa, Artificial Sequence
  Description of Artificial Sequence: Synthetic peptide
  Seed: SNLTHVLYPV (PRAME_HUMAN)
SWLTHVLYPA

SEQ ID NO: 153781 - protein, 9 aa, Artificial Sequence
  Description of Artificial Sequence: Synthetic peptide
  Seed: YLHARLREL (PRAME_HUMAN)
YTHARLREY

SEQ ID NO: 153782 - protein, 9 aa, Artificial Sequence
  Description of Artificial Sequence: Synthetic peptide
  Seed: GQMINLRRL (PRAME_HUMAN)
GMMINLRRF

SEQ ID NO: 153783 - protein, 10 aa, Artificial Sequence
  Description of Artificial Sequence: Synthetic peptide
  Seed: GTLHLERLAY (PRAME_HUMAN)
GMLHLERLAF

SEQ ID NO: 153784 - protein, 9 aa, Artificial Sequence
  Description of Artificial Sequence: Synthetic peptide
  Seed: ISISALQSL (PRAME_HUMAN)
IPISALQSI

SEQ ID NO: 153785 - protein, 9 aa, Artificial Sequence
  Description of Artificial Sequence: Synthetic peptide
  Seed: GQSLLKDEA (PRAME_HUMAN)
GESLLKDEL

SEQ ID NO: 153786 - protein, 9 aa, Artificial Sequence
  Description of Artificial Sequence: Synthetic peptide
  Seed: RLDQLLRHV (PRAME_HUMAN)
RTDQLLRHF

SEQ ID NO: 153787 - protein, 9 aa, Artificial Sequence
  Description of Artificial Sequence: Synthetic peptide
  Seed: SLLQHLIGL (PRAME_HUMAN)
SILQHLIGM

SEQ ID NO: 153788 - protein, 9 aa, Artificial Sequence
  Description of Artificial Sequence: Synthetic peptide
  Seed: AAFDGRHSQ (PRAME_HUMAN)
AIFDGRHSV

SEQ ID NO: 153789 - protein, 9 aa, Artificial Sequence
  Description of Artificial Sequence: Synthetic peptide
  Seed: SIQSRYISM (PRAME_HUMAN)
SIQSRYISF

SEQ ID NO: 153790 - protein, 9 aa, Artificial Sequence
  Description of Artificial Sequence: Synthetic peptide
  Seed: VLDGLDVLL (PRAME_HUMAN)
VVDGLDVLV

SEQ ID NO: 153791 - protein, 8 aa, Artificial Sequence
  Description of Artificial Sequence: Synthetic peptide
  Seed: FYDPEPIL (PRAME_HUMAN)
FADPEPIV

SEQ ID NO: 153792 - protein, 9 aa, Artificial Sequence
  Description of Artificial Sequence: Synthetic peptide
  Seed: DEALAIAAL (PRAME_HUMAN)
DHALAIAAI

SEQ ID NO: 153793 - protein, 9 aa, Artificial Sequence
  Description of Artificial Sequence: Synthetic peptide
  Seed: RRRLWGSIQ (PRAME_HUMAN)
RRRLWGSIF

SEQ ID NO: 153794 - protein, 9 aa, Artificial Sequence
  Description of Artificial Sequence: Synthetic peptide
  Seed: ASSYISPEK (PRAME_HUMAN)
AASYISPEK

SEQ ID NO: 153795 - protein, 9 aa, Artificial Sequence
  Description of Artificial Sequence: Synthetic peptide
  Seed: RLAYLHARL (PRAME_HUMAN)
RVAYLHARW

SEQ ID NO: 153796 - protein, 11 aa, Artificial Sequence
  Description of Artificial Sequence: Synthetic peptide
  Seed: MKGQHLHLETF (PRAME_HUMAN)
MTGQHLHLETF

SEQ ID NO: 153797 - protein, 10 aa, Artificial Sequence
  Description of Artificial Sequence: Synthetic peptide
  Seed: MVQAWPFTCL (PRAME_HUMAN)
MHQAWPFTCY

SEQ ID NO: 153798 - protein, 11 aa, Artificial Sequence
  Description of Artificial Sequence: Synthetic peptide
  Seed: VMLTDVSPEPL (PRAME_HUMAN)
VYLTDVSPEPV

SEQ ID NO: 153799 - protein, 10 aa, Artificial Sequence
  Description of Artificial Sequence: Synthetic peptide
  Seed: LPTLAKFSPY (PRAME_HUMAN)
LRTLAKFSPY

SEQ ID NO: 153800 - protein, 9 aa, Artificial Sequence
  Description of Artificial Sequence: Synthetic peptide
  Seed: LAIAALELL (PRAME_HUMAN)
LMIAALELM

SEQ ID NO: 153801 - protein, 9 aa, Artificial Sequence
  Description of Artificial Sequence: Synthetic peptide
  Seed: LAIAALELL (PRAME_HUMAN)
LTIAALELA

SEQ ID NO: 153802 - protein, 9 aa, Artificial Sequence
  Description of Artificial Sequence: Synthetic peptide
  Seed: YIAQFTSQF (PRAME_HUMAN)
YMAQFTSQF

SEQ ID NO: 153803 - protein, 9 aa, Artificial Sequence
  Description of Artificial Sequence: Synthetic peptide
  Seed: RLAYLHARL (PRAME_HUMAN)
RAAYLHARR

SEQ ID NO: 153804 - protein, 10 aa, Artificial Sequence
  Description of Artificial Sequence: Synthetic peptide
  Seed: RLVELAGQSL (PRAME_HUMAN)
RYVELAGQSY

SEQ ID NO: 153805 - protein, 10 aa, Artificial Sequence
  Description of Artificial Sequence: Synthetic peptide
  Seed: QSLLQHLIGL (PRAME_HUMAN)
QLLLQHLIGV

SEQ ID NO: 153806 - protein, 9 aa, Artificial Sequence
  Description of Artificial Sequence: Synthetic peptide
  Seed: SLLQHLIGL (PRAME_HUMAN)
SHLQHLIGM

SEQ ID NO: 153807 - protein, 11 aa, Artificial Sequence
  Description of Artificial Sequence: Synthetic peptide
  Seed: DVSPEPLQALL (PRAME_HUMAN)
DLSPEPLQALR

SEQ ID NO: 153808 - protein, 10 aa, Artificial Sequence
  Description of Artificial Sequence: Synthetic peptide
  Seed: IQSRYISMSV (PRAME_HUMAN)
IESRYISMSY

SEQ ID NO: 153809 - protein, 9 aa, Artificial Sequence
  Description of Artificial Sequence: Synthetic peptide
  Seed: QLLALLPSL (PRAME_HUMAN)
QSLALLPSY

SEQ ID NO: 153810 - protein, 11 aa, Artificial Sequence
  Description of Artificial Sequence: Synthetic peptide
  Seed: KLPTLAKFSPY (PRAME_HUMAN)
KQPTLAKFSPF

SEQ ID NO: 153811 - protein, 10 aa, Artificial Sequence
  Description of Artificial Sequence: Synthetic peptide
  Seed: LLLSHIHASS (PRAME_HUMAN)
LILSHIHASL

SEQ ID NO: 153812 - protein, 9 aa, Artificial Sequence
  Description of Artificial Sequence: Synthetic peptide
  Seed: QTLKAMVQA (PRAME_HUMAN)
QTLKAMVQI

SEQ ID NO: 153813 - protein, 9 aa, Artificial Sequence
  Description of Artificial Sequence: Synthetic peptide
  Seed: ELFPPLFMA (PRAME_HUMAN)
ETFPPLFMA

SEQ ID NO: 153814 - protein, 8 aa, Artificial Sequence
  Description of Artificial Sequence: Synthetic peptide
  Seed: LELLPREL (PRAME_HUMAN)
LQLLPREV

SEQ ID NO: 153815 - protein, 10 aa, Artificial Sequence
  Description of Artificial Sequence: Synthetic peptide
  Seed: LKAMVQAWPF (PRAME_HUMAN)
LKAMVQAWPY

SEQ ID NO: 153816 - protein, 10 aa, Artificial Sequence
  Description of Artificial Sequence: Synthetic peptide
  Seed: LSLQCLQALY (PRAME_HUMAN)
LALQCLQALW

SEQ ID NO: 153817 - protein, 9 aa, Artificial Sequence
  Description of Artificial Sequence: Synthetic peptide
  Seed: TFYDPEPIL (PRAME_HUMAN)
TVYDPEPIL

SEQ ID NO: 153818 - protein, 10 aa, Artificial Sequence
  Description of Artificial Sequence: Synthetic peptide
  Seed: SLQCLQALYV (PRAME_HUMAN)
SIQCLQALYV

SEQ ID NO: 153819 - protein, 10 aa, Artificial Sequence
  Description of Artificial Sequence: Synthetic peptide
  Seed: DRTFYDPEPI (PRAME_HUMAN)
DGTFYDPEPV

SEQ ID NO: 153820 - protein, 9 aa, Artificial Sequence
  Description of Artificial Sequence: Synthetic peptide
  Seed: VLDGLDVLL (PRAME_HUMAN)
VQDGLDVLY

SEQ ID NO: 153821 - protein, 10 aa, Artificial Sequence
  Description of Artificial Sequence: Synthetic peptide
  Seed: SLLQHLIGLS (PRAME_HUMAN)
SILQHLIGLV

SEQ ID NO: 153822 - protein, 9 aa, Artificial Sequence
  Description of Artificial Sequence: Synthetic peptide
  Seed: KAMVQAWPF (PRAME_HUMAN)
KAMVQAWPM

SEQ ID NO: 153823 - protein, 9 aa, Artificial Sequence
  Description of Artificial Sequence: Synthetic peptide
  Seed: LAIAALELL (PRAME_HUMAN)
LMIAALELT

SEQ ID NO: 153824 - protein, 10 aa, Artificial Sequence
  Description of Artificial Sequence: Synthetic peptide
  Seed: KKLKIFAMPM (PRAME_HUMAN)
KVLKIFAMPI

SEQ ID NO: 153825 - protein, 9 aa, Artificial Sequence
  Description of Artificial Sequence: Synthetic peptide
  Seed: LFMAAFDGR (PRAME_HUMAN)
LAMAAFDGK

SEQ ID NO: 153826 - protein, 9 aa, Artificial Sequence
  Description of Artificial Sequence: Synthetic peptide
  Seed: IAQFTSQFL (PRAME_HUMAN)
ISQFTSQFF

SEQ ID NO: 153827 - protein, 10 aa, Artificial Sequence
  Description of Artificial Sequence: Synthetic peptide
  Seed: LSQSPSVSQL (PRAME_HUMAN)
LHQSPSVSQF

SEQ ID NO: 153828 - protein, 8 aa, Artificial Sequence
  Description of Artificial Sequence: Synthetic peptide
  Seed: TDDQLLAL (PRAME_HUMAN)
TIDQLLAV

SEQ ID NO: 153829 - protein, 10 aa, Artificial Sequence
  Description of Artificial Sequence: Synthetic peptide
  Seed: DRTFYDPEPI (PRAME_HUMAN)
DITFYDPEPV

SEQ ID NO: 153830 - protein, 10 aa, Artificial Sequence
  Description of Artificial Sequence: Synthetic peptide
  Seed: VDSLFFLRGR (PRAME_HUMAN)
VFSLFFLRGR

SEQ ID NO: 153831 - protein, 9 aa, Artificial Sequence
  Description of Artificial Sequence: Synthetic peptide
  Seed: TLAKFSPYL (PRAME_HUMAN)
TFAKFSPYF

SEQ ID NO: 153832 - protein, 9 aa, Artificial Sequence
  Description of Artificial Sequence: Synthetic peptide
  Seed: LSVLSLSGV (PRAME_HUMAN)
LQVLSLSGA

SEQ ID NO: 153833 - protein, 10 aa, Artificial Sequence
  Description of Artificial Sequence: Synthetic peptide
  Seed: KDEALAIAAL (PRAME_HUMAN)
KHEALAIAAL

SEQ ID NO: 153834 - protein, 10 aa, Artificial Sequence
  Description of Artificial Sequence: Synthetic peptide
  Seed: LPTLAKFSPY (PRAME_HUMAN)
LCTLAKFSPF

SEQ ID NO: 153835 - protein, 10 aa, Artificial Sequence
  Description of Artificial Sequence: Synthetic peptide
  Seed: ELFPPLFMAA (PRAME_HUMAN)
EVFPPLFMAT

SEQ ID NO: 153836 - protein, 9 aa, Artificial Sequence
  Description of Artificial Sequence: Synthetic peptide
  Seed: YIAQFTSQF (PRAME_HUMAN)
YEAQFTSQM

SEQ ID NO: 153837 - protein, 9 aa, Artificial Sequence
  Description of Artificial Sequence: Synthetic peptide
  Seed: SLSHCSQLT (PRAME_HUMAN)
SVSHCSQLI

SEQ ID NO: 153838 - protein, 9 aa, Artificial Sequence
  Description of Artificial Sequence: Synthetic peptide
  Seed: TFYDPEPIL (PRAME_HUMAN)
TRYDPEPIM

SEQ ID NO: 153839 - protein, 9 aa, Artificial Sequence
  Description of Artificial Sequence: Synthetic peptide
  Seed: MQDIKMILK (PRAME_HUMAN)
MSDIKMILM

SEQ ID NO: 153840 - protein, 10 aa, Artificial Sequence
  Description of Artificial Sequence: Synthetic peptide
  Seed: SLSGVMLTDV (PRAME_HUMAN)
SMSGVMLTDV

SEQ ID NO: 153841 - protein, 11 aa, Artificial Sequence
  Description of Artificial Sequence: Synthetic peptide
  Seed: KEGACDELFSY (PRAME_HUMAN)
KTGACDELFSY

SEQ ID NO: 153842 - protein, 10 aa, Artificial Sequence
  Description of Artificial Sequence: Synthetic peptide
  Seed: ETFKAVLDGL (PRAME_HUMAN)
ETFKAVLDGF

SEQ ID NO: 153843 - protein, 9 aa, Artificial Sequence
  Description of Artificial Sequence: Synthetic peptide
  Seed: FYDPEPILC (PRAME_HUMAN)
FSDPEPILM

SEQ ID NO: 153844 - protein, 10 aa, Artificial Sequence
  Description of Artificial Sequence: Synthetic peptide
  Seed: ALYVDSLFFL (PRAME_HUMAN)
ADYVDSLFFI

SEQ ID NO: 153845 - protein, 9 aa, Artificial Sequence
  Description of Artificial Sequence: Synthetic peptide
  Seed: RGRLDQLLR (PRAME_HUMAN)
RIRLDQLLI

SEQ ID NO: 153846 - protein, 10 aa, Artificial Sequence
  Description of Artificial Sequence: Synthetic peptide
  Seed: ALYVDSLFFL (PRAME_HUMAN)
ATYVDSLFFF

SEQ ID NO: 153847 - protein, 9 aa, Artificial Sequence
  Description of Artificial Sequence: Synthetic peptide
  Seed: SYEDIHGTL (PRAME_HUMAN)
SYEDIHGTI

SEQ ID NO: 153848 - protein, 10 aa, Artificial Sequence
  Description of Artificial Sequence: Synthetic peptide
  Seed: ITDDQLLALL (PRAME_HUMAN)
IADDQLLALI

SEQ ID NO: 153849 - protein, 9 aa, Artificial Sequence
  Description of Artificial Sequence: Synthetic peptide
  Seed: YIAQFTSQF (PRAME_HUMAN)
YIAQFTSQW

SEQ ID NO: 153850 - protein, 9 aa, Artificial Sequence
  Description of Artificial Sequence: Synthetic peptide
  Seed: RWKLQVLDL (PRAME_HUMAN)
RAKLQVLDK

SEQ ID NO: 153851 - protein, 11 aa, Artificial Sequence
  Description of Artificial Sequence: Synthetic peptide
  Seed: LPTLAKFSPYL (PRAME_HUMAN)
LFTLAKFSPYV

SEQ ID NO: 153852 - protein, 9 aa, Artificial Sequence
  Description of Artificial Sequence: Synthetic peptide
  Seed: MINLRRLLL (PRAME_HUMAN)
MLNLRRLLV

SEQ ID NO: 153853 - protein, 9 aa, Artificial Sequence
  Description of Artificial Sequence: Synthetic peptide
  Seed: AMVQAWPFT (PRAME_HUMAN)
AVVQAWPFL

SEQ ID NO: 153854 - protein, 9 aa, Artificial Sequence
  Description of Artificial Sequence: Synthetic peptide
  Seed: SPRRLVELA (PRAME_HUMAN)
SPRRLVELI

SEQ ID NO: 153855 - protein, 9 aa, Artificial Sequence
  Description of Artificial Sequence: Synthetic peptide
  Seed: VELAGQSLL (PRAME_HUMAN)
VQLAGQSLF

SEQ ID NO: 153856 - protein, 9 aa, Artificial Sequence
  Description of Artificial Sequence: Synthetic peptide
  Seed: RWKLQVLDL (PRAME_HUMAN)
RSKLQVLDI

SEQ ID NO: 153857 - protein, 9 aa, Artificial Sequence
  Description of Artificial Sequence: Synthetic peptide
  Seed: SFYGNSISI (PRAME_HUMAN)
SDYGNSISL

SEQ ID NO: 153858 - protein, 9 aa, Artificial Sequence
  Description of Artificial Sequence: Synthetic peptide
  Seed: LSEGDVMHL (PRAME_HUMAN)
LVEGDVMHY

SEQ ID NO: 153859 - protein, 9 aa, Artificial Sequence
  Description of Artificial Sequence: Synthetic peptide
  Seed: YGNSISISA (PRAME_HUMAN)
YGNSISISL

SEQ ID NO: 153860 - protein, 10 aa, Artificial Sequence
  Description of Artificial Sequence: Synthetic peptide
  Seed: FFLRGRLDQL (PRAME_HUMAN)
FQLRGRLDQA

SEQ ID NO: 153861 - protein, 10 aa, Artificial Sequence
  Description of Artificial Sequence: Synthetic peptide
  Seed: SISISALQSL (PRAME_HUMAN)
SHSISALQSW

SEQ ID NO: 153862 - protein, 8 aa, Artificial Sequence
  Description of Artificial Sequence: Synthetic peptide
  Seed: ITDDQLLA (PRAME_HUMAN)
IGDDQLLL

SEQ ID NO: 153863 - protein, 9 aa, Artificial Sequence
  Description of Artificial Sequence: Synthetic peptide
  Seed: KLKIFAMPM (PRAME_HUMAN)
KSKIFAMPR

SEQ ID NO: 153864 - protein, 9 aa, Artificial Sequence
  Description of Artificial Sequence: Synthetic peptide
  Seed: LTDVSPEPL (PRAME_HUMAN)
LPDVSPEPF

SEQ ID NO: 153865 - protein, 9 aa, Artificial Sequence
  Description of Artificial Sequence: Synthetic peptide
  Seed: QALYVDSLF (PRAME_HUMAN)
QVLYVDSLW

SEQ ID NO: 153866 - protein, 10 aa, Artificial Sequence
  Description of Artificial Sequence: Synthetic peptide
  Seed: TVWSGNRASL (PRAME_HUMAN)
TLWSGNRASV

SEQ ID NO: 153867 - protein, 9 aa, Artificial Sequence
  Description of Artificial Sequence: Synthetic peptide
  Seed: LYPVPLESY (PRAME_HUMAN)
LQPVPLESY

SEQ ID NO: 153868 - protein, 9 aa, Artificial Sequence
  Description of Artificial Sequence: Synthetic peptide
  Seed: LSLQCLQAL (PRAME_HUMAN)
LMLQCLQAL

SEQ ID NO: 153869 - protein, 9 aa, Artificial Sequence
  Description of Artificial Sequence: Synthetic peptide
  Seed: YIAQFTSQF (PRAME_HUMAN)
YTAQFTSQW

SEQ ID NO: 153870 - protein, 9 aa, Artificial Sequence
  Description of Artificial Sequence: Synthetic peptide
  Seed: SHIHASSYI (PRAME_HUMAN)
SHIHASSYF

SEQ ID NO: 153871 - protein, 11 aa, Artificial Sequence
  Description of Artificial Sequence: Synthetic peptide
  Seed: ELFSYLIEKVK (PRAME_HUMAN)
EVFSYLIEKVK

SEQ ID NO: 153872 - protein, 9 aa, Artificial Sequence
  Description of Artificial Sequence: Synthetic peptide
  Seed: LSNLTHVLY (PRAME_HUMAN)
LKNLTHVLM

SEQ ID NO: 153873 - protein, 9 aa, Artificial Sequence
  Description of Artificial Sequence: Synthetic peptide
  Seed: FYDPEPILC (PRAME_HUMAN)
FYDPEPILV

SEQ ID NO: 153874 - protein, 9 aa, Artificial Sequence
  Description of Artificial Sequence: Synthetic peptide
  Seed: YVDSLFFLR (PRAME_HUMAN)
YADSLFFLF

SEQ ID NO: 153875 - protein, 9 aa, Artificial Sequence
  Description of Artificial Sequence: Synthetic peptide
  Seed: VLDGLDVLL (PRAME_HUMAN)
VADGLDVLL

SEQ ID NO: 153876 - protein, 9 aa, Artificial Sequence
  Description of Artificial Sequence: Synthetic peptide
  Seed: SIQSRYISM (PRAME_HUMAN)
SMQSRYISR

SEQ ID NO: 153877 - protein, 10 aa, Artificial Sequence
  Description of Artificial Sequence: Synthetic peptide
  Seed: RLDQLLRHVM (PRAME_HUMAN)
RMDQLLRHVW

SEQ ID NO: 153878 - protein, 9 aa, Artificial Sequence
  Description of Artificial Sequence: Synthetic peptide
  Seed: LYPVPLESY (PRAME_HUMAN)
LYPVPLESI

SEQ ID NO: 153879 - protein, 9 aa, Artificial Sequence
  Description of Artificial Sequence: Synthetic peptide
  Seed: ALYVDSLFF (PRAME_HUMAN)
AIYVDSLFW

SEQ ID NO: 153880 - protein, 10 aa, Artificial Sequence
  Description of Artificial Sequence: Synthetic peptide
  Seed: DQLLALLPSL (PRAME_HUMAN)
DQLLALLPSV

SEQ ID NO: 153881 - protein, 9 aa, Artificial Sequence
  Description of Artificial Sequence: Synthetic peptide
  Seed: ESYEDIHGT (PRAME_HUMAN)
ESYEDIHGM

SEQ ID NO: 153882 - protein, 9 aa, Artificial Sequence
  Description of Artificial Sequence: Synthetic peptide
  Seed: LMKGQHLHL (PRAME_HUMAN)
LFKGQHLHM

SEQ ID NO: 153883 - protein, 10 aa, Artificial Sequence
  Description of Artificial Sequence: Synthetic peptide
  Seed: LKAMVQAWPF (PRAME_HUMAN)
LSAMVQAWPY

SEQ ID NO: 153884 - protein, 9 aa, Artificial Sequence
  Description of Artificial Sequence: Synthetic peptide
  Seed: YLGQMINLR (PRAME_HUMAN)
YSGQMINLY

SEQ ID NO: 153885 - protein, 10 aa, Artificial Sequence
  Description of Artificial Sequence: Synthetic peptide
  Seed: SISISALQSL (PRAME_HUMAN)
SASISALQSF

SEQ ID NO: 153886 - protein, 11 aa, Artificial Sequence
  Description of Artificial Sequence: Synthetic peptide
  Seed: RLAYLHARLRE (PRAME_HUMAN)
RIAYLHARLRR

SEQ ID NO: 153887 - protein, 9 aa, Artificial Sequence
  Description of Artificial Sequence: Synthetic peptide
  Seed: ALAIAALEL (PRAME_HUMAN)
ASAIAALEV

SEQ ID NO: 153888 - protein, 10 aa, Artificial Sequence
  Description of Artificial Sequence: Synthetic peptide
  Seed: IGLSNLTHVL (PRAME_HUMAN)
IHLSNLTHVL

SEQ ID NO: 153889 - protein, 9 aa, Artificial Sequence
  Description of Artificial Sequence: Synthetic peptide
  Seed: LKMVQLDSI (PRAME_HUMAN)
LMMVQLDSM

SEQ ID NO: 153890 - protein, 10 aa, Artificial Sequence
  Description of Artificial Sequence: Synthetic peptide
  Seed: ITDDQLLALL (PRAME_HUMAN)
IVDDQLLALV

SEQ ID NO: 153891 - protein, 9 aa, Artificial Sequence
  Description of Artificial Sequence: Synthetic peptide
  Seed: LLLSHIHAS (PRAME_HUMAN)
LQLSHIHAV

SEQ ID NO: 153892 - protein, 9 aa, Artificial Sequence
  Description of Artificial Sequence: Synthetic peptide
  Seed: RLRELLCEL (PRAME_HUMAN)
RTRELLCEA

SEQ ID NO: 153893 - protein, 9 aa, Artificial Sequence
  Description of Artificial Sequence: Synthetic peptide
  Seed: LSHIHASSY (PRAME_HUMAN)
LMHIHASSY

SEQ ID NO: 153894 - protein, 10 aa, Artificial Sequence
  Description of Artificial Sequence: Synthetic peptide
  Seed: ETFKAVLDGL (PRAME_HUMAN)
EMFKAVLDGR

SEQ ID NO: 153895 - protein, 10 aa, Artificial Sequence
  Description of Artificial Sequence: Synthetic peptide
  Seed: RLVELAGQSL (PRAME_HUMAN)
RSVELAGQSF

SEQ ID NO: 153896 - protein, 10 aa, Artificial Sequence
  Description of Artificial Sequence: Synthetic peptide
  Seed: RGRLDQLLRH (PRAME_HUMAN)
RTRLDQLLRF

SEQ ID NO: 153897 - protein, 9 aa, Artificial Sequence
  Description of Artificial Sequence: Synthetic peptide
  Seed: SQSPSVSQL (PRAME_HUMAN)
SVSPSVSQI

SEQ ID NO: 153898 - protein, 10 aa, Artificial Sequence
  Description of Artificial Sequence: Synthetic peptide
  Seed: HCSQLTTLSF (PRAME_HUMAN)
HSSQLTTLSW

SEQ ID NO: 153899 - protein, 8 aa, Artificial Sequence
  Description of Artificial Sequence: Synthetic peptide
  Seed: DVLLAQEV (PRAME_HUMAN)
DQLLAQEI

SEQ ID NO: 153900 - protein, 9 aa, Artificial Sequence
  Description of Artificial Sequence: Synthetic peptide
  Seed: ALYVDSLFF (PRAME_HUMAN)
AWYVDSLFY

SEQ ID NO: 153901 - protein, 10 aa, Artificial Sequence
  Description of Artificial Sequence: Synthetic peptide
  Seed: YSFPEPEAAQ (PRAME_HUMAN)
YIFPEPEAAY

SEQ ID NO: 153902 - protein, 9 aa, Artificial Sequence
  Description of Artificial Sequence: Synthetic peptide
  Seed: RASATLQDL (PRAME_HUMAN)
RQSATLQDY

SEQ ID NO: 153903 - protein, 9 aa, Artificial Sequence
  Description of Artificial Sequence: Synthetic peptide
  Seed: VSPEPLQAL (PRAME_HUMAN)
VAPEPLQAK

SEQ ID NO: 153904 - protein, 8 aa, Artificial Sequence
  Description of Artificial Sequence: Synthetic peptide
  Seed: FYDPEPIL (PRAME_HUMAN)
FYDPEPIV

SEQ ID NO: 153905 - protein, 9 aa, Artificial Sequence
  Description of Artificial Sequence: Synthetic peptide
  Seed: YGNSISISA (PRAME_HUMAN)
YLNSISISL

SEQ ID NO: 153906 - protein, 9 aa, Artificial Sequence
  Description of Artificial Sequence: Synthetic peptide
  Seed: LSTEAEQPF (PRAME_HUMAN)
LQTEAEQPF

SEQ ID NO: 153907 - protein, 11 aa, Artificial Sequence
  Description of Artificial Sequence: Synthetic peptide
  Seed: RRWKLQVLDLR (PRAME_HUMAN)
RLWKLQVLDLR

SEQ ID NO: 153908 - protein, 9 aa, Artificial Sequence
  Description of Artificial Sequence: Synthetic peptide
  Seed: TDDQLLALL (PRAME_HUMAN)
TADQLLALL

SEQ ID NO: 153909 - protein, 11 aa, Artificial Sequence
  Description of Artificial Sequence: Synthetic peptide
  Seed: AAFDGRHSQTL (PRAME_HUMAN)
AVFDGRHSQTW

SEQ ID NO: 153910 - protein, 10 aa, Artificial Sequence
  Description of Artificial Sequence: Synthetic peptide
  Seed: MLTDVSPEPL (PRAME_HUMAN)
MVTDVSPEPL

SEQ ID NO: 153911 - protein, 10 aa, Artificial Sequence
  Description of Artificial Sequence: Synthetic peptide
  Seed: VELAGQSLLK (PRAME_HUMAN)
VRLAGQSLLK

SEQ ID NO: 153912 - protein, 10 aa, Artificial Sequence
  Description of Artificial Sequence: Synthetic peptide
  Seed: SPSVSQLSVL (PRAME_HUMAN)
SCSVSQLSVW

SEQ ID NO: 153913 - protein, 9 aa, Artificial Sequence
  Description of Artificial Sequence: Synthetic peptide
  Seed: VSPEPLQAL (PRAME_HUMAN)
VTPEPLQAM

SEQ ID NO: 153914 - protein, 9 aa, Artificial Sequence
  Description of Artificial Sequence: Synthetic peptide
  Seed: SFYGNSISI (PRAME_HUMAN)
SGYGNSISL

SEQ ID NO: 153915 - protein, 10 aa, Artificial Sequence
  Description of Artificial Sequence: Synthetic peptide
  Seed: SPYLGQMINL (PRAME_HUMAN)
SDYLGQMINF

SEQ ID NO: 153916 - protein, 9 aa, Artificial Sequence
  Description of Artificial Sequence: Synthetic peptide
  Seed: ALQSLLQHL (PRAME_HUMAN)
AMQSLLQHM

SEQ ID NO: 153917 - protein, 10 aa, Artificial Sequence
  Description of Artificial Sequence: Synthetic peptide
  Seed: LPTLAKFSPY (PRAME_HUMAN)
LFTLAKFSPW

SEQ ID NO: 153918 - protein, 10 aa, Artificial Sequence
  Description of Artificial Sequence: Synthetic peptide
  Seed: KGQHLHLETF (PRAME_HUMAN)
KMQHLHLETF

SEQ ID NO: 153919 - protein, 10 aa, Artificial Sequence
  Description of Artificial Sequence: Synthetic peptide
  Seed: AYLHARLREL (PRAME_HUMAN)
AALHARLREV

SEQ ID NO: 153920 - protein, 11 aa, Artificial Sequence
  Description of Artificial Sequence: Synthetic peptide
  Seed: GTLHLERLAYL (PRAME_HUMAN)
GLLHLERLAYI

SEQ ID NO: 153921 - protein, 11 aa, Artificial Sequence
  Description of Artificial Sequence: Synthetic peptide
  Seed: QALYVDSLFFL (PRAME_HUMAN)
QFLYVDSLFFF

SEQ ID NO: 153922 - protein, 9 aa, Artificial Sequence
  Description of Artificial Sequence: Synthetic peptide
  Seed: LAIAALELL (PRAME_HUMAN)
LMIAALELL

SEQ ID NO: 153923 - protein, 9 aa, Artificial Sequence
  Description of Artificial Sequence: Synthetic peptide
  Seed: SVLSLSGVM (PRAME_HUMAN)
SKLSLSGVL

SEQ ID NO: 153924 - protein, 9 aa, Artificial Sequence
  Description of Artificial Sequence: Synthetic peptide
  Seed: RLAYLHARL (PRAME_HUMAN)
RMAYLHARY

SEQ ID NO: 153925 - protein, 10 aa, Artificial Sequence
  Description of Artificial Sequence: Synthetic peptide
  Seed: HLERLAYLHA (PRAME_HUMAN)
HSERLAYLHK

SEQ ID NO: 153926 - protein, 9 aa, Artificial Sequence
  Description of Artificial Sequence: Synthetic peptide
  Seed: SFYGNSISI (PRAME_HUMAN)
STYGNSISY

SEQ ID NO: 153927 - protein, 9 aa, Artificial Sequence
  Description of Artificial Sequence: Synthetic peptide
  Seed: VLDGLDVLL (PRAME_HUMAN)
VMDGLDVLF

SEQ ID NO: 153928 - protein, 9 aa, Artificial Sequence
  Description of Artificial Sequence: Synthetic peptide
  Seed: DGRHSQTLK (PRAME_HUMAN)
DMRHSQTLR

SEQ ID NO: 153929 - protein, 9 aa, Artificial Sequence
  Description of Artificial Sequence: Synthetic peptide
  Seed: FTCLPLGVL (PRAME_HUMAN)
FLCLPLGVL

SEQ ID NO: 153930 - protein, 10 aa, Artificial Sequence
  Description of Artificial Sequence: Synthetic peptide
  Seed: YIAQFTSQFL (PRAME_HUMAN)
YIAQFTSQFY

SEQ ID NO: 153931 - protein, 9 aa, Artificial Sequence
  Description of Artificial Sequence: Synthetic peptide
  Seed: ALAIAALEL (PRAME_HUMAN)
AAAIAALEI

SEQ ID NO: 153932 - protein, 9 aa, Artificial Sequence
  Description of Artificial Sequence: Synthetic peptide
  Seed: LSTEAEQPF (PRAME_HUMAN)
LTTEAEQPW

SEQ ID NO: 153933 - protein, 9 aa, Artificial Sequence
  Description of Artificial Sequence: Synthetic peptide
  Seed: MINLRRLLL (PRAME_HUMAN)
MMNLRRLLM

SEQ ID NO: 153934 - protein, 9 aa, Artificial Sequence
  Description of Artificial Sequence: Synthetic peptide
  Seed: QALYVDSLF (PRAME_HUMAN)
QSLYVDSLF

SEQ ID NO: 153935 - protein, 10 aa, Artificial Sequence
  Description of Artificial Sequence: Synthetic peptide
  Seed: QAWPFTCLPL (PRAME_HUMAN)
QWWPFTCLPF

SEQ ID NO: 153936 - protein, 9 aa, Artificial Sequence
  Description of Artificial Sequence: Synthetic peptide
  Seed: TLHLERLAY (PRAME_HUMAN)
TIHLERLAY

SEQ ID NO: 153937 - protein, 9 aa, Artificial Sequence
  Description of Artificial Sequence: Synthetic peptide
  Seed: ACDELFSYL (PRAME_HUMAN)
AMDELFSYL

SEQ ID NO: 153938 - protein, 9 aa, Artificial Sequence
  Description of Artificial Sequence: Synthetic peptide
  Seed: KVDGLSTEA (PRAME_HUMAN)
KLDGLSTEI

SEQ ID NO: 153939 - protein, 9 aa, Artificial Sequence
  Description of Artificial Sequence: Synthetic peptide
  Seed: VQLDSIEDL (PRAME_HUMAN)
VRLDSIEDY

SEQ ID NO: 153940 - protein, 9 aa, Artificial Sequence
  Description of Artificial Sequence: Synthetic peptide
  Seed: HLHLETFKA (PRAME_HUMAN)
HMHLETFKI

SEQ ID NO: 153941 - protein, 9 aa, Artificial Sequence
  Description of Artificial Sequence: Synthetic peptide
  Seed: WKLPTLAKF (PRAME_HUMAN)
WQLPTLAKL

SEQ ID NO: 153942 - protein, 9 aa, Artificial Sequence
  Description of Artificial Sequence: Synthetic peptide
  Seed: RLAYLHARL (PRAME_HUMAN)
RMAYLHARW

SEQ ID NO: 153943 - protein, 10 aa, Artificial Sequence
  Description of Artificial Sequence: Synthetic peptide
  Seed: MNPLETLSIT (PRAME_HUMAN)
MMPLETLSIV

SEQ ID NO: 153944 - protein, 9 aa, Artificial Sequence
  Description of Artificial Sequence: Synthetic peptide
  Seed: ELFPPLFMA (PRAME_HUMAN)
ELFPPLFMV

SEQ ID NO: 153945 - protein, 10 aa, Artificial Sequence
  Description of Artificial Sequence: Synthetic peptide
  Seed: LSFYGNSISI (PRAME_HUMAN)
LPFYGNSISM

SEQ ID NO: 153946 - protein, 9 aa, Artificial Sequence
  Description of Artificial Sequence: Synthetic peptide
  Seed: YSFPEPEAA (PRAME_HUMAN)
YEFPEPEAI

SEQ ID NO: 153947 - protein, 9 aa, Artificial Sequence
  Description of Artificial Sequence: Synthetic peptide
  Seed: ALYVDSLFF (PRAME_HUMAN)
ASYVDSLFW

SEQ ID NO: 153948 - protein, 9 aa, Artificial Sequence
  Description of Artificial Sequence: Synthetic peptide
  Seed: MVQAWPFTC (PRAME_HUMAN)
MTQAWPFTM

SEQ ID NO: 153949 - protein, 8 aa, Artificial Sequence
  Description of Artificial Sequence: Synthetic peptide
  Seed: ITDDQLLA (PRAME_HUMAN)
ISDDQLLM

SEQ ID NO: 153950 - protein, 9 aa, Artificial Sequence
  Description of Artificial Sequence: Synthetic peptide
  Seed: CSQLTTLSF (PRAME_HUMAN)
CHQLTTLSF

SEQ ID NO: 153951 - protein, 9 aa, Artificial Sequence
  Description of Artificial Sequence: Synthetic peptide
  Seed: KMILKMVQL (PRAME_HUMAN)
KLILKMVQL

SEQ ID NO: 153952 - protein, 11 aa, Artificial Sequence
  Description of Artificial Sequence: Synthetic peptide
  Seed: VQAWPFTCLPL (PRAME_HUMAN)
VQAWPFTCLPY

SEQ ID NO: 153953 - protein, 10 aa, Artificial Sequence
  Description of Artificial Sequence: Synthetic peptide
  Seed: LSQSPSVSQL (PRAME_HUMAN)
LSQSPSVSQW

SEQ ID NO: 153954 - protein, 9 aa, Artificial Sequence
  Description of Artificial Sequence: Synthetic peptide
  Seed: LLSHIHASS (PRAME_HUMAN)
LMSHIHASA

SEQ ID NO: 153955 - protein, 9 aa, Artificial Sequence
  Description of Artificial Sequence: Synthetic peptide
  Seed: RRLVELAGQ (PRAME_HUMAN)
RRLVELAGL

SEQ ID NO: 153956 - protein, 9 aa, Artificial Sequence
  Description of Artificial Sequence: Synthetic peptide
  Seed: EDIHGTLHL (PRAME_HUMAN)
EEIHGTLHL

SEQ ID NO: 153957 - protein, 9 aa, Artificial Sequence
  Description of Artificial Sequence: Synthetic peptide
  Seed: RTFYDPEPI (PRAME_HUMAN)
RMFYDPEPI

SEQ ID NO: 153958 - protein, 10 aa, Artificial Sequence
  Description of Artificial Sequence: Synthetic peptide
  Seed: FYDPEPILCP (PRAME_HUMAN)
FGDPEPILCL

SEQ ID NO: 153959 - protein, 9 aa, Artificial Sequence
  Description of Artificial Sequence: Synthetic peptide
  Seed: TLKAMVQAW (PRAME_HUMAN)
TMKAMVQAW

SEQ ID NO: 153960 - protein, 10 aa, Artificial Sequence
  Description of Artificial Sequence: Synthetic peptide
  Seed: LSVLSLSGVM (PRAME_HUMAN)
LIVLSLSGVF

SEQ ID NO: 153961 - protein, 9 aa, Artificial Sequence
  Description of Artificial Sequence: Synthetic peptide
  Seed: MINLRRLLL (PRAME_HUMAN)
MSNLRRLLL

SEQ ID NO: 153962 - protein, 9 aa, Artificial Sequence
  Description of Artificial Sequence: Synthetic peptide
  Seed: GACDELFSY (PRAME_HUMAN)
GRCDELFSL

SEQ ID NO: 153963 - protein, 10 aa, Artificial Sequence
  Description of Artificial Sequence: Synthetic peptide
  Seed: ISMSVWTSPR (PRAME_HUMAN)
ILMSVWTSPR

SEQ ID NO: 153964 - protein, 10 aa, Artificial Sequence
  Description of Artificial Sequence: Synthetic peptide
  Seed: LSFYGNSISI (PRAME_HUMAN)
LLFYGNSISL

SEQ ID NO: 153965 - protein, 9 aa, Artificial Sequence
  Description of Artificial Sequence: Synthetic peptide
  Seed: FSPYLGQMI (PRAME_HUMAN)
FVPYLGQML

SEQ ID NO: 153966 - protein, 10 aa, Artificial Sequence
  Description of Artificial Sequence: Synthetic peptide
  Seed: TFYDPEPILC (PRAME_HUMAN)
TQYDPEPILL

SEQ ID NO: 153967 - protein, 9 aa, Artificial Sequence
  Description of Artificial Sequence: Synthetic peptide
  Seed: ELFPPLFMA (PRAME_HUMAN)
ENFPPLFMV

SEQ ID NO: 153968 - protein, 11 aa, Artificial Sequence
  Description of Artificial Sequence: Synthetic peptide
  Seed: AAFDGRHSQTL (PRAME_HUMAN)
AAFDGRHSQTM

SEQ ID NO: 153969 - protein, 8 aa, Artificial Sequence
  Description of Artificial Sequence: Synthetic peptide
  Seed: QPFIPVEV (PRAME_HUMAN)
QPFIPVEA

SEQ ID NO: 153970 - protein, 8 aa, Artificial Sequence
  Description of Artificial Sequence: Synthetic peptide
  Seed: TDDQLLAL (PRAME_HUMAN)
TTDQLLAI

SEQ ID NO: 153971 - protein, 9 aa, Artificial Sequence
  Description of Artificial Sequence: Synthetic peptide
  Seed: YIAQFTSQF (PRAME_HUMAN)
YAAQFTSQA

SEQ ID NO: 153972 - protein, 10 aa, Artificial Sequence
  Description of Artificial Sequence: Synthetic peptide
  Seed: SISISALQSL (PRAME_HUMAN)
SISISALQSV

SEQ ID NO: 153973 - protein, 10 aa, Artificial Sequence
  Description of Artificial Sequence: Synthetic peptide
  Seed: CELGRPSMVW (PRAME_HUMAN)
CALGRPSMVW

SEQ ID NO: 153974 - protein, 10 aa, Artificial Sequence
  Description of Artificial Sequence: Synthetic peptide
  Seed: LPTLAKFSPY (PRAME_HUMAN)
LCTLAKFSPW

SEQ ID NO: 153975 - protein, 10 aa, Artificial Sequence
  Description of Artificial Sequence: Synthetic peptide
  Seed: FFLRGRLDQL (PRAME_HUMAN)
FALRGRLDQV

SEQ ID NO: 153976 - protein, 8 aa, Artificial Sequence
  Description of Artificial Sequence: Synthetic peptide
  Seed: FYDPEPIL (PRAME_HUMAN)
FWDPEPIL

SEQ ID NO: 153977 - protein, 9 aa, Artificial Sequence
  Description of Artificial Sequence: Synthetic peptide
  Seed: ELFPPLFMA (PRAME_HUMAN)
EVFPPLFMI

SEQ ID NO: 153978 - protein, 9 aa, Artificial Sequence
  Description of Artificial Sequence: Synthetic peptide
  Seed: ITDDQLLAL (PRAME_HUMAN)
IQDDQLLAW

SEQ ID NO: 153979 - protein, 9 aa, Artificial Sequence
  Description of Artificial Sequence: Synthetic peptide
  Seed: FLRGRLDQL (PRAME_HUMAN)
FRRGRLDQY

SEQ ID NO: 153980 - protein, 9 aa, Artificial Sequence
  Description of Artificial Sequence: Synthetic peptide
  Seed: LALLPSLSH (PRAME_HUMAN)
LALLPSLSM

SEQ ID NO: 153981 - protein, 11 aa, Artificial Sequence
  Description of Artificial Sequence: Synthetic peptide
  Seed: RRLWGSIQSRY (PRAME_HUMAN)
RVLWGSIQSRR

SEQ ID NO: 153982 - protein, 9 aa, Artificial Sequence
  Description of Artificial Sequence: Synthetic peptide
  Seed: LALLPSLSH (PRAME_HUMAN)
LQLLPSLSF

SEQ ID NO: 153983 - protein, 9 aa, Artificial Sequence
  Description of Artificial Sequence: Synthetic peptide
  Seed: SHIHASSYI (PRAME_HUMAN)
SQIHASSYY

SEQ ID NO: 153984 - protein, 9 aa, Artificial Sequence
  Description of Artificial Sequence: Synthetic peptide
  Seed: HVMNPLETL (PRAME_HUMAN)
HAMNPLETV

SEQ ID NO: 153985 - protein, 11 aa, Artificial Sequence
  Description of Artificial Sequence: Synthetic peptide
  Seed: RRLVELAGQSL (PRAME_HUMAN)
RRLVELAGQSM

SEQ ID NO: 153986 - protein, 9 aa, Artificial Sequence
  Description of Artificial Sequence: Synthetic peptide
  Seed: SHCSQLTTL (PRAME_HUMAN)
SQCSQLTTL

SEQ ID NO: 153987 - protein, 9 aa, Artificial Sequence
  Description of Artificial Sequence: Synthetic peptide
  Seed: YGNSISISA (PRAME_HUMAN)
YANSISISH

SEQ ID NO: 153988 - protein, 10 aa, Artificial Sequence
  Description of Artificial Sequence: Synthetic peptide
  Seed: MVQAWPFTCL (PRAME_HUMAN)
MGQAWPFTCY

SEQ ID NO: 153989 - protein, 11 aa, Artificial Sequence
  Description of Artificial Sequence: Synthetic peptide
  Seed: QALYVDSLFFL (PRAME_HUMAN)
QILYVDSLFFF

SEQ ID NO: 153990 - protein, 10 aa, Artificial Sequence
  Description of Artificial Sequence: Synthetic peptide
  Seed: VELAGQSLLK (PRAME_HUMAN)
VMLAGQSLLY

SEQ ID NO: 153991 - protein, 9 aa, Artificial Sequence
  Description of Artificial Sequence: Synthetic peptide
  Seed: LALLPSLSH (PRAME_HUMAN)
LLLLPSLSM

SEQ ID NO: 153992 - protein, 9 aa, Artificial Sequence
  Description of Artificial Sequence: Synthetic peptide
  Seed: SYEDIHGTL (PRAME_HUMAN)
STEDIHGTM

SEQ ID NO: 153993 - protein, 10 aa, Artificial Sequence
  Description of Artificial Sequence: Synthetic peptide
  Seed: YIAQFTSQFL (PRAME_HUMAN)
YPAQFTSQFY

SEQ ID NO: 153994 - protein, 9 aa, Artificial Sequence
  Description of Artificial Sequence: Synthetic peptide
  Seed: AVLDGLDVL (PRAME_HUMAN)
AILDGLDVF

SEQ ID NO: 153995 - protein, 9 aa, Artificial Sequence
  Description of Artificial Sequence: Synthetic peptide
  Seed: CKKLKIFAM (PRAME_HUMAN)
CPKLKIFAI

SEQ ID NO: 153996 - protein, 10 aa, Artificial Sequence
  Description of Artificial Sequence: Synthetic peptide
  Seed: LLPRELFPPL (PRAME_HUMAN)
LLPRELFPPF

SEQ ID NO: 153997 - protein, 9 aa, Artificial Sequence
  Description of Artificial Sequence: Synthetic peptide
  Seed: QPFIPVEVL (PRAME_HUMAN)
QQFIPVEVF

SEQ ID NO: 153998 - protein, 10 aa, Artificial Sequence
  Description of Artificial Sequence: Synthetic peptide
  Seed: LSQSPSVSQL (PRAME_HUMAN)
LLQSPSVSQM

SEQ ID NO: 153999 - protein, 10 aa, Artificial Sequence
  Description of Artificial Sequence: Synthetic peptide
  Seed: RGRLDQLLRH (PRAME_HUMAN)
RYRLDQLLRF

SEQ ID NO: 154000 - protein, 10 aa, Artificial Sequence
  Description of Artificial Sequence: Synthetic peptide
  Seed: MPMQDIKMIL (PRAME_HUMAN)
MKMQDIKMIV

SEQ ID NO: 154001 - protein, 9 aa, Artificial Sequence
  Description of Artificial Sequence: Synthetic peptide
  Seed: HVMNPLETL (PRAME_HUMAN)
HWMNPLETF

SEQ ID NO: 154002 - protein, 9 aa, Artificial Sequence
  Description of Artificial Sequence: Synthetic peptide
  Seed: FYDPEPILC (PRAME_HUMAN)
FVDPEPILI

SEQ ID NO: 154003 - protein, 9 aa, Artificial Sequence
  Description of Artificial Sequence: Synthetic peptide
  Seed: EAAQPMTKK (PRAME_HUMAN)
EYAQPMTKR

SEQ ID NO: 154004 - protein, 9 aa, Artificial Sequence
  Description of Artificial Sequence: Synthetic peptide
  Seed: RELLCELGR (PRAME_HUMAN)
RFLLCELGR

SEQ ID NO: 154005 - protein, 9 aa, Artificial Sequence
  Description of Artificial Sequence: Synthetic peptide
  Seed: QLLALLPSL (PRAME_HUMAN)
QALALLPSV

SEQ ID NO: 154006 - protein, 10 aa, Artificial Sequence
  Description of Artificial Sequence: Synthetic peptide
  Seed: SNLTHVLYPV (PRAME_HUMAN)
SCLTHVLYPA

SEQ ID NO: 154007 - protein, 9 aa, Artificial Sequence
  Description of Artificial Sequence: Synthetic peptide
  Seed: LQHLIGLSN (PRAME_HUMAN)
LVHLIGLSY

SEQ ID NO: 154008 - protein, 10 aa, Artificial Sequence
  Description of Artificial Sequence: Synthetic peptide
  Seed: PTLAKFSPYL (PRAME_HUMAN)
PKLAKFSPYI

SEQ ID NO: 154009 - protein, 9 aa, Artificial Sequence
  Description of Artificial Sequence: Synthetic peptide
  Seed: SFYGNSISI (PRAME_HUMAN)
SYYGNSISV

SEQ ID NO: 154010 - protein, 9 aa, Artificial Sequence
  Description of Artificial Sequence: Synthetic peptide
  Seed: SISALQSLL (PRAME_HUMAN)
SISALQSLA

SEQ ID NO: 154011 - protein, 10 aa, Artificial Sequence
  Description of Artificial Sequence: Synthetic peptide
  Seed: SVSQLSVLSL (PRAME_HUMAN)
SYSQLSVLSW

SEQ ID NO: 154012 - protein, 9 aa, Artificial Sequence
  Description of Artificial Sequence: Synthetic peptide
  Seed: RELFPPLFM (PRAME_HUMAN)
RVLFPPLFY

SEQ ID NO: 154013 - protein, 8 aa, Artificial Sequence
  Description of Artificial Sequence: Synthetic peptide
  Seed: SHIHASSY (PRAME_HUMAN)
SKIHASSY

SEQ ID NO: 154014 - protein, 9 aa, Artificial Sequence
  Description of Artificial Sequence: Synthetic peptide
  Seed: RRWKLQVLD (PRAME_HUMAN)
RQWKLQVLR

SEQ ID NO: 154015 - protein, 9 aa, Artificial Sequence
  Description of Artificial Sequence: Synthetic peptide
  Seed: KEGACDELF (PRAME_HUMAN)
KLGACDELF

SEQ ID NO: 154016 - protein, 9 aa, Artificial Sequence
  Description of Artificial Sequence: Synthetic peptide
  Seed: THVLYPVPL (PRAME_HUMAN)
TVVLYPVPF

SEQ ID NO: 154017 - protein, 10 aa, Artificial Sequence
  Description of Artificial Sequence: Synthetic peptide
  Seed: RGRLDQLLRH (PRAME_HUMAN)
RDRLDQLLRR

SEQ ID NO: 154018 - protein, 9 aa, Artificial Sequence
  Description of Artificial Sequence: Synthetic peptide
  Seed: ASATLQDLV (PRAME_HUMAN)
AQATLQDLV

SEQ ID NO: 154019 - protein, 8 aa, Artificial Sequence
  Description of Artificial Sequence: Synthetic peptide
  Seed: MINLRRLL (PRAME_HUMAN)
MLNLRRLI

SEQ ID NO: 154020 - protein, 10 aa, Artificial Sequence
  Description of Artificial Sequence: Synthetic peptide
  Seed: CSQLTTLSFY (PRAME_HUMAN)
CEQLTTLSFF

SEQ ID NO: 154021 - protein, 11 aa, Artificial Sequence
  Description of Artificial Sequence: Synthetic peptide
  Seed: SLYSFPEPEAA (PRAME_HUMAN)
SLYSFPEPEAL

SEQ ID NO: 154022 - protein, 10 aa, Artificial Sequence
  Description of Artificial Sequence: Synthetic peptide
  Seed: FPEPEAAQPM (PRAME_HUMAN)
FPEPEAAQPY

SEQ ID NO: 154023 - protein, 8 aa, Artificial Sequence
  Description of Artificial Sequence: Synthetic peptide
  Seed: ITDDQLLA (PRAME_HUMAN)
ISDDQLLI

SEQ ID NO: 154024 - protein, 9 aa, Artificial Sequence
  Description of Artificial Sequence: Synthetic peptide
  Seed: KMILKMVQL (PRAME_HUMAN)
KLILKMVQY

SEQ ID NO: 154025 - protein, 9 aa, Artificial Sequence
  Description of Artificial Sequence: Synthetic peptide
  Seed: LSNLTHVLY (PRAME_HUMAN)
LANLTHVLV

SEQ ID NO: 154026 - protein, 10 aa, Artificial Sequence
  Description of Artificial Sequence: Synthetic peptide
  Seed: LPTLAKFSPY (PRAME_HUMAN)
LVTLAKFSPW

SEQ ID NO: 154027 - protein, 10 aa, Artificial Sequence
  Description of Artificial Sequence: Synthetic peptide
  Seed: TLAKFSPYLG (PRAME_HUMAN)
TIAKFSPYLV

SEQ ID NO: 154028 - protein, 9 aa, Artificial Sequence
  Description of Artificial Sequence: Synthetic peptide
  Seed: KAMVQAWPF (PRAME_HUMAN)
KQMVQAWPL

SEQ ID NO: 154029 - protein, 8 aa, Artificial Sequence
  Description of Artificial Sequence: Synthetic peptide
  Seed: VMNPLETL (PRAME_HUMAN)
VQNPLETV

SEQ ID NO: 154030 - protein, 10 aa, Artificial Sequence
  Description of Artificial Sequence: Synthetic peptide
  Seed: AAFDGRHSQT (PRAME_HUMAN)
AMFDGRHSQF

SEQ ID NO: 154031 - protein, 9 aa, Artificial Sequence
  Description of Artificial Sequence: Synthetic peptide
  Seed: VQAWPFTCL (PRAME_HUMAN)
VKAWPFTCF

SEQ ID NO: 154032 - protein, 9 aa, Artificial Sequence
  Description of Artificial Sequence: Synthetic peptide
  Seed: KMILKMVQL (PRAME_HUMAN)
KIILKMVQK

SEQ ID NO: 154033 - protein, 8 aa, Artificial Sequence
  Description of Artificial Sequence: Synthetic peptide
  Seed: YEDIHGTL (PRAME_HUMAN)
YFDIHGTI

SEQ ID NO: 154034 - protein, 10 aa, Artificial Sequence
  Description of Artificial Sequence: Synthetic peptide
  Seed: FFLRGRLDQL (PRAME_HUMAN)
FDLRGRLDQV

SEQ ID NO: 154035 - protein, 11 aa, Artificial Sequence
  Description of Artificial Sequence: Synthetic peptide
  Seed: RLSEGDVMHLS (PRAME_HUMAN)
RISEGDVMHLV

SEQ ID NO: 154036 - protein, 10 aa, Artificial Sequence
  Description of Artificial Sequence: Synthetic peptide
  Seed: RGRLDQLLRH (PRAME_HUMAN)
RIRLDQLLRI

SEQ ID NO: 154037 - protein, 9 aa, Artificial Sequence
  Description of Artificial Sequence: Synthetic peptide
  Seed: LSLQCLQAL (PRAME_HUMAN)
LKLQCLQAM

SEQ ID NO: 154038 - protein, 10 aa, Artificial Sequence
  Description of Artificial Sequence: Synthetic peptide
  Seed: DQLLALLPSL (PRAME_HUMAN)
DLLLALLPSV

SEQ ID NO: 154039 - protein, 9 aa, Artificial Sequence
  Description of Artificial Sequence: Synthetic peptide
  Seed: RLAYLHARL (PRAME_HUMAN)
RMAYLHARF

SEQ ID NO: 154040 - protein, 10 aa, Artificial Sequence
  Description of Artificial Sequence: Synthetic peptide
  Seed: AEQPFIPVEV (PRAME_HUMAN)
AEQPFIPVES

SEQ ID NO: 154041 - protein, 9 aa, Artificial Sequence
  Description of Artificial Sequence: Synthetic peptide
  Seed: NSHQDFWTV (PRAME_HUMAN)
NTHQDFWTL

SEQ ID NO: 154042 - protein, 9 aa, Artificial Sequence
  Description of Artificial Sequence: Synthetic peptide
  Seed: KLKIFAMPM (PRAME_HUMAN)
KLKIFAMPV

SEQ ID NO: 154043 - protein, 8 aa, Artificial Sequence
  Description of Artificial Sequence: Synthetic peptide
  Seed: SPYLGQMI (PRAME_HUMAN)
SQYLGQMV

SEQ ID NO: 154044 - protein, 11 aa, Artificial Sequence
  Description of Artificial Sequence: Synthetic peptide
  Seed: ALYVDSLFFLR (PRAME_HUMAN)
ALYVDSLFFLH

SEQ ID NO: 154045 - protein, 9 aa, Artificial Sequence
  Description of Artificial Sequence: Synthetic peptide
  Seed: ELFPPLFMA (PRAME_HUMAN)
EVFPPLFMV

SEQ ID NO: 154046 - protein, 10 aa, Artificial Sequence
  Description of Artificial Sequence: Synthetic peptide
  Seed: EALAIAALEL (PRAME_HUMAN)
ETLAIAALEA

SEQ ID NO: 154047 - protein, 10 aa, Artificial Sequence
  Description of Artificial Sequence: Synthetic peptide
  Seed: QYIAQFTSQF (PRAME_HUMAN)
QLIAQFTSQF

SEQ ID NO: 154048 - protein, 10 aa, Artificial Sequence
  Description of Artificial Sequence: Synthetic peptide
  Seed: TLQDLVFDEC (PRAME_HUMAN)
TLQDLVFDEI

SEQ ID NO: 154049 - protein, 9 aa, Artificial Sequence
  Description of Artificial Sequence: Synthetic peptide
  Seed: SISALQSLL (PRAME_HUMAN)
SVSALQSLF

SEQ ID NO: 154050 - protein, 9 aa, Artificial Sequence
  Description of Artificial Sequence: Synthetic peptide
  Seed: TFYDPEPIL (PRAME_HUMAN)
TSYDPEPIF

SEQ ID NO: 154051 - protein, 10 aa, Artificial Sequence
  Description of Artificial Sequence: Synthetic peptide
  Seed: ETFKAVLDGL (PRAME_HUMAN)
EVFKAVLDGR

SEQ ID NO: 154052 - protein, 9 aa, Artificial Sequence
  Description of Artificial Sequence: Synthetic peptide
  Seed: QFTSQFLSL (PRAME_HUMAN)
QWTSQFLSF

SEQ ID NO: 154053 - protein, 10 aa, Artificial Sequence
  Description of Artificial Sequence: Synthetic peptide
  Seed: FFLRGRLDQL (PRAME_HUMAN)
FELRGRLDQI

SEQ ID NO: 154054 - protein, 9 aa, Artificial Sequence
  Description of Artificial Sequence: Synthetic peptide
  Seed: RHSQTLKAM (PRAME_HUMAN)
RQSQTLKAL

SEQ ID NO: 154055 - protein, 9 aa, Artificial Sequence
  Description of Artificial Sequence: Synthetic peptide
  Seed: SFYGNSISI (PRAME_HUMAN)
SYYGNSISA

SEQ ID NO: 154056 - protein, 10 aa, Artificial Sequence
  Description of Artificial Sequence: Synthetic peptide
  Seed: RELFPPLFMA (PRAME_HUMAN)
RCLFPPLFMM

SEQ ID NO: 154057 - protein, 10 aa, Artificial Sequence
  Description of Artificial Sequence: Synthetic peptide
  Seed: MVQAWPFTCL (PRAME_HUMAN)
MGQAWPFTCV

SEQ ID NO: 154058 - protein, 10 aa, Artificial Sequence
  Description of Artificial Sequence: Synthetic peptide
  Seed: ETFKAVLDGL (PRAME_HUMAN)
EVFKAVLDGV

SEQ ID NO: 154059 - protein, 9 aa, Artificial Sequence
  Description of Artificial Sequence: Synthetic peptide
  Seed: HLIGLSNLT (PRAME_HUMAN)
HMIGLSNLL

SEQ ID NO: 154060 - protein, 10 aa, Artificial Sequence
  Description of Artificial Sequence: Synthetic peptide
  Seed: FYDPEPILCP (PRAME_HUMAN)
FYDPEPILCM

SEQ ID NO: 154061 - protein, 9 aa, Artificial Sequence
  Description of Artificial Sequence: Synthetic peptide
  Seed: LYVDSLFFL (PRAME_HUMAN)
LEVDSLFFV

SEQ ID NO: 154062 - protein, 9 aa, Artificial Sequence
  Description of Artificial Sequence: Synthetic peptide
  Seed: SLQCLQALY (PRAME_HUMAN)
SMQCLQALY

SEQ ID NO: 154063 - protein, 10 aa, Artificial Sequence
  Description of Artificial Sequence: Synthetic peptide
  Seed: RRRLWGSIQS (PRAME_HUMAN)
RQRLWGSIQR

SEQ ID NO: 154064 - protein, 9 aa, Artificial Sequence
  Description of Artificial Sequence: Synthetic peptide
  Seed: LTDVSPEPL (PRAME_HUMAN)
LWDVSPEPF

SEQ ID NO: 154065 - protein, 9 aa, Artificial Sequence
  Description of Artificial Sequence: Synthetic peptide
  Seed: RLCCKKLKI (PRAME_HUMAN)
RQCCKKLKL

SEQ ID NO: 154066 - protein, 10 aa, Artificial Sequence
  Description of Artificial Sequence: Synthetic peptide
  Seed: AQFTSQFLSL (PRAME_HUMAN)
AVFTSQFLSI

SEQ ID NO: 154067 - protein, 9 aa, Artificial Sequence
  Description of Artificial Sequence: Synthetic peptide
  Seed: KFSPYLGQM (PRAME_HUMAN)
KQSPYLGQY

SEQ ID NO: 154068 - protein, 9 aa, Artificial Sequence
  Description of Artificial Sequence: Synthetic peptide
  Seed: YGNSISISA (PRAME_HUMAN)
YMNSISISY

SEQ ID NO: 154069 - protein, 9 aa, Artificial Sequence
  Description of Artificial Sequence: Synthetic peptide
  Seed: WKLPTLAKF (PRAME_HUMAN)
WSLPTLAKY

SEQ ID NO: 154070 - protein, 9 aa, Artificial Sequence
  Description of Artificial Sequence: Synthetic peptide
  Seed: SIEDLEVTC (PRAME_HUMAN)
SSEDLEVTF

SEQ ID NO: 154071 - protein, 11 aa, Artificial Sequence
  Description of Artificial Sequence: Synthetic peptide
  Seed: RLWGSIQSRYI (PRAME_HUMAN)
RQWGSIQSRYY

SEQ ID NO: 154072 - protein, 9 aa, Artificial Sequence
  Description of Artificial Sequence: Synthetic peptide
  Seed: RELFPPLFM (PRAME_HUMAN)
RELFPPLFA

SEQ ID NO: 154073 - protein, 10 aa, Artificial Sequence
  Description of Artificial Sequence: Synthetic peptide
  Seed: FYDPEPILCP (PRAME_HUMAN)
FFDPEPILCV

SEQ ID NO: 154074 - protein, 10 aa, Artificial Sequence
  Description of Artificial Sequence: Synthetic peptide
  Seed: SALQSLLQHL (PRAME_HUMAN)
SVLQSLLQHA

SEQ ID NO: 154075 - protein, 9 aa, Artificial Sequence
  Description of Artificial Sequence: Synthetic peptide
  Seed: YSFPEPEAA (PRAME_HUMAN)
YEFPEPEAV

SEQ ID NO: 154076 - protein, 9 aa, Artificial Sequence
  Description of Artificial Sequence: Synthetic peptide
  Seed: ISPEKEEQY (PRAME_HUMAN)
IYPEKEEQF

SEQ ID NO: 154077 - protein, 9 aa, Artificial Sequence
  Description of Artificial Sequence: Synthetic peptide
  Seed: LSHIHASSY (PRAME_HUMAN)
LQHIHASSK

SEQ ID NO: 154078 - protein, 9 aa, Artificial Sequence
  Description of Artificial Sequence: Synthetic peptide
  Seed: LSNLTHVLY (PRAME_HUMAN)
LMNLTHVLW

SEQ ID NO: 154079 - protein, 9 aa, Artificial Sequence
  Description of Artificial Sequence: Synthetic peptide
  Seed: RASATLQDL (PRAME_HUMAN)
RVSATLQDV

SEQ ID NO: 154080 - protein, 9 aa, Artificial Sequence
  Description of Artificial Sequence: Synthetic peptide
  Seed: SLLQHLIGL (PRAME_HUMAN)
SSLQHLIGM

SEQ ID NO: 154081 - protein, 9 aa, Artificial Sequence
  Description of Artificial Sequence: Synthetic peptide
  Seed: YLHARLREL (PRAME_HUMAN)
YPHARLREF

SEQ ID NO: 154082 - protein, 10 aa, Artificial Sequence
  Description of Artificial Sequence: Synthetic peptide
  Seed: ERLAYLHARL (PRAME_HUMAN)
ETLAYLHARA

SEQ ID NO: 154083 - protein, 9 aa, Artificial Sequence
  Description of Artificial Sequence: Synthetic peptide
  Seed: LSVLSLSGV (PRAME_HUMAN)
LTVLSLSGF

SEQ ID NO: 154084 - protein, 10 aa, Artificial Sequence
  Description of Artificial Sequence: Synthetic peptide
  Seed: MNPLETLSIT (PRAME_HUMAN)
MKPLETLSIA

SEQ ID NO: 154085 - protein, 10 aa, Artificial Sequence
  Description of Artificial Sequence: Synthetic peptide
  Seed: RELFPPLFMA (PRAME_HUMAN)
RALFPPLFMV

SEQ ID NO: 154086 - protein, 9 aa, Artificial Sequence
  Description of Artificial Sequence: Synthetic peptide
  Seed: SFYGNSISI (PRAME_HUMAN)
SKYGNSISH

SEQ ID NO: 154087 - protein, 10 aa, Artificial Sequence
  Description of Artificial Sequence: Synthetic peptide
  Seed: LLSHIHASSY (PRAME_HUMAN)
LTSHIHASSM

SEQ ID NO: 154088 - protein, 9 aa, Artificial Sequence
  Description of Artificial Sequence: Synthetic peptide
  Seed: TFYDPEPIL (PRAME_HUMAN)
TFYDPEPIF

SEQ ID NO: 154089 - protein, 10 aa, Artificial Sequence
  Description of Artificial Sequence: Synthetic peptide
  Seed: GRLDQLLRHV (PRAME_HUMAN)
GMLDQLLRHL

SEQ ID NO: 154090 - protein, 8 aa, Artificial Sequence
  Description of Artificial Sequence: Synthetic peptide
  Seed: YLGQMINL (PRAME_HUMAN)
YMGQMINV

SEQ ID NO: 154091 - protein, 9 aa, Artificial Sequence
  Description of Artificial Sequence: Synthetic peptide
  Seed: RLDQLLRHV (PRAME_HUMAN)
RIDQLLRHV

SEQ ID NO: 154092 - protein, 11 aa, Artificial Sequence
  Description of Artificial Sequence: Synthetic peptide
  Seed: AAFDGRHSQTL (PRAME_HUMAN)
AQFDGRHSQTI

SEQ ID NO: 154093 - protein, 9 aa, Artificial Sequence
  Description of Artificial Sequence: Synthetic peptide
  Seed: GRLDQLLRH (PRAME_HUMAN)
GRLDQLLRF

SEQ ID NO: 154094 - protein, 9 aa, Artificial Sequence
  Description of Artificial Sequence: Synthetic peptide
  Seed: KFSPYLGQM (PRAME_HUMAN)
KASPYLGQV

SEQ ID NO: 154095 - protein, 9 aa, Artificial Sequence
  Description of Artificial Sequence: Synthetic peptide
  Seed: ELFSYLIEK (PRAME_HUMAN)
EFFSYLIER

SEQ ID NO: 154096 - protein, 10 aa, Artificial Sequence
  Description of Artificial Sequence: Synthetic peptide
  Seed: LPTLAKFSPY (PRAME_HUMAN)
LKTLAKFSPY

SEQ ID NO: 154097 - protein, 9 aa, Artificial Sequence
  Description of Artificial Sequence: Synthetic peptide
  Seed: LALLPSLSH (PRAME_HUMAN)
LSLLPSLSY

SEQ ID NO: 154098 - protein, 11 aa, Artificial Sequence
  Description of Artificial Sequence: Synthetic peptide
  Seed: ESYEDIHGTLH (PRAME_HUMAN)
EMYEDIHGTLK

SEQ ID NO: 154099 - protein, 11 aa, Artificial Sequence
  Description of Artificial Sequence: Synthetic peptide
  Seed: SNLTHVLYPVP (PRAME_HUMAN)
SILTHVLYPVV

SEQ ID NO: 154100 - protein, 11 aa, Artificial Sequence
  Description of Artificial Sequence: Synthetic peptide
  Seed: RLAYLHARLRE (PRAME_HUMAN)
RWAYLHARLRR

SEQ ID NO: 154101 - protein, 9 aa, Artificial Sequence
  Description of Artificial Sequence: Synthetic peptide
  Seed: LAIAALELL (PRAME_HUMAN)
LKIAALELM

SEQ ID NO: 154102 - protein, 10 aa, Artificial Sequence
  Description of Artificial Sequence: Synthetic peptide
  Seed: RRRLWGSIQS (PRAME_HUMAN)
RHRLWGSIQK

SEQ ID NO: 154103 - protein, 9 aa, Artificial Sequence
  Description of Artificial Sequence: Synthetic peptide
  Seed: WPFTCLPLG (PRAME_HUMAN)
WAFTCLPLF

SEQ ID NO: 154104 - protein, 9 aa, Artificial Sequence
  Description of Artificial Sequence: Synthetic peptide
  Seed: NSISISALQ (PRAME_HUMAN)
NAISISALY

SEQ ID NO: 154105 - protein, 9 aa, Artificial Sequence
  Description of Artificial Sequence: Synthetic peptide
  Seed: ETLSITNCR (PRAME_HUMAN)
EILSITNCR

SEQ ID NO: 154106 - protein, 9 aa, Artificial Sequence
  Description of Artificial Sequence: Synthetic peptide
  Seed: HVMNPLETL (PRAME_HUMAN)
HIMNPLETI

SEQ ID NO: 154107 - protein, 9 aa, Artificial Sequence
  Description of Artificial Sequence: Synthetic peptide
  Seed: KAMVQAWPF (PRAME_HUMAN)
KPMVQAWPA

SEQ ID NO: 154108 - protein, 11 aa, Artificial Sequence
  Description of Artificial Sequence: Synthetic peptide
  Seed: RTFYDPEPILC (PRAME_HUMAN)
RIFYDPEPILW

SEQ ID NO: 154109 - protein, 9 aa, Artificial Sequence
  Description of Artificial Sequence: Synthetic peptide
  Seed: VSQLSVLSL (PRAME_HUMAN)
VLQLSVLSL

SEQ ID NO: 154110 - protein, 8 aa, Artificial Sequence
  Description of Artificial Sequence: Synthetic peptide
  Seed: FYDPEPIL (PRAME_HUMAN)
FADPEPIM

SEQ ID NO: 154111 - protein, 10 aa, Artificial Sequence
  Description of Artificial Sequence: Synthetic peptide
  Seed: KNVLRLCCKK (PRAME_HUMAN)
KWVLRLCCKR

SEQ ID NO: 154112 - protein, 9 aa, Artificial Sequence
  Description of Artificial Sequence: Synthetic peptide
  Seed: ALQSLLQHL (PRAME_HUMAN)
AWQSLLQHY

SEQ ID NO: 154113 - protein, 10 aa, Artificial Sequence
  Description of Artificial Sequence: Synthetic peptide
  Seed: VLDGLDVLLA (PRAME_HUMAN)
VMDGLDVLLM

SEQ ID NO: 154114 - protein, 9 aa, Artificial Sequence
  Description of Artificial Sequence: Synthetic peptide
  Seed: ALLERASAT (PRAME_HUMAN)
ALLERASAI

SEQ ID NO: 154115 - protein, 10 aa, Artificial Sequence
  Description of Artificial Sequence: Synthetic peptide
  Seed: VLYPVPLESY (PRAME_HUMAN)
VEYPVPLESY

SEQ ID NO: 154116 - protein, 9 aa, Artificial Sequence
  Description of Artificial Sequence: Synthetic peptide
  Seed: AWPFTCLPL (PRAME_HUMAN)
AWPFTCLPW

SEQ ID NO: 154117 - protein, 8 aa, Artificial Sequence
  Description of Artificial Sequence: Synthetic peptide
  Seed: SHIHASSY (PRAME_HUMAN)
SQIHASSM

SEQ ID NO: 154118 - protein, 10 aa, Artificial Sequence
  Description of Artificial Sequence: Synthetic peptide
  Seed: FYDPEPILCP (PRAME_HUMAN)
FLDPEPILCL

SEQ ID NO: 154119 - protein, 10 aa, Artificial Sequence
  Description of Artificial Sequence: Synthetic peptide
  Seed: SPYLGQMINL (PRAME_HUMAN)
SKYLGQMINL

SEQ ID NO: 154120 - protein, 9 aa, Artificial Sequence
  Description of Artificial Sequence: Synthetic peptide
  Seed: LAIAALELL (PRAME_HUMAN)
LHIAALELF

SEQ ID NO: 154121 - protein, 10 aa, Artificial Sequence
  Description of Artificial Sequence: Synthetic peptide
  Seed: AVLDGLDVLL (PRAME_HUMAN)
AGLDGLDVLW

SEQ ID NO: 154122 - protein, 9 aa, Artificial Sequence
  Description of Artificial Sequence: Synthetic peptide
  Seed: GQHLHLETF (PRAME_HUMAN)
GVHLHLETY

SEQ ID NO: 154123 - protein, 10 aa, Artificial Sequence
  Description of Artificial Sequence: Synthetic peptide
  Seed: MPMQDIKMIL (PRAME_HUMAN)
MMMQDIKMIV

SEQ ID NO: 154124 - protein, 10 aa, Artificial Sequence
  Description of Artificial Sequence: Synthetic peptide
  Seed: VRPRRWKLQV (PRAME_HUMAN)
VIPRRWKLQL

SEQ ID NO: 154125 - protein, 9 aa, Artificial Sequence
  Description of Artificial Sequence: Synthetic peptide
  Seed: RWKLQVLDL (PRAME_HUMAN)
RTKLQVLDV

SEQ ID NO: 154126 - protein, 9 aa, Artificial Sequence
  Description of Artificial Sequence: Synthetic peptide
  Seed: TSPRRLVEL (PRAME_HUMAN)
TFPRRLVEM

SEQ ID NO: 154127 - protein, 9 aa, Artificial Sequence
  Description of Artificial Sequence: Synthetic peptide
  Seed: QPFIPVEVL (PRAME_HUMAN)
QPFIPVEVM

SEQ ID NO: 154128 - protein, 9 aa, Artificial Sequence
  Description of Artificial Sequence: Synthetic peptide
  Seed: KAMVQAWPF (PRAME_HUMAN)
KWMVQAWPL

SEQ ID NO: 154129 - protein, 11 aa, Artificial Sequence
  Description of Artificial Sequence: Synthetic peptide
  Seed: QALYVDSLFFL (PRAME_HUMAN)
QWLYVDSLFFL

SEQ ID NO: 154130 - protein, 9 aa, Artificial Sequence
  Description of Artificial Sequence: Synthetic peptide
  Seed: TSPRRLVEL (PRAME_HUMAN)
TSPRRLVEF

SEQ ID NO: 154131 - protein, 9 aa, Artificial Sequence
  Description of Artificial Sequence: Synthetic peptide
  Seed: RLRELLCEL (PRAME_HUMAN)
RARELLCEY

SEQ ID NO: 154132 - protein, 11 aa, Artificial Sequence
  Description of Artificial Sequence: Synthetic peptide
  Seed: QALYVDSLFFL (PRAME_HUMAN)
QQLYVDSLFFF

SEQ ID NO: 154133 - protein, 9 aa, Artificial Sequence
  Description of Artificial Sequence: Synthetic peptide
  Seed: LSHIHASSY (PRAME_HUMAN)
LFHIHASSY

SEQ ID NO: 154134 - protein, 9 aa, Artificial Sequence
  Description of Artificial Sequence: Synthetic peptide
  Seed: LYVDSLFFL (PRAME_HUMAN)
LTVDSLFFV

SEQ ID NO: 154135 - protein, 10 aa, Artificial Sequence
  Description of Artificial Sequence: Synthetic peptide
  Seed: RLSEGDVMHL (PRAME_HUMAN)
RESEGDVMHF

SEQ ID NO: 154136 - protein, 9 aa, Artificial Sequence
  Description of Artificial Sequence: Synthetic peptide
  Seed: YPVPLESYE (PRAME_HUMAN)
YGVPLESYY

SEQ ID NO: 154137 - protein, 10 aa, Artificial Sequence
  Description of Artificial Sequence: Synthetic peptide
  Seed: AMVQAWPFTC (PRAME_HUMAN)
AMVQAWPFTA

SEQ ID NO: 154138 - protein, 9 aa, Artificial Sequence
  Description of Artificial Sequence: Synthetic peptide
  Seed: GQHLHLETF (PRAME_HUMAN)
GFHLHLETY

SEQ ID NO: 154139 - protein, 9 aa, Artificial Sequence
  Description of Artificial Sequence: Synthetic peptide
  Seed: TLSFYGNSI (PRAME_HUMAN)
TASFYGNSL

SEQ ID NO: 154140 - protein, 11 aa, Artificial Sequence
  Description of Artificial Sequence: Synthetic peptide
  Seed: YISMSVWTSPR (PRAME_HUMAN)
YFSMSVWTSPR

SEQ ID NO: 154141 - protein, 9 aa, Artificial Sequence
  Description of Artificial Sequence: Synthetic peptide
  Seed: MVQAWPFTC (PRAME_HUMAN)
MIQAWPFTI

SEQ ID NO: 154142 - protein, 9 aa, Artificial Sequence
  Description of Artificial Sequence: Synthetic peptide
  Seed: RLWGSIQSR (PRAME_HUMAN)
RQWGSIQSK

SEQ ID NO: 154143 - protein, 9 aa, Artificial Sequence
  Description of Artificial Sequence: Synthetic peptide
  Seed: VSQLSVLSL (PRAME_HUMAN)
VHQLSVLSM

SEQ ID NO: 154144 - protein, 10 aa, Artificial Sequence
  Description of Artificial Sequence: Synthetic peptide
  Seed: LSFYGNSISI (PRAME_HUMAN)
LCFYGNSISM

SEQ ID NO: 154145 - protein, 9 aa, Artificial Sequence
  Description of Artificial Sequence: Synthetic peptide
  Seed: KVDGLSTEA (PRAME_HUMAN)
KADGLSTEL

SEQ ID NO: 154146 - protein, 9 aa, Artificial Sequence
  Description of Artificial Sequence: Synthetic peptide
  Seed: YSFPEPEAA (PRAME_HUMAN)
YHFPEPEAV

SEQ ID NO: 154147 - protein, 9 aa, Artificial Sequence
  Description of Artificial Sequence: Synthetic peptide
  Seed: FYDPEPILC (PRAME_HUMAN)
FWDPEPILA

SEQ ID NO: 154148 - protein, 10 aa, Artificial Sequence
  Description of Artificial Sequence: Synthetic peptide
  Seed: SISISALQSL (PRAME_HUMAN)
SQSISALQSY

SEQ ID NO: 154149 - protein, 10 aa, Artificial Sequence
  Description of Artificial Sequence: Synthetic peptide
  Seed: DFWTVWSGNR (PRAME_HUMAN)
DMWTVWSGNR

SEQ ID NO: 154150 - protein, 9 aa, Artificial Sequence
  Description of Artificial Sequence: Synthetic peptide
  Seed: KAMVQAWPF (PRAME_HUMAN)
KLMVQAWPL

SEQ ID NO: 154151 - protein, 10 aa, Artificial Sequence
  Description of Artificial Sequence: Synthetic peptide
  Seed: TSQFLSLQCL (PRAME_HUMAN)
TAQFLSLQCF

SEQ ID NO: 154152 - protein, 9 aa, Artificial Sequence
  Description of Artificial Sequence: Synthetic peptide
  Seed: TLKAMVQAW (PRAME_HUMAN)
TAKAMVQAY

SEQ ID NO: 154153 - protein, 9 aa, Artificial Sequence
  Description of Artificial Sequence: Synthetic peptide
  Seed: LAIAALELL (PRAME_HUMAN)
LQIAALELM

SEQ ID NO: 154154 - protein, 9 aa, Artificial Sequence
  Description of Artificial Sequence: Synthetic peptide
  Seed: KVDGLSTEA (PRAME_HUMAN)
KWDGLSTEL

SEQ ID NO: 154155 - protein, 9 aa, Artificial Sequence
  Description of Artificial Sequence: Synthetic peptide
  Seed: LQHLIGLSN (PRAME_HUMAN)
LQHLIGLSF

SEQ ID NO: 154156 - protein, 9 aa, Artificial Sequence
  Description of Artificial Sequence: Synthetic peptide
  Seed: ALLPSLSHC (PRAME_HUMAN)
AILPSLSHV

SEQ ID NO: 154157 - protein, 10 aa, Artificial Sequence
  Description of Artificial Sequence: Synthetic peptide
  Seed: VLYPVPLESY (PRAME_HUMAN)
VSYPVPLESF

SEQ ID NO: 154158 - protein, 10 aa, Artificial Sequence
  Description of Artificial Sequence: Synthetic peptide
  Seed: GACDELFSYL (PRAME_HUMAN)
GTCDELFSYF

SEQ ID NO: 154159 - protein, 9 aa, Artificial Sequence
  Description of Artificial Sequence: Synthetic peptide
  Seed: IAALELLPR (PRAME_HUMAN)
IMALELLPK

SEQ ID NO: 154160 - protein, 9 aa, Artificial Sequence
  Description of Artificial Sequence: Synthetic peptide
  Seed: NPLETLSIT (PRAME_HUMAN)
NPLETLSIA

SEQ ID NO: 154161 - protein, 10 aa, Artificial Sequence
  Description of Artificial Sequence: Synthetic peptide
  Seed: AFDGRHSQTL (PRAME_HUMAN)
ATDGRHSQTL

SEQ ID NO: 154162 - protein, 9 aa, Artificial Sequence
  Description of Artificial Sequence: Synthetic peptide
  Seed: EAAQPMTKK (PRAME_HUMAN)
ETAQPMTKH

SEQ ID NO: 154163 - protein, 9 aa, Artificial Sequence
  Description of Artificial Sequence: Synthetic peptide
  Seed: HVMNPLETL (PRAME_HUMAN)
HRMNPLETV

SEQ ID NO: 154164 - protein, 9 aa, Artificial Sequence
  Description of Artificial Sequence: Synthetic peptide
  Seed: KFSPYLGQM (PRAME_HUMAN)
KYSPYLGQW

SEQ ID NO: 154165 - protein, 9 aa, Artificial Sequence
  Description of Artificial Sequence: Synthetic peptide
  Seed: ALYVDSLFF (PRAME_HUMAN)
AMYVDSLFM

SEQ ID NO: 154166 - protein, 9 aa, Artificial Sequence
  Description of Artificial Sequence: Synthetic peptide
  Seed: KEGACDELF (PRAME_HUMAN)
KQGACDELF

SEQ ID NO: 154167 - protein, 10 aa, Artificial Sequence
  Description of Artificial Sequence: Synthetic peptide
  Seed: IQSRYISMSV (PRAME_HUMAN)
IYSRYISMSK

SEQ ID NO: 154168 - protein, 9 aa, Artificial Sequence
  Description of Artificial Sequence: Synthetic peptide
  Seed: LSHIHASSY (PRAME_HUMAN)
LIHIHASSY

SEQ ID NO: 154169 - protein, 9 aa, Artificial Sequence
  Description of Artificial Sequence: Synthetic peptide
  Seed: LQALYVDSL (PRAME_HUMAN)
LLALYVDSY

SEQ ID NO: 154170 - protein, 10 aa, Artificial Sequence
  Description of Artificial Sequence: Synthetic peptide
  Seed: YIAQFTSQFL (PRAME_HUMAN)
YIAQFTSQFF

SEQ ID NO: 154171 - protein, 11 aa, Artificial Sequence
  Description of Artificial Sequence: Synthetic peptide
  Seed: AAFDGRHSQTL (PRAME_HUMAN)
AHFDGRHSQTF

SEQ ID NO: 154172 - protein, 9 aa, Artificial Sequence
  Description of Artificial Sequence: Synthetic peptide
  Seed: YLHARLREL (PRAME_HUMAN)
YLHARLREM

SEQ ID NO: 154173 - protein, 9 aa, Artificial Sequence
  Description of Artificial Sequence: Synthetic peptide
  Seed: GQHLHLETF (PRAME_HUMAN)
GFHLHLETM

SEQ ID NO: 154174 - protein, 9 aa, Artificial Sequence
  Description of Artificial Sequence: Synthetic peptide
  Seed: NSHQDFWTV (PRAME_HUMAN)
NIHQDFWTA

SEQ ID NO: 154175 - protein, 10 aa, Artificial Sequence
  Description of Artificial Sequence: Synthetic peptide
  Seed: KGQHLHLETF (PRAME_HUMAN)
KCQHLHLETF

SEQ ID NO: 154176 - protein, 11 aa, Artificial Sequence
  Description of Artificial Sequence: Synthetic peptide
  Seed: LTDVSPEPLQA (PRAME_HUMAN)
LADVSPEPLQM

SEQ ID NO: 154177 - protein, 10 aa, Artificial Sequence
  Description of Artificial Sequence: Synthetic peptide
  Seed: ETLSITNCRL (PRAME_HUMAN)
EVLSITNCRR

SEQ ID NO: 154178 - protein, 11 aa, Artificial Sequence
  Description of Artificial Sequence: Synthetic peptide
  Seed: QALYVDSLFFL (PRAME_HUMAN)
QLLYVDSLFFL

SEQ ID NO: 154179 - protein, 10 aa, Artificial Sequence
  Description of Artificial Sequence: Synthetic peptide
  Seed: RASATLQDLV (PRAME_HUMAN)
RQSATLQDLF

SEQ ID NO: 154180 - protein, 9 aa, Artificial Sequence
  Description of Artificial Sequence: Synthetic peptide
  Seed: RTFYDPEPI (PRAME_HUMAN)
RAFYDPEPY

SEQ ID NO: 154181 - protein, 9 aa, Artificial Sequence
  Description of Artificial Sequence: Synthetic peptide
  Seed: ALQSLLQHL (PRAME_HUMAN)
AIQSLLQHR

SEQ ID NO: 154182 - protein, 10 aa, Artificial Sequence
  Description of Artificial Sequence: Synthetic peptide
  Seed: RRRLWGSIQS (PRAME_HUMAN)
RRRLWGSIQL

SEQ ID NO: 154183 - protein, 9 aa, Artificial Sequence
  Description of Artificial Sequence: Synthetic peptide
  Seed: ALQSLLQHL (PRAME_HUMAN)
AAQSLLQHY

SEQ ID NO: 154184 - protein, 9 aa, Artificial Sequence
  Description of Artificial Sequence: Synthetic peptide
  Seed: RLWGSIQSR (PRAME_HUMAN)
RAWGSIQSF

SEQ ID NO: 154185 - protein, 10 aa, Artificial Sequence
  Description of Artificial Sequence: Synthetic peptide
  Seed: MVQAWPFTCL (PRAME_HUMAN)
MCQAWPFTCF

SEQ ID NO: 154186 - protein, 9 aa, Artificial Sequence
  Description of Artificial Sequence: Synthetic peptide
  Seed: LLSHIHASS (PRAME_HUMAN)
LMSHIHASM

SEQ ID NO: 154187 - protein, 9 aa, Artificial Sequence
  Description of Artificial Sequence: Synthetic peptide
  Seed: SIQSRYISM (PRAME_HUMAN)
SPQSRYISF

SEQ ID NO: 154188 - protein, 9 aa, Artificial Sequence
  Description of Artificial Sequence: Synthetic peptide
  Seed: VLDGLDVLL (PRAME_HUMAN)
VFDGLDVLV

SEQ ID NO: 154189 - protein, 10 aa, Artificial Sequence
  Description of Artificial Sequence: Synthetic peptide
  Seed: RLAYLHARLR (PRAME_HUMAN)
RLAYLHARLL

SEQ ID NO: 154190 - protein, 11 aa, Artificial Sequence
  Description of Artificial Sequence: Synthetic peptide
  Seed: ALYVDSLFFLR (PRAME_HUMAN)
ALYVDSLFFLM

SEQ ID NO: 154191 - protein, 11 aa, Artificial Sequence
  Description of Artificial Sequence: Synthetic peptide
  Seed: KNSHQDFWTVW (PRAME_HUMAN)
KVSHQDFWTVW

SEQ ID NO: 154192 - protein, 9 aa, Artificial Sequence
  Description of Artificial Sequence: Synthetic peptide
  Seed: LYPVPLESY (PRAME_HUMAN)
LSPVPLESF

SEQ ID NO: 154193 - protein, 10 aa, Artificial Sequence
  Description of Artificial Sequence: Synthetic peptide
  Seed: LLPRELFPPL (PRAME_HUMAN)
LFPRELFPPI

SEQ ID NO: 154194 - protein, 10 aa, Artificial Sequence
  Description of Artificial Sequence: Synthetic peptide
  Seed: RELFPPLFMA (PRAME_HUMAN)
RALFPPLFMT

SEQ ID NO: 154195 - protein, 11 aa, Artificial Sequence
  Description of Artificial Sequence: Synthetic peptide
  Seed: RELFPPLFMAA (PRAME_HUMAN)
RILFPPLFMAV

SEQ ID NO: 154196 - protein, 9 aa, Artificial Sequence
  Description of Artificial Sequence: Synthetic peptide
  Seed: ERLAYLHAR (PRAME_HUMAN)
ETLAYLHAR

SEQ ID NO: 154197 - protein, 9 aa, Artificial Sequence
  Description of Artificial Sequence: Synthetic peptide
  Seed: VLMKGQHLH (PRAME_HUMAN)
VIMKGQHLF

SEQ ID NO: 154198 - protein, 8 aa, Artificial Sequence
  Description of Artificial Sequence: Synthetic peptide
  Seed: ITDDQLLA (PRAME_HUMAN)
IGDDQLLM

SEQ ID NO: 154199 - protein, 9 aa, Artificial Sequence
  Description of Artificial Sequence: Synthetic peptide
  Seed: LSVLSLSGV (PRAME_HUMAN)
LAVLSLSGW

SEQ ID NO: 154200 - protein, 10 aa, Artificial Sequence
  Description of Artificial Sequence: Synthetic peptide
  Seed: SMVWLSANPC (PRAME_HUMAN)
SMVWLSANPV

SEQ ID NO: 154201 - protein, 9 aa, Artificial Sequence
  Description of Artificial Sequence: Synthetic peptide
  Seed: YVDSLFFLR (PRAME_HUMAN)
YYDSLFFLR

SEQ ID NO: 154202 - protein, 10 aa, Artificial Sequence
  Description of Artificial Sequence: Synthetic peptide
  Seed: ELFPPLFMAA (PRAME_HUMAN)
ESFPPLFMAI

SEQ ID NO: 154203 - protein, 9 aa, Artificial Sequence
  Description of Artificial Sequence: Synthetic peptide
  Seed: IFAMPMQDI (PRAME_HUMAN)
IYAMPMQDF

SEQ ID NO: 154204 - protein, 9 aa, Artificial Sequence
  Description of Artificial Sequence: Synthetic peptide
  Seed: SLLQHLIGL (PRAME_HUMAN)
SMLQHLIGC

SEQ ID NO: 154205 - protein, 10 aa, Artificial Sequence
  Description of Artificial Sequence: Synthetic peptide
  Seed: LLSHIHASSY (PRAME_HUMAN)
LHSHIHASSF

SEQ ID NO: 154206 - protein, 10 aa, Artificial Sequence
  Description of Artificial Sequence: Synthetic peptide
  Seed: RGRLDQLLRH (PRAME_HUMAN)
RCRLDQLLRI

SEQ ID NO: 154207 - protein, 9 aa, Artificial Sequence
  Description of Artificial Sequence: Synthetic peptide
  Seed: TFYDPEPIL (PRAME_HUMAN)
TYYDPEPIF

SEQ ID NO: 154208 - protein, 9 aa, Artificial Sequence
  Description of Artificial Sequence: Synthetic peptide
  Seed: YVDSLFFLR (PRAME_HUMAN)
YTDSLFFLH

SEQ ID NO: 154209 - protein, 9 aa, Artificial Sequence
  Description of Artificial Sequence: Synthetic peptide
  Seed: YLHARLREL (PRAME_HUMAN)
YQHARLREY

SEQ ID NO: 154210 - protein, 9 aa, Artificial Sequence
  Description of Artificial Sequence: Synthetic peptide
  Seed: VWSGNRASL (PRAME_HUMAN)
VYSGNRASW

SEQ ID NO: 154211 - protein, 9 aa, Artificial Sequence
  Description of Artificial Sequence: Synthetic peptide
  Seed: LLLSHIHAS (PRAME_HUMAN)
LLLSHIHAV

SEQ ID NO: 154212 - protein, 10 aa, Artificial Sequence
  Description of Artificial Sequence: Synthetic peptide
  Seed: GQHLHLETFK (PRAME_HUMAN)
GVHLHLETFK

SEQ ID NO: 154213 - protein, 9 aa, Artificial Sequence
  Description of Artificial Sequence: Synthetic peptide
  Seed: CPHCGDRTF (PRAME_HUMAN)
CAHCGDRTY

SEQ ID NO: 154214 - protein, 9 aa, Artificial Sequence
  Description of Artificial Sequence: Synthetic peptide
  Seed: KAMVQAWPF (PRAME_HUMAN)
KMMVQAWPY

SEQ ID NO: 154215 - protein, 10 aa, Artificial Sequence
  Description of Artificial Sequence: Synthetic peptide
  Seed: RRLWGSIQSR (PRAME_HUMAN)
RRLWGSIQSK

SEQ ID NO: 154216 - protein, 10 aa, Artificial Sequence
  Description of Artificial Sequence: Synthetic peptide
  Seed: MPMQDIKMIL (PRAME_HUMAN)
MAMQDIKMIM

SEQ ID NO: 154217 - protein, 9 aa, Artificial Sequence
  Description of Artificial Sequence: Synthetic peptide
  Seed: ACDELFSYL (PRAME_HUMAN)
ARDELFSYF

SEQ ID NO: 154218 - protein, 11 aa, Artificial Sequence
  Description of Artificial Sequence: Synthetic peptide
  Seed: RRLWGSIQSRY (PRAME_HUMAN)
RRLWGSIQSRL

SEQ ID NO: 154219 - protein, 10 aa, Artificial Sequence
  Description of Artificial Sequence: Synthetic peptide
  Seed: ERLAYLHARL (PRAME_HUMAN)
EALAYLHARV

SEQ ID NO: 154220 - protein, 10 aa, Artificial Sequence
  Description of Artificial Sequence: Synthetic peptide
  Seed: LLSHIHASSY (PRAME_HUMAN)
LKSHIHASSF

SEQ ID NO: 154221 - protein, 10 aa, Artificial Sequence
  Description of Artificial Sequence: Synthetic peptide
  Seed: VRPRRWKLQV (PRAME_HUMAN)
VYPRRWKLQL

SEQ ID NO: 154222 - protein, 10 aa, Artificial Sequence
  Description of Artificial Sequence: Synthetic peptide
  Seed: RLVELAGQSL (PRAME_HUMAN)
RQVELAGQSL

SEQ ID NO: 154223 - protein, 9 aa, Artificial Sequence
  Description of Artificial Sequence: Synthetic peptide
  Seed: RPSMVWLSA (PRAME_HUMAN)
RPSMVWLSL

SEQ ID NO: 154224 - protein, 10 aa, Artificial Sequence
  Description of Artificial Sequence: Synthetic peptide
  Seed: TFYDPEPILC (PRAME_HUMAN)
TYYDPEPILW

SEQ ID NO: 154225 - protein, 9 aa, Artificial Sequence
  Description of Artificial Sequence: Synthetic peptide
  Seed: AQFTSQFLS (PRAME_HUMAN)
AVFTSQFLV

SEQ ID NO: 154226 - protein, 10 aa, Artificial Sequence
  Description of Artificial Sequence: Synthetic peptide
  Seed: AMVQAWPFTC (PRAME_HUMAN)
AHVQAWPFTV

SEQ ID NO: 154227 - protein, 9 aa, Artificial Sequence
  Description of Artificial Sequence: Synthetic peptide
  Seed: ISISALQSL (PRAME_HUMAN)
IIISALQSM

SEQ ID NO: 154228 - protein, 9 aa, Artificial Sequence
  Description of Artificial Sequence: Synthetic peptide
  Seed: LKMVQLDSI (PRAME_HUMAN)
LRMVQLDSF

SEQ ID NO: 154229 - protein, 9 aa, Artificial Sequence
  Description of Artificial Sequence: Synthetic peptide
  Seed: LLAQEVRPR (PRAME_HUMAN)
LTAQEVRPK

SEQ ID NO: 154230 - protein, 8 aa, Artificial Sequence
  Description of Artificial Sequence: Synthetic peptide
  Seed: LHLERLAY (PRAME_HUMAN)
LQLERLAY

SEQ ID NO: 154231 - protein, 9 aa, Artificial Sequence
  Description of Artificial Sequence: Synthetic peptide
  Seed: MVQAWPFTC (PRAME_HUMAN)
MMQAWPFTT

SEQ ID NO: 154232 - protein, 9 aa, Artificial Sequence
  Description of Artificial Sequence: Synthetic peptide
  Seed: SQSPSVSQL (PRAME_HUMAN)
STSPSVSQI

SEQ ID NO: 154233 - protein, 10 aa, Artificial Sequence
  Description of Artificial Sequence: Synthetic peptide
  Seed: AAFDGRHSQT (PRAME_HUMAN)
AEFDGRHSQY

SEQ ID NO: 154234 - protein, 9 aa, Artificial Sequence
  Description of Artificial Sequence: Synthetic peptide
  Seed: IAALELLPR (PRAME_HUMAN)
IMALELLPR

SEQ ID NO: 154235 - protein, 9 aa, Artificial Sequence
  Description of Artificial Sequence: Synthetic peptide
  Seed: VLDGLDVLL (PRAME_HUMAN)
VWDGLDVLL

SEQ ID NO: 154236 - protein, 10 aa, Artificial Sequence
  Description of Artificial Sequence: Synthetic peptide
  Seed: RHVMNPLETL (PRAME_HUMAN)
RFVMNPLETW

SEQ ID NO: 154237 - protein, 10 aa, Artificial Sequence
  Description of Artificial Sequence: Synthetic peptide
  Seed: SLYSFPEPEA (PRAME_HUMAN)
STYSFPEPEV

SEQ ID NO: 154238 - protein, 10 aa, Artificial Sequence
  Description of Artificial Sequence: Synthetic peptide
  Seed: LPTLAKFSPY (PRAME_HUMAN)
LSTLAKFSPF

SEQ ID NO: 154239 - protein, 9 aa, Artificial Sequence
  Description of Artificial Sequence: Synthetic peptide
  Seed: LSHIHASSY (PRAME_HUMAN)
LRHIHASSY

SEQ ID NO: 154240 - protein, 9 aa, Artificial Sequence
  Description of Artificial Sequence: Synthetic peptide
  Seed: ELFSYLIEK (PRAME_HUMAN)
ENFSYLIEK

SEQ ID NO: 154241 - protein, 8 aa, Artificial Sequence
  Description of Artificial Sequence: Synthetic peptide
  Seed: ALYVDSLF (PRAME_HUMAN)
AMYVDSLY

SEQ ID NO: 154242 - protein, 9 aa, Artificial Sequence
  Description of Artificial Sequence: Synthetic peptide
  Seed: ESYEDIHGT (PRAME_HUMAN)
ETYEDIHGL

SEQ ID NO: 154243 - protein, 9 aa, Artificial Sequence
  Description of Artificial Sequence: Synthetic peptide
  Seed: RTFYDPEPI (PRAME_HUMAN)
RSFYDPEPM

SEQ ID NO: 154244 - protein, 11 aa, Artificial Sequence
  Description of Artificial Sequence: Synthetic peptide
  Seed: SNLTHVLYPVP (PRAME_HUMAN)
SLLTHVLYPVH

SEQ ID NO: 154245 - protein, 9 aa, Artificial Sequence
  Description of Artificial Sequence: Synthetic peptide
  Seed: YLHARLREL (PRAME_HUMAN)
YLHARLRET

SEQ ID NO: 154246 - protein, 10 aa, Artificial Sequence
  Description of Artificial Sequence: Synthetic peptide
  Seed: QAWPFTCLPL (PRAME_HUMAN)
QCWPFTCLPF

SEQ ID NO: 154247 - protein, 9 aa, Artificial Sequence
  Description of Artificial Sequence: Synthetic peptide
  Seed: ERLAYLHAR (PRAME_HUMAN)
ESLAYLHAR

SEQ ID NO: 154248 - protein, 11 aa, Artificial Sequence
  Description of Artificial Sequence: Synthetic peptide
  Seed: QALYVDSLFFL (PRAME_HUMAN)
QLLYVDSLFFF

SEQ ID NO: 154249 - protein, 10 aa, Artificial Sequence
  Description of Artificial Sequence: Synthetic peptide
  Seed: LSQSPSVSQL (PRAME_HUMAN)
LSQSPSVSQM

SEQ ID NO: 154250 - protein, 9 aa, Artificial Sequence
  Description of Artificial Sequence: Synthetic peptide
  Seed: THVLYPVPL (PRAME_HUMAN)
TMVLYPVPY

SEQ ID NO: 154251 - protein, 8 aa, Artificial Sequence
  Description of Artificial Sequence: Synthetic peptide
  Seed: FYDPEPIL (PRAME_HUMAN)
FTDPEPII

SEQ ID NO: 154252 - protein, 10 aa, Artificial Sequence
  Description of Artificial Sequence: Synthetic peptide
  Seed: ARLRELLCEL (PRAME_HUMAN)
AFLRELLCEL

SEQ ID NO: 154253 - protein, 9 aa, Artificial Sequence
  Description of Artificial Sequence: Synthetic peptide
  Seed: QFTSQFLSL (PRAME_HUMAN)
QRTSQFLSY

SEQ ID NO: 154254 - protein, 10 aa, Artificial Sequence
  Description of Artificial Sequence: Synthetic peptide
  Seed: MERRRLWGSI (PRAME_HUMAN)
MFRRRLWGSL

SEQ ID NO: 154255 - protein, 11 aa, Artificial Sequence
  Description of Artificial Sequence: Synthetic peptide
  Seed: RRWKLQVLDLR (PRAME_HUMAN)
RRWKLQVLDLQ

SEQ ID NO: 154256 - protein, 9 aa, Artificial Sequence
  Description of Artificial Sequence: Synthetic peptide
  Seed: TSPRRLVEL (PRAME_HUMAN)
TSPRRLVEV

SEQ ID NO: 154257 - protein, 9 aa, Artificial Sequence
  Description of Artificial Sequence: Synthetic peptide
  Seed: VWSGNRASL (PRAME_HUMAN)
VLSGNRASL

SEQ ID NO: 154258 - protein, 9 aa, Artificial Sequence
  Description of Artificial Sequence: Synthetic peptide
  Seed: ISPEKEEQY (PRAME_HUMAN)
ISPEKEEQL

SEQ ID NO: 154259 - protein, 9 aa, Artificial Sequence
  Description of Artificial Sequence: Synthetic peptide
  Seed: YEDIHGTLH (PRAME_HUMAN)
YEDIHGTLY

SEQ ID NO: 154260 - protein, 10 aa, Artificial Sequence
  Description of Artificial Sequence: Synthetic peptide
  Seed: AIAALELLPR (PRAME_HUMAN)
AAAALELLPK

SEQ ID NO: 154261 - protein, 10 aa, Artificial Sequence
  Description of Artificial Sequence: Synthetic peptide
  Seed: RGRLDQLLRH (PRAME_HUMAN)
RARLDQLLRF

SEQ ID NO: 154262 - protein, 9 aa, Artificial Sequence
  Description of Artificial Sequence: Synthetic peptide
  Seed: YVDSLFFLR (PRAME_HUMAN)
YCDSLFFLY

SEQ ID NO: 154263 - protein, 10 aa, Artificial Sequence
  Description of Artificial Sequence: Synthetic peptide
  Seed: FAMPMQDIKM (PRAME_HUMAN)
FTMPMQDIKL

SEQ ID NO: 154264 - protein, 10 aa, Artificial Sequence
  Description of Artificial Sequence: Synthetic peptide
  Seed: QYIAQFTSQF (PRAME_HUMAN)
QFIAQFTSQY

SEQ ID NO: 154265 - protein, 10 aa, Artificial Sequence
  Description of Artificial Sequence: Synthetic peptide
  Seed: SISISALQSL (PRAME_HUMAN)
SYSISALQSF

SEQ ID NO: 154266 - protein, 9 aa, Artificial Sequence
  Description of Artificial Sequence: Synthetic peptide
  Seed: RTFYDPEPI (PRAME_HUMAN)
RQFYDPEPW

SEQ ID NO: 154267 - protein, 10 aa, Artificial Sequence
  Description of Artificial Sequence: Synthetic peptide
  Seed: RHVMNPLETL (PRAME_HUMAN)
RTVMNPLETW

SEQ ID NO: 154268 - protein, 9 aa, Artificial Sequence
  Description of Artificial Sequence: Synthetic peptide
  Seed: ESYEDIHGT (PRAME_HUMAN)
ESYEDIHGV

SEQ ID NO: 154269 - protein, 9 aa, Artificial Sequence
  Description of Artificial Sequence: Synthetic peptide
  Seed: LPRELFPPL (PRAME_HUMAN)
LMRELFPPL

SEQ ID NO: 154270 - protein, 9 aa, Artificial Sequence
  Description of Artificial Sequence: Synthetic peptide
  Seed: KEEQYIAQF (PRAME_HUMAN)
KLEQYIAQY

SEQ ID NO: 154271 - protein, 10 aa, Artificial Sequence
  Description of Artificial Sequence: Synthetic peptide
  Seed: MERRRLWGSI (PRAME_HUMAN)
MQRRRLWGSV

SEQ ID NO: 154272 - protein, 9 aa, Artificial Sequence
  Description of Artificial Sequence: Synthetic peptide
  Seed: LMKGQHLHL (PRAME_HUMAN)
LLKGQHLHW

SEQ ID NO: 154273 - protein, 9 aa, Artificial Sequence
  Description of Artificial Sequence: Synthetic peptide
  Seed: HVMNPLETL (PRAME_HUMAN)
HVMNPLETM

SEQ ID NO: 154274 - protein, 9 aa, Artificial Sequence
  Description of Artificial Sequence: Synthetic peptide
  Seed: VLDGLDVLL (PRAME_HUMAN)
VIDGLDVLV

SEQ ID NO: 154275 - protein, 9 aa, Artificial Sequence
  Description of Artificial Sequence: Synthetic peptide
  Seed: QPFIPVEVL (PRAME_HUMAN)
QQFIPVEVL

SEQ ID NO: 154276 - protein, 10 aa, Artificial Sequence
  Description of Artificial Sequence: Synthetic peptide
  Seed: LLLSHIHASS (PRAME_HUMAN)
LLLSHIHASI

SEQ ID NO: 154277 - protein, 10 aa, Artificial Sequence
  Description of Artificial Sequence: Synthetic peptide
  Seed: ALYVDSLFFL (PRAME_HUMAN)
ALYVDSLFFR

SEQ ID NO: 154278 - protein, 10 aa, Artificial Sequence
  Description of Artificial Sequence: Synthetic peptide
  Seed: FAMPMQDIKM (PRAME_HUMAN)
FLMPMQDIKL

SEQ ID NO: 154279 - protein, 9 aa, Artificial Sequence
  Description of Artificial Sequence: Synthetic peptide
  Seed: LSTEAEQPF (PRAME_HUMAN)
LKTEAEQPY

SEQ ID NO: 154280 - protein, 9 aa, Artificial Sequence
  Description of Artificial Sequence: Synthetic peptide
  Seed: RWKLQVLDL (PRAME_HUMAN)
RYKLQVLDF

SEQ ID NO: 154281 - protein, 9 aa, Artificial Sequence
  Description of Artificial Sequence: Synthetic peptide
  Seed: SIQSRYISM (PRAME_HUMAN)
SLQSRYISI

SEQ ID NO: 154282 - protein, 10 aa, Artificial Sequence
  Description of Artificial Sequence: Synthetic peptide
  Seed: RLSEGDVMHL (PRAME_HUMAN)
RISEGDVMHY

SEQ ID NO: 154283 - protein, 9 aa, Artificial Sequence
  Description of Artificial Sequence: Synthetic peptide
  Seed: ALLPSLSHC (PRAME_HUMAN)
ATLPSLSHA

SEQ ID NO: 154284 - protein, 10 aa, Artificial Sequence
  Description of Artificial Sequence: Synthetic peptide
  Seed: FFLRGRLDQL (PRAME_HUMAN)
FLLRGRLDQL

SEQ ID NO: 154285 - protein, 9 aa, Artificial Sequence
  Description of Artificial Sequence: Synthetic peptide
  Seed: SALQSLLQH (PRAME_HUMAN)
STLQSLLQL

SEQ ID NO: 154286 - protein, 10 aa, Artificial Sequence
  Description of Artificial Sequence: Synthetic peptide
  Seed: VLMKGQHLHL (PRAME_HUMAN)
VMMKGQHLHR

SEQ ID NO: 154287 - protein, 9 aa, Artificial Sequence
  Description of Artificial Sequence: Synthetic peptide
  Seed: SISALQSLL (PRAME_HUMAN)
SLSALQSLR

SEQ ID NO: 154288 - protein, 9 aa, Artificial Sequence
  Description of Artificial Sequence: Synthetic peptide
  Seed: SRYISMSVW (PRAME_HUMAN)
SMYISMSVH

SEQ ID NO: 154289 - protein, 10 aa, Artificial Sequence
  Description of Artificial Sequence: Synthetic peptide
  Seed: AALELLPREL (PRAME_HUMAN)
ALLELLPREV

SEQ ID NO: 154290 - protein, 9 aa, Artificial Sequence
  Description of Artificial Sequence: Synthetic peptide
  Seed: SIQSRYISM (PRAME_HUMAN)
SQQSRYISL

SEQ ID NO: 154291 - protein, 10 aa, Artificial Sequence
  Description of Artificial Sequence: Synthetic peptide
  Seed: DRTFYDPEPI (PRAME_HUMAN)
DHTFYDPEPV

SEQ ID NO: 154292 - protein, 9 aa, Artificial Sequence
  Description of Artificial Sequence: Synthetic peptide
  Seed: AVLDGLDVL (PRAME_HUMAN)
ATLDGLDVL

SEQ ID NO: 154293 - protein, 10 aa, Artificial Sequence
  Description of Artificial Sequence: Synthetic peptide
  Seed: HCSQLTTLSF (PRAME_HUMAN)
HRSQLTTLSW

SEQ ID NO: 154294 - protein, 9 aa, Artificial Sequence
  Description of Artificial Sequence: Synthetic peptide
  Seed: QALYVDSLF (PRAME_HUMAN)
QCLYVDSLW

SEQ ID NO: 154295 - protein, 9 aa, Artificial Sequence
  Description of Artificial Sequence: Synthetic peptide
  Seed: GLSNLTHVL (PRAME_HUMAN)
GVSNLTHVV

SEQ ID NO: 154296 - protein, 10 aa, Artificial Sequence
  Description of Artificial Sequence: Synthetic peptide
  Seed: ISMSVWTSPR (PRAME_HUMAN)
IGMSVWTSPK

SEQ ID NO: 154297 - protein, 9 aa, Artificial Sequence
  Description of Artificial Sequence: Synthetic peptide
  Seed: GQHLHLETF (PRAME_HUMAN)
GQHLHLETY

SEQ ID NO: 154298 - protein, 9 aa, Artificial Sequence
  Description of Artificial Sequence: Synthetic peptide
  Seed: MHLSQSPSV (PRAME_HUMAN)
MSLSQSPSY

SEQ ID NO: 154299 - protein, 11 aa, Artificial Sequence
  Description of Artificial Sequence: Synthetic peptide
  Seed: SIQSRYISMSV (PRAME_HUMAN)
SHQSRYISMSK

SEQ ID NO: 154300 - protein, 9 aa, Artificial Sequence
  Description of Artificial Sequence: Synthetic peptide
  Seed: RLDQLLRHV (PRAME_HUMAN)
RMDQLLRHL

SEQ ID NO: 154301 - protein, 9 aa, Artificial Sequence
  Description of Artificial Sequence: Synthetic peptide
  Seed: MQDIKMILK (PRAME_HUMAN)
MSDIKMILK

SEQ ID NO: 154302 - protein, 10 aa, Artificial Sequence
  Description of Artificial Sequence: Synthetic peptide
  Seed: YLHARLRELL (PRAME_HUMAN)
YVHARLRELV

SEQ ID NO: 154303 - protein, 9 aa, Artificial Sequence
  Description of Artificial Sequence: Synthetic peptide
  Seed: LLERASATL (PRAME_HUMAN)
LMERASATF

SEQ ID NO: 154304 - protein, 10 aa, Artificial Sequence
  Description of Artificial Sequence: Synthetic peptide
  Seed: SQLTTLSFYG (PRAME_HUMAN)
SALTTLSFYY

SEQ ID NO: 154305 - protein, 9 aa, Artificial Sequence
  Description of Artificial Sequence: Synthetic peptide
  Seed: SQFLSLQCL (PRAME_HUMAN)
SHFLSLQCL

SEQ ID NO: 154306 - protein, 10 aa, Artificial Sequence
  Description of Artificial Sequence: Synthetic peptide
  Seed: SPYLGQMINL (PRAME_HUMAN)
SYYLGQMINW

SEQ ID NO: 154307 - protein, 10 aa, Artificial Sequence
  Description of Artificial Sequence: Synthetic peptide
  Seed: LSQSPSVSQL (PRAME_HUMAN)
LIQSPSVSQY

SEQ ID NO: 154308 - protein, 9 aa, Artificial Sequence
  Description of Artificial Sequence: Synthetic peptide
  Seed: TSPRRLVEL (PRAME_HUMAN)
TLPRRLVEL

SEQ ID NO: 154309 - protein, 10 aa, Artificial Sequence
  Description of Artificial Sequence: Synthetic peptide
  Seed: VRPRRWKLQV (PRAME_HUMAN)
VCPRRWKLQL

SEQ ID NO: 154310 - protein, 9 aa, Artificial Sequence
  Description of Artificial Sequence: Synthetic peptide
  Seed: YSFPEPEAA (PRAME_HUMAN)
YGFPEPEAL

SEQ ID NO: 154311 - protein, 10 aa, Artificial Sequence
  Description of Artificial Sequence: Synthetic peptide
  Seed: ARLRELLCEL (PRAME_HUMAN)
ALLRELLCEV

SEQ ID NO: 154312 - protein, 11 aa, Artificial Sequence
  Description of Artificial Sequence: Synthetic peptide
  Seed: MKGQHLHLETF (PRAME_HUMAN)
MLGQHLHLETY

SEQ ID NO: 154313 - protein, 9 aa, Artificial Sequence
  Description of Artificial Sequence: Synthetic peptide
  Seed: YIAQFTSQF (PRAME_HUMAN)
YRAQFTSQM

SEQ ID NO: 154314 - protein, 10 aa, Artificial Sequence
  Description of Artificial Sequence: Synthetic peptide
  Seed: KVKRKKNVLR (PRAME_HUMAN)
KSKRKKNVLA

SEQ ID NO: 154315 - protein, 8 aa, Artificial Sequence
  Description of Artificial Sequence: Synthetic peptide
  Seed: FYDPEPIL (PRAME_HUMAN)
FVDPEPIM

SEQ ID NO: 154316 - protein, 9 aa, Artificial Sequence
  Description of Artificial Sequence: Synthetic peptide
  Seed: ALYVDSLFF (PRAME_HUMAN)
ANYVDSLFF

SEQ ID NO: 154317 - protein, 10 aa, Artificial Sequence
  Description of Artificial Sequence: Synthetic peptide
  Seed: AALELLPREL (PRAME_HUMAN)
AALELLPREV

SEQ ID NO: 154318 - protein, 9 aa, Artificial Sequence
  Description of Artificial Sequence: Synthetic peptide
  Seed: RLRELLCEL (PRAME_HUMAN)
RIRELLCEF

SEQ ID NO: 154319 - protein, 9 aa, Artificial Sequence
  Description of Artificial Sequence: Synthetic peptide
  Seed: WLSANPCPH (PRAME_HUMAN)
WQSANPCPF

SEQ ID NO: 154320 - protein, 9 aa, Artificial Sequence
  Description of Artificial Sequence: Synthetic peptide
  Seed: RPRRWKLQV (PRAME_HUMAN)
RPRRWKLQA

SEQ ID NO: 154321 - protein, 9 aa, Artificial Sequence
  Description of Artificial Sequence: Synthetic peptide
  Seed: FPEPEAAQP (PRAME_HUMAN)
FPEPEAAQV

SEQ ID NO: 154322 - protein, 9 aa, Artificial Sequence
  Description of Artificial Sequence: Synthetic peptide
  Seed: FYDPEPILC (PRAME_HUMAN)
FQDPEPILF

SEQ ID NO: 154323 - protein, 11 aa, Artificial Sequence
  Description of Artificial Sequence: Synthetic peptide
  Seed: NPCPHCGDRTF (PRAME_HUMAN)
NTCPHCGDRTF

SEQ ID NO: 154324 - protein, 10 aa, Artificial Sequence
  Description of Artificial Sequence: Synthetic peptide
  Seed: ERLAYLHARL (PRAME_HUMAN)
ELLAYLHARV

SEQ ID NO: 154325 - protein, 11 aa, Artificial Sequence
  Description of Artificial Sequence: Synthetic peptide
  Seed: HVMNPLETLSI (PRAME_HUMAN)
HQMNPLETLSL

SEQ ID NO: 154326 - protein, 9 aa, Artificial Sequence
  Description of Artificial Sequence: Synthetic peptide
  Seed: RLRELLCEL (PRAME_HUMAN)
RTRELLCET

SEQ ID NO: 154327 - protein, 9 aa, Artificial Sequence
  Description of Artificial Sequence: Synthetic peptide
  Seed: ELFSYLIEK (PRAME_HUMAN)
EIFSYLIEY

SEQ ID NO: 154328 - protein, 10 aa, Artificial Sequence
  Description of Artificial Sequence: Synthetic peptide
  Seed: LSQSPSVSQL (PRAME_HUMAN)
LTQSPSVSQY

SEQ ID NO: 154329 - protein, 9 aa, Artificial Sequence
  Description of Artificial Sequence: Synthetic peptide
  Seed: WLSANPCPH (PRAME_HUMAN)
WLSANPCPF

SEQ ID NO: 154330 - protein, 9 aa, Artificial Sequence
  Description of Artificial Sequence: Synthetic peptide
  Seed: AVLDGLDVL (PRAME_HUMAN)
AQLDGLDVY

SEQ ID NO: 154331 - protein, 9 aa, Artificial Sequence
  Description of Artificial Sequence: Synthetic peptide
  Seed: SIQSRYISM (PRAME_HUMAN)
SVQSRYISF

SEQ ID NO: 154332 - protein, 10 aa, Artificial Sequence
  Description of Artificial Sequence: Synthetic peptide
  Seed: LLKDEALAIA (PRAME_HUMAN)
LMKDEALAIV

SEQ ID NO: 154333 - protein, 9 aa, Artificial Sequence
  Description of Artificial Sequence: Synthetic peptide
  Seed: LEVTCTWKL (PRAME_HUMAN)
LQVTCTWKI

SEQ ID NO: 154334 - protein, 10 aa, Artificial Sequence
  Description of Artificial Sequence: Synthetic peptide
  Seed: GLSNLTHVLY (PRAME_HUMAN)
GMSNLTHVLR

SEQ ID NO: 154335 - protein, 8 aa, Artificial Sequence
  Description of Artificial Sequence: Synthetic peptide
  Seed: YEDIHGTL (PRAME_HUMAN)
YMDIHGTL

SEQ ID NO: 154336 - protein, 11 aa, Artificial Sequence
  Description of Artificial Sequence: Synthetic peptide
  Seed: RELFPPLFMAA (PRAME_HUMAN)
RWLFPPLFMAL

SEQ ID NO: 154337 - protein, 10 aa, Artificial Sequence
  Description of Artificial Sequence: Synthetic peptide
  Seed: RTFYDPEPIL (PRAME_HUMAN)
RAFYDPEPIY

SEQ ID NO: 154338 - protein, 11 aa, Artificial Sequence
  Description of Artificial Sequence: Synthetic peptide
  Seed: SNLTHVLYPVP (PRAME_HUMAN)
SMLTHVLYPVP

SEQ ID NO: 154339 - protein, 10 aa, Artificial Sequence
  Description of Artificial Sequence: Synthetic peptide
  Seed: ITDDQLLALL (PRAME_HUMAN)
ILDDQLLALY

SEQ ID NO: 154340 - protein, 9 aa, Artificial Sequence
  Description of Artificial Sequence: Synthetic peptide
  Seed: ELFPPLFMA (PRAME_HUMAN)
EAFPPLFMA

SEQ ID NO: 154341 - protein, 11 aa, Artificial Sequence
  Description of Artificial Sequence: Synthetic peptide
  Seed: AAFDGRHSQTL (PRAME_HUMAN)
ASFDGRHSQTF

SEQ ID NO: 154342 - protein, 9 aa, Artificial Sequence
  Description of Artificial Sequence: Synthetic peptide
  Seed: SQSPSVSQL (PRAME_HUMAN)
SASPSVSQH

SEQ ID NO: 154343 - protein, 9 aa, Artificial Sequence
  Description of Artificial Sequence: Synthetic peptide
  Seed: YIAQFTSQF (PRAME_HUMAN)
YAAQFTSQK

SEQ ID NO: 154344 - protein, 9 aa, Artificial Sequence
  Description of Artificial Sequence: Synthetic peptide
  Seed: LSVLSLSGV (PRAME_HUMAN)
LIVLSLSGI

SEQ ID NO: 154345 - protein, 9 aa, Artificial Sequence
  Description of Artificial Sequence: Synthetic peptide
  Seed: FYDPEPILC (PRAME_HUMAN)
FKDPEPILM

SEQ ID NO: 154346 - protein, 10 aa, Artificial Sequence
  Description of Artificial Sequence: Synthetic peptide
  Seed: LERLAYLHAR (PRAME_HUMAN)
LRRLAYLHAL

SEQ ID NO: 154347 - protein, 9 aa, Artificial Sequence
  Description of Artificial Sequence: Synthetic peptide
  Seed: VSPEPLQAL (PRAME_HUMAN)
VWPEPLQAY

SEQ ID NO: 154348 - protein, 11 aa, Artificial Sequence
  Description of Artificial Sequence: Synthetic peptide
  Seed: NLTHVLYPVPL (PRAME_HUMAN)
NLTHVLYPVPV

SEQ ID NO: 154349 - protein, 10 aa, Artificial Sequence
  Description of Artificial Sequence: Synthetic peptide
  Seed: QLLALLPSLS (PRAME_HUMAN)
QQLALLPSLI

SEQ ID NO: 154350 - protein, 10 aa, Artificial Sequence
  Description of Artificial Sequence: Synthetic peptide
  Seed: LKAMVQAWPF (PRAME_HUMAN)
LHAMVQAWPY

SEQ ID NO: 154351 - protein, 10 aa, Artificial Sequence
  Description of Artificial Sequence: Synthetic peptide
  Seed: RLSEGDVMHL (PRAME_HUMAN)
RMSEGDVMHM

SEQ ID NO: 154352 - protein, 10 aa, Artificial Sequence
  Description of Artificial Sequence: Synthetic peptide
  Seed: MERRRLWGSI (PRAME_HUMAN)
MVRRRLWGSL

SEQ ID NO: 154353 - protein, 10 aa, Artificial Sequence
  Description of Artificial Sequence: Synthetic peptide
  Seed: VEVLVDLFLK (PRAME_HUMAN)
VSVLVDLFLR

SEQ ID NO: 154354 - protein, 10 aa, Artificial Sequence
  Description of Artificial Sequence: Synthetic peptide
  Seed: RLSEGDVMHL (PRAME_HUMAN)
RASEGDVMHV

SEQ ID NO: 154355 - protein, 10 aa, Artificial Sequence
  Description of Artificial Sequence: Synthetic peptide
  Seed: FAMPMQDIKM (PRAME_HUMAN)
FSMPMQDIKW

SEQ ID NO: 154356 - protein, 10 aa, Artificial Sequence
  Description of Artificial Sequence: Synthetic peptide
  Seed: KGQHLHLETF (PRAME_HUMAN)
KTQHLHLETF

SEQ ID NO: 154357 - protein, 10 aa, Artificial Sequence
  Description of Artificial Sequence: Synthetic peptide
  Seed: AKFSPYLGQM (PRAME_HUMAN)
ARFSPYLGQF

SEQ ID NO: 154358 - protein, 9 aa, Artificial Sequence
  Description of Artificial Sequence: Synthetic peptide
  Seed: KAMVQAWPF (PRAME_HUMAN)
KSMVQAWPW

SEQ ID NO: 154359 - protein, 10 aa, Artificial Sequence
  Description of Artificial Sequence: Synthetic peptide
  Seed: AEQPFIPVEV (PRAME_HUMAN)
AEQPFIPVET

SEQ ID NO: 154360 - protein, 10 aa, Artificial Sequence
  Description of Artificial Sequence: Synthetic peptide
  Seed: FLKEGACDEL (PRAME_HUMAN)
FLKEGACDEV

SEQ ID NO: 154361 - protein, 8 aa, Artificial Sequence
  Description of Artificial Sequence: Synthetic peptide
  Seed: AEQPFIPV (PRAME_HUMAN)
AEQPFIPI

SEQ ID NO: 154362 - protein, 9 aa, Artificial Sequence
  Description of Artificial Sequence: Synthetic peptide
  Seed: ITDDQLLAL (PRAME_HUMAN)
IQDDQLLAF

SEQ ID NO: 154363 - protein, 9 aa, Artificial Sequence
  Description of Artificial Sequence: Synthetic peptide
  Seed: SQLTTLSFY (PRAME_HUMAN)
SELTTLSFW

SEQ ID NO: 154364 - protein, 10 aa, Artificial Sequence
  Description of Artificial Sequence: Synthetic peptide
  Seed: YEDIHGTLHL (PRAME_HUMAN)
YVDIHGTLHL

SEQ ID NO: 154365 - protein, 11 aa, Artificial Sequence
  Description of Artificial Sequence: Synthetic peptide
  Seed: RLWGSIQSRYI (PRAME_HUMAN)
RMWGSIQSRYM

SEQ ID NO: 154366 - protein, 9 aa, Artificial Sequence
  Description of Artificial Sequence: Synthetic peptide
  Seed: EAAQPMTKK (PRAME_HUMAN)
EMAQPMTKR

SEQ ID NO: 154367 - protein, 10 aa, Artificial Sequence
  Description of Artificial Sequence: Synthetic peptide
  Seed: RYISMSVWTS (PRAME_HUMAN)
RTISMSVWTF

SEQ ID NO: 154368 - protein, 10 aa, Artificial Sequence
  Description of Artificial Sequence: Synthetic peptide
  Seed: AAFDGRHSQT (PRAME_HUMAN)
AGFDGRHSQY

SEQ ID NO: 154369 - protein, 9 aa, Artificial Sequence
  Description of Artificial Sequence: Synthetic peptide
  Seed: YEDIHGTLH (PRAME_HUMAN)
YEDIHGTLI

SEQ ID NO: 154370 - protein, 11 aa, Artificial Sequence
  Description of Artificial Sequence: Synthetic peptide
  Seed: RLWGSIQSRYI (PRAME_HUMAN)
RIWGSIQSRYF

SEQ ID NO: 154371 - protein, 9 aa, Artificial Sequence
  Description of Artificial Sequence: Synthetic peptide
  Seed: FYDPEPILC (PRAME_HUMAN)
FMDPEPILF

SEQ ID NO: 154372 - protein, 9 aa, Artificial Sequence
  Description of Artificial Sequence: Synthetic peptide
  Seed: SQSPSVSQL (PRAME_HUMAN)
SVSPSVSQH

SEQ ID NO: 154373 - protein, 9 aa, Artificial Sequence
  Description of Artificial Sequence: Synthetic peptide
  Seed: RLRELLCEL (PRAME_HUMAN)
RQRELLCEW

SEQ ID NO: 154374 - protein, 9 aa, Artificial Sequence
  Description of Artificial Sequence: Synthetic peptide
  Seed: SLSHCSQLT (PRAME_HUMAN)
SLSHCSQLV

SEQ ID NO: 154375 - protein, 10 aa, Artificial Sequence
  Description of Artificial Sequence: Synthetic peptide
  Seed: SQLTTLSFYG (PRAME_HUMAN)
SQLTTLSFYF

SEQ ID NO: 154376 - protein, 10 aa, Artificial Sequence
  Description of Artificial Sequence: Synthetic peptide
  Seed: MVQAWPFTCL (PRAME_HUMAN)
MFQAWPFTCV

SEQ ID NO: 154377 - protein, 10 aa, Artificial Sequence
  Description of Artificial Sequence: Synthetic peptide
  Seed: LERLAYLHAR (PRAME_HUMAN)
LWRLAYLHAK

SEQ ID NO: 154378 - protein, 10 aa, Artificial Sequence
  Description of Artificial Sequence: Synthetic peptide
  Seed: RTFYDPEPIL (PRAME_HUMAN)
RTFYDPEPIM

SEQ ID NO: 154379 - protein, 9 aa, Artificial Sequence
  Description of Artificial Sequence: Synthetic peptide
  Seed: SQSPSVSQL (PRAME_HUMAN)
SQSPSVSQM

SEQ ID NO: 154380 - protein, 9 aa, Artificial Sequence
  Description of Artificial Sequence: Synthetic peptide
  Seed: KAMVQAWPF (PRAME_HUMAN)
KMMVQAWPV

SEQ ID NO: 154381 - protein, 10 aa, Artificial Sequence
  Description of Artificial Sequence: Synthetic peptide
  Seed: ALLERASATL (PRAME_HUMAN)
ALLERASATM

SEQ ID NO: 154382 - protein, 9 aa, Artificial Sequence
  Description of Artificial Sequence: Synthetic peptide
  Seed: NVLRLCCKK (PRAME_HUMAN)
NLLRLCCKR

SEQ ID NO: 154383 - protein, 10 aa, Artificial Sequence
  Description of Artificial Sequence: Synthetic peptide
  Seed: RLSEGDVMHL (PRAME_HUMAN)
RQSEGDVMHV

SEQ ID NO: 154384 - protein, 9 aa, Artificial Sequence
  Description of Artificial Sequence: Synthetic peptide
  Seed: FYDPEPILC (PRAME_HUMAN)
FSDPEPILV

SEQ ID NO: 154385 - protein, 9 aa, Artificial Sequence
  Description of Artificial Sequence: Synthetic peptide
  Seed: LMKGQHLHL (PRAME_HUMAN)
LLKGQHLHV

SEQ ID NO: 154386 - protein, 9 aa, Artificial Sequence
  Description of Artificial Sequence: Synthetic peptide
  Seed: YIAQFTSQF (PRAME_HUMAN)
YHAQFTSQF

SEQ ID NO: 154387 - protein, 11 aa, Artificial Sequence
  Description of Artificial Sequence: Synthetic peptide
  Seed: QALYVDSLFFL (PRAME_HUMAN)
QYLYVDSLFFI

SEQ ID NO: 154388 - protein, 9 aa, Artificial Sequence
  Description of Artificial Sequence: Synthetic peptide
  Seed: VSPEPLQAL (PRAME_HUMAN)
VNPEPLQAM

SEQ ID NO: 154389 - protein, 9 aa, Artificial Sequence
  Description of Artificial Sequence: Synthetic peptide
  Seed: CKKLKIFAM (PRAME_HUMAN)
CPKLKIFAM

SEQ ID NO: 154390 - protein, 10 aa, Artificial Sequence
  Description of Artificial Sequence: Synthetic peptide
  Seed: RGRLDQLLRH (PRAME_HUMAN)
RDRLDQLLRM

SEQ ID NO: 154391 - protein, 10 aa, Artificial Sequence
  Description of Artificial Sequence: Synthetic peptide
  Seed: SISISALQSL (PRAME_HUMAN)
SMSISALQSL

SEQ ID NO: 154392 - protein, 9 aa, Artificial Sequence
  Description of Artificial Sequence: Synthetic peptide
  Seed: TSPRRLVEL (PRAME_HUMAN)
TVPRRLVEF

SEQ ID NO: 154393 - protein, 9 aa, Artificial Sequence
  Description of Artificial Sequence: Synthetic peptide
  Seed: ITDDQLLAL (PRAME_HUMAN)
ILDDQLLAL

SEQ ID NO: 154394 - protein, 9 aa, Artificial Sequence
  Description of Artificial Sequence: Synthetic peptide
  Seed: RLRELLCEL (PRAME_HUMAN)
RMRELLCEM

SEQ ID NO: 154395 - protein, 9 aa, Artificial Sequence
  Description of Artificial Sequence: Synthetic peptide
  Seed: EPLQALLER (PRAME_HUMAN)
EVLQALLER

SEQ ID NO: 154396 - protein, 11 aa, Artificial Sequence
  Description of Artificial Sequence: Synthetic peptide
  Seed: LTDVSPEPLQA (PRAME_HUMAN)
LVDVSPEPLQF

SEQ ID NO: 154397 - protein, 9 aa, Artificial Sequence
  Description of Artificial Sequence: Synthetic peptide
  Seed: HVMNPLETL (PRAME_HUMAN)
HEMNPLETM

SEQ ID NO: 154398 - protein, 10 aa, Artificial Sequence
  Description of Artificial Sequence: Synthetic peptide
  Seed: RGRLDQLLRH (PRAME_HUMAN)
RARLDQLLRR

SEQ ID NO: 154399 - protein, 11 aa, Artificial Sequence
  Description of Artificial Sequence: Synthetic peptide
  Seed: SFPEPEAAQPM (PRAME_HUMAN)
SLPEPEAAQPL

SEQ ID NO: 154400 - protein, 11 aa, Artificial Sequence
  Description of Artificial Sequence: Synthetic peptide
  Seed: SIQSRYISMSV (PRAME_HUMAN)
SAQSRYISMSK

SEQ ID NO: 154401 - protein, 9 aa, Artificial Sequence
  Description of Artificial Sequence: Synthetic peptide
  Seed: FYDPEPILC (PRAME_HUMAN)
FIDPEPILI

SEQ ID NO: 154402 - protein, 10 aa, Artificial Sequence
  Description of Artificial Sequence: Synthetic peptide
  Seed: DQLLALLPSL (PRAME_HUMAN)
DSLLALLPSL

SEQ ID NO: 154403 - protein, 9 aa, Artificial Sequence
  Description of Artificial Sequence: Synthetic peptide
  Seed: RELLCELGR (PRAME_HUMAN)
RILLCELGR

SEQ ID NO: 154404 - protein, 10 aa, Artificial Sequence
  Description of Artificial Sequence: Synthetic peptide
  Seed: EAAQPMTKKR (PRAME_HUMAN)
ETAQPMTKKR

SEQ ID NO: 154405 - protein, 10 aa, Artificial Sequence
  Description of Artificial Sequence: Synthetic peptide
  Seed: TWKLPTLAKF (PRAME_HUMAN)
TMKLPTLAKY

SEQ ID NO: 154406 - protein, 9 aa, Artificial Sequence
  Description of Artificial Sequence: Synthetic peptide
  Seed: SISALQSLL (PRAME_HUMAN)
SMSALQSLA

SEQ ID NO: 154407 - protein, 10 aa, Artificial Sequence
  Description of Artificial Sequence: Synthetic peptide
  Seed: LSVLSLSGVM (PRAME_HUMAN)
LPVLSLSGVY

SEQ ID NO: 154408 - protein, 9 aa, Artificial Sequence
  Description of Artificial Sequence: Synthetic peptide
  Seed: SISALQSLL (PRAME_HUMAN)
SISALQSLR

SEQ ID NO: 154409 - protein, 10 aa, Artificial Sequence
  Description of Artificial Sequence: Synthetic peptide
  Seed: YGNSISISAL (PRAME_HUMAN)
YINSISISAF

SEQ ID NO: 154410 - protein, 9 aa, Artificial Sequence
  Description of Artificial Sequence: Synthetic peptide
  Seed: CSQLTTLSF (PRAME_HUMAN)
CQQLTTLSY

SEQ ID NO: 154411 - protein, 10 aa, Artificial Sequence
  Description of Artificial Sequence: Synthetic peptide
  Seed: LYVDSLFFLR (PRAME_HUMAN)
LQVDSLFFLR

SEQ ID NO: 154412 - protein, 8 aa, Artificial Sequence
  Description of Artificial Sequence: Synthetic peptide
  Seed: FYGNSISI (PRAME_HUMAN)
FFGNSISY

SEQ ID NO: 154413 - protein, 10 aa, Artificial Sequence
  Description of Artificial Sequence: Synthetic peptide
  Seed: TFYDPEPILC (PRAME_HUMAN)
TQYDPEPILF

SEQ ID NO: 154414 - protein, 9 aa, Artificial Sequence
  Description of Artificial Sequence: Synthetic peptide
  Seed: YIAQFTSQF (PRAME_HUMAN)
YYAQFTSQH

SEQ ID NO: 154415 - protein, 10 aa, Artificial Sequence
  Description of Artificial Sequence: Synthetic peptide
  Seed: HCSQLTTLSF (PRAME_HUMAN)
HDSQLTTLSF

SEQ ID NO: 154416 - protein, 11 aa, Artificial Sequence
  Description of Artificial Sequence: Synthetic peptide
  Seed: ISALQSLLQHL (PRAME_HUMAN)
IMALQSLLQHV

SEQ ID NO: 154417 - protein, 10 aa, Artificial Sequence
  Description of Artificial Sequence: Synthetic peptide
  Seed: LSQSPSVSQL (PRAME_HUMAN)
LYQSPSVSQY

SEQ ID NO: 154418 - protein, 9 aa, Artificial Sequence
  Description of Artificial Sequence: Synthetic peptide
  Seed: SISALQSLL (PRAME_HUMAN)
SQSALQSLF

SEQ ID NO: 154419 - protein, 9 aa, Artificial Sequence
  Description of Artificial Sequence: Synthetic peptide
  Seed: TSPRRLVEL (PRAME_HUMAN)
TWPRRLVEL

SEQ ID NO: 154420 - protein, 8 aa, Artificial Sequence
  Description of Artificial Sequence: Synthetic peptide
  Seed: LSNLTHVL (PRAME_HUMAN)
LSNLTHVM

SEQ ID NO: 154421 - protein, 9 aa, Artificial Sequence
  Description of Artificial Sequence: Synthetic peptide
  Seed: QMINLRRLL (PRAME_HUMAN)
QMINLRRLW

SEQ ID NO: 154422 - protein, 11 aa, Artificial Sequence
  Description of Artificial Sequence: Synthetic peptide
  Seed: FLSLQCLQALY (PRAME_HUMAN)
FGSLQCLQALL

SEQ ID NO: 154423 - protein, 10 aa, Artificial Sequence
  Description of Artificial Sequence: Synthetic peptide
  Seed: SALQSLLQHL (PRAME_HUMAN)
SFLQSLLQHV

SEQ ID NO: 154424 - protein, 10 aa, Artificial Sequence
  Description of Artificial Sequence: Synthetic peptide
  Seed: ARLRELLCEL (PRAME_HUMAN)
AYLRELLCEL

SEQ ID NO: 154425 - protein, 9 aa, Artificial Sequence
  Description of Artificial Sequence: Synthetic peptide
  Seed: EDLEVTCTW (PRAME_HUMAN)
ELLEVTCTY

SEQ ID NO: 154426 - protein, 10 aa, Artificial Sequence
  Description of Artificial Sequence: Synthetic peptide
  Seed: RELFPPLFMA (PRAME_HUMAN)
RRLFPPLFMM

SEQ ID NO: 154427 - protein, 10 aa, Artificial Sequence
  Description of Artificial Sequence: Synthetic peptide
  Seed: SVSQLSVLSL (PRAME_HUMAN)
SQSQLSVLSF

SEQ ID NO: 154428 - protein, 10 aa, Artificial Sequence
  Description of Artificial Sequence: Synthetic peptide
  Seed: KKLKIFAMPM (PRAME_HUMAN)
KRLKIFAMPK

SEQ ID NO: 154429 - protein, 10 aa, Artificial Sequence
  Description of Artificial Sequence: Synthetic peptide
  Seed: QAWPFTCLPL (PRAME_HUMAN)
QKWPFTCLPF

SEQ ID NO: 154430 - protein, 10 aa, Artificial Sequence
  Description of Artificial Sequence: Synthetic peptide
  Seed: LSFYGNSISI (PRAME_HUMAN)
LGFYGNSISW

SEQ ID NO: 154431 - protein, 9 aa, Artificial Sequence
  Description of Artificial Sequence: Synthetic peptide
  Seed: CRLSEGDVM (PRAME_HUMAN)
CHLSEGDVI

SEQ ID NO: 154432 - protein, 9 aa, Artificial Sequence
  Description of Artificial Sequence: Synthetic peptide
  Seed: LALLPSLSH (PRAME_HUMAN)
LVLLPSLSK

SEQ ID NO: 154433 - protein, 10 aa, Artificial Sequence
  Description of Artificial Sequence: Synthetic peptide
  Seed: LPTLAKFSPY (PRAME_HUMAN)
LITLAKFSPY

SEQ ID NO: 154434 - protein, 9 aa, Artificial Sequence
  Description of Artificial Sequence: Synthetic peptide
  Seed: MHLSQSPSV (PRAME_HUMAN)
MRLSQSPSF

SEQ ID NO: 154435 - protein, 10 aa, Artificial Sequence
  Description of Artificial Sequence: Synthetic peptide
  Seed: RRLLLSHIHA (PRAME_HUMAN)
RRLLLSHIHL

SEQ ID NO: 154436 - protein, 9 aa, Artificial Sequence
  Description of Artificial Sequence: Synthetic peptide
  Seed: TLAKFSPYL (PRAME_HUMAN)
TLAKFSPYT

SEQ ID NO: 154437 - protein, 9 aa, Artificial Sequence
  Description of Artificial Sequence: Synthetic peptide
  Seed: ALYVDSLFF (PRAME_HUMAN)
AQYVDSLFY

SEQ ID NO: 154438 - protein, 10 aa, Artificial Sequence
  Description of Artificial Sequence: Synthetic peptide
  Seed: ISISALQSLL (PRAME_HUMAN)
IAISALQSLW

SEQ ID NO: 154439 - protein, 10 aa, Artificial Sequence
  Description of Artificial Sequence: Synthetic peptide
  Seed: LLLSHIHASS (PRAME_HUMAN)
LGLSHIHASL

SEQ ID NO: 154440 - protein, 9 aa, Artificial Sequence
  Description of Artificial Sequence: Synthetic peptide
  Seed: FYDPEPILC (PRAME_HUMAN)
FVDPEPILC

SEQ ID NO: 154441 - protein, 9 aa, Artificial Sequence
  Description of Artificial Sequence: Synthetic peptide
  Seed: RLCCKKLKI (PRAME_HUMAN)
RLCCKKLKF

SEQ ID NO: 154442 - protein, 10 aa, Artificial Sequence
  Description of Artificial Sequence: Synthetic peptide
  Seed: LLLSHIHASS (PRAME_HUMAN)
LFLSHIHASI

SEQ ID NO: 154443 - protein, 9 aa, Artificial Sequence
  Description of Artificial Sequence: Synthetic peptide
  Seed: SALQSLLQH (PRAME_HUMAN)
SMLQSLLQF

SEQ ID NO: 154444 - protein, 10 aa, Artificial Sequence
  Description of Artificial Sequence: Synthetic peptide
  Seed: FLRGRLDQLL (PRAME_HUMAN)
FMRGRLDQLA

SEQ ID NO: 154445 - protein, 10 aa, Artificial Sequence
  Description of Artificial Sequence: Synthetic peptide
  Seed: RLSEGDVMHL (PRAME_HUMAN)
RLSEGDVMHI

SEQ ID NO: 154446 - protein, 10 aa, Artificial Sequence
  Description of Artificial Sequence: Synthetic peptide
  Seed: QSLLQHLIGL (PRAME_HUMAN)
QYLLQHLIGA

SEQ ID NO: 154447 - protein, 10 aa, Artificial Sequence
  Description of Artificial Sequence: Synthetic peptide
  Seed: FIPVEVLVDL (PRAME_HUMAN)
FEPVEVLVDM

SEQ ID NO: 154448 - protein, 9 aa, Artificial Sequence
  Description of Artificial Sequence: Synthetic peptide
  Seed: KLKIFAMPM (PRAME_HUMAN)
KTKIFAMPP

SEQ ID NO: 154449 - protein, 9 aa, Artificial Sequence
  Description of Artificial Sequence: Synthetic peptide
  Seed: RRLLLSHIH (PRAME_HUMAN)
RQLLLSHIL

SEQ ID NO: 154450 - protein, 10 aa, Artificial Sequence
  Description of Artificial Sequence: Synthetic peptide
  Seed: GLSNLTHVLY (PRAME_HUMAN)
GMSNLTHVLA

SEQ ID NO: 154451 - protein, 10 aa, Artificial Sequence
  Description of Artificial Sequence: Synthetic peptide
  Seed: TSQFLSLQCL (PRAME_HUMAN)
TYQFLSLQCF

SEQ ID NO: 154452 - protein, 11 aa, Artificial Sequence
  Description of Artificial Sequence: Synthetic peptide
  Seed: LQSLLQHLIGL (PRAME_HUMAN)
LDSLLQHLIGV

SEQ ID NO: 154453 - protein, 10 aa, Artificial Sequence
  Description of Artificial Sequence: Synthetic peptide
  Seed: SPYLGQMINL (PRAME_HUMAN)
SKYLGQMINI

SEQ ID NO: 154454 - protein, 9 aa, Artificial Sequence
  Description of Artificial Sequence: Synthetic peptide
  Seed: RELFPPLFM (PRAME_HUMAN)
RELFPPLFY

SEQ ID NO: 154455 - protein, 9 aa, Artificial Sequence
  Description of Artificial Sequence: Synthetic peptide
  Seed: TLAKFSPYL (PRAME_HUMAN)
TVAKFSPYF

SEQ ID NO: 154456 - protein, 9 aa, Artificial Sequence
  Description of Artificial Sequence: Synthetic peptide
  Seed: KLKIFAMPM (PRAME_HUMAN)
KGKIFAMPY

SEQ ID NO: 154457 - protein, 9 aa, Artificial Sequence
  Description of Artificial Sequence: Synthetic peptide
  Seed: LSHIHASSY (PRAME_HUMAN)
LQHIHASSI

SEQ ID NO: 154458 - protein, 9 aa, Artificial Sequence
  Description of Artificial Sequence: Synthetic peptide
  Seed: GITDDQLLA (PRAME_HUMAN)
GITDDQLLV

SEQ ID NO: 154459 - protein, 9 aa, Artificial Sequence
  Description of Artificial Sequence: Synthetic peptide
  Seed: FLRGRLDQL (PRAME_HUMAN)
FMRGRLDQI

SEQ ID NO: 154460 - protein, 10 aa, Artificial Sequence
  Description of Artificial Sequence: Synthetic peptide
  Seed: LLSHIHASSY (PRAME_HUMAN)
LCSHIHASSF

SEQ ID NO: 154461 - protein, 9 aa, Artificial Sequence
  Description of Artificial Sequence: Synthetic peptide
  Seed: SFYGNSISI (PRAME_HUMAN)
SFYGNSISL

SEQ ID NO: 154462 - protein, 10 aa, Artificial Sequence
  Description of Artificial Sequence: Synthetic peptide
  Seed: RLVELAGQSL (PRAME_HUMAN)
RLVELAGQSW

SEQ ID NO: 154463 - protein, 9 aa, Artificial Sequence
  Description of Artificial Sequence: Synthetic peptide
  Seed: LPRELFPPL (PRAME_HUMAN)
LPRELFPPS

SEQ ID NO: 154464 - protein, 10 aa, Artificial Sequence
  Description of Artificial Sequence: Synthetic peptide
  Seed: GTLHLERLAY (PRAME_HUMAN)
GFLHLERLAY

SEQ ID NO: 154465 - protein, 9 aa, Artificial Sequence
  Description of Artificial Sequence: Synthetic peptide
  Seed: SQSPSVSQL (PRAME_HUMAN)
SISPSVSQM

SEQ ID NO: 154466 - protein, 9 aa, Artificial Sequence
  Description of Artificial Sequence: Synthetic peptide
  Seed: RTFYDPEPI (PRAME_HUMAN)
RQFYDPEPH

SEQ ID NO: 154467 - protein, 10 aa, Artificial Sequence
  Description of Artificial Sequence: Synthetic peptide
  Seed: SLLKDEALAI (PRAME_HUMAN)
SWLKDEALAV

SEQ ID NO: 154468 - protein, 9 aa, Artificial Sequence
  Description of Artificial Sequence: Synthetic peptide
  Seed: LMKGQHLHL (PRAME_HUMAN)
LKKGQHLHF

SEQ ID NO: 154469 - protein, 10 aa, Artificial Sequence
  Description of Artificial Sequence: Synthetic peptide
  Seed: RLAYLHARLR (PRAME_HUMAN)
RFAYLHARLR

SEQ ID NO: 154470 - protein, 9 aa, Artificial Sequence
  Description of Artificial Sequence: Synthetic peptide
  Seed: LSLQCLQAL (PRAME_HUMAN)
LILQCLQAV

SEQ ID NO: 154471 - protein, 8 aa, Artificial Sequence
  Description of Artificial Sequence: Synthetic peptide
  Seed: DVLLAQEV (PRAME_HUMAN)
DALLAQEV

SEQ ID NO: 154472 - protein, 10 aa, Artificial Sequence
  Description of Artificial Sequence: Synthetic peptide
  Seed: MPMQDIKMIL (PRAME_HUMAN)
MAMQDIKMIY

SEQ ID NO: 154473 - protein, 10 aa, Artificial Sequence
  Description of Artificial Sequence: Synthetic peptide
  Seed: RASATLQDLV (PRAME_HUMAN)
RRSATLQDLF

SEQ ID NO: 154474 - protein, 9 aa, Artificial Sequence
  Description of Artificial Sequence: Synthetic peptide
  Seed: HVMNPLETL (PRAME_HUMAN)
HIMNPLETM

SEQ ID NO: 154475 - protein, 9 aa, Artificial Sequence
  Description of Artificial Sequence: Synthetic peptide
  Seed: RLDQLLRHV (PRAME_HUMAN)
RLDQLLRHL

SEQ ID NO: 154476 - protein, 10 aa, Artificial Sequence
  Description of Artificial Sequence: Synthetic peptide
  Seed: RHVMNPLETL (PRAME_HUMAN)
RLVMNPLETW

SEQ ID NO: 154477 - protein, 10 aa, Artificial Sequence
  Description of Artificial Sequence: Synthetic peptide
  Seed: AQFTSQFLSL (PRAME_HUMAN)
AMFTSQFLSV

SEQ ID NO: 154478 - protein, 10 aa, Artificial Sequence
  Description of Artificial Sequence: Synthetic peptide
  Seed: AALELLPREL (PRAME_HUMAN)
AVLELLPREI

SEQ ID NO: 154479 - protein, 10 aa, Artificial Sequence
  Description of Artificial Sequence: Synthetic peptide
  Seed: KIFAMPMQDI (PRAME_HUMAN)
KMFAMPMQDF

SEQ ID NO: 154480 - protein, 9 aa, Artificial Sequence
  Description of Artificial Sequence: Synthetic peptide
  Seed: ALLERASAT (PRAME_HUMAN)
AILERASAV

SEQ ID NO: 154481 - protein, 9 aa, Artificial Sequence
  Description of Artificial Sequence: Synthetic peptide
  Seed: SVLSLSGVM (PRAME_HUMAN)
SVLSLSGVW

SEQ ID NO: 154482 - protein, 9 aa, Artificial Sequence
  Description of Artificial Sequence: Synthetic peptide
  Seed: SQSPSVSQL (PRAME_HUMAN)
SHSPSVSQW

SEQ ID NO: 154483 - protein, 10 aa, Artificial Sequence
  Description of Artificial Sequence: Synthetic peptide
  Seed: SPYLGQMINL (PRAME_HUMAN)
SHYLGQMINI

SEQ ID NO: 154484 - protein, 10 aa, Artificial Sequence
  Description of Artificial Sequence: Synthetic peptide
  Seed: LERLAYLHAR (PRAME_HUMAN)
LTRLAYLHAK

SEQ ID NO: 154485 - protein, 9 aa, Artificial Sequence
  Description of Artificial Sequence: Synthetic peptide
  Seed: LLSHIHASS (PRAME_HUMAN)
LISHIHASL

SEQ ID NO: 154486 - protein, 9 aa, Artificial Sequence
  Description of Artificial Sequence: Synthetic peptide
  Seed: ISISALQSL (PRAME_HUMAN)
IYISALQSV

SEQ ID NO: 154487 - protein, 10 aa, Artificial Sequence
  Description of Artificial Sequence: Synthetic peptide
  Seed: ETLSITNCRL (PRAME_HUMAN)
ETLSITNCRV

SEQ ID NO: 154488 - protein, 11 aa, Artificial Sequence
  Description of Artificial Sequence: Synthetic peptide
  Seed: RRRLWGSIQSR (PRAME_HUMAN)
RQRLWGSIQSR

SEQ ID NO: 154489 - protein, 11 aa, Artificial Sequence
  Description of Artificial Sequence: Synthetic peptide
  Seed: AAFDGRHSQTL (PRAME_HUMAN)
ALFDGRHSQTM

SEQ ID NO: 154490 - protein, 9 aa, Artificial Sequence
  Description of Artificial Sequence: Synthetic peptide
  Seed: KFSPYLGQM (PRAME_HUMAN)
KRSPYLGQY

SEQ ID NO: 154491 - protein, 11 aa, Artificial Sequence
  Description of Artificial Sequence: Synthetic peptide
  Seed: CRLSEGDVMHL (PRAME_HUMAN)
CLLSEGDVMHV

SEQ ID NO: 154492 - protein, 9 aa, Artificial Sequence
  Description of Artificial Sequence: Synthetic peptide
  Seed: SPEPLQALL (PRAME_HUMAN)
STEPLQALM

SEQ ID NO: 154493 - protein, 10 aa, Artificial Sequence
  Description of Artificial Sequence: Synthetic peptide
  Seed: FTCLPLGVLM (PRAME_HUMAN)
FSCLPLGVLW

SEQ ID NO: 154494 - protein, 9 aa, Artificial Sequence
  Description of Artificial Sequence: Synthetic peptide
  Seed: EDLEVTCTW (PRAME_HUMAN)
EVLEVTCTM

SEQ ID NO: 154495 - protein, 9 aa, Artificial Sequence
  Description of Artificial Sequence: Synthetic peptide
  Seed: ISPEKEEQY (PRAME_HUMAN)
IVPEKEEQF

SEQ ID NO: 154496 - protein, 9 aa, Artificial Sequence
  Description of Artificial Sequence: Synthetic peptide
  Seed: YSFPEPEAA (PRAME_HUMAN)
YIFPEPEAV

SEQ ID NO: 154497 - protein, 9 aa, Artificial Sequence
  Description of Artificial Sequence: Synthetic peptide
  Seed: LVELAGQSL (PRAME_HUMAN)
LLELAGQSY

SEQ ID NO: 154498 - protein, 10 aa, Artificial Sequence
  Description of Artificial Sequence: Synthetic peptide
  Seed: LLLSHIHASS (PRAME_HUMAN)
LGLSHIHASI

SEQ ID NO: 154499 - protein, 9 aa, Artificial Sequence
  Description of Artificial Sequence: Synthetic peptide
  Seed: KVDGLSTEA (PRAME_HUMAN)
KQDGLSTEF

SEQ ID NO: 154500 - protein, 10 aa, Artificial Sequence
  Description of Artificial Sequence: Synthetic peptide
  Seed: TFYDPEPILC (PRAME_HUMAN)
TFYDPEPILW

SEQ ID NO: 154501 - protein, 9 aa, Artificial Sequence
  Description of Artificial Sequence: Synthetic peptide
  Seed: SFYGNSISI (PRAME_HUMAN)
SVYGNSISI

SEQ ID NO: 154502 - protein, 10 aa, Artificial Sequence
  Description of Artificial Sequence: Synthetic peptide
  Seed: AYLHARLREL (PRAME_HUMAN)
ADLHARLREV

SEQ ID NO: 154503 - protein, 10 aa, Artificial Sequence
  Description of Artificial Sequence: Synthetic peptide
  Seed: LKAMVQAWPF (PRAME_HUMAN)
LSAMVQAWPF

SEQ ID NO: 154504 - protein, 9 aa, Artificial Sequence
  Description of Artificial Sequence: Synthetic peptide
  Seed: EAAQPMTKK (PRAME_HUMAN)
ETAQPMTKK

SEQ ID NO: 154505 - protein, 10 aa, Artificial Sequence
  Description of Artificial Sequence: Synthetic peptide
  Seed: LLSHIHASSY (PRAME_HUMAN)
LRSHIHASSY

SEQ ID NO: 154506 - protein, 10 aa, Artificial Sequence
  Description of Artificial Sequence: Synthetic peptide
  Seed: YISPEKEEQY (PRAME_HUMAN)
YFSPEKEEQY

SEQ ID NO: 154507 - protein, 9 aa, Artificial Sequence
  Description of Artificial Sequence: Synthetic peptide
  Seed: FLSLQCLQA (PRAME_HUMAN)
FVSLQCLQL

SEQ ID NO: 154508 - protein, 9 aa, Artificial Sequence
  Description of Artificial Sequence: Synthetic peptide
  Seed: SQFLSLQCL (PRAME_HUMAN)
SVFLSLQCF

SEQ ID NO: 154509 - protein, 8 aa, Artificial Sequence
  Description of Artificial Sequence: Synthetic peptide
  Seed: TDDQLLAL (PRAME_HUMAN)
TYDQLLAI

SEQ ID NO: 154510 - protein, 9 aa, Artificial Sequence
  Description of Artificial Sequence: Synthetic peptide
  Seed: SQSPSVSQL (PRAME_HUMAN)
SKSPSVSQY

SEQ ID NO: 154511 - protein, 11 aa, Artificial Sequence
  Description of Artificial Sequence: Synthetic peptide
  Seed: RRWKLQVLDLR (PRAME_HUMAN)
RRWKLQVLDLV

SEQ ID NO: 154512 - protein, 9 aa, Artificial Sequence
  Description of Artificial Sequence: Synthetic peptide
  Seed: NLTHVLYPV (PRAME_HUMAN)
NITHVLYPA

SEQ ID NO: 154513 - protein, 9 aa, Artificial Sequence
  Description of Artificial Sequence: Synthetic peptide
  Seed: MNPLETLSI (PRAME_HUMAN)
MVPLETLSL

SEQ ID NO: 154514 - protein, 9 aa, Artificial Sequence
  Description of Artificial Sequence: Synthetic peptide
  Seed: TLKAMVQAW (PRAME_HUMAN)
TQKAMVQAL

SEQ ID NO: 154515 - protein, 10 aa, Artificial Sequence
  Description of Artificial Sequence: Synthetic peptide
  Seed: MVQAWPFTCL (PRAME_HUMAN)
MMQAWPFTCM

SEQ ID NO: 154516 - protein, 10 aa, Artificial Sequence
  Description of Artificial Sequence: Synthetic peptide
  Seed: RGRLDQLLRH (PRAME_HUMAN)
RGRLDQLLRI

SEQ ID NO: 154517 - protein, 8 aa, Artificial Sequence
  Description of Artificial Sequence: Synthetic peptide
  Seed: MQDIKMIL (PRAME_HUMAN)
MTDIKMIL

SEQ ID NO: 154518 - protein, 9 aa, Artificial Sequence
  Description of Artificial Sequence: Synthetic peptide
  Seed: QSRYISMSV (PRAME_HUMAN)
QYRYISMSA

SEQ ID NO: 154519 - protein, 9 aa, Artificial Sequence
  Description of Artificial Sequence: Synthetic peptide
  Seed: RLRELLCEL (PRAME_HUMAN)
RVRELLCEG

SEQ ID NO: 154520 - protein, 10 aa, Artificial Sequence
  Description of Artificial Sequence: Synthetic peptide
  Seed: GACDELFSYL (PRAME_HUMAN)
GVCDELFSYL

SEQ ID NO: 154521 - protein, 10 aa, Artificial Sequence
  Description of Artificial Sequence: Synthetic peptide
  Seed: MVQAWPFTCL (PRAME_HUMAN)
MSQAWPFTCF

SEQ ID NO: 154522 - protein, 9 aa, Artificial Sequence
  Description of Artificial Sequence: Synthetic peptide
  Seed: LSLQCLQAL (PRAME_HUMAN)
LRLQCLQAY

SEQ ID NO: 154523 - protein, 9 aa, Artificial Sequence
  Description of Artificial Sequence: Synthetic peptide
  Seed: EAAQPMTKK (PRAME_HUMAN)
ETAQPMTKR

SEQ ID NO: 154524 - protein, 11 aa, Artificial Sequence
  Description of Artificial Sequence: Synthetic peptide
  Seed: KMVQLDSIEDL (PRAME_HUMAN)
KMVQLDSIEDV

SEQ ID NO: 154525 - protein, 10 aa, Artificial Sequence
  Description of Artificial Sequence: Synthetic peptide
  Seed: HCSQLTTLSF (PRAME_HUMAN)
HASQLTTLSW

SEQ ID NO: 154526 - protein, 10 aa, Artificial Sequence
  Description of Artificial Sequence: Synthetic peptide
  Seed: AAFDGRHSQT (PRAME_HUMAN)
ATFDGRHSQM

SEQ ID NO: 154527 - protein, 10 aa, Artificial Sequence
  Description of Artificial Sequence: Synthetic peptide
  Seed: MNPLETLSIT (PRAME_HUMAN)
MTPLETLSIA

SEQ ID NO: 154528 - protein, 9 aa, Artificial Sequence
  Description of Artificial Sequence: Synthetic peptide
  Seed: HVMNPLETL (PRAME_HUMAN)
HIMNPLETW

SEQ ID NO: 154529 - protein, 9 aa, Artificial Sequence
  Description of Artificial Sequence: Synthetic peptide
  Seed: ACDELFSYL (PRAME_HUMAN)
AMDELFSYM

SEQ ID NO: 154530 - protein, 9 aa, Artificial Sequence
  Description of Artificial Sequence: Synthetic peptide
  Seed: FYDPEPILC (PRAME_HUMAN)
FVDPEPILV

SEQ ID NO: 154531 - protein, 10 aa, Artificial Sequence
  Description of Artificial Sequence: Synthetic peptide
  Seed: VTCTWKLPTL (PRAME_HUMAN)
VVCTWKLPTW

SEQ ID NO: 154532 - protein, 9 aa, Artificial Sequence
  Description of Artificial Sequence: Synthetic peptide
  Seed: VFDECGITD (PRAME_HUMAN)
VMDECGITL

SEQ ID NO: 154533 - protein, 10 aa, Artificial Sequence
  Description of Artificial Sequence: Synthetic peptide
  Seed: RYISMSVWTS (PRAME_HUMAN)
RFISMSVWTM

SEQ ID NO: 154534 - protein, 9 aa, Artificial Sequence
  Description of Artificial Sequence: Synthetic peptide
  Seed: GACDELFSY (PRAME_HUMAN)
GRCDELFSM

SEQ ID NO: 154535 - protein, 9 aa, Artificial Sequence
  Description of Artificial Sequence: Synthetic peptide
  Seed: AQFTSQFLS (PRAME_HUMAN)
ATFTSQFLV

SEQ ID NO: 154536 - protein, 10 aa, Artificial Sequence
  Description of Artificial Sequence: Synthetic peptide
  Seed: ARLRELLCEL (PRAME_HUMAN)
ASLRELLCEA

SEQ ID NO: 154537 - protein, 9 aa, Artificial Sequence
  Description of Artificial Sequence: Synthetic peptide
  Seed: MQDIKMILK (PRAME_HUMAN)
MTDIKMILL

SEQ ID NO: 154538 - protein, 9 aa, Artificial Sequence
  Description of Artificial Sequence: Synthetic peptide
  Seed: TCLPLGVLM (PRAME_HUMAN)
TTLPLGVLL

SEQ ID NO: 154539 - protein, 10 aa, Artificial Sequence
  Description of Artificial Sequence: Synthetic peptide
  Seed: SPSVSQLSVL (PRAME_HUMAN)
SQSVSQLSVY

SEQ ID NO: 154540 - protein, 10 aa, Artificial Sequence
  Description of Artificial Sequence: Synthetic peptide
  Seed: TTLSFYGNSI (PRAME_HUMAN)
TNLSFYGNSV

SEQ ID NO: 154541 - protein, 9 aa, Artificial Sequence
  Description of Artificial Sequence: Synthetic peptide
  Seed: LSANPCPHC (PRAME_HUMAN)
LTANPCPHW

SEQ ID NO: 154542 - protein, 9 aa, Artificial Sequence
  Description of Artificial Sequence: Synthetic peptide
  Seed: SQFLSLQCL (PRAME_HUMAN)
SLFLSLQCY

SEQ ID NO: 154543 - protein, 9 aa, Artificial Sequence
  Description of Artificial Sequence: Synthetic peptide
  Seed: SHCSQLTTL (PRAME_HUMAN)
SYCSQLTTF

SEQ ID NO: 154544 - protein, 10 aa, Artificial Sequence
  Description of Artificial Sequence: Synthetic peptide
  Seed: GQHLHLETFK (PRAME_HUMAN)
GTHLHLETFR

SEQ ID NO: 154545 - protein, 10 aa, Artificial Sequence
  Description of Artificial Sequence: Synthetic peptide
  Seed: FFLRGRLDQL (PRAME_HUMAN)
FPLRGRLDQA

SEQ ID NO: 154546 - protein, 9 aa, Artificial Sequence
  Description of Artificial Sequence: Synthetic peptide
  Seed: LSHIHASSY (PRAME_HUMAN)
LEHIHASSM

SEQ ID NO: 154547 - protein, 10 aa, Artificial Sequence
  Description of Artificial Sequence: Synthetic peptide
  Seed: AQFTSQFLSL (PRAME_HUMAN)
AIFTSQFLSI

SEQ ID NO: 154548 - protein, 9 aa, Artificial Sequence
  Description of Artificial Sequence: Synthetic peptide
  Seed: TFYDPEPIL (PRAME_HUMAN)
TTYDPEPIV

SEQ ID NO: 154549 - protein, 9 aa, Artificial Sequence
  Description of Artificial Sequence: Synthetic peptide
  Seed: LMKGQHLHL (PRAME_HUMAN)
LSKGQHLHL

SEQ ID NO: 154550 - protein, 9 aa, Artificial Sequence
  Description of Artificial Sequence: Synthetic peptide
  Seed: LYVDSLFFL (PRAME_HUMAN)
LSVDSLFFI

SEQ ID NO: 154551 - protein, 10 aa, Artificial Sequence
  Description of Artificial Sequence: Synthetic peptide
  Seed: SLSHCSQLTT (PRAME_HUMAN)
SISHCSQLTV

SEQ ID NO: 154552 - protein, 9 aa, Artificial Sequence
  Description of Artificial Sequence: Synthetic peptide
  Seed: MQDIKMILK (PRAME_HUMAN)
MVDIKMILY

SEQ ID NO: 154553 - protein, 9 aa, Artificial Sequence
  Description of Artificial Sequence: Synthetic peptide
  Seed: LLLSHIHAS (PRAME_HUMAN)
LMLSHIHAA

SEQ ID NO: 154554 - protein, 9 aa, Artificial Sequence
  Description of Artificial Sequence: Synthetic peptide
  Seed: VSQLSVLSL (PRAME_HUMAN)
VRQLSVLSM

SEQ ID NO: 154555 - protein, 10 aa, Artificial Sequence
  Description of Artificial Sequence: Synthetic peptide
  Seed: DQLLALLPSL (PRAME_HUMAN)
DSLLALLPSI

SEQ ID NO: 154556 - protein, 10 aa, Artificial Sequence
  Description of Artificial Sequence: Synthetic peptide
  Seed: RHVMNPLETL (PRAME_HUMAN)
RDVMNPLETV

SEQ ID NO: 154557 - protein, 9 aa, Artificial Sequence
  Description of Artificial Sequence: Synthetic peptide
  Seed: KVKRKKNVL (PRAME_HUMAN)
KFKRKKNVK

SEQ ID NO: 154558 - protein, 10 aa, Artificial Sequence
  Description of Artificial Sequence: Synthetic peptide
  Seed: FYDPEPILCP (PRAME_HUMAN)
FLDPEPILCM

SEQ ID NO: 154559 - protein, 10 aa, Artificial Sequence
  Description of Artificial Sequence: Synthetic peptide
  Seed: TFYDPEPILC (PRAME_HUMAN)
TFYDPEPILM

SEQ ID NO: 154560 - protein, 9 aa, Artificial Sequence
  Description of Artificial Sequence: Synthetic peptide
  Seed: EAEQPFIPV (PRAME_HUMAN)
EIEQPFIPV

SEQ ID NO: 154561 - protein, 9 aa, Artificial Sequence
  Description of Artificial Sequence: Synthetic peptide
  Seed: VLMKGQHLH (PRAME_HUMAN)
VQMKGQHLY

SEQ ID NO: 154562 - protein, 9 aa, Artificial Sequence
  Description of Artificial Sequence: Synthetic peptide
  Seed: VLMKGQHLH (PRAME_HUMAN)
VVMKGQHLR

SEQ ID NO: 154563 - protein, 9 aa, Artificial Sequence
  Description of Artificial Sequence: Synthetic peptide
  Seed: QSRYISMSV (PRAME_HUMAN)
QTRYISMSL

SEQ ID NO: 154564 - protein, 9 aa, Artificial Sequence
  Description of Artificial Sequence: Synthetic peptide
  Seed: RLCCKKLKI (PRAME_HUMAN)
RMCCKKLKW

SEQ ID NO: 154565 - protein, 11 aa, Artificial Sequence
  Description of Artificial Sequence: Synthetic peptide
  Seed: CRLSEGDVMHL (PRAME_HUMAN)
CYLSEGDVMHL

SEQ ID NO: 154566 - protein, 9 aa, Artificial Sequence
  Description of Artificial Sequence: Synthetic peptide
  Seed: RLRELLCEL (PRAME_HUMAN)
RMRELLCEF

SEQ ID NO: 154567 - protein, 9 aa, Artificial Sequence
  Description of Artificial Sequence: Synthetic peptide
  Seed: FDGRHSQTL (PRAME_HUMAN)
FAGRHSQTL

SEQ ID NO: 154568 - protein, 9 aa, Artificial Sequence
  Description of Artificial Sequence: Synthetic peptide
  Seed: SFYGNSISI (PRAME_HUMAN)
SAYGNSISM

SEQ ID NO: 154569 - protein, 9 aa, Artificial Sequence
  Description of Artificial Sequence: Synthetic peptide
  Seed: KVDGLSTEA (PRAME_HUMAN)
KCDGLSTEL

SEQ ID NO: 154570 - protein, 9 aa, Artificial Sequence
  Description of Artificial Sequence: Synthetic peptide
  Seed: RLWGSIQSR (PRAME_HUMAN)
RMWGSIQSM

SEQ ID NO: 154571 - protein, 10 aa, Artificial Sequence
  Description of Artificial Sequence: Synthetic peptide
  Seed: SISISALQSL (PRAME_HUMAN)
SLSISALQSW

SEQ ID NO: 154572 - protein, 9 aa, Artificial Sequence
  Description of Artificial Sequence: Synthetic peptide
  Seed: HVMNPLETL (PRAME_HUMAN)
HHMNPLETW

SEQ ID NO: 154573 - protein, 9 aa, Artificial Sequence
  Description of Artificial Sequence: Synthetic peptide
  Seed: VSQLSVLSL (PRAME_HUMAN)
VQQLSVLSH

SEQ ID NO: 154574 - protein, 9 aa, Artificial Sequence
  Description of Artificial Sequence: Synthetic peptide
  Seed: YISMSVWTS (PRAME_HUMAN)
YFSMSVWTV

SEQ ID NO: 154575 - protein, 10 aa, Artificial Sequence
  Description of Artificial Sequence: Synthetic peptide
  Seed: YIAQFTSQFL (PRAME_HUMAN)
YAAQFTSQFY

SEQ ID NO: 154576 - protein, 9 aa, Artificial Sequence
  Description of Artificial Sequence: Synthetic peptide
  Seed: YGNSISISA (PRAME_HUMAN)
YMNSISISL

SEQ ID NO: 154577 - protein, 10 aa, Artificial Sequence
  Description of Artificial Sequence: Synthetic peptide
  Seed: MPMQDIKMIL (PRAME_HUMAN)
MGMQDIKMIV

SEQ ID NO: 154578 - protein, 10 aa, Artificial Sequence
  Description of Artificial Sequence: Synthetic peptide
  Seed: LSQSPSVSQL (PRAME_HUMAN)
LWQSPSVSQM

SEQ ID NO: 154579 - protein, 9 aa, Artificial Sequence
  Description of Artificial Sequence: Synthetic peptide
  Seed: LYPVPLESY (PRAME_HUMAN)
LSPVPLESY

SEQ ID NO: 154580 - protein, 9 aa, Artificial Sequence
  Description of Artificial Sequence: Synthetic peptide
  Seed: VWSGNRASL (PRAME_HUMAN)
VASGNRASM

SEQ ID NO: 154581 - protein, 8 aa, Artificial Sequence
  Description of Artificial Sequence: Synthetic peptide
  Seed: RYISMSVW (PRAME_HUMAN)
RYISMSVF

SEQ ID NO: 154582 - protein, 9 aa, Artificial Sequence
  Description of Artificial Sequence: Synthetic peptide
  Seed: LQSLLQHLI (PRAME_HUMAN)
LQSLLQHLW

SEQ ID NO: 154583 - protein, 9 aa, Artificial Sequence
  Description of Artificial Sequence: Synthetic peptide
  Seed: TDDQLLALL (PRAME_HUMAN)
TVDQLLALL

SEQ ID NO: 154584 - protein, 10 aa, Artificial Sequence
  Description of Artificial Sequence: Synthetic peptide
  Seed: RLWGSIQSRY (PRAME_HUMAN)
RLWGSIQSRF

SEQ ID NO: 154585 - protein, 10 aa, Artificial Sequence
  Description of Artificial Sequence: Synthetic peptide
  Seed: RYISMSVWTS (PRAME_HUMAN)
RWISMSVWTM

SEQ ID NO: 154586 - protein, 9 aa, Artificial Sequence
  Description of Artificial Sequence: Synthetic peptide
  Seed: YIAQFTSQF (PRAME_HUMAN)
YSAQFTSQA

SEQ ID NO: 154587 - protein, 11 aa, Artificial Sequence
  Description of Artificial Sequence: Synthetic peptide
  Seed: FSPYLGQMINL (PRAME_HUMAN)
FYPYLGQMINF

SEQ ID NO: 154588 - protein, 9 aa, Artificial Sequence
  Description of Artificial Sequence: Synthetic peptide
  Seed: ALLPSLSHC (PRAME_HUMAN)
AILPSLSHI

SEQ ID NO: 154589 - protein, 10 aa, Artificial Sequence
  Description of Artificial Sequence: Synthetic peptide
  Seed: YSFPEPEAAQ (PRAME_HUMAN)
YGFPEPEAAY

SEQ ID NO: 154590 - protein, 9 aa, Artificial Sequence
  Description of Artificial Sequence: Synthetic peptide
  Seed: VLYPVPLES (PRAME_HUMAN)
VMYPVPLEC

SEQ ID NO: 154591 - protein, 9 aa, Artificial Sequence
  Description of Artificial Sequence: Synthetic peptide
  Seed: NVLRLCCKK (PRAME_HUMAN)
NYLRLCCKR

SEQ ID NO: 154592 - protein, 8 aa, Artificial Sequence
  Description of Artificial Sequence: Synthetic peptide
  Seed: YEDIHGTL (PRAME_HUMAN)
YFDIHGTV

SEQ ID NO: 154593 - protein, 9 aa, Artificial Sequence
  Description of Artificial Sequence: Synthetic peptide
  Seed: RGRLDQLLR (PRAME_HUMAN)
RLRLDQLLA

SEQ ID NO: 154594 - protein, 10 aa, Artificial Sequence
  Description of Artificial Sequence: Synthetic peptide
  Seed: KKLKIFAMPM (PRAME_HUMAN)
KELKIFAMPF

SEQ ID NO: 154595 - protein, 11 aa, Artificial Sequence
  Description of Artificial Sequence: Synthetic peptide
  Seed: AAFDGRHSQTL (PRAME_HUMAN)
AIFDGRHSQTF

SEQ ID NO: 154596 - protein, 11 aa, Artificial Sequence
  Description of Artificial Sequence: Synthetic peptide
  Seed: AAFDGRHSQTL (PRAME_HUMAN)
AQFDGRHSQTM

SEQ ID NO: 154597 - protein, 9 aa, Artificial Sequence
  Description of Artificial Sequence: Synthetic peptide
  Seed: TLAKFSPYL (PRAME_HUMAN)
TIAKFSPYL

SEQ ID NO: 154598 - protein, 9 aa, Artificial Sequence
  Description of Artificial Sequence: Synthetic peptide
  Seed: SVLSLSGVM (PRAME_HUMAN)
SSLSLSGVL

SEQ ID NO: 154599 - protein, 9 aa, Artificial Sequence
  Description of Artificial Sequence: Synthetic peptide
  Seed: MINLRRLLL (PRAME_HUMAN)
MVNLRRLLM

SEQ ID NO: 154600 - protein, 10 aa, Artificial Sequence
  Description of Artificial Sequence: Synthetic peptide
  Seed: CTWKLPTLAK (PRAME_HUMAN)
CIWKLPTLAR

SEQ ID NO: 154601 - protein, 11 aa, Artificial Sequence
  Description of Artificial Sequence: Synthetic peptide
  Seed: IAQFTSQFLSL (PRAME_HUMAN)
IKQFTSQFLSM

SEQ ID NO: 154602 - protein, 9 aa, Artificial Sequence
  Description of Artificial Sequence: Synthetic peptide
  Seed: AQFTSQFLS (PRAME_HUMAN)
AMFTSQFLV

SEQ ID NO: 154603 - protein, 9 aa, Artificial Sequence
  Description of Artificial Sequence: Synthetic peptide
  Seed: KLKIFAMPM (PRAME_HUMAN)
KSKIFAMPT

SEQ ID NO: 154604 - protein, 9 aa, Artificial Sequence
  Description of Artificial Sequence: Synthetic peptide
  Seed: YLHARLREL (PRAME_HUMAN)
YSHARLREV

SEQ ID NO: 154605 - protein, 10 aa, Artificial Sequence
  Description of Artificial Sequence: Synthetic peptide
  Seed: ISISALQSLL (PRAME_HUMAN)
IDISALQSLW

SEQ ID NO: 154606 - protein, 10 aa, Artificial Sequence
  Description of Artificial Sequence: Synthetic peptide
  Seed: KAVLDGLDVL (PRAME_HUMAN)
KLVLDGLDVW

SEQ ID NO: 154607 - protein, 9 aa, Artificial Sequence
  Description of Artificial Sequence: Synthetic peptide
  Seed: LGRPSMVWL (PRAME_HUMAN)
LARPSMVWW

SEQ ID NO: 154608 - protein, 10 aa, Artificial Sequence
  Description of Artificial Sequence: Synthetic peptide
  Seed: YSFPEPEAAQ (PRAME_HUMAN)
YGFPEPEAAF

SEQ ID NO: 154609 - protein, 9 aa, Artificial Sequence
  Description of Artificial Sequence: Synthetic peptide
  Seed: LCCKKLKIF (PRAME_HUMAN)
LVCKKLKIW

SEQ ID NO: 154610 - protein, 9 aa, Artificial Sequence
  Description of Artificial Sequence: Synthetic peptide
  Seed: VSPEPLQAL (PRAME_HUMAN)
VYPEPLQAL

SEQ ID NO: 154611 - protein, 8 aa, Artificial Sequence
  Description of Artificial Sequence: Synthetic peptide
  Seed: MINLRRLL (PRAME_HUMAN)
MMNLRRLL

SEQ ID NO: 154612 - protein, 9 aa, Artificial Sequence
  Description of Artificial Sequence: Synthetic peptide
  Seed: LQDLVFDEC (PRAME_HUMAN)
LMDLVFDEF

SEQ ID NO: 154613 - protein, 9 aa, Artificial Sequence
  Description of Artificial Sequence: Synthetic peptide
  Seed: LEVTCTWKL (PRAME_HUMAN)
LQVTCTWKV

SEQ ID NO: 154614 - protein, 10 aa, Artificial Sequence
  Description of Artificial Sequence: Synthetic peptide
  Seed: YIAQFTSQFL (PRAME_HUMAN)
YAAQFTSQFF

SEQ ID NO: 154615 - protein, 11 aa, Artificial Sequence
  Description of Artificial Sequence: Synthetic peptide
  Seed: FKAVLDGLDVL (PRAME_HUMAN)
FHAVLDGLDVV

SEQ ID NO: 154616 - protein, 9 aa, Artificial Sequence
  Description of Artificial Sequence: Synthetic peptide
  Seed: TSPRRLVEL (PRAME_HUMAN)
TWPRRLVEY

SEQ ID NO: 154617 - protein, 9 aa, Artificial Sequence
  Description of Artificial Sequence: Synthetic peptide
  Seed: SISALQSLL (PRAME_HUMAN)
SVSALQSLR

SEQ ID NO: 154618 - protein, 10 aa, Artificial Sequence
  Description of Artificial Sequence: Synthetic peptide
  Seed: RYISMSVWTS (PRAME_HUMAN)
RYISMSVWTV

SEQ ID NO: 154619 - protein, 9 aa, Artificial Sequence
  Description of Artificial Sequence: Synthetic peptide
  Seed: VLDGLDVLL (PRAME_HUMAN)
VLDGLDVLV

SEQ ID NO: 154620 - protein, 9 aa, Artificial Sequence
  Description of Artificial Sequence: Synthetic peptide
  Seed: LAIAALELL (PRAME_HUMAN)
LPIAALELL

SEQ ID NO: 154621 - protein, 10 aa, Artificial Sequence
  Description of Artificial Sequence: Synthetic peptide
  Seed: GACDELFSYL (PRAME_HUMAN)
GVCDELFSYW

SEQ ID NO: 154622 - protein, 11 aa, Artificial Sequence
  Description of Artificial Sequence: Synthetic peptide
  Seed: LPTLAKFSPYL (PRAME_HUMAN)
LFTLAKFSPYL

SEQ ID NO: 154623 - protein, 10 aa, Artificial Sequence
  Description of Artificial Sequence: Synthetic peptide
  Seed: SLLKDEALAI (PRAME_HUMAN)
SQLKDEALAV

SEQ ID NO: 154624 - protein, 9 aa, Artificial Sequence
  Description of Artificial Sequence: Synthetic peptide
  Seed: ELFSYLIEK (PRAME_HUMAN)
EMFSYLIER

SEQ ID NO: 154625 - protein, 9 aa, Artificial Sequence
  Description of Artificial Sequence: Synthetic peptide
  Seed: MQDIKMILK (PRAME_HUMAN)
MTDIKMILK

SEQ ID NO: 154626 - protein, 10 aa, Artificial Sequence
  Description of Artificial Sequence: Synthetic peptide
  Seed: IGLSNLTHVL (PRAME_HUMAN)
ILLSNLTHVG

SEQ ID NO: 154627 - protein, 10 aa, Artificial Sequence
  Description of Artificial Sequence: Synthetic peptide
  Seed: KGQHLHLETF (PRAME_HUMAN)
KWQHLHLETY

SEQ ID NO: 154628 - protein, 9 aa, Artificial Sequence
  Description of Artificial Sequence: Synthetic peptide
  Seed: RRLWGSIQS (PRAME_HUMAN)
RRLWGSIQY

SEQ ID NO: 154629 - protein, 10 aa, Artificial Sequence
  Description of Artificial Sequence: Synthetic peptide
  Seed: AQFTSQFLSL (PRAME_HUMAN)
AAFTSQFLSV

SEQ ID NO: 154630 - protein, 9 aa, Artificial Sequence
  Description of Artificial Sequence: Synthetic peptide
  Seed: ELFPPLFMA (PRAME_HUMAN)
ETFPPLFMM

SEQ ID NO: 154631 - protein, 9 aa, Artificial Sequence
  Description of Artificial Sequence: Synthetic peptide
  Seed: HVMNPLETL (PRAME_HUMAN)
HQMNPLETL

SEQ ID NO: 154632 - protein, 9 aa, Artificial Sequence
  Description of Artificial Sequence: Synthetic peptide
  Seed: CSQLTTLSF (PRAME_HUMAN)
CIQLTTLSY

SEQ ID NO: 154633 - protein, 10 aa, Artificial Sequence
  Description of Artificial Sequence: Synthetic peptide
  Seed: SPYLGQMINL (PRAME_HUMAN)
SHYLGQMINL

SEQ ID NO: 154634 - protein, 10 aa, Artificial Sequence
  Description of Artificial Sequence: Synthetic peptide
  Seed: CELGRPSMVW (PRAME_HUMAN)
CSLGRPSMVW

SEQ ID NO: 154635 - protein, 11 aa, Artificial Sequence
  Description of Artificial Sequence: Synthetic peptide
  Seed: RRWKLQVLDLR (PRAME_HUMAN)
RRWKLQVLDLL

SEQ ID NO: 154636 - protein, 11 aa, Artificial Sequence
  Description of Artificial Sequence: Synthetic peptide
  Seed: RELFPPLFMAA (PRAME_HUMAN)
RRLFPPLFMAV

SEQ ID NO: 154637 - protein, 8 aa, Artificial Sequence
  Description of Artificial Sequence: Synthetic peptide
  Seed: RRWKLQVL (PRAME_HUMAN)
RRWKLQVR

SEQ ID NO: 154638 - protein, 9 aa, Artificial Sequence
  Description of Artificial Sequence: Synthetic peptide
  Seed: SHCSQLTTL (PRAME_HUMAN)
SYCSQLTTM

SEQ ID NO: 154639 - protein, 9 aa, Artificial Sequence
  Description of Artificial Sequence: Synthetic peptide
  Seed: SFPEPEAAQ (PRAME_HUMAN)
SYPEPEAAY

SEQ ID NO: 154640 - protein, 10 aa, Artificial Sequence
  Description of Artificial Sequence: Synthetic peptide
  Seed: IGLSNLTHVL (PRAME_HUMAN)
IGLSNLTHVV

SEQ ID NO: 154641 - protein, 8 aa, Artificial Sequence
  Description of Artificial Sequence: Synthetic peptide
  Seed: YEDIHGTL (PRAME_HUMAN)
YSDIHGTI

SEQ ID NO: 154642 - protein, 9 aa, Artificial Sequence
  Description of Artificial Sequence: Synthetic peptide
  Seed: MINLRRLLL (PRAME_HUMAN)
MSNLRRLLF

SEQ ID NO: 154643 - protein, 9 aa, Artificial Sequence
  Description of Artificial Sequence: Synthetic peptide
  Seed: GQHLHLETF (PRAME_HUMAN)
GMHLHLETF

SEQ ID NO: 154644 - protein, 9 aa, Artificial Sequence
  Description of Artificial Sequence: Synthetic peptide
  Seed: ITDDQLLAL (PRAME_HUMAN)
ISDDQLLAW

SEQ ID NO: 154645 - protein, 11 aa, Artificial Sequence
  Description of Artificial Sequence: Synthetic peptide
  Seed: FLSLQCLQALY (PRAME_HUMAN)
FMSLQCLQALM

SEQ ID NO: 154646 - protein, 10 aa, Artificial Sequence
  Description of Artificial Sequence: Synthetic peptide
  Seed: ALYVDSLFFL (PRAME_HUMAN)
AAYVDSLFFL

SEQ ID NO: 154647 - protein, 10 aa, Artificial Sequence
  Description of Artificial Sequence: Synthetic peptide
  Seed: QYIAQFTSQF (PRAME_HUMAN)
QQIAQFTSQY

SEQ ID NO: 154648 - protein, 9 aa, Artificial Sequence
  Description of Artificial Sequence: Synthetic peptide
  Seed: EPLQALLER (PRAME_HUMAN)
EALQALLEK

SEQ ID NO: 154649 - protein, 10 aa, Artificial Sequence
  Description of Artificial Sequence: Synthetic peptide
  Seed: ESYEDIHGTL (PRAME_HUMAN)
EVYEDIHGTW

SEQ ID NO: 154650 - protein, 9 aa, Artificial Sequence
  Description of Artificial Sequence: Synthetic peptide
  Seed: SQSPSVSQL (PRAME_HUMAN)
SSSPSVSQI

SEQ ID NO: 154651 - protein, 10 aa, Artificial Sequence
  Description of Artificial Sequence: Synthetic peptide
  Seed: LSVLSLSGVM (PRAME_HUMAN)
LQVLSLSGVL

SEQ ID NO: 154652 - protein, 10 aa, Artificial Sequence
  Description of Artificial Sequence: Synthetic peptide
  Seed: YIAQFTSQFL (PRAME_HUMAN)
YCAQFTSQFF

SEQ ID NO: 154653 - protein, 9 aa, Artificial Sequence
  Description of Artificial Sequence: Synthetic peptide
  Seed: KMILKMVQL (PRAME_HUMAN)
KMILKMVQR

SEQ ID NO: 154654 - protein, 9 aa, Artificial Sequence
  Description of Artificial Sequence: Synthetic peptide
  Seed: YSFPEPEAA (PRAME_HUMAN)
YIFPEPEAF

SEQ ID NO: 154655 - protein, 11 aa, Artificial Sequence
  Description of Artificial Sequence: Synthetic peptide
  Seed: LSNLTHVLYPV (PRAME_HUMAN)
LLNLTHVLYPV

SEQ ID NO: 154656 - protein, 9 aa, Artificial Sequence
  Description of Artificial Sequence: Synthetic peptide
  Seed: ISPEKEEQY (PRAME_HUMAN)
IVPEKEEQV

SEQ ID NO: 154657 - protein, 9 aa, Artificial Sequence
  Description of Artificial Sequence: Synthetic peptide
  Seed: ITDDQLLAL (PRAME_HUMAN)
ILDDQLLAA

SEQ ID NO: 154658 - protein, 10 aa, Artificial Sequence
  Description of Artificial Sequence: Synthetic peptide
  Seed: ELFPPLFMAA (PRAME_HUMAN)
EVFPPLFMAM

SEQ ID NO: 154659 - protein, 10 aa, Artificial Sequence
  Description of Artificial Sequence: Synthetic peptide
  Seed: SPYLGQMINL (PRAME_HUMAN)
SAYLGQMINW

SEQ ID NO: 154660 - protein, 9 aa, Artificial Sequence
  Description of Artificial Sequence: Synthetic peptide
  Seed: LALLPSLSH (PRAME_HUMAN)
LMLLPSLSI

SEQ ID NO: 154661 - protein, 11 aa, Artificial Sequence
  Description of Artificial Sequence: Synthetic peptide
  Seed: LSLQCLQALYV (PRAME_HUMAN)
LLLQCLQALYV

SEQ ID NO: 154662 - protein, 10 aa, Artificial Sequence
  Description of Artificial Sequence: Synthetic peptide
  Seed: LLPRELFPPL (PRAME_HUMAN)
LQPRELFPPM

SEQ ID NO: 154663 - protein, 9 aa, Artificial Sequence
  Description of Artificial Sequence: Synthetic peptide
  Seed: THVLYPVPL (PRAME_HUMAN)
THVLYPVPY

SEQ ID NO: 154664 - protein, 10 aa, Artificial Sequence
  Description of Artificial Sequence: Synthetic peptide
  Seed: CSQLTTLSFY (PRAME_HUMAN)
CVQLTTLSFY

SEQ ID NO: 154665 - protein, 10 aa, Artificial Sequence
  Description of Artificial Sequence: Synthetic peptide
  Seed: TVWSGNRASL (PRAME_HUMAN)
TVWSGNRASV

SEQ ID NO: 154666 - protein, 11 aa, Artificial Sequence
  Description of Artificial Sequence: Synthetic peptide
  Seed: FSPYLGQMINL (PRAME_HUMAN)
FGPYLGQMINF

SEQ ID NO: 154667 - protein, 9 aa, Artificial Sequence
  Description of Artificial Sequence: Synthetic peptide
  Seed: ALQSLLQHL (PRAME_HUMAN)
AIQSLLQHL

SEQ ID NO: 154668 - protein, 9 aa, Artificial Sequence
  Description of Artificial Sequence: Synthetic peptide
  Seed: VLMKGQHLH (PRAME_HUMAN)
VWMKGQHLY

SEQ ID NO: 154669 - protein, 10 aa, Artificial Sequence
  Description of Artificial Sequence: Synthetic peptide
  Seed: GACDELFSYL (PRAME_HUMAN)
GSCDELFSYF

SEQ ID NO: 154670 - protein, 9 aa, Artificial Sequence
  Description of Artificial Sequence: Synthetic peptide
  Seed: CRLSEGDVM (PRAME_HUMAN)
CMLSEGDVF

SEQ ID NO: 154671 - protein, 9 aa, Artificial Sequence
  Description of Artificial Sequence: Synthetic peptide
  Seed: VELAGQSLL (PRAME_HUMAN)
VHLAGQSLM

SEQ ID NO: 154672 - protein, 9 aa, Artificial Sequence
  Description of Artificial Sequence: Synthetic peptide
  Seed: QSRYISMSV (PRAME_HUMAN)
QTRYISMSF

SEQ ID NO: 154673 - protein, 11 aa, Artificial Sequence
  Description of Artificial Sequence: Synthetic peptide
  Seed: MKGQHLHLETF (PRAME_HUMAN)
MWGQHLHLETY

SEQ ID NO: 154674 - protein, 9 aa, Artificial Sequence
  Description of Artificial Sequence: Synthetic peptide
  Seed: GQHLHLETF (PRAME_HUMAN)
GEHLHLETT

SEQ ID NO: 154675 - protein, 9 aa, Artificial Sequence
  Description of Artificial Sequence: Synthetic peptide
  Seed: ESYEDIHGT (PRAME_HUMAN)
EAYEDIHGM

SEQ ID NO: 154676 - protein, 9 aa, Artificial Sequence
  Description of Artificial Sequence: Synthetic peptide
  Seed: FPPLFMAAF (PRAME_HUMAN)
FSPLFMAAY

SEQ ID NO: 154677 - protein, 9 aa, Artificial Sequence
  Description of Artificial Sequence: Synthetic peptide
  Seed: LQSLLQHLI (PRAME_HUMAN)
LVSLLQHLL

SEQ ID NO: 154678 - protein, 9 aa, Artificial Sequence
  Description of Artificial Sequence: Synthetic peptide
  Seed: EVLVDLFLK (PRAME_HUMAN)
EYLVDLFLR

SEQ ID NO: 154679 - protein, 9 aa, Artificial Sequence
  Description of Artificial Sequence: Synthetic peptide
  Seed: RLRELLCEL (PRAME_HUMAN)
RGRELLCEK

SEQ ID NO: 154680 - protein, 9 aa, Artificial Sequence
  Description of Artificial Sequence: Synthetic peptide
  Seed: FLSLQCLQA (PRAME_HUMAN)
FVSLQCLQV

SEQ ID NO: 154681 - protein, 9 aa, Artificial Sequence
  Description of Artificial Sequence: Synthetic peptide
  Seed: SFYGNSISI (PRAME_HUMAN)
SYYGNSISL

SEQ ID NO: 154682 - protein, 10 aa, Artificial Sequence
  Description of Artificial Sequence: Synthetic peptide
  Seed: TTLSFYGNSI (PRAME_HUMAN)
TQLSFYGNSV

SEQ ID NO: 154683 - protein, 9 aa, Artificial Sequence
  Description of Artificial Sequence: Synthetic peptide
  Seed: WSGNRASLY (PRAME_HUMAN)
WWGNRASLY

SEQ ID NO: 154684 - protein, 9 aa, Artificial Sequence
  Description of Artificial Sequence: Synthetic peptide
  Seed: SALQSLLQH (PRAME_HUMAN)
STLQSLLQR

SEQ ID NO: 154685 - protein, 9 aa, Artificial Sequence
  Description of Artificial Sequence: Synthetic peptide
  Seed: RLAYLHARL (PRAME_HUMAN)
RQAYLHARV

SEQ ID NO: 154686 - protein, 10 aa, Artificial Sequence
  Description of Artificial Sequence: Synthetic peptide
  Seed: SVSQLSVLSL (PRAME_HUMAN)
SSSQLSVLSF

SEQ ID NO: 154687 - protein, 9 aa, Artificial Sequence
  Description of Artificial Sequence: Synthetic peptide
  Seed: AWPFTCLPL (PRAME_HUMAN)
AWPFTCLPI

SEQ ID NO: 154688 - protein, 10 aa, Artificial Sequence
  Description of Artificial Sequence: Synthetic peptide
  Seed: ARLRELLCEL (PRAME_HUMAN)
AVLRELLCEA

SEQ ID NO: 154689 - protein, 10 aa, Artificial Sequence
  Description of Artificial Sequence: Synthetic peptide
  Seed: SLLKDEALAI (PRAME_HUMAN)
SQLKDEALAL

SEQ ID NO: 154690 - protein, 9 aa, Artificial Sequence
  Description of Artificial Sequence: Synthetic peptide
  Seed: YGNSISISA (PRAME_HUMAN)
YGNSISISF

SEQ ID NO: 154691 - protein, 10 aa, Artificial Sequence
  Description of Artificial Sequence: Synthetic peptide
  Seed: LKAMVQAWPF (PRAME_HUMAN)
LIAMVQAWPW

SEQ ID NO: 154692 - protein, 10 aa, Artificial Sequence
  Description of Artificial Sequence: Synthetic peptide
  Seed: YSFPEPEAAQ (PRAME_HUMAN)
YLFPEPEAAY

SEQ ID NO: 154693 - protein, 9 aa, Artificial Sequence
  Description of Artificial Sequence: Synthetic peptide
  Seed: SQSPSVSQL (PRAME_HUMAN)
SHSPSVSQM

SEQ ID NO: 154694 - protein, 9 aa, Artificial Sequence
  Description of Artificial Sequence: Synthetic peptide
  Seed: YISMSVWTS (PRAME_HUMAN)
YASMSVWTA

SEQ ID NO: 154695 - protein, 10 aa, Artificial Sequence
  Description of Artificial Sequence: Synthetic peptide
  Seed: LTDVSPEPLQ (PRAME_HUMAN)
LLDVSPEPLY

SEQ ID NO: 154696 - protein, 10 aa, Artificial Sequence
  Description of Artificial Sequence: Synthetic peptide
  Seed: LLSHIHASSY (PRAME_HUMAN)
LNSHIHASSW

SEQ ID NO: 154697 - protein, 9 aa, Artificial Sequence
  Description of Artificial Sequence: Synthetic peptide
  Seed: LTDVSPEPL (PRAME_HUMAN)
LGDVSPEPF

SEQ ID NO: 154698 - protein, 9 aa, Artificial Sequence
  Description of Artificial Sequence: Synthetic peptide
  Seed: QSRYISMSV (PRAME_HUMAN)
QIRYISMSI

SEQ ID NO: 154699 - protein, 9 aa, Artificial Sequence
  Description of Artificial Sequence: Synthetic peptide
  Seed: LSNLTHVLY (PRAME_HUMAN)
LINLTHVLF

SEQ ID NO: 154700 - protein, 9 aa, Artificial Sequence
  Description of Artificial Sequence: Synthetic peptide
  Seed: VWSGNRASL (PRAME_HUMAN)
VFSGNRASF

SEQ ID NO: 154701 - protein, 10 aa, Artificial Sequence
  Description of Artificial Sequence: Synthetic peptide
  Seed: GITDDQLLAL (PRAME_HUMAN)
GITDDQLLAV

SEQ ID NO: 154702 - protein, 9 aa, Artificial Sequence
  Description of Artificial Sequence: Synthetic peptide
  Seed: VLDGLDVLL (PRAME_HUMAN)
VIDGLDVLF

SEQ ID NO: 154703 - protein, 9 aa, Artificial Sequence
  Description of Artificial Sequence: Synthetic peptide
  Seed: FPPLFMAAF (PRAME_HUMAN)
FYPLFMAAF

SEQ ID NO: 154704 - protein, 9 aa, Artificial Sequence
  Description of Artificial Sequence: Synthetic peptide
  Seed: TLKAMVQAW (PRAME_HUMAN)
TTKAMVQAF

SEQ ID NO: 154705 - protein, 9 aa, Artificial Sequence
  Description of Artificial Sequence: Synthetic peptide
  Seed: LYPVPLESY (PRAME_HUMAN)
LWPVPLESI

SEQ ID NO: 154706 - protein, 9 aa, Artificial Sequence
  Description of Artificial Sequence: Synthetic peptide
  Seed: LQSLLQHLI (PRAME_HUMAN)
LKSLLQHLM

SEQ ID NO: 154707 - protein, 9 aa, Artificial Sequence
  Description of Artificial Sequence: Synthetic peptide
  Seed: TCLPLGVLM (PRAME_HUMAN)
TTLPLGVLM

SEQ ID NO: 154708 - protein, 9 aa, Artificial Sequence
  Description of Artificial Sequence: Synthetic peptide
  Seed: LSHIHASSY (PRAME_HUMAN)
LGHIHASSF

SEQ ID NO: 154709 - protein, 11 aa, Artificial Sequence
  Description of Artificial Sequence: Synthetic peptide
  Seed: RLWGSIQSRYI (PRAME_HUMAN)
RLWGSIQSRYM

SEQ ID NO: 154710 - protein, 10 aa, Artificial Sequence
  Description of Artificial Sequence: Synthetic peptide
  Seed: RLVELAGQSL (PRAME_HUMAN)
RIVELAGQSW

SEQ ID NO: 154711 - protein, 9 aa, Artificial Sequence
  Description of Artificial Sequence: Synthetic peptide
  Seed: LQCLQALYV (PRAME_HUMAN)
LLCLQALYI

SEQ ID NO: 154712 - protein, 9 aa, Artificial Sequence
  Description of Artificial Sequence: Synthetic peptide
  Seed: YISMSVWTS (PRAME_HUMAN)
YSSMSVWTI

SEQ ID NO: 154713 - protein, 9 aa, Artificial Sequence
  Description of Artificial Sequence: Synthetic peptide
  Seed: YSFPEPEAA (PRAME_HUMAN)
YTFPEPEAM

SEQ ID NO: 154714 - protein, 10 aa, Artificial Sequence
  Description of Artificial Sequence: Synthetic peptide
  Seed: AVLDGLDVLL (PRAME_HUMAN)
AALDGLDVLV

SEQ ID NO: 154715 - protein, 10 aa, Artificial Sequence
  Description of Artificial Sequence: Synthetic peptide
  Seed: RELFPPLFMA (PRAME_HUMAN)
RHLFPPLFMI

SEQ ID NO: 154716 - protein, 9 aa, Artificial Sequence
  Description of Artificial Sequence: Synthetic peptide
  Seed: CRLSEGDVM (PRAME_HUMAN)
CQLSEGDVF

SEQ ID NO: 154717 - protein, 9 aa, Artificial Sequence
  Description of Artificial Sequence: Synthetic peptide
  Seed: KLKIFAMPM (PRAME_HUMAN)
KAKIFAMPI

SEQ ID NO: 154718 - protein, 10 aa, Artificial Sequence
  Description of Artificial Sequence: Synthetic peptide
  Seed: IKMILKMVQL (PRAME_HUMAN)
IYMILKMVQA

SEQ ID NO: 154719 - protein, 10 aa, Artificial Sequence
  Description of Artificial Sequence: Synthetic peptide
  Seed: LLPRELFPPL (PRAME_HUMAN)
LPPRELFPPF

SEQ ID NO: 154720 - protein, 10 aa, Artificial Sequence
  Description of Artificial Sequence: Synthetic peptide
  Seed: LSFYGNSISI (PRAME_HUMAN)
LTFYGNSISW

SEQ ID NO: 154721 - protein, 9 aa, Artificial Sequence
  Description of Artificial Sequence: Synthetic peptide
  Seed: LAQEVRPRR (PRAME_HUMAN)
LTQEVRPRR

SEQ ID NO: 154722 - protein, 10 aa, Artificial Sequence
  Description of Artificial Sequence: Synthetic peptide
  Seed: MNPLETLSIT (PRAME_HUMAN)
MEPLETLSIV

SEQ ID NO: 154723 - protein, 10 aa, Artificial Sequence
  Description of Artificial Sequence: Synthetic peptide
  Seed: QLLRHVMNPL (PRAME_HUMAN)
QCLRHVMNPV

SEQ ID NO: 154724 - protein, 10 aa, Artificial Sequence
  Description of Artificial Sequence: Synthetic peptide
  Seed: RRLWGSIQSR (PRAME_HUMAN)
RALWGSIQSK

SEQ ID NO: 154725 - protein, 9 aa, Artificial Sequence
  Description of Artificial Sequence: Synthetic peptide
  Seed: AAFDGRHSQ (PRAME_HUMAN)
AQFDGRHSM

SEQ ID NO: 154726 - protein, 9 aa, Artificial Sequence
  Description of Artificial Sequence: Synthetic peptide
  Seed: FPPLFMAAF (PRAME_HUMAN)
FYPLFMAAM

SEQ ID NO: 154727 - protein, 9 aa, Artificial Sequence
  Description of Artificial Sequence: Synthetic peptide
  Seed: VSQLSVLSL (PRAME_HUMAN)
VMQLSVLSV

SEQ ID NO: 154728 - protein, 10 aa, Artificial Sequence
  Description of Artificial Sequence: Synthetic peptide
  Seed: YSFPEPEAAQ (PRAME_HUMAN)
YAFPEPEAAF

SEQ ID NO: 154729 - protein, 9 aa, Artificial Sequence
  Description of Artificial Sequence: Synthetic peptide
  Seed: VSPEPLQAL (PRAME_HUMAN)
VSPEPLQAF

SEQ ID NO: 154730 - protein, 11 aa, Artificial Sequence
  Description of Artificial Sequence: Synthetic peptide
  Seed: VQLDSIEDLEV (PRAME_HUMAN)
VLLDSIEDLEM

SEQ ID NO: 154731 - protein, 8 aa, Artificial Sequence
  Description of Artificial Sequence: Synthetic peptide
  Seed: YEDIHGTL (PRAME_HUMAN)
YQDIHGTL

SEQ ID NO: 154732 - protein, 9 aa, Artificial Sequence
  Description of Artificial Sequence: Synthetic peptide
  Seed: SHCSQLTTL (PRAME_HUMAN)
SQCSQLTTI

SEQ ID NO: 154733 - protein, 9 aa, Artificial Sequence
  Description of Artificial Sequence: Synthetic peptide
  Seed: SQFLSLQCL (PRAME_HUMAN)
SMFLSLQCY

SEQ ID NO: 154734 - protein, 9 aa, Artificial Sequence
  Description of Artificial Sequence: Synthetic peptide
  Seed: LVELAGQSL (PRAME_HUMAN)
LMELAGQSF

SEQ ID NO: 154735 - protein, 9 aa, Artificial Sequence
  Description of Artificial Sequence: Synthetic peptide
  Seed: ALAIAALEL (PRAME_HUMAN)
AMAIAALEI

SEQ ID NO: 154736 - protein, 9 aa, Artificial Sequence
  Description of Artificial Sequence: Synthetic peptide
  Seed: SFYGNSISI (PRAME_HUMAN)
SSYGNSISL

SEQ ID NO: 154737 - protein, 10 aa, Artificial Sequence
  Description of Artificial Sequence: Synthetic peptide
  Seed: YIAQFTSQFL (PRAME_HUMAN)
YSAQFTSQFM

SEQ ID NO: 154738 - protein, 9 aa, Artificial Sequence
  Description of Artificial Sequence: Synthetic peptide
  Seed: LMKGQHLHL (PRAME_HUMAN)
LMKGQHLHF

SEQ ID NO: 154739 - protein, 10 aa, Artificial Sequence
  Description of Artificial Sequence: Synthetic peptide
  Seed: YEDIHGTLHL (PRAME_HUMAN)
YGDIHGTLHL

SEQ ID NO: 154740 - protein, 9 aa, Artificial Sequence
  Description of Artificial Sequence: Synthetic peptide
  Seed: AAFDGRHSQ (PRAME_HUMAN)
AVFDGRHSF

SEQ ID NO: 154741 - protein, 10 aa, Artificial Sequence
  Description of Artificial Sequence: Synthetic peptide
  Seed: VLMKGQHLHL (PRAME_HUMAN)
VVMKGQHLHR

SEQ ID NO: 154742 - protein, 10 aa, Artificial Sequence
  Description of Artificial Sequence: Synthetic peptide
  Seed: SNLTHVLYPV (PRAME_HUMAN)
STLTHVLYPV

SEQ ID NO: 154743 - protein, 9 aa, Artificial Sequence
  Description of Artificial Sequence: Synthetic peptide
  Seed: LALLPSLSH (PRAME_HUMAN)
LELLPSLSY

SEQ ID NO: 154744 - protein, 9 aa, Artificial Sequence
  Description of Artificial Sequence: Synthetic peptide
  Seed: RLDQLLRHV (PRAME_HUMAN)
RFDQLLRHF

SEQ ID NO: 154745 - protein, 11 aa, Artificial Sequence
  Description of Artificial Sequence: Synthetic peptide
  Seed: FLSLQCLQALY (PRAME_HUMAN)
FKSLQCLQALL

SEQ ID NO: 154746 - protein, 10 aa, Artificial Sequence
  Description of Artificial Sequence: Synthetic peptide
  Seed: GQHLHLETFK (PRAME_HUMAN)
GTHLHLETFK

SEQ ID NO: 154747 - protein, 9 aa, Artificial Sequence
  Description of Artificial Sequence: Synthetic peptide
  Seed: LSNLTHVLY (PRAME_HUMAN)
LMNLTHVLM

SEQ ID NO: 154748 - protein, 10 aa, Artificial Sequence
  Description of Artificial Sequence: Synthetic peptide
  Seed: QAWPFTCLPL (PRAME_HUMAN)
QQWPFTCLPA

SEQ ID NO: 154749 - protein, 10 aa, Artificial Sequence
  Description of Artificial Sequence: Synthetic peptide
  Seed: RLVELAGQSL (PRAME_HUMAN)
RIVELAGQSF

SEQ ID NO: 154750 - protein, 9 aa, Artificial Sequence
  Description of Artificial Sequence: Synthetic peptide
  Seed: RLWGSIQSR (PRAME_HUMAN)
RMWGSIQSK

SEQ ID NO: 154751 - protein, 10 aa, Artificial Sequence
  Description of Artificial Sequence: Synthetic peptide
  Seed: RLSEGDVMHL (PRAME_HUMAN)
RSSEGDVMHW

SEQ ID NO: 154752 - protein, 9 aa, Artificial Sequence
  Description of Artificial Sequence: Synthetic peptide
  Seed: SHCSQLTTL (PRAME_HUMAN)
SICSQLTTL

SEQ ID NO: 154753 - protein, 9 aa, Artificial Sequence
  Description of Artificial Sequence: Synthetic peptide
  Seed: VSQLSVLSL (PRAME_HUMAN)
VIQLSVLSY

SEQ ID NO: 154754 - protein, 10 aa, Artificial Sequence
  Description of Artificial Sequence: Synthetic peptide
  Seed: LSFYGNSISI (PRAME_HUMAN)
LHFYGNSISM

SEQ ID NO: 154755 - protein, 10 aa, Artificial Sequence
  Description of Artificial Sequence: Synthetic peptide
  Seed: ISISALQSLL (PRAME_HUMAN)
ITISALQSLF

SEQ ID NO: 154756 - protein, 10 aa, Artificial Sequence
  Description of Artificial Sequence: Synthetic peptide
  Seed: MVQAWPFTCL (PRAME_HUMAN)
MGQAWPFTCF

SEQ ID NO: 154757 - protein, 10 aa, Artificial Sequence
  Description of Artificial Sequence: Synthetic peptide
  Seed: LLPRELFPPL (PRAME_HUMAN)
LLPRELFPPM

SEQ ID NO: 154758 - protein, 9 aa, Artificial Sequence
  Description of Artificial Sequence: Synthetic peptide
  Seed: RLRELLCEL (PRAME_HUMAN)
RVRELLCEA

SEQ ID NO: 154759 - protein, 10 aa, Artificial Sequence
  Description of Artificial Sequence: Synthetic peptide
  Seed: ARLRELLCEL (PRAME_HUMAN)
ADLRELLCEV

SEQ ID NO: 154760 - protein, 9 aa, Artificial Sequence
  Description of Artificial Sequence: Synthetic peptide
  Seed: LVELAGQSL (PRAME_HUMAN)
LIELAGQSL

SEQ ID NO: 154761 - protein, 9 aa, Artificial Sequence
  Description of Artificial Sequence: Synthetic peptide
  Seed: SLLQHLIGL (PRAME_HUMAN)
STLQHLIGL

SEQ ID NO: 154762 - protein, 11 aa, Artificial Sequence
  Description of Artificial Sequence: Synthetic peptide
  Seed: RASATLQDLVF (PRAME_HUMAN)
RMSATLQDLVW

SEQ ID NO: 154763 - protein, 9 aa, Artificial Sequence
  Description of Artificial Sequence: Synthetic peptide
  Seed: SIQSRYISM (PRAME_HUMAN)
STQSRYISY

SEQ ID NO: 154764 - protein, 9 aa, Artificial Sequence
  Description of Artificial Sequence: Synthetic peptide
  Seed: ISISALQSL (PRAME_HUMAN)
IMISALQST

SEQ ID NO: 154765 - protein, 9 aa, Artificial Sequence
  Description of Artificial Sequence: Synthetic peptide
  Seed: YVDSLFFLR (PRAME_HUMAN)
YQDSLFFLK

SEQ ID NO: 154766 - protein, 9 aa, Artificial Sequence
  Description of Artificial Sequence: Synthetic peptide
  Seed: LGQMINLRR (PRAME_HUMAN)
LLQMINLRR

SEQ ID NO: 154767 - protein, 8 aa, Artificial Sequence
  Description of Artificial Sequence: Synthetic peptide
  Seed: TDDQLLAL (PRAME_HUMAN)
TFDQLLAM

SEQ ID NO: 154768 - protein, 10 aa, Artificial Sequence
  Description of Artificial Sequence: Synthetic peptide
  Seed: YIAQFTSQFL (PRAME_HUMAN)
YVAQFTSQFL

SEQ ID NO: 154769 - protein, 9 aa, Artificial Sequence
  Description of Artificial Sequence: Synthetic peptide
  Seed: FLSLQCLQA (PRAME_HUMAN)
FISLQCLQV

SEQ ID NO: 154770 - protein, 10 aa, Artificial Sequence
  Description of Artificial Sequence: Synthetic peptide
  Seed: RLAYLHARLR (PRAME_HUMAN)
RNAYLHARLK

SEQ ID NO: 154771 - protein, 9 aa, Artificial Sequence
  Description of Artificial Sequence: Synthetic peptide
  Seed: LSHIHASSY (PRAME_HUMAN)
LMHIHASSF

SEQ ID NO: 154772 - protein, 9 aa, Artificial Sequence
  Description of Artificial Sequence: Synthetic peptide
  Seed: ISPEKEEQY (PRAME_HUMAN)
ITPEKEEQM

SEQ ID NO: 154773 - protein, 9 aa, Artificial Sequence
  Description of Artificial Sequence: Synthetic peptide
  Seed: VQAWPFTCL (PRAME_HUMAN)
VSAWPFTCL

SEQ ID NO: 154774 - protein, 11 aa, Artificial Sequence
  Description of Artificial Sequence: Synthetic peptide
  Seed: LPTLAKFSPYL (PRAME_HUMAN)
LLTLAKFSPYL

SEQ ID NO: 154775 - protein, 10 aa, Artificial Sequence
  Description of Artificial Sequence: Synthetic peptide
  Seed: KIFAMPMQDI (PRAME_HUMAN)
KQFAMPMQDV

SEQ ID NO: 154776 - protein, 10 aa, Artificial Sequence
  Description of Artificial Sequence: Synthetic peptide
  Seed: TSQFLSLQCL (PRAME_HUMAN)
TLQFLSLQCY

SEQ ID NO: 154777 - protein, 9 aa, Artificial Sequence
  Description of Artificial Sequence: Synthetic peptide
  Seed: DGRHSQTLK (PRAME_HUMAN)
DIRHSQTLK

SEQ ID NO: 154778 - protein, 9 aa, Artificial Sequence
  Description of Artificial Sequence: Synthetic peptide
  Seed: LYPVPLESY (PRAME_HUMAN)
LYPVPLESW

SEQ ID NO: 154779 - protein, 9 aa, Artificial Sequence
  Description of Artificial Sequence: Synthetic peptide
  Seed: RLWGSIQSR (PRAME_HUMAN)
RIWGSIQSR

SEQ ID NO: 154780 - protein, 9 aa, Artificial Sequence
  Description of Artificial Sequence: Synthetic peptide
  Seed: TLHLERLAY (PRAME_HUMAN)
TMHLERLAY

SEQ ID NO: 154781 - protein, 9 aa, Artificial Sequence
  Description of Artificial Sequence: Synthetic peptide
  Seed: KLKIFAMPM (PRAME_HUMAN)
KFKIFAMPL

SEQ ID NO: 154782 - protein, 11 aa, Artificial Sequence
  Description of Artificial Sequence: Synthetic peptide
  Seed: QALYVDSLFFL (PRAME_HUMAN)
QMLYVDSLFFA

SEQ ID NO: 154783 - protein, 10 aa, Artificial Sequence
  Description of Artificial Sequence: Synthetic peptide
  Seed: LSFYGNSISI (PRAME_HUMAN)
LIFYGNSISV

SEQ ID NO: 154784 - protein, 9 aa, Artificial Sequence
  Description of Artificial Sequence: Synthetic peptide
  Seed: RLAYLHARL (PRAME_HUMAN)
RVAYLHARK

SEQ ID NO: 154785 - protein, 10 aa, Artificial Sequence
  Description of Artificial Sequence: Synthetic peptide
  Seed: VLYPVPLESY (PRAME_HUMAN)
VSYPVPLESY

SEQ ID NO: 154786 - protein, 9 aa, Artificial Sequence
  Description of Artificial Sequence: Synthetic peptide
  Seed: SALQSLLQH (PRAME_HUMAN)
SPLQSLLQY

SEQ ID NO: 154787 - protein, 10 aa, Artificial Sequence
  Description of Artificial Sequence: Synthetic peptide
  Seed: TLHLERLAYL (PRAME_HUMAN)
TMHLERLAYA

SEQ ID NO: 154788 - protein, 11 aa, Artificial Sequence
  Description of Artificial Sequence: Synthetic peptide
  Seed: LLLSHIHASSY (PRAME_HUMAN)
LSLSHIHASSY

SEQ ID NO: 154789 - protein, 9 aa, Artificial Sequence
  Description of Artificial Sequence: Synthetic peptide
  Seed: LAIAALELL (PRAME_HUMAN)
LRIAALELY

SEQ ID NO: 154790 - protein, 9 aa, Artificial Sequence
  Description of Artificial Sequence: Synthetic peptide
  Seed: SISALQSLL (PRAME_HUMAN)
SLSALQSLL

SEQ ID NO: 154791 - protein, 10 aa, Artificial Sequence
  Description of Artificial Sequence: Synthetic peptide
  Seed: IGLSNLTHVL (PRAME_HUMAN)
IDLSNLTHVL

SEQ ID NO: 154792 - protein, 11 aa, Artificial Sequence
  Description of Artificial Sequence: Synthetic peptide
  Seed: QALYVDSLFFL (PRAME_HUMAN)
QWLYVDSLFFV

SEQ ID NO: 154793 - protein, 9 aa, Artificial Sequence
  Description of Artificial Sequence: Synthetic peptide
  Seed: EVRPRRWKL (PRAME_HUMAN)
EMRPRRWKV

SEQ ID NO: 154794 - protein, 9 aa, Artificial Sequence
  Description of Artificial Sequence: Synthetic peptide
  Seed: SATLQDLVF (PRAME_HUMAN)
SKTLQDLVF

SEQ ID NO: 154795 - protein, 9 aa, Artificial Sequence
  Description of Artificial Sequence: Synthetic peptide
  Seed: ISISALQSL (PRAME_HUMAN)
IAISALQSY

SEQ ID NO: 154796 - protein, 10 aa, Artificial Sequence
  Description of Artificial Sequence: Synthetic peptide
  Seed: MERRRLWGSI (PRAME_HUMAN)
MMRRRLWGSF

SEQ ID NO: 154797 - protein, 9 aa, Artificial Sequence
  Description of Artificial Sequence: Synthetic peptide
  Seed: FYDPEPILC (PRAME_HUMAN)
FLDPEPILW

SEQ ID NO: 154798 - protein, 10 aa, Artificial Sequence
  Description of Artificial Sequence: Synthetic peptide
  Seed: YGNSISISAL (PRAME_HUMAN)
YSNSISISAF

SEQ ID NO: 154799 - protein, 9 aa, Artificial Sequence
  Description of Artificial Sequence: Synthetic peptide
  Seed: ALELLPREL (PRAME_HUMAN)
AYELLPREM

SEQ ID NO: 154800 - protein, 9 aa, Artificial Sequence
  Description of Artificial Sequence: Synthetic peptide
  Seed: SYEDIHGTL (PRAME_HUMAN)
SMEDIHGTY

SEQ ID NO: 154801 - protein, 11 aa, Artificial Sequence
  Description of Artificial Sequence: Synthetic peptide
  Seed: LSNLTHVLYPV (PRAME_HUMAN)
LTNLTHVLYPV

SEQ ID NO: 154802 - protein, 10 aa, Artificial Sequence
  Description of Artificial Sequence: Synthetic peptide
  Seed: ISISALQSLL (PRAME_HUMAN)
IFISALQSLV

SEQ ID NO: 154803 - protein, 10 aa, Artificial Sequence
  Description of Artificial Sequence: Synthetic peptide
  Seed: FIPVEVLVDL (PRAME_HUMAN)
FYPVEVLVDY

SEQ ID NO: 154804 - protein, 9 aa, Artificial Sequence
  Description of Artificial Sequence: Synthetic peptide
  Seed: KDEALAIAA (PRAME_HUMAN)
KEEALAIAF

SEQ ID NO: 154805 - protein, 9 aa, Artificial Sequence
  Description of Artificial Sequence: Synthetic peptide
  Seed: YIAQFTSQF (PRAME_HUMAN)
YEAQFTSQV

SEQ ID NO: 154806 - protein, 9 aa, Artificial Sequence
  Description of Artificial Sequence: Synthetic peptide
  Seed: ESYEDIHGT (PRAME_HUMAN)
EVYEDIHGT

SEQ ID NO: 154807 - protein, 10 aa, Artificial Sequence
  Description of Artificial Sequence: Synthetic peptide
  Seed: KKLKIFAMPM (PRAME_HUMAN)
KALKIFAMPY

SEQ ID NO: 154808 - protein, 9 aa, Artificial Sequence
  Description of Artificial Sequence: Synthetic peptide
  Seed: LLLSHIHAS (PRAME_HUMAN)
LSLSHIHAV

SEQ ID NO: 154809 - protein, 10 aa, Artificial Sequence
  Description of Artificial Sequence: Synthetic peptide
  Seed: SISISALQSL (PRAME_HUMAN)
SPSISALQSY

SEQ ID NO: 154810 - protein, 10 aa, Artificial Sequence
  Description of Artificial Sequence: Synthetic peptide
  Seed: LLCELGRPSM (PRAME_HUMAN)
LQCELGRPSY

SEQ ID NO: 154811 - protein, 9 aa, Artificial Sequence
  Description of Artificial Sequence: Synthetic peptide
  Seed: FYDPEPILC (PRAME_HUMAN)
FRDPEPILY

SEQ ID NO: 154812 - protein, 10 aa, Artificial Sequence
  Description of Artificial Sequence: Synthetic peptide
  Seed: ALYVDSLFFL (PRAME_HUMAN)
AIYVDSLFFM

SEQ ID NO: 154813 - protein, 10 aa, Artificial Sequence
  Description of Artificial Sequence: Synthetic peptide
  Seed: SISISALQSL (PRAME_HUMAN)
SLSISALQSL

SEQ ID NO: 154814 - protein, 10 aa, Artificial Sequence
  Description of Artificial Sequence: Synthetic peptide
  Seed: SALQSLLQHL (PRAME_HUMAN)
SVLQSLLQHV

SEQ ID NO: 154815 - protein, 11 aa, Artificial Sequence
  Description of Artificial Sequence: Synthetic peptide
  Seed: IAQFTSQFLSL (PRAME_HUMAN)
IAQFTSQFLSY

SEQ ID NO: 154816 - protein, 9 aa, Artificial Sequence
  Description of Artificial Sequence: Synthetic peptide
  Seed: WKLPTLAKF (PRAME_HUMAN)
WQLPTLAKF

SEQ ID NO: 154817 - protein, 8 aa, Artificial Sequence
  Description of Artificial Sequence: Synthetic peptide
  Seed: FYDPEPIL (PRAME_HUMAN)
FTDPEPIL

SEQ ID NO: 154818 - protein, 9 aa, Artificial Sequence
  Description of Artificial Sequence: Synthetic peptide
  Seed: LYVDSLFFL (PRAME_HUMAN)
LTVDSLFFM

SEQ ID NO: 154819 - protein, 8 aa, Artificial Sequence
  Description of Artificial Sequence: Synthetic peptide
  Seed: YEDIHGTL (PRAME_HUMAN)
YYDIHGTF

SEQ ID NO: 154820 - protein, 9 aa, Artificial Sequence
  Description of Artificial Sequence: Synthetic peptide
  Seed: LLKDEALAI (PRAME_HUMAN)
LTKDEALAM

SEQ ID NO: 154821 - protein, 9 aa, Artificial Sequence
  Description of Artificial Sequence: Synthetic peptide
  Seed: LALLPSLSH (PRAME_HUMAN)
LQLLPSLSM

SEQ ID NO: 154822 - protein, 9 aa, Artificial Sequence
  Description of Artificial Sequence: Synthetic peptide
  Seed: ACDELFSYL (PRAME_HUMAN)
AIDELFSYY

SEQ ID NO: 154823 - protein, 11 aa, Artificial Sequence
  Description of Artificial Sequence: Synthetic peptide
  Seed: AAFDGRHSQTL (PRAME_HUMAN)
AAFDGRHSQTW

SEQ ID NO: 154824 - protein, 8 aa, Artificial Sequence
  Description of Artificial Sequence: Synthetic peptide
  Seed: FYDPEPIL (PRAME_HUMAN)
FFDPEPIF

SEQ ID NO: 154825 - protein, 9 aa, Artificial Sequence
  Description of Artificial Sequence: Synthetic peptide
  Seed: TFYDPEPIL (PRAME_HUMAN)
TFYDPEPIM

SEQ ID NO: 154826 - protein, 9 aa, Artificial Sequence
  Description of Artificial Sequence: Synthetic peptide
  Seed: SQLSVLSLS (PRAME_HUMAN)
SLLSVLSLL

SEQ ID NO: 154827 - protein, 9 aa, Artificial Sequence
  Description of Artificial Sequence: Synthetic peptide
  Seed: VLYPVPLES (PRAME_HUMAN)
VVYPVPLEA

SEQ ID NO: 154828 - protein, 9 aa, Artificial Sequence
  Description of Artificial Sequence: Synthetic peptide
  Seed: LLLSHIHAS (PRAME_HUMAN)
LVLSHIHAV

SEQ ID NO: 154829 - protein, 10 aa, Artificial Sequence
  Description of Artificial Sequence: Synthetic peptide
  Seed: HCSQLTTLSF (PRAME_HUMAN)
HPSQLTTLSW

SEQ ID NO: 154830 - protein, 9 aa, Artificial Sequence
  Description of Artificial Sequence: Synthetic peptide
  Seed: ISISALQSL (PRAME_HUMAN)
IQISALQSF

SEQ ID NO: 154831 - protein, 11 aa, Artificial Sequence
  Description of Artificial Sequence: Synthetic peptide
  Seed: LPTLAKFSPYL (PRAME_HUMAN)
LSTLAKFSPYV

SEQ ID NO: 154832 - protein, 10 aa, Artificial Sequence
  Description of Artificial Sequence: Synthetic peptide
  Seed: RLAYLHARLR (PRAME_HUMAN)
RMAYLHARLV

SEQ ID NO: 154833 - protein, 9 aa, Artificial Sequence
  Description of Artificial Sequence: Synthetic peptide
  Seed: AEQPFIPVE (PRAME_HUMAN)
AEQPFIPVS

SEQ ID NO: 154834 - protein, 10 aa, Artificial Sequence
  Description of Artificial Sequence: Synthetic peptide
  Seed: ELFSYLIEKV (PRAME_HUMAN)
EMFSYLIEKV

SEQ ID NO: 154835 - protein, 10 aa, Artificial Sequence
  Description of Artificial Sequence: Synthetic peptide
  Seed: LSFYGNSISI (PRAME_HUMAN)
LVFYGNSISW

SEQ ID NO: 154836 - protein, 9 aa, Artificial Sequence
  Description of Artificial Sequence: Synthetic peptide
  Seed: HVMNPLETL (PRAME_HUMAN)
HSMNPLETR

SEQ ID NO: 154837 - protein, 9 aa, Artificial Sequence
  Description of Artificial Sequence: Synthetic peptide
  Seed: RLRELLCEL (PRAME_HUMAN)
RVRELLCEV

SEQ ID NO: 154838 - protein, 9 aa, Artificial Sequence
  Description of Artificial Sequence: Synthetic peptide
  Seed: YIAQFTSQF (PRAME_HUMAN)
YLAQFTSQR

SEQ ID NO: 154839 - protein, 9 aa, Artificial Sequence
  Description of Artificial Sequence: Synthetic peptide
  Seed: LSTEAEQPF (PRAME_HUMAN)
LATEAEQPL

SEQ ID NO: 154840 - protein, 9 aa, Artificial Sequence
  Description of Artificial Sequence: Synthetic peptide
  Seed: FLRGRLDQL (PRAME_HUMAN)
FVRGRLDQY

SEQ ID NO: 154841 - protein, 9 aa, Artificial Sequence
  Description of Artificial Sequence: Synthetic peptide
  Seed: SRYISMSVW (PRAME_HUMAN)
SQYISMSVV

SEQ ID NO: 154842 - protein, 11 aa, Artificial Sequence
  Description of Artificial Sequence: Synthetic peptide
  Seed: LPTLAKFSPYL (PRAME_HUMAN)
LVTLAKFSPYI

SEQ ID NO: 154843 - protein, 10 aa, Artificial Sequence
  Description of Artificial Sequence: Synthetic peptide
  Seed: KGQHLHLETF (PRAME_HUMAN)
KDQHLHLETY

SEQ ID NO: 154844 - protein, 11 aa, Artificial Sequence
  Description of Artificial Sequence: Synthetic peptide
  Seed: VQAWPFTCLPL (PRAME_HUMAN)
VQAWPFTCLPM

SEQ ID NO: 154845 - protein, 10 aa, Artificial Sequence
  Description of Artificial Sequence: Synthetic peptide
  Seed: MLTDVSPEPL (PRAME_HUMAN)
MMTDVSPEPL

SEQ ID NO: 154846 - protein, 9 aa, Artificial Sequence
  Description of Artificial Sequence: Synthetic peptide
  Seed: KMILKMVQL (PRAME_HUMAN)
KYILKMVQM

SEQ ID NO: 154847 - protein, 9 aa, Artificial Sequence
  Description of Artificial Sequence: Synthetic peptide
  Seed: LMKGQHLHL (PRAME_HUMAN)
LAKGQHLHW

SEQ ID NO: 154848 - protein, 9 aa, Artificial Sequence
  Description of Artificial Sequence: Synthetic peptide
  Seed: LTDVSPEPL (PRAME_HUMAN)
LNDVSPEPM

SEQ ID NO: 154849 - protein, 9 aa, Artificial Sequence
  Description of Artificial Sequence: Synthetic peptide
  Seed: KLKIFAMPM (PRAME_HUMAN)
KTKIFAMPN

SEQ ID NO: 154850 - protein, 11 aa, Artificial Sequence
  Description of Artificial Sequence: Synthetic peptide
  Seed: LPTLAKFSPYL (PRAME_HUMAN)
LDTLAKFSPYV

SEQ ID NO: 154851 - protein, 9 aa, Artificial Sequence
  Description of Artificial Sequence: Synthetic peptide
  Seed: RLAYLHARL (PRAME_HUMAN)
RIAYLHARR

SEQ ID NO: 154852 - protein, 10 aa, Artificial Sequence
  Description of Artificial Sequence: Synthetic peptide
  Seed: AEQPFIPVEV (PRAME_HUMAN)
AEQPFIPVEL

SEQ ID NO: 154853 - protein, 9 aa, Artificial Sequence
  Description of Artificial Sequence: Synthetic peptide
  Seed: SIQSRYISM (PRAME_HUMAN)
SAQSRYISL

SEQ ID NO: 154854 - protein, 9 aa, Artificial Sequence
  Description of Artificial Sequence: Synthetic peptide
  Seed: NLTHVLYPV (PRAME_HUMAN)
NTTHVLYPM

SEQ ID NO: 154855 - protein, 10 aa, Artificial Sequence
  Description of Artificial Sequence: Synthetic peptide
  Seed: LSFYGNSISI (PRAME_HUMAN)
LAFYGNSISY

SEQ ID NO: 154856 - protein, 9 aa, Artificial Sequence
  Description of Artificial Sequence: Synthetic peptide
  Seed: ISPEKEEQY (PRAME_HUMAN)
IMPEKEEQM

SEQ ID NO: 154857 - protein, 10 aa, Artificial Sequence
  Description of Artificial Sequence: Synthetic peptide
  Seed: KAVLDGLDVL (PRAME_HUMAN)
KLVLDGLDVV

SEQ ID NO: 154858 - protein, 10 aa, Artificial Sequence
  Description of Artificial Sequence: Synthetic peptide
  Seed: SPYLGQMINL (PRAME_HUMAN)
SNYLGQMINW

SEQ ID NO: 154859 - protein, 10 aa, Artificial Sequence
  Description of Artificial Sequence: Synthetic peptide
  Seed: LLLSHIHASS (PRAME_HUMAN)
LPLSHIHASI

SEQ ID NO: 154860 - protein, 9 aa, Artificial Sequence
  Description of Artificial Sequence: Synthetic peptide
  Seed: MHLSQSPSV (PRAME_HUMAN)
MHLSQSPSL

SEQ ID NO: 154861 - protein, 10 aa, Artificial Sequence
  Description of Artificial Sequence: Synthetic peptide
  Seed: KAVLDGLDVL (PRAME_HUMAN)
KQVLDGLDVW

SEQ ID NO: 154862 - protein, 9 aa, Artificial Sequence
  Description of Artificial Sequence: Synthetic peptide
  Seed: KVKRKKNVL (PRAME_HUMAN)
KAKRKKNVK

SEQ ID NO: 154863 - protein, 10 aa, Artificial Sequence
  Description of Artificial Sequence: Synthetic peptide
  Seed: TTLSFYGNSI (PRAME_HUMAN)
TRLSFYGNSV

SEQ ID NO: 154864 - protein, 9 aa, Artificial Sequence
  Description of Artificial Sequence: Synthetic peptide
  Seed: SHIHASSYI (PRAME_HUMAN)
SQIHASSYH

SEQ ID NO: 154865 - protein, 10 aa, Artificial Sequence
  Description of Artificial Sequence: Synthetic peptide
  Seed: KNVLRLCCKK (PRAME_HUMAN)
KVVLRLCCKR

SEQ ID NO: 154866 - protein, 10 aa, Artificial Sequence
  Description of Artificial Sequence: Synthetic peptide
  Seed: RHVMNPLETL (PRAME_HUMAN)
RAVMNPLETM

SEQ ID NO: 154867 - protein, 10 aa, Artificial Sequence
  Description of Artificial Sequence: Synthetic peptide
  Seed: RASATLQDLV (PRAME_HUMAN)
RWSATLQDLF

SEQ ID NO: 154868 - protein, 9 aa, Artificial Sequence
  Description of Artificial Sequence: Synthetic peptide
  Seed: QPFIPVEVL (PRAME_HUMAN)
QAFIPVEVW

SEQ ID NO: 154869 - protein, 9 aa, Artificial Sequence
  Description of Artificial Sequence: Synthetic peptide
  Seed: SHCSQLTTL (PRAME_HUMAN)
SFCSQLTTF

SEQ ID NO: 154870 - protein, 9 aa, Artificial Sequence
  Description of Artificial Sequence: Synthetic peptide
  Seed: WKLPTLAKF (PRAME_HUMAN)
WRLPTLAKF

SEQ ID NO: 154871 - protein, 9 aa, Artificial Sequence
  Description of Artificial Sequence: Synthetic peptide
  Seed: TLAKFSPYL (PRAME_HUMAN)
TMAKFSPYI

SEQ ID NO: 154872 - protein, 9 aa, Artificial Sequence
  Description of Artificial Sequence: Synthetic peptide
  Seed: RLAYLHARL (PRAME_HUMAN)
RQAYLHARM

SEQ ID NO: 154873 - protein, 11 aa, Artificial Sequence
  Description of Artificial Sequence: Synthetic peptide
  Seed: LPTLAKFSPYL (PRAME_HUMAN)
LYTLAKFSPYI

SEQ ID NO: 154874 - protein, 9 aa, Artificial Sequence
  Description of Artificial Sequence: Synthetic peptide
  Seed: LSHIHASSY (PRAME_HUMAN)
LWHIHASSF

SEQ ID NO: 154875 - protein, 9 aa, Artificial Sequence
  Description of Artificial Sequence: Synthetic peptide
  Seed: YLHARLREL (PRAME_HUMAN)
YFHARLREY

SEQ ID NO: 154876 - protein, 9 aa, Artificial Sequence
  Description of Artificial Sequence: Synthetic peptide
  Seed: YIAQFTSQF (PRAME_HUMAN)
YHAQFTSQY

SEQ ID NO: 154877 - protein, 9 aa, Artificial Sequence
  Description of Artificial Sequence: Synthetic peptide
  Seed: GRHSQTLKA (PRAME_HUMAN)
GRHSQTLKI

SEQ ID NO: 154878 - protein, 10 aa, Artificial Sequence
  Description of Artificial Sequence: Synthetic peptide
  Seed: RLVELAGQSL (PRAME_HUMAN)
RVVELAGQSF

SEQ ID NO: 154879 - protein, 10 aa, Artificial Sequence
  Description of Artificial Sequence: Synthetic peptide
  Seed: TSQFLSLQCL (PRAME_HUMAN)
TPQFLSLQCF

SEQ ID NO: 154880 - protein, 11 aa, Artificial Sequence
  Description of Artificial Sequence: Synthetic peptide
  Seed: HLSQSPSVSQL (PRAME_HUMAN)
HISQSPSVSQY

SEQ ID NO: 154881 - protein, 10 aa, Artificial Sequence
  Description of Artificial Sequence: Synthetic peptide
  Seed: RRWKLQVLDL (PRAME_HUMAN)
RRWKLQVLDK

SEQ ID NO: 154882 - protein, 9 aa, Artificial Sequence
  Description of Artificial Sequence: Synthetic peptide
  Seed: SALQSLLQH (PRAME_HUMAN)
STLQSLLQY

SEQ ID NO: 154883 - protein, 10 aa, Artificial Sequence
  Description of Artificial Sequence: Synthetic peptide
  Seed: SPYLGQMINL (PRAME_HUMAN)
SWYLGQMINL

SEQ ID NO: 154884 - protein, 9 aa, Artificial Sequence
  Description of Artificial Sequence: Synthetic peptide
  Seed: HARLRELLC (PRAME_HUMAN)
HARLRELLL

SEQ ID NO: 154885 - protein, 9 aa, Artificial Sequence
  Description of Artificial Sequence: Synthetic peptide
  Seed: LVELAGQSL (PRAME_HUMAN)
LWELAGQSF

SEQ ID NO: 154886 - protein, 9 aa, Artificial Sequence
  Description of Artificial Sequence: Synthetic peptide
  Seed: THVLYPVPL (PRAME_HUMAN)
TKVLYPVPM

SEQ ID NO: 154887 - protein, 10 aa, Artificial Sequence
  Description of Artificial Sequence: Synthetic peptide
  Seed: LLSHIHASSY (PRAME_HUMAN)
LISHIHASSW

SEQ ID NO: 154888 - protein, 9 aa, Artificial Sequence
  Description of Artificial Sequence: Synthetic peptide
  Seed: KLKIFAMPM (PRAME_HUMAN)
KMKIFAMPW

SEQ ID NO: 154889 - protein, 9 aa, Artificial Sequence
  Description of Artificial Sequence: Synthetic peptide
  Seed: SLLQHLIGL (PRAME_HUMAN)
SLLQHLIGM

SEQ ID NO: 154890 - protein, 9 aa, Artificial Sequence
  Description of Artificial Sequence: Synthetic peptide
  Seed: LSEGDVMHL (PRAME_HUMAN)
LLEGDVMHM

SEQ ID NO: 154891 - protein, 11 aa, Artificial Sequence
  Description of Artificial Sequence: Synthetic peptide
  Seed: MPMQDIKMILK (PRAME_HUMAN)
MPMQDIKMILL

SEQ ID NO: 154892 - protein, 9 aa, Artificial Sequence
  Description of Artificial Sequence: Synthetic peptide
  Seed: THVLYPVPL (PRAME_HUMAN)
TEVLYPVPF

SEQ ID NO: 154893 - protein, 10 aa, Artificial Sequence
  Description of Artificial Sequence: Synthetic peptide
  Seed: IQSRYISMSV (PRAME_HUMAN)
IMSRYISMSI

SEQ ID NO: 154894 - protein, 9 aa, Artificial Sequence
  Description of Artificial Sequence: Synthetic peptide
  Seed: MVQAWPFTC (PRAME_HUMAN)
MMQAWPFTC

SEQ ID NO: 154895 - protein, 9 aa, Artificial Sequence
  Description of Artificial Sequence: Synthetic peptide
  Seed: FLRGRLDQL (PRAME_HUMAN)
FQRGRLDQY

SEQ ID NO: 154896 - protein, 9 aa, Artificial Sequence
  Description of Artificial Sequence: Synthetic peptide
  Seed: KEEQYIAQF (PRAME_HUMAN)
KEEQYIAQL

SEQ ID NO: 154897 - protein, 11 aa, Artificial Sequence
  Description of Artificial Sequence: Synthetic peptide
  Seed: LLPRELFPPLF (PRAME_HUMAN)
LYPRELFPPLW

SEQ ID NO: 154898 - protein, 10 aa, Artificial Sequence
  Description of Artificial Sequence: Synthetic peptide
  Seed: KGQHLHLETF (PRAME_HUMAN)
KEQHLHLETF

SEQ ID NO: 154899 - protein, 9 aa, Artificial Sequence
  Description of Artificial Sequence: Synthetic peptide
  Seed: SLLQHLIGL (PRAME_HUMAN)
SSLQHLIGW

SEQ ID NO: 154900 - protein, 11 aa, Artificial Sequence
  Description of Artificial Sequence: Synthetic peptide
  Seed: QALYVDSLFFL (PRAME_HUMAN)
QVLYVDSLFFI

SEQ ID NO: 154901 - protein, 9 aa, Artificial Sequence
  Description of Artificial Sequence: Synthetic peptide
  Seed: CSQLTTLSF (PRAME_HUMAN)
CYQLTTLSY

SEQ ID NO: 154902 - protein, 9 aa, Artificial Sequence
  Description of Artificial Sequence: Synthetic peptide
  Seed: VQAWPFTCL (PRAME_HUMAN)
VHAWPFTCL

SEQ ID NO: 154903 - protein, 10 aa, Artificial Sequence
  Description of Artificial Sequence: Synthetic peptide
  Seed: SGNRASLYSF (PRAME_HUMAN)
SSNRASLYSF

SEQ ID NO: 154904 - protein, 10 aa, Artificial Sequence
  Description of Artificial Sequence: Synthetic peptide
  Seed: FMAAFDGRHS (PRAME_HUMAN)
FMAAFDGRHL

SEQ ID NO: 154905 - protein, 10 aa, Artificial Sequence
  Description of Artificial Sequence: Synthetic peptide
  Seed: RGRLDQLLRH (PRAME_HUMAN)
RMRLDQLLRR

SEQ ID NO: 154906 - protein, 10 aa, Artificial Sequence
  Description of Artificial Sequence: Synthetic peptide
  Seed: ITDDQLLALL (PRAME_HUMAN)
ITDDQLLALF

SEQ ID NO: 154907 - protein, 9 aa, Artificial Sequence
  Description of Artificial Sequence: Synthetic peptide
  Seed: FYDPEPILC (PRAME_HUMAN)
FGDPEPILT

SEQ ID NO: 154908 - protein, 9 aa, Artificial Sequence
  Description of Artificial Sequence: Synthetic peptide
  Seed: SQSPSVSQL (PRAME_HUMAN)
SWSPSVSQY

SEQ ID NO: 154909 - protein, 10 aa, Artificial Sequence
  Description of Artificial Sequence: Synthetic peptide
  Seed: MPMQDIKMIL (PRAME_HUMAN)
MHMQDIKMIL

SEQ ID NO: 154910 - protein, 9 aa, Artificial Sequence
  Description of Artificial Sequence: Synthetic peptide
  Seed: LLLSHIHAS (PRAME_HUMAN)
LSLSHIHAA

SEQ ID NO: 154911 - protein, 9 aa, Artificial Sequence
  Description of Artificial Sequence: Synthetic peptide
  Seed: AAFDGRHSQ (PRAME_HUMAN)
AIFDGRHSF

SEQ ID NO: 154912 - protein, 9 aa, Artificial Sequence
  Description of Artificial Sequence: Synthetic peptide
  Seed: YISMSVWTS (PRAME_HUMAN)
YLSMSVWTL

SEQ ID NO: 154913 - protein, 10 aa, Artificial Sequence
  Description of Artificial Sequence: Synthetic peptide
  Seed: GRLDQLLRHV (PRAME_HUMAN)
GLLDQLLRHV

SEQ ID NO: 154914 - protein, 9 aa, Artificial Sequence
  Description of Artificial Sequence: Synthetic peptide
  Seed: SQLSVLSLS (PRAME_HUMAN)
SLLSVLSLA

SEQ ID NO: 154915 - protein, 11 aa, Artificial Sequence
  Description of Artificial Sequence: Synthetic peptide
  Seed: LTDVSPEPLQA (PRAME_HUMAN)
LLDVSPEPLQL

SEQ ID NO: 154916 - protein, 9 aa, Artificial Sequence
  Description of Artificial Sequence: Synthetic peptide
  Seed: ITDDQLLAL (PRAME_HUMAN)
IVDDQLLAC

SEQ ID NO: 154917 - protein, 9 aa, Artificial Sequence
  Description of Artificial Sequence: Synthetic peptide
  Seed: LGRPSMVWL (PRAME_HUMAN)
LTRPSMVWK

SEQ ID NO: 154918 - protein, 10 aa, Artificial Sequence
  Description of Artificial Sequence: Synthetic peptide
  Seed: ITDDQLLALL (PRAME_HUMAN)
ITDDQLLALV

SEQ ID NO: 154919 - protein, 10 aa, Artificial Sequence
  Description of Artificial Sequence: Synthetic peptide
  Seed: RLSEGDVMHL (PRAME_HUMAN)
RISEGDVMHL

SEQ ID NO: 154920 - protein, 9 aa, Artificial Sequence
  Description of Artificial Sequence: Synthetic peptide
  Seed: NLTHVLYPV (PRAME_HUMAN)
NATHVLYPI

SEQ ID NO: 154921 - protein, 10 aa, Artificial Sequence
  Description of Artificial Sequence: Synthetic peptide
  Seed: AVLDGLDVLL (PRAME_HUMAN)
ALLDGLDVLA

SEQ ID NO: 154922 - protein, 9 aa, Artificial Sequence
  Description of Artificial Sequence: Synthetic peptide
  Seed: KAMVQAWPF (PRAME_HUMAN)
KLMVQAWPF

SEQ ID NO: 154923 - protein, 10 aa, Artificial Sequence
  Description of Artificial Sequence: Synthetic peptide
  Seed: DIHGTLHLER (PRAME_HUMAN)
DTHGTLHLEK

SEQ ID NO: 154924 - protein, 9 aa, Artificial Sequence
  Description of Artificial Sequence: Synthetic peptide
  Seed: ELFPPLFMA (PRAME_HUMAN)
EVFPPLFMT

SEQ ID NO: 154925 - protein, 9 aa, Artificial Sequence
  Description of Artificial Sequence: Synthetic peptide
  Seed: FMAAFDGRH (PRAME_HUMAN)
FAAAFDGRY

SEQ ID NO: 154926 - protein, 10 aa, Artificial Sequence
  Description of Artificial Sequence: Synthetic peptide
  Seed: GLSNLTHVLY (PRAME_HUMAN)
GSSNLTHVLW

SEQ ID NO: 154927 - protein, 9 aa, Artificial Sequence
  Description of Artificial Sequence: Synthetic peptide
  Seed: LERLAYLHA (PRAME_HUMAN)
LERLAYLHL

SEQ ID NO: 154928 - protein, 9 aa, Artificial Sequence
  Description of Artificial Sequence: Synthetic peptide
  Seed: YPVPLESYE (PRAME_HUMAN)
YTVPLESYF

SEQ ID NO: 154929 - protein, 9 aa, Artificial Sequence
  Description of Artificial Sequence: Synthetic peptide
  Seed: RLSEGDVMH (PRAME_HUMAN)
RLSEGDVMK

SEQ ID NO: 154930 - protein, 10 aa, Artificial Sequence
  Description of Artificial Sequence: Synthetic peptide
  Seed: YISPEKEEQY (PRAME_HUMAN)
YSSPEKEEQY

SEQ ID NO: 154931 - protein, 9 aa, Artificial Sequence
  Description of Artificial Sequence: Synthetic peptide
  Seed: FSPYLGQMI (PRAME_HUMAN)
FAPYLGQMF

SEQ ID NO: 154932 - protein, 9 aa, Artificial Sequence
  Description of Artificial Sequence: Synthetic peptide
  Seed: ACDELFSYL (PRAME_HUMAN)
AGDELFSYL

SEQ ID NO: 154933 - protein, 11 aa, Artificial Sequence
  Description of Artificial Sequence: Synthetic peptide
  Seed: SYISPEKEEQY (PRAME_HUMAN)
SQISPEKEEQF

SEQ ID NO: 154934 - protein, 9 aa, Artificial Sequence
  Description of Artificial Sequence: Synthetic peptide
  Seed: VFDECGITD (PRAME_HUMAN)
VMDECGITI

SEQ ID NO: 154935 - protein, 9 aa, Artificial Sequence
  Description of Artificial Sequence: Synthetic peptide
  Seed: IGLSNLTHV (PRAME_HUMAN)
IMLSNLTHM

SEQ ID NO: 154936 - protein, 9 aa, Artificial Sequence
  Description of Artificial Sequence: Synthetic peptide
  Seed: RHSQTLKAM (PRAME_HUMAN)
RNSQTLKAF

SEQ ID NO: 154937 - protein, 10 aa, Artificial Sequence
  Description of Artificial Sequence: Synthetic peptide
  Seed: LSFYGNSISI (PRAME_HUMAN)
LMFYGNSISY

SEQ ID NO: 154938 - protein, 10 aa, Artificial Sequence
  Description of Artificial Sequence: Synthetic peptide
  Seed: RRRLWGSIQS (PRAME_HUMAN)
RRRLWGSIQY

SEQ ID NO: 154939 - protein, 10 aa, Artificial Sequence
  Description of Artificial Sequence: Synthetic peptide
  Seed: AEQPFIPVEV (PRAME_HUMAN)
AEQPFIPVEW

SEQ ID NO: 154940 - protein, 9 aa, Artificial Sequence
  Description of Artificial Sequence: Synthetic peptide
  Seed: VLSLSGVML (PRAME_HUMAN)
VQSLSGVML

SEQ ID NO: 154941 - protein, 10 aa, Artificial Sequence
  Description of Artificial Sequence: Synthetic peptide
  Seed: LQALYVDSLF (PRAME_HUMAN)
LMALYVDSLM

SEQ ID NO: 154942 - protein, 10 aa, Artificial Sequence
  Description of Artificial Sequence: Synthetic peptide
  Seed: MPMQDIKMIL (PRAME_HUMAN)
MIMQDIKMIV

SEQ ID NO: 154943 - protein, 9 aa, Artificial Sequence
  Description of Artificial Sequence: Synthetic peptide
  Seed: ISISALQSL (PRAME_HUMAN)
IGISALQSW

SEQ ID NO: 154944 - protein, 9 aa, Artificial Sequence
  Description of Artificial Sequence: Synthetic peptide
  Seed: SFYGNSISI (PRAME_HUMAN)
SQYGNSISG

SEQ ID NO: 154945 - protein, 11 aa, Artificial Sequence
  Description of Artificial Sequence: Synthetic peptide
  Seed: AAFDGRHSQTL (PRAME_HUMAN)
AMFDGRHSQTL

SEQ ID NO: 154946 - protein, 11 aa, Artificial Sequence
  Description of Artificial Sequence: Synthetic peptide
  Seed: RRRLWGSIQSR (PRAME_HUMAN)
RGRLWGSIQSR

SEQ ID NO: 154947 - protein, 9 aa, Artificial Sequence
  Description of Artificial Sequence: Synthetic peptide
  Seed: QLLALLPSL (PRAME_HUMAN)
QMLALLPSL

SEQ ID NO: 154948 - protein, 10 aa, Artificial Sequence
  Description of Artificial Sequence: Synthetic peptide
  Seed: FFLRGRLDQL (PRAME_HUMAN)
FTLRGRLDQV

SEQ ID NO: 154949 - protein, 9 aa, Artificial Sequence
  Description of Artificial Sequence: Synthetic peptide
  Seed: RGRLDQLLR (PRAME_HUMAN)
RQRLDQLLK

SEQ ID NO: 154950 - protein, 10 aa, Artificial Sequence
  Description of Artificial Sequence: Synthetic peptide
  Seed: ALYVDSLFFL (PRAME_HUMAN)
AVYVDSLFFW

SEQ ID NO: 154951 - protein, 11 aa, Artificial Sequence
  Description of Artificial Sequence: Synthetic peptide
  Seed: LQSLLQHLIGL (PRAME_HUMAN)
LWSLLQHLIGV

SEQ ID NO: 154952 - protein, 10 aa, Artificial Sequence
  Description of Artificial Sequence: Synthetic peptide
  Seed: FTCLPLGVLM (PRAME_HUMAN)
FSCLPLGVLY

SEQ ID NO: 154953 - protein, 10 aa, Artificial Sequence
  Description of Artificial Sequence: Synthetic peptide
  Seed: KAVLDGLDVL (PRAME_HUMAN)
KTVLDGLDVW

SEQ ID NO: 154954 - protein, 9 aa, Artificial Sequence
  Description of Artificial Sequence: Synthetic peptide
  Seed: RGRLDQLLR (PRAME_HUMAN)
RYRLDQLLR

SEQ ID NO: 154955 - protein, 9 aa, Artificial Sequence
  Description of Artificial Sequence: Synthetic peptide
  Seed: LQDLVFDEC (PRAME_HUMAN)
LCDLVFDEM

SEQ ID NO: 154956 - protein, 9 aa, Artificial Sequence
  Description of Artificial Sequence: Synthetic peptide
  Seed: FYDPEPILC (PRAME_HUMAN)
FTDPEPILI

SEQ ID NO: 154957 - protein, 9 aa, Artificial Sequence
  Description of Artificial Sequence: Synthetic peptide
  Seed: LLKDEALAI (PRAME_HUMAN)
LGKDEALAY

SEQ ID NO: 154958 - protein, 9 aa, Artificial Sequence
  Description of Artificial Sequence: Synthetic peptide
  Seed: RTFYDPEPI (PRAME_HUMAN)
RKFYDPEPL

SEQ ID NO: 154959 - protein, 11 aa, Artificial Sequence
  Description of Artificial Sequence: Synthetic peptide
  Seed: QYIAQFTSQFL (PRAME_HUMAN)
QWIAQFTSQFF

SEQ ID NO: 154960 - protein, 9 aa, Artificial Sequence
  Description of Artificial Sequence: Synthetic peptide
  Seed: ISPEKEEQY (PRAME_HUMAN)
IFPEKEEQM

SEQ ID NO: 154961 - protein, 10 aa, Artificial Sequence
  Description of Artificial Sequence: Synthetic peptide
  Seed: AALELLPREL (PRAME_HUMAN)
AALELLPREY

SEQ ID NO: 154962 - protein, 9 aa, Artificial Sequence
  Description of Artificial Sequence: Synthetic peptide
  Seed: SISALQSLL (PRAME_HUMAN)
SASALQSLI

SEQ ID NO: 154963 - protein, 11 aa, Artificial Sequence
  Description of Artificial Sequence: Synthetic peptide
  Seed: RRLWGSIQSRY (PRAME_HUMAN)
RILWGSIQSRR

SEQ ID NO: 154964 - protein, 9 aa, Artificial Sequence
  Description of Artificial Sequence: Synthetic peptide
  Seed: LMKGQHLHL (PRAME_HUMAN)
LPKGQHLHM

SEQ ID NO: 154965 - protein, 11 aa, Artificial Sequence
  Description of Artificial Sequence: Synthetic peptide
  Seed: LPTLAKFSPYL (PRAME_HUMAN)
LKTLAKFSPYI

SEQ ID NO: 154966 - protein, 9 aa, Artificial Sequence
  Description of Artificial Sequence: Synthetic peptide
  Seed: LLRHVMNPL (PRAME_HUMAN)
LPRHVMNPI

SEQ ID NO: 154967 - protein, 9 aa, Artificial Sequence
  Description of Artificial Sequence: Synthetic peptide
  Seed: YISMSVWTS (PRAME_HUMAN)
YASMSVWTV

SEQ ID NO: 154968 - protein, 8 aa, Artificial Sequence
  Description of Artificial Sequence: Synthetic peptide
  Seed: YEDIHGTL (PRAME_HUMAN)
YVDIHGTV

SEQ ID NO: 154969 - protein, 11 aa, Artificial Sequence
  Description of Artificial Sequence: Synthetic peptide
  Seed: MKGQHLHLETF (PRAME_HUMAN)
MRGQHLHLETF

SEQ ID NO: 154970 - protein, 9 aa, Artificial Sequence
  Description of Artificial Sequence: Synthetic peptide
  Seed: RLWGSIQSR (PRAME_HUMAN)
RSWGSIQSK

SEQ ID NO: 154971 - protein, 9 aa, Artificial Sequence
  Description of Artificial Sequence: Synthetic peptide
  Seed: VSQLSVLSL (PRAME_HUMAN)
VMQLSVLSM

SEQ ID NO: 154972 - protein, 9 aa, Artificial Sequence
  Description of Artificial Sequence: Synthetic peptide
  Seed: AVLDGLDVL (PRAME_HUMAN)
AQLDGLDVL

SEQ ID NO: 154973 - protein, 11 aa, Artificial Sequence
  Description of Artificial Sequence: Synthetic peptide
  Seed: SNLTHVLYPVP (PRAME_HUMAN)
SLLTHVLYPVW

SEQ ID NO: 154974 - protein, 9 aa, Artificial Sequence
  Description of Artificial Sequence: Synthetic peptide
  Seed: KVDGLSTEA (PRAME_HUMAN)
KLDGLSTEM

SEQ ID NO: 154975 - protein, 8 aa, Artificial Sequence
  Description of Artificial Sequence: Synthetic peptide
  Seed: YEDIHGTL (PRAME_HUMAN)
YTDIHGTM

SEQ ID NO: 154976 - protein, 10 aa, Artificial Sequence
  Description of Artificial Sequence: Synthetic peptide
  Seed: RASATLQDLV (PRAME_HUMAN)
RMSATLQDLW

SEQ ID NO: 154977 - protein, 10 aa, Artificial Sequence
  Description of Artificial Sequence: Synthetic peptide
  Seed: LSVLSLSGVM (PRAME_HUMAN)
LQVLSLSGVF

SEQ ID NO: 154978 - protein, 9 aa, Artificial Sequence
  Description of Artificial Sequence: Synthetic peptide
  Seed: YIAQFTSQF (PRAME_HUMAN)
YWAQFTSQI

SEQ ID NO: 154979 - protein, 9 aa, Artificial Sequence
  Description of Artificial Sequence: Synthetic peptide
  Seed: CSQLTTLSF (PRAME_HUMAN)
CKQLTTLSL

SEQ ID NO: 154980 - protein, 11 aa, Artificial Sequence
  Description of Artificial Sequence: Synthetic peptide
  Seed: RLSEGDVMHLS (PRAME_HUMAN)
RMSEGDVMHLL

SEQ ID NO: 154981 - protein, 9 aa, Artificial Sequence
  Description of Artificial Sequence: Synthetic peptide
  Seed: QLLALLPSL (PRAME_HUMAN)
QLLALLPSV

SEQ ID NO: 154982 - protein, 9 aa, Artificial Sequence
  Description of Artificial Sequence: Synthetic peptide
  Seed: ALLPSLSHC (PRAME_HUMAN)
AALPSLSHI

SEQ ID NO: 154983 - protein, 10 aa, Artificial Sequence
  Description of Artificial Sequence: Synthetic peptide
  Seed: AEQPFIPVEV (PRAME_HUMAN)
AQQPFIPVEW

SEQ ID NO: 154984 - protein, 11 aa, Artificial Sequence
  Description of Artificial Sequence: Synthetic peptide
  Seed: HVMNPLETLSI (PRAME_HUMAN)
HMMNPLETLSL

SEQ ID NO: 154985 - protein, 9 aa, Artificial Sequence
  Description of Artificial Sequence: Synthetic peptide
  Seed: RLRELLCEL (PRAME_HUMAN)
RKRELLCEY

SEQ ID NO: 154986 - protein, 10 aa, Artificial Sequence
  Description of Artificial Sequence: Synthetic peptide
  Seed: VRPRRWKLQV (PRAME_HUMAN)
VTPRRWKLQL

SEQ ID NO: 154987 - protein, 9 aa, Artificial Sequence
  Description of Artificial Sequence: Synthetic peptide
  Seed: SALQSLLQH (PRAME_HUMAN)
SSLQSLLQF

SEQ ID NO: 154988 - protein, 10 aa, Artificial Sequence
  Description of Artificial Sequence: Synthetic peptide
  Seed: SGNRASLYSF (PRAME_HUMAN)
SQNRASLYSM

SEQ ID NO: 154989 - protein, 10 aa, Artificial Sequence
  Description of Artificial Sequence: Synthetic peptide
  Seed: SQLTTLSFYG (PRAME_HUMAN)
SQLTTLSFYM

SEQ ID NO: 154990 - protein, 9 aa, Artificial Sequence
  Description of Artificial Sequence: Synthetic peptide
  Seed: LGRPSMVWL (PRAME_HUMAN)
LSRPSMVWI

SEQ ID NO: 154991 - protein, 9 aa, Artificial Sequence
  Description of Artificial Sequence: Synthetic peptide
  Seed: SIQSRYISM (PRAME_HUMAN)
SYQSRYISI

SEQ ID NO: 154992 - protein, 11 aa, Artificial Sequence
  Description of Artificial Sequence: Synthetic peptide
  Seed: KAVLDGLDVLL (PRAME_HUMAN)
KQVLDGLDVLM

SEQ ID NO: 154993 - protein, 9 aa, Artificial Sequence
  Description of Artificial Sequence: Synthetic peptide
  Seed: TWKLPTLAK (PRAME_HUMAN)
TQKLPTLAR

SEQ ID NO: 154994 - protein, 9 aa, Artificial Sequence
  Description of Artificial Sequence: Synthetic peptide
  Seed: FYDPEPILC (PRAME_HUMAN)
FSDPEPILY

SEQ ID NO: 154995 - protein, 10 aa, Artificial Sequence
  Description of Artificial Sequence: Synthetic peptide
  Seed: AAFDGRHSQT (PRAME_HUMAN)
ALFDGRHSQL

SEQ ID NO: 154996 - protein, 11 aa, Artificial Sequence
  Description of Artificial Sequence: Synthetic peptide
  Seed: SNLTHVLYPVP (PRAME_HUMAN)
SLLTHVLYPVP

SEQ ID NO: 154997 - protein, 10 aa, Artificial Sequence
  Description of Artificial Sequence: Synthetic peptide
  Seed: ASATLQDLVF (PRAME_HUMAN)
ALATLQDLVY

SEQ ID NO: 154998 - protein, 9 aa, Artificial Sequence
  Description of Artificial Sequence: Synthetic peptide
  Seed: LYVDSLFFL (PRAME_HUMAN)
LLVDSLFFS

SEQ ID NO: 154999 - protein, 9 aa, Artificial Sequence
  Description of Artificial Sequence: Synthetic peptide
  Seed: LSNLTHVLY (PRAME_HUMAN)
LRNLTHVLY

SEQ ID NO: 155000 - protein, 10 aa, Artificial Sequence
  Description of Artificial Sequence: Synthetic peptide
  Seed: CSQLTTLSFY (PRAME_HUMAN)
CYQLTTLSFY

SEQ ID NO: 155001 - protein, 9 aa, Artificial Sequence
  Description of Artificial Sequence: Synthetic peptide
  Seed: SRYISMSVW (PRAME_HUMAN)
SRYISMSVF

SEQ ID NO: 155002 - protein, 10 aa, Artificial Sequence
  Description of Artificial Sequence: Synthetic peptide
  Seed: LSLQCLQALY (PRAME_HUMAN)
LMLQCLQALY

SEQ ID NO: 155003 - protein, 9 aa, Artificial Sequence
  Description of Artificial Sequence: Synthetic peptide
  Seed: EDIHGTLHL (PRAME_HUMAN)
EEIHGTLHM

SEQ ID NO: 155004 - protein, 10 aa, Artificial Sequence
  Description of Artificial Sequence: Synthetic peptide
  Seed: GACDELFSYL (PRAME_HUMAN)
GMCDELFSYF

SEQ ID NO: 155005 - protein, 9 aa, Artificial Sequence
  Description of Artificial Sequence: Synthetic peptide
  Seed: SQFLSLQCL (PRAME_HUMAN)
SHFLSLQCY

SEQ ID NO: 155006 - protein, 9 aa, Artificial Sequence
  Description of Artificial Sequence: Synthetic peptide
  Seed: SYEDIHGTL (PRAME_HUMAN)
SHEDIHGTI

SEQ ID NO: 155007 - protein, 9 aa, Artificial Sequence
  Description of Artificial Sequence: Synthetic peptide
  Seed: LALLPSLSH (PRAME_HUMAN)
LSLLPSLSM

SEQ ID NO: 155008 - protein, 9 aa, Artificial Sequence
  Description of Artificial Sequence: Synthetic peptide
  Seed: CKKLKIFAM (PRAME_HUMAN)
CLKLKIFAV

SEQ ID NO: 155009 - protein, 9 aa, Artificial Sequence
  Description of Artificial Sequence: Synthetic peptide
  Seed: TSPRRLVEL (PRAME_HUMAN)
TMPRRLVEL

SEQ ID NO: 155010 - protein, 9 aa, Artificial Sequence
  Description of Artificial Sequence: Synthetic peptide
  Seed: KAMVQAWPF (PRAME_HUMAN)
KVMVQAWPI

SEQ ID NO: 155011 - protein, 11 aa, Artificial Sequence
  Description of Artificial Sequence: Synthetic peptide
  Seed: RASATLQDLVF (PRAME_HUMAN)
RTSATLQDLVM

SEQ ID NO: 155012 - protein, 10 aa, Artificial Sequence
  Description of Artificial Sequence: Synthetic peptide
  Seed: SLLKDEALAI (PRAME_HUMAN)
SDLKDEALAV

SEQ ID NO: 155013 - protein, 9 aa, Artificial Sequence
  Description of Artificial Sequence: Synthetic peptide
  Seed: QPFIPVEVL (PRAME_HUMAN)
QVFIPVEVY

SEQ ID NO: 155014 - protein, 9 aa, Artificial Sequence
  Description of Artificial Sequence: Synthetic peptide
  Seed: SMVWLSANP (PRAME_HUMAN)
SMVWLSANI

SEQ ID NO: 155015 - protein, 10 aa, Artificial Sequence
  Description of Artificial Sequence: Synthetic peptide
  Seed: VELAGQSLLK (PRAME_HUMAN)
VNLAGQSLLK

SEQ ID NO: 155016 - protein, 9 aa, Artificial Sequence
  Description of Artificial Sequence: Synthetic peptide
  Seed: LKMVQLDSI (PRAME_HUMAN)
LQMVQLDSF

SEQ ID NO: 155017 - protein, 10 aa, Artificial Sequence
  Description of Artificial Sequence: Synthetic peptide
  Seed: YVDSLFFLRG (PRAME_HUMAN)
YLDSLFFLRR

SEQ ID NO: 155018 - protein, 9 aa, Artificial Sequence
  Description of Artificial Sequence: Synthetic peptide
  Seed: SQLTTLSFY (PRAME_HUMAN)
SALTTLSFR

SEQ ID NO: 155019 - protein, 9 aa, Artificial Sequence
  Description of Artificial Sequence: Synthetic peptide
  Seed: VSQLSVLSL (PRAME_HUMAN)
VKQLSVLSF

SEQ ID NO: 155020 - protein, 9 aa, Artificial Sequence
  Description of Artificial Sequence: Synthetic peptide
  Seed: LMKGQHLHL (PRAME_HUMAN)
LQKGQHLHL

SEQ ID NO: 155021 - protein, 10 aa, Artificial Sequence
  Description of Artificial Sequence: Synthetic peptide
  Seed: VLYPVPLESY (PRAME_HUMAN)
VTYPVPLESI

SEQ ID NO: 155022 - protein, 10 aa, Artificial Sequence
  Description of Artificial Sequence: Synthetic peptide
  Seed: SLLKDEALAI (PRAME_HUMAN)
SQLKDEALAW

SEQ ID NO: 155023 - protein, 9 aa, Artificial Sequence
  Description of Artificial Sequence: Synthetic peptide
  Seed: LLKDEALAI (PRAME_HUMAN)
LIKDEALAV

SEQ ID NO: 155024 - protein, 9 aa, Artificial Sequence
  Description of Artificial Sequence: Synthetic peptide
  Seed: YLGQMINLR (PRAME_HUMAN)
YVGQMINLR

SEQ ID NO: 155025 - protein, 10 aa, Artificial Sequence
  Description of Artificial Sequence: Synthetic peptide
  Seed: ARLRELLCEL (PRAME_HUMAN)
ASLRELLCEL

SEQ ID NO: 155026 - protein, 9 aa, Artificial Sequence
  Description of Artificial Sequence: Synthetic peptide
  Seed: SIEDLEVTC (PRAME_HUMAN)
SGEDLEVTL

SEQ ID NO: 155027 - protein, 10 aa, Artificial Sequence
  Description of Artificial Sequence: Synthetic peptide
  Seed: FMAAFDGRHS (PRAME_HUMAN)
FLAAFDGRHI

SEQ ID NO: 155028 - protein, 9 aa, Artificial Sequence
  Description of Artificial Sequence: Synthetic peptide
  Seed: RWKLQVLDL (PRAME_HUMAN)
RSKLQVLDA

SEQ ID NO: 155029 - protein, 9 aa, Artificial Sequence
  Description of Artificial Sequence: Synthetic peptide
  Seed: VSQLSVLSL (PRAME_HUMAN)
VFQLSVLSY

SEQ ID NO: 155030 - protein, 9 aa, Artificial Sequence
  Description of Artificial Sequence: Synthetic peptide
  Seed: LLRHVMNPL (PRAME_HUMAN)
LPRHVMNPM

SEQ ID NO: 155031 - protein, 9 aa, Artificial Sequence
  Description of Artificial Sequence: Synthetic peptide
  Seed: SALQSLLQH (PRAME_HUMAN)
SLLQSLLQK

SEQ ID NO: 155032 - protein, 9 aa, Artificial Sequence
  Description of Artificial Sequence: Synthetic peptide
  Seed: AWPFTCLPL (PRAME_HUMAN)
AYPFTCLPL

SEQ ID NO: 155033 - protein, 9 aa, Artificial Sequence
  Description of Artificial Sequence: Synthetic peptide
  Seed: SQSPSVSQL (PRAME_HUMAN)
SPSPSVSQY

SEQ ID NO: 155034 - protein, 10 aa, Artificial Sequence
  Description of Artificial Sequence: Synthetic peptide
  Seed: VELAGQSLLK (PRAME_HUMAN)
VGLAGQSLLK

SEQ ID NO: 155035 - protein, 10 aa, Artificial Sequence
  Description of Artificial Sequence: Synthetic peptide
  Seed: YLHARLRELL (PRAME_HUMAN)
YMHARLRELA

SEQ ID NO: 155036 - protein, 9 aa, Artificial Sequence
  Description of Artificial Sequence: Synthetic peptide
  Seed: LVELAGQSL (PRAME_HUMAN)
LYELAGQSI

SEQ ID NO: 155037 - protein, 9 aa, Artificial Sequence
  Description of Artificial Sequence: Synthetic peptide
  Seed: QALYVDSLF (PRAME_HUMAN)
QLLYVDSLF

SEQ ID NO: 155038 - protein, 11 aa, Artificial Sequence
  Description of Artificial Sequence: Synthetic peptide
  Seed: RELFPPLFMAA (PRAME_HUMAN)
RHLFPPLFMAV

SEQ ID NO: 155039 - protein, 9 aa, Artificial Sequence
  Description of Artificial Sequence: Synthetic peptide
  Seed: FLRGRLDQL (PRAME_HUMAN)
FQRGRLDQF

SEQ ID NO: 155040 - protein, 9 aa, Artificial Sequence
  Description of Artificial Sequence: Synthetic peptide
  Seed: LSLQCLQAL (PRAME_HUMAN)
LALQCLQAM

SEQ ID NO: 155041 - protein, 10 aa, Artificial Sequence
  Description of Artificial Sequence: Synthetic peptide
  Seed: VRPRRWKLQV (PRAME_HUMAN)
VNPRRWKLQL

SEQ ID NO: 155042 - protein, 10 aa, Artificial Sequence
  Description of Artificial Sequence: Synthetic peptide
  Seed: LSFYGNSISI (PRAME_HUMAN)
LMFYGNSISV

SEQ ID NO: 155043 - protein, 10 aa, Artificial Sequence
  Description of Artificial Sequence: Synthetic peptide
  Seed: ESYEDIHGTL (PRAME_HUMAN)
EIYEDIHGTW

SEQ ID NO: 155044 - protein, 9 aa, Artificial Sequence
  Description of Artificial Sequence: Synthetic peptide
  Seed: KDEALAIAA (PRAME_HUMAN)
KEEALAIAV

SEQ ID NO: 155045 - protein, 10 aa, Artificial Sequence
  Description of Artificial Sequence: Synthetic peptide
  Seed: ITDDQLLALL (PRAME_HUMAN)
IFDDQLLALY

SEQ ID NO: 155046 - protein, 10 aa, Artificial Sequence
  Description of Artificial Sequence: Synthetic peptide
  Seed: FAMPMQDIKM (PRAME_HUMAN)
FAMPMQDIKY

SEQ ID NO: 155047 - protein, 10 aa, Artificial Sequence
  Description of Artificial Sequence: Synthetic peptide
  Seed: RLWGSIQSRY (PRAME_HUMAN)
RLWGSIQSRR

SEQ ID NO: 155048 - protein, 9 aa, Artificial Sequence
  Description of Artificial Sequence: Synthetic peptide
  Seed: LSHIHASSY (PRAME_HUMAN)
LMHIHASSM

SEQ ID NO: 155049 - protein, 9 aa, Artificial Sequence
  Description of Artificial Sequence: Synthetic peptide
  Seed: ALYVDSLFF (PRAME_HUMAN)
AHYVDSLFM

SEQ ID NO: 155050 - protein, 8 aa, Artificial Sequence
  Description of Artificial Sequence: Synthetic peptide
  Seed: DELFSYLI (PRAME_HUMAN)
DELFSYLF

SEQ ID NO: 155051 - protein, 10 aa, Artificial Sequence
  Description of Artificial Sequence: Synthetic peptide
  Seed: RRLWGSIQSR (PRAME_HUMAN)
RVLWGSIQSK

SEQ ID NO: 155052 - protein, 9 aa, Artificial Sequence
  Description of Artificial Sequence: Synthetic peptide
  Seed: RHSQTLKAM (PRAME_HUMAN)
RASQTLKAY

SEQ ID NO: 155053 - protein, 11 aa, Artificial Sequence
  Description of Artificial Sequence: Synthetic peptide
  Seed: EALAIAALELL (PRAME_HUMAN)
EYLAIAALELV

SEQ ID NO: 155054 - protein, 11 aa, Artificial Sequence
  Description of Artificial Sequence: Synthetic peptide
  Seed: TVWSGNRASLY (PRAME_HUMAN)
TMWSGNRASLF

SEQ ID NO: 155055 - protein, 10 aa, Artificial Sequence
  Description of Artificial Sequence: Synthetic peptide
  Seed: ALYVDSLFFL (PRAME_HUMAN)
ANYVDSLFFI

SEQ ID NO: 155056 - protein, 9 aa, Artificial Sequence
  Description of Artificial Sequence: Synthetic peptide
  Seed: RLCCKKLKI (PRAME_HUMAN)
RACCKKLKY

SEQ ID NO: 155057 - protein, 9 aa, Artificial Sequence
  Description of Artificial Sequence: Synthetic peptide
  Seed: YIAQFTSQF (PRAME_HUMAN)
YQAQFTSQW

SEQ ID NO: 155058 - protein, 8 aa, Artificial Sequence
  Description of Artificial Sequence: Synthetic peptide
  Seed: DVLLAQEV (PRAME_HUMAN)
DALLAQEI

SEQ ID NO: 155059 - protein, 9 aa, Artificial Sequence
  Description of Artificial Sequence: Synthetic peptide
  Seed: VSPEPLQAL (PRAME_HUMAN)
VNPEPLQAI

SEQ ID NO: 155060 - protein, 10 aa, Artificial Sequence
  Description of Artificial Sequence: Synthetic peptide
  Seed: LSQSPSVSQL (PRAME_HUMAN)
LRQSPSVSQY

SEQ ID NO: 155061 - protein, 10 aa, Artificial Sequence
  Description of Artificial Sequence: Synthetic peptide
  Seed: TTLSFYGNSI (PRAME_HUMAN)
TDLSFYGNSV

SEQ ID NO: 155062 - protein, 9 aa, Artificial Sequence
  Description of Artificial Sequence: Synthetic peptide
  Seed: SVLSLSGVM (PRAME_HUMAN)
SSLSLSGVY

SEQ ID NO: 155063 - protein, 9 aa, Artificial Sequence
  Description of Artificial Sequence: Synthetic peptide
  Seed: VSQLSVLSL (PRAME_HUMAN)
VAQLSVLSI

SEQ ID NO: 155064 - protein, 9 aa, Artificial Sequence
  Description of Artificial Sequence: Synthetic peptide
  Seed: ACDELFSYL (PRAME_HUMAN)
ACDELFSYV

SEQ ID NO: 155065 - protein, 10 aa, Artificial Sequence
  Description of Artificial Sequence: Synthetic peptide
  Seed: ESYEDIHGTL (PRAME_HUMAN)
ESYEDIHGTY

SEQ ID NO: 155066 - protein, 9 aa, Artificial Sequence
  Description of Artificial Sequence: Synthetic peptide
  Seed: RLDQLLRHV (PRAME_HUMAN)
RRDQLLRHL

SEQ ID NO: 155067 - protein, 9 aa, Artificial Sequence
  Description of Artificial Sequence: Synthetic peptide
  Seed: YIAQFTSQF (PRAME_HUMAN)
YMAQFTSQH

SEQ ID NO: 155068 - protein, 10 aa, Artificial Sequence
  Description of Artificial Sequence: Synthetic peptide
  Seed: LLLSHIHASS (PRAME_HUMAN)
LNLSHIHASL

SEQ ID NO: 155069 - protein, 10 aa, Artificial Sequence
  Description of Artificial Sequence: Synthetic peptide
  Seed: LSQSPSVSQL (PRAME_HUMAN)
LAQSPSVSQW

SEQ ID NO: 155070 - protein, 9 aa, Artificial Sequence
  Description of Artificial Sequence: Synthetic peptide
  Seed: ISISALQSL (PRAME_HUMAN)
ILISALQSW

SEQ ID NO: 155071 - protein, 8 aa, Artificial Sequence
  Description of Artificial Sequence: Synthetic peptide
  Seed: YLGQMINL (PRAME_HUMAN)
YLGQMINV

SEQ ID NO: 155072 - protein, 9 aa, Artificial Sequence
  Description of Artificial Sequence: Synthetic peptide
  Seed: SFYGNSISI (PRAME_HUMAN)
SYYGNSISH

SEQ ID NO: 155073 - protein, 11 aa, Artificial Sequence
  Description of Artificial Sequence: Synthetic peptide
  Seed: LPTLAKFSPYL (PRAME_HUMAN)
LSTLAKFSPYL

SEQ ID NO: 155074 - protein, 9 aa, Artificial Sequence
  Description of Artificial Sequence: Synthetic peptide
  Seed: LYVDSLFFL (PRAME_HUMAN)
LAVDSLFFA

SEQ ID NO: 155075 - protein, 10 aa, Artificial Sequence
  Description of Artificial Sequence: Synthetic peptide
  Seed: ERLAYLHARL (PRAME_HUMAN)
ESLAYLHARV

SEQ ID NO: 155076 - protein, 9 aa, Artificial Sequence
  Description of Artificial Sequence: Synthetic peptide
  Seed: LQALYVDSL (PRAME_HUMAN)
LIALYVDSL

SEQ ID NO: 155077 - protein, 11 aa, Artificial Sequence
  Description of Artificial Sequence: Synthetic peptide
  Seed: FSPYLGQMINL (PRAME_HUMAN)
FHPYLGQMINF

SEQ ID NO: 155078 - protein, 10 aa, Artificial Sequence
  Description of Artificial Sequence: Synthetic peptide
  Seed: FTCLPLGVLM (PRAME_HUMAN)
FQCLPLGVLI

SEQ ID NO: 155079 - protein, 9 aa, Artificial Sequence
  Description of Artificial Sequence: Synthetic peptide
  Seed: YISMSVWTS (PRAME_HUMAN)
YQSMSVWTT

SEQ ID NO: 155080 - protein, 9 aa, Artificial Sequence
  Description of Artificial Sequence: Synthetic peptide
  Seed: QALYVDSLF (PRAME_HUMAN)
QKLYVDSLF

SEQ ID NO: 155081 - protein, 9 aa, Artificial Sequence
  Description of Artificial Sequence: Synthetic peptide
  Seed: HVMNPLETL (PRAME_HUMAN)
HDMNPLETL

SEQ ID NO: 155082 - protein, 11 aa, Artificial Sequence
  Description of Artificial Sequence: Synthetic peptide
  Seed: RLWGSIQSRYI (PRAME_HUMAN)
RVWGSIQSRYW

SEQ ID NO: 155083 - protein, 9 aa, Artificial Sequence
  Description of Artificial Sequence: Synthetic peptide
  Seed: SYEDIHGTL (PRAME_HUMAN)
SLEDIHGTM

SEQ ID NO: 155084 - protein, 11 aa, Artificial Sequence
  Description of Artificial Sequence: Synthetic peptide
  Seed: FKAVLDGLDVL (PRAME_HUMAN)
FLAVLDGLDVV

SEQ ID NO: 155085 - protein, 9 aa, Artificial Sequence
  Description of Artificial Sequence: Synthetic peptide
  Seed: TLHLERLAY (PRAME_HUMAN)
TPHLERLAF

SEQ ID NO: 155086 - protein, 9 aa, Artificial Sequence
  Description of Artificial Sequence: Synthetic peptide
  Seed: SPSVSQLSV (PRAME_HUMAN)
SASVSQLSM

SEQ ID NO: 155087 - protein, 9 aa, Artificial Sequence
  Description of Artificial Sequence: Synthetic peptide
  Seed: NLTHVLYPV (PRAME_HUMAN)
NLTHVLYPL

SEQ ID NO: 155088 - protein, 10 aa, Artificial Sequence
  Description of Artificial Sequence: Synthetic peptide
  Seed: LQHLIGLSNL (PRAME_HUMAN)
LMHLIGLSNF

SEQ ID NO: 155089 - protein, 9 aa, Artificial Sequence
  Description of Artificial Sequence: Synthetic peptide
  Seed: RLRELLCEL (PRAME_HUMAN)
RLRELLCEK

SEQ ID NO: 155090 - protein, 9 aa, Artificial Sequence
  Description of Artificial Sequence: Synthetic peptide
  Seed: SEGDVMHLS (PRAME_HUMAN)
SEGDVMHLA

SEQ ID NO: 155091 - protein, 9 aa, Artificial Sequence
  Description of Artificial Sequence: Synthetic peptide
  Seed: HVMNPLETL (PRAME_HUMAN)
HSMNPLETK

SEQ ID NO: 155092 - protein, 9 aa, Artificial Sequence
  Description of Artificial Sequence: Synthetic peptide
  Seed: LQHLIGLSN (PRAME_HUMAN)
LQHLIGLSL

SEQ ID NO: 155093 - protein, 9 aa, Artificial Sequence
  Description of Artificial Sequence: Synthetic peptide
  Seed: SIEDLEVTC (PRAME_HUMAN)
SVEDLEVTV

SEQ ID NO: 155094 - protein, 9 aa, Artificial Sequence
  Description of Artificial Sequence: Synthetic peptide
  Seed: ISISALQSL (PRAME_HUMAN)
IQISALQSL

SEQ ID NO: 155095 - protein, 9 aa, Artificial Sequence
  Description of Artificial Sequence: Synthetic peptide
  Seed: HVMNPLETL (PRAME_HUMAN)
HHMNPLETV

SEQ ID NO: 155096 - protein, 9 aa, Artificial Sequence
  Description of Artificial Sequence: Synthetic peptide
  Seed: LAIAALELL (PRAME_HUMAN)
LTIAALELM

SEQ ID NO: 155097 - protein, 10 aa, Artificial Sequence
  Description of Artificial Sequence: Synthetic peptide
  Seed: RRWKLQVLDL (PRAME_HUMAN)
RRWKLQVLDY

SEQ ID NO: 155098 - protein, 10 aa, Artificial Sequence
  Description of Artificial Sequence: Synthetic peptide
  Seed: RLVELAGQSL (PRAME_HUMAN)
RAVELAGQSF

SEQ ID NO: 155099 - protein, 9 aa, Artificial Sequence
  Description of Artificial Sequence: Synthetic peptide
  Seed: SQLTTLSFY (PRAME_HUMAN)
SRLTTLSFM

SEQ ID NO: 155100 - protein, 9 aa, Artificial Sequence
  Description of Artificial Sequence: Synthetic peptide
  Seed: YLHARLREL (PRAME_HUMAN)
YIHARLREM

SEQ ID NO: 155101 - protein, 9 aa, Artificial Sequence
  Description of Artificial Sequence: Synthetic peptide
  Seed: YGNSISISA (PRAME_HUMAN)
YPNSISISS

SEQ ID NO: 155102 - protein, 9 aa, Artificial Sequence
  Description of Artificial Sequence: Synthetic peptide
  Seed: KFSPYLGQM (PRAME_HUMAN)
KVSPYLGQF

SEQ ID NO: 155103 - protein, 9 aa, Artificial Sequence
  Description of Artificial Sequence: Synthetic peptide
  Seed: LTDVSPEPL (PRAME_HUMAN)
LLDVSPEPV

SEQ ID NO: 155104 - protein, 10 aa, Artificial Sequence
  Description of Artificial Sequence: Synthetic peptide
  Seed: FIPVEVLVDL (PRAME_HUMAN)
FTPVEVLVDW

SEQ ID NO: 155105 - protein, 10 aa, Artificial Sequence
  Description of Artificial Sequence: Synthetic peptide
  Seed: VLSLSGVMLT (PRAME_HUMAN)
VMSLSGVMLL

SEQ ID NO: 155106 - protein, 8 aa, Artificial Sequence
  Description of Artificial Sequence: Synthetic peptide
  Seed: FYDPEPIL (PRAME_HUMAN)
FIDPEPIM

SEQ ID NO: 155107 - protein, 9 aa, Artificial Sequence
  Description of Artificial Sequence: Synthetic peptide
  Seed: LLRHVMNPL (PRAME_HUMAN)
LMRHVMNPR

SEQ ID NO: 155108 - protein, 9 aa, Artificial Sequence
  Description of Artificial Sequence: Synthetic peptide
  Seed: SHIHASSYI (PRAME_HUMAN)
SHIHASSYY

SEQ ID NO: 155109 - protein, 9 aa, Artificial Sequence
  Description of Artificial Sequence: Synthetic peptide
  Seed: YIAQFTSQF (PRAME_HUMAN)
YLAQFTSQA

SEQ ID NO: 155110 - protein, 9 aa, Artificial Sequence
  Description of Artificial Sequence: Synthetic peptide
  Seed: YISMSVWTS (PRAME_HUMAN)
YVSMSVWTA

SEQ ID NO: 155111 - protein, 9 aa, Artificial Sequence
  Description of Artificial Sequence: Synthetic peptide
  Seed: KMILKMVQL (PRAME_HUMAN)
KLILKMVQF

SEQ ID NO: 155112 - protein, 10 aa, Artificial Sequence
  Description of Artificial Sequence: Synthetic peptide
  Seed: IGLSNLTHVL (PRAME_HUMAN)
IMLSNLTHVA

SEQ ID NO: 155113 - protein, 10 aa, Artificial Sequence
  Description of Artificial Sequence: Synthetic peptide
  Seed: LSFYGNSISI (PRAME_HUMAN)
LTFYGNSISV

SEQ ID NO: 155114 - protein, 9 aa, Artificial Sequence
  Description of Artificial Sequence: Synthetic peptide
  Seed: QSRYISMSV (PRAME_HUMAN)
QTRYISMSI

SEQ ID NO: 155115 - protein, 10 aa, Artificial Sequence
  Description of Artificial Sequence: Synthetic peptide
  Seed: ETLSITNCRL (PRAME_HUMAN)
ELLSITNCRR

SEQ ID NO: 155116 - protein, 11 aa, Artificial Sequence
  Description of Artificial Sequence: Synthetic peptide
  Seed: QDFWTVWSGNR (PRAME_HUMAN)
QFFWTVWSGNR

SEQ ID NO: 155117 - protein, 10 aa, Artificial Sequence
  Description of Artificial Sequence: Synthetic peptide
  Seed: QAWPFTCLPL (PRAME_HUMAN)
QFWPFTCLPF

SEQ ID NO: 155118 - protein, 10 aa, Artificial Sequence
  Description of Artificial Sequence: Synthetic peptide
  Seed: SNLTHVLYPV (PRAME_HUMAN)
SSLTHVLYPI

SEQ ID NO: 155119 - protein, 9 aa, Artificial Sequence
  Description of Artificial Sequence: Synthetic peptide
  Seed: YIAQFTSQF (PRAME_HUMAN)
YPAQFTSQV

SEQ ID NO: 155120 - protein, 9 aa, Artificial Sequence
  Description of Artificial Sequence: Synthetic peptide
  Seed: QSRYISMSV (PRAME_HUMAN)
QARYISMSY

SEQ ID NO: 155121 - protein, 8 aa, Artificial Sequence
  Description of Artificial Sequence: Synthetic peptide
  Seed: ITDDQLLA (PRAME_HUMAN)
ILDDQLLL

SEQ ID NO: 155122 - protein, 10 aa, Artificial Sequence
  Description of Artificial Sequence: Synthetic peptide
  Seed: QLLALLPSLS (PRAME_HUMAN)
QLLALLPSLL

SEQ ID NO: 155123 - protein, 9 aa, Artificial Sequence
  Description of Artificial Sequence: Synthetic peptide
  Seed: IGLSNLTHV (PRAME_HUMAN)
ISLSNLTHY

SEQ ID NO: 155124 - protein, 9 aa, Artificial Sequence
  Description of Artificial Sequence: Synthetic peptide
  Seed: QSRYISMSV (PRAME_HUMAN)
QVRYISMSM

SEQ ID NO: 155125 - protein, 9 aa, Artificial Sequence
  Description of Artificial Sequence: Synthetic peptide
  Seed: KLKIFAMPM (PRAME_HUMAN)
KYKIFAMPY

SEQ ID NO: 155126 - protein, 9 aa, Artificial Sequence
  Description of Artificial Sequence: Synthetic peptide
  Seed: MINLRRLLL (PRAME_HUMAN)
MTNLRRLLW

SEQ ID NO: 155127 - protein, 9 aa, Artificial Sequence
  Description of Artificial Sequence: Synthetic peptide
  Seed: SFPEPEAAQ (PRAME_HUMAN)
SFPEPEAAL

SEQ ID NO: 155128 - protein, 10 aa, Artificial Sequence
  Description of Artificial Sequence: Synthetic peptide
  Seed: YEDIHGTLHL (PRAME_HUMAN)
YLDIHGTLHM

SEQ ID NO: 155129 - protein, 11 aa, Artificial Sequence
  Description of Artificial Sequence: Synthetic peptide
  Seed: SLLKDEALAIA (PRAME_HUMAN)
SMLKDEALAIL

SEQ ID NO: 155130 - protein, 10 aa, Artificial Sequence
  Description of Artificial Sequence: Synthetic peptide
  Seed: RLWGSIQSRY (PRAME_HUMAN)
RAWGSIQSRM

SEQ ID NO: 155131 - protein, 9 aa, Artificial Sequence
  Description of Artificial Sequence: Synthetic peptide
  Seed: QFTSQFLSL (PRAME_HUMAN)
QYTSQFLSY

SEQ ID NO: 155132 - protein, 9 aa, Artificial Sequence
  Description of Artificial Sequence: Synthetic peptide
  Seed: VSPEPLQAL (PRAME_HUMAN)
VEPEPLQAL

SEQ ID NO: 155133 - protein, 9 aa, Artificial Sequence
  Description of Artificial Sequence: Synthetic peptide
  Seed: FLRGRLDQL (PRAME_HUMAN)
FMRGRLDQT

SEQ ID NO: 155134 - protein, 9 aa, Artificial Sequence
  Description of Artificial Sequence: Synthetic peptide
  Seed: NSHQDFWTV (PRAME_HUMAN)
NQHQDFWTV

SEQ ID NO: 155135 - protein, 10 aa, Artificial Sequence
  Description of Artificial Sequence: Synthetic peptide
  Seed: AVLDGLDVLL (PRAME_HUMAN)
AYLDGLDVLL

SEQ ID NO: 155136 - protein, 9 aa, Artificial Sequence
  Description of Artificial Sequence: Synthetic peptide
  Seed: RLRELLCEL (PRAME_HUMAN)
RARELLCEI

SEQ ID NO: 155137 - protein, 10 aa, Artificial Sequence
  Description of Artificial Sequence: Synthetic peptide
  Seed: RRLWGSIQSR (PRAME_HUMAN)
RYLWGSIQSR

SEQ ID NO: 155138 - protein, 9 aa, Artificial Sequence
  Description of Artificial Sequence: Synthetic peptide
  Seed: DEALAIAAL (PRAME_HUMAN)
DRALAIAAV

SEQ ID NO: 155139 - protein, 10 aa, Artificial Sequence
  Description of Artificial Sequence: Synthetic peptide
  Seed: ISISALQSLL (PRAME_HUMAN)
ISISALQSLW

SEQ ID NO: 155140 - protein, 9 aa, Artificial Sequence
  Description of Artificial Sequence: Synthetic peptide
  Seed: SPEPLQALL (PRAME_HUMAN)
SLEPLQALL

SEQ ID NO: 155141 - protein, 9 aa, Artificial Sequence
  Description of Artificial Sequence: Synthetic peptide
  Seed: SVLSLSGVM (PRAME_HUMAN)
SELSLSGVM

SEQ ID NO: 155142 - protein, 8 aa, Artificial Sequence
  Description of Artificial Sequence: Synthetic peptide
  Seed: LTHVLYPV (PRAME_HUMAN)
LYHVLYPV

SEQ ID NO: 155143 - protein, 9 aa, Artificial Sequence
  Description of Artificial Sequence: Synthetic peptide
  Seed: KMILKMVQL (PRAME_HUMAN)
KLILKMVQM

SEQ ID NO: 155144 - protein, 10 aa, Artificial Sequence
  Description of Artificial Sequence: Synthetic peptide
  Seed: ELFSYLIEKV (PRAME_HUMAN)
EVFSYLIEKI

SEQ ID NO: 155145 - protein, 9 aa, Artificial Sequence
  Description of Artificial Sequence: Synthetic peptide
  Seed: SATLQDLVF (PRAME_HUMAN)
SPTLQDLVM

SEQ ID NO: 155146 - protein, 9 aa, Artificial Sequence
  Description of Artificial Sequence: Synthetic peptide
  Seed: RLRELLCEL (PRAME_HUMAN)
RLRELLCEW

SEQ ID NO: 155147 - protein, 9 aa, Artificial Sequence
  Description of Artificial Sequence: Synthetic peptide
  Seed: LMKGQHLHL (PRAME_HUMAN)
LMKGQHLHM

SEQ ID NO: 155148 - protein, 9 aa, Artificial Sequence
  Description of Artificial Sequence: Synthetic peptide
  Seed: ALQSLLQHL (PRAME_HUMAN)
ASQSLLQHY

SEQ ID NO: 155149 - protein, 10 aa, Artificial Sequence
  Description of Artificial Sequence: Synthetic peptide
  Seed: ETFKAVLDGL (PRAME_HUMAN)
ETFKAVLDGR

SEQ ID NO: 155150 - protein, 9 aa, Artificial Sequence
  Description of Artificial Sequence: Synthetic peptide
  Seed: YIAQFTSQF (PRAME_HUMAN)
YSAQFTSQR

SEQ ID NO: 155151 - protein, 10 aa, Artificial Sequence
  Description of Artificial Sequence: Synthetic peptide
  Seed: DFWTVWSGNR (PRAME_HUMAN)
DLWTVWSGNR

SEQ ID NO: 155152 - protein, 9 aa, Artificial Sequence
  Description of Artificial Sequence: Synthetic peptide
  Seed: NSHQDFWTV (PRAME_HUMAN)
NMHQDFWTL

SEQ ID NO: 155153 - protein, 9 aa, Artificial Sequence
  Description of Artificial Sequence: Synthetic peptide
  Seed: LQDLVFDEC (PRAME_HUMAN)
LADLVFDEV

SEQ ID NO: 155154 - protein, 9 aa, Artificial Sequence
  Description of Artificial Sequence: Synthetic peptide
  Seed: CPHCGDRTF (PRAME_HUMAN)
CLHCGDRTY

SEQ ID NO: 155155 - protein, 8 aa, Artificial Sequence
  Description of Artificial Sequence: Synthetic peptide
  Seed: AQFTSQFL (PRAME_HUMAN)
AMFTSQFY

SEQ ID NO: 155156 - protein, 11 aa, Artificial Sequence
  Description of Artificial Sequence: Synthetic peptide
  Seed: SQSPSVSQLSV (PRAME_HUMAN)
SQSPSVSQLSW

SEQ ID NO: 155157 - protein, 10 aa, Artificial Sequence
  Description of Artificial Sequence: Synthetic peptide
  Seed: LPTLAKFSPY (PRAME_HUMAN)
LWTLAKFSPW

SEQ ID NO: 155158 - protein, 10 aa, Artificial Sequence
  Description of Artificial Sequence: Synthetic peptide
  Seed: AAFDGRHSQT (PRAME_HUMAN)
ATFDGRHSQL

SEQ ID NO: 155159 - protein, 11 aa, Artificial Sequence
  Description of Artificial Sequence: Synthetic peptide
  Seed: LSNLTHVLYPV (PRAME_HUMAN)
LENLTHVLYPV

SEQ ID NO: 155160 - protein, 9 aa, Artificial Sequence
  Description of Artificial Sequence: Synthetic peptide
  Seed: LHLETFKAV (PRAME_HUMAN)
LQLETFKAV

SEQ ID NO: 155161 - protein, 9 aa, Artificial Sequence
  Description of Artificial Sequence: Synthetic peptide
  Seed: GQHLHLETF (PRAME_HUMAN)
GGHLHLETY

SEQ ID NO: 155162 - protein, 10 aa, Artificial Sequence
  Description of Artificial Sequence: Synthetic peptide
  Seed: SNLTHVLYPV (PRAME_HUMAN)
SCLTHVLYPL

SEQ ID NO: 155163 - protein, 9 aa, Artificial Sequence
  Description of Artificial Sequence: Synthetic peptide
  Seed: QLLALLPSL (PRAME_HUMAN)
QLLALLPSA

SEQ ID NO: 155164 - protein, 10 aa, Artificial Sequence
  Description of Artificial Sequence: Synthetic peptide
  Seed: RLAYLHARLR (PRAME_HUMAN)
RMAYLHARLK

SEQ ID NO: 155165 - protein, 9 aa, Artificial Sequence
  Description of Artificial Sequence: Synthetic peptide
  Seed: SFYGNSISI (PRAME_HUMAN)
SIYGNSISY

SEQ ID NO: 155166 - protein, 9 aa, Artificial Sequence
  Description of Artificial Sequence: Synthetic peptide
  Seed: LQALYVDSL (PRAME_HUMAN)
LTALYVDSV

SEQ ID NO: 155167 - protein, 9 aa, Artificial Sequence
  Description of Artificial Sequence: Synthetic peptide
  Seed: THVLYPVPL (PRAME_HUMAN)
THVLYPVPF

SEQ ID NO: 155168 - protein, 10 aa, Artificial Sequence
  Description of Artificial Sequence: Synthetic peptide
  Seed: AIAALELLPR (PRAME_HUMAN)
ASAALELLPK

SEQ ID NO: 155169 - protein, 9 aa, Artificial Sequence
  Description of Artificial Sequence: Synthetic peptide
  Seed: FPPLFMAAF (PRAME_HUMAN)
FSPLFMAAM

SEQ ID NO: 155170 - protein, 9 aa, Artificial Sequence
  Description of Artificial Sequence: Synthetic peptide
  Seed: SQSPSVSQL (PRAME_HUMAN)
SGSPSVSQF

SEQ ID NO: 155171 - protein, 10 aa, Artificial Sequence
  Description of Artificial Sequence: Synthetic peptide
  Seed: ARLRELLCEL (PRAME_HUMAN)
AELRELLCEL

SEQ ID NO: 155172 - protein, 9 aa, Artificial Sequence
  Description of Artificial Sequence: Synthetic peptide
  Seed: YGNSISISA (PRAME_HUMAN)
YPNSISISV

SEQ ID NO: 155173 - protein, 10 aa, Artificial Sequence
  Description of Artificial Sequence: Synthetic peptide
  Seed: RGRLDQLLRH (PRAME_HUMAN)
RIRLDQLLRM

SEQ ID NO: 155174 - protein, 10 aa, Artificial Sequence
  Description of Artificial Sequence: Synthetic peptide
  Seed: KGQHLHLETF (PRAME_HUMAN)
KRQHLHLETF

SEQ ID NO: 155175 - protein, 9 aa, Artificial Sequence
  Description of Artificial Sequence: Synthetic peptide
  Seed: CSQLTTLSF (PRAME_HUMAN)
CLQLTTLSF

SEQ ID NO: 155176 - protein, 10 aa, Artificial Sequence
  Description of Artificial Sequence: Synthetic peptide
  Seed: RLAYLHARLR (PRAME_HUMAN)
RKAYLHARLR

SEQ ID NO: 155177 - protein, 10 aa, Artificial Sequence
  Description of Artificial Sequence: Synthetic peptide
  Seed: MVQAWPFTCL (PRAME_HUMAN)
MMQAWPFTCY

SEQ ID NO: 155178 - protein, 10 aa, Artificial Sequence
  Description of Artificial Sequence: Synthetic peptide
  Seed: RLVELAGQSL (PRAME_HUMAN)
RVVELAGQSW

SEQ ID NO: 155179 - protein, 9 aa, Artificial Sequence
  Description of Artificial Sequence: Synthetic peptide
  Seed: THVLYPVPL (PRAME_HUMAN)
TQVLYPVPL

SEQ ID NO: 155180 - protein, 9 aa, Artificial Sequence
  Description of Artificial Sequence: Synthetic peptide
  Seed: ISISALQSL (PRAME_HUMAN)
IVISALQSA

SEQ ID NO: 155181 - protein, 9 aa, Artificial Sequence
  Description of Artificial Sequence: Synthetic peptide
  Seed: TDDQLLALL (PRAME_HUMAN)
TCDQLLALL

SEQ ID NO: 155182 - protein, 10 aa, Artificial Sequence
  Description of Artificial Sequence: Synthetic peptide
  Seed: SNLTHVLYPV (PRAME_HUMAN)
SRLTHVLYPV

SEQ ID NO: 155183 - protein, 9 aa, Artificial Sequence
  Description of Artificial Sequence: Synthetic peptide
  Seed: RLRELLCEL (PRAME_HUMAN)
RQRELLCEL

SEQ ID NO: 155184 - protein, 10 aa, Artificial Sequence
  Description of Artificial Sequence: Synthetic peptide
  Seed: ALYVDSLFFL (PRAME_HUMAN)
AMYVDSLFFK

SEQ ID NO: 155185 - protein, 10 aa, Artificial Sequence
  Description of Artificial Sequence: Synthetic peptide
  Seed: AQFTSQFLSL (PRAME_HUMAN)
AVFTSQFLSV

SEQ ID NO: 155186 - protein, 10 aa, Artificial Sequence
  Description of Artificial Sequence: Synthetic peptide
  Seed: LSFYGNSISI (PRAME_HUMAN)
LTFYGNSISY

SEQ ID NO: 155187 - protein, 9 aa, Artificial Sequence
  Description of Artificial Sequence: Synthetic peptide
  Seed: FYDPEPILC (PRAME_HUMAN)
FMDPEPILW

SEQ ID NO: 155188 - protein, 10 aa, Artificial Sequence
  Description of Artificial Sequence: Synthetic peptide
  Seed: RHVMNPLETL (PRAME_HUMAN)
REVMNPLETW

SEQ ID NO: 155189 - protein, 9 aa, Artificial Sequence
  Description of Artificial Sequence: Synthetic peptide
  Seed: WSGNRASLY (PRAME_HUMAN)
WQGNRASLY

SEQ ID NO: 155190 - protein, 9 aa, Artificial Sequence
  Description of Artificial Sequence: Synthetic peptide
  Seed: QLLALLPSL (PRAME_HUMAN)
QVLALLPSR

SEQ ID NO: 155191 - protein, 9 aa, Artificial Sequence
  Description of Artificial Sequence: Synthetic peptide
  Seed: CKKLKIFAM (PRAME_HUMAN)
CTKLKIFAM

SEQ ID NO: 155192 - protein, 9 aa, Artificial Sequence
  Description of Artificial Sequence: Synthetic peptide
  Seed: SQSPSVSQL (PRAME_HUMAN)
SRSPSVSQI

SEQ ID NO: 155193 - protein, 9 aa, Artificial Sequence
  Description of Artificial Sequence: Synthetic peptide
  Seed: LSLQCLQAL (PRAME_HUMAN)
LELQCLQAY

SEQ ID NO: 155194 - protein, 11 aa, Artificial Sequence
  Description of Artificial Sequence: Synthetic peptide
  Seed: RTFYDPEPILC (PRAME_HUMAN)
RTFYDPEPILF

SEQ ID NO: 155195 - protein, 9 aa, Artificial Sequence
  Description of Artificial Sequence: Synthetic peptide
  Seed: ELFSYLIEK (PRAME_HUMAN)
EVFSYLIEH

SEQ ID NO: 155196 - protein, 11 aa, Artificial Sequence
  Description of Artificial Sequence: Synthetic peptide
  Seed: VQAWPFTCLPL (PRAME_HUMAN)
VMAWPFTCLPY

SEQ ID NO: 155197 - protein, 9 aa, Artificial Sequence
  Description of Artificial Sequence: Synthetic peptide
  Seed: LYPVPLESY (PRAME_HUMAN)
LLPVPLESY

SEQ ID NO: 155198 - protein, 9 aa, Artificial Sequence
  Description of Artificial Sequence: Synthetic peptide
  Seed: SVLSLSGVM (PRAME_HUMAN)
SKLSLSGVF

SEQ ID NO: 155199 - protein, 10 aa, Artificial Sequence
  Description of Artificial Sequence: Synthetic peptide
  Seed: RGRLDQLLRH (PRAME_HUMAN)
RQRLDQLLRF

SEQ ID NO: 155200 - protein, 9 aa, Artificial Sequence
  Description of Artificial Sequence: Synthetic peptide
  Seed: LSLQCLQAL (PRAME_HUMAN)
LILQCLQAL

SEQ ID NO: 155201 - protein, 9 aa, Artificial Sequence
  Description of Artificial Sequence: Synthetic peptide
  Seed: SMSVWTSPR (PRAME_HUMAN)
SSSVWTSPK

SEQ ID NO: 155202 - protein, 9 aa, Artificial Sequence
  Description of Artificial Sequence: Synthetic peptide
  Seed: RRWKLQVLD (PRAME_HUMAN)
RKWKLQVLK

SEQ ID NO: 155203 - protein, 10 aa, Artificial Sequence
  Description of Artificial Sequence: Synthetic peptide
  Seed: LSFYGNSISI (PRAME_HUMAN)
LLFYGNSISM

SEQ ID NO: 155204 - protein, 11 aa, Artificial Sequence
  Description of Artificial Sequence: Synthetic peptide
  Seed: ALYVDSLFFLR (PRAME_HUMAN)
AVYVDSLFFLR

SEQ ID NO: 155205 - protein, 9 aa, Artificial Sequence
  Description of Artificial Sequence: Synthetic peptide
  Seed: ISISALQSL (PRAME_HUMAN)
IAISALQSW

SEQ ID NO: 155206 - protein, 9 aa, Artificial Sequence
  Description of Artificial Sequence: Synthetic peptide
  Seed: LDVLLAQEV (PRAME_HUMAN)
LEVLLAQEA

SEQ ID NO: 155207 - protein, 10 aa, Artificial Sequence
  Description of Artificial Sequence: Synthetic peptide
  Seed: LQHLIGLSNL (PRAME_HUMAN)
LKHLIGLSNY

SEQ ID NO: 155208 - protein, 10 aa, Artificial Sequence
  Description of Artificial Sequence: Synthetic peptide
  Seed: ALYVDSLFFL (PRAME_HUMAN)
ASYVDSLFFW

SEQ ID NO: 155209 - protein, 10 aa, Artificial Sequence
  Description of Artificial Sequence: Synthetic peptide
  Seed: LKAMVQAWPF (PRAME_HUMAN)
LDAMVQAWPY

SEQ ID NO: 155210 - protein, 10 aa, Artificial Sequence
  Description of Artificial Sequence: Synthetic peptide
  Seed: MLTDVSPEPL (PRAME_HUMAN)
MMTDVSPEPI

SEQ ID NO: 155211 - protein, 9 aa, Artificial Sequence
  Description of Artificial Sequence: Synthetic peptide
  Seed: MNPLETLSI (PRAME_HUMAN)
MSPLETLSF

SEQ ID NO: 155212 - protein, 9 aa, Artificial Sequence
  Description of Artificial Sequence: Synthetic peptide
  Seed: RRLLLSHIH (PRAME_HUMAN)
RRLLLSHIK

SEQ ID NO: 155213 - protein, 9 aa, Artificial Sequence
  Description of Artificial Sequence: Synthetic peptide
  Seed: RGRLDQLLR (PRAME_HUMAN)
RVRLDQLLY

SEQ ID NO: 155214 - protein, 9 aa, Artificial Sequence
  Description of Artificial Sequence: Synthetic peptide
  Seed: VFDECGITD (PRAME_HUMAN)
VFDECGITW

SEQ ID NO: 155215 - protein, 9 aa, Artificial Sequence
  Description of Artificial Sequence: Synthetic peptide
  Seed: KAMVQAWPF (PRAME_HUMAN)
KLMVQAWPV

SEQ ID NO: 155216 - protein, 9 aa, Artificial Sequence
  Description of Artificial Sequence: Synthetic peptide
  Seed: IAQFTSQFL (PRAME_HUMAN)
ITQFTSQFW

SEQ ID NO: 155217 - protein, 9 aa, Artificial Sequence
  Description of Artificial Sequence: Synthetic peptide
  Seed: VFDECGITD (PRAME_HUMAN)
VVDECGITV

SEQ ID NO: 155218 - protein, 9 aa, Artificial Sequence
  Description of Artificial Sequence: Synthetic peptide
  Seed: SQFLSLQCL (PRAME_HUMAN)
SAFLSLQCL

SEQ ID NO: 155219 - protein, 9 aa, Artificial Sequence
  Description of Artificial Sequence: Synthetic peptide
  Seed: LAIAALELL (PRAME_HUMAN)
LIIAALELL

SEQ ID NO: 155220 - protein, 9 aa, Artificial Sequence
  Description of Artificial Sequence: Synthetic peptide
  Seed: FYDPEPILC (PRAME_HUMAN)
FTDPEPILM

SEQ ID NO: 155221 - protein, 10 aa, Artificial Sequence
  Description of Artificial Sequence: Synthetic peptide
  Seed: LPTLAKFSPY (PRAME_HUMAN)
LNTLAKFSPY

SEQ ID NO: 155222 - protein, 11 aa, Artificial Sequence
  Description of Artificial Sequence: Synthetic peptide
  Seed: RRLWGSIQSRY (PRAME_HUMAN)
RMLWGSIQSRR

SEQ ID NO: 155223 - protein, 9 aa, Artificial Sequence
  Description of Artificial Sequence: Synthetic peptide
  Seed: SYEDIHGTL (PRAME_HUMAN)
SIEDIHGTL

SEQ ID NO: 155224 - protein, 10 aa, Artificial Sequence
  Description of Artificial Sequence: Synthetic peptide
  Seed: QAWPFTCLPL (PRAME_HUMAN)
QRWPFTCLPF

SEQ ID NO: 155225 - protein, 10 aa, Artificial Sequence
  Description of Artificial Sequence: Synthetic peptide
  Seed: RLAYLHARLR (PRAME_HUMAN)
RVAYLHARLR

SEQ ID NO: 155226 - protein, 9 aa, Artificial Sequence
  Description of Artificial Sequence: Synthetic peptide
  Seed: AAFDGRHSQ (PRAME_HUMAN)
ASFDGRHSV

SEQ ID NO: 155227 - protein, 9 aa, Artificial Sequence
  Description of Artificial Sequence: Synthetic peptide
  Seed: SIEDLEVTC (PRAME_HUMAN)
SFEDLEVTM

SEQ ID NO: 155228 - protein, 11 aa, Artificial Sequence
  Description of Artificial Sequence: Synthetic peptide
  Seed: TVWSGNRASLY (PRAME_HUMAN)
TFWSGNRASLY

SEQ ID NO: 155229 - protein, 9 aa, Artificial Sequence
  Description of Artificial Sequence: Synthetic peptide
  Seed: HVMNPLETL (PRAME_HUMAN)
HWMNPLETL

SEQ ID NO: 155230 - protein, 10 aa, Artificial Sequence
  Description of Artificial Sequence: Synthetic peptide
  Seed: DELFSYLIEK (PRAME_HUMAN)
DRLFSYLIER

SEQ ID NO: 155231 - protein, 9 aa, Artificial Sequence
  Description of Artificial Sequence: Synthetic peptide
  Seed: RLLLSHIHA (PRAME_HUMAN)
RMLLSHIHI

SEQ ID NO: 155232 - protein, 9 aa, Artificial Sequence
  Description of Artificial Sequence: Synthetic peptide
  Seed: NLTHVLYPV (PRAME_HUMAN)
NMTHVLYPA

SEQ ID NO: 155233 - protein, 9 aa, Artificial Sequence
  Description of Artificial Sequence: Synthetic peptide
  Seed: KAMVQAWPF (PRAME_HUMAN)
KSMVQAWPY

SEQ ID NO: 155234 - protein, 10 aa, Artificial Sequence
  Description of Artificial Sequence: Synthetic peptide
  Seed: PTLAKFSPYL (PRAME_HUMAN)
PFLAKFSPYL

SEQ ID NO: 155235 - protein, 9 aa, Artificial Sequence
  Description of Artificial Sequence: Synthetic peptide
  Seed: RRLLLSHIH (PRAME_HUMAN)
RRLLLSHII

SEQ ID NO: 155236 - protein, 9 aa, Artificial Sequence
  Description of Artificial Sequence: Synthetic peptide
  Seed: TWKLPTLAK (PRAME_HUMAN)
TSKLPTLAR

SEQ ID NO: 155237 - protein, 10 aa, Artificial Sequence
  Description of Artificial Sequence: Synthetic peptide
  Seed: SLQCLQALYV (PRAME_HUMAN)
SMQCLQALYL

SEQ ID NO: 155238 - protein, 10 aa, Artificial Sequence
  Description of Artificial Sequence: Synthetic peptide
  Seed: IQSRYISMSV (PRAME_HUMAN)
IRSRYISMSK

SEQ ID NO: 155239 - protein, 9 aa, Artificial Sequence
  Description of Artificial Sequence: Synthetic peptide
  Seed: QSRYISMSV (PRAME_HUMAN)
QSRYISMSG

SEQ ID NO: 155240 - protein, 10 aa, Artificial Sequence
  Description of Artificial Sequence: Synthetic peptide
  Seed: RLAYLHARLR (PRAME_HUMAN)
RVAYLHARLK

SEQ ID NO: 155241 - protein, 9 aa, Artificial Sequence
  Description of Artificial Sequence: Synthetic peptide
  Seed: ALAIAALEL (PRAME_HUMAN)
ASAIAALEI

SEQ ID NO: 155242 - protein, 10 aa, Artificial Sequence
  Description of Artificial Sequence: Synthetic peptide
  Seed: DIHGTLHLER (PRAME_HUMAN)
DAHGTLHLER

SEQ ID NO: 155243 - protein, 9 aa, Artificial Sequence
  Description of Artificial Sequence: Synthetic peptide
  Seed: YIAQFTSQF (PRAME_HUMAN)
YYAQFTSQW

SEQ ID NO: 155244 - protein, 10 aa, Artificial Sequence
  Description of Artificial Sequence: Synthetic peptide
  Seed: LSFYGNSISI (PRAME_HUMAN)
LRFYGNSISF

SEQ ID NO: 155245 - protein, 9 aa, Artificial Sequence
  Description of Artificial Sequence: Synthetic peptide
  Seed: LALLPSLSH (PRAME_HUMAN)
LLLLPSLSY

SEQ ID NO: 155246 - protein, 10 aa, Artificial Sequence
  Description of Artificial Sequence: Synthetic peptide
  Seed: MVQAWPFTCL (PRAME_HUMAN)
MQQAWPFTCY

SEQ ID NO: 155247 - protein, 9 aa, Artificial Sequence
  Description of Artificial Sequence: Synthetic peptide
  Seed: SLSHCSQLT (PRAME_HUMAN)
SLSHCSQLI

SEQ ID NO: 155248 - protein, 10 aa, Artificial Sequence
  Description of Artificial Sequence: Synthetic peptide
  Seed: YVDSLFFLRG (PRAME_HUMAN)
YIDSLFFLRR

SEQ ID NO: 155249 - protein, 11 aa, Artificial Sequence
  Description of Artificial Sequence: Synthetic peptide
  Seed: RLVELAGQSLL (PRAME_HUMAN)
RTVELAGQSLW

SEQ ID NO: 155250 - protein, 9 aa, Artificial Sequence
  Description of Artificial Sequence: Synthetic peptide
  Seed: ALAIAALEL (PRAME_HUMAN)
AMAIAALEF

SEQ ID NO: 155251 - protein, 10 aa, Artificial Sequence
  Description of Artificial Sequence: Synthetic peptide
  Seed: GACDELFSYL (PRAME_HUMAN)
GTCDELFSYL

SEQ ID NO: 155252 - protein, 10 aa, Artificial Sequence
  Description of Artificial Sequence: Synthetic peptide
  Seed: RRLWGSIQSR (PRAME_HUMAN)
RGLWGSIQSR

SEQ ID NO: 155253 - protein, 9 aa, Artificial Sequence
  Description of Artificial Sequence: Synthetic peptide
  Seed: ISISALQSL (PRAME_HUMAN)
INISALQSW

SEQ ID NO: 155254 - protein, 10 aa, Artificial Sequence
  Description of Artificial Sequence: Synthetic peptide
  Seed: SPSVSQLSVL (PRAME_HUMAN)
SASVSQLSVF

SEQ ID NO: 155255 - protein, 10 aa, Artificial Sequence
  Description of Artificial Sequence: Synthetic peptide
  Seed: LLLSHIHASS (PRAME_HUMAN)
LFLSHIHASV

SEQ ID NO: 155256 - protein, 9 aa, Artificial Sequence
  Description of Artificial Sequence: Synthetic peptide
  Seed: LSHIHASSY (PRAME_HUMAN)
LVHIHASSM

SEQ ID NO: 155257 - protein, 10 aa, Artificial Sequence
  Description of Artificial Sequence: Synthetic peptide
  Seed: SNLTHVLYPV (PRAME_HUMAN)
SGLTHVLYPA

SEQ ID NO: 155258 - protein, 10 aa, Artificial Sequence
  Description of Artificial Sequence: Synthetic peptide
  Seed: ALLERASATL (PRAME_HUMAN)
AILERASATY

SEQ ID NO: 155259 - protein, 10 aa, Artificial Sequence
  Description of Artificial Sequence: Synthetic peptide
  Seed: AAFDGRHSQT (PRAME_HUMAN)
AVFDGRHSQL

SEQ ID NO: 155260 - protein, 9 aa, Artificial Sequence
  Description of Artificial Sequence: Synthetic peptide
  Seed: MINLRRLLL (PRAME_HUMAN)
MYNLRRLLK

SEQ ID NO: 155261 - protein, 8 aa, Artificial Sequence
  Description of Artificial Sequence: Synthetic peptide
  Seed: LKIFAMPM (PRAME_HUMAN)
LMIFAMPY

SEQ ID NO: 155262 - protein, 9 aa, Artificial Sequence
  Description of Artificial Sequence: Synthetic peptide
  Seed: RTFYDPEPI (PRAME_HUMAN)
RTFYDPEPF

SEQ ID NO: 155263 - protein, 9 aa, Artificial Sequence
  Description of Artificial Sequence: Synthetic peptide
  Seed: LYPVPLESY (PRAME_HUMAN)
LFPVPLESL

SEQ ID NO: 155264 - protein, 9 aa, Artificial Sequence
  Description of Artificial Sequence: Synthetic peptide
  Seed: RHSQTLKAM (PRAME_HUMAN)
RYSQTLKAV

SEQ ID NO: 155265 - protein, 9 aa, Artificial Sequence
  Description of Artificial Sequence: Synthetic peptide
  Seed: LLKDEALAI (PRAME_HUMAN)
LAKDEALAL

SEQ ID NO: 155266 - protein, 9 aa, Artificial Sequence
  Description of Artificial Sequence: Synthetic peptide
  Seed: ELAGQSLLK (PRAME_HUMAN)
ETAGQSLLK

SEQ ID NO: 155267 - protein, 10 aa, Artificial Sequence
  Description of Artificial Sequence: Synthetic peptide
  Seed: SPYLGQMINL (PRAME_HUMAN)
SCYLGQMINL

SEQ ID NO: 155268 - protein, 9 aa, Artificial Sequence
  Description of Artificial Sequence: Synthetic peptide
  Seed: LLALLPSLS (PRAME_HUMAN)
LQALLPSLV

SEQ ID NO: 155269 - protein, 10 aa, Artificial Sequence
  Description of Artificial Sequence: Synthetic peptide
  Seed: IQSRYISMSV (PRAME_HUMAN)
IQSRYISMSF

SEQ ID NO: 155270 - protein, 10 aa, Artificial Sequence
  Description of Artificial Sequence: Synthetic peptide
  Seed: LKAMVQAWPF (PRAME_HUMAN)
LEAMVQAWPY

SEQ ID NO: 155271 - protein, 9 aa, Artificial Sequence
  Description of Artificial Sequence: Synthetic peptide
  Seed: RGRLDQLLR (PRAME_HUMAN)
RARLDQLLK

SEQ ID NO: 155272 - protein, 9 aa, Artificial Sequence
  Description of Artificial Sequence: Synthetic peptide
  Seed: RLRELLCEL (PRAME_HUMAN)
RPRELLCEL

SEQ ID NO: 155273 - protein, 9 aa, Artificial Sequence
  Description of Artificial Sequence: Synthetic peptide
  Seed: SIEDLEVTC (PRAME_HUMAN)
SCEDLEVTL

SEQ ID NO: 155274 - protein, 9 aa, Artificial Sequence
  Description of Artificial Sequence: Synthetic peptide
  Seed: RGRLDQLLR (PRAME_HUMAN)
RVRLDQLLM

SEQ ID NO: 155275 - protein, 11 aa, Artificial Sequence
  Description of Artificial Sequence: Synthetic peptide
  Seed: RELFPPLFMAA (PRAME_HUMAN)
RNLFPPLFMAV

SEQ ID NO: 155276 - protein, 10 aa, Artificial Sequence
  Description of Artificial Sequence: Synthetic peptide
  Seed: RLAYLHARLR (PRAME_HUMAN)
RPAYLHARLK

SEQ ID NO: 155277 - protein, 10 aa, Artificial Sequence
  Description of Artificial Sequence: Synthetic peptide
  Seed: TLHLERLAYL (PRAME_HUMAN)
TMHLERLAYL

SEQ ID NO: 155278 - protein, 9 aa, Artificial Sequence
  Description of Artificial Sequence: Synthetic peptide
  Seed: QSLLKDEAL (PRAME_HUMAN)
QMLLKDEAF

SEQ ID NO: 155279 - protein, 9 aa, Artificial Sequence
  Description of Artificial Sequence: Synthetic peptide
  Seed: ELFSYLIEK (PRAME_HUMAN)
ETFSYLIEY

SEQ ID NO: 155280 - protein, 10 aa, Artificial Sequence
  Description of Artificial Sequence: Synthetic peptide
  Seed: QLLRHVMNPL (PRAME_HUMAN)
QKLRHVMNPV

SEQ ID NO: 155281 - protein, 9 aa, Artificial Sequence
  Description of Artificial Sequence: Synthetic peptide
  Seed: EVRPRRWKL (PRAME_HUMAN)
EMRPRRWKM

SEQ ID NO: 155282 - protein, 10 aa, Artificial Sequence
  Description of Artificial Sequence: Synthetic peptide
  Seed: TSQFLSLQCL (PRAME_HUMAN)
TTQFLSLQCF

SEQ ID NO: 155283 - protein, 9 aa, Artificial Sequence
  Description of Artificial Sequence: Synthetic peptide
  Seed: AEQPFIPVE (PRAME_HUMAN)
AEQPFIPVA

SEQ ID NO: 155284 - protein, 10 aa, Artificial Sequence
  Description of Artificial Sequence: Synthetic peptide
  Seed: RLAYLHARLR (PRAME_HUMAN)
RNAYLHARLR

SEQ ID NO: 155285 - protein, 9 aa, Artificial Sequence
  Description of Artificial Sequence: Synthetic peptide
  Seed: SQSPSVSQL (PRAME_HUMAN)
SWSPSVSQM

SEQ ID NO: 155286 - protein, 9 aa, Artificial Sequence
  Description of Artificial Sequence: Synthetic peptide
  Seed: RTFYDPEPI (PRAME_HUMAN)
RQFYDPEPV

SEQ ID NO: 155287 - protein, 9 aa, Artificial Sequence
  Description of Artificial Sequence: Synthetic peptide
  Seed: HVMNPLETL (PRAME_HUMAN)
HMMNPLETF

SEQ ID NO: 155288 - protein, 9 aa, Artificial Sequence
  Description of Artificial Sequence: Synthetic peptide
  Seed: LAIAALELL (PRAME_HUMAN)
LMIAALELA

SEQ ID NO: 155289 - protein, 10 aa, Artificial Sequence
  Description of Artificial Sequence: Synthetic peptide
  Seed: PTLAKFSPYL (PRAME_HUMAN)
PWLAKFSPYI

SEQ ID NO: 155290 - protein, 9 aa, Artificial Sequence
  Description of Artificial Sequence: Synthetic peptide
  Seed: GQHLHLETF (PRAME_HUMAN)
GHHLHLETM

SEQ ID NO: 155291 - protein, 10 aa, Artificial Sequence
  Description of Artificial Sequence: Synthetic peptide
  Seed: LKAMVQAWPF (PRAME_HUMAN)
LDAMVQAWPW

SEQ ID NO: 155292 - protein, 9 aa, Artificial Sequence
  Description of Artificial Sequence: Synthetic peptide
  Seed: VLDGLDVLL (PRAME_HUMAN)
VTDGLDVLY

SEQ ID NO: 155293 - protein, 9 aa, Artificial Sequence
  Description of Artificial Sequence: Synthetic peptide
  Seed: SIQSRYISM (PRAME_HUMAN)
SMQSRYISY

SEQ ID NO: 155294 - protein, 9 aa, Artificial Sequence
  Description of Artificial Sequence: Synthetic peptide
  Seed: RLAYLHARL (PRAME_HUMAN)
RLAYLHARA

SEQ ID NO: 155295 - protein, 8 aa, Artificial Sequence
  Description of Artificial Sequence: Synthetic peptide
  Seed: MQDIKMIL (PRAME_HUMAN)
MSDIKMIL

SEQ ID NO: 155296 - protein, 9 aa, Artificial Sequence
  Description of Artificial Sequence: Synthetic peptide
  Seed: SHIHASSYI (PRAME_HUMAN)
SEIHASSYY

SEQ ID NO: 155297 - protein, 9 aa, Artificial Sequence
  Description of Artificial Sequence: Synthetic peptide
  Seed: RLAYLHARL (PRAME_HUMAN)
RTAYLHARF

SEQ ID NO: 155298 - protein, 9 aa, Artificial Sequence
  Description of Artificial Sequence: Synthetic peptide
  Seed: ALQSLLQHL (PRAME_HUMAN)
ARQSLLQHL

SEQ ID NO: 155299 - protein, 8 aa, Artificial Sequence
  Description of Artificial Sequence: Synthetic peptide
  Seed: YEDIHGTL (PRAME_HUMAN)
YWDIHGTV

SEQ ID NO: 155300 - protein, 10 aa, Artificial Sequence
  Description of Artificial Sequence: Synthetic peptide
  Seed: ALELLPRELF (PRAME_HUMAN)
AKELLPRELW

SEQ ID NO: 155301 - protein, 9 aa, Artificial Sequence
  Description of Artificial Sequence: Synthetic peptide
  Seed: FLRGRLDQL (PRAME_HUMAN)
FVRGRLDQL

SEQ ID NO: 155302 - protein, 9 aa, Artificial Sequence
  Description of Artificial Sequence: Synthetic peptide
  Seed: LALLPSLSH (PRAME_HUMAN)
LELLPSLSF

SEQ ID NO: 155303 - protein, 11 aa, Artificial Sequence
  Description of Artificial Sequence: Synthetic peptide
  Seed: LLPRELFPPLF (PRAME_HUMAN)
LWPRELFPPLF

SEQ ID NO: 155304 - protein, 9 aa, Artificial Sequence
  Description of Artificial Sequence: Synthetic peptide
  Seed: HVMNPLETL (PRAME_HUMAN)
HGMNPLETF

SEQ ID NO: 155305 - protein, 9 aa, Artificial Sequence
  Description of Artificial Sequence: Synthetic peptide
  Seed: LGRPSMVWL (PRAME_HUMAN)
LSRPSMVWA

SEQ ID NO: 155306 - protein, 9 aa, Artificial Sequence
  Description of Artificial Sequence: Synthetic peptide
  Seed: RTFYDPEPI (PRAME_HUMAN)
RLFYDPEPW

SEQ ID NO: 155307 - protein, 9 aa, Artificial Sequence
  Description of Artificial Sequence: Synthetic peptide
  Seed: SHIHASSYI (PRAME_HUMAN)
SMIHASSYW

SEQ ID NO: 155308 - protein, 9 aa, Artificial Sequence
  Description of Artificial Sequence: Synthetic peptide
  Seed: SYEDIHGTL (PRAME_HUMAN)
SYEDIHGTM

SEQ ID NO: 155309 - protein, 9 aa, Artificial Sequence
  Description of Artificial Sequence: Synthetic peptide
  Seed: NSHQDFWTV (PRAME_HUMAN)
NMHQDFWTI

SEQ ID NO: 155310 - protein, 9 aa, Artificial Sequence
  Description of Artificial Sequence: Synthetic peptide
  Seed: RLDQLLRHV (PRAME_HUMAN)
RVDQLLRHI

SEQ ID NO: 155311 - protein, 9 aa, Artificial Sequence
  Description of Artificial Sequence: Synthetic peptide
  Seed: QFTSQFLSL (PRAME_HUMAN)
QYTSQFLSI

SEQ ID NO: 155312 - protein, 9 aa, Artificial Sequence
  Description of Artificial Sequence: Synthetic peptide
  Seed: LHLETFKAV (PRAME_HUMAN)
LQLETFKAI

SEQ ID NO: 155313 - protein, 10 aa, Artificial Sequence
  Description of Artificial Sequence: Synthetic peptide
  Seed: ARLRELLCEL (PRAME_HUMAN)
AWLRELLCEI

SEQ ID NO: 155314 - protein, 8 aa, Artificial Sequence
  Description of Artificial Sequence: Synthetic peptide
  Seed: TDDQLLAL (PRAME_HUMAN)
TYDQLLAM

SEQ ID NO: 155315 - protein, 9 aa, Artificial Sequence
  Description of Artificial Sequence: Synthetic peptide
  Seed: AFDGRHSQT (PRAME_HUMAN)
AVDGRHSQL

SEQ ID NO: 155316 - protein, 10 aa, Artificial Sequence
  Description of Artificial Sequence: Synthetic peptide
  Seed: ALELLPRELF (PRAME_HUMAN)
ANELLPRELW

SEQ ID NO: 155317 - protein, 10 aa, Artificial Sequence
  Description of Artificial Sequence: Synthetic peptide
  Seed: FIPVEVLVDL (PRAME_HUMAN)
FLPVEVLVDM

SEQ ID NO: 155318 - protein, 9 aa, Artificial Sequence
  Description of Artificial Sequence: Synthetic peptide
  Seed: LSTEAEQPF (PRAME_HUMAN)
LTTEAEQPF

SEQ ID NO: 155319 - protein, 9 aa, Artificial Sequence
  Description of Artificial Sequence: Synthetic peptide
  Seed: SQSPSVSQL (PRAME_HUMAN)
SHSPSVSQA

SEQ ID NO: 155320 - protein, 10 aa, Artificial Sequence
  Description of Artificial Sequence: Synthetic peptide
  Seed: VRPRRWKLQV (PRAME_HUMAN)
VPPRRWKLQL

SEQ ID NO: 155321 - protein, 10 aa, Artificial Sequence
  Description of Artificial Sequence: Synthetic peptide
  Seed: FIPVEVLVDL (PRAME_HUMAN)
FTPVEVLVDV

SEQ ID NO: 155322 - protein, 10 aa, Artificial Sequence
  Description of Artificial Sequence: Synthetic peptide
  Seed: AIAALELLPR (PRAME_HUMAN)
AYAALELLPR

SEQ ID NO: 155323 - protein, 10 aa, Artificial Sequence
  Description of Artificial Sequence: Synthetic peptide
  Seed: SMSVWTSPRR (PRAME_HUMAN)
STSVWTSPRR

SEQ ID NO: 155324 - protein, 9 aa, Artificial Sequence
  Description of Artificial Sequence: Synthetic peptide
  Seed: RTFYDPEPI (PRAME_HUMAN)
RHFYDPEPM

SEQ ID NO: 155325 - protein, 9 aa, Artificial Sequence
  Description of Artificial Sequence: Synthetic peptide
  Seed: LSEGDVMHL (PRAME_HUMAN)
LWEGDVMHL

SEQ ID NO: 155326 - protein, 10 aa, Artificial Sequence
  Description of Artificial Sequence: Synthetic peptide
  Seed: RLWGSIQSRY (PRAME_HUMAN)
RQWGSIQSRL

SEQ ID NO: 155327 - protein, 9 aa, Artificial Sequence
  Description of Artificial Sequence: Synthetic peptide
  Seed: VQLDSIEDL (PRAME_HUMAN)
VHLDSIEDM

SEQ ID NO: 155328 - protein, 9 aa, Artificial Sequence
  Description of Artificial Sequence: Synthetic peptide
  Seed: LQDLVFDEC (PRAME_HUMAN)
LVDLVFDEF

SEQ ID NO: 155329 - protein, 9 aa, Artificial Sequence
  Description of Artificial Sequence: Synthetic peptide
  Seed: VLDGLDVLL (PRAME_HUMAN)
VYDGLDVLM

SEQ ID NO: 155330 - protein, 9 aa, Artificial Sequence
  Description of Artificial Sequence: Synthetic peptide
  Seed: AAFDGRHSQ (PRAME_HUMAN)
AAFDGRHSL

SEQ ID NO: 155331 - protein, 9 aa, Artificial Sequence
  Description of Artificial Sequence: Synthetic peptide
  Seed: SIEDLEVTC (PRAME_HUMAN)
SFEDLEVTL

SEQ ID NO: 155332 - protein, 9 aa, Artificial Sequence
  Description of Artificial Sequence: Synthetic peptide
  Seed: SIQSRYISM (PRAME_HUMAN)
SMQSRYISM

SEQ ID NO: 155333 - protein, 11 aa, Artificial Sequence
  Description of Artificial Sequence: Synthetic peptide
  Seed: FKAVLDGLDVL (PRAME_HUMAN)
FMAVLDGLDVV

SEQ ID NO: 155334 - protein, 9 aa, Artificial Sequence
  Description of Artificial Sequence: Synthetic peptide
  Seed: QSRYISMSV (PRAME_HUMAN)
QARYISMSF

SEQ ID NO: 155335 - protein, 9 aa, Artificial Sequence
  Description of Artificial Sequence: Synthetic peptide
  Seed: ISISALQSL (PRAME_HUMAN)
ITISALQSL

SEQ ID NO: 155336 - protein, 9 aa, Artificial Sequence
  Description of Artificial Sequence: Synthetic peptide
  Seed: VSPEPLQAL (PRAME_HUMAN)
VTPEPLQAI

SEQ ID NO: 155337 - protein, 9 aa, Artificial Sequence
  Description of Artificial Sequence: Synthetic peptide
  Seed: LALLPSLSH (PRAME_HUMAN)
LALLPSLSI

SEQ ID NO: 155338 - protein, 9 aa, Artificial Sequence
  Description of Artificial Sequence: Synthetic peptide
  Seed: LQSLLQHLI (PRAME_HUMAN)
LESLLQHLL

SEQ ID NO: 155339 - protein, 11 aa, Artificial Sequence
  Description of Artificial Sequence: Synthetic peptide
  Seed: RRRLWGSIQSR (PRAME_HUMAN)
RRRLWGSIQSF

SEQ ID NO: 155340 - protein, 10 aa, Artificial Sequence
  Description of Artificial Sequence: Synthetic peptide
  Seed: RRRLWGSIQS (PRAME_HUMAN)
RMRLWGSIQR

SEQ ID NO: 155341 - protein, 10 aa, Artificial Sequence
  Description of Artificial Sequence: Synthetic peptide
  Seed: FSYLIEKVKR (PRAME_HUMAN)
FYYLIEKVKR

SEQ ID NO: 155342 - protein, 9 aa, Artificial Sequence
  Description of Artificial Sequence: Synthetic peptide
  Seed: ETLSITNCR (PRAME_HUMAN)
EVLSITNCK

SEQ ID NO: 155343 - protein, 11 aa, Artificial Sequence
  Description of Artificial Sequence: Synthetic peptide
  Seed: RTFYDPEPILC (PRAME_HUMAN)
RAFYDPEPILW

SEQ ID NO: 155344 - protein, 10 aa, Artificial Sequence
  Description of Artificial Sequence: Synthetic peptide
  Seed: SPSVSQLSVL (PRAME_HUMAN)
SRSVSQLSVF

SEQ ID NO: 155345 - protein, 9 aa, Artificial Sequence
  Description of Artificial Sequence: Synthetic peptide
  Seed: SHIHASSYI (PRAME_HUMAN)
SQIHASSYM

SEQ ID NO: 155346 - protein, 8 aa, Artificial Sequence
  Description of Artificial Sequence: Synthetic peptide
  Seed: EAAQPMTK (PRAME_HUMAN)
ETAQPMTR

SEQ ID NO: 155347 - protein, 10 aa, Artificial Sequence
  Description of Artificial Sequence: Synthetic peptide
  Seed: GQHLHLETFK (PRAME_HUMAN)
GVHLHLETFR

SEQ ID NO: 155348 - protein, 9 aa, Artificial Sequence
  Description of Artificial Sequence: Synthetic peptide
  Seed: ERLAYLHAR (PRAME_HUMAN)
EWLAYLHAK

SEQ ID NO: 155349 - protein, 9 aa, Artificial Sequence
  Description of Artificial Sequence: Synthetic peptide
  Seed: RELLCELGR (PRAME_HUMAN)
RTLLCELGK

SEQ ID NO: 155350 - protein, 9 aa, Artificial Sequence
  Description of Artificial Sequence: Synthetic peptide
  Seed: ACDELFSYL (PRAME_HUMAN)
AIDELFSYM

SEQ ID NO: 155351 - protein, 10 aa, Artificial Sequence
  Description of Artificial Sequence: Synthetic peptide
  Seed: RASATLQDLV (PRAME_HUMAN)
RDSATLQDLW

SEQ ID NO: 155352 - protein, 10 aa, Artificial Sequence
  Description of Artificial Sequence: Synthetic peptide
  Seed: YIAQFTSQFL (PRAME_HUMAN)
YDAQFTSQFF

SEQ ID NO: 155353 - protein, 11 aa, Artificial Sequence
  Description of Artificial Sequence: Synthetic peptide
  Seed: SQLSVLSLSGV (PRAME_HUMAN)
SLLSVLSLSGL

SEQ ID NO: 155354 - protein, 9 aa, Artificial Sequence
  Description of Artificial Sequence: Synthetic peptide
  Seed: KMILKMVQL (PRAME_HUMAN)
KAILKMVQY

SEQ ID NO: 155355 - protein, 9 aa, Artificial Sequence
  Description of Artificial Sequence: Synthetic peptide
  Seed: LTDVSPEPL (PRAME_HUMAN)
LWDVSPEPV

SEQ ID NO: 155356 - protein, 10 aa, Artificial Sequence
  Description of Artificial Sequence: Synthetic peptide
  Seed: MNPLETLSIT (PRAME_HUMAN)
MQPLETLSIV

SEQ ID NO: 155357 - protein, 9 aa, Artificial Sequence
  Description of Artificial Sequence: Synthetic peptide
  Seed: KAMVQAWPF (PRAME_HUMAN)
KEMVQAWPY

SEQ ID NO: 155358 - protein, 10 aa, Artificial Sequence
  Description of Artificial Sequence: Synthetic peptide
  Seed: IQSRYISMSV (PRAME_HUMAN)
IKSRYISMSV

SEQ ID NO: 155359 - protein, 10 aa, Artificial Sequence
  Description of Artificial Sequence: Synthetic peptide
  Seed: LSFYGNSISI (PRAME_HUMAN)
LRFYGNSISM

SEQ ID NO: 155360 - protein, 9 aa, Artificial Sequence
  Description of Artificial Sequence: Synthetic peptide
  Seed: VLMKGQHLH (PRAME_HUMAN)
VMMKGQHLF

SEQ ID NO: 155361 - protein, 10 aa, Artificial Sequence
  Description of Artificial Sequence: Synthetic peptide
  Seed: SLSHCSQLTT (PRAME_HUMAN)
SLSHCSQLTL

SEQ ID NO: 155362 - protein, 10 aa, Artificial Sequence
  Description of Artificial Sequence: Synthetic peptide
  Seed: CSQLTTLSFY (PRAME_HUMAN)
CQQLTTLSFM

SEQ ID NO: 155363 - protein, 9 aa, Artificial Sequence
  Description of Artificial Sequence: Synthetic peptide
  Seed: ALQSLLQHL (PRAME_HUMAN)
AIQSLLQHI

SEQ ID NO: 155364 - protein, 9 aa, Artificial Sequence
  Description of Artificial Sequence: Synthetic peptide
  Seed: LQSLLQHLI (PRAME_HUMAN)
LLSLLQHLI

SEQ ID NO: 155365 - protein, 11 aa, Artificial Sequence
  Description of Artificial Sequence: Synthetic peptide
  Seed: DFWTVWSGNRA (PRAME_HUMAN)
DYWTVWSGNRR

SEQ ID NO: 155366 - protein, 9 aa, Artificial Sequence
  Description of Artificial Sequence: Synthetic peptide
  Seed: RLAYLHARL (PRAME_HUMAN)
RLAYLHARM

SEQ ID NO: 155367 - protein, 9 aa, Artificial Sequence
  Description of Artificial Sequence: Synthetic peptide
  Seed: SQSPSVSQL (PRAME_HUMAN)
SLSPSVSQF

SEQ ID NO: 155368 - protein, 10 aa, Artificial Sequence
  Description of Artificial Sequence: Synthetic peptide
  Seed: LSQSPSVSQL (PRAME_HUMAN)
LRQSPSVSQF

SEQ ID NO: 155369 - protein, 10 aa, Artificial Sequence
  Description of Artificial Sequence: Synthetic peptide
  Seed: MERRRLWGSI (PRAME_HUMAN)
MPRRRLWGSI

SEQ ID NO: 155370 - protein, 8 aa, Artificial Sequence
  Description of Artificial Sequence: Synthetic peptide
  Seed: SQLSVLSL (PRAME_HUMAN)
SQLSVLSV

SEQ ID NO: 155371 - protein, 9 aa, Artificial Sequence
  Description of Artificial Sequence: Synthetic peptide
  Seed: KVDGLSTEA (PRAME_HUMAN)
KWDGLSTEM

SEQ ID NO: 155372 - protein, 9 aa, Artificial Sequence
  Description of Artificial Sequence: Synthetic peptide
  Seed: SIQSRYISM (PRAME_HUMAN)
SHQSRYISF

SEQ ID NO: 155373 - protein, 10 aa, Artificial Sequence
  Description of Artificial Sequence: Synthetic peptide
  Seed: RLWGSIQSRY (PRAME_HUMAN)
RHWGSIQSRY

SEQ ID NO: 155374 - protein, 9 aa, Artificial Sequence
  Description of Artificial Sequence: Synthetic peptide
  Seed: KLKIFAMPM (PRAME_HUMAN)
KKKIFAMPM

SEQ ID NO: 155375 - protein, 9 aa, Artificial Sequence
  Description of Artificial Sequence: Synthetic peptide
  Seed: GLSNLTHVL (PRAME_HUMAN)
GASNLTHVL

SEQ ID NO: 155376 - protein, 9 aa, Artificial Sequence
  Description of Artificial Sequence: Synthetic peptide
  Seed: SQFLSLQCL (PRAME_HUMAN)
STFLSLQCV

SEQ ID NO: 155377 - protein, 9 aa, Artificial Sequence
  Description of Artificial Sequence: Synthetic peptide
  Seed: SQLTTLSFY (PRAME_HUMAN)
SRLTTLSFL

SEQ ID NO: 155378 - protein, 10 aa, Artificial Sequence
  Description of Artificial Sequence: Synthetic peptide
  Seed: MVQAWPFTCL (PRAME_HUMAN)
MLQAWPFTCL

SEQ ID NO: 155379 - protein, 9 aa, Artificial Sequence
  Description of Artificial Sequence: Synthetic peptide
  Seed: LQCLQALYV (PRAME_HUMAN)
LLCLQALYV

SEQ ID NO: 155380 - protein, 11 aa, Artificial Sequence
  Description of Artificial Sequence: Synthetic peptide
  Seed: HLSQSPSVSQL (PRAME_HUMAN)
HQSQSPSVSQI

SEQ ID NO: 155381 - protein, 9 aa, Artificial Sequence
  Description of Artificial Sequence: Synthetic peptide
  Seed: LQDLVFDEC (PRAME_HUMAN)
LTDLVFDEI

SEQ ID NO: 155382 - protein, 9 aa, Artificial Sequence
  Description of Artificial Sequence: Synthetic peptide
  Seed: SALQSLLQH (PRAME_HUMAN)
SQLQSLLQY

SEQ ID NO: 155383 - protein, 9 aa, Artificial Sequence
  Description of Artificial Sequence: Synthetic peptide
  Seed: SQFLSLQCL (PRAME_HUMAN)
SIFLSLQCI

SEQ ID NO: 155384 - protein, 10 aa, Artificial Sequence
  Description of Artificial Sequence: Synthetic peptide
  Seed: MERRRLWGSI (PRAME_HUMAN)
MARRRLWGSM

SEQ ID NO: 155385 - protein, 10 aa, Artificial Sequence
  Description of Artificial Sequence: Synthetic peptide
  Seed: FMAAFDGRHS (PRAME_HUMAN)
FMAAFDGRHA

SEQ ID NO: 155386 - protein, 9 aa, Artificial Sequence
  Description of Artificial Sequence: Synthetic peptide
  Seed: ELFPPLFMA (PRAME_HUMAN)
EMFPPLFMV

SEQ ID NO: 155387 - protein, 10 aa, Artificial Sequence
  Description of Artificial Sequence: Synthetic peptide
  Seed: KKLKIFAMPM (PRAME_HUMAN)
KHLKIFAMPK

SEQ ID NO: 155388 - protein, 10 aa, Artificial Sequence
  Description of Artificial Sequence: Synthetic peptide
  Seed: FIPVEVLVDL (PRAME_HUMAN)
FMPVEVLVDA

SEQ ID NO: 155389 - protein, 10 aa, Artificial Sequence
  Description of Artificial Sequence: Synthetic peptide
  Seed: LSVLSLSGVM (PRAME_HUMAN)
LIVLSLSGVY

SEQ ID NO: 155390 - protein, 10 aa, Artificial Sequence
  Description of Artificial Sequence: Synthetic peptide
  Seed: RRLLLSHIHA (PRAME_HUMAN)
RRLLLSHIHM

SEQ ID NO: 155391 - protein, 10 aa, Artificial Sequence
  Description of Artificial Sequence: Synthetic peptide
  Seed: RGRLDQLLRH (PRAME_HUMAN)
RVRLDQLLRL

SEQ ID NO: 155392 - protein, 9 aa, Artificial Sequence
  Description of Artificial Sequence: Synthetic peptide
  Seed: FYDPEPILC (PRAME_HUMAN)
FDDPEPILI

SEQ ID NO: 155393 - protein, 9 aa, Artificial Sequence
  Description of Artificial Sequence: Synthetic peptide
  Seed: NLTHVLYPV (PRAME_HUMAN)
NSTHVLYPA

SEQ ID NO: 155394 - protein, 10 aa, Artificial Sequence
  Description of Artificial Sequence: Synthetic peptide
  Seed: ALYVDSLFFL (PRAME_HUMAN)
AQYVDSLFFF

SEQ ID NO: 155395 - protein, 11 aa, Artificial Sequence
  Description of Artificial Sequence: Synthetic peptide
  Seed: FKAVLDGLDVL (PRAME_HUMAN)
FMAVLDGLDVI

SEQ ID NO: 155396 - protein, 9 aa, Artificial Sequence
  Description of Artificial Sequence: Synthetic peptide
  Seed: ACDELFSYL (PRAME_HUMAN)
AYDELFSYY

SEQ ID NO: 155397 - protein, 9 aa, Artificial Sequence
  Description of Artificial Sequence: Synthetic peptide
  Seed: VSPEPLQAL (PRAME_HUMAN)
VIPEPLQAA

SEQ ID NO: 155398 - protein, 9 aa, Artificial Sequence
  Description of Artificial Sequence: Synthetic peptide
  Seed: VSPEPLQAL (PRAME_HUMAN)
VYPEPLQAF

SEQ ID NO: 155399 - protein, 10 aa, Artificial Sequence
  Description of Artificial Sequence: Synthetic peptide
  Seed: RGRLDQLLRH (PRAME_HUMAN)
RTRLDQLLRR

SEQ ID NO: 155400 - protein, 9 aa, Artificial Sequence
  Description of Artificial Sequence: Synthetic peptide
  Seed: IAQFTSQFL (PRAME_HUMAN)
IAQFTSQFF

SEQ ID NO: 155401 - protein, 9 aa, Artificial Sequence
  Description of Artificial Sequence: Synthetic peptide
  Seed: LLALLPSLS (PRAME_HUMAN)
LLALLPSLM

SEQ ID NO: 155402 - protein, 9 aa, Artificial Sequence
  Description of Artificial Sequence: Synthetic peptide
  Seed: LSTEAEQPF (PRAME_HUMAN)
LSTEAEQPL

SEQ ID NO: 155403 - protein, 9 aa, Artificial Sequence
  Description of Artificial Sequence: Synthetic peptide
  Seed: LLLSHIHAS (PRAME_HUMAN)
LVLSHIHAI

SEQ ID NO: 155404 - protein, 10 aa, Artificial Sequence
  Description of Artificial Sequence: Synthetic peptide
  Seed: RELFPPLFMA (PRAME_HUMAN)
RCLFPPLFMV

SEQ ID NO: 155405 - protein, 9 aa, Artificial Sequence
  Description of Artificial Sequence: Synthetic peptide
  Seed: RTFYDPEPI (PRAME_HUMAN)
RAFYDPEPK

SEQ ID NO: 155406 - protein, 9 aa, Artificial Sequence
  Description of Artificial Sequence: Synthetic peptide
  Seed: SLQCLQALY (PRAME_HUMAN)
SAQCLQALY

SEQ ID NO: 155407 - protein, 9 aa, Artificial Sequence
  Description of Artificial Sequence: Synthetic peptide
  Seed: SIEDLEVTC (PRAME_HUMAN)
SLEDLEVTL

SEQ ID NO: 155408 - protein, 11 aa, Artificial Sequence
  Description of Artificial Sequence: Synthetic peptide
  Seed: QALYVDSLFFL (PRAME_HUMAN)
QELYVDSLFFF

SEQ ID NO: 155409 - protein, 11 aa, Artificial Sequence
  Description of Artificial Sequence: Synthetic peptide
  Seed: SLQCLQALYVD (PRAME_HUMAN)
SLQCLQALYVV

SEQ ID NO: 155410 - protein, 10 aa, Artificial Sequence
  Description of Artificial Sequence: Synthetic peptide
  Seed: ARLRELLCEL (PRAME_HUMAN)
AELRELLCEV

SEQ ID NO: 155411 - protein, 10 aa, Artificial Sequence
  Description of Artificial Sequence: Synthetic peptide
  Seed: MVQAWPFTCL (PRAME_HUMAN)
MWQAWPFTCV

SEQ ID NO: 155412 - protein, 9 aa, Artificial Sequence
  Description of Artificial Sequence: Synthetic peptide
  Seed: SHCSQLTTL (PRAME_HUMAN)
SMCSQLTTY

SEQ ID NO: 155413 - protein, 9 aa, Artificial Sequence
  Description of Artificial Sequence: Synthetic peptide
  Seed: EPLQALLER (PRAME_HUMAN)
EFLQALLER

SEQ ID NO: 155414 - protein, 11 aa, Artificial Sequence
  Description of Artificial Sequence: Synthetic peptide
  Seed: KEGACDELFSY (PRAME_HUMAN)
KEGACDELFSW

SEQ ID NO: 155415 - protein, 9 aa, Artificial Sequence
  Description of Artificial Sequence: Synthetic peptide
  Seed: NLTHVLYPV (PRAME_HUMAN)
NMTHVLYPM

SEQ ID NO: 155416 - protein, 9 aa, Artificial Sequence
  Description of Artificial Sequence: Synthetic peptide
  Seed: TEAEQPFIP (PRAME_HUMAN)
TEAEQPFIL

SEQ ID NO: 155417 - protein, 10 aa, Artificial Sequence
  Description of Artificial Sequence: Synthetic peptide
  Seed: CSQLTTLSFY (PRAME_HUMAN)
CFQLTTLSFF

SEQ ID NO: 155418 - protein, 10 aa, Artificial Sequence
  Description of Artificial Sequence: Synthetic peptide
  Seed: LSQSPSVSQL (PRAME_HUMAN)
LLQSPSVSQY

SEQ ID NO: 155419 - protein, 9 aa, Artificial Sequence
  Description of Artificial Sequence: Synthetic peptide
  Seed: IGLSNLTHV (PRAME_HUMAN)
IQLSNLTHI

SEQ ID NO: 155420 - protein, 10 aa, Artificial Sequence
  Description of Artificial Sequence: Synthetic peptide
  Seed: RGRLDQLLRH (PRAME_HUMAN)
RKRLDQLLRK

SEQ ID NO: 155421 - protein, 9 aa, Artificial Sequence
  Description of Artificial Sequence: Synthetic peptide
  Seed: ITDDQLLAL (PRAME_HUMAN)
IPDDQLLAF

SEQ ID NO: 155422 - protein, 10 aa, Artificial Sequence
  Description of Artificial Sequence: Synthetic peptide
  Seed: YLHARLRELL (PRAME_HUMAN)
YMHARLRELL

SEQ ID NO: 155423 - protein, 10 aa, Artificial Sequence
  Description of Artificial Sequence: Synthetic peptide
  Seed: RELFPPLFMA (PRAME_HUMAN)
RKLFPPLFMV

SEQ ID NO: 155424 - protein, 9 aa, Artificial Sequence
  Description of Artificial Sequence: Synthetic peptide
  Seed: LAYLHARLR (PRAME_HUMAN)
LFYLHARLR

SEQ ID NO: 155425 - protein, 9 aa, Artificial Sequence
  Description of Artificial Sequence: Synthetic peptide
  Seed: QSRYISMSV (PRAME_HUMAN)
QVRYISMSF

SEQ ID NO: 155426 - protein, 9 aa, Artificial Sequence
  Description of Artificial Sequence: Synthetic peptide
  Seed: ELFPPLFMA (PRAME_HUMAN)
ETFPPLFMS

SEQ ID NO: 155427 - protein, 10 aa, Artificial Sequence
  Description of Artificial Sequence: Synthetic peptide
  Seed: RGRLDQLLRH (PRAME_HUMAN)
RFRLDQLLRR

SEQ ID NO: 155428 - protein, 9 aa, Artificial Sequence
  Description of Artificial Sequence: Synthetic peptide
  Seed: YLHARLREL (PRAME_HUMAN)
YKHARLREY

SEQ ID NO: 155429 - protein, 9 aa, Artificial Sequence
  Description of Artificial Sequence: Synthetic peptide
  Seed: SIEDLEVTC (PRAME_HUMAN)
STEDLEVTV

SEQ ID NO: 155430 - protein, 10 aa, Artificial Sequence
  Description of Artificial Sequence: Synthetic peptide
  Seed: ALELLPRELF (PRAME_HUMAN)
AAELLPRELW

SEQ ID NO: 155431 - protein, 10 aa, Artificial Sequence
  Description of Artificial Sequence: Synthetic peptide
  Seed: SLSHCSQLTT (PRAME_HUMAN)
SMSHCSQLTV

SEQ ID NO: 155432 - protein, 9 aa, Artificial Sequence
  Description of Artificial Sequence: Synthetic peptide
  Seed: AAQPMTKKR (PRAME_HUMAN)
ALQPMTKKK

SEQ ID NO: 155433 - protein, 10 aa, Artificial Sequence
  Description of Artificial Sequence: Synthetic peptide
  Seed: ARLRELLCEL (PRAME_HUMAN)
AYLRELLCEI

SEQ ID NO: 155434 - protein, 9 aa, Artificial Sequence
  Description of Artificial Sequence: Synthetic peptide
  Seed: MNPLETLSI (PRAME_HUMAN)
MCPLETLSL

SEQ ID NO: 155435 - protein, 9 aa, Artificial Sequence
  Description of Artificial Sequence: Synthetic peptide
  Seed: VSPEPLQAL (PRAME_HUMAN)
VGPEPLQAF

SEQ ID NO: 155436 - protein, 9 aa, Artificial Sequence
  Description of Artificial Sequence: Synthetic peptide
  Seed: ASSYISPEK (PRAME_HUMAN)
ALSYISPEK

SEQ ID NO: 155437 - protein, 9 aa, Artificial Sequence
  Description of Artificial Sequence: Synthetic peptide
  Seed: ALLERASAT (PRAME_HUMAN)
AILERASAI

SEQ ID NO: 155438 - protein, 9 aa, Artificial Sequence
  Description of Artificial Sequence: Synthetic peptide
  Seed: VELAGQSLL (PRAME_HUMAN)
VELAGQSLV

SEQ ID NO: 155439 - protein, 10 aa, Artificial Sequence
  Description of Artificial Sequence: Synthetic peptide
  Seed: EAAQPMTKKR (PRAME_HUMAN)
EVAQPMTKKK

SEQ ID NO: 155440 - protein, 9 aa, Artificial Sequence
  Description of Artificial Sequence: Synthetic peptide
  Seed: RGRLDQLLR (PRAME_HUMAN)
RFRLDQLLV

SEQ ID NO: 155441 - protein, 10 aa, Artificial Sequence
  Description of Artificial Sequence: Synthetic peptide
  Seed: FIPVEVLVDL (PRAME_HUMAN)
FSPVEVLVDF

SEQ ID NO: 155442 - protein, 9 aa, Artificial Sequence
  Description of Artificial Sequence: Synthetic peptide
  Seed: NLTHVLYPV (PRAME_HUMAN)
NTTHVLYPL

SEQ ID NO: 155443 - protein, 9 aa, Artificial Sequence
  Description of Artificial Sequence: Synthetic peptide
  Seed: ACDELFSYL (PRAME_HUMAN)
ASDELFSYV

SEQ ID NO: 155444 - protein, 9 aa, Artificial Sequence
  Description of Artificial Sequence: Synthetic peptide
  Seed: CSQLTTLSF (PRAME_HUMAN)
CQQLTTLSF

SEQ ID NO: 155445 - protein, 9 aa, Artificial Sequence
  Description of Artificial Sequence: Synthetic peptide
  Seed: QLLALLPSL (PRAME_HUMAN)
QTLALLPSL

SEQ ID NO: 155446 - protein, 10 aa, Artificial Sequence
  Description of Artificial Sequence: Synthetic peptide
  Seed: SMSVWTSPRR (PRAME_HUMAN)
SFSVWTSPRR

SEQ ID NO: 155447 - protein, 10 aa, Artificial Sequence
  Description of Artificial Sequence: Synthetic peptide
  Seed: RLSEGDVMHL (PRAME_HUMAN)
RMSEGDVMHA

SEQ ID NO: 155448 - protein, 10 aa, Artificial Sequence
  Description of Artificial Sequence: Synthetic peptide
  Seed: KGQHLHLETF (PRAME_HUMAN)
KFQHLHLETF

SEQ ID NO: 155449 - protein, 10 aa, Artificial Sequence
  Description of Artificial Sequence: Synthetic peptide
  Seed: FFLRGRLDQL (PRAME_HUMAN)
FFLRGRLDQV

SEQ ID NO: 155450 - protein, 10 aa, Artificial Sequence
  Description of Artificial Sequence: Synthetic peptide
  Seed: SLLKDEALAI (PRAME_HUMAN)
SFLKDEALAV

SEQ ID NO: 155451 - protein, 10 aa, Artificial Sequence
  Description of Artificial Sequence: Synthetic peptide
  Seed: HLIGLSNLTH (PRAME_HUMAN)
HAIGLSNLTY

SEQ ID NO: 155452 - protein, 11 aa, Artificial Sequence
  Description of Artificial Sequence: Synthetic peptide
  Seed: AAFDGRHSQTL (PRAME_HUMAN)
AFFDGRHSQTM

SEQ ID NO: 155453 - protein, 10 aa, Artificial Sequence
  Description of Artificial Sequence: Synthetic peptide
  Seed: SISISALQSL (PRAME_HUMAN)
SQSISALQSL

SEQ ID NO: 155454 - protein, 9 aa, Artificial Sequence
  Description of Artificial Sequence: Synthetic peptide
  Seed: FPEPEAAQP (PRAME_HUMAN)
FPEPEAAQM

SEQ ID NO: 155455 - protein, 9 aa, Artificial Sequence
  Description of Artificial Sequence: Synthetic peptide
  Seed: RASATLQDL (PRAME_HUMAN)
RRSATLQDL

SEQ ID NO: 155456 - protein, 9 aa, Artificial Sequence
  Description of Artificial Sequence: Synthetic peptide
  Seed: LQHLIGLSN (PRAME_HUMAN)
LKHLIGLSY

SEQ ID NO: 155457 - protein, 11 aa, Artificial Sequence
  Description of Artificial Sequence: Synthetic peptide
  Seed: SIQSRYISMSV (PRAME_HUMAN)
SEQSRYISMSK

SEQ ID NO: 155458 - protein, 9 aa, Artificial Sequence
  Description of Artificial Sequence: Synthetic peptide
  Seed: LSHIHASSY (PRAME_HUMAN)
LVHIHASSL

SEQ ID NO: 155459 - protein, 9 aa, Artificial Sequence
  Description of Artificial Sequence: Synthetic peptide
  Seed: ALELLPREL (PRAME_HUMAN)
ASELLPREL

SEQ ID NO: 155460 - protein, 10 aa, Artificial Sequence
  Description of Artificial Sequence: Synthetic peptide
  Seed: YIAQFTSQFL (PRAME_HUMAN)
YLAQFTSQFM

SEQ ID NO: 155461 - protein, 9 aa, Artificial Sequence
  Description of Artificial Sequence: Synthetic peptide
  Seed: LLRHVMNPL (PRAME_HUMAN)
LLRHVMNPM

SEQ ID NO: 155462 - protein, 10 aa, Artificial Sequence
  Description of Artificial Sequence: Synthetic peptide
  Seed: RELFPPLFMA (PRAME_HUMAN)
RQLFPPLFML

SEQ ID NO: 155463 - protein, 8 aa, Artificial Sequence
  Description of Artificial Sequence: Synthetic peptide
  Seed: DVLLAQEV (PRAME_HUMAN)
DALLAQEL

SEQ ID NO: 155464 - protein, 9 aa, Artificial Sequence
  Description of Artificial Sequence: Synthetic peptide
  Seed: QSLLKDEAL (PRAME_HUMAN)
QELLKDEAF

SEQ ID NO: 155465 - protein, 9 aa, Artificial Sequence
  Description of Artificial Sequence: Synthetic peptide
  Seed: QFTSQFLSL (PRAME_HUMAN)
QYTSQFLSV

SEQ ID NO: 155466 - protein, 10 aa, Artificial Sequence
  Description of Artificial Sequence: Synthetic peptide
  Seed: AAFDGRHSQT (PRAME_HUMAN)
AVFDGRHSQF

SEQ ID NO: 155467 - protein, 9 aa, Artificial Sequence
  Description of Artificial Sequence: Synthetic peptide
  Seed: YVDSLFFLR (PRAME_HUMAN)
YTDSLFFLL

SEQ ID NO: 155468 - protein, 10 aa, Artificial Sequence
  Description of Artificial Sequence: Synthetic peptide
  Seed: VLYPVPLESY (PRAME_HUMAN)
VMYPVPLESK

SEQ ID NO: 155469 - protein, 10 aa, Artificial Sequence
  Description of Artificial Sequence: Synthetic peptide
  Seed: IKMILKMVQL (PRAME_HUMAN)
IAMILKMVQV

SEQ ID NO: 155470 - protein, 9 aa, Artificial Sequence
  Description of Artificial Sequence: Synthetic peptide
  Seed: LQHLIGLSN (PRAME_HUMAN)
LSHLIGLSF

SEQ ID NO: 155471 - protein, 10 aa, Artificial Sequence
  Description of Artificial Sequence: Synthetic peptide
  Seed: QSLLQHLIGL (PRAME_HUMAN)
QQLLQHLIGV

SEQ ID NO: 155472 - protein, 9 aa, Artificial Sequence
  Description of Artificial Sequence: Synthetic peptide
  Seed: SFPEPEAAQ (PRAME_HUMAN)
SLPEPEAAM

SEQ ID NO: 155473 - protein, 9 aa, Artificial Sequence
  Description of Artificial Sequence: Synthetic peptide
  Seed: SLLQHLIGL (PRAME_HUMAN)
STLQHLIGF

SEQ ID NO: 155474 - protein, 11 aa, Artificial Sequence
  Description of Artificial Sequence: Synthetic peptide
  Seed: LLPRELFPPLF (PRAME_HUMAN)
LYPRELFPPLL

SEQ ID NO: 155475 - protein, 10 aa, Artificial Sequence
  Description of Artificial Sequence: Synthetic peptide
  Seed: SPSVSQLSVL (PRAME_HUMAN)
SQSVSQLSVF

SEQ ID NO: 155476 - protein, 10 aa, Artificial Sequence
  Description of Artificial Sequence: Synthetic peptide
  Seed: KKLKIFAMPM (PRAME_HUMAN)
KVLKIFAMPV

SEQ ID NO: 155477 - protein, 9 aa, Artificial Sequence
  Description of Artificial Sequence: Synthetic peptide
  Seed: THVLYPVPL (PRAME_HUMAN)
TRVLYPVPA

SEQ ID NO: 155478 - protein, 11 aa, Artificial Sequence
  Description of Artificial Sequence: Synthetic peptide
  Seed: LPTLAKFSPYL (PRAME_HUMAN)
LWTLAKFSPYV

SEQ ID NO: 155479 - protein, 9 aa, Artificial Sequence
  Description of Artificial Sequence: Synthetic peptide
  Seed: QTLKAMVQA (PRAME_HUMAN)
QMLKAMVQL

SEQ ID NO: 155480 - protein, 10 aa, Artificial Sequence
  Description of Artificial Sequence: Synthetic peptide
  Seed: ALYVDSLFFL (PRAME_HUMAN)
AQYVDSLFFM

SEQ ID NO: 155481 - protein, 10 aa, Artificial Sequence
  Description of Artificial Sequence: Synthetic peptide
  Seed: LKAMVQAWPF (PRAME_HUMAN)
LSAMVQAWPW

SEQ ID NO: 155482 - protein, 9 aa, Artificial Sequence
  Description of Artificial Sequence: Synthetic peptide
  Seed: LLSHIHASS (PRAME_HUMAN)
LQSHIHASL

SEQ ID NO: 155483 - protein, 9 aa, Artificial Sequence
  Description of Artificial Sequence: Synthetic peptide
  Seed: VSPEPLQAL (PRAME_HUMAN)
VIPEPLQAY

SEQ ID NO: 155484 - protein, 10 aa, Artificial Sequence
  Description of Artificial Sequence: Synthetic peptide
  Seed: RELFPPLFMA (PRAME_HUMAN)
RTLFPPLFMM

SEQ ID NO: 155485 - protein, 10 aa, Artificial Sequence
  Description of Artificial Sequence: Synthetic peptide
  Seed: FFLRGRLDQL (PRAME_HUMAN)
FCLRGRLDQV

SEQ ID NO: 155486 - protein, 10 aa, Artificial Sequence
  Description of Artificial Sequence: Synthetic peptide
  Seed: RLAYLHARLR (PRAME_HUMAN)
REAYLHARLR

SEQ ID NO: 155487 - protein, 9 aa, Artificial Sequence
  Description of Artificial Sequence: Synthetic peptide
  Seed: VFDECGITD (PRAME_HUMAN)
VFDECGITC

SEQ ID NO: 155488 - protein, 9 aa, Artificial Sequence
  Description of Artificial Sequence: Synthetic peptide
  Seed: LEVTCTWKL (PRAME_HUMAN)
LEVTCTWKY

SEQ ID NO: 155489 - protein, 9 aa, Artificial Sequence
  Description of Artificial Sequence: Synthetic peptide
  Seed: LMKGQHLHL (PRAME_HUMAN)
LFKGQHLHY

SEQ ID NO: 155490 - protein, 10 aa, Artificial Sequence
  Description of Artificial Sequence: Synthetic peptide
  Seed: SQLTTLSFYG (PRAME_HUMAN)
STLTTLSFYY

SEQ ID NO: 155491 - protein, 10 aa, Artificial Sequence
  Description of Artificial Sequence: Synthetic peptide
  Seed: IQSRYISMSV (PRAME_HUMAN)
IVSRYISMSF

SEQ ID NO: 155492 - protein, 9 aa, Artificial Sequence
  Description of Artificial Sequence: Synthetic peptide
  Seed: VQLDSIEDL (PRAME_HUMAN)
VALDSIEDV

SEQ ID NO: 155493 - protein, 10 aa, Artificial Sequence
  Description of Artificial Sequence: Synthetic peptide
  Seed: KGQHLHLETF (PRAME_HUMAN)
KSQHLHLETW

SEQ ID NO: 155494 - protein, 9 aa, Artificial Sequence
  Description of Artificial Sequence: Synthetic peptide
  Seed: LSNLTHVLY (PRAME_HUMAN)
LTNLTHVLF

SEQ ID NO: 155495 - protein, 10 aa, Artificial Sequence
  Description of Artificial Sequence: Synthetic peptide
  Seed: CSQLTTLSFY (PRAME_HUMAN)
CYQLTTLSFF

SEQ ID NO: 155496 - protein, 9 aa, Artificial Sequence
  Description of Artificial Sequence: Synthetic peptide
  Seed: LSLQCLQAL (PRAME_HUMAN)
LMLQCLQAI

SEQ ID NO: 155497 - protein, 11 aa, Artificial Sequence
  Description of Artificial Sequence: Synthetic peptide
  Seed: LQSLLQHLIGL (PRAME_HUMAN)
LESLLQHLIGV

SEQ ID NO: 155498 - protein, 8 aa, Artificial Sequence
  Description of Artificial Sequence: Synthetic peptide
  Seed: FYDPEPIL (PRAME_HUMAN)
FWDPEPIM

SEQ ID NO: 155499 - protein, 10 aa, Artificial Sequence
  Description of Artificial Sequence: Synthetic peptide
  Seed: RLWGSIQSRY (PRAME_HUMAN)
RSWGSIQSRW

SEQ ID NO: 155500 - protein, 11 aa, Artificial Sequence
  Description of Artificial Sequence: Synthetic peptide
  Seed: RELFPPLFMAA (PRAME_HUMAN)
RKLFPPLFMAV

SEQ ID NO: 155501 - protein, 10 aa, Artificial Sequence
  Description of Artificial Sequence: Synthetic peptide
  Seed: AYLHARLREL (PRAME_HUMAN)
ACLHARLREV

SEQ ID NO: 155502 - protein, 9 aa, Artificial Sequence
  Description of Artificial Sequence: Synthetic peptide
  Seed: LSLQCLQAL (PRAME_HUMAN)
LMLQCLQAA

SEQ ID NO: 155503 - protein, 9 aa, Artificial Sequence
  Description of Artificial Sequence: Synthetic peptide
  Seed: YLHARLREL (PRAME_HUMAN)
YYHARLREV

SEQ ID NO: 155504 - protein, 9 aa, Artificial Sequence
  Description of Artificial Sequence: Synthetic peptide
  Seed: LSHIHASSY (PRAME_HUMAN)
LWHIHASSM

SEQ ID NO: 155505 - protein, 9 aa, Artificial Sequence
  Description of Artificial Sequence: Synthetic peptide
  Seed: SISALQSLL (PRAME_HUMAN)
SQSALQSLW

SEQ ID NO: 155506 - protein, 10 aa, Artificial Sequence
  Description of Artificial Sequence: Synthetic peptide
  Seed: IQSRYISMSV (PRAME_HUMAN)
INSRYISMSK

SEQ ID NO: 155507 - protein, 8 aa, Artificial Sequence
  Description of Artificial Sequence: Synthetic peptide
  Seed: ITDDQLLA (PRAME_HUMAN)
IADDQLLV

SEQ ID NO: 155508 - protein, 8 aa, Artificial Sequence
  Description of Artificial Sequence: Synthetic peptide
  Seed: QAWPFTCL (PRAME_HUMAN)
QQWPFTCI

SEQ ID NO: 155509 - protein, 9 aa, Artificial Sequence
  Description of Artificial Sequence: Synthetic peptide
  Seed: ISISALQSL (PRAME_HUMAN)
IMISALQSM

SEQ ID NO: 155510 - protein, 9 aa, Artificial Sequence
  Description of Artificial Sequence: Synthetic peptide
  Seed: SVLSLSGVM (PRAME_HUMAN)
SQLSLSGVF

SEQ ID NO: 155511 - protein, 8 aa, Artificial Sequence
  Description of Artificial Sequence: Synthetic peptide
  Seed: SQLSVLSL (PRAME_HUMAN)
SQLSVLSY

SEQ ID NO: 155512 - protein, 11 aa, Artificial Sequence
  Description of Artificial Sequence: Synthetic peptide
  Seed: FSPYLGQMINL (PRAME_HUMAN)
FYPYLGQMINW

SEQ ID NO: 155513 - protein, 9 aa, Artificial Sequence
  Description of Artificial Sequence: Synthetic peptide
  Seed: SFYGNSISI (PRAME_HUMAN)
SYYGNSISW

SEQ ID NO: 155514 - protein, 9 aa, Artificial Sequence
  Description of Artificial Sequence: Synthetic peptide
  Seed: LQDLVFDEC (PRAME_HUMAN)
LFDLVFDEM

SEQ ID NO: 155515 - protein, 10 aa, Artificial Sequence
  Description of Artificial Sequence: Synthetic peptide
  Seed: DQLLALLPSL (PRAME_HUMAN)
DCLLALLPSV

SEQ ID NO: 155516 - protein, 9 aa, Artificial Sequence
  Description of Artificial Sequence: Synthetic peptide
  Seed: THVLYPVPL (PRAME_HUMAN)
THVLYPVPV

SEQ ID NO: 155517 - protein, 8 aa, Artificial Sequence
  Description of Artificial Sequence: Synthetic peptide
  Seed: LLALLPSL (PRAME_HUMAN)
LQALLPSI

SEQ ID NO: 155518 - protein, 10 aa, Artificial Sequence
  Description of Artificial Sequence: Synthetic peptide
  Seed: ETFKAVLDGL (PRAME_HUMAN)
EIFKAVLDGL

SEQ ID NO: 155519 - protein, 10 aa, Artificial Sequence
  Description of Artificial Sequence: Synthetic peptide
  Seed: AAFDGRHSQT (PRAME_HUMAN)
AIFDGRHSQY

SEQ ID NO: 155520 - protein, 8 aa, Artificial Sequence
  Description of Artificial Sequence: Synthetic peptide
  Seed: ITDDQLLA (PRAME_HUMAN)
IMDDQLLI

SEQ ID NO: 155521 - protein, 9 aa, Artificial Sequence
  Description of Artificial Sequence: Synthetic peptide
  Seed: QLLALLPSL (PRAME_HUMAN)
QILALLPSA

SEQ ID NO: 155522 - protein, 10 aa, Artificial Sequence
  Description of Artificial Sequence: Synthetic peptide
  Seed: RRWKLQVLDL (PRAME_HUMAN)
RRWKLQVLDF

SEQ ID NO: 155523 - protein, 9 aa, Artificial Sequence
  Description of Artificial Sequence: Synthetic peptide
  Seed: TDDQLLALL (PRAME_HUMAN)
TMDQLLALM

SEQ ID NO: 155524 - protein, 10 aa, Artificial Sequence
  Description of Artificial Sequence: Synthetic peptide
  Seed: RLSEGDVMHL (PRAME_HUMAN)
RMSEGDVMHF

SEQ ID NO: 155525 - protein, 8 aa, Artificial Sequence
  Description of Artificial Sequence: Synthetic peptide
  Seed: YEDIHGTL (PRAME_HUMAN)
YDDIHGTL

SEQ ID NO: 155526 - protein, 9 aa, Artificial Sequence
  Description of Artificial Sequence: Synthetic peptide
  Seed: YSFPEPEAA (PRAME_HUMAN)
YQFPEPEAF

SEQ ID NO: 155527 - protein, 10 aa, Artificial Sequence
  Description of Artificial Sequence: Synthetic peptide
  Seed: YSFPEPEAAQ (PRAME_HUMAN)
YIFPEPEAAF

SEQ ID NO: 155528 - protein, 9 aa, Artificial Sequence
  Description of Artificial Sequence: Synthetic peptide
  Seed: TDDQLLALL (PRAME_HUMAN)
TEDQLLALI

SEQ ID NO: 155529 - protein, 10 aa, Artificial Sequence
  Description of Artificial Sequence: Synthetic peptide
  Seed: AVLDGLDVLL (PRAME_HUMAN)
AQLDGLDVLI

SEQ ID NO: 155530 - protein, 9 aa, Artificial Sequence
  Description of Artificial Sequence: Synthetic peptide
  Seed: ITDDQLLAL (PRAME_HUMAN)
IMDDQLLAL

SEQ ID NO: 155531 - protein, 10 aa, Artificial Sequence
  Description of Artificial Sequence: Synthetic peptide
  Seed: RGRLDQLLRH (PRAME_HUMAN)
RMRLDQLLRL

SEQ ID NO: 155532 - protein, 9 aa, Artificial Sequence
  Description of Artificial Sequence: Synthetic peptide
  Seed: LSHIHASSY (PRAME_HUMAN)
LQHIHASSL

SEQ ID NO: 155533 - protein, 9 aa, Artificial Sequence
  Description of Artificial Sequence: Synthetic peptide
  Seed: FYDPEPILC (PRAME_HUMAN)
FNDPEPILM

SEQ ID NO: 155534 - protein, 10 aa, Artificial Sequence
  Description of Artificial Sequence: Synthetic peptide
  Seed: ERLAYLHARL (PRAME_HUMAN)
ETLAYLHARV

SEQ ID NO: 155535 - protein, 9 aa, Artificial Sequence
  Description of Artificial Sequence: Synthetic peptide
  Seed: SQSPSVSQL (PRAME_HUMAN)
SWSPSVSQF

SEQ ID NO: 155536 - protein, 10 aa, Artificial Sequence
  Description of Artificial Sequence: Synthetic peptide
  Seed: KVKRKKNVLR (PRAME_HUMAN)
KIKRKKNVLK

SEQ ID NO: 155537 - protein, 9 aa, Artificial Sequence
  Description of Artificial Sequence: Synthetic peptide
  Seed: LAIAALELL (PRAME_HUMAN)
LGIAALELW

SEQ ID NO: 155538 - protein, 10 aa, Artificial Sequence
  Description of Artificial Sequence: Synthetic peptide
  Seed: MNPLETLSIT (PRAME_HUMAN)
MAPLETLSIA

SEQ ID NO: 155539 - protein, 10 aa, Artificial Sequence
  Description of Artificial Sequence: Synthetic peptide
  Seed: MSVWTSPRRL (PRAME_HUMAN)
MTVWTSPRRW

SEQ ID NO: 155540 - protein, 9 aa, Artificial Sequence
  Description of Artificial Sequence: Synthetic peptide
  Seed: VLDGLDVLL (PRAME_HUMAN)
VFDGLDVLL

SEQ ID NO: 155541 - protein, 10 aa, Artificial Sequence
  Description of Artificial Sequence: Synthetic peptide
  Seed: YIAQFTSQFL (PRAME_HUMAN)
YAAQFTSQFV

SEQ ID NO: 155542 - protein, 10 aa, Artificial Sequence
  Description of Artificial Sequence: Synthetic peptide
  Seed: LPTLAKFSPY (PRAME_HUMAN)
LITLAKFSPW

SEQ ID NO: 155543 - protein, 10 aa, Artificial Sequence
  Description of Artificial Sequence: Synthetic peptide
  Seed: IQSRYISMSV (PRAME_HUMAN)
IHSRYISMSA

SEQ ID NO: 155544 - protein, 10 aa, Artificial Sequence
  Description of Artificial Sequence: Synthetic peptide
  Seed: KDEALAIAAL (PRAME_HUMAN)
KAEALAIAAL

SEQ ID NO: 155545 - protein, 9 aa, Artificial Sequence
  Description of Artificial Sequence: Synthetic peptide
  Seed: EDLEVTCTW (PRAME_HUMAN)
ELLEVTCTF

SEQ ID NO: 155546 - protein, 9 aa, Artificial Sequence
  Description of Artificial Sequence: Synthetic peptide
  Seed: RLRELLCEL (PRAME_HUMAN)
RVRELLCEM

SEQ ID NO: 155547 - protein, 9 aa, Artificial Sequence
  Description of Artificial Sequence: Synthetic peptide
  Seed: ITDDQLLAL (PRAME_HUMAN)
INDDQLLAY

SEQ ID NO: 155548 - protein, 10 aa, Artificial Sequence
  Description of Artificial Sequence: Synthetic peptide
  Seed: YEDIHGTLHL (PRAME_HUMAN)
YVDIHGTLHI

SEQ ID NO: 155549 - protein, 9 aa, Artificial Sequence
  Description of Artificial Sequence: Synthetic peptide
  Seed: ALELLPREL (PRAME_HUMAN)
AFELLPREM

SEQ ID NO: 155550 - protein, 9 aa, Artificial Sequence
  Description of Artificial Sequence: Synthetic peptide
  Seed: ALLPSLSHC (PRAME_HUMAN)
ALLPSLSHL

SEQ ID NO: 155551 - protein, 10 aa, Artificial Sequence
  Description of Artificial Sequence: Synthetic peptide
  Seed: RLAYLHARLR (PRAME_HUMAN)
RSAYLHARLK

SEQ ID NO: 155552 - protein, 10 aa, Artificial Sequence
  Description of Artificial Sequence: Synthetic peptide
  Seed: AMVQAWPFTC (PRAME_HUMAN)
AFVQAWPFTV

SEQ ID NO: 155553 - protein, 9 aa, Artificial Sequence
  Description of Artificial Sequence: Synthetic peptide
  Seed: LQHLIGLSN (PRAME_HUMAN)
LQHLIGLSH

SEQ ID NO: 155554 - protein, 9 aa, Artificial Sequence
  Description of Artificial Sequence: Synthetic peptide
  Seed: ACDELFSYL (PRAME_HUMAN)
AWDELFSYF

SEQ ID NO: 155555 - protein, 9 aa, Artificial Sequence
  Description of Artificial Sequence: Synthetic peptide
  Seed: VFDECGITD (PRAME_HUMAN)
VHDECGITF

SEQ ID NO: 155556 - protein, 9 aa, Artificial Sequence
  Description of Artificial Sequence: Synthetic peptide
  Seed: DGRHSQTLK (PRAME_HUMAN)
DWRHSQTLR

SEQ ID NO: 155557 - protein, 10 aa, Artificial Sequence
  Description of Artificial Sequence: Synthetic peptide
  Seed: LLSHIHASSY (PRAME_HUMAN)
LASHIHASSW

SEQ ID NO: 155558 - protein, 10 aa, Artificial Sequence
  Description of Artificial Sequence: Synthetic peptide
  Seed: LLLSHIHASS (PRAME_HUMAN)
LKLSHIHASL

SEQ ID NO: 155559 - protein, 11 aa, Artificial Sequence
  Description of Artificial Sequence: Synthetic peptide
  Seed: LLLSHIHASSY (PRAME_HUMAN)
LVLSHIHASSW

SEQ ID NO: 155560 - protein, 9 aa, Artificial Sequence
  Description of Artificial Sequence: Synthetic peptide
  Seed: KEEQYIAQF (PRAME_HUMAN)
KAEQYIAQY

SEQ ID NO: 155561 - protein, 11 aa, Artificial Sequence
  Description of Artificial Sequence: Synthetic peptide
  Seed: QALYVDSLFFL (PRAME_HUMAN)
QFLYVDSLFFL

SEQ ID NO: 155562 - protein, 10 aa, Artificial Sequence
  Description of Artificial Sequence: Synthetic peptide
  Seed: LSFYGNSISI (PRAME_HUMAN)
LVFYGNSISV

SEQ ID NO: 155563 - protein, 9 aa, Artificial Sequence
  Description of Artificial Sequence: Synthetic peptide
  Seed: LLLSHIHAS (PRAME_HUMAN)
LMLSHIHAV

SEQ ID NO: 155564 - protein, 9 aa, Artificial Sequence
  Description of Artificial Sequence: Synthetic peptide
  Seed: RGRLDQLLR (PRAME_HUMAN)
RWRLDQLLR

SEQ ID NO: 155565 - protein, 10 aa, Artificial Sequence
  Description of Artificial Sequence: Synthetic peptide
  Seed: SPYLGQMINL (PRAME_HUMAN)
SFYLGQMINI

SEQ ID NO: 155566 - protein, 9 aa, Artificial Sequence
  Description of Artificial Sequence: Synthetic peptide
  Seed: THVLYPVPL (PRAME_HUMAN)
TEVLYPVPY

SEQ ID NO: 155567 - protein, 11 aa, Artificial Sequence
  Description of Artificial Sequence: Synthetic peptide
  Seed: NSISISALQSL (PRAME_HUMAN)
NSISISALQSW

SEQ ID NO: 155568 - protein, 10 aa, Artificial Sequence
  Description of Artificial Sequence: Synthetic peptide
  Seed: AQFTSQFLSL (PRAME_HUMAN)
ATFTSQFLSF

SEQ ID NO: 155569 - protein, 10 aa, Artificial Sequence
  Description of Artificial Sequence: Synthetic peptide
  Seed: ITDDQLLALL (PRAME_HUMAN)
IFDDQLLALV

SEQ ID NO: 155570 - protein, 9 aa, Artificial Sequence
  Description of Artificial Sequence: Synthetic peptide
  Seed: YEDIHGTLH (PRAME_HUMAN)
YEDIHGTLT

SEQ ID NO: 155571 - protein, 11 aa, Artificial Sequence
  Description of Artificial Sequence: Synthetic peptide
  Seed: QALYVDSLFFL (PRAME_HUMAN)
QVLYVDSLFFL

SEQ ID NO: 155572 - protein, 9 aa, Artificial Sequence
  Description of Artificial Sequence: Synthetic peptide
  Seed: HVMNPLETL (PRAME_HUMAN)
HLMNPLETR

SEQ ID NO: 155573 - protein, 9 aa, Artificial Sequence
  Description of Artificial Sequence: Synthetic peptide
  Seed: RLRELLCEL (PRAME_HUMAN)
RRRELLCEM

SEQ ID NO: 155574 - protein, 9 aa, Artificial Sequence
  Description of Artificial Sequence: Synthetic peptide
  Seed: LSLQCLQAL (PRAME_HUMAN)
LTLQCLQAI

SEQ ID NO: 155575 - protein, 9 aa, Artificial Sequence
  Description of Artificial Sequence: Synthetic peptide
  Seed: QDIKMILKM (PRAME_HUMAN)
QEIKMILKI

SEQ ID NO: 155576 - protein, 10 aa, Artificial Sequence
  Description of Artificial Sequence: Synthetic peptide
  Seed: LSFYGNSISI (PRAME_HUMAN)
LEFYGNSISF

SEQ ID NO: 155577 - protein, 9 aa, Artificial Sequence
  Description of Artificial Sequence: Synthetic peptide
  Seed: AVLDGLDVL (PRAME_HUMAN)
AMLDGLDVY

SEQ ID NO: 155578 - protein, 9 aa, Artificial Sequence
  Description of Artificial Sequence: Synthetic peptide
  Seed: HLHLETFKA (PRAME_HUMAN)
HLHLETFKL

SEQ ID NO: 155579 - protein, 9 aa, Artificial Sequence
  Description of Artificial Sequence: Synthetic peptide
  Seed: LLLSHIHAS (PRAME_HUMAN)
LILSHIHAA

SEQ ID NO: 155580 - protein, 10 aa, Artificial Sequence
  Description of Artificial Sequence: Synthetic peptide
  Seed: LLLSHIHASS (PRAME_HUMAN)
LKLSHIHASV

SEQ ID NO: 155581 - protein, 11 aa, Artificial Sequence
  Description of Artificial Sequence: Synthetic peptide
  Seed: RASATLQDLVF (PRAME_HUMAN)
RKSATLQDLVY

SEQ ID NO: 155582 - protein, 10 aa, Artificial Sequence
  Description of Artificial Sequence: Synthetic peptide
  Seed: MERRRLWGSI (PRAME_HUMAN)
MGRRRLWGSL

SEQ ID NO: 155583 - protein, 10 aa, Artificial Sequence
  Description of Artificial Sequence: Synthetic peptide
  Seed: TSQFLSLQCL (PRAME_HUMAN)
TLQFLSLQCF

SEQ ID NO: 155584 - protein, 9 aa, Artificial Sequence
  Description of Artificial Sequence: Synthetic peptide
  Seed: AEQPFIPVE (PRAME_HUMAN)
AEQPFIPVW

SEQ ID NO: 155585 - protein, 10 aa, Artificial Sequence
  Description of Artificial Sequence: Synthetic peptide
  Seed: ERLAYLHARL (PRAME_HUMAN)
EVLAYLHARI

SEQ ID NO: 155586 - protein, 9 aa, Artificial Sequence
  Description of Artificial Sequence: Synthetic peptide
  Seed: EDLEVTCTW (PRAME_HUMAN)
EALEVTCTW

SEQ ID NO: 155587 - protein, 11 aa, Artificial Sequence
  Description of Artificial Sequence: Synthetic peptide
  Seed: GTLHLERLAYL (PRAME_HUMAN)
GYLHLERLAYV

SEQ ID NO: 155588 - protein, 10 aa, Artificial Sequence
  Description of Artificial Sequence: Synthetic peptide
  Seed: SLLKDEALAI (PRAME_HUMAN)
SLLKDEALAL

SEQ ID NO: 155589 - protein, 9 aa, Artificial Sequence
  Description of Artificial Sequence: Synthetic peptide
  Seed: YIAQFTSQF (PRAME_HUMAN)
YLAQFTSQC

SEQ ID NO: 155590 - protein, 9 aa, Artificial Sequence
  Description of Artificial Sequence: Synthetic peptide
  Seed: SYEDIHGTL (PRAME_HUMAN)
SREDIHGTY

SEQ ID NO: 155591 - protein, 10 aa, Artificial Sequence
  Description of Artificial Sequence: Synthetic peptide
  Seed: VTCTWKLPTL (PRAME_HUMAN)
VMCTWKLPTL

SEQ ID NO: 155592 - protein, 10 aa, Artificial Sequence
  Description of Artificial Sequence: Synthetic peptide
  Seed: IGLSNLTHVL (PRAME_HUMAN)
IALSNLTHVL

SEQ ID NO: 155593 - protein, 10 aa, Artificial Sequence
  Description of Artificial Sequence: Synthetic peptide
  Seed: SNLTHVLYPV (PRAME_HUMAN)
SPLTHVLYPI

SEQ ID NO: 155594 - protein, 9 aa, Artificial Sequence
  Description of Artificial Sequence: Synthetic peptide
  Seed: VSQLSVLSL (PRAME_HUMAN)
VQQLSVLSI

SEQ ID NO: 155595 - protein, 10 aa, Artificial Sequence
  Description of Artificial Sequence: Synthetic peptide
  Seed: LLPRELFPPL (PRAME_HUMAN)
LPPRELFPPI

SEQ ID NO: 155596 - protein, 10 aa, Artificial Sequence
  Description of Artificial Sequence: Synthetic peptide
  Seed: MPMQDIKMIL (PRAME_HUMAN)
MLMQDIKMIM

SEQ ID NO: 155597 - protein, 10 aa, Artificial Sequence
  Description of Artificial Sequence: Synthetic peptide
  Seed: SPSVSQLSVL (PRAME_HUMAN)
SSSVSQLSVW

SEQ ID NO: 155598 - protein, 10 aa, Artificial Sequence
  Description of Artificial Sequence: Synthetic peptide
  Seed: VELAGQSLLK (PRAME_HUMAN)
VHLAGQSLLK

SEQ ID NO: 155599 - protein, 10 aa, Artificial Sequence
  Description of Artificial Sequence: Synthetic peptide
  Seed: MERRRLWGSI (PRAME_HUMAN)
MIRRRLWGSF

SEQ ID NO: 155600 - protein, 9 aa, Artificial Sequence
  Description of Artificial Sequence: Synthetic peptide
  Seed: RPSMVWLSA (PRAME_HUMAN)
RPSMVWLSF

SEQ ID NO: 155601 - protein, 10 aa, Artificial Sequence
  Description of Artificial Sequence: Synthetic peptide
  Seed: AQFTSQFLSL (PRAME_HUMAN)
AIFTSQFLSY

SEQ ID NO: 155602 - protein, 9 aa, Artificial Sequence
  Description of Artificial Sequence: Synthetic peptide
  Seed: SRYISMSVW (PRAME_HUMAN)
SKYISMSVV

SEQ ID NO: 155603 - protein, 9 aa, Artificial Sequence
  Description of Artificial Sequence: Synthetic peptide
  Seed: TCTWKLPTL (PRAME_HUMAN)
TATWKLPTF

SEQ ID NO: 155604 - protein, 9 aa, Artificial Sequence
  Description of Artificial Sequence: Synthetic peptide
  Seed: SYEDIHGTL (PRAME_HUMAN)
SAEDIHGTV

SEQ ID NO: 155605 - protein, 9 aa, Artificial Sequence
  Description of Artificial Sequence: Synthetic peptide
  Seed: HLIGLSNLT (PRAME_HUMAN)
HMIGLSNLV

SEQ ID NO: 155606 - protein, 9 aa, Artificial Sequence
  Description of Artificial Sequence: Synthetic peptide
  Seed: SFYGNSISI (PRAME_HUMAN)
STYGNSISV

SEQ ID NO: 155607 - protein, 9 aa, Artificial Sequence
  Description of Artificial Sequence: Synthetic peptide
  Seed: SQLTTLSFY (PRAME_HUMAN)
SSLTTLSFF

SEQ ID NO: 155608 - protein, 10 aa, Artificial Sequence
  Description of Artificial Sequence: Synthetic peptide
  Seed: ALAIAALELL (PRAME_HUMAN)
ALAIAALELV

SEQ ID NO: 155609 - protein, 10 aa, Artificial Sequence
  Description of Artificial Sequence: Synthetic peptide
  Seed: KNVLRLCCKK (PRAME_HUMAN)
KQVLRLCCKR

SEQ ID NO: 155610 - protein, 9 aa, Artificial Sequence
  Description of Artificial Sequence: Synthetic peptide
  Seed: EAAQPMTKK (PRAME_HUMAN)
EVAQPMTKY

SEQ ID NO: 155611 - protein, 9 aa, Artificial Sequence
  Description of Artificial Sequence: Synthetic peptide
  Seed: ALAIAALEL (PRAME_HUMAN)
AMAIAALEM

SEQ ID NO: 155612 - protein, 9 aa, Artificial Sequence
  Description of Artificial Sequence: Synthetic peptide
  Seed: LSTEAEQPF (PRAME_HUMAN)
LPTEAEQPM

SEQ ID NO: 155613 - protein, 11 aa, Artificial Sequence
  Description of Artificial Sequence: Synthetic peptide
  Seed: EDIHGTLHLER (PRAME_HUMAN)
EIIHGTLHLER

SEQ ID NO: 155614 - protein, 9 aa, Artificial Sequence
  Description of Artificial Sequence: Synthetic peptide
  Seed: MHLSQSPSV (PRAME_HUMAN)
MQLSQSPSV

SEQ ID NO: 155615 - protein, 10 aa, Artificial Sequence
  Description of Artificial Sequence: Synthetic peptide
  Seed: FIPVEVLVDL (PRAME_HUMAN)
FDPVEVLVDM

SEQ ID NO: 155616 - protein, 10 aa, Artificial Sequence
  Description of Artificial Sequence: Synthetic peptide
  Seed: KKLKIFAMPM (PRAME_HUMAN)
KHLKIFAMPF

SEQ ID NO: 155617 - protein, 10 aa, Artificial Sequence
  Description of Artificial Sequence: Synthetic peptide
  Seed: FFLRGRLDQL (PRAME_HUMAN)
FMLRGRLDQA

SEQ ID NO: 155618 - protein, 10 aa, Artificial Sequence
  Description of Artificial Sequence: Synthetic peptide
  Seed: LQALYVDSLF (PRAME_HUMAN)
LVALYVDSLW

SEQ ID NO: 155619 - protein, 10 aa, Artificial Sequence
  Description of Artificial Sequence: Synthetic peptide
  Seed: RASATLQDLV (PRAME_HUMAN)
RTSATLQDLF

SEQ ID NO: 155620 - protein, 8 aa, Artificial Sequence
  Description of Artificial Sequence: Synthetic peptide
  Seed: YEDIHGTL (PRAME_HUMAN)
YGDIHGTI

SEQ ID NO: 155621 - protein, 10 aa, Artificial Sequence
  Description of Artificial Sequence: Synthetic peptide
  Seed: RASATLQDLV (PRAME_HUMAN)
RVSATLQDLF

SEQ ID NO: 155622 - protein, 10 aa, Artificial Sequence
  Description of Artificial Sequence: Synthetic peptide
  Seed: FFLRGRLDQL (PRAME_HUMAN)
FWLRGRLDQL

SEQ ID NO: 155623 - protein, 10 aa, Artificial Sequence
  Description of Artificial Sequence: Synthetic peptide
  Seed: LLSHIHASSY (PRAME_HUMAN)
LDSHIHASSW

SEQ ID NO: 155624 - protein, 10 aa, Artificial Sequence
  Description of Artificial Sequence: Synthetic peptide
  Seed: LYVDSLFFLR (PRAME_HUMAN)
LFVDSLFFLK

SEQ ID NO: 155625 - protein, 10 aa, Artificial Sequence
  Description of Artificial Sequence: Synthetic peptide
  Seed: RTFYDPEPIL (PRAME_HUMAN)
RAFYDPEPIF

SEQ ID NO: 155626 - protein, 9 aa, Artificial Sequence
  Description of Artificial Sequence: Synthetic peptide
  Seed: HVMNPLETL (PRAME_HUMAN)
HAMNPLETY

SEQ ID NO: 155627 - protein, 10 aa, Artificial Sequence
  Description of Artificial Sequence: Synthetic peptide
  Seed: FIPVEVLVDL (PRAME_HUMAN)
FLPVEVLVDL

SEQ ID NO: 155628 - protein, 10 aa, Artificial Sequence
  Description of Artificial Sequence: Synthetic peptide
  Seed: VELAGQSLLK (PRAME_HUMAN)
VFLAGQSLLK

SEQ ID NO: 155629 - protein, 10 aa, Artificial Sequence
  Description of Artificial Sequence: Synthetic peptide
  Seed: ELFSYLIEKV (PRAME_HUMAN)
ETFSYLIEKV

SEQ ID NO: 155630 - protein, 9 aa, Artificial Sequence
  Description of Artificial Sequence: Synthetic peptide
  Seed: SISALQSLL (PRAME_HUMAN)
SMSALQSLM

SEQ ID NO: 155631 - protein, 9 aa, Artificial Sequence
  Description of Artificial Sequence: Synthetic peptide
  Seed: KNVLRLCCK (PRAME_HUMAN)
KQVLRLCCR

SEQ ID NO: 155632 - protein, 10 aa, Artificial Sequence
  Description of Artificial Sequence: Synthetic peptide
  Seed: EDLEVTCTWK (PRAME_HUMAN)
EVLEVTCTWK

SEQ ID NO: 155633 - protein, 9 aa, Artificial Sequence
  Description of Artificial Sequence: Synthetic peptide
  Seed: KLKIFAMPM (PRAME_HUMAN)
KMKIFAMPT

SEQ ID NO: 155634 - protein, 10 aa, Artificial Sequence
  Description of Artificial Sequence: Synthetic peptide
  Seed: GITDDQLLAL (PRAME_HUMAN)
GMTDDQLLAI

SEQ ID NO: 155635 - protein, 9 aa, Artificial Sequence
  Description of Artificial Sequence: Synthetic peptide
  Seed: LMKGQHLHL (PRAME_HUMAN)
LPKGQHLHF

SEQ ID NO: 155636 - protein, 10 aa, Artificial Sequence
  Description of Artificial Sequence: Synthetic peptide
  Seed: LPTLAKFSPY (PRAME_HUMAN)
LDTLAKFSPF

SEQ ID NO: 155637 - protein, 9 aa, Artificial Sequence
  Description of Artificial Sequence: Synthetic peptide
  Seed: LQALYVDSL (PRAME_HUMAN)
LSALYVDSF

SEQ ID NO: 155638 - protein, 10 aa, Artificial Sequence
  Description of Artificial Sequence: Synthetic peptide
  Seed: FAMPMQDIKM (PRAME_HUMAN)
FTMPMQDIKI

SEQ ID NO: 155639 - protein, 10 aa, Artificial Sequence
  Description of Artificial Sequence: Synthetic peptide
  Seed: RYISMSVWTS (PRAME_HUMAN)
RQISMSVWTF

SEQ ID NO: 155640 - protein, 9 aa, Artificial Sequence
  Description of Artificial Sequence: Synthetic peptide
  Seed: SQLTTLSFY (PRAME_HUMAN)
SILTTLSFY

SEQ ID NO: 155641 - protein, 9 aa, Artificial Sequence
  Description of Artificial Sequence: Synthetic peptide
  Seed: FYDPEPILC (PRAME_HUMAN)
FFDPEPILT

SEQ ID NO: 155642 - protein, 9 aa, Artificial Sequence
  Description of Artificial Sequence: Synthetic peptide
  Seed: SALQSLLQH (PRAME_HUMAN)
SILQSLLQF

SEQ ID NO: 155643 - protein, 9 aa, Artificial Sequence
  Description of Artificial Sequence: Synthetic peptide
  Seed: MINLRRLLL (PRAME_HUMAN)
MANLRRLLA

SEQ ID NO: 155644 - protein, 10 aa, Artificial Sequence
  Description of Artificial Sequence: Synthetic peptide
  Seed: LLLSHIHASS (PRAME_HUMAN)
LRLSHIHASA

SEQ ID NO: 155645 - protein, 10 aa, Artificial Sequence
  Description of Artificial Sequence: Synthetic peptide
  Seed: FLSLQCLQAL (PRAME_HUMAN)
FVSLQCLQAV

SEQ ID NO: 155646 - protein, 9 aa, Artificial Sequence
  Description of Artificial Sequence: Synthetic peptide
  Seed: KVKRKKNVL (PRAME_HUMAN)
KYKRKKNVK

SEQ ID NO: 155647 - protein, 9 aa, Artificial Sequence
  Description of Artificial Sequence: Synthetic peptide
  Seed: SQLTTLSFY (PRAME_HUMAN)
SALTTLSFF

SEQ ID NO: 155648 - protein, 9 aa, Artificial Sequence
  Description of Artificial Sequence: Synthetic peptide
  Seed: GQHLHLETF (PRAME_HUMAN)
GDHLHLETV

SEQ ID NO: 155649 - protein, 9 aa, Artificial Sequence
  Description of Artificial Sequence: Synthetic peptide
  Seed: HARLRELLC (PRAME_HUMAN)
HPRLRELLV

SEQ ID NO: 155650 - protein, 8 aa, Artificial Sequence
  Description of Artificial Sequence: Synthetic peptide
  Seed: ITDDQLLA (PRAME_HUMAN)
ITDDQLLF

SEQ ID NO: 155651 - protein, 10 aa, Artificial Sequence
  Description of Artificial Sequence: Synthetic peptide
  Seed: ITDDQLLALL (PRAME_HUMAN)
IYDDQLLALI

SEQ ID NO: 155652 - protein, 9 aa, Artificial Sequence
  Description of Artificial Sequence: Synthetic peptide
  Seed: LLRHVMNPL (PRAME_HUMAN)
LKRHVMNPF

SEQ ID NO: 155653 - protein, 9 aa, Artificial Sequence
  Description of Artificial Sequence: Synthetic peptide
  Seed: VQAWPFTCL (PRAME_HUMAN)
VMAWPFTCL

SEQ ID NO: 155654 - protein, 8 aa, Artificial Sequence
  Description of Artificial Sequence: Synthetic peptide
  Seed: FYDPEPIL (PRAME_HUMAN)
FLDPEPIL

SEQ ID NO: 155655 - protein, 10 aa, Artificial Sequence
  Description of Artificial Sequence: Synthetic peptide
  Seed: AEQPFIPVEV (PRAME_HUMAN)
AEQPFIPVEF

SEQ ID NO: 155656 - protein, 10 aa, Artificial Sequence
  Description of Artificial Sequence: Synthetic peptide
  Seed: SPYLGQMINL (PRAME_HUMAN)
SSYLGQMINW

SEQ ID NO: 155657 - protein, 10 aa, Artificial Sequence
  Description of Artificial Sequence: Synthetic peptide
  Seed: YIAQFTSQFL (PRAME_HUMAN)
YIAQFTSQFM

SEQ ID NO: 155658 - protein, 9 aa, Artificial Sequence
  Description of Artificial Sequence: Synthetic peptide
  Seed: LYPVPLESY (PRAME_HUMAN)
LWPVPLESF

SEQ ID NO: 155659 - protein, 10 aa, Artificial Sequence
  Description of Artificial Sequence: Synthetic peptide
  Seed: LPRELFPPLF (PRAME_HUMAN)
LPRELFPPLL

SEQ ID NO: 155660 - protein, 10 aa, Artificial Sequence
  Description of Artificial Sequence: Synthetic peptide
  Seed: SALQSLLQHL (PRAME_HUMAN)
SYLQSLLQHV

SEQ ID NO: 155661 - protein, 11 aa, Artificial Sequence
  Description of Artificial Sequence: Synthetic peptide
  Seed: AAFDGRHSQTL (PRAME_HUMAN)
ARFDGRHSQTY

SEQ ID NO: 155662 - protein, 9 aa, Artificial Sequence
  Description of Artificial Sequence: Synthetic peptide
  Seed: THVLYPVPL (PRAME_HUMAN)
TYVLYPVPF

SEQ ID NO: 155663 - protein, 9 aa, Artificial Sequence
  Description of Artificial Sequence: Synthetic peptide
  Seed: KMILKMVQL (PRAME_HUMAN)
KLILKMVQV

SEQ ID NO: 155664 - protein, 10 aa, Artificial Sequence
  Description of Artificial Sequence: Synthetic peptide
  Seed: LLPRELFPPL (PRAME_HUMAN)
LQPRELFPPL

SEQ ID NO: 155665 - protein, 10 aa, Artificial Sequence
  Description of Artificial Sequence: Synthetic peptide
  Seed: ARLRELLCEL (PRAME_HUMAN)
AHLRELLCEA

SEQ ID NO: 155666 - protein, 9 aa, Artificial Sequence
  Description of Artificial Sequence: Synthetic peptide
  Seed: SFYGNSISI (PRAME_HUMAN)
SQYGNSISA

SEQ ID NO: 155667 - protein, 9 aa, Artificial Sequence
  Description of Artificial Sequence: Synthetic peptide
  Seed: KMILKMVQL (PRAME_HUMAN)
KSILKMVQY

SEQ ID NO: 155668 - protein, 9 aa, Artificial Sequence
  Description of Artificial Sequence: Synthetic peptide
  Seed: VQLDSIEDL (PRAME_HUMAN)
VLLDSIEDL

SEQ ID NO: 155669 - protein, 10 aa, Artificial Sequence
  Description of Artificial Sequence: Synthetic peptide
  Seed: FIPVEVLVDL (PRAME_HUMAN)
FQPVEVLVDY

SEQ ID NO: 155670 - protein, 9 aa, Artificial Sequence
  Description of Artificial Sequence: Synthetic peptide
  Seed: KLKIFAMPM (PRAME_HUMAN)
KQKIFAMPK

SEQ ID NO: 155671 - protein, 10 aa, Artificial Sequence
  Description of Artificial Sequence: Synthetic peptide
  Seed: MERRRLWGSI (PRAME_HUMAN)
MLRRRLWGSA

SEQ ID NO: 155672 - protein, 10 aa, Artificial Sequence
  Description of Artificial Sequence: Synthetic peptide
  Seed: LERLAYLHAR (PRAME_HUMAN)
LNRLAYLHAK

SEQ ID NO: 155673 - protein, 9 aa, Artificial Sequence
  Description of Artificial Sequence: Synthetic peptide
  Seed: VLDGLDVLL (PRAME_HUMAN)
VMDGLDVLM

SEQ ID NO: 155674 - protein, 10 aa, Artificial Sequence
  Description of Artificial Sequence: Synthetic peptide
  Seed: LYVDSLFFLR (PRAME_HUMAN)
LYVDSLFFLK

SEQ ID NO: 155675 - protein, 10 aa, Artificial Sequence
  Description of Artificial Sequence: Synthetic peptide
  Seed: GQMINLRRLL (PRAME_HUMAN)
GRMINLRRLI

SEQ ID NO: 155676 - protein, 9 aa, Artificial Sequence
  Description of Artificial Sequence: Synthetic peptide
  Seed: FYDPEPILC (PRAME_HUMAN)
FLDPEPILM

SEQ ID NO: 155677 - protein, 9 aa, Artificial Sequence
  Description of Artificial Sequence: Synthetic peptide
  Seed: YISMSVWTS (PRAME_HUMAN)
YLSMSVWTM

SEQ ID NO: 155678 - protein, 10 aa, Artificial Sequence
  Description of Artificial Sequence: Synthetic peptide
  Seed: LSFYGNSISI (PRAME_HUMAN)
LDFYGNSISF

SEQ ID NO: 155679 - protein, 9 aa, Artificial Sequence
  Description of Artificial Sequence: Synthetic peptide
  Seed: KLKIFAMPM (PRAME_HUMAN)
KQKIFAMPR

SEQ ID NO: 155680 - protein, 9 aa, Artificial Sequence
  Description of Artificial Sequence: Synthetic peptide
  Seed: LFMAAFDGR (PRAME_HUMAN)
LAMAAFDGR

SEQ ID NO: 155681 - protein, 9 aa, Artificial Sequence
  Description of Artificial Sequence: Synthetic peptide
  Seed: FYDPEPILC (PRAME_HUMAN)
FRDPEPILF

SEQ ID NO: 155682 - protein, 9 aa, Artificial Sequence
  Description of Artificial Sequence: Synthetic peptide
  Seed: LGRPSMVWL (PRAME_HUMAN)
LMRPSMVWK

SEQ ID NO: 155683 - protein, 9 aa, Artificial Sequence
  Description of Artificial Sequence: Synthetic peptide
  Seed: DELFSYLIE (PRAME_HUMAN)
DELFSYLIY

SEQ ID NO: 155684 - protein, 10 aa, Artificial Sequence
  Description of Artificial Sequence: Synthetic peptide
  Seed: IGLSNLTHVL (PRAME_HUMAN)
IMLSNLTHVL

SEQ ID NO: 155685 - protein, 9 aa, Artificial Sequence
  Description of Artificial Sequence: Synthetic peptide
  Seed: SQSPSVSQL (PRAME_HUMAN)
SISPSVSQW

SEQ ID NO: 155686 - protein, 9 aa, Artificial Sequence
  Description of Artificial Sequence: Synthetic peptide
  Seed: RELFPPLFM (PRAME_HUMAN)
RQLFPPLFL

SEQ ID NO: 155687 - protein, 10 aa, Artificial Sequence
  Description of Artificial Sequence: Synthetic peptide
  Seed: LLLSHIHASS (PRAME_HUMAN)
LDLSHIHASI

SEQ ID NO: 155688 - protein, 11 aa, Artificial Sequence
  Description of Artificial Sequence: Synthetic peptide
  Seed: SNLTHVLYPVP (PRAME_HUMAN)
SLLTHVLYPVT

SEQ ID NO: 155689 - protein, 9 aa, Artificial Sequence
  Description of Artificial Sequence: Synthetic peptide
  Seed: WSGNRASLY (PRAME_HUMAN)
WAGNRASLM

SEQ ID NO: 155690 - protein, 10 aa, Artificial Sequence
  Description of Artificial Sequence: Synthetic peptide
  Seed: SEGDVMHLSQ (PRAME_HUMAN)
SEGDVMHLSA

SEQ ID NO: 155691 - protein, 10 aa, Artificial Sequence
  Description of Artificial Sequence: Synthetic peptide
  Seed: RGRLDQLLRH (PRAME_HUMAN)
RPRLDQLLRK

SEQ ID NO: 155692 - protein, 9 aa, Artificial Sequence
  Description of Artificial Sequence: Synthetic peptide
  Seed: LSEGDVMHL (PRAME_HUMAN)
LFEGDVMHF

SEQ ID NO: 155693 - protein, 10 aa, Artificial Sequence
  Description of Artificial Sequence: Synthetic peptide
  Seed: LSLQCLQALY (PRAME_HUMAN)
LMLQCLQALF

SEQ ID NO: 155694 - protein, 9 aa, Artificial Sequence
  Description of Artificial Sequence: Synthetic peptide
  Seed: SALQSLLQH (PRAME_HUMAN)
SMLQSLLQK

SEQ ID NO: 155695 - protein, 9 aa, Artificial Sequence
  Description of Artificial Sequence: Synthetic peptide
  Seed: ETLSITNCR (PRAME_HUMAN)
ESLSITNCR

SEQ ID NO: 155696 - protein, 10 aa, Artificial Sequence
  Description of Artificial Sequence: Synthetic peptide
  Seed: RLWGSIQSRY (PRAME_HUMAN)
RQWGSIQSRR

SEQ ID NO: 155697 - protein, 8 aa, Artificial Sequence
  Description of Artificial Sequence: Synthetic peptide
  Seed: VSPEPLQA (PRAME_HUMAN)
VLPEPLQL

SEQ ID NO: 155698 - protein, 10 aa, Artificial Sequence
  Description of Artificial Sequence: Synthetic peptide
  Seed: RLSEGDVMHL (PRAME_HUMAN)
RYSEGDVMHF

SEQ ID NO: 155699 - protein, 9 aa, Artificial Sequence
  Description of Artificial Sequence: Synthetic peptide
  Seed: ALYVDSLFF (PRAME_HUMAN)
AVYVDSLFW

SEQ ID NO: 155700 - protein, 9 aa, Artificial Sequence
  Description of Artificial Sequence: Synthetic peptide
  Seed: MVQAWPFTC (PRAME_HUMAN)
MQQAWPFTA

SEQ ID NO: 155701 - protein, 9 aa, Artificial Sequence
  Description of Artificial Sequence: Synthetic peptide
  Seed: ITDDQLLAL (PRAME_HUMAN)
ITDDQLLAA

SEQ ID NO: 155702 - protein, 10 aa, Artificial Sequence
  Description of Artificial Sequence: Synthetic peptide
  Seed: YISPEKEEQY (PRAME_HUMAN)
YLSPEKEEQW

SEQ ID NO: 155703 - protein, 10 aa, Artificial Sequence
  Description of Artificial Sequence: Synthetic peptide
  Seed: MNPLETLSIT (PRAME_HUMAN)
MMPLETLSIA

SEQ ID NO: 155704 - protein, 10 aa, Artificial Sequence
  Description of Artificial Sequence: Synthetic peptide
  Seed: HASSYISPEK (PRAME_HUMAN)
HKSSYISPER

SEQ ID NO: 155705 - protein, 9 aa, Artificial Sequence
  Description of Artificial Sequence: Synthetic peptide
  Seed: MINLRRLLL (PRAME_HUMAN)
MINLRRLLF

SEQ ID NO: 155706 - protein, 10 aa, Artificial Sequence
  Description of Artificial Sequence: Synthetic peptide
  Seed: ALYVDSLFFL (PRAME_HUMAN)
ACYVDSLFFW

SEQ ID NO: 155707 - protein, 9 aa, Artificial Sequence
  Description of Artificial Sequence: Synthetic peptide
  Seed: KMILKMVQL (PRAME_HUMAN)
KTILKMVQI

SEQ ID NO: 155708 - protein, 9 aa, Artificial Sequence
  Description of Artificial Sequence: Synthetic peptide
  Seed: LSVLSLSGV (PRAME_HUMAN)
LSVLSLSGL

SEQ ID NO: 155709 - protein, 9 aa, Artificial Sequence
  Description of Artificial Sequence: Synthetic peptide
  Seed: ALQSLLQHL (PRAME_HUMAN)
AQQSLLQHW

SEQ ID NO: 155710 - protein, 9 aa, Artificial Sequence
  Description of Artificial Sequence: Synthetic peptide
  Seed: KAMVQAWPF (PRAME_HUMAN)
KIMVQAWPL

SEQ ID NO: 155711 - protein, 9 aa, Artificial Sequence
  Description of Artificial Sequence: Synthetic peptide
  Seed: SQFLSLQCL (PRAME_HUMAN)
SRFLSLQCI

SEQ ID NO: 155712 - protein, 10 aa, Artificial Sequence
  Description of Artificial Sequence: Synthetic peptide
  Seed: AVLDGLDVLL (PRAME_HUMAN)
ATLDGLDVLV

SEQ ID NO: 155713 - protein, 9 aa, Artificial Sequence
  Description of Artificial Sequence: Synthetic peptide
  Seed: YIAQFTSQF (PRAME_HUMAN)
YVAQFTSQT

SEQ ID NO: 155714 - protein, 10 aa, Artificial Sequence
  Description of Artificial Sequence: Synthetic peptide
  Seed: SNLTHVLYPV (PRAME_HUMAN)
SILTHVLYPI

SEQ ID NO: 155715 - protein, 10 aa, Artificial Sequence
  Description of Artificial Sequence: Synthetic peptide
  Seed: SVSQLSVLSL (PRAME_HUMAN)
SQSQLSVLSL

SEQ ID NO: 155716 - protein, 9 aa, Artificial Sequence
  Description of Artificial Sequence: Synthetic peptide
  Seed: RELFPPLFM (PRAME_HUMAN)
RLLFPPLFY

SEQ ID NO: 155717 - protein, 9 aa, Artificial Sequence
  Description of Artificial Sequence: Synthetic peptide
  Seed: VLYPVPLES (PRAME_HUMAN)
VLYPVPLEV

SEQ ID NO: 155718 - protein, 10 aa, Artificial Sequence
  Description of Artificial Sequence: Synthetic peptide
  Seed: RASATLQDLV (PRAME_HUMAN)
RESATLQDLW

SEQ ID NO: 155719 - protein, 10 aa, Artificial Sequence
  Description of Artificial Sequence: Synthetic peptide
  Seed: LKAMVQAWPF (PRAME_HUMAN)
LPAMVQAWPW

SEQ ID NO: 155720 - protein, 9 aa, Artificial Sequence
  Description of Artificial Sequence: Synthetic peptide
  Seed: GACDELFSY (PRAME_HUMAN)
GSCDELFSK

SEQ ID NO: 155721 - protein, 9 aa, Artificial Sequence
  Description of Artificial Sequence: Synthetic peptide
  Seed: SPEPLQALL (PRAME_HUMAN)
SAEPLQALI

SEQ ID NO: 155722 - protein, 10 aa, Artificial Sequence
  Description of Artificial Sequence: Synthetic peptide
  Seed: RLDQLLRHVM (PRAME_HUMAN)
RQDQLLRHVL

SEQ ID NO: 155723 - protein, 10 aa, Artificial Sequence
  Description of Artificial Sequence: Synthetic peptide
  Seed: QSLLQHLIGL (PRAME_HUMAN)
QMLLQHLIGV

SEQ ID NO: 155724 - protein, 10 aa, Artificial Sequence
  Description of Artificial Sequence: Synthetic peptide
  Seed: KKLKIFAMPM (PRAME_HUMAN)
KDLKIFAMPK

SEQ ID NO: 155725 - protein, 9 aa, Artificial Sequence
  Description of Artificial Sequence: Synthetic peptide
  Seed: SQSPSVSQL (PRAME_HUMAN)
SFSPSVSQL

SEQ ID NO: 155726 - protein, 10 aa, Artificial Sequence
  Description of Artificial Sequence: Synthetic peptide
  Seed: YSFPEPEAAQ (PRAME_HUMAN)
YTFPEPEAAF

SEQ ID NO: 155727 - protein, 10 aa, Artificial Sequence
  Description of Artificial Sequence: Synthetic peptide
  Seed: CCKKLKIFAM (PRAME_HUMAN)
CPKKLKIFAL

SEQ ID NO: 155728 - protein, 9 aa, Artificial Sequence
  Description of Artificial Sequence: Synthetic peptide
  Seed: GACDELFSY (PRAME_HUMAN)
GMCDELFSK

SEQ ID NO: 155729 - protein, 9 aa, Artificial Sequence
  Description of Artificial Sequence: Synthetic peptide
  Seed: FAMPMQDIK (PRAME_HUMAN)
FSMPMQDIK

SEQ ID NO: 155730 - protein, 9 aa, Artificial Sequence
  Description of Artificial Sequence: Synthetic peptide
  Seed: SHIHASSYI (PRAME_HUMAN)
SQIHASSYW

SEQ ID NO: 155731 - protein, 9 aa, Artificial Sequence
  Description of Artificial Sequence: Synthetic peptide
  Seed: TDDQLLALL (PRAME_HUMAN)
TIDQLLALF

SEQ ID NO: 155732 - protein, 11 aa, Artificial Sequence
  Description of Artificial Sequence: Synthetic peptide
  Seed: IGLSNLTHVLY (PRAME_HUMAN)
ISLSNLTHVLW

SEQ ID NO: 155733 - protein, 9 aa, Artificial Sequence
  Description of Artificial Sequence: Synthetic peptide
  Seed: RLWGSIQSR (PRAME_HUMAN)
RTWGSIQSL

SEQ ID NO: 155734 - protein, 10 aa, Artificial Sequence
  Description of Artificial Sequence: Synthetic peptide
  Seed: ARLRELLCEL (PRAME_HUMAN)
AILRELLCEI

SEQ ID NO: 155735 - protein, 9 aa, Artificial Sequence
  Description of Artificial Sequence: Synthetic peptide
  Seed: ITDDQLLAL (PRAME_HUMAN)
IIDDQLLAI

SEQ ID NO: 155736 - protein, 10 aa, Artificial Sequence
  Description of Artificial Sequence: Synthetic peptide
  Seed: VRPRRWKLQV (PRAME_HUMAN)
VEPRRWKLQL

SEQ ID NO: 155737 - protein, 9 aa, Artificial Sequence
  Description of Artificial Sequence: Synthetic peptide
  Seed: FYDPEPILC (PRAME_HUMAN)
FGDPEPILM

SEQ ID NO: 155738 - protein, 9 aa, Artificial Sequence
  Description of Artificial Sequence: Synthetic peptide
  Seed: YISMSVWTS (PRAME_HUMAN)
YQSMSVWTC

SEQ ID NO: 155739 - protein, 9 aa, Artificial Sequence
  Description of Artificial Sequence: Synthetic peptide
  Seed: LGQMINLRR (PRAME_HUMAN)
LMQMINLRR

SEQ ID NO: 155740 - protein, 9 aa, Artificial Sequence
  Description of Artificial Sequence: Synthetic peptide
  Seed: FSPYLGQMI (PRAME_HUMAN)
FMPYLGQML

SEQ ID NO: 155741 - protein, 9 aa, Artificial Sequence
  Description of Artificial Sequence: Synthetic peptide
  Seed: SQLSVLSLS (PRAME_HUMAN)
SMLSVLSLI

SEQ ID NO: 155742 - protein, 9 aa, Artificial Sequence
  Description of Artificial Sequence: Synthetic peptide
  Seed: RLAYLHARL (PRAME_HUMAN)
RHAYLHARY

SEQ ID NO: 155743 - protein, 10 aa, Artificial Sequence
  Description of Artificial Sequence: Synthetic peptide
  Seed: HASSYISPEK (PRAME_HUMAN)
HSSSYISPER

SEQ ID NO: 155744 - protein, 9 aa, Artificial Sequence
  Description of Artificial Sequence: Synthetic peptide
  Seed: ALYVDSLFF (PRAME_HUMAN)
ATYVDSLFY

SEQ ID NO: 155745 - protein, 9 aa, Artificial Sequence
  Description of Artificial Sequence: Synthetic peptide
  Seed: SLLQHLIGL (PRAME_HUMAN)
SQLQHLIGI

SEQ ID NO: 155746 - protein, 9 aa, Artificial Sequence
  Description of Artificial Sequence: Synthetic peptide
  Seed: TCLPLGVLM (PRAME_HUMAN)
TSLPLGVLF

SEQ ID NO: 155747 - protein, 9 aa, Artificial Sequence
  Description of Artificial Sequence: Synthetic peptide
  Seed: VQLDSIEDL (PRAME_HUMAN)
VLLDSIEDA

SEQ ID NO: 155748 - protein, 9 aa, Artificial Sequence
  Description of Artificial Sequence: Synthetic peptide
  Seed: YPVPLESYE (PRAME_HUMAN)
YPVPLESYY

SEQ ID NO: 155749 - protein, 9 aa, Artificial Sequence
  Description of Artificial Sequence: Synthetic peptide
  Seed: LQHLIGLSN (PRAME_HUMAN)
LNHLIGLSF

SEQ ID NO: 155750 - protein, 9 aa, Artificial Sequence
  Description of Artificial Sequence: Synthetic peptide
  Seed: SQSPSVSQL (PRAME_HUMAN)
SQSPSVSQF

SEQ ID NO: 155751 - protein, 9 aa, Artificial Sequence
  Description of Artificial Sequence: Synthetic peptide
  Seed: KLKIFAMPM (PRAME_HUMAN)
KGKIFAMPF

SEQ ID NO: 155752 - protein, 10 aa, Artificial Sequence
  Description of Artificial Sequence: Synthetic peptide
  Seed: LSFYGNSISI (PRAME_HUMAN)
LAFYGNSISF

SEQ ID NO: 155753 - protein, 10 aa, Artificial Sequence
  Description of Artificial Sequence: Synthetic peptide
  Seed: SLSGVMLTDV (PRAME_HUMAN)
SLSGVMLTDA

SEQ ID NO: 155754 - protein, 10 aa, Artificial Sequence
  Description of Artificial Sequence: Synthetic peptide
  Seed: GITDDQLLAL (PRAME_HUMAN)
GLTDDQLLAV

SEQ ID NO: 155755 - protein, 10 aa, Artificial Sequence
  Description of Artificial Sequence: Synthetic peptide
  Seed: KKLKIFAMPM (PRAME_HUMAN)
KMLKIFAMPM

SEQ ID NO: 155756 - protein, 10 aa, Artificial Sequence
  Description of Artificial Sequence: Synthetic peptide
  Seed: QSLLQHLIGL (PRAME_HUMAN)
QKLLQHLIGI

SEQ ID NO: 155757 - protein, 9 aa, Artificial Sequence
  Description of Artificial Sequence: Synthetic peptide
  Seed: LALLPSLSH (PRAME_HUMAN)
LKLLPSLSM

SEQ ID NO: 155758 - protein, 10 aa, Artificial Sequence
  Description of Artificial Sequence: Synthetic peptide
  Seed: MVQAWPFTCL (PRAME_HUMAN)
MNQAWPFTCF

SEQ ID NO: 155759 - protein, 10 aa, Artificial Sequence
  Description of Artificial Sequence: Synthetic peptide
  Seed: KKLKIFAMPM (PRAME_HUMAN)
KVLKIFAMPF

SEQ ID NO: 155760 - protein, 9 aa, Artificial Sequence
  Description of Artificial Sequence: Synthetic peptide
  Seed: QALYVDSLF (PRAME_HUMAN)
QKLYVDSLY

SEQ ID NO: 155761 - protein, 11 aa, Artificial Sequence
  Description of Artificial Sequence: Synthetic peptide
  Seed: RELFPPLFMAA (PRAME_HUMAN)
RWLFPPLFMAV

SEQ ID NO: 155762 - protein, 9 aa, Artificial Sequence
  Description of Artificial Sequence: Synthetic peptide
  Seed: LYPVPLESY (PRAME_HUMAN)
LYPVPLESV

SEQ ID NO: 155763 - protein, 10 aa, Artificial Sequence
  Description of Artificial Sequence: Synthetic peptide
  Seed: GRPSMVWLSA (PRAME_HUMAN)
GRPSMVWLSV

SEQ ID NO: 155764 - protein, 10 aa, Artificial Sequence
  Description of Artificial Sequence: Synthetic peptide
  Seed: ILKMVQLDSI (PRAME_HUMAN)
IMKMVQLDSV

SEQ ID NO: 155765 - protein, 10 aa, Artificial Sequence
  Description of Artificial Sequence: Synthetic peptide
  Seed: YIAQFTSQFL (PRAME_HUMAN)
YMAQFTSQFY

SEQ ID NO: 155766 - protein, 10 aa, Artificial Sequence
  Description of Artificial Sequence: Synthetic peptide
  Seed: RELFPPLFMA (PRAME_HUMAN)
RWLFPPLFMI

SEQ ID NO: 155767 - protein, 9 aa, Artificial Sequence
  Description of Artificial Sequence: Synthetic peptide
  Seed: KAMVQAWPF (PRAME_HUMAN)
KVMVQAWPF

SEQ ID NO: 155768 - protein, 9 aa, Artificial Sequence
  Description of Artificial Sequence: Synthetic peptide
  Seed: YVDSLFFLR (PRAME_HUMAN)
YFDSLFFLR

SEQ ID NO: 155769 - protein, 10 aa, Artificial Sequence
  Description of Artificial Sequence: Synthetic peptide
  Seed: LLLSHIHASS (PRAME_HUMAN)
LALSHIHASI

SEQ ID NO: 155770 - protein, 11 aa, Artificial Sequence
  Description of Artificial Sequence: Synthetic peptide
  Seed: LPTLAKFSPYL (PRAME_HUMAN)
LATLAKFSPYI

SEQ ID NO: 155771 - protein, 10 aa, Artificial Sequence
  Description of Artificial Sequence: Synthetic peptide
  Seed: LSFYGNSISI (PRAME_HUMAN)
LGFYGNSISM

SEQ ID NO: 155772 - protein, 10 aa, Artificial Sequence
  Description of Artificial Sequence: Synthetic peptide
  Seed: DIHGTLHLER (PRAME_HUMAN)
DYHGTLHLER

SEQ ID NO: 155773 - protein, 10 aa, Artificial Sequence
  Description of Artificial Sequence: Synthetic peptide
  Seed: TTLSFYGNSI (PRAME_HUMAN)
TGLSFYGNSV

SEQ ID NO: 155774 - protein, 9 aa, Artificial Sequence
  Description of Artificial Sequence: Synthetic peptide
  Seed: QLLALLPSL (PRAME_HUMAN)
QSLALLPSL

SEQ ID NO: 155775 - protein, 9 aa, Artificial Sequence
  Description of Artificial Sequence: Synthetic peptide
  Seed: KRKKNVLRL (PRAME_HUMAN)
KRKKNVLRF

SEQ ID NO: 155776 - protein, 9 aa, Artificial Sequence
  Description of Artificial Sequence: Synthetic peptide
  Seed: LAIAALELL (PRAME_HUMAN)
LNIAALELW

SEQ ID NO: 155777 - protein, 10 aa, Artificial Sequence
  Description of Artificial Sequence: Synthetic peptide
  Seed: ETFKAVLDGL (PRAME_HUMAN)
ESFKAVLDGI

SEQ ID NO: 155778 - protein, 11 aa, Artificial Sequence
  Description of Artificial Sequence: Synthetic peptide
  Seed: LPTLAKFSPYL (PRAME_HUMAN)
LETLAKFSPYL

SEQ ID NO: 155779 - protein, 9 aa, Artificial Sequence
  Description of Artificial Sequence: Synthetic peptide
  Seed: YLHARLREL (PRAME_HUMAN)
YQHARLREM

SEQ ID NO: 155780 - protein, 9 aa, Artificial Sequence
  Description of Artificial Sequence: Synthetic peptide
  Seed: QPFIPVEVL (PRAME_HUMAN)
QQFIPVEVY

SEQ ID NO: 155781 - protein, 10 aa, Artificial Sequence
  Description of Artificial Sequence: Synthetic peptide
  Seed: IQSRYISMSV (PRAME_HUMAN)
ILSRYISMSY

SEQ ID NO: 155782 - protein, 9 aa, Artificial Sequence
  Description of Artificial Sequence: Synthetic peptide
  Seed: SEGDVMHLS (PRAME_HUMAN)
SEGDVMHLC

SEQ ID NO: 155783 - protein, 9 aa, Artificial Sequence
  Description of Artificial Sequence: Synthetic peptide
  Seed: GLSNLTHVL (PRAME_HUMAN)
GMSNLTHVM

SEQ ID NO: 155784 - protein, 9 aa, Artificial Sequence
  Description of Artificial Sequence: Synthetic peptide
  Seed: SIQSRYISM (PRAME_HUMAN)
SPQSRYISC

SEQ ID NO: 155785 - protein, 9 aa, Artificial Sequence
  Description of Artificial Sequence: Synthetic peptide
  Seed: IAQFTSQFL (PRAME_HUMAN)
ISQFTSQFL

SEQ ID NO: 155786 - protein, 8 aa, Artificial Sequence
  Description of Artificial Sequence: Synthetic peptide
  Seed: TLAKFSPY (PRAME_HUMAN)
TMAKFSPY

SEQ ID NO: 155787 - protein, 9 aa, Artificial Sequence
  Description of Artificial Sequence: Synthetic peptide
  Seed: ITDDQLLAL (PRAME_HUMAN)
INDDQLLAL

SEQ ID NO: 155788 - protein, 10 aa, Artificial Sequence
  Description of Artificial Sequence: Synthetic peptide
  Seed: FTCLPLGVLM (PRAME_HUMAN)
FQCLPLGVLL

SEQ ID NO: 155789 - protein, 10 aa, Artificial Sequence
  Description of Artificial Sequence: Synthetic peptide
  Seed: SNLTHVLYPV (PRAME_HUMAN)
SHLTHVLYPV

SEQ ID NO: 155790 - protein, 9 aa, Artificial Sequence
  Description of Artificial Sequence: Synthetic peptide
  Seed: ESYEDIHGT (PRAME_HUMAN)
ENYEDIHGV

SEQ ID NO: 155791 - protein, 9 aa, Artificial Sequence
  Description of Artificial Sequence: Synthetic peptide
  Seed: IGLSNLTHV (PRAME_HUMAN)
IRLSNLTHL

SEQ ID NO: 155792 - protein, 9 aa, Artificial Sequence
  Description of Artificial Sequence: Synthetic peptide
  Seed: RRLWGSIQS (PRAME_HUMAN)
RRLWGSIQF

SEQ ID NO: 155793 - protein, 10 aa, Artificial Sequence
  Description of Artificial Sequence: Synthetic peptide
  Seed: KDEALAIAAL (PRAME_HUMAN)
KWEALAIAAA

SEQ ID NO: 155794 - protein, 9 aa, Artificial Sequence
  Description of Artificial Sequence: Synthetic peptide
  Seed: SALQSLLQH (PRAME_HUMAN)
SMLQSLLQL

SEQ ID NO: 155795 - protein, 9 aa, Artificial Sequence
  Description of Artificial Sequence: Synthetic peptide
  Seed: FTCLPLGVL (PRAME_HUMAN)
FLCLPLGVI

SEQ ID NO: 155796 - protein, 9 aa, Artificial Sequence
  Description of Artificial Sequence: Synthetic peptide
  Seed: FSPYLGQMI (PRAME_HUMAN)
FPPYLGQMV

SEQ ID NO: 155797 - protein, 9 aa, Artificial Sequence
  Description of Artificial Sequence: Synthetic peptide
  Seed: SQSPSVSQL (PRAME_HUMAN)
SYSPSVSQI

SEQ ID NO: 155798 - protein, 8 aa, Artificial Sequence
  Description of Artificial Sequence: Synthetic peptide
  Seed: YEDIHGTL (PRAME_HUMAN)
YMDIHGTM

SEQ ID NO: 155799 - protein, 9 aa, Artificial Sequence
  Description of Artificial Sequence: Synthetic peptide
  Seed: MHLSQSPSV (PRAME_HUMAN)
MRLSQSPSY

SEQ ID NO: 155800 - protein, 10 aa, Artificial Sequence
  Description of Artificial Sequence: Synthetic peptide
  Seed: ITDDQLLALL (PRAME_HUMAN)
IMDDQLLALL

SEQ ID NO: 155801 - protein, 9 aa, Artificial Sequence
  Description of Artificial Sequence: Synthetic peptide
  Seed: TLAKFSPYL (PRAME_HUMAN)
TLAKFSPYV

SEQ ID NO: 155802 - protein, 9 aa, Artificial Sequence
  Description of Artificial Sequence: Synthetic peptide
  Seed: ACDELFSYL (PRAME_HUMAN)
AMDELFSYV

SEQ ID NO: 155803 - protein, 9 aa, Artificial Sequence
  Description of Artificial Sequence: Synthetic peptide
  Seed: AQFTSQFLS (PRAME_HUMAN)
AMFTSQFLA

SEQ ID NO: 155804 - protein, 9 aa, Artificial Sequence
  Description of Artificial Sequence: Synthetic peptide
  Seed: QSLLKDEAL (PRAME_HUMAN)
QELLKDEAM

SEQ ID NO: 155805 - protein, 10 aa, Artificial Sequence
  Description of Artificial Sequence: Synthetic peptide
  Seed: KGQHLHLETF (PRAME_HUMAN)
KVQHLHLETW

SEQ ID NO: 155806 - protein, 9 aa, Artificial Sequence
  Description of Artificial Sequence: Synthetic peptide
  Seed: MHLSQSPSV (PRAME_HUMAN)
MMLSQSPSF

SEQ ID NO: 155807 - protein, 8 aa, Artificial Sequence
  Description of Artificial Sequence: Synthetic peptide
  Seed: FYDPEPIL (PRAME_HUMAN)
FLDPEPII

SEQ ID NO: 155808 - protein, 9 aa, Artificial Sequence
  Description of Artificial Sequence: Synthetic peptide
  Seed: KLKIFAMPM (PRAME_HUMAN)
KIKIFAMPV

SEQ ID NO: 155809 - protein, 9 aa, Artificial Sequence
  Description of Artificial Sequence: Synthetic peptide
  Seed: RGRLDQLLR (PRAME_HUMAN)
RIRLDQLLR

SEQ ID NO: 155810 - protein, 9 aa, Artificial Sequence
  Description of Artificial Sequence: Synthetic peptide
  Seed: ALELLPREL (PRAME_HUMAN)
AFELLPREF

SEQ ID NO: 155811 - protein, 10 aa, Artificial Sequence
  Description of Artificial Sequence: Synthetic peptide
  Seed: RTFYDPEPIL (PRAME_HUMAN)
RQFYDPEPII

SEQ ID NO: 155812 - protein, 8 aa, Artificial Sequence
  Description of Artificial Sequence: Synthetic peptide
  Seed: YEDIHGTL (PRAME_HUMAN)
YADIHGTV

SEQ ID NO: 155813 - protein, 8 aa, Artificial Sequence
  Description of Artificial Sequence: Synthetic peptide
  Seed: YSFPEPEA (PRAME_HUMAN)
YVFPEPEL

SEQ ID NO: 155814 - protein, 9 aa, Artificial Sequence
  Description of Artificial Sequence: Synthetic peptide
  Seed: SLQCLQALY (PRAME_HUMAN)
SGQCLQALY

SEQ ID NO: 155815 - protein, 11 aa, Artificial Sequence
  Description of Artificial Sequence: Synthetic peptide
  Seed: SQSPSVSQLSV (PRAME_HUMAN)
SMSPSVSQLSF

SEQ ID NO: 155816 - protein, 9 aa, Artificial Sequence
  Description of Artificial Sequence: Synthetic peptide
  Seed: SIQSRYISM (PRAME_HUMAN)
SLQSRYISF

SEQ ID NO: 155817 - protein, 9 aa, Artificial Sequence
  Description of Artificial Sequence: Synthetic peptide
  Seed: YSFPEPEAA (PRAME_HUMAN)
YLFPEPEAM

SEQ ID NO: 155818 - protein, 10 aa, Artificial Sequence
  Description of Artificial Sequence: Synthetic peptide
  Seed: LPTLAKFSPY (PRAME_HUMAN)
LQTLAKFSPW

SEQ ID NO: 155819 - protein, 10 aa, Artificial Sequence
  Description of Artificial Sequence: Synthetic peptide
  Seed: LSLQCLQALY (PRAME_HUMAN)
LSLQCLQALW

SEQ ID NO: 155820 - protein, 10 aa, Artificial Sequence
  Description of Artificial Sequence: Synthetic peptide
  Seed: DQLLALLPSL (PRAME_HUMAN)
DWLLALLPSV

SEQ ID NO: 155821 - protein, 9 aa, Artificial Sequence
  Description of Artificial Sequence: Synthetic peptide
  Seed: SPSVSQLSV (PRAME_HUMAN)
SPSVSQLSL

SEQ ID NO: 155822 - protein, 9 aa, Artificial Sequence
  Description of Artificial Sequence: Synthetic peptide
  Seed: QFTSQFLSL (PRAME_HUMAN)
QRTSQFLSL

SEQ ID NO: 155823 - protein, 11 aa, Artificial Sequence
  Description of Artificial Sequence: Synthetic peptide
  Seed: SQSPSVSQLSV (PRAME_HUMAN)
SMSPSVSQLSL

SEQ ID NO: 155824 - protein, 10 aa, Artificial Sequence
  Description of Artificial Sequence: Synthetic peptide
  Seed: PTLAKFSPYL (PRAME_HUMAN)
PKLAKFSPYL

SEQ ID NO: 155825 - protein, 11 aa, Artificial Sequence
  Description of Artificial Sequence: Synthetic peptide
  Seed: RRWKLQVLDLR (PRAME_HUMAN)
RSWKLQVLDLR

SEQ ID NO: 155826 - protein, 11 aa, Artificial Sequence
  Description of Artificial Sequence: Synthetic peptide
  Seed: LLLSHIHASSY (PRAME_HUMAN)
LFLSHIHASSW

SEQ ID NO: 155827 - protein, 10 aa, Artificial Sequence
  Description of Artificial Sequence: Synthetic peptide
  Seed: ALYVDSLFFL (PRAME_HUMAN)
AMYVDSLFFA

SEQ ID NO: 155828 - protein, 9 aa, Artificial Sequence
  Description of Artificial Sequence: Synthetic peptide
  Seed: CKKLKIFAM (PRAME_HUMAN)
CQKLKIFAF

SEQ ID NO: 155829 - protein, 9 aa, Artificial Sequence
  Description of Artificial Sequence: Synthetic peptide
  Seed: TSPRRLVEL (PRAME_HUMAN)
TVPRRLVEL

SEQ ID NO: 155830 - protein, 9 aa, Artificial Sequence
  Description of Artificial Sequence: Synthetic peptide
  Seed: LSNLTHVLY (PRAME_HUMAN)
LMNLTHVLY

SEQ ID NO: 155831 - protein, 9 aa, Artificial Sequence
  Description of Artificial Sequence: Synthetic peptide
  Seed: HARLRELLC (PRAME_HUMAN)
HARLRELLV

SEQ ID NO: 155832 - protein, 9 aa, Artificial Sequence
  Description of Artificial Sequence: Synthetic peptide
  Seed: LQSLLQHLI (PRAME_HUMAN)
LLSLLQHLY

SEQ ID NO: 155833 - protein, 9 aa, Artificial Sequence
  Description of Artificial Sequence: Synthetic peptide
  Seed: SFYGNSISI (PRAME_HUMAN)
SIYGNSISV

SEQ ID NO: 155834 - protein, 10 aa, Artificial Sequence
  Description of Artificial Sequence: Synthetic peptide
  Seed: RLAYLHARLR (PRAME_HUMAN)
RTAYLHARLA

SEQ ID NO: 155835 - protein, 9 aa, Artificial Sequence
  Description of Artificial Sequence: Synthetic peptide
  Seed: SIEDLEVTC (PRAME_HUMAN)
SSEDLEVTV

SEQ ID NO: 155836 - protein, 9 aa, Artificial Sequence
  Description of Artificial Sequence: Synthetic peptide
  Seed: LLERASATL (PRAME_HUMAN)
LLERASATV

SEQ ID NO: 155837 - protein, 9 aa, Artificial Sequence
  Description of Artificial Sequence: Synthetic peptide
  Seed: TCLPLGVLM (PRAME_HUMAN)
TALPLGVLW

SEQ ID NO: 155838 - protein, 9 aa, Artificial Sequence
  Description of Artificial Sequence: Synthetic peptide
  Seed: LSNLTHVLY (PRAME_HUMAN)
LQNLTHVLY

SEQ ID NO: 155839 - protein, 9 aa, Artificial Sequence
  Description of Artificial Sequence: Synthetic peptide
  Seed: SIQSRYISM (PRAME_HUMAN)
SSQSRYISL

SEQ ID NO: 155840 - protein, 10 aa, Artificial Sequence
  Description of Artificial Sequence: Synthetic peptide
  Seed: YLHARLRELL (PRAME_HUMAN)
YIHARLRELV

SEQ ID NO: 155841 - protein, 10 aa, Artificial Sequence
  Description of Artificial Sequence: Synthetic peptide
  Seed: RRLWGSIQSR (PRAME_HUMAN)
RYLWGSIQSK

SEQ ID NO: 155842 - protein, 11 aa, Artificial Sequence
  Description of Artificial Sequence: Synthetic peptide
  Seed: ISMSVWTSPRR (PRAME_HUMAN)
IYMSVWTSPRR

SEQ ID NO: 155843 - protein, 9 aa, Artificial Sequence
  Description of Artificial Sequence: Synthetic peptide
  Seed: QPFIPVEVL (PRAME_HUMAN)
QQFIPVEVI

SEQ ID NO: 155844 - protein, 9 aa, Artificial Sequence
  Description of Artificial Sequence: Synthetic peptide
  Seed: SHCSQLTTL (PRAME_HUMAN)
SMCSQLTTI

SEQ ID NO: 155845 - protein, 9 aa, Artificial Sequence
  Description of Artificial Sequence: Synthetic peptide
  Seed: MINLRRLLL (PRAME_HUMAN)
MQNLRRLLK

SEQ ID NO: 155846 - protein, 10 aa, Artificial Sequence
  Description of Artificial Sequence: Synthetic peptide
  Seed: DIHGTLHLER (PRAME_HUMAN)
DWHGTLHLER

SEQ ID NO: 155847 - protein, 10 aa, Artificial Sequence
  Description of Artificial Sequence: Synthetic peptide
  Seed: LSVLSLSGVM (PRAME_HUMAN)
LNVLSLSGVY

SEQ ID NO: 155848 - protein, 10 aa, Artificial Sequence
  Description of Artificial Sequence: Synthetic peptide
  Seed: MERRRLWGSI (PRAME_HUMAN)
MPRRRLWGSF

SEQ ID NO: 155849 - protein, 11 aa, Artificial Sequence
  Description of Artificial Sequence: Synthetic peptide
  Seed: RRWKLQVLDLR (PRAME_HUMAN)
RRWKLQVLDLH

SEQ ID NO: 155850 - protein, 10 aa, Artificial Sequence
  Description of Artificial Sequence: Synthetic peptide
  Seed: SPYLGQMINL (PRAME_HUMAN)
SYYLGQMINI

SEQ ID NO: 155851 - protein, 9 aa, Artificial Sequence
  Description of Artificial Sequence: Synthetic peptide
  Seed: SLLQHLIGL (PRAME_HUMAN)
STLQHLIGR

SEQ ID NO: 155852 - protein, 11 aa, Artificial Sequence
  Description of Artificial Sequence: Synthetic peptide
  Seed: PRELFPPLFMA (PRAME_HUMAN)
PYELFPPLFML

SEQ ID NO: 155853 - protein, 9 aa, Artificial Sequence
  Description of Artificial Sequence: Synthetic peptide
  Seed: YLHARLREL (PRAME_HUMAN)
YLHARLREA

SEQ ID NO: 155854 - protein, 9 aa, Artificial Sequence
  Description of Artificial Sequence: Synthetic peptide
  Seed: KLKIFAMPM (PRAME_HUMAN)
KNKIFAMPI

SEQ ID NO: 155855 - protein, 11 aa, Artificial Sequence
  Description of Artificial Sequence: Synthetic peptide
  Seed: SQLSVLSLSGV (PRAME_HUMAN)
SMLSVLSLSGV

SEQ ID NO: 155856 - protein, 10 aa, Artificial Sequence
  Description of Artificial Sequence: Synthetic peptide
  Seed: SPRRLVELAG (PRAME_HUMAN)
SPRRLVELAF

SEQ ID NO: 155857 - protein, 9 aa, Artificial Sequence
  Description of Artificial Sequence: Synthetic peptide
  Seed: KMILKMVQL (PRAME_HUMAN)
KLILKMVQI

SEQ ID NO: 155858 - protein, 8 aa, Artificial Sequence
  Description of Artificial Sequence: Synthetic peptide
  Seed: LKIFAMPM (PRAME_HUMAN)
LQIFAMPY

SEQ ID NO: 155859 - protein, 9 aa, Artificial Sequence
  Description of Artificial Sequence: Synthetic peptide
  Seed: SVLSLSGVM (PRAME_HUMAN)
SALSLSGVW

SEQ ID NO: 155860 - protein, 9 aa, Artificial Sequence
  Description of Artificial Sequence: Synthetic peptide
  Seed: SIQSRYISM (PRAME_HUMAN)
SQQSRYISF

SEQ ID NO: 155861 - protein, 9 aa, Artificial Sequence
  Description of Artificial Sequence: Synthetic peptide
  Seed: YIAQFTSQF (PRAME_HUMAN)
YVAQFTSQL

SEQ ID NO: 155862 - protein, 9 aa, Artificial Sequence
  Description of Artificial Sequence: Synthetic peptide
  Seed: VSPEPLQAL (PRAME_HUMAN)
VFPEPLQAV

SEQ ID NO: 155863 - protein, 9 aa, Artificial Sequence
  Description of Artificial Sequence: Synthetic peptide
  Seed: ACDELFSYL (PRAME_HUMAN)
ARDELFSYY

SEQ ID NO: 155864 - protein, 9 aa, Artificial Sequence
  Description of Artificial Sequence: Synthetic peptide
  Seed: HLETFKAVL (PRAME_HUMAN)
HQETFKAVY

SEQ ID NO: 155865 - protein, 9 aa, Artificial Sequence
  Description of Artificial Sequence: Synthetic peptide
  Seed: LAIAALELL (PRAME_HUMAN)
LIIAALELV

SEQ ID NO: 155866 - protein, 9 aa, Artificial Sequence
  Description of Artificial Sequence: Synthetic peptide
  Seed: SFYGNSISI (PRAME_HUMAN)
SFYGNSISW

SEQ ID NO: 155867 - protein, 8 aa, Artificial Sequence
  Description of Artificial Sequence: Synthetic peptide
  Seed: EEQYIAQF (PRAME_HUMAN)
EEQYIAQY

SEQ ID NO: 155868 - protein, 9 aa, Artificial Sequence
  Description of Artificial Sequence: Synthetic peptide
  Seed: LYPVPLESY (PRAME_HUMAN)
LQPVPLESF

SEQ ID NO: 155869 - protein, 11 aa, Artificial Sequence
  Description of Artificial Sequence: Synthetic peptide
  Seed: SQSPSVSQLSV (PRAME_HUMAN)
SMSPSVSQLSV

SEQ ID NO: 155870 - protein, 9 aa, Artificial Sequence
  Description of Artificial Sequence: Synthetic peptide
  Seed: SQSPSVSQL (PRAME_HUMAN)
SVSPSVSQL

SEQ ID NO: 155871 - protein, 10 aa, Artificial Sequence
  Description of Artificial Sequence: Synthetic peptide
  Seed: TLHLERLAYL (PRAME_HUMAN)
TMHLERLAYI

SEQ ID NO: 155872 - protein, 10 aa, Artificial Sequence
  Description of Artificial Sequence: Synthetic peptide
  Seed: GQHLHLETFK (PRAME_HUMAN)
GYHLHLETFR

SEQ ID NO: 155873 - protein, 9 aa, Artificial Sequence
  Description of Artificial Sequence: Synthetic peptide
  Seed: LLLSHIHAS (PRAME_HUMAN)
LMLSHIHAC

SEQ ID NO: 155874 - protein, 10 aa, Artificial Sequence
  Description of Artificial Sequence: Synthetic peptide
  Seed: QAWPFTCLPL (PRAME_HUMAN)
QHWPFTCLPF

SEQ ID NO: 155875 - protein, 9 aa, Artificial Sequence
  Description of Artificial Sequence: Synthetic peptide
  Seed: LYPVPLESY (PRAME_HUMAN)
LYPVPLESF

SEQ ID NO: 155876 - protein, 9 aa, Artificial Sequence
  Description of Artificial Sequence: Synthetic peptide
  Seed: SATLQDLVF (PRAME_HUMAN)
SLTLQDLVY

SEQ ID NO: 155877 - protein, 10 aa, Artificial Sequence
  Description of Artificial Sequence: Synthetic peptide
  Seed: SPSVSQLSVL (PRAME_HUMAN)
SISVSQLSVY

SEQ ID NO: 155878 - protein, 11 aa, Artificial Sequence
  Description of Artificial Sequence: Synthetic peptide
  Seed: FSPYLGQMINL (PRAME_HUMAN)
FCPYLGQMINF

SEQ ID NO: 155879 - protein, 10 aa, Artificial Sequence
  Description of Artificial Sequence: Synthetic peptide
  Seed: LQALYVDSLF (PRAME_HUMAN)
LTALYVDSLF

SEQ ID NO: 155880 - protein, 11 aa, Artificial Sequence
  Description of Artificial Sequence: Synthetic peptide
  Seed: RRRLWGSIQSR (PRAME_HUMAN)
RRRLWGSIQSM

SEQ ID NO: 155881 - protein, 9 aa, Artificial Sequence
  Description of Artificial Sequence: Synthetic peptide
  Seed: KEEQYIAQF (PRAME_HUMAN)
KREQYIAQL

SEQ ID NO: 155882 - protein, 11 aa, Artificial Sequence
  Description of Artificial Sequence: Synthetic peptide
  Seed: GTLHLERLAYL (PRAME_HUMAN)
GFLHLERLAYA

SEQ ID NO: 155883 - protein, 10 aa, Artificial Sequence
  Description of Artificial Sequence: Synthetic peptide
  Seed: RLVELAGQSL (PRAME_HUMAN)
RVVELAGQSV

SEQ ID NO: 155884 - protein, 9 aa, Artificial Sequence
  Description of Artificial Sequence: Synthetic peptide
  Seed: FMAAFDGRH (PRAME_HUMAN)
FMAAFDGRY

SEQ ID NO: 155885 - protein, 10 aa, Artificial Sequence
  Description of Artificial Sequence: Synthetic peptide
  Seed: SNLTHVLYPV (PRAME_HUMAN)
SFLTHVLYPL

SEQ ID NO: 155886 - protein, 9 aa, Artificial Sequence
  Description of Artificial Sequence: Synthetic peptide
  Seed: VSPEPLQAL (PRAME_HUMAN)
VPPEPLQAT

SEQ ID NO: 155887 - protein, 10 aa, Artificial Sequence
  Description of Artificial Sequence: Synthetic peptide
  Seed: YEDIHGTLHL (PRAME_HUMAN)
YQDIHGTLHL

SEQ ID NO: 155888 - protein, 9 aa, Artificial Sequence
  Description of Artificial Sequence: Synthetic peptide
  Seed: VSQLSVLSL (PRAME_HUMAN)
VTQLSVLSW

SEQ ID NO: 155889 - protein, 9 aa, Artificial Sequence
  Description of Artificial Sequence: Synthetic peptide
  Seed: LVELAGQSL (PRAME_HUMAN)
LAELAGQSM

SEQ ID NO: 155890 - protein, 10 aa, Artificial Sequence
  Description of Artificial Sequence: Synthetic peptide
  Seed: ETLSITNCRL (PRAME_HUMAN)
EILSITNCRK

SEQ ID NO: 155891 - protein, 10 aa, Artificial Sequence
  Description of Artificial Sequence: Synthetic peptide
  Seed: RELFPPLFMA (PRAME_HUMAN)
RSLFPPLFMA

SEQ ID NO: 155892 - protein, 9 aa, Artificial Sequence
  Description of Artificial Sequence: Synthetic peptide
  Seed: KFSPYLGQM (PRAME_HUMAN)
KFSPYLGQY

SEQ ID NO: 155893 - protein, 10 aa, Artificial Sequence
  Description of Artificial Sequence: Synthetic peptide
  Seed: FIPVEVLVDL (PRAME_HUMAN)
FKPVEVLVDF

SEQ ID NO: 155894 - protein, 9 aa, Artificial Sequence
  Description of Artificial Sequence: Synthetic peptide
  Seed: RLWGSIQSR (PRAME_HUMAN)
RVWGSIQSF

SEQ ID NO: 155895 - protein, 8 aa, Artificial Sequence
  Description of Artificial Sequence: Synthetic peptide
  Seed: YEDIHGTL (PRAME_HUMAN)
YIDIHGTF

SEQ ID NO: 155896 - protein, 10 aa, Artificial Sequence
  Description of Artificial Sequence: Synthetic peptide
  Seed: RELFPPLFMA (PRAME_HUMAN)
RTLFPPLFML

SEQ ID NO: 155897 - protein, 10 aa, Artificial Sequence
  Description of Artificial Sequence: Synthetic peptide
  Seed: SLYSFPEPEA (PRAME_HUMAN)
SVYSFPEPEL

SEQ ID NO: 155898 - protein, 9 aa, Artificial Sequence
  Description of Artificial Sequence: Synthetic peptide
  Seed: ITDDQLLAL (PRAME_HUMAN)
ISDDQLLAM

SEQ ID NO: 155899 - protein, 9 aa, Artificial Sequence
  Description of Artificial Sequence: Synthetic peptide
  Seed: FLRGRLDQL (PRAME_HUMAN)
FARGRLDQF

SEQ ID NO: 155900 - protein, 9 aa, Artificial Sequence
  Description of Artificial Sequence: Synthetic peptide
  Seed: SVWTSPRRL (PRAME_HUMAN)
SAWTSPRRL

SEQ ID NO: 155901 - protein, 10 aa, Artificial Sequence
  Description of Artificial Sequence: Synthetic peptide
  Seed: AMVQAWPFTC (PRAME_HUMAN)
ARVQAWPFTV

SEQ ID NO: 155902 - protein, 10 aa, Artificial Sequence
  Description of Artificial Sequence: Synthetic peptide
  Seed: IQSRYISMSV (PRAME_HUMAN)
IQSRYISMSL

SEQ ID NO: 155903 - protein, 9 aa, Artificial Sequence
  Description of Artificial Sequence: Synthetic peptide
  Seed: MHLSQSPSV (PRAME_HUMAN)
MGLSQSPSF

SEQ ID NO: 155904 - protein, 11 aa, Artificial Sequence
  Description of Artificial Sequence: Synthetic peptide
  Seed: AAFDGRHSQTL (PRAME_HUMAN)
ATFDGRHSQTW

SEQ ID NO: 155905 - protein, 10 aa, Artificial Sequence
  Description of Artificial Sequence: Synthetic peptide
  Seed: LLLSHIHASS (PRAME_HUMAN)
LRLSHIHASI

SEQ ID NO: 155906 - protein, 10 aa, Artificial Sequence
  Description of Artificial Sequence: Synthetic peptide
  Seed: MPMQDIKMIL (PRAME_HUMAN)
MSMQDIKMIW

SEQ ID NO: 155907 - protein, 9 aa, Artificial Sequence
  Description of Artificial Sequence: Synthetic peptide
  Seed: RLWGSIQSR (PRAME_HUMAN)
RSWGSIQSR

SEQ ID NO: 155908 - protein, 8 aa, Artificial Sequence
  Description of Artificial Sequence: Synthetic peptide
  Seed: YEDIHGTL (PRAME_HUMAN)
YNDIHGTF

SEQ ID NO: 155909 - protein, 9 aa, Artificial Sequence
  Description of Artificial Sequence: Synthetic peptide
  Seed: QSRYISMSV (PRAME_HUMAN)
QPRYISMSM

SEQ ID NO: 155910 - protein, 9 aa, Artificial Sequence
  Description of Artificial Sequence: Synthetic peptide
  Seed: SALQSLLQH (PRAME_HUMAN)
SKLQSLLQY

SEQ ID NO: 155911 - protein, 10 aa, Artificial Sequence
  Description of Artificial Sequence: Synthetic peptide
  Seed: MVQAWPFTCL (PRAME_HUMAN)
MVQAWPFTCA

SEQ ID NO: 155912 - protein, 10 aa, Artificial Sequence
  Description of Artificial Sequence: Synthetic peptide
  Seed: IQSRYISMSV (PRAME_HUMAN)
IRSRYISMSM

SEQ ID NO: 155913 - protein, 9 aa, Artificial Sequence
  Description of Artificial Sequence: Synthetic peptide
  Seed: MINLRRLLL (PRAME_HUMAN)
MMNLRRLLW

SEQ ID NO: 155914 - protein, 10 aa, Artificial Sequence
  Description of Artificial Sequence: Synthetic peptide
  Seed: SVLSLSGVML (PRAME_HUMAN)
SMLSLSGVML

SEQ ID NO: 155915 - protein, 10 aa, Artificial Sequence
  Description of Artificial Sequence: Synthetic peptide
  Seed: IQSRYISMSV (PRAME_HUMAN)
IMSRYISMSV

SEQ ID NO: 155916 - protein, 9 aa, Artificial Sequence
  Description of Artificial Sequence: Synthetic peptide
  Seed: RLWGSIQSR (PRAME_HUMAN)
RIWGSIQSK

SEQ ID NO: 155917 - protein, 10 aa, Artificial Sequence
  Description of Artificial Sequence: Synthetic peptide
  Seed: RLWGSIQSRY (PRAME_HUMAN)
RTWGSIQSRL

SEQ ID NO: 155918 - protein, 9 aa, Artificial Sequence
  Description of Artificial Sequence: Synthetic peptide
  Seed: SRYISMSVW (PRAME_HUMAN)
SYYISMSVY

SEQ ID NO: 155919 - protein, 9 aa, Artificial Sequence
  Description of Artificial Sequence: Synthetic peptide
  Seed: YSFPEPEAA (PRAME_HUMAN)
YRFPEPEAA

SEQ ID NO: 155920 - protein, 10 aa, Artificial Sequence
  Description of Artificial Sequence: Synthetic peptide
  Seed: FYDPEPILCP (PRAME_HUMAN)
FLDPEPILCF

SEQ ID NO: 155921 - protein, 10 aa, Artificial Sequence
  Description of Artificial Sequence: Synthetic peptide
  Seed: IQSRYISMSV (PRAME_HUMAN)
IKSRYISMSA

SEQ ID NO: 155922 - protein, 8 aa, Artificial Sequence
  Description of Artificial Sequence: Synthetic peptide
  Seed: YSFPEPEA (PRAME_HUMAN)
YTFPEPEL

SEQ ID NO: 155923 - protein, 10 aa, Artificial Sequence
  Description of Artificial Sequence: Synthetic peptide
  Seed: GRLDQLLRHV (PRAME_HUMAN)
GVLDQLLRHV

SEQ ID NO: 155924 - protein, 9 aa, Artificial Sequence
  Description of Artificial Sequence: Synthetic peptide
  Seed: TEAEQPFIP (PRAME_HUMAN)
TEAEQPFIV

SEQ ID NO: 155925 - protein, 9 aa, Artificial Sequence
  Description of Artificial Sequence: Synthetic peptide
  Seed: SLSHCSQLT (PRAME_HUMAN)
SMSHCSQLA

SEQ ID NO: 155926 - protein, 9 aa, Artificial Sequence
  Description of Artificial Sequence: Synthetic peptide
  Seed: VLSLSGVML (PRAME_HUMAN)
VMSLSGVMF

SEQ ID NO: 155927 - protein, 9 aa, Artificial Sequence
  Description of Artificial Sequence: Synthetic peptide
  Seed: LYPVPLESY (PRAME_HUMAN)
LSPVPLESM

SEQ ID NO: 155928 - protein, 9 aa, Artificial Sequence
  Description of Artificial Sequence: Synthetic peptide
  Seed: SFYGNSISI (PRAME_HUMAN)
SAYGNSISH

SEQ ID NO: 155929 - protein, 10 aa, Artificial Sequence
  Description of Artificial Sequence: Synthetic peptide
  Seed: ALYVDSLFFL (PRAME_HUMAN)
AFYVDSLFFL

SEQ ID NO: 155930 - protein, 9 aa, Artificial Sequence
  Description of Artificial Sequence: Synthetic peptide
  Seed: ALLPSLSHC (PRAME_HUMAN)
AALPSLSHL

SEQ ID NO: 155931 - protein, 9 aa, Artificial Sequence
  Description of Artificial Sequence: Synthetic peptide
  Seed: VQLDSIEDL (PRAME_HUMAN)
VALDSIEDY

SEQ ID NO: 155932 - protein, 9 aa, Artificial Sequence
  Description of Artificial Sequence: Synthetic peptide
  Seed: RLWGSIQSR (PRAME_HUMAN)
RMWGSIQSF

SEQ ID NO: 155933 - protein, 10 aa, Artificial Sequence
  Description of Artificial Sequence: Synthetic peptide
  Seed: HCSQLTTLSF (PRAME_HUMAN)
HPSQLTTLSF

SEQ ID NO: 155934 - protein, 11 aa, Artificial Sequence
  Description of Artificial Sequence: Synthetic peptide
  Seed: SFPEPEAAQPM (PRAME_HUMAN)
SAPEPEAAQPM

SEQ ID NO: 155935 - protein, 9 aa, Artificial Sequence
  Description of Artificial Sequence: Synthetic peptide
  Seed: RGRLDQLLR (PRAME_HUMAN)
RMRLDQLLM

SEQ ID NO: 155936 - protein, 9 aa, Artificial Sequence
  Description of Artificial Sequence: Synthetic peptide
  Seed: LLKDEALAI (PRAME_HUMAN)
LQKDEALAV

SEQ ID NO: 155937 - protein, 9 aa, Artificial Sequence
  Description of Artificial Sequence: Synthetic peptide
  Seed: LSNLTHVLY (PRAME_HUMAN)
LVNLTHVLY

SEQ ID NO: 155938 - protein, 10 aa, Artificial Sequence
  Description of Artificial Sequence: Synthetic peptide
  Seed: ESYEDIHGTL (PRAME_HUMAN)
EVYEDIHGTM

SEQ ID NO: 155939 - protein, 8 aa, Artificial Sequence
  Description of Artificial Sequence: Synthetic peptide
  Seed: FYDPEPIL (PRAME_HUMAN)
FTDPEPIM

SEQ ID NO: 155940 - protein, 10 aa, Artificial Sequence
  Description of Artificial Sequence: Synthetic peptide
  Seed: YSFPEPEAAQ (PRAME_HUMAN)
YVFPEPEAAF

SEQ ID NO: 155941 - protein, 10 aa, Artificial Sequence
  Description of Artificial Sequence: Synthetic peptide
  Seed: RLRELLCELG (PRAME_HUMAN)
RMRELLCELL

SEQ ID NO: 155942 - protein, 10 aa, Artificial Sequence
  Description of Artificial Sequence: Synthetic peptide
  Seed: TWKLPTLAKF (PRAME_HUMAN)
TYKLPTLAKW

SEQ ID NO: 155943 - protein, 10 aa, Artificial Sequence
  Description of Artificial Sequence: Synthetic peptide
  Seed: LERLAYLHAR (PRAME_HUMAN)
LCRLAYLHAK

SEQ ID NO: 155944 - protein, 10 aa, Artificial Sequence
  Description of Artificial Sequence: Synthetic peptide
  Seed: RLWGSIQSRY (PRAME_HUMAN)
RMWGSIQSRK

SEQ ID NO: 155945 - protein, 9 aa, Artificial Sequence
  Description of Artificial Sequence: Synthetic peptide
  Seed: SQFLSLQCL (PRAME_HUMAN)
SEFLSLQCL

SEQ ID NO: 155946 - protein, 9 aa, Artificial Sequence
  Description of Artificial Sequence: Synthetic peptide
  Seed: YIAQFTSQF (PRAME_HUMAN)
YTAQFTSQK

SEQ ID NO: 155947 - protein, 9 aa, Artificial Sequence
  Description of Artificial Sequence: Synthetic peptide
  Seed: FLSLQCLQA (PRAME_HUMAN)
FSSLQCLQV

SEQ ID NO: 155948 - protein, 9 aa, Artificial Sequence
  Description of Artificial Sequence: Synthetic peptide
  Seed: GQHLHLETF (PRAME_HUMAN)
GDHLHLETF

SEQ ID NO: 155949 - protein, 10 aa, Artificial Sequence
  Description of Artificial Sequence: Synthetic peptide
  Seed: RRRLWGSIQS (PRAME_HUMAN)
RGRLWGSIQK

SEQ ID NO: 155950 - protein, 9 aa, Artificial Sequence
  Description of Artificial Sequence: Synthetic peptide
  Seed: ITDDQLLAL (PRAME_HUMAN)
IYDDQLLAL

SEQ ID NO: 155951 - protein, 9 aa, Artificial Sequence
  Description of Artificial Sequence: Synthetic peptide
  Seed: VELAGQSLL (PRAME_HUMAN)
VELAGQSLI

SEQ ID NO: 155952 - protein, 9 aa, Artificial Sequence
  Description of Artificial Sequence: Synthetic peptide
  Seed: SHQDFWTVW (PRAME_HUMAN)
SFQDFWTVW

SEQ ID NO: 155953 - protein, 10 aa, Artificial Sequence
  Description of Artificial Sequence: Synthetic peptide
  Seed: QSLLQHLIGL (PRAME_HUMAN)
QYLLQHLIGI

SEQ ID NO: 155954 - protein, 8 aa, Artificial Sequence
  Description of Artificial Sequence: Synthetic peptide
  Seed: SQLSVLSL (PRAME_HUMAN)
SKLSVLSF

SEQ ID NO: 155955 - protein, 10 aa, Artificial Sequence
  Description of Artificial Sequence: Synthetic peptide
  Seed: RLWGSIQSRY (PRAME_HUMAN)
RAWGSIQSRW

SEQ ID NO: 155956 - protein, 10 aa, Artificial Sequence
  Description of Artificial Sequence: Synthetic peptide
  Seed: SPYLGQMINL (PRAME_HUMAN)
SAYLGQMINL

SEQ ID NO: 155957 - protein, 8 aa, Artificial Sequence
  Description of Artificial Sequence: Synthetic peptide
  Seed: VSPEPLQA (PRAME_HUMAN)
VAPEPLQM

SEQ ID NO: 155958 - protein, 11 aa, Artificial Sequence
  Description of Artificial Sequence: Synthetic peptide
  Seed: IAQFTSQFLSL (PRAME_HUMAN)
ILQFTSQFLSY

SEQ ID NO: 155959 - protein, 11 aa, Artificial Sequence
  Description of Artificial Sequence: Synthetic peptide
  Seed: FLSLQCLQALY (PRAME_HUMAN)
FYSLQCLQALY

SEQ ID NO: 155960 - protein, 9 aa, Artificial Sequence
  Description of Artificial Sequence: Synthetic peptide
  Seed: YIAQFTSQF (PRAME_HUMAN)
YAAQFTSQF

SEQ ID NO: 155961 - protein, 10 aa, Artificial Sequence
  Description of Artificial Sequence: Synthetic peptide
  Seed: HLIGLSNLTH (PRAME_HUMAN)
HSIGLSNLTY

SEQ ID NO: 155962 - protein, 10 aa, Artificial Sequence
  Description of Artificial Sequence: Synthetic peptide
  Seed: ETLSITNCRL (PRAME_HUMAN)
EVLSITNCRW

SEQ ID NO: 155963 - protein, 9 aa, Artificial Sequence
  Description of Artificial Sequence: Synthetic peptide
  Seed: MQDIKMILK (PRAME_HUMAN)
MMDIKMILY

SEQ ID NO: 155964 - protein, 10 aa, Artificial Sequence
  Description of Artificial Sequence: Synthetic peptide
  Seed: ARLRELLCEL (PRAME_HUMAN)
ACLRELLCEA

SEQ ID NO: 155965 - protein, 9 aa, Artificial Sequence
  Description of Artificial Sequence: Synthetic peptide
  Seed: RRWKLQVLD (PRAME_HUMAN)
RHWKLQVLL

SEQ ID NO: 155966 - protein, 10 aa, Artificial Sequence
  Description of Artificial Sequence: Synthetic peptide
  Seed: TFYDPEPILC (PRAME_HUMAN)
TFYDPEPILF

SEQ ID NO: 155967 - protein, 11 aa, Artificial Sequence
  Description of Artificial Sequence: Synthetic peptide
  Seed: TDVSPEPLQAL (PRAME_HUMAN)
TEVSPEPLQAI

SEQ ID NO: 155968 - protein, 9 aa, Artificial Sequence
  Description of Artificial Sequence: Synthetic peptide
  Seed: SFYGNSISI (PRAME_HUMAN)
SVYGNSISV

SEQ ID NO: 155969 - protein, 10 aa, Artificial Sequence
  Description of Artificial Sequence: Synthetic peptide
  Seed: VLSLSGVMLT (PRAME_HUMAN)
VMSLSGVMLA

SEQ ID NO: 155970 - protein, 9 aa, Artificial Sequence
  Description of Artificial Sequence: Synthetic peptide
  Seed: RTFYDPEPI (PRAME_HUMAN)
RMFYDPEPF

SEQ ID NO: 155971 - protein, 9 aa, Artificial Sequence
  Description of Artificial Sequence: Synthetic peptide
  Seed: YIAQFTSQF (PRAME_HUMAN)
YVAQFTSQM

SEQ ID NO: 155972 - protein, 10 aa, Artificial Sequence
  Description of Artificial Sequence: Synthetic peptide
  Seed: RHVMNPLETL (PRAME_HUMAN)
RLVMNPLETV

SEQ ID NO: 155973 - protein, 9 aa, Artificial Sequence
  Description of Artificial Sequence: Synthetic peptide
  Seed: GLSNLTHVL (PRAME_HUMAN)
GASNLTHVY

SEQ ID NO: 155974 - protein, 10 aa, Artificial Sequence
  Description of Artificial Sequence: Synthetic peptide
  Seed: GACDELFSYL (PRAME_HUMAN)
GVCDELFSYA

SEQ ID NO: 155975 - protein, 9 aa, Artificial Sequence
  Description of Artificial Sequence: Synthetic peptide
  Seed: RLWGSIQSR (PRAME_HUMAN)
RIWGSIQSF

SEQ ID NO: 155976 - protein, 10 aa, Artificial Sequence
  Description of Artificial Sequence: Synthetic peptide
  Seed: MSVWTSPRRL (PRAME_HUMAN)
MAVWTSPRRY

SEQ ID NO: 155977 - protein, 9 aa, Artificial Sequence
  Description of Artificial Sequence: Synthetic peptide
  Seed: VFDECGITD (PRAME_HUMAN)
VWDECGITF

SEQ ID NO: 155978 - protein, 9 aa, Artificial Sequence
  Description of Artificial Sequence: Synthetic peptide
  Seed: LSLQCLQAL (PRAME_HUMAN)
LHLQCLQAM

SEQ ID NO: 155979 - protein, 10 aa, Artificial Sequence
  Description of Artificial Sequence: Synthetic peptide
  Seed: QAWPFTCLPL (PRAME_HUMAN)
QMWPFTCLPI

SEQ ID NO: 155980 - protein, 11 aa, Artificial Sequence
  Description of Artificial Sequence: Synthetic peptide
  Seed: SNLTHVLYPVP (PRAME_HUMAN)
SMLTHVLYPVL

SEQ ID NO: 155981 - protein, 9 aa, Artificial Sequence
  Description of Artificial Sequence: Synthetic peptide
  Seed: GQHLHLETF (PRAME_HUMAN)
GSHLHLETY

SEQ ID NO: 155982 - protein, 9 aa, Artificial Sequence
  Description of Artificial Sequence: Synthetic peptide
  Seed: VLDGLDVLL (PRAME_HUMAN)
VQDGLDVLL

SEQ ID NO: 155983 - protein, 11 aa, Artificial Sequence
  Description of Artificial Sequence: Synthetic peptide
  Seed: LLLSHIHASSY (PRAME_HUMAN)
LRLSHIHASSW

SEQ ID NO: 155984 - protein, 10 aa, Artificial Sequence
  Description of Artificial Sequence: Synthetic peptide
  Seed: ITDDQLLALL (PRAME_HUMAN)
IIDDQLLALV

SEQ ID NO: 155985 - protein, 9 aa, Artificial Sequence
  Description of Artificial Sequence: Synthetic peptide
  Seed: KMILKMVQL (PRAME_HUMAN)
KVILKMVQL

SEQ ID NO: 155986 - protein, 9 aa, Artificial Sequence
  Description of Artificial Sequence: Synthetic peptide
  Seed: VQAWPFTCL (PRAME_HUMAN)
VLAWPFTCF

SEQ ID NO: 155987 - protein, 10 aa, Artificial Sequence
  Description of Artificial Sequence: Synthetic peptide
  Seed: FAMPMQDIKM (PRAME_HUMAN)
FLMPMQDIKA

SEQ ID NO: 155988 - protein, 10 aa, Artificial Sequence
  Description of Artificial Sequence: Synthetic peptide
  Seed: LLLSHIHASS (PRAME_HUMAN)
LNLSHIHASI

SEQ ID NO: 155989 - protein, 10 aa, Artificial Sequence
  Description of Artificial Sequence: Synthetic peptide
  Seed: CSQLTTLSFY (PRAME_HUMAN)
CFQLTTLSFY

SEQ ID NO: 155990 - protein, 9 aa, Artificial Sequence
  Description of Artificial Sequence: Synthetic peptide
  Seed: QALYVDSLF (PRAME_HUMAN)
QTLYVDSLW

SEQ ID NO: 155991 - protein, 10 aa, Artificial Sequence
  Description of Artificial Sequence: Synthetic peptide
  Seed: YEDIHGTLHL (PRAME_HUMAN)
YTDIHGTLHI

SEQ ID NO: 155992 - protein, 9 aa, Artificial Sequence
  Description of Artificial Sequence: Synthetic peptide
  Seed: RELFPPLFM (PRAME_HUMAN)
RELFPPLFI

SEQ ID NO: 155993 - protein, 11 aa, Artificial Sequence
  Description of Artificial Sequence: Synthetic peptide
  Seed: SIEDLEVTCTW (PRAME_HUMAN)
SIEDLEVTCTY

SEQ ID NO: 155994 - protein, 10 aa, Artificial Sequence
  Description of Artificial Sequence: Synthetic peptide
  Seed: FIPVEVLVDL (PRAME_HUMAN)
FSPVEVLVDY

SEQ ID NO: 155995 - protein, 11 aa, Artificial Sequence
  Description of Artificial Sequence: Synthetic peptide
  Seed: RASATLQDLVF (PRAME_HUMAN)
RISATLQDLVW

SEQ ID NO: 155996 - protein, 9 aa, Artificial Sequence
  Description of Artificial Sequence: Synthetic peptide
  Seed: VLDGLDVLL (PRAME_HUMAN)
VADGLDVLY

SEQ ID NO: 155997 - protein, 10 aa, Artificial Sequence
  Description of Artificial Sequence: Synthetic peptide
  Seed: ALELLPRELF (PRAME_HUMAN)
AFELLPRELW

SEQ ID NO: 155998 - protein, 9 aa, Artificial Sequence
  Description of Artificial Sequence: Synthetic peptide
  Seed: QLLALLPSL (PRAME_HUMAN)
QVLALLPSL

SEQ ID NO: 155999 - protein, 9 aa, Artificial Sequence
  Description of Artificial Sequence: Synthetic peptide
  Seed: ITDDQLLAL (PRAME_HUMAN)
ILDDQLLAT

SEQ ID NO: 156000 - protein, 9 aa, Artificial Sequence
  Description of Artificial Sequence: Synthetic peptide
  Seed: SQSPSVSQL (PRAME_HUMAN)
SHSPSVSQL

SEQ ID NO: 156001 - protein, 9 aa, Artificial Sequence
  Description of Artificial Sequence: Synthetic peptide
  Seed: QTLKAMVQA (PRAME_HUMAN)
QTLKAMVQV

SEQ ID NO: 156002 - protein, 10 aa, Artificial Sequence
  Description of Artificial Sequence: Synthetic peptide
  Seed: ESYEDIHGTL (PRAME_HUMAN)
EVYEDIHGTV

SEQ ID NO: 156003 - protein, 10 aa, Artificial Sequence
  Description of Artificial Sequence: Synthetic peptide
  Seed: MLTDVSPEPL (PRAME_HUMAN)
MQTDVSPEPL

SEQ ID NO: 156004 - protein, 9 aa, Artificial Sequence
  Description of Artificial Sequence: Synthetic peptide
  Seed: QPFIPVEVL (PRAME_HUMAN)
QAFIPVEVI

SEQ ID NO: 156005 - protein, 9 aa, Artificial Sequence
  Description of Artificial Sequence: Synthetic peptide
  Seed: VSPEPLQAL (PRAME_HUMAN)
VRPEPLQAM

SEQ ID NO: 156006 - protein, 10 aa, Artificial Sequence
  Description of Artificial Sequence: Synthetic peptide
  Seed: ARLRELLCEL (PRAME_HUMAN)
ACLRELLCEI

SEQ ID NO: 156007 - protein, 9 aa, Artificial Sequence
  Description of Artificial Sequence: Synthetic peptide
  Seed: LMKGQHLHL (PRAME_HUMAN)
LYKGQHLHF

SEQ ID NO: 156008 - protein, 10 aa, Artificial Sequence
  Description of Artificial Sequence: Synthetic peptide
  Seed: LQALYVDSLF (PRAME_HUMAN)
LMALYVDSLY

SEQ ID NO: 156009 - protein, 10 aa, Artificial Sequence
  Description of Artificial Sequence: Synthetic peptide
  Seed: LSFYGNSISI (PRAME_HUMAN)
LMFYGNSISL

SEQ ID NO: 156010 - protein, 10 aa, Artificial Sequence
  Description of Artificial Sequence: Synthetic peptide
  Seed: AVLDGLDVLL (PRAME_HUMAN)
AMLDGLDVLF

SEQ ID NO: 156011 - protein, 9 aa, Artificial Sequence
  Description of Artificial Sequence: Synthetic peptide
  Seed: RHSQTLKAM (PRAME_HUMAN)
RRSQTLKAF

SEQ ID NO: 156012 - protein, 10 aa, Artificial Sequence
  Description of Artificial Sequence: Synthetic peptide
  Seed: GRLDQLLRHV (PRAME_HUMAN)
GRLDQLLRHF

SEQ ID NO: 156013 - protein, 8 aa, Artificial Sequence
  Description of Artificial Sequence: Synthetic peptide
  Seed: RRWKLQVL (PRAME_HUMAN)
RRWKLQVV

SEQ ID NO: 156014 - protein, 9 aa, Artificial Sequence
  Description of Artificial Sequence: Synthetic peptide
  Seed: MINLRRLLL (PRAME_HUMAN)
MINLRRLLV

SEQ ID NO: 156015 - protein, 9 aa, Artificial Sequence
  Description of Artificial Sequence: Synthetic peptide
  Seed: LTDVSPEPL (PRAME_HUMAN)
LQDVSPEPL

SEQ ID NO: 156016 - protein, 9 aa, Artificial Sequence
  Description of Artificial Sequence: Synthetic peptide
  Seed: RASATLQDL (PRAME_HUMAN)
RMSATLQDF

SEQ ID NO: 156017 - protein, 10 aa, Artificial Sequence
  Description of Artificial Sequence: Synthetic peptide
  Seed: FIPVEVLVDL (PRAME_HUMAN)
FNPVEVLVDM

SEQ ID NO: 156018 - protein, 10 aa, Artificial Sequence
  Description of Artificial Sequence: Synthetic peptide
  Seed: RASATLQDLV (PRAME_HUMAN)
RQSATLQDLV

SEQ ID NO: 156019 - protein, 9 aa, Artificial Sequence
  Description of Artificial Sequence: Synthetic peptide
  Seed: RLDQLLRHV (PRAME_HUMAN)
RTDQLLRHI

SEQ ID NO: 156020 - protein, 9 aa, Artificial Sequence
  Description of Artificial Sequence: Synthetic peptide
  Seed: VLMKGQHLH (PRAME_HUMAN)
VLMKGQHLY

SEQ ID NO: 156021 - protein, 9 aa, Artificial Sequence
  Description of Artificial Sequence: Synthetic peptide
  Seed: YGNSISISA (PRAME_HUMAN)
YYNSISISM

SEQ ID NO: 156022 - protein, 10 aa, Artificial Sequence
  Description of Artificial Sequence: Synthetic peptide
  Seed: LSFYGNSISI (PRAME_HUMAN)
LMFYGNSISM

SEQ ID NO: 156023 - protein, 10 aa, Artificial Sequence
  Description of Artificial Sequence: Synthetic peptide
  Seed: RGRLDQLLRH (PRAME_HUMAN)
RRRLDQLLRY

SEQ ID NO: 156024 - protein, 10 aa, Artificial Sequence
  Description of Artificial Sequence: Synthetic peptide
  Seed: VTCTWKLPTL (PRAME_HUMAN)
VLCTWKLPTM

SEQ ID NO: 156025 - protein, 9 aa, Artificial Sequence
  Description of Artificial Sequence: Synthetic peptide
  Seed: SQSPSVSQL (PRAME_HUMAN)
SESPSVSQY

SEQ ID NO: 156026 - protein, 9 aa, Artificial Sequence
  Description of Artificial Sequence: Synthetic peptide
  Seed: SIQSRYISM (PRAME_HUMAN)
SMQSRYISA

SEQ ID NO: 156027 - protein, 9 aa, Artificial Sequence
  Description of Artificial Sequence: Synthetic peptide
  Seed: LYVDSLFFL (PRAME_HUMAN)
LQVDSLFFV

SEQ ID NO: 156028 - protein, 9 aa, Artificial Sequence
  Description of Artificial Sequence: Synthetic peptide
  Seed: KVDGLSTEA (PRAME_HUMAN)
KNDGLSTEI

SEQ ID NO: 156029 - protein, 9 aa, Artificial Sequence
  Description of Artificial Sequence: Synthetic peptide
  Seed: NSHQDFWTV (PRAME_HUMAN)
NLHQDFWTI

SEQ ID NO: 156030 - protein, 9 aa, Artificial Sequence
  Description of Artificial Sequence: Synthetic peptide
  Seed: SYEDIHGTL (PRAME_HUMAN)
SHEDIHGTM

SEQ ID NO: 156031 - protein, 10 aa, Artificial Sequence
  Description of Artificial Sequence: Synthetic peptide
  Seed: KKLKIFAMPM (PRAME_HUMAN)
KTLKIFAMPM

SEQ ID NO: 156032 - protein, 9 aa, Artificial Sequence
  Description of Artificial Sequence: Synthetic peptide
  Seed: YGNSISISA (PRAME_HUMAN)
YVNSISISM

SEQ ID NO: 156033 - protein, 8 aa, Artificial Sequence
  Description of Artificial Sequence: Synthetic peptide
  Seed: SHIHASSY (PRAME_HUMAN)
SQIHASSY

SEQ ID NO: 156034 - protein, 10 aa, Artificial Sequence
  Description of Artificial Sequence: Synthetic peptide
  Seed: LQALYVDSLF (PRAME_HUMAN)
LDALYVDSLW

SEQ ID NO: 156035 - protein, 8 aa, Artificial Sequence
  Description of Artificial Sequence: Synthetic peptide
  Seed: YEDIHGTL (PRAME_HUMAN)
YYDIHGTI

SEQ ID NO: 156036 - protein, 10 aa, Artificial Sequence
  Description of Artificial Sequence: Synthetic peptide
  Seed: RLVELAGQSL (PRAME_HUMAN)
RLVELAGQSM

SEQ ID NO: 156037 - protein, 10 aa, Artificial Sequence
  Description of Artificial Sequence: Synthetic peptide
  Seed: RGRLDQLLRH (PRAME_HUMAN)
RRRLDQLLRK

SEQ ID NO: 156038 - protein, 9 aa, Artificial Sequence
  Description of Artificial Sequence: Synthetic peptide
  Seed: YVDSLFFLR (PRAME_HUMAN)
YFDSLFFLK

SEQ ID NO: 156039 - protein, 10 aa, Artificial Sequence
  Description of Artificial Sequence: Synthetic peptide
  Seed: PTLAKFSPYL (PRAME_HUMAN)
PFLAKFSPYM

SEQ ID NO: 156040 - protein, 10 aa, Artificial Sequence
  Description of Artificial Sequence: Synthetic peptide
  Seed: RTFYDPEPIL (PRAME_HUMAN)
RCFYDPEPIW

SEQ ID NO: 156041 - protein, 9 aa, Artificial Sequence
  Description of Artificial Sequence: Synthetic peptide
  Seed: THVLYPVPL (PRAME_HUMAN)
TVVLYPVPY

SEQ ID NO: 156042 - protein, 9 aa, Artificial Sequence
  Description of Artificial Sequence: Synthetic peptide
  Seed: SISALQSLL (PRAME_HUMAN)
SASALQSLV

SEQ ID NO: 156043 - protein, 8 aa, Artificial Sequence
  Description of Artificial Sequence: Synthetic peptide
  Seed: VLMKGQHL (PRAME_HUMAN)
VQMKGQHV

SEQ ID NO: 156044 - protein, 11 aa, Artificial Sequence
  Description of Artificial Sequence: Synthetic peptide
  Seed: NPCPHCGDRTF (PRAME_HUMAN)
NSCPHCGDRTW

SEQ ID NO: 156045 - protein, 10 aa, Artificial Sequence
  Description of Artificial Sequence: Synthetic peptide
  Seed: LSFYGNSISI (PRAME_HUMAN)
LMFYGNSISW

SEQ ID NO: 156046 - protein, 11 aa, Artificial Sequence
  Description of Artificial Sequence: Synthetic peptide
  Seed: RRLWGSIQSRY (PRAME_HUMAN)
RSLWGSIQSRR

SEQ ID NO: 156047 - protein, 9 aa, Artificial Sequence
  Description of Artificial Sequence: Synthetic peptide
  Seed: YVDSLFFLR (PRAME_HUMAN)
YIDSLFFLR

SEQ ID NO: 156048 - protein, 9 aa, Artificial Sequence
  Description of Artificial Sequence: Synthetic peptide
  Seed: EAEQPFIPV (PRAME_HUMAN)
EVEQPFIPV

SEQ ID NO: 156049 - protein, 10 aa, Artificial Sequence
  Description of Artificial Sequence: Synthetic peptide
  Seed: IQSRYISMSV (PRAME_HUMAN)
IASRYISMSA

SEQ ID NO: 156050 - protein, 8 aa, Artificial Sequence
  Description of Artificial Sequence: Synthetic peptide
  Seed: RELFPPLF (PRAME_HUMAN)
RELFPPLV

SEQ ID NO: 156051 - protein, 10 aa, Artificial Sequence
  Description of Artificial Sequence: Synthetic peptide
  Seed: LPTLAKFSPY (PRAME_HUMAN)
LYTLAKFSPF

SEQ ID NO: 156052 - protein, 10 aa, Artificial Sequence
  Description of Artificial Sequence: Synthetic peptide
  Seed: RHVMNPLETL (PRAME_HUMAN)
RCVMNPLETW

SEQ ID NO: 156053 - protein, 10 aa, Artificial Sequence
  Description of Artificial Sequence: Synthetic peptide
  Seed: ELFSYLIEKV (PRAME_HUMAN)
EIFSYLIEKV

SEQ ID NO: 156054 - protein, 10 aa, Artificial Sequence
  Description of Artificial Sequence: Synthetic peptide
  Seed: ALYVDSLFFL (PRAME_HUMAN)
ATYVDSLFFK

SEQ ID NO: 156055 - protein, 11 aa, Artificial Sequence
  Description of Artificial Sequence: Synthetic peptide
  Seed: SYISPEKEEQY (PRAME_HUMAN)
SMISPEKEEQY

SEQ ID NO: 156056 - protein, 9 aa, Artificial Sequence
  Description of Artificial Sequence: Synthetic peptide
  Seed: TCLPLGVLM (PRAME_HUMAN)
TSLPLGVLV

SEQ ID NO: 156057 - protein, 9 aa, Artificial Sequence
  Description of Artificial Sequence: Synthetic peptide
  Seed: SLLQHLIGL (PRAME_HUMAN)
SQLQHLIGT

SEQ ID NO: 156058 - protein, 9 aa, Artificial Sequence
  Description of Artificial Sequence: Synthetic peptide
  Seed: GACDELFSY (PRAME_HUMAN)
GPCDELFSW

SEQ ID NO: 156059 - protein, 8 aa, Artificial Sequence
  Description of Artificial Sequence: Synthetic peptide
  Seed: FYDPEPIL (PRAME_HUMAN)
FNDPEPIM

SEQ ID NO: 156060 - protein, 9 aa, Artificial Sequence
  Description of Artificial Sequence: Synthetic peptide
  Seed: FPPLFMAAF (PRAME_HUMAN)
FQPLFMAAF

SEQ ID NO: 156061 - protein, 9 aa, Artificial Sequence
  Description of Artificial Sequence: Synthetic peptide
  Seed: TCTWKLPTL (PRAME_HUMAN)
TATWKLPTL

SEQ ID NO: 156062 - protein, 9 aa, Artificial Sequence
  Description of Artificial Sequence: Synthetic peptide
  Seed: TWKLPTLAK (PRAME_HUMAN)
TTKLPTLAK

SEQ ID NO: 156063 - protein, 10 aa, Artificial Sequence
  Description of Artificial Sequence: Synthetic peptide
  Seed: GACDELFSYL (PRAME_HUMAN)
GLCDELFSYL

SEQ ID NO: 156064 - protein, 9 aa, Artificial Sequence
  Description of Artificial Sequence: Synthetic peptide
  Seed: SFYGNSISI (PRAME_HUMAN)
SGYGNSISF

SEQ ID NO: 156065 - protein, 10 aa, Artificial Sequence
  Description of Artificial Sequence: Synthetic peptide
  Seed: SNLTHVLYPV (PRAME_HUMAN)
SCLTHVLYPI

SEQ ID NO: 156066 - protein, 9 aa, Artificial Sequence
  Description of Artificial Sequence: Synthetic peptide
  Seed: LLLSHIHAS (PRAME_HUMAN)
LQLSHIHAT

SEQ ID NO: 156067 - protein, 9 aa, Artificial Sequence
  Description of Artificial Sequence: Synthetic peptide
  Seed: DEALAIAAL (PRAME_HUMAN)
DMALAIAAY

SEQ ID NO: 156068 - protein, 11 aa, Artificial Sequence
  Description of Artificial Sequence: Synthetic peptide
  Seed: MKGQHLHLETF (PRAME_HUMAN)
MMGQHLHLETF

SEQ ID NO: 156069 - protein, 9 aa, Artificial Sequence
  Description of Artificial Sequence: Synthetic peptide
  Seed: EDLEVTCTW (PRAME_HUMAN)
EALEVTCTL

SEQ ID NO: 156070 - protein, 9 aa, Artificial Sequence
  Description of Artificial Sequence: Synthetic peptide
  Seed: QSRYISMSV (PRAME_HUMAN)
QMRYISMSI

SEQ ID NO: 156071 - protein, 10 aa, Artificial Sequence
  Description of Artificial Sequence: Synthetic peptide
  Seed: IGLSNLTHVL (PRAME_HUMAN)
ILLSNLTHVH

SEQ ID NO: 156072 - protein, 9 aa, Artificial Sequence
  Description of Artificial Sequence: Synthetic peptide
  Seed: AEQPFIPVE (PRAME_HUMAN)
ADQPFIPVL

SEQ ID NO: 156073 - protein, 11 aa, Artificial Sequence
  Description of Artificial Sequence: Synthetic peptide
  Seed: LTDVSPEPLQA (PRAME_HUMAN)
LMDVSPEPLQL

SEQ ID NO: 156074 - protein, 9 aa, Artificial Sequence
  Description of Artificial Sequence: Synthetic peptide
  Seed: LFMAAFDGR (PRAME_HUMAN)
LIMAAFDGR

SEQ ID NO: 156075 - protein, 10 aa, Artificial Sequence
  Description of Artificial Sequence: Synthetic peptide
  Seed: RTFYDPEPIL (PRAME_HUMAN)
RSFYDPEPIY

SEQ ID NO: 156076 - protein, 10 aa, Artificial Sequence
  Description of Artificial Sequence: Synthetic peptide
  Seed: SPSVSQLSVL (PRAME_HUMAN)
STSVSQLSVW

SEQ ID NO: 156077 - protein, 10 aa, Artificial Sequence
  Description of Artificial Sequence: Synthetic peptide
  Seed: ARLRELLCEL (PRAME_HUMAN)
AKLRELLCEI

SEQ ID NO: 156078 - protein, 10 aa, Artificial Sequence
  Description of Artificial Sequence: Synthetic peptide
  Seed: LKAMVQAWPF (PRAME_HUMAN)
LPAMVQAWPY

SEQ ID NO: 156079 - protein, 9 aa, Artificial Sequence
  Description of Artificial Sequence: Synthetic peptide
  Seed: YIAQFTSQF (PRAME_HUMAN)
YSAQFTSQM

SEQ ID NO: 156080 - protein, 10 aa, Artificial Sequence
  Description of Artificial Sequence: Synthetic peptide
  Seed: RTFYDPEPIL (PRAME_HUMAN)
RTFYDPEPIF

SEQ ID NO: 156081 - protein, 9 aa, Artificial Sequence
  Description of Artificial Sequence: Synthetic peptide
  Seed: ALYVDSLFF (PRAME_HUMAN)
AHYVDSLFY

SEQ ID NO: 156082 - protein, 10 aa, Artificial Sequence
  Description of Artificial Sequence: Synthetic peptide
  Seed: ASATLQDLVF (PRAME_HUMAN)
ATATLQDLVY

SEQ ID NO: 156083 - protein, 9 aa, Artificial Sequence
  Description of Artificial Sequence: Synthetic peptide
  Seed: SHIHASSYI (PRAME_HUMAN)
SFIHASSYL

SEQ ID NO: 156084 - protein, 9 aa, Artificial Sequence
  Description of Artificial Sequence: Synthetic peptide
  Seed: SPEPLQALL (PRAME_HUMAN)
SYEPLQALM

SEQ ID NO: 156085 - protein, 9 aa, Artificial Sequence
  Description of Artificial Sequence: Synthetic peptide
  Seed: IGLSNLTHV (PRAME_HUMAN)
IALSNLTHM

SEQ ID NO: 156086 - protein, 9 aa, Artificial Sequence
  Description of Artificial Sequence: Synthetic peptide
  Seed: TCLPLGVLM (PRAME_HUMAN)
TSLPLGVLW

SEQ ID NO: 156087 - protein, 9 aa, Artificial Sequence
  Description of Artificial Sequence: Synthetic peptide
  Seed: FLRGRLDQL (PRAME_HUMAN)
FPRGRLDQF

SEQ ID NO: 156088 - protein, 9 aa, Artificial Sequence
  Description of Artificial Sequence: Synthetic peptide
  Seed: ISISALQSL (PRAME_HUMAN)
IAISALQSH

SEQ ID NO: 156089 - protein, 9 aa, Artificial Sequence
  Description of Artificial Sequence: Synthetic peptide
  Seed: SQFLSLQCL (PRAME_HUMAN)
SEFLSLQCT

SEQ ID NO: 156090 - protein, 10 aa, Artificial Sequence
  Description of Artificial Sequence: Synthetic peptide
  Seed: AMVQAWPFTC (PRAME_HUMAN)
AMVQAWPFTV

SEQ ID NO: 156091 - protein, 8 aa, Artificial Sequence
  Description of Artificial Sequence: Synthetic peptide
  Seed: DQLLRHVM (PRAME_HUMAN)
DALLRHVL

SEQ ID NO: 156092 - protein, 9 aa, Artificial Sequence
  Description of Artificial Sequence: Synthetic peptide
  Seed: GQHLHLETF (PRAME_HUMAN)
GSHLHLETM

SEQ ID NO: 156093 - protein, 9 aa, Artificial Sequence
  Description of Artificial Sequence: Synthetic peptide
  Seed: SQSPSVSQL (PRAME_HUMAN)
SESPSVSQP

SEQ ID NO: 156094 - protein, 9 aa, Artificial Sequence
  Description of Artificial Sequence: Synthetic peptide
  Seed: ACDELFSYL (PRAME_HUMAN)
AQDELFSYL

SEQ ID NO: 156095 - protein, 10 aa, Artificial Sequence
  Description of Artificial Sequence: Synthetic peptide
  Seed: KDEALAIAAL (PRAME_HUMAN)
KSEALAIAAL

SEQ ID NO: 156096 - protein, 9 aa, Artificial Sequence
  Description of Artificial Sequence: Synthetic peptide
  Seed: VSQLSVLSL (PRAME_HUMAN)
VFQLSVLSM

SEQ ID NO: 156097 - protein, 11 aa, Artificial Sequence
  Description of Artificial Sequence: Synthetic peptide
  Seed: ALYVDSLFFLR (PRAME_HUMAN)
ALYVDSLFFLT

SEQ ID NO: 156098 - protein, 9 aa, Artificial Sequence
  Description of Artificial Sequence: Synthetic peptide
  Seed: YISMSVWTS (PRAME_HUMAN)
YMSMSVWTG

SEQ ID NO: 156099 - protein, 9 aa, Artificial Sequence
  Description of Artificial Sequence: Synthetic peptide
  Seed: AWPFTCLPL (PRAME_HUMAN)
AYPFTCLPM

SEQ ID NO: 156100 - protein, 10 aa, Artificial Sequence
  Description of Artificial Sequence: Synthetic peptide
  Seed: RLWGSIQSRY (PRAME_HUMAN)
RMWGSIQSRY

SEQ ID NO: 156101 - protein, 9 aa, Artificial Sequence
  Description of Artificial Sequence: Synthetic peptide
  Seed: SPEPLQALL (PRAME_HUMAN)
SPEPLQALW

SEQ ID NO: 156102 - protein, 9 aa, Artificial Sequence
  Description of Artificial Sequence: Synthetic peptide
  Seed: VLYPVPLES (PRAME_HUMAN)
VMYPVPLEV

SEQ ID NO: 156103 - protein, 10 aa, Artificial Sequence
  Description of Artificial Sequence: Synthetic peptide
  Seed: KAVLDGLDVL (PRAME_HUMAN)
KQVLDGLDVV

SEQ ID NO: 156104 - protein, 10 aa, Artificial Sequence
  Description of Artificial Sequence: Synthetic peptide
  Seed: RLVELAGQSL (PRAME_HUMAN)
RMVELAGQSF

SEQ ID NO: 156105 - protein, 10 aa, Artificial Sequence
  Description of Artificial Sequence: Synthetic peptide
  Seed: PTLAKFSPYL (PRAME_HUMAN)
PFLAKFSPYA

SEQ ID NO: 156106 - protein, 10 aa, Artificial Sequence
  Description of Artificial Sequence: Synthetic peptide
  Seed: QSRYISMSVW (PRAME_HUMAN)
QARYISMSVF

SEQ ID NO: 156107 - protein, 9 aa, Artificial Sequence
  Description of Artificial Sequence: Synthetic peptide
  Seed: RGRLDQLLR (PRAME_HUMAN)
RFRLDQLLR

SEQ ID NO: 156108 - protein, 9 aa, Artificial Sequence
  Description of Artificial Sequence: Synthetic peptide
  Seed: RLAYLHARL (PRAME_HUMAN)
RMAYLHARL

SEQ ID NO: 156109 - protein, 9 aa, Artificial Sequence
  Description of Artificial Sequence: Synthetic peptide
  Seed: MVQAWPFTC (PRAME_HUMAN)
MMQAWPFTS

SEQ ID NO: 156110 - protein, 10 aa, Artificial Sequence
  Description of Artificial Sequence: Synthetic peptide
  Seed: AQFTSQFLSL (PRAME_HUMAN)
AQFTSQFLSF

SEQ ID NO: 156111 - protein, 10 aa, Artificial Sequence
  Description of Artificial Sequence: Synthetic peptide
  Seed: LLPRELFPPL (PRAME_HUMAN)
LWPRELFPPF

SEQ ID NO: 156112 - protein, 9 aa, Artificial Sequence
  Description of Artificial Sequence: Synthetic peptide
  Seed: SHQDFWTVW (PRAME_HUMAN)
SWQDFWTVM

SEQ ID NO: 156113 - protein, 9 aa, Artificial Sequence
  Description of Artificial Sequence: Synthetic peptide
  Seed: VSPEPLQAL (PRAME_HUMAN)
VFPEPLQAF

SEQ ID NO: 156114 - protein, 9 aa, Artificial Sequence
  Description of Artificial Sequence: Synthetic peptide
  Seed: ETLSITNCR (PRAME_HUMAN)
ESLSITNCK

SEQ ID NO: 156115 - protein, 10 aa, Artificial Sequence
  Description of Artificial Sequence: Synthetic peptide
  Seed: MVQAWPFTCL (PRAME_HUMAN)
MSQAWPFTCM

SEQ ID NO: 156116 - protein, 10 aa, Artificial Sequence
  Description of Artificial Sequence: Synthetic peptide
  Seed: AFDGRHSQTL (PRAME_HUMAN)
AFDGRHSQTM

SEQ ID NO: 156117 - protein, 9 aa, Artificial Sequence
  Description of Artificial Sequence: Synthetic peptide
  Seed: TSPRRLVEL (PRAME_HUMAN)
TQPRRLVEY

SEQ ID NO: 156118 - protein, 9 aa, Artificial Sequence
  Description of Artificial Sequence: Synthetic peptide
  Seed: FTCLPLGVL (PRAME_HUMAN)
FSCLPLGVY

SEQ ID NO: 156119 - protein, 10 aa, Artificial Sequence
  Description of Artificial Sequence: Synthetic peptide
  Seed: LSVLSLSGVM (PRAME_HUMAN)
LAVLSLSGVY

SEQ ID NO: 156120 - protein, 10 aa, Artificial Sequence
  Description of Artificial Sequence: Synthetic peptide
  Seed: LLPRELFPPL (PRAME_HUMAN)
LCPRELFPPI

SEQ ID NO: 156121 - protein, 9 aa, Artificial Sequence
  Description of Artificial Sequence: Synthetic peptide
  Seed: SLLQHLIGL (PRAME_HUMAN)
STLQHLIGW

SEQ ID NO: 156122 - protein, 9 aa, Artificial Sequence
  Description of Artificial Sequence: Synthetic peptide
  Seed: LMKGQHLHL (PRAME_HUMAN)
LPKGQHLHL

SEQ ID NO: 156123 - protein, 10 aa, Artificial Sequence
  Description of Artificial Sequence: Synthetic peptide
  Seed: LLSHIHASSY (PRAME_HUMAN)
LTSHIHASSF

SEQ ID NO: 156124 - protein, 9 aa, Artificial Sequence
  Description of Artificial Sequence: Synthetic peptide
  Seed: VWSGNRASL (PRAME_HUMAN)
VMSGNRASL

SEQ ID NO: 156125 - protein, 10 aa, Artificial Sequence
  Description of Artificial Sequence: Synthetic peptide
  Seed: LSHCSQLTTL (PRAME_HUMAN)
LGHCSQLTTW

SEQ ID NO: 156126 - protein, 9 aa, Artificial Sequence
  Description of Artificial Sequence: Synthetic peptide
  Seed: RLWGSIQSR (PRAME_HUMAN)
RFWGSIQSF

SEQ ID NO: 156127 - protein, 9 aa, Artificial Sequence
  Description of Artificial Sequence: Synthetic peptide
  Seed: VWSGNRASL (PRAME_HUMAN)
VWSGNRASF

SEQ ID NO: 156128 - protein, 9 aa, Artificial Sequence
  Description of Artificial Sequence: Synthetic peptide
  Seed: SQLTTLSFY (PRAME_HUMAN)
SKLTTLSFY

SEQ ID NO: 156129 - protein, 9 aa, Artificial Sequence
  Description of Artificial Sequence: Synthetic peptide
  Seed: KVDGLSTEA (PRAME_HUMAN)
KIDGLSTEL

SEQ ID NO: 156130 - protein, 9 aa, Artificial Sequence
  Description of Artificial Sequence: Synthetic peptide
  Seed: VLDGLDVLL (PRAME_HUMAN)
VSDGLDVLL

SEQ ID NO: 156131 - protein, 9 aa, Artificial Sequence
  Description of Artificial Sequence: Synthetic peptide
  Seed: LMKGQHLHL (PRAME_HUMAN)
LVKGQHLHY

SEQ ID NO: 156132 - protein, 9 aa, Artificial Sequence
  Description of Artificial Sequence: Synthetic peptide
  Seed: LSVLSLSGV (PRAME_HUMAN)
LAVLSLSGF

SEQ ID NO: 156133 - protein, 10 aa, Artificial Sequence
  Description of Artificial Sequence: Synthetic peptide
  Seed: DIHGTLHLER (PRAME_HUMAN)
DFHGTLHLER

SEQ ID NO: 156134 - protein, 9 aa, Artificial Sequence
  Description of Artificial Sequence: Synthetic peptide
  Seed: VSPEPLQAL (PRAME_HUMAN)
VTPEPLQAF

SEQ ID NO: 156135 - protein, 9 aa, Artificial Sequence
  Description of Artificial Sequence: Synthetic peptide
  Seed: YIAQFTSQF (PRAME_HUMAN)
YIAQFTSQI

SEQ ID NO: 156136 - protein, 10 aa, Artificial Sequence
  Description of Artificial Sequence: Synthetic peptide
  Seed: SVSQLSVLSL (PRAME_HUMAN)
SLSQLSVLSI

SEQ ID NO: 156137 - protein, 9 aa, Artificial Sequence
  Description of Artificial Sequence: Synthetic peptide
  Seed: SRYISMSVW (PRAME_HUMAN)
STYISMSVY

SEQ ID NO: 156138 - protein, 10 aa, Artificial Sequence
  Description of Artificial Sequence: Synthetic peptide
  Seed: KDEALAIAAL (PRAME_HUMAN)
KTEALAIAAA

SEQ ID NO: 156139 - protein, 10 aa, Artificial Sequence
  Description of Artificial Sequence: Synthetic peptide
  Seed: QAWPFTCLPL (PRAME_HUMAN)
QYWPFTCLPM

SEQ ID NO: 156140 - protein, 9 aa, Artificial Sequence
  Description of Artificial Sequence: Synthetic peptide
  Seed: VSPEPLQAL (PRAME_HUMAN)
VPPEPLQAV

SEQ ID NO: 156141 - protein, 10 aa, Artificial Sequence
  Description of Artificial Sequence: Synthetic peptide
  Seed: SLLQHLIGLS (PRAME_HUMAN)
SLLQHLIGLL

SEQ ID NO: 156142 - protein, 9 aa, Artificial Sequence
  Description of Artificial Sequence: Synthetic peptide
  Seed: ITDDQLLAL (PRAME_HUMAN)
IMDDQLLAF

SEQ ID NO: 156143 - protein, 9 aa, Artificial Sequence
  Description of Artificial Sequence: Synthetic peptide
  Seed: LLRHVMNPL (PRAME_HUMAN)
LARHVMNPM

SEQ ID NO: 156144 - protein, 9 aa, Artificial Sequence
  Description of Artificial Sequence: Synthetic peptide
  Seed: ALAIAALEL (PRAME_HUMAN)
ALAIAALEI

SEQ ID NO: 156145 - protein, 11 aa, Artificial Sequence
  Description of Artificial Sequence: Synthetic peptide
  Seed: KLPTLAKFSPY (PRAME_HUMAN)
KTPTLAKFSPW

SEQ ID NO: 156146 - protein, 10 aa, Artificial Sequence
  Description of Artificial Sequence: Synthetic peptide
  Seed: DELFSYLIEK (PRAME_HUMAN)
DDLFSYLIER

SEQ ID NO: 156147 - protein, 9 aa, Artificial Sequence
  Description of Artificial Sequence: Synthetic peptide
  Seed: SRYISMSVW (PRAME_HUMAN)
SSYISMSVM

SEQ ID NO: 156148 - protein, 10 aa, Artificial Sequence
  Description of Artificial Sequence: Synthetic peptide
  Seed: ALLERASATL (PRAME_HUMAN)
AQLERASATW

SEQ ID NO: 156149 - protein, 9 aa, Artificial Sequence
  Description of Artificial Sequence: Synthetic peptide
  Seed: SIEDLEVTC (PRAME_HUMAN)
SSEDLEVTI

SEQ ID NO: 156150 - protein, 10 aa, Artificial Sequence
  Description of Artificial Sequence: Synthetic peptide
  Seed: LLSHIHASSY (PRAME_HUMAN)
LMSHIHASSF

SEQ ID NO: 156151 - protein, 10 aa, Artificial Sequence
  Description of Artificial Sequence: Synthetic peptide
  Seed: AFDGRHSQTL (PRAME_HUMAN)
ASDGRHSQTI

SEQ ID NO: 156152 - protein, 10 aa, Artificial Sequence
  Description of Artificial Sequence: Synthetic peptide
  Seed: AQFTSQFLSL (PRAME_HUMAN)
AHFTSQFLSM

SEQ ID NO: 156153 - protein, 10 aa, Artificial Sequence
  Description of Artificial Sequence: Synthetic peptide
  Seed: AEQPFIPVEV (PRAME_HUMAN)
AEQPFIPVEM

SEQ ID NO: 156154 - protein, 9 aa, Artificial Sequence
  Description of Artificial Sequence: Synthetic peptide
  Seed: SRYISMSVW (PRAME_HUMAN)
SMYISMSVF

SEQ ID NO: 156155 - protein, 9 aa, Artificial Sequence
  Description of Artificial Sequence: Synthetic peptide
  Seed: YVDSLFFLR (PRAME_HUMAN)
YSDSLFFLR

SEQ ID NO: 156156 - protein, 9 aa, Artificial Sequence
  Description of Artificial Sequence: Synthetic peptide
  Seed: QPMTKKRKV (PRAME_HUMAN)
QLMTKKRKL

SEQ ID NO: 156157 - protein, 9 aa, Artificial Sequence
  Description of Artificial Sequence: Synthetic peptide
  Seed: EDLEVTCTW (PRAME_HUMAN)
EMLEVTCTW

SEQ ID NO: 156158 - protein, 10 aa, Artificial Sequence
  Description of Artificial Sequence: Synthetic peptide
  Seed: RLSEGDVMHL (PRAME_HUMAN)
RLSEGDVMHR

SEQ ID NO: 156159 - protein, 9 aa, Artificial Sequence
  Description of Artificial Sequence: Synthetic peptide
  Seed: ERLAYLHAR (PRAME_HUMAN)
ENLAYLHAR

SEQ ID NO: 156160 - protein, 9 aa, Artificial Sequence
  Description of Artificial Sequence: Synthetic peptide
  Seed: SVLSLSGVM (PRAME_HUMAN)
SALSLSGVL

SEQ ID NO: 156161 - protein, 10 aa, Artificial Sequence
  Description of Artificial Sequence: Synthetic peptide
  Seed: QAWPFTCLPL (PRAME_HUMAN)
QVWPFTCLPV

SEQ ID NO: 156162 - protein, 9 aa, Artificial Sequence
  Description of Artificial Sequence: Synthetic peptide
  Seed: DEALAIAAL (PRAME_HUMAN)
DHALAIAAA

SEQ ID NO: 156163 - protein, 9 aa, Artificial Sequence
  Description of Artificial Sequence: Synthetic peptide
  Seed: RTFYDPEPI (PRAME_HUMAN)
RQFYDPEPL

SEQ ID NO: 156164 - protein, 11 aa, Artificial Sequence
  Description of Artificial Sequence: Synthetic peptide
  Seed: LPTLAKFSPYL (PRAME_HUMAN)
LCTLAKFSPYI

SEQ ID NO: 156165 - protein, 10 aa, Artificial Sequence
  Description of Artificial Sequence: Synthetic peptide
  Seed: SLLQHLIGLS (PRAME_HUMAN)
SMLQHLIGLL

SEQ ID NO: 156166 - protein, 9 aa, Artificial Sequence
  Description of Artificial Sequence: Synthetic peptide
  Seed: FYDPEPILC (PRAME_HUMAN)
FADPEPILA

SEQ ID NO: 156167 - protein, 9 aa, Artificial Sequence
  Description of Artificial Sequence: Synthetic peptide
  Seed: VLMKGQHLH (PRAME_HUMAN)
VLMKGQHLR

SEQ ID NO: 156168 - protein, 9 aa, Artificial Sequence
  Description of Artificial Sequence: Synthetic peptide
  Seed: LSHIHASSY (PRAME_HUMAN)
LPHIHASSM

SEQ ID NO: 156169 - protein, 11 aa, Artificial Sequence
  Description of Artificial Sequence: Synthetic peptide
  Seed: MKGQHLHLETF (PRAME_HUMAN)
MAGQHLHLETY

SEQ ID NO: 156170 - protein, 11 aa, Artificial Sequence
  Description of Artificial Sequence: Synthetic peptide
  Seed: SNLTHVLYPVP (PRAME_HUMAN)
SLLTHVLYPVQ

SEQ ID NO: 156171 - protein, 8 aa, Artificial Sequence
  Description of Artificial Sequence: Synthetic peptide
  Seed: LAIAALEL (PRAME_HUMAN)
LQIAALEI

SEQ ID NO: 156172 - protein, 10 aa, Artificial Sequence
  Description of Artificial Sequence: Synthetic peptide
  Seed: SPSVSQLSVL (PRAME_HUMAN)
SYSVSQLSVW

SEQ ID NO: 156173 - protein, 9 aa, Artificial Sequence
  Description of Artificial Sequence: Synthetic peptide
  Seed: FYDPEPILC (PRAME_HUMAN)
FRDPEPILM

SEQ ID NO: 156174 - protein, 10 aa, Artificial Sequence
  Description of Artificial Sequence: Synthetic peptide
  Seed: LLLSHIHASS (PRAME_HUMAN)
LTLSHIHASI

SEQ ID NO: 156175 - protein, 9 aa, Artificial Sequence
  Description of Artificial Sequence: Synthetic peptide
  Seed: LKMVQLDSI (PRAME_HUMAN)
LAMVQLDSF

SEQ ID NO: 156176 - protein, 9 aa, Artificial Sequence
  Description of Artificial Sequence: Synthetic peptide
  Seed: ALAIAALEL (PRAME_HUMAN)
ASAIAALEY

SEQ ID NO: 156177 - protein, 10 aa, Artificial Sequence
  Description of Artificial Sequence: Synthetic peptide
  Seed: SPSVSQLSVL (PRAME_HUMAN)
SFSVSQLSVF

SEQ ID NO: 156178 - protein, 10 aa, Artificial Sequence
  Description of Artificial Sequence: Synthetic peptide
  Seed: RASATLQDLV (PRAME_HUMAN)
RLSATLQDLF

SEQ ID NO: 156179 - protein, 9 aa, Artificial Sequence
  Description of Artificial Sequence: Synthetic peptide
  Seed: KLKIFAMPM (PRAME_HUMAN)
KFKIFAMPV

SEQ ID NO: 156180 - protein, 9 aa, Artificial Sequence
  Description of Artificial Sequence: Synthetic peptide
  Seed: EDLEVTCTW (PRAME_HUMAN)
EILEVTCTM

SEQ ID NO: 156181 - protein, 9 aa, Artificial Sequence
  Description of Artificial Sequence: Synthetic peptide
  Seed: LLALLPSLS (PRAME_HUMAN)
LIALLPSLL

SEQ ID NO: 156182 - protein, 9 aa, Artificial Sequence
  Description of Artificial Sequence: Synthetic peptide
  Seed: VSQLSVLSL (PRAME_HUMAN)
VIQLSVLSF

SEQ ID NO: 156183 - protein, 11 aa, Artificial Sequence
  Description of Artificial Sequence: Synthetic peptide
  Seed: CRLSEGDVMHL (PRAME_HUMAN)
CHLSEGDVMHM

SEQ ID NO: 156184 - protein, 10 aa, Artificial Sequence
  Description of Artificial Sequence: Synthetic peptide
  Seed: MPMQDIKMIL (PRAME_HUMAN)
MRMQDIKMIL

SEQ ID NO: 156185 - protein, 9 aa, Artificial Sequence
  Description of Artificial Sequence: Synthetic peptide
  Seed: SFYGNSISI (PRAME_HUMAN)
SRYGNSISL

SEQ ID NO: 156186 - protein, 9 aa, Artificial Sequence
  Description of Artificial Sequence: Synthetic peptide
  Seed: RLAYLHARL (PRAME_HUMAN)
RVAYLHARI

SEQ ID NO: 156187 - protein, 10 aa, Artificial Sequence
  Description of Artificial Sequence: Synthetic peptide
  Seed: ASATLQDLVF (PRAME_HUMAN)
AKATLQDLVY

SEQ ID NO: 156188 - protein, 9 aa, Artificial Sequence
  Description of Artificial Sequence: Synthetic peptide
  Seed: QSRYISMSV (PRAME_HUMAN)
QFRYISMSA

SEQ ID NO: 156189 - protein, 9 aa, Artificial Sequence
  Description of Artificial Sequence: Synthetic peptide
  Seed: RELFPPLFM (PRAME_HUMAN)
RALFPPLFY

SEQ ID NO: 156190 - protein, 10 aa, Artificial Sequence
  Description of Artificial Sequence: Synthetic peptide
  Seed: GQHLHLETFK (PRAME_HUMAN)
GSHLHLETFK

SEQ ID NO: 156191 - protein, 10 aa, Artificial Sequence
  Description of Artificial Sequence: Synthetic peptide
  Seed: RLVELAGQSL (PRAME_HUMAN)
RMVELAGQSL

SEQ ID NO: 156192 - protein, 9 aa, Artificial Sequence
  Description of Artificial Sequence: Synthetic peptide
  Seed: SHIHASSYI (PRAME_HUMAN)
SIIHASSYF

SEQ ID NO: 156193 - protein, 10 aa, Artificial Sequence
  Description of Artificial Sequence: Synthetic peptide
  Seed: RELFPPLFMA (PRAME_HUMAN)
RELFPPLFMV

SEQ ID NO: 156194 - protein, 9 aa, Artificial Sequence
  Description of Artificial Sequence: Synthetic peptide
  Seed: RLRELLCEL (PRAME_HUMAN)
RTRELLCEM

SEQ ID NO: 156195 - protein, 9 aa, Artificial Sequence
  Description of Artificial Sequence: Synthetic peptide
  Seed: YIAQFTSQF (PRAME_HUMAN)
YTAQFTSQA

SEQ ID NO: 156196 - protein, 9 aa, Artificial Sequence
  Description of Artificial Sequence: Synthetic peptide
  Seed: YISMSVWTS (PRAME_HUMAN)
YTSMSVWTI

SEQ ID NO: 156197 - protein, 9 aa, Artificial Sequence
  Description of Artificial Sequence: Synthetic peptide
  Seed: EEQYIAQFT (PRAME_HUMAN)
EEQYIAQFV

SEQ ID NO: 156198 - protein, 9 aa, Artificial Sequence
  Description of Artificial Sequence: Synthetic peptide
  Seed: TDDQLLALL (PRAME_HUMAN)
TIDQLLALV

SEQ ID NO: 156199 - protein, 9 aa, Artificial Sequence
  Description of Artificial Sequence: Synthetic peptide
  Seed: SALQSLLQH (PRAME_HUMAN)
SALQSLLQY

SEQ ID NO: 156200 - protein, 9 aa, Artificial Sequence
  Description of Artificial Sequence: Synthetic peptide
  Seed: FAMPMQDIK (PRAME_HUMAN)
FAMPMQDII

SEQ ID NO: 156201 - protein, 9 aa, Artificial Sequence
  Description of Artificial Sequence: Synthetic peptide
  Seed: YVDSLFFLR (PRAME_HUMAN)
YQDSLFFLY

SEQ ID NO: 156202 - protein, 9 aa, Artificial Sequence
  Description of Artificial Sequence: Synthetic peptide
  Seed: RLLLSHIHA (PRAME_HUMAN)
RYLLSHIHK

SEQ ID NO: 156203 - protein, 9 aa, Artificial Sequence
  Description of Artificial Sequence: Synthetic peptide
  Seed: MINLRRLLL (PRAME_HUMAN)
MVNLRRLLI

SEQ ID NO: 156204 - protein, 9 aa, Artificial Sequence
  Description of Artificial Sequence: Synthetic peptide
  Seed: QPMTKKRKV (PRAME_HUMAN)
QPMTKKRKL

SEQ ID NO: 156205 - protein, 10 aa, Artificial Sequence
  Description of Artificial Sequence: Synthetic peptide
  Seed: ESYEDIHGTL (PRAME_HUMAN)
EVYEDIHGTK

SEQ ID NO: 156206 - protein, 10 aa, Artificial Sequence
  Description of Artificial Sequence: Synthetic peptide
  Seed: RGRLDQLLRH (PRAME_HUMAN)
RHRLDQLLRI

SEQ ID NO: 156207 - protein, 9 aa, Artificial Sequence
  Description of Artificial Sequence: Synthetic peptide
  Seed: YEDIHGTLH (PRAME_HUMAN)
YVDIHGTLY

SEQ ID NO: 156208 - protein, 10 aa, Artificial Sequence
  Description of Artificial Sequence: Synthetic peptide
  Seed: LLLSHIHASS (PRAME_HUMAN)
LYLSHIHASL

SEQ ID NO: 156209 - protein, 10 aa, Artificial Sequence
  Description of Artificial Sequence: Synthetic peptide
  Seed: AFDGRHSQTL (PRAME_HUMAN)
ASDGRHSQTL

SEQ ID NO: 156210 - protein, 10 aa, Artificial Sequence
  Description of Artificial Sequence: Synthetic peptide
  Seed: MPMQDIKMIL (PRAME_HUMAN)
MAMQDIKMIW

SEQ ID NO: 156211 - protein, 9 aa, Artificial Sequence
  Description of Artificial Sequence: Synthetic peptide
  Seed: MINLRRLLL (PRAME_HUMAN)
MVNLRRLLA

SEQ ID NO: 156212 - protein, 9 aa, Artificial Sequence
  Description of Artificial Sequence: Synthetic peptide
  Seed: HVMNPLETL (PRAME_HUMAN)
HGMNPLETM

SEQ ID NO: 156213 - protein, 8 aa, Artificial Sequence
  Description of Artificial Sequence: Synthetic peptide
  Seed: TDDQLLAL (PRAME_HUMAN)
TFDQLLAI

SEQ ID NO: 156214 - protein, 10 aa, Artificial Sequence
  Description of Artificial Sequence: Synthetic peptide
  Seed: MPMQDIKMIL (PRAME_HUMAN)
MCMQDIKMIV

SEQ ID NO: 156215 - protein, 9 aa, Artificial Sequence
  Description of Artificial Sequence: Synthetic peptide
  Seed: FTCLPLGVL (PRAME_HUMAN)
FICLPLGVY

SEQ ID NO: 156216 - protein, 10 aa, Artificial Sequence
  Description of Artificial Sequence: Synthetic peptide
  Seed: ARLRELLCEL (PRAME_HUMAN)
AMLRELLCEM

SEQ ID NO: 156217 - protein, 10 aa, Artificial Sequence
  Description of Artificial Sequence: Synthetic peptide
  Seed: RELFPPLFMA (PRAME_HUMAN)
RPLFPPLFMI

SEQ ID NO: 156218 - protein, 10 aa, Artificial Sequence
  Description of Artificial Sequence: Synthetic peptide
  Seed: IQSRYISMSV (PRAME_HUMAN)
IHSRYISMSK

SEQ ID NO: 156219 - protein, 9 aa, Artificial Sequence
  Description of Artificial Sequence: Synthetic peptide
  Seed: LDSIEDLEV (PRAME_HUMAN)
LESIEDLEA

SEQ ID NO: 156220 - protein, 9 aa, Artificial Sequence
  Description of Artificial Sequence: Synthetic peptide
  Seed: LQALYVDSL (PRAME_HUMAN)
LIALYVDSI

SEQ ID NO: 156221 - protein, 9 aa, Artificial Sequence
  Description of Artificial Sequence: Synthetic peptide
  Seed: RWKLQVLDL (PRAME_HUMAN)
RYKLQVLDM

SEQ ID NO: 156222 - protein, 10 aa, Artificial Sequence
  Description of Artificial Sequence: Synthetic peptide
  Seed: AIAALELLPR (PRAME_HUMAN)
AQAALELLPR

SEQ ID NO: 156223 - protein, 9 aa, Artificial Sequence
  Description of Artificial Sequence: Synthetic peptide
  Seed: LYVDSLFFL (PRAME_HUMAN)
LMVDSLFFM

SEQ ID NO: 156224 - protein, 9 aa, Artificial Sequence
  Description of Artificial Sequence: Synthetic peptide
  Seed: THVLYPVPL (PRAME_HUMAN)
TQVLYPVPY

SEQ ID NO: 156225 - protein, 10 aa, Artificial Sequence
  Description of Artificial Sequence: Synthetic peptide
  Seed: LERLAYLHAR (PRAME_HUMAN)
LRRLAYLHAM

SEQ ID NO: 156226 - protein, 10 aa, Artificial Sequence
  Description of Artificial Sequence: Synthetic peptide
  Seed: LLLSHIHASS (PRAME_HUMAN)
LSLSHIHASV

SEQ ID NO: 156227 - protein, 10 aa, Artificial Sequence
  Description of Artificial Sequence: Synthetic peptide
  Seed: ELFSYLIEKV (PRAME_HUMAN)
ELFSYLIEKL

SEQ ID NO: 156228 - protein, 11 aa, Artificial Sequence
  Description of Artificial Sequence: Synthetic peptide
  Seed: CRLSEGDVMHL (PRAME_HUMAN)
CWLSEGDVMHL

SEQ ID NO: 156229 - protein, 9 aa, Artificial Sequence
  Description of Artificial Sequence: Synthetic peptide
  Seed: QLLALLPSL (PRAME_HUMAN)
QILALLPSI

SEQ ID NO: 156230 - protein, 9 aa, Artificial Sequence
  Description of Artificial Sequence: Synthetic peptide
  Seed: RTFYDPEPI (PRAME_HUMAN)
RTFYDPEPY

SEQ ID NO: 156231 - protein, 11 aa, Artificial Sequence
  Description of Artificial Sequence: Synthetic peptide
  Seed: TVWSGNRASLY (PRAME_HUMAN)
TQWSGNRASLY

SEQ ID NO: 156232 - protein, 10 aa, Artificial Sequence
  Description of Artificial Sequence: Synthetic peptide
  Seed: AKFSPYLGQM (PRAME_HUMAN)
ARFSPYLGQY

SEQ ID NO: 156233 - protein, 9 aa, Artificial Sequence
  Description of Artificial Sequence: Synthetic peptide
  Seed: ALLERASAT (PRAME_HUMAN)
ATLERASAL

SEQ ID NO: 156234 - protein, 9 aa, Artificial Sequence
  Description of Artificial Sequence: Synthetic peptide
  Seed: VSQLSVLSL (PRAME_HUMAN)
VYQLSVLSI

SEQ ID NO: 156235 - protein, 9 aa, Artificial Sequence
  Description of Artificial Sequence: Synthetic peptide
  Seed: SLSHCSQLT (PRAME_HUMAN)
SQSHCSQLL

SEQ ID NO: 156236 - protein, 10 aa, Artificial Sequence
  Description of Artificial Sequence: Synthetic peptide
  Seed: YEDIHGTLHL (PRAME_HUMAN)
YSDIHGTLHV

SEQ ID NO: 156237 - protein, 9 aa, Artificial Sequence
  Description of Artificial Sequence: Synthetic peptide
  Seed: FLRGRLDQL (PRAME_HUMAN)
FARGRLDQM

SEQ ID NO: 156238 - protein, 10 aa, Artificial Sequence
  Description of Artificial Sequence: Synthetic peptide
  Seed: LLPRELFPPL (PRAME_HUMAN)
LSPRELFPPM

SEQ ID NO: 156239 - protein, 10 aa, Artificial Sequence
  Description of Artificial Sequence: Synthetic peptide
  Seed: VWSGNRASLY (PRAME_HUMAN)
VSSGNRASLY

SEQ ID NO: 156240 - protein, 8 aa, Artificial Sequence
  Description of Artificial Sequence: Synthetic peptide
  Seed: LFPPLFMA (PRAME_HUMAN)
LLPPLFMV

SEQ ID NO: 156241 - protein, 8 aa, Artificial Sequence
  Description of Artificial Sequence: Synthetic peptide
  Seed: MPMQDIKM (PRAME_HUMAN)
MPMQDIKY

SEQ ID NO: 156242 - protein, 10 aa, Artificial Sequence
  Description of Artificial Sequence: Synthetic peptide
  Seed: IQSRYISMSV (PRAME_HUMAN)
ILSRYISMSI

SEQ ID NO: 156243 - protein, 10 aa, Artificial Sequence
  Description of Artificial Sequence: Synthetic peptide
  Seed: MVQAWPFTCL (PRAME_HUMAN)
MPQAWPFTCF

SEQ ID NO: 156244 - protein, 9 aa, Artificial Sequence
  Description of Artificial Sequence: Synthetic peptide
  Seed: LAYLHARLR (PRAME_HUMAN)
LIYLHARLK

SEQ ID NO: 156245 - protein, 9 aa, Artificial Sequence
  Description of Artificial Sequence: Synthetic peptide
  Seed: KAMVQAWPF (PRAME_HUMAN)
KQMVQAWPW

SEQ ID NO: 156246 - protein, 9 aa, Artificial Sequence
  Description of Artificial Sequence: Synthetic peptide
  Seed: LLRHVMNPL (PRAME_HUMAN)
LMRHVMNPY

SEQ ID NO: 156247 - protein, 8 aa, Artificial Sequence
  Description of Artificial Sequence: Synthetic peptide
  Seed: VLDGLDVL (PRAME_HUMAN)
VADGLDVL

SEQ ID NO: 156248 - protein, 10 aa, Artificial Sequence
  Description of Artificial Sequence: Synthetic peptide
  Seed: RELFPPLFMA (PRAME_HUMAN)
RRLFPPLFMI

SEQ ID NO: 156249 - protein, 10 aa, Artificial Sequence
  Description of Artificial Sequence: Synthetic peptide
  Seed: HLHLETFKAV (PRAME_HUMAN)
HMHLETFKAV

SEQ ID NO: 156250 - protein, 10 aa, Artificial Sequence
  Description of Artificial Sequence: Synthetic peptide
  Seed: FLSLQCLQAL (PRAME_HUMAN)
FQSLQCLQAA

SEQ ID NO: 156251 - protein, 9 aa, Artificial Sequence
  Description of Artificial Sequence: Synthetic peptide
  Seed: LYVDSLFFL (PRAME_HUMAN)
LAVDSLFFL

SEQ ID NO: 156252 - protein, 9 aa, Artificial Sequence
  Description of Artificial Sequence: Synthetic peptide
  Seed: QALYVDSLF (PRAME_HUMAN)
QTLYVDSLL

SEQ ID NO: 156253 - protein, 11 aa, Artificial Sequence
  Description of Artificial Sequence: Synthetic peptide
  Seed: LLLSHIHASSY (PRAME_HUMAN)
LNLSHIHASSW

SEQ ID NO: 156254 - protein, 11 aa, Artificial Sequence
  Description of Artificial Sequence: Synthetic peptide
  Seed: QALYVDSLFFL (PRAME_HUMAN)
QFLYVDSLFFV

SEQ ID NO: 156255 - protein, 11 aa, Artificial Sequence
  Description of Artificial Sequence: Synthetic peptide
  Seed: RELFPPLFMAA (PRAME_HUMAN)
RRLFPPLFMAI

SEQ ID NO: 156256 - protein, 10 aa, Artificial Sequence
  Description of Artificial Sequence: Synthetic peptide
  Seed: ALAIAALELL (PRAME_HUMAN)
AIAIAALELV

SEQ ID NO: 156257 - protein, 10 aa, Artificial Sequence
  Description of Artificial Sequence: Synthetic peptide
  Seed: LSFYGNSISI (PRAME_HUMAN)
LVFYGNSISF

SEQ ID NO: 156258 - protein, 10 aa, Artificial Sequence
  Description of Artificial Sequence: Synthetic peptide
  Seed: AQFTSQFLSL (PRAME_HUMAN)
ALFTSQFLSV

SEQ ID NO: 156259 - protein, 10 aa, Artificial Sequence
  Description of Artificial Sequence: Synthetic peptide
  Seed: MPMQDIKMIL (PRAME_HUMAN)
MAMQDIKMIV

SEQ ID NO: 156260 - protein, 10 aa, Artificial Sequence
  Description of Artificial Sequence: Synthetic peptide
  Seed: ALLERASATL (PRAME_HUMAN)
AVLERASATY

SEQ ID NO: 156261 - protein, 10 aa, Artificial Sequence
  Description of Artificial Sequence: Synthetic peptide
  Seed: MVQAWPFTCL (PRAME_HUMAN)
MTQAWPFTCF

SEQ ID NO: 156262 - protein, 9 aa, Artificial Sequence
  Description of Artificial Sequence: Synthetic peptide
  Seed: FYDPEPILC (PRAME_HUMAN)
FLDPEPILV

SEQ ID NO: 156263 - protein, 9 aa, Artificial Sequence
  Description of Artificial Sequence: Synthetic peptide
  Seed: TDDQLLALL (PRAME_HUMAN)
TWDQLLALI

SEQ ID NO: 156264 - protein, 9 aa, Artificial Sequence
  Description of Artificial Sequence: Synthetic peptide
  Seed: ALYVDSLFF (PRAME_HUMAN)
ASYVDSLFM

SEQ ID NO: 156265 - protein, 9 aa, Artificial Sequence
  Description of Artificial Sequence: Synthetic peptide
  Seed: YSFPEPEAA (PRAME_HUMAN)
YQFPEPEAA

SEQ ID NO: 156266 - protein, 8 aa, Artificial Sequence
  Description of Artificial Sequence: Synthetic peptide
  Seed: LHLERLAY (PRAME_HUMAN)
LMLERLAF

SEQ ID NO: 156267 - protein, 10 aa, Artificial Sequence
  Description of Artificial Sequence: Synthetic peptide
  Seed: SMSVWTSPRR (PRAME_HUMAN)
SISVWTSPRR

SEQ ID NO: 156268 - protein, 10 aa, Artificial Sequence
  Description of Artificial Sequence: Synthetic peptide
  Seed: RGRLDQLLRH (PRAME_HUMAN)
RARLDQLLRM

SEQ ID NO: 156269 - protein, 10 aa, Artificial Sequence
  Description of Artificial Sequence: Synthetic peptide
  Seed: LLPRELFPPL (PRAME_HUMAN)
LLPRELFPPI

SEQ ID NO: 156270 - protein, 9 aa, Artificial Sequence
  Description of Artificial Sequence: Synthetic peptide
  Seed: SQSPSVSQL (PRAME_HUMAN)
SMSPSVSQA

SEQ ID NO: 156271 - protein, 9 aa, Artificial Sequence
  Description of Artificial Sequence: Synthetic peptide
  Seed: LYPVPLESY (PRAME_HUMAN)
LVPVPLESF

SEQ ID NO: 156272 - protein, 9 aa, Artificial Sequence
  Description of Artificial Sequence: Synthetic peptide
  Seed: LDSIEDLEV (PRAME_HUMAN)
LESIEDLEV

SEQ ID NO: 156273 - protein, 9 aa, Artificial Sequence
  Description of Artificial Sequence: Synthetic peptide
  Seed: YSFPEPEAA (PRAME_HUMAN)
YDFPEPEAY

SEQ ID NO: 156274 - protein, 9 aa, Artificial Sequence
  Description of Artificial Sequence: Synthetic peptide
  Seed: MHLSQSPSV (PRAME_HUMAN)
MVLSQSPSM

SEQ ID NO: 156275 - protein, 11 aa, Artificial Sequence
  Description of Artificial Sequence: Synthetic peptide
  Seed: DVSPEPLQALL (PRAME_HUMAN)
DSSPEPLQALR

SEQ ID NO: 156276 - protein, 9 aa, Artificial Sequence
  Description of Artificial Sequence: Synthetic peptide
  Seed: VLMKGQHLH (PRAME_HUMAN)
VTMKGQHLK

SEQ ID NO: 156277 - protein, 9 aa, Artificial Sequence
  Description of Artificial Sequence: Synthetic peptide
  Seed: LSNLTHVLY (PRAME_HUMAN)
LANLTHVLW

SEQ ID NO: 156278 - protein, 9 aa, Artificial Sequence
  Description of Artificial Sequence: Synthetic peptide
  Seed: TDDQLLALL (PRAME_HUMAN)
TYDQLLALI

SEQ ID NO: 156279 - protein, 9 aa, Artificial Sequence
  Description of Artificial Sequence: Synthetic peptide
  Seed: EAAQPMTKK (PRAME_HUMAN)
ESAQPMTKR

SEQ ID NO: 156280 - protein, 10 aa, Artificial Sequence
  Description of Artificial Sequence: Synthetic peptide
  Seed: ALYVDSLFFL (PRAME_HUMAN)
AMYVDSLFFI

SEQ ID NO: 156281 - protein, 9 aa, Artificial Sequence
  Description of Artificial Sequence: Synthetic peptide
  Seed: LCCKKLKIF (PRAME_HUMAN)
LSCKKLKIW

SEQ ID NO: 156282 - protein, 10 aa, Artificial Sequence
  Description of Artificial Sequence: Synthetic peptide
  Seed: MPMQDIKMIL (PRAME_HUMAN)
MLMQDIKMIL

SEQ ID NO: 156283 - protein, 10 aa, Artificial Sequence
  Description of Artificial Sequence: Synthetic peptide
  Seed: GACDELFSYL (PRAME_HUMAN)
GLCDELFSYI

SEQ ID NO: 156284 - protein, 9 aa, Artificial Sequence
  Description of Artificial Sequence: Synthetic peptide
  Seed: CKKLKIFAM (PRAME_HUMAN)
CPKLKIFAV

SEQ ID NO: 156285 - protein, 9 aa, Artificial Sequence
  Description of Artificial Sequence: Synthetic peptide
  Seed: LELLPRELF (PRAME_HUMAN)
LMLLPRELF

SEQ ID NO: 156286 - protein, 9 aa, Artificial Sequence
  Description of Artificial Sequence: Synthetic peptide
  Seed: NSISISALQ (PRAME_HUMAN)
NIISISALY

SEQ ID NO: 156287 - protein, 11 aa, Artificial Sequence
  Description of Artificial Sequence: Synthetic peptide
  Seed: RRLWGSIQSRY (PRAME_HUMAN)
RTLWGSIQSRY

SEQ ID NO: 156288 - protein, 9 aa, Artificial Sequence
  Description of Artificial Sequence: Synthetic peptide
  Seed: DSLFFLRGR (PRAME_HUMAN)
DALFFLRGR

SEQ ID NO: 156289 - protein, 9 aa, Artificial Sequence
  Description of Artificial Sequence: Synthetic peptide
  Seed: RRWKLQVLD (PRAME_HUMAN)
RRWKLQVLG

SEQ ID NO: 156290 - protein, 10 aa, Artificial Sequence
  Description of Artificial Sequence: Synthetic peptide
  Seed: VLMKGQHLHL (PRAME_HUMAN)
VLMKGQHLHI

SEQ ID NO: 156291 - protein, 10 aa, Artificial Sequence
  Description of Artificial Sequence: Synthetic peptide
  Seed: MVQAWPFTCL (PRAME_HUMAN)
MVQAWPFTCW

SEQ ID NO: 156292 - protein, 10 aa, Artificial Sequence
  Description of Artificial Sequence: Synthetic peptide
  Seed: ALLERASATL (PRAME_HUMAN)
AILERASATV

SEQ ID NO: 156293 - protein, 9 aa, Artificial Sequence
  Description of Artificial Sequence: Synthetic peptide
  Seed: LVELAGQSL (PRAME_HUMAN)
LYELAGQSM

SEQ ID NO: 156294 - protein, 10 aa, Artificial Sequence
  Description of Artificial Sequence: Synthetic peptide
  Seed: FIPVEVLVDL (PRAME_HUMAN)
FFPVEVLVDW

SEQ ID NO: 156295 - protein, 10 aa, Artificial Sequence
  Description of Artificial Sequence: Synthetic peptide
  Seed: VLYPVPLESY (PRAME_HUMAN)
VSYPVPLESL

SEQ ID NO: 156296 - protein, 9 aa, Artificial Sequence
  Description of Artificial Sequence: Synthetic peptide
  Seed: FLRGRLDQL (PRAME_HUMAN)
FSRGRLDQF

SEQ ID NO: 156297 - protein, 9 aa, Artificial Sequence
  Description of Artificial Sequence: Synthetic peptide
  Seed: LSHIHASSY (PRAME_HUMAN)
LTHIHASSK

SEQ ID NO: 156298 - protein, 9 aa, Artificial Sequence
  Description of Artificial Sequence: Synthetic peptide
  Seed: MHLSQSPSV (PRAME_HUMAN)
MQLSQSPSH

SEQ ID NO: 156299 - protein, 10 aa, Artificial Sequence
  Description of Artificial Sequence: Synthetic peptide
  Seed: RASATLQDLV (PRAME_HUMAN)
RSSATLQDLW

SEQ ID NO: 156300 - protein, 9 aa, Artificial Sequence
  Description of Artificial Sequence: Synthetic peptide
  Seed: IPVEVLVDL (PRAME_HUMAN)
IQVEVLVDY

SEQ ID NO: 156301 - protein, 10 aa, Artificial Sequence
  Description of Artificial Sequence: Synthetic peptide
  Seed: QLLRHVMNPL (PRAME_HUMAN)
QMLRHVMNPV

SEQ ID NO: 156302 - protein, 10 aa, Artificial Sequence
  Description of Artificial Sequence: Synthetic peptide
  Seed: AYLHARLREL (PRAME_HUMAN)
AQLHARLREV

SEQ ID NO: 156303 - protein, 10 aa, Artificial Sequence
  Description of Artificial Sequence: Synthetic peptide
  Seed: FYDPEPILCP (PRAME_HUMAN)
FMDPEPILCM

SEQ ID NO: 156304 - protein, 9 aa, Artificial Sequence
  Description of Artificial Sequence: Synthetic peptide
  Seed: SALQSLLQH (PRAME_HUMAN)
SSLQSLLQK

SEQ ID NO: 156305 - protein, 10 aa, Artificial Sequence
  Description of Artificial Sequence: Synthetic peptide
  Seed: SLYSFPEPEA (PRAME_HUMAN)
SLYSFPEPEV

SEQ ID NO: 156306 - protein, 10 aa, Artificial Sequence
  Description of Artificial Sequence: Synthetic peptide
  Seed: RLSEGDVMHL (PRAME_HUMAN)
RLSEGDVMHV

SEQ ID NO: 156307 - protein, 9 aa, Artificial Sequence
  Description of Artificial Sequence: Synthetic peptide
  Seed: AVLDGLDVL (PRAME_HUMAN)
AVLDGLDVA

SEQ ID NO: 156308 - protein, 9 aa, Artificial Sequence
  Description of Artificial Sequence: Synthetic peptide
  Seed: YSFPEPEAA (PRAME_HUMAN)
YPFPEPEAI

SEQ ID NO: 156309 - protein, 10 aa, Artificial Sequence
  Description of Artificial Sequence: Synthetic peptide
  Seed: QAWPFTCLPL (PRAME_HUMAN)
QYWPFTCLPW

SEQ ID NO: 156310 - protein, 8 aa, Artificial Sequence
  Description of Artificial Sequence: Synthetic peptide
  Seed: FYDPEPIL (PRAME_HUMAN)
FGDPEPIL

SEQ ID NO: 156311 - protein, 9 aa, Artificial Sequence
  Description of Artificial Sequence: Synthetic peptide
  Seed: LQALYVDSL (PRAME_HUMAN)
LHALYVDSI

SEQ ID NO: 156312 - protein, 10 aa, Artificial Sequence
  Description of Artificial Sequence: Synthetic peptide
  Seed: SVSQLSVLSL (PRAME_HUMAN)
SLSQLSVLSV

SEQ ID NO: 156313 - protein, 9 aa, Artificial Sequence
  Description of Artificial Sequence: Synthetic peptide
  Seed: SFYGNSISI (PRAME_HUMAN)
STYGNSISI

SEQ ID NO: 156314 - protein, 10 aa, Artificial Sequence
  Description of Artificial Sequence: Synthetic peptide
  Seed: KGQHLHLETF (PRAME_HUMAN)
KAQHLHLETW

SEQ ID NO: 156315 - protein, 10 aa, Artificial Sequence
  Description of Artificial Sequence: Synthetic peptide
  Seed: SMSVWTSPRR (PRAME_HUMAN)
SVSVWTSPRR

SEQ ID NO: 156316 - protein, 9 aa, Artificial Sequence
  Description of Artificial Sequence: Synthetic peptide
  Seed: SLLQHLIGL (PRAME_HUMAN)
SVLQHLIGI

SEQ ID NO: 156317 - protein, 9 aa, Artificial Sequence
  Description of Artificial Sequence: Synthetic peptide
  Seed: LSEGDVMHL (PRAME_HUMAN)
LLEGDVMHY

SEQ ID NO: 156318 - protein, 9 aa, Artificial Sequence
  Description of Artificial Sequence: Synthetic peptide
  Seed: LYVDSLFFL (PRAME_HUMAN)
LTVDSLFFT

SEQ ID NO: 156319 - protein, 10 aa, Artificial Sequence
  Description of Artificial Sequence: Synthetic peptide
  Seed: RHVMNPLETL (PRAME_HUMAN)
RTVMNPLETV

SEQ ID NO: 156320 - protein, 9 aa, Artificial Sequence
  Description of Artificial Sequence: Synthetic peptide
  Seed: QSLLKDEAL (PRAME_HUMAN)
QSLLKDEAW

SEQ ID NO: 156321 - protein, 9 aa, Artificial Sequence
  Description of Artificial Sequence: Synthetic peptide
  Seed: ELFSYLIEK (PRAME_HUMAN)
ESFSYLIEK

SEQ ID NO: 156322 - protein, 9 aa, Artificial Sequence
  Description of Artificial Sequence: Synthetic peptide
  Seed: LFPPLFMAA (PRAME_HUMAN)
LMPPLFMAM

SEQ ID NO: 156323 - protein, 9 aa, Artificial Sequence
  Description of Artificial Sequence: Synthetic peptide
  Seed: LLLSHIHAS (PRAME_HUMAN)
LTLSHIHAL

SEQ ID NO: 156324 - protein, 10 aa, Artificial Sequence
  Description of Artificial Sequence: Synthetic peptide
  Seed: RELFPPLFMA (PRAME_HUMAN)
RMLFPPLFMA

SEQ ID NO: 156325 - protein, 9 aa, Artificial Sequence
  Description of Artificial Sequence: Synthetic peptide
  Seed: LLKDEALAI (PRAME_HUMAN)
LVKDEALAF

SEQ ID NO: 156326 - protein, 10 aa, Artificial Sequence
  Description of Artificial Sequence: Synthetic peptide
  Seed: QAWPFTCLPL (PRAME_HUMAN)
QEWPFTCLPF

SEQ ID NO: 156327 - protein, 9 aa, Artificial Sequence
  Description of Artificial Sequence: Synthetic peptide
  Seed: RTFYDPEPI (PRAME_HUMAN)
RKFYDPEPY

SEQ ID NO: 156328 - protein, 9 aa, Artificial Sequence
  Description of Artificial Sequence: Synthetic peptide
  Seed: RLAYLHARL (PRAME_HUMAN)
RSAYLHARR

SEQ ID NO: 156329 - protein, 9 aa, Artificial Sequence
  Description of Artificial Sequence: Synthetic peptide
  Seed: SQSPSVSQL (PRAME_HUMAN)
SFSPSVSQV

SEQ ID NO: 156330 - protein, 11 aa, Artificial Sequence
  Description of Artificial Sequence: Synthetic peptide
  Seed: LVELAGQSLLK (PRAME_HUMAN)
LVELAGQSLLY

SEQ ID NO: 156331 - protein, 11 aa, Artificial Sequence
  Description of Artificial Sequence: Synthetic peptide
  Seed: HLSQSPSVSQL (PRAME_HUMAN)
HASQSPSVSQY

SEQ ID NO: 156332 - protein, 9 aa, Artificial Sequence
  Description of Artificial Sequence: Synthetic peptide
  Seed: HVMNPLETL (PRAME_HUMAN)
HLMNPLETY

SEQ ID NO: 156333 - protein, 9 aa, Artificial Sequence
  Description of Artificial Sequence: Synthetic peptide
  Seed: QPFIPVEVL (PRAME_HUMAN)
QPFIPVEVI

SEQ ID NO: 156334 - protein, 10 aa, Artificial Sequence
  Description of Artificial Sequence: Synthetic peptide
  Seed: FAMPMQDIKM (PRAME_HUMAN)
FTMPMQDIKY

SEQ ID NO: 156335 - protein, 9 aa, Artificial Sequence
  Description of Artificial Sequence: Synthetic peptide
  Seed: LQSLLQHLI (PRAME_HUMAN)
LLSLLQHLL

SEQ ID NO: 156336 - protein, 10 aa, Artificial Sequence
  Description of Artificial Sequence: Synthetic peptide
  Seed: RELFPPLFMA (PRAME_HUMAN)
RILFPPLFMM

SEQ ID NO: 156337 - protein, 9 aa, Artificial Sequence
  Description of Artificial Sequence: Synthetic peptide
  Seed: GLSNLTHVL (PRAME_HUMAN)
GSSNLTHVL

SEQ ID NO: 156338 - protein, 9 aa, Artificial Sequence
  Description of Artificial Sequence: Synthetic peptide
  Seed: MHLSQSPSV (PRAME_HUMAN)
MSLSQSPSF

SEQ ID NO: 156339 - protein, 9 aa, Artificial Sequence
  Description of Artificial Sequence: Synthetic peptide
  Seed: LTDVSPEPL (PRAME_HUMAN)
LTDVSPEPW

SEQ ID NO: 156340 - protein, 10 aa, Artificial Sequence
  Description of Artificial Sequence: Synthetic peptide
  Seed: ALYVDSLFFL (PRAME_HUMAN)
AMYVDSLFFT

SEQ ID NO: 156341 - protein, 9 aa, Artificial Sequence
  Description of Artificial Sequence: Synthetic peptide
  Seed: EQPFIPVEV (PRAME_HUMAN)
ELPFIPVEI

SEQ ID NO: 156342 - protein, 10 aa, Artificial Sequence
  Description of Artificial Sequence: Synthetic peptide
  Seed: RGRLDQLLRH (PRAME_HUMAN)
RGRLDQLLRR

SEQ ID NO: 156343 - protein, 9 aa, Artificial Sequence
  Description of Artificial Sequence: Synthetic peptide
  Seed: LSEGDVMHL (PRAME_HUMAN)
LLEGDVMHV

SEQ ID NO: 156344 - protein, 8 aa, Artificial Sequence
  Description of Artificial Sequence: Synthetic peptide
  Seed: YEDIHGTL (PRAME_HUMAN)
YLDIHGTF

SEQ ID NO: 156345 - protein, 11 aa, Artificial Sequence
  Description of Artificial Sequence: Synthetic peptide
  Seed: MKGQHLHLETF (PRAME_HUMAN)
MGGQHLHLETY

SEQ ID NO: 156346 - protein, 11 aa, Artificial Sequence
  Description of Artificial Sequence: Synthetic peptide
  Seed: RELFPPLFMAA (PRAME_HUMAN)
RGLFPPLFMAV

SEQ ID NO: 156347 - protein, 10 aa, Artificial Sequence
  Description of Artificial Sequence: Synthetic peptide
  Seed: TLAKFSPYLG (PRAME_HUMAN)
TMAKFSPYLM

SEQ ID NO: 156348 - protein, 10 aa, Artificial Sequence
  Description of Artificial Sequence: Synthetic peptide
  Seed: LSVLSLSGVM (PRAME_HUMAN)
LTVLSLSGVW

SEQ ID NO: 156349 - protein, 9 aa, Artificial Sequence
  Description of Artificial Sequence: Synthetic peptide
  Seed: THVLYPVPL (PRAME_HUMAN)
TFVLYPVPY

SEQ ID NO: 156350 - protein, 10 aa, Artificial Sequence
  Description of Artificial Sequence: Synthetic peptide
  Seed: YLGQMINLRR (PRAME_HUMAN)
YTGQMINLRR

SEQ ID NO: 156351 - protein, 9 aa, Artificial Sequence
  Description of Artificial Sequence: Synthetic peptide
  Seed: LQSLLQHLI (PRAME_HUMAN)
LMSLLQHLA

SEQ ID NO: 156352 - protein, 11 aa, Artificial Sequence
  Description of Artificial Sequence: Synthetic peptide
  Seed: EDIHGTLHLER (PRAME_HUMAN)
ETIHGTLHLER

SEQ ID NO: 156353 - protein, 10 aa, Artificial Sequence
  Description of Artificial Sequence: Synthetic peptide
  Seed: PTLAKFSPYL (PRAME_HUMAN)
PHLAKFSPYV

SEQ ID NO: 156354 - protein, 9 aa, Artificial Sequence
  Description of Artificial Sequence: Synthetic peptide
  Seed: LAYLHARLR (PRAME_HUMAN)
LMYLHARLK

SEQ ID NO: 156355 - protein, 9 aa, Artificial Sequence
  Description of Artificial Sequence: Synthetic peptide
  Seed: VFDECGITD (PRAME_HUMAN)
VADECGITV

SEQ ID NO: 156356 - protein, 9 aa, Artificial Sequence
  Description of Artificial Sequence: Synthetic peptide
  Seed: MINLRRLLL (PRAME_HUMAN)
MLNLRRLLK

SEQ ID NO: 156357 - protein, 10 aa, Artificial Sequence
  Description of Artificial Sequence: Synthetic peptide
  Seed: LERLAYLHAR (PRAME_HUMAN)
LLRLAYLHAK

SEQ ID NO: 156358 - protein, 11 aa, Artificial Sequence
  Description of Artificial Sequence: Synthetic peptide
  Seed: LLSHIHASSYI (PRAME_HUMAN)
LLSHIHASSYV

SEQ ID NO: 156359 - protein, 9 aa, Artificial Sequence
  Description of Artificial Sequence: Synthetic peptide
  Seed: KFSPYLGQM (PRAME_HUMAN)
KYSPYLGQL

SEQ ID NO: 156360 - protein, 9 aa, Artificial Sequence
  Description of Artificial Sequence: Synthetic peptide
  Seed: LAIAALELL (PRAME_HUMAN)
LHIAALELY

SEQ ID NO: 156361 - protein, 9 aa, Artificial Sequence
  Description of Artificial Sequence: Synthetic peptide
  Seed: MQDIKMILK (PRAME_HUMAN)
MIDIKMILY

SEQ ID NO: 156362 - protein, 10 aa, Artificial Sequence
  Description of Artificial Sequence: Synthetic peptide
  Seed: CTWKLPTLAK (PRAME_HUMAN)
CLWKLPTLAK

SEQ ID NO: 156363 - protein, 10 aa, Artificial Sequence
  Description of Artificial Sequence: Synthetic peptide
  Seed: KGQHLHLETF (PRAME_HUMAN)
KCQHLHLETY

SEQ ID NO: 156364 - protein, 9 aa, Artificial Sequence
  Description of Artificial Sequence: Synthetic peptide
  Seed: SRYISMSVW (PRAME_HUMAN)
SLYISMSVY

SEQ ID NO: 156365 - protein, 10 aa, Artificial Sequence
  Description of Artificial Sequence: Synthetic peptide
  Seed: YEDIHGTLHL (PRAME_HUMAN)
YWDIHGTLHL

SEQ ID NO: 156366 - protein, 10 aa, Artificial Sequence
  Description of Artificial Sequence: Synthetic peptide
  Seed: DELFSYLIEK (PRAME_HUMAN)
DMLFSYLIER

SEQ ID NO: 156367 - protein, 11 aa, Artificial Sequence
  Description of Artificial Sequence: Synthetic peptide
  Seed: LPTLAKFSPYL (PRAME_HUMAN)
LCTLAKFSPYL

SEQ ID NO: 156368 - protein, 9 aa, Artificial Sequence
  Description of Artificial Sequence: Synthetic peptide
  Seed: LQDLVFDEC (PRAME_HUMAN)
LQDLVFDEM

SEQ ID NO: 156369 - protein, 9 aa, Artificial Sequence
  Description of Artificial Sequence: Synthetic peptide
  Seed: LQALYVDSL (PRAME_HUMAN)
LSALYVDSV

SEQ ID NO: 156370 - protein, 11 aa, Artificial Sequence
  Description of Artificial Sequence: Synthetic peptide
  Seed: GTLHLERLAYL (PRAME_HUMAN)
GQLHLERLAYV

SEQ ID NO: 156371 - protein, 9 aa, Artificial Sequence
  Description of Artificial Sequence: Synthetic peptide
  Seed: MVQAWPFTC (PRAME_HUMAN)
MVQAWPFTM

SEQ ID NO: 156372 - protein, 9 aa, Artificial Sequence
  Description of Artificial Sequence: Synthetic peptide
  Seed: RELLCELGR (PRAME_HUMAN)
RQLLCELGR

SEQ ID NO: 156373 - protein, 9 aa, Artificial Sequence
  Description of Artificial Sequence: Synthetic peptide
  Seed: GACDELFSY (PRAME_HUMAN)
GQCDELFSY

SEQ ID NO: 156374 - protein, 9 aa, Artificial Sequence
  Description of Artificial Sequence: Synthetic peptide
  Seed: SVLSLSGVM (PRAME_HUMAN)
SPLSLSGVM

SEQ ID NO: 156375 - protein, 9 aa, Artificial Sequence
  Description of Artificial Sequence: Synthetic peptide
  Seed: FSPYLGQMI (PRAME_HUMAN)
FTPYLGQMV

SEQ ID NO: 156376 - protein, 9 aa, Artificial Sequence
  Description of Artificial Sequence: Synthetic peptide
  Seed: SHQDFWTVW (PRAME_HUMAN)
SYQDFWTVF

SEQ ID NO: 156377 - protein, 8 aa, Artificial Sequence
  Description of Artificial Sequence: Synthetic peptide
  Seed: ITDDQLLA (PRAME_HUMAN)
IADDQLLI

SEQ ID NO: 156378 - protein, 9 aa, Artificial Sequence
  Description of Artificial Sequence: Synthetic peptide
  Seed: RLDQLLRHV (PRAME_HUMAN)
RFDQLLRHV

SEQ ID NO: 156379 - protein, 10 aa, Artificial Sequence
  Description of Artificial Sequence: Synthetic peptide
  Seed: KKLKIFAMPM (PRAME_HUMAN)
KSLKIFAMPL

SEQ ID NO: 156380 - protein, 10 aa, Artificial Sequence
  Description of Artificial Sequence: Synthetic peptide
  Seed: RLDQLLRHVM (PRAME_HUMAN)
REDQLLRHVV

SEQ ID NO: 156381 - protein, 9 aa, Artificial Sequence
  Description of Artificial Sequence: Synthetic peptide
  Seed: YIAQFTSQF (PRAME_HUMAN)
YQAQFTSQM

SEQ ID NO: 156382 - protein, 9 aa, Artificial Sequence
  Description of Artificial Sequence: Synthetic peptide
  Seed: MINLRRLLL (PRAME_HUMAN)
MLNLRRLLM

SEQ ID NO: 156383 - protein, 9 aa, Artificial Sequence
  Description of Artificial Sequence: Synthetic peptide
  Seed: IAALELLPR (PRAME_HUMAN)
IAALELLPM

SEQ ID NO: 156384 - protein, 9 aa, Artificial Sequence
  Description of Artificial Sequence: Synthetic peptide
  Seed: LQSLLQHLI (PRAME_HUMAN)
LESLLQHLI

SEQ ID NO: 156385 - protein, 10 aa, Artificial Sequence
  Description of Artificial Sequence: Synthetic peptide
  Seed: MLTDVSPEPL (PRAME_HUMAN)
MTTDVSPEPM

SEQ ID NO: 156386 - protein, 10 aa, Artificial Sequence
  Description of Artificial Sequence: Synthetic peptide
  Seed: MVQAWPFTCL (PRAME_HUMAN)
MMQAWPFTCI

SEQ ID NO: 156387 - protein, 9 aa, Artificial Sequence
  Description of Artificial Sequence: Synthetic peptide
  Seed: RRWKLQVLD (PRAME_HUMAN)
RKWKLQVLI

SEQ ID NO: 156388 - protein, 9 aa, Artificial Sequence
  Description of Artificial Sequence: Synthetic peptide
  Seed: HVMNPLETL (PRAME_HUMAN)
HAMNPLETH

SEQ ID NO: 156389 - protein, 9 aa, Artificial Sequence
  Description of Artificial Sequence: Synthetic peptide
  Seed: SHCSQLTTL (PRAME_HUMAN)
SHCSQLTTV

SEQ ID NO: 156390 - protein, 11 aa, Artificial Sequence
  Description of Artificial Sequence: Synthetic peptide
  Seed: ALYVDSLFFLR (PRAME_HUMAN)
AMYVDSLFFLL

SEQ ID NO: 156391 - protein, 9 aa, Artificial Sequence
  Description of Artificial Sequence: Synthetic peptide
  Seed: LLALLPSLS (PRAME_HUMAN)
LIALLPSLI

SEQ ID NO: 156392 - protein, 9 aa, Artificial Sequence
  Description of Artificial Sequence: Synthetic peptide
  Seed: SHIHASSYI (PRAME_HUMAN)
SMIHASSYF

SEQ ID NO: 156393 - protein, 10 aa, Artificial Sequence
  Description of Artificial Sequence: Synthetic peptide
  Seed: VEVLVDLFLK (PRAME_HUMAN)
VTVLVDLFLR

SEQ ID NO: 156394 - protein, 10 aa, Artificial Sequence
  Description of Artificial Sequence: Synthetic peptide
  Seed: ISISALQSLL (PRAME_HUMAN)
IMISALQSLM

SEQ ID NO: 156395 - protein, 10 aa, Artificial Sequence
  Description of Artificial Sequence: Synthetic peptide
  Seed: LSQSPSVSQL (PRAME_HUMAN)
LVQSPSVSQW

SEQ ID NO: 156396 - protein, 10 aa, Artificial Sequence
  Description of Artificial Sequence: Synthetic peptide
  Seed: ALYVDSLFFL (PRAME_HUMAN)
ALYVDSLFFI

SEQ ID NO: 156397 - protein, 10 aa, Artificial Sequence
  Description of Artificial Sequence: Synthetic peptide
  Seed: LSFYGNSISI (PRAME_HUMAN)
LIFYGNSISM

SEQ ID NO: 156398 - protein, 9 aa, Artificial Sequence
  Description of Artificial Sequence: Synthetic peptide
  Seed: RRLLLSHIH (PRAME_HUMAN)
RQLLLSHII

SEQ ID NO: 156399 - protein, 9 aa, Artificial Sequence
  Description of Artificial Sequence: Synthetic peptide
  Seed: SMVWLSANP (PRAME_HUMAN)
SLVWLSANA

SEQ ID NO: 156400 - protein, 10 aa, Artificial Sequence
  Description of Artificial Sequence: Synthetic peptide
  Seed: YLHARLRELL (PRAME_HUMAN)
YMHARLRELI

SEQ ID NO: 156401 - protein, 9 aa, Artificial Sequence
  Description of Artificial Sequence: Synthetic peptide
  Seed: ITDDQLLAL (PRAME_HUMAN)
IGDDQLLAV

SEQ ID NO: 156402 - protein, 10 aa, Artificial Sequence
  Description of Artificial Sequence: Synthetic peptide
  Seed: ARLRELLCEL (PRAME_HUMAN)
AALRELLCEL

SEQ ID NO: 156403 - protein, 9 aa, Artificial Sequence
  Description of Artificial Sequence: Synthetic peptide
  Seed: HVMNPLETL (PRAME_HUMAN)
HTMNPLETL

SEQ ID NO: 156404 - protein, 9 aa, Artificial Sequence
  Description of Artificial Sequence: Synthetic peptide
  Seed: RLLLSHIHA (PRAME_HUMAN)
RVLLSHIHA

SEQ ID NO: 156405 - protein, 9 aa, Artificial Sequence
  Description of Artificial Sequence: Synthetic peptide
  Seed: VWSGNRASL (PRAME_HUMAN)
VYSGNRASY

SEQ ID NO: 156406 - protein, 9 aa, Artificial Sequence
  Description of Artificial Sequence: Synthetic peptide
  Seed: LQCLQALYV (PRAME_HUMAN)
LMCLQALYL

SEQ ID NO: 156407 - protein, 9 aa, Artificial Sequence
  Description of Artificial Sequence: Synthetic peptide
  Seed: KAMVQAWPF (PRAME_HUMAN)
KLMVQAWPY

SEQ ID NO: 156408 - protein, 9 aa, Artificial Sequence
  Description of Artificial Sequence: Synthetic peptide
  Seed: FMAAFDGRH (PRAME_HUMAN)
FKAAFDGRF

SEQ ID NO: 156409 - protein, 11 aa, Artificial Sequence
  Description of Artificial Sequence: Synthetic peptide
  Seed: LQSLLQHLIGL (PRAME_HUMAN)
LASLLQHLIGV

SEQ ID NO: 156410 - protein, 9 aa, Artificial Sequence
  Description of Artificial Sequence: Synthetic peptide
  Seed: MPMQDIKMI (PRAME_HUMAN)
MAMQDIKMF

SEQ ID NO: 156411 - protein, 10 aa, Artificial Sequence
  Description of Artificial Sequence: Synthetic peptide
  Seed: SMSVWTSPRR (PRAME_HUMAN)
SQSVWTSPRK

SEQ ID NO: 156412 - protein, 9 aa, Artificial Sequence
  Description of Artificial Sequence: Synthetic peptide
  Seed: LSHIHASSY (PRAME_HUMAN)
LRHIHASSF

SEQ ID NO: 156413 - protein, 10 aa, Artificial Sequence
  Description of Artificial Sequence: Synthetic peptide
  Seed: AAFDGRHSQT (PRAME_HUMAN)
AAFDGRHSQI

SEQ ID NO: 156414 - protein, 10 aa, Artificial Sequence
  Description of Artificial Sequence: Synthetic peptide
  Seed: MPMQDIKMIL (PRAME_HUMAN)
MLMQDIKMII

SEQ ID NO: 156415 - protein, 11 aa, Artificial Sequence
  Description of Artificial Sequence: Synthetic peptide
  Seed: QALLERASATL (PRAME_HUMAN)
QYLLERASATV

SEQ ID NO: 156416 - protein, 10 aa, Artificial Sequence
  Description of Artificial Sequence: Synthetic peptide
  Seed: ITDDQLLALL (PRAME_HUMAN)
IFDDQLLALF

SEQ ID NO: 156417 - protein, 10 aa, Artificial Sequence
  Description of Artificial Sequence: Synthetic peptide
  Seed: LLPRELFPPL (PRAME_HUMAN)
LYPRELFPPL

SEQ ID NO: 156418 - protein, 9 aa, Artificial Sequence
  Description of Artificial Sequence: Synthetic peptide
  Seed: GLSNLTHVL (PRAME_HUMAN)
GISNLTHVV

SEQ ID NO: 156419 - protein, 9 aa, Artificial Sequence
  Description of Artificial Sequence: Synthetic peptide
  Seed: MVQAWPFTC (PRAME_HUMAN)
MLQAWPFTA

SEQ ID NO: 156420 - protein, 9 aa, Artificial Sequence
  Description of Artificial Sequence: Synthetic peptide
  Seed: SIQSRYISM (PRAME_HUMAN)
SVQSRYISY

SEQ ID NO: 156421 - protein, 8 aa, Artificial Sequence
  Description of Artificial Sequence: Synthetic peptide
  Seed: YVDSLFFL (PRAME_HUMAN)
YQDSLFFV

SEQ ID NO: 156422 - protein, 10 aa, Artificial Sequence
  Description of Artificial Sequence: Synthetic peptide
  Seed: ALLERASATL (PRAME_HUMAN)
ALLERASATF

SEQ ID NO: 156423 - protein, 10 aa, Artificial Sequence
  Description of Artificial Sequence: Synthetic peptide
  Seed: YEDIHGTLHL (PRAME_HUMAN)
YFDIHGTLHF

SEQ ID NO: 156424 - protein, 11 aa, Artificial Sequence
  Description of Artificial Sequence: Synthetic peptide
  Seed: SNLTHVLYPVP (PRAME_HUMAN)
SLLTHVLYPVS

SEQ ID NO: 156425 - protein, 10 aa, Artificial Sequence
  Description of Artificial Sequence: Synthetic peptide
  Seed: KGQHLHLETF (PRAME_HUMAN)
KLQHLHLETF

SEQ ID NO: 156426 - protein, 8 aa, Artificial Sequence
  Description of Artificial Sequence: Synthetic peptide
  Seed: LDQLLRHV (PRAME_HUMAN)
LEQLLRHL

SEQ ID NO: 156427 - protein, 9 aa, Artificial Sequence
  Description of Artificial Sequence: Synthetic peptide
  Seed: SFYGNSISI (PRAME_HUMAN)
SEYGNSISV

SEQ ID NO: 156428 - protein, 9 aa, Artificial Sequence
  Description of Artificial Sequence: Synthetic peptide
  Seed: YGNSISISA (PRAME_HUMAN)
YTNSISISF

SEQ ID NO: 156429 - protein, 11 aa, Artificial Sequence
  Description of Artificial Sequence: Synthetic peptide
  Seed: AAFDGRHSQTL (PRAME_HUMAN)
ARFDGRHSQTF

SEQ ID NO: 156430 - protein, 9 aa, Artificial Sequence
  Description of Artificial Sequence: Synthetic peptide
  Seed: LAIAALELL (PRAME_HUMAN)
LMIAALELF

SEQ ID NO: 156431 - protein, 9 aa, Artificial Sequence
  Description of Artificial Sequence: Synthetic peptide
  Seed: KVDGLSTEA (PRAME_HUMAN)
KNDGLSTEL

SEQ ID NO: 156432 - protein, 9 aa, Artificial Sequence
  Description of Artificial Sequence: Synthetic peptide
  Seed: LLRHVMNPL (PRAME_HUMAN)
LQRHVMNPI

SEQ ID NO: 156433 - protein, 10 aa, Artificial Sequence
  Description of Artificial Sequence: Synthetic peptide
  Seed: FIPVEVLVDL (PRAME_HUMAN)
FTPVEVLVDF

SEQ ID NO: 156434 - protein, 10 aa, Artificial Sequence
  Description of Artificial Sequence: Synthetic peptide
  Seed: YSFPEPEAAQ (PRAME_HUMAN)
YAFPEPEAAY

SEQ ID NO: 156435 - protein, 9 aa, Artificial Sequence
  Description of Artificial Sequence: Synthetic peptide
  Seed: QSRYISMSV (PRAME_HUMAN)
QTRYISMSM

SEQ ID NO: 156436 - protein, 9 aa, Artificial Sequence
  Description of Artificial Sequence: Synthetic peptide
  Seed: NSISISALQ (PRAME_HUMAN)
NIISISALK

SEQ ID NO: 156437 - protein, 9 aa, Artificial Sequence
  Description of Artificial Sequence: Synthetic peptide
  Seed: SQSPSVSQL (PRAME_HUMAN)
SESPSVSQT

SEQ ID NO: 156438 - protein, 10 aa, Artificial Sequence
  Description of Artificial Sequence: Synthetic peptide
  Seed: RELFPPLFMA (PRAME_HUMAN)
RWLFPPLFMM

SEQ ID NO: 156439 - protein, 9 aa, Artificial Sequence
  Description of Artificial Sequence: Synthetic peptide
  Seed: VSQLSVLSL (PRAME_HUMAN)
VLQLSVLSY

SEQ ID NO: 156440 - protein, 10 aa, Artificial Sequence
  Description of Artificial Sequence: Synthetic peptide
  Seed: EAAQPMTKKR (PRAME_HUMAN)
ELAQPMTKKR

SEQ ID NO: 156441 - protein, 10 aa, Artificial Sequence
  Description of Artificial Sequence: Synthetic peptide
  Seed: ETLSITNCRL (PRAME_HUMAN)
EVLSITNCRL

SEQ ID NO: 156442 - protein, 9 aa, Artificial Sequence
  Description of Artificial Sequence: Synthetic peptide
  Seed: QDIKMILKM (PRAME_HUMAN)
QEIKMILKW

SEQ ID NO: 156443 - protein, 10 aa, Artificial Sequence
  Description of Artificial Sequence: Synthetic peptide
  Seed: KDEALAIAAL (PRAME_HUMAN)
KREALAIAAA

SEQ ID NO: 156444 - protein, 10 aa, Artificial Sequence
  Description of Artificial Sequence: Synthetic peptide
  Seed: LERLAYLHAR (PRAME_HUMAN)
LIRLAYLHAK

SEQ ID NO: 156445 - protein, 9 aa, Artificial Sequence
  Description of Artificial Sequence: Synthetic peptide
  Seed: WSGNRASLY (PRAME_HUMAN)
WAGNRASLL

SEQ ID NO: 156446 - protein, 10 aa, Artificial Sequence
  Description of Artificial Sequence: Synthetic peptide
  Seed: IGLSNLTHVL (PRAME_HUMAN)
INLSNLTHVL

SEQ ID NO: 156447 - protein, 10 aa, Artificial Sequence
  Description of Artificial Sequence: Synthetic peptide
  Seed: RKVDGLSTEA (PRAME_HUMAN)
RHVDGLSTEA

SEQ ID NO: 156448 - protein, 11 aa, Artificial Sequence
  Description of Artificial Sequence: Synthetic peptide
  Seed: MKGQHLHLETF (PRAME_HUMAN)
MMGQHLHLETY

SEQ ID NO: 156449 - protein, 10 aa, Artificial Sequence
  Description of Artificial Sequence: Synthetic peptide
  Seed: LPTLAKFSPY (PRAME_HUMAN)
LHTLAKFSPW

SEQ ID NO: 156450 - protein, 9 aa, Artificial Sequence
  Description of Artificial Sequence: Synthetic peptide
  Seed: WKLPTLAKF (PRAME_HUMAN)
WMLPTLAKY

SEQ ID NO: 156451 - protein, 9 aa, Artificial Sequence
  Description of Artificial Sequence: Synthetic peptide
  Seed: KFSPYLGQM (PRAME_HUMAN)
KYSPYLGQM

SEQ ID NO: 156452 - protein, 9 aa, Artificial Sequence
  Description of Artificial Sequence: Synthetic peptide
  Seed: SEGDVMHLS (PRAME_HUMAN)
SEGDVMHLV

SEQ ID NO: 156453 - protein, 10 aa, Artificial Sequence
  Description of Artificial Sequence: Synthetic peptide
  Seed: EAAQPMTKKR (PRAME_HUMAN)
EFAQPMTKKR

SEQ ID NO: 156454 - protein, 9 aa, Artificial Sequence
  Description of Artificial Sequence: Synthetic peptide
  Seed: FYDPEPILC (PRAME_HUMAN)
FFDPEPILA

SEQ ID NO: 156455 - protein, 10 aa, Artificial Sequence
  Description of Artificial Sequence: Synthetic peptide
  Seed: DRTFYDPEPI (PRAME_HUMAN)
DDTFYDPEPV

SEQ ID NO: 156456 - protein, 10 aa, Artificial Sequence
  Description of Artificial Sequence: Synthetic peptide
  Seed: RHVMNPLETL (PRAME_HUMAN)
RWVMNPLETW

SEQ ID NO: 156457 - protein, 9 aa, Artificial Sequence
  Description of Artificial Sequence: Synthetic peptide
  Seed: CSQLTTLSF (PRAME_HUMAN)
CMQLTTLSF

SEQ ID NO: 156458 - protein, 9 aa, Artificial Sequence
  Description of Artificial Sequence: Synthetic peptide
  Seed: FWTVWSGNR (PRAME_HUMAN)
FYTVWSGNR

SEQ ID NO: 156459 - protein, 10 aa, Artificial Sequence
  Description of Artificial Sequence: Synthetic peptide
  Seed: SVSQLSVLSL (PRAME_HUMAN)
SISQLSVLSW

SEQ ID NO: 156460 - protein, 11 aa, Artificial Sequence
  Description of Artificial Sequence: Synthetic peptide
  Seed: IAQFTSQFLSL (PRAME_HUMAN)
ISQFTSQFLSY

SEQ ID NO: 156461 - protein, 11 aa, Artificial Sequence
  Description of Artificial Sequence: Synthetic peptide
  Seed: FLSLQCLQALY (PRAME_HUMAN)
FHSLQCLQALL

SEQ ID NO: 156462 - protein, 9 aa, Artificial Sequence
  Description of Artificial Sequence: Synthetic peptide
  Seed: ACDELFSYL (PRAME_HUMAN)
AWDELFSYL

SEQ ID NO: 156463 - protein, 9 aa, Artificial Sequence
  Description of Artificial Sequence: Synthetic peptide
  Seed: ALELLPREL (PRAME_HUMAN)
AFELLPREL

SEQ ID NO: 156464 - protein, 9 aa, Artificial Sequence
  Description of Artificial Sequence: Synthetic peptide
  Seed: MSVWTSPRR (PRAME_HUMAN)
MAVWTSPRK

SEQ ID NO: 156465 - protein, 10 aa, Artificial Sequence
  Description of Artificial Sequence: Synthetic peptide
  Seed: LQHLIGLSNL (PRAME_HUMAN)
LLHLIGLSNY

SEQ ID NO: 156466 - protein, 10 aa, Artificial Sequence
  Description of Artificial Sequence: Synthetic peptide
  Seed: FLRGRLDQLL (PRAME_HUMAN)
FLRGRLDQLI

SEQ ID NO: 156467 - protein, 10 aa, Artificial Sequence
  Description of Artificial Sequence: Synthetic peptide
  Seed: FLKEGACDEL (PRAME_HUMAN)
FMKEGACDEM

SEQ ID NO: 156468 - protein, 10 aa, Artificial Sequence
  Description of Artificial Sequence: Synthetic peptide
  Seed: FIPVEVLVDL (PRAME_HUMAN)
FKPVEVLVDY

SEQ ID NO: 156469 - protein, 10 aa, Artificial Sequence
  Description of Artificial Sequence: Synthetic peptide
  Seed: QALYVDSLFF (PRAME_HUMAN)
QMLYVDSLFW

SEQ ID NO: 156470 - protein, 10 aa, Artificial Sequence
  Description of Artificial Sequence: Synthetic peptide
  Seed: ESYEDIHGTL (PRAME_HUMAN)
ELYEDIHGTW

SEQ ID NO: 156471 - protein, 10 aa, Artificial Sequence
  Description of Artificial Sequence: Synthetic peptide
  Seed: QYIAQFTSQF (PRAME_HUMAN)
QVIAQFTSQF

SEQ ID NO: 156472 - protein, 10 aa, Artificial Sequence
  Description of Artificial Sequence: Synthetic peptide
  Seed: FAMPMQDIKM (PRAME_HUMAN)
FSMPMQDIKY

SEQ ID NO: 156473 - protein, 10 aa, Artificial Sequence
  Description of Artificial Sequence: Synthetic peptide
  Seed: MERRRLWGSI (PRAME_HUMAN)
MRRRRLWGSL

SEQ ID NO: 156474 - protein, 11 aa, Artificial Sequence
  Description of Artificial Sequence: Synthetic peptide
  Seed: QALYVDSLFFL (PRAME_HUMAN)
QSLYVDSLFFL

SEQ ID NO: 156475 - protein, 10 aa, Artificial Sequence
  Description of Artificial Sequence: Synthetic peptide
  Seed: KAVLDGLDVL (PRAME_HUMAN)
KIVLDGLDVV

SEQ ID NO: 156476 - protein, 10 aa, Artificial Sequence
  Description of Artificial Sequence: Synthetic peptide
  Seed: ALYVDSLFFL (PRAME_HUMAN)
AIYVDSLFFR

SEQ ID NO: 156477 - protein, 10 aa, Artificial Sequence
  Description of Artificial Sequence: Synthetic peptide
  Seed: LQALYVDSLF (PRAME_HUMAN)
LMALYVDSLW

SEQ ID NO: 156478 - protein, 10 aa, Artificial Sequence
  Description of Artificial Sequence: Synthetic peptide
  Seed: RELFPPLFMA (PRAME_HUMAN)
RLLFPPLFMI

SEQ ID NO: 156479 - protein, 10 aa, Artificial Sequence
  Description of Artificial Sequence: Synthetic peptide
  Seed: YIAQFTSQFL (PRAME_HUMAN)
YHAQFTSQFF

SEQ ID NO: 156480 - protein, 10 aa, Artificial Sequence
  Description of Artificial Sequence: Synthetic peptide
  Seed: IGLSNLTHVL (PRAME_HUMAN)
IPLSNLTHVV

SEQ ID NO: 156481 - protein, 10 aa, Artificial Sequence
  Description of Artificial Sequence: Synthetic peptide
  Seed: FLKEGACDEL (PRAME_HUMAN)
FVKEGACDEY

SEQ ID NO: 156482 - protein, 10 aa, Artificial Sequence
  Description of Artificial Sequence: Synthetic peptide
  Seed: LSQSPSVSQL (PRAME_HUMAN)
LPQSPSVSQY

SEQ ID NO: 156483 - protein, 9 aa, Artificial Sequence
  Description of Artificial Sequence: Synthetic peptide
  Seed: KAMVQAWPF (PRAME_HUMAN)
KIMVQAWPV

SEQ ID NO: 156484 - protein, 9 aa, Artificial Sequence
  Description of Artificial Sequence: Synthetic peptide
  Seed: YIAQFTSQF (PRAME_HUMAN)
YVAQFTSQH

SEQ ID NO: 156485 - protein, 9 aa, Artificial Sequence
  Description of Artificial Sequence: Synthetic peptide
  Seed: SLLQHLIGL (PRAME_HUMAN)
SRLQHLIGF

SEQ ID NO: 156486 - protein, 11 aa, Artificial Sequence
  Description of Artificial Sequence: Synthetic peptide
  Seed: QALYVDSLFFL (PRAME_HUMAN)
QALYVDSLFFI

SEQ ID NO: 156487 - protein, 9 aa, Artificial Sequence
  Description of Artificial Sequence: Synthetic peptide
  Seed: QDIKMILKM (PRAME_HUMAN)
QEIKMILKV

SEQ ID NO: 156488 - protein, 9 aa, Artificial Sequence
  Description of Artificial Sequence: Synthetic peptide
  Seed: LLRHVMNPL (PRAME_HUMAN)
LQRHVMNPM

SEQ ID NO: 156489 - protein, 10 aa, Artificial Sequence
  Description of Artificial Sequence: Synthetic peptide
  Seed: ISISALQSLL (PRAME_HUMAN)
IMISALQSLI

SEQ ID NO: 156490 - protein, 9 aa, Artificial Sequence
  Description of Artificial Sequence: Synthetic peptide
  Seed: MPMQDIKMI (PRAME_HUMAN)
MTMQDIKMY

SEQ ID NO: 156491 - protein, 11 aa, Artificial Sequence
  Description of Artificial Sequence: Synthetic peptide
  Seed: RELFPPLFMAA (PRAME_HUMAN)
RELFPPLFMAM

SEQ ID NO: 156492 - protein, 9 aa, Artificial Sequence
  Description of Artificial Sequence: Synthetic peptide
  Seed: SRYISMSVW (PRAME_HUMAN)
SIYISMSVF

SEQ ID NO: 156493 - protein, 10 aa, Artificial Sequence
  Description of Artificial Sequence: Synthetic peptide
  Seed: FMAAFDGRHS (PRAME_HUMAN)
FMAAFDGRHI

SEQ ID NO: 156494 - protein, 9 aa, Artificial Sequence
  Description of Artificial Sequence: Synthetic peptide
  Seed: YSFPEPEAA (PRAME_HUMAN)
YQFPEPEAL

SEQ ID NO: 156495 - protein, 9 aa, Artificial Sequence
  Description of Artificial Sequence: Synthetic peptide
  Seed: VLMKGQHLH (PRAME_HUMAN)
VIMKGQHLK

SEQ ID NO: 156496 - protein, 9 aa, Artificial Sequence
  Description of Artificial Sequence: Synthetic peptide
  Seed: SLSHCSQLT (PRAME_HUMAN)
SLSHCSQLL

SEQ ID NO: 156497 - protein, 9 aa, Artificial Sequence
  Description of Artificial Sequence: Synthetic peptide
  Seed: SYEDIHGTL (PRAME_HUMAN)
SWEDIHGTL

SEQ ID NO: 156498 - protein, 8 aa, Artificial Sequence
  Description of Artificial Sequence: Synthetic peptide
  Seed: SQLSVLSL (PRAME_HUMAN)
SMLSVLSF

SEQ ID NO: 156499 - protein, 10 aa, Artificial Sequence
  Description of Artificial Sequence: Synthetic peptide
  Seed: SPYLGQMINL (PRAME_HUMAN)
SIYLGQMINW

SEQ ID NO: 156500 - protein, 10 aa, Artificial Sequence
  Description of Artificial Sequence: Synthetic peptide
  Seed: ELFPPLFMAA (PRAME_HUMAN)
EAFPPLFMAV

SEQ ID NO: 156501 - protein, 10 aa, Artificial Sequence
  Description of Artificial Sequence: Synthetic peptide
  Seed: FLSLQCLQAL (PRAME_HUMAN)
FMSLQCLQAM

SEQ ID NO: 156502 - protein, 10 aa, Artificial Sequence
  Description of Artificial Sequence: Synthetic peptide
  Seed: QALYVDSLFF (PRAME_HUMAN)
QCLYVDSLFW

SEQ ID NO: 156503 - protein, 10 aa, Artificial Sequence
  Description of Artificial Sequence: Synthetic peptide
  Seed: IQSRYISMSV (PRAME_HUMAN)
IASRYISMSY

SEQ ID NO: 156504 - protein, 9 aa, Artificial Sequence
  Description of Artificial Sequence: Synthetic peptide
  Seed: RELFPPLFM (PRAME_HUMAN)
RQLFPPLFI

SEQ ID NO: 156505 - protein, 10 aa, Artificial Sequence
  Description of Artificial Sequence: Synthetic peptide
  Seed: TVWSGNRASL (PRAME_HUMAN)
TVWSGNRASR

SEQ ID NO: 156506 - protein, 10 aa, Artificial Sequence
  Description of Artificial Sequence: Synthetic peptide
  Seed: ELFPPLFMAA (PRAME_HUMAN)
EVFPPLFMAL

SEQ ID NO: 156507 - protein, 9 aa, Artificial Sequence
  Description of Artificial Sequence: Synthetic peptide
  Seed: LTDVSPEPL (PRAME_HUMAN)
LPDVSPEPM

SEQ ID NO: 156508 - protein, 9 aa, Artificial Sequence
  Description of Artificial Sequence: Synthetic peptide
  Seed: LKMVQLDSI (PRAME_HUMAN)
LKMVQLDSM

SEQ ID NO: 156509 - protein, 9 aa, Artificial Sequence
  Description of Artificial Sequence: Synthetic peptide
  Seed: TDDQLLALL (PRAME_HUMAN)
TMDQLLALF

SEQ ID NO: 156510 - protein, 10 aa, Artificial Sequence
  Description of Artificial Sequence: Synthetic peptide
  Seed: AFDGRHSQTL (PRAME_HUMAN)
AADGRHSQTL

SEQ ID NO: 156511 - protein, 9 aa, Artificial Sequence
  Description of Artificial Sequence: Synthetic peptide
  Seed: QMINLRRLL (PRAME_HUMAN)
QMINLRRLF

SEQ ID NO: 156512 - protein, 11 aa, Artificial Sequence
  Description of Artificial Sequence: Synthetic peptide
  Seed: AAFDGRHSQTL (PRAME_HUMAN)
ASFDGRHSQTW

SEQ ID NO: 156513 - protein, 9 aa, Artificial Sequence
  Description of Artificial Sequence: Synthetic peptide
  Seed: FLRGRLDQL (PRAME_HUMAN)
FVRGRLDQM

SEQ ID NO: 156514 - protein, 9 aa, Artificial Sequence
  Description of Artificial Sequence: Synthetic peptide
  Seed: RTFYDPEPI (PRAME_HUMAN)
RLFYDPEPF

SEQ ID NO: 156515 - protein, 9 aa, Artificial Sequence
  Description of Artificial Sequence: Synthetic peptide
  Seed: TSPRRLVEL (PRAME_HUMAN)
TCPRRLVEL

SEQ ID NO: 156516 - protein, 9 aa, Artificial Sequence
  Description of Artificial Sequence: Synthetic peptide
  Seed: SHIHASSYI (PRAME_HUMAN)
SVIHASSYY

SEQ ID NO: 156517 - protein, 10 aa, Artificial Sequence
  Description of Artificial Sequence: Synthetic peptide
  Seed: DQLLALLPSL (PRAME_HUMAN)
DFLLALLPSL

SEQ ID NO: 156518 - protein, 10 aa, Artificial Sequence
  Description of Artificial Sequence: Synthetic peptide
  Seed: ASATLQDLVF (PRAME_HUMAN)
AMATLQDLVF

SEQ ID NO: 156519 - protein, 9 aa, Artificial Sequence
  Description of Artificial Sequence: Synthetic peptide
  Seed: YLHARLREL (PRAME_HUMAN)
YAHARLREH

SEQ ID NO: 156520 - protein, 9 aa, Artificial Sequence
  Description of Artificial Sequence: Synthetic peptide
  Seed: RGRLDQLLR (PRAME_HUMAN)
RTRLDQLLV

SEQ ID NO: 156521 - protein, 11 aa, Artificial Sequence
  Description of Artificial Sequence: Synthetic peptide
  Seed: RTFYDPEPILC (PRAME_HUMAN)
RVFYDPEPILF

SEQ ID NO: 156522 - protein, 10 aa, Artificial Sequence
  Description of Artificial Sequence: Synthetic peptide
  Seed: ISMSVWTSPR (PRAME_HUMAN)
ITMSVWTSPY

SEQ ID NO: 156523 - protein, 9 aa, Artificial Sequence
  Description of Artificial Sequence: Synthetic peptide
  Seed: VFDECGITD (PRAME_HUMAN)
VYDECGITW

SEQ ID NO: 156524 - protein, 9 aa, Artificial Sequence
  Description of Artificial Sequence: Synthetic peptide
  Seed: YISMSVWTS (PRAME_HUMAN)
YMSMSVWTV

SEQ ID NO: 156525 - protein, 10 aa, Artificial Sequence
  Description of Artificial Sequence: Synthetic peptide
  Seed: RGRLDQLLRH (PRAME_HUMAN)
RERLDQLLRR

SEQ ID NO: 156526 - protein, 11 aa, Artificial Sequence
  Description of Artificial Sequence: Synthetic peptide
  Seed: RRLWGSIQSRY (PRAME_HUMAN)
RQLWGSIQSRR

SEQ ID NO: 156527 - protein, 8 aa, Artificial Sequence
  Description of Artificial Sequence: Synthetic peptide
  Seed: LQSLLQHL (PRAME_HUMAN)
LQSLLQHV

SEQ ID NO: 156528 - protein, 10 aa, Artificial Sequence
  Description of Artificial Sequence: Synthetic peptide
  Seed: ESYEDIHGTL (PRAME_HUMAN)
EVYEDIHGTL

SEQ ID NO: 156529 - protein, 9 aa, Artificial Sequence
  Description of Artificial Sequence: Synthetic peptide
  Seed: TDDQLLALL (PRAME_HUMAN)
TEDQLLALT

SEQ ID NO: 156530 - protein, 9 aa, Artificial Sequence
  Description of Artificial Sequence: Synthetic peptide
  Seed: TSPRRLVEL (PRAME_HUMAN)
TMPRRLVEI

SEQ ID NO: 156531 - protein, 10 aa, Artificial Sequence
  Description of Artificial Sequence: Synthetic peptide
  Seed: MPMQDIKMIL (PRAME_HUMAN)
MMMQDIKMII

SEQ ID NO: 156532 - protein, 9 aa, Artificial Sequence
  Description of Artificial Sequence: Synthetic peptide
  Seed: LSHIHASSY (PRAME_HUMAN)
LFHIHASSM

SEQ ID NO: 156533 - protein, 9 aa, Artificial Sequence
  Description of Artificial Sequence: Synthetic peptide
  Seed: FAMPMQDIK (PRAME_HUMAN)
FIMPMQDIK

SEQ ID NO: 156534 - protein, 9 aa, Artificial Sequence
  Description of Artificial Sequence: Synthetic peptide
  Seed: FLSLQCLQA (PRAME_HUMAN)
FMSLQCLQM

SEQ ID NO: 156535 - protein, 9 aa, Artificial Sequence
  Description of Artificial Sequence: Synthetic peptide
  Seed: RTFYDPEPI (PRAME_HUMAN)
RAFYDPEPL

SEQ ID NO: 156536 - protein, 9 aa, Artificial Sequence
  Description of Artificial Sequence: Synthetic peptide
  Seed: LSVLSLSGV (PRAME_HUMAN)
LMVLSLSGA

SEQ ID NO: 156537 - protein, 9 aa, Artificial Sequence
  Description of Artificial Sequence: Synthetic peptide
  Seed: TLHLERLAY (PRAME_HUMAN)
TKHLERLAY

SEQ ID NO: 156538 - protein, 9 aa, Artificial Sequence
  Description of Artificial Sequence: Synthetic peptide
  Seed: ASATLQDLV (PRAME_HUMAN)
AAATLQDLF

SEQ ID NO: 156539 - protein, 9 aa, Artificial Sequence
  Description of Artificial Sequence: Synthetic peptide
  Seed: ITDDQLLAL (PRAME_HUMAN)
IQDDQLLAI

SEQ ID NO: 156540 - protein, 9 aa, Artificial Sequence
  Description of Artificial Sequence: Synthetic peptide
  Seed: RLCCKKLKI (PRAME_HUMAN)
RICCKKLKW

SEQ ID NO: 156541 - protein, 10 aa, Artificial Sequence
  Description of Artificial Sequence: Synthetic peptide
  Seed: RGRLDQLLRH (PRAME_HUMAN)
RWRLDQLLRM

SEQ ID NO: 156542 - protein, 10 aa, Artificial Sequence
  Description of Artificial Sequence: Synthetic peptide
  Seed: HASSYISPEK (PRAME_HUMAN)
HPSSYISPER

SEQ ID NO: 156543 - protein, 10 aa, Artificial Sequence
  Description of Artificial Sequence: Synthetic peptide
  Seed: SNLTHVLYPV (PRAME_HUMAN)
SLLTHVLYPA

SEQ ID NO: 156544 - protein, 9 aa, Artificial Sequence
  Description of Artificial Sequence: Synthetic peptide
  Seed: VLSLSGVML (PRAME_HUMAN)
VLSLSGVMY

SEQ ID NO: 156545 - protein, 9 aa, Artificial Sequence
  Description of Artificial Sequence: Synthetic peptide
  Seed: LSHIHASSY (PRAME_HUMAN)
LMHIHASSW

SEQ ID NO: 156546 - protein, 9 aa, Artificial Sequence
  Description of Artificial Sequence: Synthetic peptide
  Seed: VFDECGITD (PRAME_HUMAN)
VMDECGITM

SEQ ID NO: 156547 - protein, 10 aa, Artificial Sequence
  Description of Artificial Sequence: Synthetic peptide
  Seed: FLSLQCLQAL (PRAME_HUMAN)
FISLQCLQAL

SEQ ID NO: 156548 - protein, 10 aa, Artificial Sequence
  Description of Artificial Sequence: Synthetic peptide
  Seed: ETLSITNCRL (PRAME_HUMAN)
ETLSITNCRI

SEQ ID NO: 156549 - protein, 11 aa, Artificial Sequence
  Description of Artificial Sequence: Synthetic peptide
  Seed: LPTLAKFSPYL (PRAME_HUMAN)
LETLAKFSPYI

SEQ ID NO: 156550 - protein, 9 aa, Artificial Sequence
  Description of Artificial Sequence: Synthetic peptide
  Seed: MINLRRLLL (PRAME_HUMAN)
MSNLRRLLM

SEQ ID NO: 156551 - protein, 10 aa, Artificial Sequence
  Description of Artificial Sequence: Synthetic peptide
  Seed: FIPVEVLVDL (PRAME_HUMAN)
FTPVEVLVDM

SEQ ID NO: 156552 - protein, 9 aa, Artificial Sequence
  Description of Artificial Sequence: Synthetic peptide
  Seed: SPEPLQALL (PRAME_HUMAN)
STEPLQALL

SEQ ID NO: 156553 - protein, 10 aa, Artificial Sequence
  Description of Artificial Sequence: Synthetic peptide
  Seed: YIAQFTSQFL (PRAME_HUMAN)
YAAQFTSQFL

SEQ ID NO: 156554 - protein, 10 aa, Artificial Sequence
  Description of Artificial Sequence: Synthetic peptide
  Seed: RRLWGSIQSR (PRAME_HUMAN)
RRLWGSIQSL

SEQ ID NO: 156555 - protein, 10 aa, Artificial Sequence
  Description of Artificial Sequence: Synthetic peptide
  Seed: IQSRYISMSV (PRAME_HUMAN)
IKSRYISMSY

SEQ ID NO: 156556 - protein, 10 aa, Artificial Sequence
  Description of Artificial Sequence: Synthetic peptide
  Seed: LSFYGNSISI (PRAME_HUMAN)
LSFYGNSISY

SEQ ID NO: 156557 - protein, 11 aa, Artificial Sequence
  Description of Artificial Sequence: Synthetic peptide
  Seed: AAFDGRHSQTL (PRAME_HUMAN)
AVFDGRHSQTI

SEQ ID NO: 156558 - protein, 9 aa, Artificial Sequence
  Description of Artificial Sequence: Synthetic peptide
  Seed: QLLALLPSL (PRAME_HUMAN)
QMLALLPSV

SEQ ID NO: 156559 - protein, 9 aa, Artificial Sequence
  Description of Artificial Sequence: Synthetic peptide
  Seed: LLALLPSLS (PRAME_HUMAN)
LIALLPSLV

SEQ ID NO: 156560 - protein, 9 aa, Artificial Sequence
  Description of Artificial Sequence: Synthetic peptide
  Seed: EDLEVTCTW (PRAME_HUMAN)
EELEVTCTF

SEQ ID NO: 156561 - protein, 10 aa, Artificial Sequence
  Description of Artificial Sequence: Synthetic peptide
  Seed: YGNSISISAL (PRAME_HUMAN)
YANSISISAF

SEQ ID NO: 156562 - protein, 9 aa, Artificial Sequence
  Description of Artificial Sequence: Synthetic peptide
  Seed: LLSHIHASS (PRAME_HUMAN)
LLSHIHASM

SEQ ID NO: 156563 - protein, 9 aa, Artificial Sequence
  Description of Artificial Sequence: Synthetic peptide
  Seed: LSLQCLQAL (PRAME_HUMAN)
LGLQCLQAY

SEQ ID NO: 156564 - protein, 10 aa, Artificial Sequence
  Description of Artificial Sequence: Synthetic peptide
  Seed: DVSPEPLQAL (PRAME_HUMAN)
DTSPEPLQAY

SEQ ID NO: 156565 - protein, 9 aa, Artificial Sequence
  Description of Artificial Sequence: Synthetic peptide
  Seed: SIEDLEVTC (PRAME_HUMAN)
SLEDLEVTI

SEQ ID NO: 156566 - protein, 10 aa, Artificial Sequence
  Description of Artificial Sequence: Synthetic peptide
  Seed: MVQAWPFTCL (PRAME_HUMAN)
MIQAWPFTCL

SEQ ID NO: 156567 - protein, 9 aa, Artificial Sequence
  Description of Artificial Sequence: Synthetic peptide
  Seed: YISMSVWTS (PRAME_HUMAN)
YISMSVWTV

SEQ ID NO: 156568 - protein, 9 aa, Artificial Sequence
  Description of Artificial Sequence: Synthetic peptide
  Seed: TDDQLLALL (PRAME_HUMAN)
TADQLLALF

SEQ ID NO: 156569 - protein, 10 aa, Artificial Sequence
  Description of Artificial Sequence: Synthetic peptide
  Seed: MVQAWPFTCL (PRAME_HUMAN)
MLQAWPFTCF

SEQ ID NO: 156570 - protein, 10 aa, Artificial Sequence
  Description of Artificial Sequence: Synthetic peptide
  Seed: KNVLRLCCKK (PRAME_HUMAN)
KMVLRLCCKR

SEQ ID NO: 156571 - protein, 10 aa, Artificial Sequence
  Description of Artificial Sequence: Synthetic peptide
  Seed: FFLRGRLDQL (PRAME_HUMAN)
FLLRGRLDQV

SEQ ID NO: 156572 - protein, 10 aa, Artificial Sequence
  Description of Artificial Sequence: Synthetic peptide
  Seed: MERRRLWGSI (PRAME_HUMAN)
MPRRRLWGSM

SEQ ID NO: 156573 - protein, 9 aa, Artificial Sequence
  Description of Artificial Sequence: Synthetic peptide
  Seed: FTCLPLGVL (PRAME_HUMAN)
FTCLPLGVV

SEQ ID NO: 156574 - protein, 10 aa, Artificial Sequence
  Description of Artificial Sequence: Synthetic peptide
  Seed: GACDELFSYL (PRAME_HUMAN)
GMCDELFSYW

SEQ ID NO: 156575 - protein, 9 aa, Artificial Sequence
  Description of Artificial Sequence: Synthetic peptide
  Seed: LDVLLAQEV (PRAME_HUMAN)
LQVLLAQEV

SEQ ID NO: 156576 - protein, 9 aa, Artificial Sequence
  Description of Artificial Sequence: Synthetic peptide
  Seed: VSPEPLQAL (PRAME_HUMAN)
VIPEPLQAM

SEQ ID NO: 156577 - protein, 10 aa, Artificial Sequence
  Description of Artificial Sequence: Synthetic peptide
  Seed: FLRGRLDQLL (PRAME_HUMAN)
FMRGRLDQLV

SEQ ID NO: 156578 - protein, 9 aa, Artificial Sequence
  Description of Artificial Sequence: Synthetic peptide
  Seed: LSLQCLQAL (PRAME_HUMAN)
LVLQCLQAW

SEQ ID NO: 156579 - protein, 9 aa, Artificial Sequence
  Description of Artificial Sequence: Synthetic peptide
  Seed: EDLEVTCTW (PRAME_HUMAN)
ETLEVTCTY

SEQ ID NO: 156580 - protein, 9 aa, Artificial Sequence
  Description of Artificial Sequence: Synthetic peptide
  Seed: LMKGQHLHL (PRAME_HUMAN)
LKKGQHLHY

SEQ ID NO: 156581 - protein, 10 aa, Artificial Sequence
  Description of Artificial Sequence: Synthetic peptide
  Seed: LPTLAKFSPY (PRAME_HUMAN)
LCTLAKFSPY

SEQ ID NO: 156582 - protein, 9 aa, Artificial Sequence
  Description of Artificial Sequence: Synthetic peptide
  Seed: YGNSISISA (PRAME_HUMAN)
YLNSISISY

SEQ ID NO: 156583 - protein, 11 aa, Artificial Sequence
  Description of Artificial Sequence: Synthetic peptide
  Seed: IQSRYISMSVW (PRAME_HUMAN)
ITSRYISMSVF

SEQ ID NO: 156584 - protein, 9 aa, Artificial Sequence
  Description of Artificial Sequence: Synthetic peptide
  Seed: YSFPEPEAA (PRAME_HUMAN)
YVFPEPEAY

SEQ ID NO: 156585 - protein, 9 aa, Artificial Sequence
  Description of Artificial Sequence: Synthetic peptide
  Seed: RELFPPLFM (PRAME_HUMAN)
RELFPPLFP

SEQ ID NO: 156586 - protein, 10 aa, Artificial Sequence
  Description of Artificial Sequence: Synthetic peptide
  Seed: RGRLDQLLRH (PRAME_HUMAN)
RMRLDQLLRF

SEQ ID NO: 156587 - protein, 10 aa, Artificial Sequence
  Description of Artificial Sequence: Synthetic peptide
  Seed: VLMKGQHLHL (PRAME_HUMAN)
VLMKGQHLHV

SEQ ID NO: 156588 - protein, 9 aa, Artificial Sequence
  Description of Artificial Sequence: Synthetic peptide
  Seed: AAFDGRHSQ (PRAME_HUMAN)
AMFDGRHSM

SEQ ID NO: 156589 - protein, 9 aa, Artificial Sequence
  Description of Artificial Sequence: Synthetic peptide
  Seed: VQLDSIEDL (PRAME_HUMAN)
VQLDSIEDY

SEQ ID NO: 156590 - protein, 9 aa, Artificial Sequence
  Description of Artificial Sequence: Synthetic peptide
  Seed: RLCCKKLKI (PRAME_HUMAN)
RICCKKLKF

SEQ ID NO: 156591 - protein, 9 aa, Artificial Sequence
  Description of Artificial Sequence: Synthetic peptide
  Seed: RRLWGSIQS (PRAME_HUMAN)
RRLWGSIQV

SEQ ID NO: 156592 - protein, 9 aa, Artificial Sequence
  Description of Artificial Sequence: Synthetic peptide
  Seed: KAMVQAWPF (PRAME_HUMAN)
KWMVQAWPV

SEQ ID NO: 156593 - protein, 9 aa, Artificial Sequence
  Description of Artificial Sequence: Synthetic peptide
  Seed: FYDPEPILC (PRAME_HUMAN)
FIDPEPILV

SEQ ID NO: 156594 - protein, 9 aa, Artificial Sequence
  Description of Artificial Sequence: Synthetic peptide
  Seed: EQPFIPVEV (PRAME_HUMAN)
ETPFIPVEA

SEQ ID NO: 156595 - protein, 10 aa, Artificial Sequence
  Description of Artificial Sequence: Synthetic peptide
  Seed: AALELLPREL (PRAME_HUMAN)
ASLELLPREW

SEQ ID NO: 156596 - protein, 9 aa, Artificial Sequence
  Description of Artificial Sequence: Synthetic peptide
  Seed: LQALYVDSL (PRAME_HUMAN)
LVALYVDSL

SEQ ID NO: 156597 - protein, 9 aa, Artificial Sequence
  Description of Artificial Sequence: Synthetic peptide
  Seed: KVKRKKNVL (PRAME_HUMAN)
KPKRKKNVL

SEQ ID NO: 156598 - protein, 10 aa, Artificial Sequence
  Description of Artificial Sequence: Synthetic peptide
  Seed: DELFSYLIEK (PRAME_HUMAN)
DTLFSYLIER

SEQ ID NO: 156599 - protein, 9 aa, Artificial Sequence
  Description of Artificial Sequence: Synthetic peptide
  Seed: KLKIFAMPM (PRAME_HUMAN)
KSKIFAMPK

SEQ ID NO: 156600 - protein, 9 aa, Artificial Sequence
  Description of Artificial Sequence: Synthetic peptide
  Seed: LQHLIGLSN (PRAME_HUMAN)
LSHLIGLSM

SEQ ID NO: 156601 - protein, 10 aa, Artificial Sequence
  Description of Artificial Sequence: Synthetic peptide
  Seed: SQLTTLSFYG (PRAME_HUMAN)
SVLTTLSFYY

SEQ ID NO: 156602 - protein, 10 aa, Artificial Sequence
  Description of Artificial Sequence: Synthetic peptide
  Seed: TWKLPTLAKF (PRAME_HUMAN)
TQKLPTLAKF

SEQ ID NO: 156603 - protein, 10 aa, Artificial Sequence
  Description of Artificial Sequence: Synthetic peptide
  Seed: GLSNLTHVLY (PRAME_HUMAN)
GMSNLTHVLV

SEQ ID NO: 156604 - protein, 10 aa, Artificial Sequence
  Description of Artificial Sequence: Synthetic peptide
  Seed: IGLSNLTHVL (PRAME_HUMAN)
IMLSNLTHVV

SEQ ID NO: 156605 - protein, 9 aa, Artificial Sequence
  Description of Artificial Sequence: Synthetic peptide
  Seed: SLLQHLIGL (PRAME_HUMAN)
SMLQHLIGK

SEQ ID NO: 156606 - protein, 9 aa, Artificial Sequence
  Description of Artificial Sequence: Synthetic peptide
  Seed: EVRPRRWKL (PRAME_HUMAN)
ELRPRRWKL

SEQ ID NO: 156607 - protein, 10 aa, Artificial Sequence
  Description of Artificial Sequence: Synthetic peptide
  Seed: GLSNLTHVLY (PRAME_HUMAN)
GISNLTHVLY

SEQ ID NO: 156608 - protein, 9 aa, Artificial Sequence
  Description of Artificial Sequence: Synthetic peptide
  Seed: LQSLLQHLI (PRAME_HUMAN)
LASLLQHLV

SEQ ID NO: 156609 - protein, 9 aa, Artificial Sequence
  Description of Artificial Sequence: Synthetic peptide
  Seed: TWKLPTLAK (PRAME_HUMAN)
TIKLPTLAR

SEQ ID NO: 156610 - protein, 9 aa, Artificial Sequence
  Description of Artificial Sequence: Synthetic peptide
  Seed: SLQCLQALY (PRAME_HUMAN)
STQCLQALK

SEQ ID NO: 156611 - protein, 9 aa, Artificial Sequence
  Description of Artificial Sequence: Synthetic peptide
  Seed: ISPEKEEQY (PRAME_HUMAN)
ILPEKEEQY

SEQ ID NO: 156612 - protein, 9 aa, Artificial Sequence
  Description of Artificial Sequence: Synthetic peptide
  Seed: QSRYISMSV (PRAME_HUMAN)
QYRYISMSI

SEQ ID NO: 156613 - protein, 9 aa, Artificial Sequence
  Description of Artificial Sequence: Synthetic peptide
  Seed: VLDGLDVLL (PRAME_HUMAN)
VCDGLDVLM

SEQ ID NO: 156614 - protein, 11 aa, Artificial Sequence
  Description of Artificial Sequence: Synthetic peptide
  Seed: LPTLAKFSPYL (PRAME_HUMAN)
LETLAKFSPYV

SEQ ID NO: 156615 - protein, 9 aa, Artificial Sequence
  Description of Artificial Sequence: Synthetic peptide
  Seed: HVMNPLETL (PRAME_HUMAN)
HSMNPLETV

SEQ ID NO: 156616 - protein, 10 aa, Artificial Sequence
  Description of Artificial Sequence: Synthetic peptide
  Seed: MPMQDIKMIL (PRAME_HUMAN)
MPMQDIKMIF

SEQ ID NO: 156617 - protein, 9 aa, Artificial Sequence
  Description of Artificial Sequence: Synthetic peptide
  Seed: AFDGRHSQT (PRAME_HUMAN)
AIDGRHSQL

SEQ ID NO: 156618 - protein, 9 aa, Artificial Sequence
  Description of Artificial Sequence: Synthetic peptide
  Seed: TLHLERLAY (PRAME_HUMAN)
TQHLERLAL

SEQ ID NO: 156619 - protein, 10 aa, Artificial Sequence
  Description of Artificial Sequence: Synthetic peptide
  Seed: ARLRELLCEL (PRAME_HUMAN)
AVLRELLCEV

SEQ ID NO: 156620 - protein, 9 aa, Artificial Sequence
  Description of Artificial Sequence: Synthetic peptide
  Seed: LYVDSLFFL (PRAME_HUMAN)
LYVDSLFFV

SEQ ID NO: 156621 - protein, 9 aa, Artificial Sequence
  Description of Artificial Sequence: Synthetic peptide
  Seed: SFYGNSISI (PRAME_HUMAN)
STYGNSISF

SEQ ID NO: 156622 - protein, 9 aa, Artificial Sequence
  Description of Artificial Sequence: Synthetic peptide
  Seed: TLAKFSPYL (PRAME_HUMAN)
TMAKFSPYW

SEQ ID NO: 156623 - protein, 10 aa, Artificial Sequence
  Description of Artificial Sequence: Synthetic peptide
  Seed: RRLWGSIQSR (PRAME_HUMAN)
RPLWGSIQSR

SEQ ID NO: 156624 - protein, 10 aa, Artificial Sequence
  Description of Artificial Sequence: Synthetic peptide
  Seed: RLAYLHARLR (PRAME_HUMAN)
REAYLHARLK

SEQ ID NO: 156625 - protein, 10 aa, Artificial Sequence
  Description of Artificial Sequence: Synthetic peptide
  Seed: MNPLETLSIT (PRAME_HUMAN)
MRPLETLSIA

SEQ ID NO: 156626 - protein, 9 aa, Artificial Sequence
  Description of Artificial Sequence: Synthetic peptide
  Seed: SALQSLLQH (PRAME_HUMAN)
SQLQSLLQK

SEQ ID NO: 156627 - protein, 9 aa, Artificial Sequence
  Description of Artificial Sequence: Synthetic peptide
  Seed: KAMVQAWPF (PRAME_HUMAN)
KTMVQAWPI

SEQ ID NO: 156628 - protein, 10 aa, Artificial Sequence
  Description of Artificial Sequence: Synthetic peptide
  Seed: SLLKDEALAI (PRAME_HUMAN)
SQLKDEALAI

SEQ ID NO: 156629 - protein, 11 aa, Artificial Sequence
  Description of Artificial Sequence: Synthetic peptide
  Seed: ELFSYLIEKVK (PRAME_HUMAN)
ESFSYLIEKVR

SEQ ID NO: 156630 - protein, 9 aa, Artificial Sequence
  Description of Artificial Sequence: Synthetic peptide
  Seed: KNVLRLCCK (PRAME_HUMAN)
KIVLRLCCR

SEQ ID NO: 156631 - protein, 11 aa, Artificial Sequence
  Description of Artificial Sequence: Synthetic peptide
  Seed: LSNLTHVLYPV (PRAME_HUMAN)
LINLTHVLYPV

SEQ ID NO: 156632 - protein, 9 aa, Artificial Sequence
  Description of Artificial Sequence: Synthetic peptide
  Seed: RRLWGSIQS (PRAME_HUMAN)
RQLWGSIQL

SEQ ID NO: 156633 - protein, 10 aa, Artificial Sequence
  Description of Artificial Sequence: Synthetic peptide
  Seed: SALQSLLQHL (PRAME_HUMAN)
SKLQSLLQHV

SEQ ID NO: 156634 - protein, 10 aa, Artificial Sequence
  Description of Artificial Sequence: Synthetic peptide
  Seed: VLYPVPLESY (PRAME_HUMAN)
VMYPVPLESM

SEQ ID NO: 156635 - protein, 9 aa, Artificial Sequence
  Description of Artificial Sequence: Synthetic peptide
  Seed: LSEGDVMHL (PRAME_HUMAN)
LLEGDVMHL

SEQ ID NO: 156636 - protein, 9 aa, Artificial Sequence
  Description of Artificial Sequence: Synthetic peptide
  Seed: FYDPEPILC (PRAME_HUMAN)
FADPEPILL

SEQ ID NO: 156637 - protein, 9 aa, Artificial Sequence
  Description of Artificial Sequence: Synthetic peptide
  Seed: MHLSQSPSV (PRAME_HUMAN)
MHLSQSPSI

SEQ ID NO: 156638 - protein, 10 aa, Artificial Sequence
  Description of Artificial Sequence: Synthetic peptide
  Seed: SLLKDEALAI (PRAME_HUMAN)
SRLKDEALAV

SEQ ID NO: 156639 - protein, 10 aa, Artificial Sequence
  Description of Artificial Sequence: Synthetic peptide
  Seed: ITDDQLLALL (PRAME_HUMAN)
IIDDQLLALL

SEQ ID NO: 156640 - protein, 9 aa, Artificial Sequence
  Description of Artificial Sequence: Synthetic peptide
  Seed: NLTHVLYPV (PRAME_HUMAN)
NTTHVLYPV

SEQ ID NO: 156641 - protein, 9 aa, Artificial Sequence
  Description of Artificial Sequence: Synthetic peptide
  Seed: ITDDQLLAL (PRAME_HUMAN)
IYDDQLLAA

SEQ ID NO: 156642 - protein, 9 aa, Artificial Sequence
  Description of Artificial Sequence: Synthetic peptide
  Seed: LYPVPLESY (PRAME_HUMAN)
LAPVPLESV

SEQ ID NO: 156643 - protein, 10 aa, Artificial Sequence
  Description of Artificial Sequence: Synthetic peptide
  Seed: MSVWTSPRRL (PRAME_HUMAN)
MCVWTSPRRW

SEQ ID NO: 156644 - protein, 11 aa, Artificial Sequence
  Description of Artificial Sequence: Synthetic peptide
  Seed: LTDVSPEPLQA (PRAME_HUMAN)
LSDVSPEPLQM

SEQ ID NO: 156645 - protein, 11 aa, Artificial Sequence
  Description of Artificial Sequence: Synthetic peptide
  Seed: QALYVDSLFFL (PRAME_HUMAN)
QILYVDSLFFV

SEQ ID NO: 156646 - protein, 10 aa, Artificial Sequence
  Description of Artificial Sequence: Synthetic peptide
  Seed: PTLAKFSPYL (PRAME_HUMAN)
PKLAKFSPYV

SEQ ID NO: 156647 - protein, 9 aa, Artificial Sequence
  Description of Artificial Sequence: Synthetic peptide
  Seed: KVDGLSTEA (PRAME_HUMAN)
KSDGLSTEF

SEQ ID NO: 156648 - protein, 9 aa, Artificial Sequence
  Description of Artificial Sequence: Synthetic peptide
  Seed: DGRHSQTLK (PRAME_HUMAN)
DARHSQTLR

SEQ ID NO: 156649 - protein, 9 aa, Artificial Sequence
  Description of Artificial Sequence: Synthetic peptide
  Seed: YLGQMINLR (PRAME_HUMAN)
YTGQMINLY

SEQ ID NO: 156650 - protein, 9 aa, Artificial Sequence
  Description of Artificial Sequence: Synthetic peptide
  Seed: RASATLQDL (PRAME_HUMAN)
RQSATLQDI

SEQ ID NO: 156651 - protein, 9 aa, Artificial Sequence
  Description of Artificial Sequence: Synthetic peptide
  Seed: LTDVSPEPL (PRAME_HUMAN)
LFDVSPEPI

SEQ ID NO: 156652 - protein, 10 aa, Artificial Sequence
  Description of Artificial Sequence: Synthetic peptide
  Seed: ALYVDSLFFL (PRAME_HUMAN)
AIYVDSLFFI

SEQ ID NO: 156653 - protein, 8 aa, Artificial Sequence
  Description of Artificial Sequence: Synthetic peptide
  Seed: LLALLPSL (PRAME_HUMAN)
LWALLPSV

SEQ ID NO: 156654 - protein, 9 aa, Artificial Sequence
  Description of Artificial Sequence: Synthetic peptide
  Seed: WKLPTLAKF (PRAME_HUMAN)
WQLPTLAKM

SEQ ID NO: 156655 - protein, 10 aa, Artificial Sequence
  Description of Artificial Sequence: Synthetic peptide
  Seed: ARLRELLCEL (PRAME_HUMAN)
APLRELLCEI

SEQ ID NO: 156656 - protein, 10 aa, Artificial Sequence
  Description of Artificial Sequence: Synthetic peptide
  Seed: EALAIAALEL (PRAME_HUMAN)
EYLAIAALEL

SEQ ID NO: 156657 - protein, 11 aa, Artificial Sequence
  Description of Artificial Sequence: Synthetic peptide
  Seed: SNLTHVLYPVP (PRAME_HUMAN)
SMLTHVLYPVQ

SEQ ID NO: 156658 - protein, 9 aa, Artificial Sequence
  Description of Artificial Sequence: Synthetic peptide
  Seed: RLDQLLRHV (PRAME_HUMAN)
RTDQLLRHV

SEQ ID NO: 156659 - protein, 9 aa, Artificial Sequence
  Description of Artificial Sequence: Synthetic peptide
  Seed: LSEGDVMHL (PRAME_HUMAN)
LSEGDVMHW

SEQ ID NO: 156660 - protein, 11 aa, Artificial Sequence
  Description of Artificial Sequence: Synthetic peptide
  Seed: LQSLLQHLIGL (PRAME_HUMAN)
LFSLLQHLIGV

SEQ ID NO: 156661 - protein, 9 aa, Artificial Sequence
  Description of Artificial Sequence: Synthetic peptide
  Seed: EQPFIPVEV (PRAME_HUMAN)
EAPFIPVEV

SEQ ID NO: 156662 - protein, 9 aa, Artificial Sequence
  Description of Artificial Sequence: Synthetic peptide
  Seed: SQLTTLSFY (PRAME_HUMAN)
SMLTTLSFR

SEQ ID NO: 156663 - protein, 9 aa, Artificial Sequence
  Description of Artificial Sequence: Synthetic peptide
  Seed: QLLALLPSL (PRAME_HUMAN)
QTLALLPSR

SEQ ID NO: 156664 - protein, 9 aa, Artificial Sequence
  Description of Artificial Sequence: Synthetic peptide
  Seed: HVMNPLETL (PRAME_HUMAN)
HTMNPLETA

SEQ ID NO: 156665 - protein, 9 aa, Artificial Sequence
  Description of Artificial Sequence: Synthetic peptide
  Seed: FMAAFDGRH (PRAME_HUMAN)
FKAAFDGRM

SEQ ID NO: 156666 - protein, 11 aa, Artificial Sequence
  Description of Artificial Sequence: Synthetic peptide
  Seed: ISMSVWTSPRR (PRAME_HUMAN)
IFMSVWTSPRR

SEQ ID NO: 156667 - protein, 10 aa, Artificial Sequence
  Description of Artificial Sequence: Synthetic peptide
  Seed: RLVELAGQSL (PRAME_HUMAN)
RQVELAGQSW

SEQ ID NO: 156668 - protein, 9 aa, Artificial Sequence
  Description of Artificial Sequence: Synthetic peptide
  Seed: SLLQHLIGL (PRAME_HUMAN)
SSLQHLIGV

SEQ ID NO: 156669 - protein, 10 aa, Artificial Sequence
  Description of Artificial Sequence: Synthetic peptide
  Seed: GACDELFSYL (PRAME_HUMAN)
GQCDELFSYV

SEQ ID NO: 156670 - protein, 11 aa, Artificial Sequence
  Description of Artificial Sequence: Synthetic peptide
  Seed: ISMSVWTSPRR (PRAME_HUMAN)
ITMSVWTSPRR

SEQ ID NO: 156671 - protein, 9 aa, Artificial Sequence
  Description of Artificial Sequence: Synthetic peptide
  Seed: ELFPPLFMA (PRAME_HUMAN)
ESFPPLFMM

SEQ ID NO: 156672 - protein, 10 aa, Artificial Sequence
  Description of Artificial Sequence: Synthetic peptide
  Seed: ALYVDSLFFL (PRAME_HUMAN)
ATYVDSLFFR

SEQ ID NO: 156673 - protein, 9 aa, Artificial Sequence
  Description of Artificial Sequence: Synthetic peptide
  Seed: LLRHVMNPL (PRAME_HUMAN)
LQRHVMNPW

SEQ ID NO: 156674 - protein, 9 aa, Artificial Sequence
  Description of Artificial Sequence: Synthetic peptide
  Seed: LSNLTHVLY (PRAME_HUMAN)
LTNLTHVLL

SEQ ID NO: 156675 - protein, 9 aa, Artificial Sequence
  Description of Artificial Sequence: Synthetic peptide
  Seed: TSPRRLVEL (PRAME_HUMAN)
TYPRRLVEY

SEQ ID NO: 156676 - protein, 9 aa, Artificial Sequence
  Description of Artificial Sequence: Synthetic peptide
  Seed: LSNLTHVLY (PRAME_HUMAN)
LKNLTHVLL

SEQ ID NO: 156677 - protein, 9 aa, Artificial Sequence
  Description of Artificial Sequence: Synthetic peptide
  Seed: HVMNPLETL (PRAME_HUMAN)
HLMNPLETA

SEQ ID NO: 156678 - protein, 9 aa, Artificial Sequence
  Description of Artificial Sequence: Synthetic peptide
  Seed: LQALYVDSL (PRAME_HUMAN)
LQALYVDSF

SEQ ID NO: 156679 - protein, 10 aa, Artificial Sequence
  Description of Artificial Sequence: Synthetic peptide
  Seed: RRRLWGSIQS (PRAME_HUMAN)
RIRLWGSIQR

SEQ ID NO: 156680 - protein, 9 aa, Artificial Sequence
  Description of Artificial Sequence: Synthetic peptide
  Seed: LSLQCLQAL (PRAME_HUMAN)
LSLQCLQAY

SEQ ID NO: 156681 - protein, 10 aa, Artificial Sequence
  Description of Artificial Sequence: Synthetic peptide
  Seed: KGQHLHLETF (PRAME_HUMAN)
KDQHLHLETF

SEQ ID NO: 156682 - protein, 9 aa, Artificial Sequence
  Description of Artificial Sequence: Synthetic peptide
  Seed: YLHARLREL (PRAME_HUMAN)
YYHARLREH

SEQ ID NO: 156683 - protein, 10 aa, Artificial Sequence
  Description of Artificial Sequence: Synthetic peptide
  Seed: SNLTHVLYPV (PRAME_HUMAN)
SVLTHVLYPV

SEQ ID NO: 156684 - protein, 11 aa, Artificial Sequence
  Description of Artificial Sequence: Synthetic peptide
  Seed: PRELFPPLFMA (PRAME_HUMAN)
PIELFPPLFMV

SEQ ID NO: 156685 - protein, 9 aa, Artificial Sequence
  Description of Artificial Sequence: Synthetic peptide
  Seed: YLIEKVKRK (PRAME_HUMAN)
YLIEKVKRM

SEQ ID NO: 156686 - protein, 9 aa, Artificial Sequence
  Description of Artificial Sequence: Synthetic peptide
  Seed: RLWGSIQSR (PRAME_HUMAN)
RFWGSIQSR

SEQ ID NO: 156687 - protein, 10 aa, Artificial Sequence
  Description of Artificial Sequence: Synthetic peptide
  Seed: QSRYISMSVW (PRAME_HUMAN)
QARYISMSVW

SEQ ID NO: 156688 - protein, 10 aa, Artificial Sequence
  Description of Artificial Sequence: Synthetic peptide
  Seed: RLDQLLRHVM (PRAME_HUMAN)
RLDQLLRHVF

SEQ ID NO: 156689 - protein, 9 aa, Artificial Sequence
  Description of Artificial Sequence: Synthetic peptide
  Seed: SEGDVMHLS (PRAME_HUMAN)
SEGDVMHLL

SEQ ID NO: 156690 - protein, 10 aa, Artificial Sequence
  Description of Artificial Sequence: Synthetic peptide
  Seed: LSFYGNSISI (PRAME_HUMAN)
LVFYGNSISY

SEQ ID NO: 156691 - protein, 10 aa, Artificial Sequence
  Description of Artificial Sequence: Synthetic peptide
  Seed: QALYVDSLFF (PRAME_HUMAN)
QPLYVDSLFY

SEQ ID NO: 156692 - protein, 10 aa, Artificial Sequence
  Description of Artificial Sequence: Synthetic peptide
  Seed: YEDIHGTLHL (PRAME_HUMAN)
YIDIHGTLHF

SEQ ID NO: 156693 - protein, 9 aa, Artificial Sequence
  Description of Artificial Sequence: Synthetic peptide
  Seed: KLKIFAMPM (PRAME_HUMAN)
KAKIFAMPS

SEQ ID NO: 156694 - protein, 9 aa, Artificial Sequence
  Description of Artificial Sequence: Synthetic peptide
  Seed: ACDELFSYL (PRAME_HUMAN)
ASDELFSYY

SEQ ID NO: 156695 - protein, 9 aa, Artificial Sequence
  Description of Artificial Sequence: Synthetic peptide
  Seed: QSLLKDEAL (PRAME_HUMAN)
QELLKDEAL

SEQ ID NO: 156696 - protein, 10 aa, Artificial Sequence
  Description of Artificial Sequence: Synthetic peptide
  Seed: ASATLQDLVF (PRAME_HUMAN)
ALATLQDLVF

SEQ ID NO: 156697 - protein, 9 aa, Artificial Sequence
  Description of Artificial Sequence: Synthetic peptide
  Seed: YGNSISISA (PRAME_HUMAN)
YQNSISISL

SEQ ID NO: 156698 - protein, 10 aa, Artificial Sequence
  Description of Artificial Sequence: Synthetic peptide
  Seed: ALYVDSLFFL (PRAME_HUMAN)
ATYVDSLFFW

SEQ ID NO: 156699 - protein, 10 aa, Artificial Sequence
  Description of Artificial Sequence: Synthetic peptide
  Seed: LLSHIHASSY (PRAME_HUMAN)
LSSHIHASSM

SEQ ID NO: 156700 - protein, 10 aa, Artificial Sequence
  Description of Artificial Sequence: Synthetic peptide
  Seed: RELFPPLFMA (PRAME_HUMAN)
RTLFPPLFMA

SEQ ID NO: 156701 - protein, 10 aa, Artificial Sequence
  Description of Artificial Sequence: Synthetic peptide
  Seed: KDEALAIAAL (PRAME_HUMAN)
KHEALAIAAA

SEQ ID NO: 156702 - protein, 9 aa, Artificial Sequence
  Description of Artificial Sequence: Synthetic peptide
  Seed: ALYVDSLFF (PRAME_HUMAN)
AAYVDSLFY

SEQ ID NO: 156703 - protein, 9 aa, Artificial Sequence
  Description of Artificial Sequence: Synthetic peptide
  Seed: SVLSLSGVM (PRAME_HUMAN)
SHLSLSGVY

SEQ ID NO: 156704 - protein, 10 aa, Artificial Sequence
  Description of Artificial Sequence: Synthetic peptide
  Seed: LYVDSLFFLR (PRAME_HUMAN)
LTVDSLFFLR

SEQ ID NO: 156705 - protein, 10 aa, Artificial Sequence
  Description of Artificial Sequence: Synthetic peptide
  Seed: MQDIKMILKM (PRAME_HUMAN)
MQDIKMILKF

SEQ ID NO: 156706 - protein, 9 aa, Artificial Sequence
  Description of Artificial Sequence: Synthetic peptide
  Seed: ITDDQLLAL (PRAME_HUMAN)
IVDDQLLAY

SEQ ID NO: 156707 - protein, 9 aa, Artificial Sequence
  Description of Artificial Sequence: Synthetic peptide
  Seed: YGNSISISA (PRAME_HUMAN)
YPNSISISP

SEQ ID NO: 156708 - protein, 10 aa, Artificial Sequence
  Description of Artificial Sequence: Synthetic peptide
  Seed: TEAEQPFIPV (PRAME_HUMAN)
TEAEQPFIPM

SEQ ID NO: 156709 - protein, 10 aa, Artificial Sequence
  Description of Artificial Sequence: Synthetic peptide
  Seed: QAWPFTCLPL (PRAME_HUMAN)
QTWPFTCLPF

SEQ ID NO: 156710 - protein, 11 aa, Artificial Sequence
  Description of Artificial Sequence: Synthetic peptide
  Seed: RRLWGSIQSRY (PRAME_HUMAN)
RLLWGSIQSRR

SEQ ID NO: 156711 - protein, 10 aa, Artificial Sequence
  Description of Artificial Sequence: Synthetic peptide
  Seed: PTLAKFSPYL (PRAME_HUMAN)
PFLAKFSPYV

SEQ ID NO: 156712 - protein, 9 aa, Artificial Sequence
  Description of Artificial Sequence: Synthetic peptide
  Seed: RLAYLHARL (PRAME_HUMAN)
RIAYLHARY

SEQ ID NO: 156713 - protein, 11 aa, Artificial Sequence
  Description of Artificial Sequence: Synthetic peptide
  Seed: AAFDGRHSQTL (PRAME_HUMAN)
AFFDGRHSQTF

SEQ ID NO: 156714 - protein, 10 aa, Artificial Sequence
  Description of Artificial Sequence: Synthetic peptide
  Seed: LLLSHIHASS (PRAME_HUMAN)
LVLSHIHASV

SEQ ID NO: 156715 - protein, 9 aa, Artificial Sequence
  Description of Artificial Sequence: Synthetic peptide
  Seed: KFSPYLGQM (PRAME_HUMAN)
KTSPYLGQM

SEQ ID NO: 156716 - protein, 10 aa, Artificial Sequence
  Description of Artificial Sequence: Synthetic peptide
  Seed: QYIAQFTSQF (PRAME_HUMAN)
QWIAQFTSQF

SEQ ID NO: 156717 - protein, 9 aa, Artificial Sequence
  Description of Artificial Sequence: Synthetic peptide
  Seed: GQHLHLETF (PRAME_HUMAN)
GEHLHLETV

SEQ ID NO: 156718 - protein, 10 aa, Artificial Sequence
  Description of Artificial Sequence: Synthetic peptide
  Seed: IQSRYISMSV (PRAME_HUMAN)
IGSRYISMSK

SEQ ID NO: 156719 - protein, 11 aa, Artificial Sequence
  Description of Artificial Sequence: Synthetic peptide
  Seed: LSNLTHVLYPV (PRAME_HUMAN)
LVNLTHVLYPV

SEQ ID NO: 156720 - protein, 9 aa, Artificial Sequence
  Description of Artificial Sequence: Synthetic peptide
  Seed: LQDLVFDEC (PRAME_HUMAN)
LCDLVFDEL

SEQ ID NO: 156721 - protein, 9 aa, Artificial Sequence
  Description of Artificial Sequence: Synthetic peptide
  Seed: YLGQMINLR (PRAME_HUMAN)
YSGQMINLR

SEQ ID NO: 156722 - protein, 9 aa, Artificial Sequence
  Description of Artificial Sequence: Synthetic peptide
  Seed: RLCCKKLKI (PRAME_HUMAN)
RVCCKKLKF

SEQ ID NO: 156723 - protein, 10 aa, Artificial Sequence
  Description of Artificial Sequence: Synthetic peptide
  Seed: SGNRASLYSF (PRAME_HUMAN)
SKNRASLYSM

SEQ ID NO: 156724 - protein, 9 aa, Artificial Sequence
  Description of Artificial Sequence: Synthetic peptide
  Seed: FYDPEPILC (PRAME_HUMAN)
FPDPEPILI

SEQ ID NO: 156725 - protein, 9 aa, Artificial Sequence
  Description of Artificial Sequence: Synthetic peptide
  Seed: RLRELLCEL (PRAME_HUMAN)
RHRELLCEF

SEQ ID NO: 156726 - protein, 10 aa, Artificial Sequence
  Description of Artificial Sequence: Synthetic peptide
  Seed: YIAQFTSQFL (PRAME_HUMAN)
YQAQFTSQFY

SEQ ID NO: 156727 - protein, 11 aa, Artificial Sequence
  Description of Artificial Sequence: Synthetic peptide
  Seed: AAFDGRHSQTL (PRAME_HUMAN)
AQFDGRHSQTW

SEQ ID NO: 156728 - protein, 9 aa, Artificial Sequence
  Description of Artificial Sequence: Synthetic peptide
  Seed: EAAQPMTKK (PRAME_HUMAN)
EMAQPMTKK

SEQ ID NO: 156729 - protein, 9 aa, Artificial Sequence
  Description of Artificial Sequence: Synthetic peptide
  Seed: AWPFTCLPL (PRAME_HUMAN)
AFPFTCLPL

SEQ ID NO: 156730 - protein, 8 aa, Artificial Sequence
  Description of Artificial Sequence: Synthetic peptide
  Seed: YEDIHGTL (PRAME_HUMAN)
YCDIHGTL

SEQ ID NO: 156731 - protein, 10 aa, Artificial Sequence
  Description of Artificial Sequence: Synthetic peptide
  Seed: FFLRGRLDQL (PRAME_HUMAN)
FSLRGRLDQL

SEQ ID NO: 156732 - protein, 11 aa, Artificial Sequence
  Description of Artificial Sequence: Synthetic peptide
  Seed: RLWGSIQSRYI (PRAME_HUMAN)
RQWGSIQSRYF

SEQ ID NO: 156733 - protein, 10 aa, Artificial Sequence
  Description of Artificial Sequence: Synthetic peptide
  Seed: VDSLFFLRGR (PRAME_HUMAN)
VTSLFFLRGR

SEQ ID NO: 156734 - protein, 11 aa, Artificial Sequence
  Description of Artificial Sequence: Synthetic peptide
  Seed: LQSLLQHLIGL (PRAME_HUMAN)
LMSLLQHLIGV

SEQ ID NO: 156735 - protein, 11 aa, Artificial Sequence
  Description of Artificial Sequence: Synthetic peptide
  Seed: AAFDGRHSQTL (PRAME_HUMAN)
AVFDGRHSQTF

SEQ ID NO: 156736 - protein, 9 aa, Artificial Sequence
  Description of Artificial Sequence: Synthetic peptide
  Seed: SHQDFWTVW (PRAME_HUMAN)
SFQDFWTVI

SEQ ID NO: 156737 - protein, 9 aa, Artificial Sequence
  Description of Artificial Sequence: Synthetic peptide
  Seed: QTLKAMVQA (PRAME_HUMAN)
QMLKAMVQA

SEQ ID NO: 156738 - protein, 10 aa, Artificial Sequence
  Description of Artificial Sequence: Synthetic peptide
  Seed: RHVMNPLETL (PRAME_HUMAN)
RSVMNPLETV

SEQ ID NO: 156739 - protein, 10 aa, Artificial Sequence
  Description of Artificial Sequence: Synthetic peptide
  Seed: GRLDQLLRHV (PRAME_HUMAN)
GLLDQLLRHI

SEQ ID NO: 156740 - protein, 9 aa, Artificial Sequence
  Description of Artificial Sequence: Synthetic peptide
  Seed: ITDDQLLAL (PRAME_HUMAN)
ITDDQLLAV

SEQ ID NO: 156741 - protein, 11 aa, Artificial Sequence
  Description of Artificial Sequence: Synthetic peptide
  Seed: LPTLAKFSPYL (PRAME_HUMAN)
LSTLAKFSPYI

SEQ ID NO: 156742 - protein, 9 aa, Artificial Sequence
  Description of Artificial Sequence: Synthetic peptide
  Seed: RLAYLHARL (PRAME_HUMAN)
RMAYLHARV

SEQ ID NO: 156743 - protein, 10 aa, Artificial Sequence
  Description of Artificial Sequence: Synthetic peptide
  Seed: ALAIAALELL (PRAME_HUMAN)
AMAIAALELL

SEQ ID NO: 156744 - protein, 9 aa, Artificial Sequence
  Description of Artificial Sequence: Synthetic peptide
  Seed: RLWGSIQSR (PRAME_HUMAN)
RYWGSIQSF

SEQ ID NO: 156745 - protein, 10 aa, Artificial Sequence
  Description of Artificial Sequence: Synthetic peptide
  Seed: RRLWGSIQSR (PRAME_HUMAN)
RILWGSIQSR

SEQ ID NO: 156746 - protein, 9 aa, Artificial Sequence
  Description of Artificial Sequence: Synthetic peptide
  Seed: VFDECGITD (PRAME_HUMAN)
VIDECGITM

SEQ ID NO: 156747 - protein, 9 aa, Artificial Sequence
  Description of Artificial Sequence: Synthetic peptide
  Seed: KMILKMVQL (PRAME_HUMAN)
KMILKMVQK

SEQ ID NO: 156748 - protein, 9 aa, Artificial Sequence
  Description of Artificial Sequence: Synthetic peptide
  Seed: HARLRELLC (PRAME_HUMAN)
HARLRELLM

SEQ ID NO: 156749 - protein, 10 aa, Artificial Sequence
  Description of Artificial Sequence: Synthetic peptide
  Seed: SPYLGQMINL (PRAME_HUMAN)
SNYLGQMINI

SEQ ID NO: 156750 - protein, 10 aa, Artificial Sequence
  Description of Artificial Sequence: Synthetic peptide
  Seed: DQLLALLPSL (PRAME_HUMAN)
DVLLALLPSV

SEQ ID NO: 156751 - protein, 9 aa, Artificial Sequence
  Description of Artificial Sequence: Synthetic peptide
  Seed: NPLETLSIT (PRAME_HUMAN)
NPLETLSIV

SEQ ID NO: 156752 - protein, 8 aa, Artificial Sequence
  Description of Artificial Sequence: Synthetic peptide
  Seed: FYDPEPIL (PRAME_HUMAN)
FYDPEPIF

SEQ ID NO: 156753 - protein, 10 aa, Artificial Sequence
  Description of Artificial Sequence: Synthetic peptide
  Seed: VTCTWKLPTL (PRAME_HUMAN)
VTCTWKLPTF

SEQ ID NO: 156754 - protein, 9 aa, Artificial Sequence
  Description of Artificial Sequence: Synthetic peptide
  Seed: LQSLLQHLI (PRAME_HUMAN)
LTSLLQHLL

SEQ ID NO: 156755 - protein, 9 aa, Artificial Sequence
  Description of Artificial Sequence: Synthetic peptide
  Seed: LQSLLQHLI (PRAME_HUMAN)
LVSLLQHLV

SEQ ID NO: 156756 - protein, 10 aa, Artificial Sequence
  Description of Artificial Sequence: Synthetic peptide
  Seed: KAVLDGLDVL (PRAME_HUMAN)
KWVLDGLDVV

SEQ ID NO: 156757 - protein, 9 aa, Artificial Sequence
  Description of Artificial Sequence: Synthetic peptide
  Seed: MSVWTSPRR (PRAME_HUMAN)
MIVWTSPRK

SEQ ID NO: 156758 - protein, 9 aa, Artificial Sequence
  Description of Artificial Sequence: Synthetic peptide
  Seed: LAIAALELL (PRAME_HUMAN)
LPIAALELW

SEQ ID NO: 156759 - protein, 10 aa, Artificial Sequence
  Description of Artificial Sequence: Synthetic peptide
  Seed: IKMILKMVQL (PRAME_HUMAN)
IPMILKMVQV

SEQ ID NO: 156760 - protein, 9 aa, Artificial Sequence
  Description of Artificial Sequence: Synthetic peptide
  Seed: YIAQFTSQF (PRAME_HUMAN)
YTAQFTSQL

SEQ ID NO: 156761 - protein, 10 aa, Artificial Sequence
  Description of Artificial Sequence: Synthetic peptide
  Seed: MPMQDIKMIL (PRAME_HUMAN)
MMMQDIKMIL

SEQ ID NO: 156762 - protein, 9 aa, Artificial Sequence
  Description of Artificial Sequence: Synthetic peptide
  Seed: IFAMPMQDI (PRAME_HUMAN)
IFAMPMQDL

SEQ ID NO: 156763 - protein, 10 aa, Artificial Sequence
  Description of Artificial Sequence: Synthetic peptide
  Seed: LSLQCLQALY (PRAME_HUMAN)
LFLQCLQALY

SEQ ID NO: 156764 - protein, 9 aa, Artificial Sequence
  Description of Artificial Sequence: Synthetic peptide
  Seed: SVLSLSGVM (PRAME_HUMAN)
SLLSLSGVF

SEQ ID NO: 156765 - protein, 10 aa, Artificial Sequence
  Description of Artificial Sequence: Synthetic peptide
  Seed: HCSQLTTLSF (PRAME_HUMAN)
HHSQLTTLSY

SEQ ID NO: 156766 - protein, 9 aa, Artificial Sequence
  Description of Artificial Sequence: Synthetic peptide
  Seed: LCCKKLKIF (PRAME_HUMAN)
LTCKKLKIF

SEQ ID NO: 156767 - protein, 8 aa, Artificial Sequence
  Description of Artificial Sequence: Synthetic peptide
  Seed: ITDDQLLA (PRAME_HUMAN)
IADDQLLF

SEQ ID NO: 156768 - protein, 9 aa, Artificial Sequence
  Description of Artificial Sequence: Synthetic peptide
  Seed: RASATLQDL (PRAME_HUMAN)
RQSATLQDW

SEQ ID NO: 156769 - protein, 9 aa, Artificial Sequence
  Description of Artificial Sequence: Synthetic peptide
  Seed: LTDVSPEPL (PRAME_HUMAN)
LVDVSPEPM

SEQ ID NO: 156770 - protein, 8 aa, Artificial Sequence
  Description of Artificial Sequence: Synthetic peptide
  Seed: LELLPREL (PRAME_HUMAN)
LELLPREA

SEQ ID NO: 156771 - protein, 10 aa, Artificial Sequence
  Description of Artificial Sequence: Synthetic peptide
  Seed: FIPVEVLVDL (PRAME_HUMAN)
FYPVEVLVDW

SEQ ID NO: 156772 - protein, 9 aa, Artificial Sequence
  Description of Artificial Sequence: Synthetic peptide
  Seed: FPPLFMAAF (PRAME_HUMAN)
FIPLFMAAL

SEQ ID NO: 156773 - protein, 10 aa, Artificial Sequence
  Description of Artificial Sequence: Synthetic peptide
  Seed: AKFSPYLGQM (PRAME_HUMAN)
AKFSPYLGQF

SEQ ID NO: 156774 - protein, 10 aa, Artificial Sequence
  Description of Artificial Sequence: Synthetic peptide
  Seed: ALYVDSLFFL (PRAME_HUMAN)
AYYVDSLFFF

SEQ ID NO: 156775 - protein, 9 aa, Artificial Sequence
  Description of Artificial Sequence: Synthetic peptide
  Seed: YLHARLREL (PRAME_HUMAN)
YMHARLRET

SEQ ID NO: 156776 - protein, 9 aa, Artificial Sequence
  Description of Artificial Sequence: Synthetic peptide
  Seed: EVLVDLFLK (PRAME_HUMAN)
ETLVDLFLR

SEQ ID NO: 156777 - protein, 9 aa, Artificial Sequence
  Description of Artificial Sequence: Synthetic peptide
  Seed: MHLSQSPSV (PRAME_HUMAN)
MILSQSPSY

SEQ ID NO: 156778 - protein, 9 aa, Artificial Sequence
  Description of Artificial Sequence: Synthetic peptide
  Seed: FLRGRLDQL (PRAME_HUMAN)
FFRGRLDQM

SEQ ID NO: 156779 - protein, 9 aa, Artificial Sequence
  Description of Artificial Sequence: Synthetic peptide
  Seed: TSPRRLVEL (PRAME_HUMAN)
TIPRRLVEL

SEQ ID NO: 156780 - protein, 9 aa, Artificial Sequence
  Description of Artificial Sequence: Synthetic peptide
  Seed: SPEPLQALL (PRAME_HUMAN)
SPEPLQALF

SEQ ID NO: 156781 - protein, 10 aa, Artificial Sequence
  Description of Artificial Sequence: Synthetic peptide
  Seed: LLPRELFPPL (PRAME_HUMAN)
LNPRELFPPI

SEQ ID NO: 156782 - protein, 9 aa, Artificial Sequence
  Description of Artificial Sequence: Synthetic peptide
  Seed: VSQLSVLSL (PRAME_HUMAN)
VEQLSVLSL

SEQ ID NO: 156783 - protein, 9 aa, Artificial Sequence
  Description of Artificial Sequence: Synthetic peptide
  Seed: MINLRRLLL (PRAME_HUMAN)
MVNLRRLLV

SEQ ID NO: 156784 - protein, 10 aa, Artificial Sequence
  Description of Artificial Sequence: Synthetic peptide
  Seed: RELFPPLFMA (PRAME_HUMAN)
RRLFPPLFMA

SEQ ID NO: 156785 - protein, 9 aa, Artificial Sequence
  Description of Artificial Sequence: Synthetic peptide
  Seed: SQLSVLSLS (PRAME_HUMAN)
SVLSVLSLL

SEQ ID NO: 156786 - protein, 10 aa, Artificial Sequence
  Description of Artificial Sequence: Synthetic peptide
  Seed: ITDDQLLALL (PRAME_HUMAN)
IYDDQLLALF

SEQ ID NO: 156787 - protein, 9 aa, Artificial Sequence
  Description of Artificial Sequence: Synthetic peptide
  Seed: LAIAALELL (PRAME_HUMAN)
LQIAALELW

SEQ ID NO: 156788 - protein, 8 aa, Artificial Sequence
  Description of Artificial Sequence: Synthetic peptide
  Seed: RELLCELG (PRAME_HUMAN)
RELLCELA

SEQ ID NO: 156789 - protein, 11 aa, Artificial Sequence
  Description of Artificial Sequence: Synthetic peptide
  Seed: RLAYLHARLRE (PRAME_HUMAN)
RMAYLHARLRK

SEQ ID NO: 156790 - protein, 9 aa, Artificial Sequence
  Description of Artificial Sequence: Synthetic peptide
  Seed: SMSVWTSPR (PRAME_HUMAN)
SWSVWTSPR

SEQ ID NO: 156791 - protein, 9 aa, Artificial Sequence
  Description of Artificial Sequence: Synthetic peptide
  Seed: ALQSLLQHL (PRAME_HUMAN)
AQQSLLQHM

SEQ ID NO: 156792 - protein, 9 aa, Artificial Sequence
  Description of Artificial Sequence: Synthetic peptide
  Seed: YLIEKVKRK (PRAME_HUMAN)
YMIEKVKRR

SEQ ID NO: 156793 - protein, 8 aa, Artificial Sequence
  Description of Artificial Sequence: Synthetic peptide
  Seed: HARLRELL (PRAME_HUMAN)
HMRLRELL

SEQ ID NO: 156794 - protein, 8 aa, Artificial Sequence
  Description of Artificial Sequence: Synthetic peptide
  Seed: MINLRRLL (PRAME_HUMAN)
MMNLRRLI

SEQ ID NO: 156795 - protein, 10 aa, Artificial Sequence
  Description of Artificial Sequence: Synthetic peptide
  Seed: SNLTHVLYPV (PRAME_HUMAN)
SLLTHVLYPL

SEQ ID NO: 156796 - protein, 10 aa, Artificial Sequence
  Description of Artificial Sequence: Synthetic peptide
  Seed: ALLERASATL (PRAME_HUMAN)
AALERASATY

SEQ ID NO: 156797 - protein, 9 aa, Artificial Sequence
  Description of Artificial Sequence: Synthetic peptide
  Seed: VLMKGQHLH (PRAME_HUMAN)
VSMKGQHLR

SEQ ID NO: 156798 - protein, 11 aa, Artificial Sequence
  Description of Artificial Sequence: Synthetic peptide
  Seed: RLSEGDVMHLS (PRAME_HUMAN)
RLSEGDVMHLL

SEQ ID NO: 156799 - protein, 9 aa, Artificial Sequence
  Description of Artificial Sequence: Synthetic peptide
  Seed: YIAQFTSQF (PRAME_HUMAN)
YKAQFTSQY

SEQ ID NO: 156800 - protein, 10 aa, Artificial Sequence
  Description of Artificial Sequence: Synthetic peptide
  Seed: ALAIAALELL (PRAME_HUMAN)
AMAIAALELA

SEQ ID NO: 156801 - protein, 10 aa, Artificial Sequence
  Description of Artificial Sequence: Synthetic peptide
  Seed: IKMILKMVQL (PRAME_HUMAN)
IRMILKMVQV

SEQ ID NO: 156802 - protein, 9 aa, Artificial Sequence
  Description of Artificial Sequence: Synthetic peptide
  Seed: SQSPSVSQL (PRAME_HUMAN)
SLSPSVSQL

SEQ ID NO: 156803 - protein, 9 aa, Artificial Sequence
  Description of Artificial Sequence: Synthetic peptide
  Seed: ERLAYLHAR (PRAME_HUMAN)
ELLAYLHAR

SEQ ID NO: 156804 - protein, 9 aa, Artificial Sequence
  Description of Artificial Sequence: Synthetic peptide
  Seed: YGNSISISA (PRAME_HUMAN)
YPNSISISM

SEQ ID NO: 156805 - protein, 9 aa, Artificial Sequence
  Description of Artificial Sequence: Synthetic peptide
  Seed: YGNSISISA (PRAME_HUMAN)
YSNSISISM

SEQ ID NO: 156806 - protein, 10 aa, Artificial Sequence
  Description of Artificial Sequence: Synthetic peptide
  Seed: DIHGTLHLER (PRAME_HUMAN)
DVHGTLHLEK

SEQ ID NO: 156807 - protein, 9 aa, Artificial Sequence
  Description of Artificial Sequence: Synthetic peptide
  Seed: SLLKDEALA (PRAME_HUMAN)
SLLKDEALI

SEQ ID NO: 156808 - protein, 10 aa, Artificial Sequence
  Description of Artificial Sequence: Synthetic peptide
  Seed: AAFDGRHSQT (PRAME_HUMAN)
AAFDGRHSQH

SEQ ID NO: 156809 - protein, 10 aa, Artificial Sequence
  Description of Artificial Sequence: Synthetic peptide
  Seed: RHVMNPLETL (PRAME_HUMAN)
RVVMNPLETV

SEQ ID NO: 156810 - protein, 10 aa, Artificial Sequence
  Description of Artificial Sequence: Synthetic peptide
  Seed: ESYEDIHGTL (PRAME_HUMAN)
ESYEDIHGTW

SEQ ID NO: 156811 - protein, 9 aa, Artificial Sequence
  Description of Artificial Sequence: Synthetic peptide
  Seed: TLAKFSPYL (PRAME_HUMAN)
TIAKFSPYR

SEQ ID NO: 156812 - protein, 10 aa, Artificial Sequence
  Description of Artificial Sequence: Synthetic peptide
  Seed: FLSLQCLQAL (PRAME_HUMAN)
FLSLQCLQAM

SEQ ID NO: 156813 - protein, 9 aa, Artificial Sequence
  Description of Artificial Sequence: Synthetic peptide
  Seed: RLRELLCEL (PRAME_HUMAN)
RMRELLCEA

SEQ ID NO: 156814 - protein, 9 aa, Artificial Sequence
  Description of Artificial Sequence: Synthetic peptide
  Seed: RTFYDPEPI (PRAME_HUMAN)
RRFYDPEPF

SEQ ID NO: 156815 - protein, 10 aa, Artificial Sequence
  Description of Artificial Sequence: Synthetic peptide
  Seed: LSHIHASSYI (PRAME_HUMAN)
LTHIHASSYF

SEQ ID NO: 156816 - protein, 11 aa, Artificial Sequence
  Description of Artificial Sequence: Synthetic peptide
  Seed: ALYVDSLFFLR (PRAME_HUMAN)
ALYVDSLFFLF

SEQ ID NO: 156817 - protein, 10 aa, Artificial Sequence
  Description of Artificial Sequence: Synthetic peptide
  Seed: RELFPPLFMA (PRAME_HUMAN)
RGLFPPLFMV

SEQ ID NO: 156818 - protein, 11 aa, Artificial Sequence
  Description of Artificial Sequence: Synthetic peptide
  Seed: SIQSRYISMSV (PRAME_HUMAN)
STQSRYISMSK

SEQ ID NO: 156819 - protein, 9 aa, Artificial Sequence
  Description of Artificial Sequence: Synthetic peptide
  Seed: FYDPEPILC (PRAME_HUMAN)
FDDPEPILV

SEQ ID NO: 156820 - protein, 10 aa, Artificial Sequence
  Description of Artificial Sequence: Synthetic peptide
  Seed: SPYLGQMINL (PRAME_HUMAN)
SAYLGQMINI

SEQ ID NO: 156821 - protein, 9 aa, Artificial Sequence
  Description of Artificial Sequence: Synthetic peptide
  Seed: YSFPEPEAA (PRAME_HUMAN)
YEFPEPEAM

SEQ ID NO: 156822 - protein, 10 aa, Artificial Sequence
  Description of Artificial Sequence: Synthetic peptide
  Seed: ALYVDSLFFL (PRAME_HUMAN)
AGYVDSLFFF

SEQ ID NO: 156823 - protein, 9 aa, Artificial Sequence
  Description of Artificial Sequence: Synthetic peptide
  Seed: MHLSQSPSV (PRAME_HUMAN)
MHLSQSPSA

SEQ ID NO: 156824 - protein, 9 aa, Artificial Sequence
  Description of Artificial Sequence: Synthetic peptide
  Seed: TLHLERLAY (PRAME_HUMAN)
TAHLERLAM

SEQ ID NO: 156825 - protein, 9 aa, Artificial Sequence
  Description of Artificial Sequence: Synthetic peptide
  Seed: LLERASATL (PRAME_HUMAN)
LQERASATF

SEQ ID NO: 156826 - protein, 10 aa, Artificial Sequence
  Description of Artificial Sequence: Synthetic peptide
  Seed: TSQFLSLQCL (PRAME_HUMAN)
TWQFLSLQCY

SEQ ID NO: 156827 - protein, 9 aa, Artificial Sequence
  Description of Artificial Sequence: Synthetic peptide
  Seed: LGQMINLRR (PRAME_HUMAN)
LIQMINLRR

SEQ ID NO: 156828 - protein, 10 aa, Artificial Sequence
  Description of Artificial Sequence: Synthetic peptide
  Seed: LTDVSPEPLQ (PRAME_HUMAN)
LTDVSPEPLY

SEQ ID NO: 156829 - protein, 10 aa, Artificial Sequence
  Description of Artificial Sequence: Synthetic peptide
  Seed: LKAMVQAWPF (PRAME_HUMAN)
LWAMVQAWPY

SEQ ID NO: 156830 - protein, 9 aa, Artificial Sequence
  Description of Artificial Sequence: Synthetic peptide
  Seed: VLDGLDVLL (PRAME_HUMAN)
VIDGLDVLL

SEQ ID NO: 156831 - protein, 11 aa, Artificial Sequence
  Description of Artificial Sequence: Synthetic peptide
  Seed: KNSHQDFWTVW (PRAME_HUMAN)
KASHQDFWTVW

SEQ ID NO: 156832 - protein, 10 aa, Artificial Sequence
  Description of Artificial Sequence: Synthetic peptide
  Seed: GLSNLTHVLY (PRAME_HUMAN)
GTSNLTHVLK

SEQ ID NO: 156833 - protein, 9 aa, Artificial Sequence
  Description of Artificial Sequence: Synthetic peptide
  Seed: QLLALLPSL (PRAME_HUMAN)
QQLALLPSM

SEQ ID NO: 156834 - protein, 10 aa, Artificial Sequence
  Description of Artificial Sequence: Synthetic peptide
  Seed: RHVMNPLETL (PRAME_HUMAN)
RQVMNPLETM

SEQ ID NO: 156835 - protein, 9 aa, Artificial Sequence
  Description of Artificial Sequence: Synthetic peptide
  Seed: ALLPSLSHC (PRAME_HUMAN)
AILPSLSHL

SEQ ID NO: 156836 - protein, 10 aa, Artificial Sequence
  Description of Artificial Sequence: Synthetic peptide
  Seed: ALYVDSLFFL (PRAME_HUMAN)
AVYVDSLFFR

SEQ ID NO: 156837 - protein, 11 aa, Artificial Sequence
  Description of Artificial Sequence: Synthetic peptide
  Seed: LSNLTHVLYPV (PRAME_HUMAN)
LFNLTHVLYPV

SEQ ID NO: 156838 - protein, 10 aa, Artificial Sequence
  Description of Artificial Sequence: Synthetic peptide
  Seed: LSLQCLQALY (PRAME_HUMAN)
LQLQCLQALW

SEQ ID NO: 156839 - protein, 9 aa, Artificial Sequence
  Description of Artificial Sequence: Synthetic peptide
  Seed: FLRGRLDQL (PRAME_HUMAN)
FLRGRLDQY

SEQ ID NO: 156840 - protein, 10 aa, Artificial Sequence
  Description of Artificial Sequence: Synthetic peptide
  Seed: SPYLGQMINL (PRAME_HUMAN)
SPYLGQMINA

SEQ ID NO: 156841 - protein, 10 aa, Artificial Sequence
  Description of Artificial Sequence: Synthetic peptide
  Seed: VSPEPLQALL (PRAME_HUMAN)
VAPEPLQALW

SEQ ID NO: 156842 - protein, 10 aa, Artificial Sequence
  Description of Artificial Sequence: Synthetic peptide
  Seed: RELFPPLFMA (PRAME_HUMAN)
RFLFPPLFMV

SEQ ID NO: 156843 - protein, 9 aa, Artificial Sequence
  Description of Artificial Sequence: Synthetic peptide
  Seed: FPPLFMAAF (PRAME_HUMAN)
FFPLFMAAF

SEQ ID NO: 156844 - protein, 9 aa, Artificial Sequence
  Description of Artificial Sequence: Synthetic peptide
  Seed: SPEPLQALL (PRAME_HUMAN)
SAEPLQALL

SEQ ID NO: 156845 - protein, 9 aa, Artificial Sequence
  Description of Artificial Sequence: Synthetic peptide
  Seed: CKKLKIFAM (PRAME_HUMAN)
CQKLKIFAM

SEQ ID NO: 156846 - protein, 9 aa, Artificial Sequence
  Description of Artificial Sequence: Synthetic peptide
  Seed: LQDLVFDEC (PRAME_HUMAN)
LSDLVFDEF

SEQ ID NO: 156847 - protein, 10 aa, Artificial Sequence
  Description of Artificial Sequence: Synthetic peptide
  Seed: AQFTSQFLSL (PRAME_HUMAN)
AQFTSQFLSV

SEQ ID NO: 156848 - protein, 9 aa, Artificial Sequence
  Description of Artificial Sequence: Synthetic peptide
  Seed: SHQDFWTVW (PRAME_HUMAN)
SYQDFWTVI

SEQ ID NO: 156849 - protein, 9 aa, Artificial Sequence
  Description of Artificial Sequence: Synthetic peptide
  Seed: RLRELLCEL (PRAME_HUMAN)
RPRELLCET

SEQ ID NO: 156850 - protein, 9 aa, Artificial Sequence
  Description of Artificial Sequence: Synthetic peptide
  Seed: ALQSLLQHL (PRAME_HUMAN)
ARQSLLQHM

SEQ ID NO: 156851 - protein, 9 aa, Artificial Sequence
  Description of Artificial Sequence: Synthetic peptide
  Seed: LYVDSLFFL (PRAME_HUMAN)
LYVDSLFFF

SEQ ID NO: 156852 - protein, 11 aa, Artificial Sequence
  Description of Artificial Sequence: Synthetic peptide
  Seed: ESYEDIHGTLH (PRAME_HUMAN)
ELYEDIHGTLK

SEQ ID NO: 156853 - protein, 9 aa, Artificial Sequence
  Description of Artificial Sequence: Synthetic peptide
  Seed: VWSGNRASL (PRAME_HUMAN)
VTSGNRASL

SEQ ID NO: 156854 - protein, 9 aa, Artificial Sequence
  Description of Artificial Sequence: Synthetic peptide
  Seed: FDGRHSQTL (PRAME_HUMAN)
FEGRHSQTM

SEQ ID NO: 156855 - protein, 10 aa, Artificial Sequence
  Description of Artificial Sequence: Synthetic peptide
  Seed: MLTDVSPEPL (PRAME_HUMAN)
MVTDVSPEPV

SEQ ID NO: 156856 - protein, 9 aa, Artificial Sequence
  Description of Artificial Sequence: Synthetic peptide
  Seed: DSLFFLRGR (PRAME_HUMAN)
DFLFFLRGR

SEQ ID NO: 156857 - protein, 9 aa, Artificial Sequence
  Description of Artificial Sequence: Synthetic peptide
  Seed: RGRLDQLLR (PRAME_HUMAN)
RYRLDQLLK

SEQ ID NO: 156858 - protein, 9 aa, Artificial Sequence
  Description of Artificial Sequence: Synthetic peptide
  Seed: YSFPEPEAA (PRAME_HUMAN)
YTFPEPEAA

SEQ ID NO: 156859 - protein, 10 aa, Artificial Sequence
  Description of Artificial Sequence: Synthetic peptide
  Seed: SVSQLSVLSL (PRAME_HUMAN)
SMSQLSVLSV

SEQ ID NO: 156860 - protein, 9 aa, Artificial Sequence
  Description of Artificial Sequence: Synthetic peptide
  Seed: SLLQHLIGL (PRAME_HUMAN)
SVLQHLIGL

SEQ ID NO: 156861 - protein, 10 aa, Artificial Sequence
  Description of Artificial Sequence: Synthetic peptide
  Seed: ISMSVWTSPR (PRAME_HUMAN)
IIMSVWTSPK

SEQ ID NO: 156862 - protein, 10 aa, Artificial Sequence
  Description of Artificial Sequence: Synthetic peptide
  Seed: SLLQHLIGLS (PRAME_HUMAN)
SVLQHLIGLV

SEQ ID NO: 156863 - protein, 10 aa, Artificial Sequence
  Description of Artificial Sequence: Synthetic peptide
  Seed: LLSHIHASSY (PRAME_HUMAN)
LMSHIHASSM

SEQ ID NO: 156864 - protein, 9 aa, Artificial Sequence
  Description of Artificial Sequence: Synthetic peptide
  Seed: QSRYISMSV (PRAME_HUMAN)
QNRYISMSK

SEQ ID NO: 156865 - protein, 11 aa, Artificial Sequence
  Description of Artificial Sequence: Synthetic peptide
  Seed: QALYVDSLFFL (PRAME_HUMAN)
QMLYVDSLFFL

SEQ ID NO: 156866 - protein, 9 aa, Artificial Sequence
  Description of Artificial Sequence: Synthetic peptide
  Seed: SQLTTLSFY (PRAME_HUMAN)
SSLTTLSFR

SEQ ID NO: 156867 - protein, 9 aa, Artificial Sequence
  Description of Artificial Sequence: Synthetic peptide
  Seed: NVLRLCCKK (PRAME_HUMAN)
NMLRLCCKR

SEQ ID NO: 156868 - protein, 9 aa, Artificial Sequence
  Description of Artificial Sequence: Synthetic peptide
  Seed: RGRLDQLLR (PRAME_HUMAN)
RYRLDQLLA

SEQ ID NO: 156869 - protein, 9 aa, Artificial Sequence
  Description of Artificial Sequence: Synthetic peptide
  Seed: RLDQLLRHV (PRAME_HUMAN)
RQDQLLRHW

SEQ ID NO: 156870 - protein, 9 aa, Artificial Sequence
  Description of Artificial Sequence: Synthetic peptide
  Seed: WLSANPCPH (PRAME_HUMAN)
WISANPCPF

SEQ ID NO: 156871 - protein, 10 aa, Artificial Sequence
  Description of Artificial Sequence: Synthetic peptide
  Seed: VSPEPLQALL (PRAME_HUMAN)
VTPEPLQALW

SEQ ID NO: 156872 - protein, 9 aa, Artificial Sequence
  Description of Artificial Sequence: Synthetic peptide
  Seed: HVMNPLETL (PRAME_HUMAN)
HTMNPLETI

SEQ ID NO: 156873 - protein, 10 aa, Artificial Sequence
  Description of Artificial Sequence: Synthetic peptide
  Seed: LPRELFPPLF (PRAME_HUMAN)
LPRELFPPLI

SEQ ID NO: 156874 - protein, 9 aa, Artificial Sequence
  Description of Artificial Sequence: Synthetic peptide
  Seed: NLTHVLYPV (PRAME_HUMAN)
NGTHVLYPV

SEQ ID NO: 156875 - protein, 9 aa, Artificial Sequence
  Description of Artificial Sequence: Synthetic peptide
  Seed: FYDPEPILC (PRAME_HUMAN)
FVDPEPILL

SEQ ID NO: 156876 - protein, 9 aa, Artificial Sequence
  Description of Artificial Sequence: Synthetic peptide
  Seed: EQPFIPVEV (PRAME_HUMAN)
EHPFIPVEV

SEQ ID NO: 156877 - protein, 9 aa, Artificial Sequence
  Description of Artificial Sequence: Synthetic peptide
  Seed: TSPRRLVEL (PRAME_HUMAN)
TYPRRLVEL

SEQ ID NO: 156878 - protein, 10 aa, Artificial Sequence
  Description of Artificial Sequence: Synthetic peptide
  Seed: LPTLAKFSPY (PRAME_HUMAN)
LYTLAKFSPW

SEQ ID NO: 156879 - protein, 8 aa, Artificial Sequence
  Description of Artificial Sequence: Synthetic peptide
  Seed: LLALLPSL (PRAME_HUMAN)
LQALLPSL

SEQ ID NO: 156880 - protein, 8 aa, Artificial Sequence
  Description of Artificial Sequence: Synthetic peptide
  Seed: YSFPEPEA (PRAME_HUMAN)
YAFPEPEL

SEQ ID NO: 156881 - protein, 10 aa, Artificial Sequence
  Description of Artificial Sequence: Synthetic peptide
  Seed: IGLSNLTHVL (PRAME_HUMAN)
ILLSNLTHVM

SEQ ID NO: 156882 - protein, 9 aa, Artificial Sequence
  Description of Artificial Sequence: Synthetic peptide
  Seed: LSLQCLQAL (PRAME_HUMAN)
LSLQCLQAM

SEQ ID NO: 156883 - protein, 10 aa, Artificial Sequence
  Description of Artificial Sequence: Synthetic peptide
  Seed: VSPEPLQALL (PRAME_HUMAN)
VLPEPLQALL

SEQ ID NO: 156884 - protein, 10 aa, Artificial Sequence
  Description of Artificial Sequence: Synthetic peptide
  Seed: RLVELAGQSL (PRAME_HUMAN)
RMVELAGQSW

SEQ ID NO: 156885 - protein, 11 aa, Artificial Sequence
  Description of Artificial Sequence: Synthetic peptide
  Seed: GITDDQLLALL (PRAME_HUMAN)
GMTDDQLLALV

SEQ ID NO: 156886 - protein, 10 aa, Artificial Sequence
  Description of Artificial Sequence: Synthetic peptide
  Seed: ILKMVQLDSI (PRAME_HUMAN)
IMKMVQLDSI

SEQ ID NO: 156887 - protein, 10 aa, Artificial Sequence
  Description of Artificial Sequence: Synthetic peptide
  Seed: QSLLQHLIGL (PRAME_HUMAN)
QGLLQHLIGV

SEQ ID NO: 156888 - protein, 9 aa, Artificial Sequence
  Description of Artificial Sequence: Synthetic peptide
  Seed: SHIHASSYI (PRAME_HUMAN)
SMIHASSYM

SEQ ID NO: 156889 - protein, 10 aa, Artificial Sequence
  Description of Artificial Sequence: Synthetic peptide
  Seed: RELFPPLFMA (PRAME_HUMAN)
RMLFPPLFMV

SEQ ID NO: 156890 - protein, 9 aa, Artificial Sequence
  Description of Artificial Sequence: Synthetic peptide
  Seed: MINLRRLLL (PRAME_HUMAN)
MQNLRRLLY

SEQ ID NO: 156891 - protein, 9 aa, Artificial Sequence
  Description of Artificial Sequence: Synthetic peptide
  Seed: MINLRRLLL (PRAME_HUMAN)
MMNLRRLLC

SEQ ID NO: 156892 - protein, 9 aa, Artificial Sequence
  Description of Artificial Sequence: Synthetic peptide
  Seed: VQLDSIEDL (PRAME_HUMAN)
VMLDSIEDL

SEQ ID NO: 156893 - protein, 9 aa, Artificial Sequence
  Description of Artificial Sequence: Synthetic peptide
  Seed: EDLEVTCTW (PRAME_HUMAN)
ETLEVTCTF

SEQ ID NO: 156894 - protein, 9 aa, Artificial Sequence
  Description of Artificial Sequence: Synthetic peptide
  Seed: RLRELLCEL (PRAME_HUMAN)
RVRELLCEL

SEQ ID NO: 156895 - protein, 10 aa, Artificial Sequence
  Description of Artificial Sequence: Synthetic peptide
  Seed: SLSHCSQLTT (PRAME_HUMAN)
SMSHCSQLTI

SEQ ID NO: 156896 - protein, 9 aa, Artificial Sequence
  Description of Artificial Sequence: Synthetic peptide
  Seed: KAMVQAWPF (PRAME_HUMAN)
KWMVQAWPY

SEQ ID NO: 156897 - protein, 10 aa, Artificial Sequence
  Description of Artificial Sequence: Synthetic peptide
  Seed: ALAIAALELL (PRAME_HUMAN)
AMAIAALELM

SEQ ID NO: 156898 - protein, 9 aa, Artificial Sequence
  Description of Artificial Sequence: Synthetic peptide
  Seed: SQLSVLSLS (PRAME_HUMAN)
SLLSVLSLI

SEQ ID NO: 156899 - protein, 10 aa, Artificial Sequence
  Description of Artificial Sequence: Synthetic peptide
  Seed: VMNPLETLSI (PRAME_HUMAN)
VQNPLETLSF

SEQ ID NO: 156900 - protein, 9 aa, Artificial Sequence
  Description of Artificial Sequence: Synthetic peptide
  Seed: TFKAVLDGL (PRAME_HUMAN)
TFKAVLDGF

SEQ ID NO: 156901 - protein, 11 aa, Artificial Sequence
  Description of Artificial Sequence: Synthetic peptide
  Seed: QALYVDSLFFL (PRAME_HUMAN)
QLLYVDSLFFV

SEQ ID NO: 156902 - protein, 10 aa, Artificial Sequence
  Description of Artificial Sequence: Synthetic peptide
  Seed: LERLAYLHAR (PRAME_HUMAN)
LKRLAYLHAK

SEQ ID NO: 156903 - protein, 9 aa, Artificial Sequence
  Description of Artificial Sequence: Synthetic peptide
  Seed: RLWGSIQSR (PRAME_HUMAN)
RMWGSIQSY

SEQ ID NO: 156904 - protein, 9 aa, Artificial Sequence
  Description of Artificial Sequence: Synthetic peptide
  Seed: HVMNPLETL (PRAME_HUMAN)
HKMNPLETF

SEQ ID NO: 156905 - protein, 9 aa, Artificial Sequence
  Description of Artificial Sequence: Synthetic peptide
  Seed: VLSLSGVML (PRAME_HUMAN)
VASLSGVML

SEQ ID NO: 156906 - protein, 10 aa, Artificial Sequence
  Description of Artificial Sequence: Synthetic peptide
  Seed: RHVMNPLETL (PRAME_HUMAN)
RTVMNPLETL

SEQ ID NO: 156907 - protein, 9 aa, Artificial Sequence
  Description of Artificial Sequence: Synthetic peptide
  Seed: SRYISMSVW (PRAME_HUMAN)
SFYISMSVF

SEQ ID NO: 156908 - protein, 10 aa, Artificial Sequence
  Description of Artificial Sequence: Synthetic peptide
  Seed: LSLQCLQALY (PRAME_HUMAN)
LTLQCLQALY

SEQ ID NO: 156909 - protein, 9 aa, Artificial Sequence
  Description of Artificial Sequence: Synthetic peptide
  Seed: QLLALLPSL (PRAME_HUMAN)
QVLALLPSI

SEQ ID NO: 156910 - protein, 9 aa, Artificial Sequence
  Description of Artificial Sequence: Synthetic peptide
  Seed: EDLEVTCTW (PRAME_HUMAN)
EPLEVTCTF

SEQ ID NO: 156911 - protein, 10 aa, Artificial Sequence
  Description of Artificial Sequence: Synthetic peptide
  Seed: AFDGRHSQTL (PRAME_HUMAN)
AIDGRHSQTF

SEQ ID NO: 156912 - protein, 9 aa, Artificial Sequence
  Description of Artificial Sequence: Synthetic peptide
  Seed: TLAKFSPYL (PRAME_HUMAN)
TLAKFSPYW

SEQ ID NO: 156913 - protein, 10 aa, Artificial Sequence
  Description of Artificial Sequence: Synthetic peptide
  Seed: ISMSVWTSPR (PRAME_HUMAN)
IVMSVWTSPY

SEQ ID NO: 156914 - protein, 9 aa, Artificial Sequence
  Description of Artificial Sequence: Synthetic peptide
  Seed: VLDGLDVLL (PRAME_HUMAN)
VIDGLDVLM

SEQ ID NO: 156915 - protein, 9 aa, Artificial Sequence
  Description of Artificial Sequence: Synthetic peptide
  Seed: YGNSISISA (PRAME_HUMAN)
YVNSISISH

SEQ ID NO: 156916 - protein, 9 aa, Artificial Sequence
  Description of Artificial Sequence: Synthetic peptide
  Seed: LSLQCLQAL (PRAME_HUMAN)
LLLQCLQAA

SEQ ID NO: 156917 - protein, 9 aa, Artificial Sequence
  Description of Artificial Sequence: Synthetic peptide
  Seed: GLSNLTHVL (PRAME_HUMAN)
GVSNLTHVI

SEQ ID NO: 156918 - protein, 10 aa, Artificial Sequence
  Description of Artificial Sequence: Synthetic peptide
  Seed: LSVLSLSGVM (PRAME_HUMAN)
LDVLSLSGVY

SEQ ID NO: 156919 - protein, 10 aa, Artificial Sequence
  Description of Artificial Sequence: Synthetic peptide
  Seed: LSQSPSVSQL (PRAME_HUMAN)
LWQSPSVSQF

SEQ ID NO: 156920 - protein, 10 aa, Artificial Sequence
  Description of Artificial Sequence: Synthetic peptide
  Seed: HCSQLTTLSF (PRAME_HUMAN)
HTSQLTTLSY

SEQ ID NO: 156921 - protein, 10 aa, Artificial Sequence
  Description of Artificial Sequence: Synthetic peptide
  Seed: TSQFLSLQCL (PRAME_HUMAN)
TMQFLSLQCY

SEQ ID NO: 156922 - protein, 9 aa, Artificial Sequence
  Description of Artificial Sequence: Synthetic peptide
  Seed: VLYPVPLES (PRAME_HUMAN)
VIYPVPLEI

SEQ ID NO: 156923 - protein, 10 aa, Artificial Sequence
  Description of Artificial Sequence: Synthetic peptide
  Seed: FFLRGRLDQL (PRAME_HUMAN)
FGLRGRLDQV

SEQ ID NO: 156924 - protein, 10 aa, Artificial Sequence
  Description of Artificial Sequence: Synthetic peptide
  Seed: RLVELAGQSL (PRAME_HUMAN)
RIVELAGQSL

SEQ ID NO: 156925 - protein, 9 aa, Artificial Sequence
  Description of Artificial Sequence: Synthetic peptide
  Seed: CSQLTTLSF (PRAME_HUMAN)
CAQLTTLSM

SEQ ID NO: 156926 - protein, 10 aa, Artificial Sequence
  Description of Artificial Sequence: Synthetic peptide
  Seed: MVQAWPFTCL (PRAME_HUMAN)
MVQAWPFTCV

SEQ ID NO: 156927 - protein, 10 aa, Artificial Sequence
  Description of Artificial Sequence: Synthetic peptide
  Seed: MERRRLWGSI (PRAME_HUMAN)
MIRRRLWGSL

SEQ ID NO: 156928 - protein, 10 aa, Artificial Sequence
  Description of Artificial Sequence: Synthetic peptide
  Seed: KIFAMPMQDI (PRAME_HUMAN)
KVFAMPMQDW

SEQ ID NO: 156929 - protein, 10 aa, Artificial Sequence
  Description of Artificial Sequence: Synthetic peptide
  Seed: TVWSGNRASL (PRAME_HUMAN)
TTWSGNRASV

SEQ ID NO: 156930 - protein, 9 aa, Artificial Sequence
  Description of Artificial Sequence: Synthetic peptide
  Seed: SHQDFWTVW (PRAME_HUMAN)
SHQDFWTVF

SEQ ID NO: 156931 - protein, 9 aa, Artificial Sequence
  Description of Artificial Sequence: Synthetic peptide
  Seed: RWKLQVLDL (PRAME_HUMAN)
RVKLQVLDK

SEQ ID NO: 156932 - protein, 9 aa, Artificial Sequence
  Description of Artificial Sequence: Synthetic peptide
  Seed: YPVPLESYE (PRAME_HUMAN)
YIVPLESYF

SEQ ID NO: 156933 - protein, 9 aa, Artificial Sequence
  Description of Artificial Sequence: Synthetic peptide
  Seed: WLSANPCPH (PRAME_HUMAN)
WMSANPCPY

SEQ ID NO: 156934 - protein, 10 aa, Artificial Sequence
  Description of Artificial Sequence: Synthetic peptide
  Seed: RLSEGDVMHL (PRAME_HUMAN)
RGSEGDVMHW

SEQ ID NO: 156935 - protein, 11 aa, Artificial Sequence
  Description of Artificial Sequence: Synthetic peptide
  Seed: IAQFTSQFLSL (PRAME_HUMAN)
IQQFTSQFLSF

SEQ ID NO: 156936 - protein, 10 aa, Artificial Sequence
  Description of Artificial Sequence: Synthetic peptide
  Seed: SPSVSQLSVL (PRAME_HUMAN)
SISVSQLSVW

SEQ ID NO: 156937 - protein, 10 aa, Artificial Sequence
  Description of Artificial Sequence: Synthetic peptide
  Seed: VLYPVPLESY (PRAME_HUMAN)
VYYPVPLESF

SEQ ID NO: 156938 - protein, 10 aa, Artificial Sequence
  Description of Artificial Sequence: Synthetic peptide
  Seed: LYVDSLFFLR (PRAME_HUMAN)
LMVDSLFFLK

SEQ ID NO: 156939 - protein, 11 aa, Artificial Sequence
  Description of Artificial Sequence: Synthetic peptide
  Seed: GITDDQLLALL (PRAME_HUMAN)
GMTDDQLLALL

SEQ ID NO: 156940 - protein, 9 aa, Artificial Sequence
  Description of Artificial Sequence: Synthetic peptide
  Seed: ALLERASAT (PRAME_HUMAN)
AMLERASAI

SEQ ID NO: 156941 - protein, 10 aa, Artificial Sequence
  Description of Artificial Sequence: Synthetic peptide
  Seed: QAWPFTCLPL (PRAME_HUMAN)
QSWPFTCLPW

SEQ ID NO: 156942 - protein, 9 aa, Artificial Sequence
  Description of Artificial Sequence: Synthetic peptide
  Seed: LSHIHASSY (PRAME_HUMAN)
LPHIHASSY

SEQ ID NO: 156943 - protein, 9 aa, Artificial Sequence
  Description of Artificial Sequence: Synthetic peptide
  Seed: RLRELLCEL (PRAME_HUMAN)
RSRELLCES

SEQ ID NO: 156944 - protein, 9 aa, Artificial Sequence
  Description of Artificial Sequence: Synthetic peptide
  Seed: SIQSRYISM (PRAME_HUMAN)
SAQSRYISV

SEQ ID NO: 156945 - protein, 9 aa, Artificial Sequence
  Description of Artificial Sequence: Synthetic peptide
  Seed: CSQLTTLSF (PRAME_HUMAN)
CAQLTTLSY

SEQ ID NO: 156946 - protein, 9 aa, Artificial Sequence
  Description of Artificial Sequence: Synthetic peptide
  Seed: WLSANPCPH (PRAME_HUMAN)
WTSANPCPF

SEQ ID NO: 156947 - protein, 10 aa, Artificial Sequence
  Description of Artificial Sequence: Synthetic peptide
  Seed: YIAQFTSQFL (PRAME_HUMAN)
YEAQFTSQFF

SEQ ID NO: 156948 - protein, 9 aa, Artificial Sequence
  Description of Artificial Sequence: Synthetic peptide
  Seed: KMILKMVQL (PRAME_HUMAN)
KMILKMVQM

SEQ ID NO: 156949 - protein, 9 aa, Artificial Sequence
  Description of Artificial Sequence: Synthetic peptide
  Seed: ACDELFSYL (PRAME_HUMAN)
APDELFSYL

SEQ ID NO: 156950 - protein, 9 aa, Artificial Sequence
  Description of Artificial Sequence: Synthetic peptide
  Seed: SQFLSLQCL (PRAME_HUMAN)
SIFLSLQCY

SEQ ID NO: 156951 - protein, 10 aa, Artificial Sequence
  Description of Artificial Sequence: Synthetic peptide
  Seed: LQALYVDSLF (PRAME_HUMAN)
LLALYVDSLY

SEQ ID NO: 156952 - protein, 10 aa, Artificial Sequence
  Description of Artificial Sequence: Synthetic peptide
  Seed: RYISMSVWTS (PRAME_HUMAN)
RFISMSVWTF

SEQ ID NO: 156953 - protein, 9 aa, Artificial Sequence
  Description of Artificial Sequence: Synthetic peptide
  Seed: GACDELFSY (PRAME_HUMAN)
GICDELFSK

SEQ ID NO: 156954 - protein, 9 aa, Artificial Sequence
  Description of Artificial Sequence: Synthetic peptide
  Seed: RLWGSIQSR (PRAME_HUMAN)
RVWGSIQSV

SEQ ID NO: 156955 - protein, 9 aa, Artificial Sequence
  Description of Artificial Sequence: Synthetic peptide
  Seed: TLKAMVQAW (PRAME_HUMAN)
TAKAMVQAW

SEQ ID NO: 156956 - protein, 9 aa, Artificial Sequence
  Description of Artificial Sequence: Synthetic peptide
  Seed: KLQVLDLRK (PRAME_HUMAN)
KVQVLDLRR

SEQ ID NO: 156957 - protein, 10 aa, Artificial Sequence
  Description of Artificial Sequence: Synthetic peptide
  Seed: GACDELFSYL (PRAME_HUMAN)
GSCDELFSYV

SEQ ID NO: 156958 - protein, 10 aa, Artificial Sequence
  Description of Artificial Sequence: Synthetic peptide
  Seed: AAFDGRHSQT (PRAME_HUMAN)
AAFDGRHSQL

SEQ ID NO: 156959 - protein, 9 aa, Artificial Sequence
  Description of Artificial Sequence: Synthetic peptide
  Seed: ITDDQLLAL (PRAME_HUMAN)
IIDDQLLAY

SEQ ID NO: 156960 - protein, 10 aa, Artificial Sequence
  Description of Artificial Sequence: Synthetic peptide
  Seed: LSLQCLQALY (PRAME_HUMAN)
LILQCLQALW

SEQ ID NO: 156961 - protein, 9 aa, Artificial Sequence
  Description of Artificial Sequence: Synthetic peptide
  Seed: LAQEVRPRR (PRAME_HUMAN)
LVQEVRPRR

SEQ ID NO: 156962 - protein, 9 aa, Artificial Sequence
  Description of Artificial Sequence: Synthetic peptide
  Seed: SMSVWTSPR (PRAME_HUMAN)
SQSVWTSPR

SEQ ID NO: 156963 - protein, 10 aa, Artificial Sequence
  Description of Artificial Sequence: Synthetic peptide
  Seed: ALYVDSLFFL (PRAME_HUMAN)
ARYVDSLFFL

SEQ ID NO: 156964 - protein, 11 aa, Artificial Sequence
  Description of Artificial Sequence: Synthetic peptide
  Seed: SYEDIHGTLHL (PRAME_HUMAN)
SWEDIHGTLHF

SEQ ID NO: 156965 - protein, 10 aa, Artificial Sequence
  Description of Artificial Sequence: Synthetic peptide
  Seed: RRLWGSIQSR (PRAME_HUMAN)
RALWGSIQSR

SEQ ID NO: 156966 - protein, 10 aa, Artificial Sequence
  Description of Artificial Sequence: Synthetic peptide
  Seed: AQFTSQFLSL (PRAME_HUMAN)
AEFTSQFLSA

SEQ ID NO: 156967 - protein, 9 aa, Artificial Sequence
  Description of Artificial Sequence: Synthetic peptide
  Seed: ITDDQLLAL (PRAME_HUMAN)
IIDDQLLAC

SEQ ID NO: 156968 - protein, 9 aa, Artificial Sequence
  Description of Artificial Sequence: Synthetic peptide
  Seed: LYVDSLFFL (PRAME_HUMAN)
LIVDSLFFV

SEQ ID NO: 156969 - protein, 10 aa, Artificial Sequence
  Description of Artificial Sequence: Synthetic peptide
  Seed: TWKLPTLAKF (PRAME_HUMAN)
TYKLPTLAKI

SEQ ID NO: 156970 - protein, 10 aa, Artificial Sequence
  Description of Artificial Sequence: Synthetic peptide
  Seed: FAMPMQDIKM (PRAME_HUMAN)
FAMPMQDIKF

SEQ ID NO: 156971 - protein, 9 aa, Artificial Sequence
  Description of Artificial Sequence: Synthetic peptide
  Seed: TLAKFSPYL (PRAME_HUMAN)
TTAKFSPYL

SEQ ID NO: 156972 - protein, 11 aa, Artificial Sequence
  Description of Artificial Sequence: Synthetic peptide
  Seed: LSLSGVMLTDV (PRAME_HUMAN)
LLLSGVMLTDL

SEQ ID NO: 156973 - protein, 10 aa, Artificial Sequence
  Description of Artificial Sequence: Synthetic peptide
  Seed: YIAQFTSQFL (PRAME_HUMAN)
YQAQFTSQFV

SEQ ID NO: 156974 - protein, 10 aa, Artificial Sequence
  Description of Artificial Sequence: Synthetic peptide
  Seed: LLSHIHASSY (PRAME_HUMAN)
LSSHIHASSW

SEQ ID NO: 156975 - protein, 11 aa, Artificial Sequence
  Description of Artificial Sequence: Synthetic peptide
  Seed: ALYVDSLFFLR (PRAME_HUMAN)
AMYVDSLFFLA

SEQ ID NO: 156976 - protein, 10 aa, Artificial Sequence
  Description of Artificial Sequence: Synthetic peptide
  Seed: KFSPYLGQMI (PRAME_HUMAN)
KYSPYLGQMM

SEQ ID NO: 156977 - protein, 9 aa, Artificial Sequence
  Description of Artificial Sequence: Synthetic peptide
  Seed: RLDQLLRHV (PRAME_HUMAN)
RVDQLLRHV

SEQ ID NO: 156978 - protein, 9 aa, Artificial Sequence
  Description of Artificial Sequence: Synthetic peptide
  Seed: LSHIHASSY (PRAME_HUMAN)
LAHIHASSY

SEQ ID NO: 156979 - protein, 10 aa, Artificial Sequence
  Description of Artificial Sequence: Synthetic peptide
  Seed: RELFPPLFMA (PRAME_HUMAN)
RDLFPPLFMV

SEQ ID NO: 156980 - protein, 9 aa, Artificial Sequence
  Description of Artificial Sequence: Synthetic peptide
  Seed: LYPVPLESY (PRAME_HUMAN)
LMPVPLESY

SEQ ID NO: 156981 - protein, 9 aa, Artificial Sequence
  Description of Artificial Sequence: Synthetic peptide
  Seed: LSANPCPHC (PRAME_HUMAN)
LTANPCPHF

SEQ ID NO: 156982 - protein, 9 aa, Artificial Sequence
  Description of Artificial Sequence: Synthetic peptide
  Seed: SRYISMSVW (PRAME_HUMAN)
SVYISMSVY

SEQ ID NO: 156983 - protein, 9 aa, Artificial Sequence
  Description of Artificial Sequence: Synthetic peptide
  Seed: TFYDPEPIL (PRAME_HUMAN)
TVYDPEPIM

SEQ ID NO: 156984 - protein, 9 aa, Artificial Sequence
  Description of Artificial Sequence: Synthetic peptide
  Seed: SLLQHLIGL (PRAME_HUMAN)
SLLQHLIGA

SEQ ID NO: 156985 - protein, 10 aa, Artificial Sequence
  Description of Artificial Sequence: Synthetic peptide
  Seed: YIAQFTSQFL (PRAME_HUMAN)
YTAQFTSQFF

SEQ ID NO: 156986 - protein, 9 aa, Artificial Sequence
  Description of Artificial Sequence: Synthetic peptide
  Seed: TLAKFSPYL (PRAME_HUMAN)
TWAKFSPYF

SEQ ID NO: 156987 - protein, 9 aa, Artificial Sequence
  Description of Artificial Sequence: Synthetic peptide
  Seed: SHIHASSYI (PRAME_HUMAN)
SGIHASSYF

SEQ ID NO: 156988 - protein, 10 aa, Artificial Sequence
  Description of Artificial Sequence: Synthetic peptide
  Seed: RLSEGDVMHL (PRAME_HUMAN)
RVSEGDVMHV

SEQ ID NO: 156989 - protein, 9 aa, Artificial Sequence
  Description of Artificial Sequence: Synthetic peptide
  Seed: LHLETFKAV (PRAME_HUMAN)
LRLETFKAL

SEQ ID NO: 156990 - protein, 9 aa, Artificial Sequence
  Description of Artificial Sequence: Synthetic peptide
  Seed: ISPEKEEQY (PRAME_HUMAN)
ITPEKEEQF

SEQ ID NO: 156991 - protein, 9 aa, Artificial Sequence
  Description of Artificial Sequence: Synthetic peptide
  Seed: LFPPLFMAA (PRAME_HUMAN)
LYPPLFMAY

SEQ ID NO: 156992 - protein, 9 aa, Artificial Sequence
  Description of Artificial Sequence: Synthetic peptide
  Seed: FPPLFMAAF (PRAME_HUMAN)
FYPLFMAAL

SEQ ID NO: 156993 - protein, 10 aa, Artificial Sequence
  Description of Artificial Sequence: Synthetic peptide
  Seed: LLSHIHASSY (PRAME_HUMAN)
LVSHIHASSF

SEQ ID NO: 156994 - protein, 9 aa, Artificial Sequence
  Description of Artificial Sequence: Synthetic peptide
  Seed: YSFPEPEAA (PRAME_HUMAN)
YTFPEPEAV

SEQ ID NO: 156995 - protein, 9 aa, Artificial Sequence
  Description of Artificial Sequence: Synthetic peptide
  Seed: RHSQTLKAM (PRAME_HUMAN)
RSSQTLKAF

SEQ ID NO: 156996 - protein, 10 aa, Artificial Sequence
  Description of Artificial Sequence: Synthetic peptide
  Seed: ARLRELLCEL (PRAME_HUMAN)
AFLRELLCEI

SEQ ID NO: 156997 - protein, 10 aa, Artificial Sequence
  Description of Artificial Sequence: Synthetic peptide
  Seed: GLSNLTHVLY (PRAME_HUMAN)
GTSNLTHVLY

SEQ ID NO: 156998 - protein, 9 aa, Artificial Sequence
  Description of Artificial Sequence: Synthetic peptide
  Seed: IAQFTSQFL (PRAME_HUMAN)
ITQFTSQFY

SEQ ID NO: 156999 - protein, 11 aa, Artificial Sequence
  Description of Artificial Sequence: Synthetic peptide
  Seed: KIFAMPMQDIK (PRAME_HUMAN)
KTFAMPMQDIK

SEQ ID NO: 157000 - protein, 9 aa, Artificial Sequence
  Description of Artificial Sequence: Synthetic peptide
  Seed: LQDLVFDEC (PRAME_HUMAN)
LQDLVFDEL

SEQ ID NO: 157001 - protein, 10 aa, Artificial Sequence
  Description of Artificial Sequence: Synthetic peptide
  Seed: VLYPVPLESY (PRAME_HUMAN)
VTYPVPLESL

SEQ ID NO: 157002 - protein, 9 aa, Artificial Sequence
  Description of Artificial Sequence: Synthetic peptide
  Seed: SLLQHLIGL (PRAME_HUMAN)
SMLQHLIGR

SEQ ID NO: 157003 - protein, 10 aa, Artificial Sequence
  Description of Artificial Sequence: Synthetic peptide
  Seed: ISMSVWTSPR (PRAME_HUMAN)
IHMSVWTSPK

SEQ ID NO: 157004 - protein, 9 aa, Artificial Sequence
  Description of Artificial Sequence: Synthetic peptide
  Seed: VLDGLDVLL (PRAME_HUMAN)
VYDGLDVLI

SEQ ID NO: 157005 - protein, 9 aa, Artificial Sequence
  Description of Artificial Sequence: Synthetic peptide
  Seed: GQHLHLETF (PRAME_HUMAN)
GQHLHLETV

SEQ ID NO: 157006 - protein, 9 aa, Artificial Sequence
  Description of Artificial Sequence: Synthetic peptide
  Seed: MINLRRLLL (PRAME_HUMAN)
MQNLRRLLI

SEQ ID NO: 157007 - protein, 10 aa, Artificial Sequence
  Description of Artificial Sequence: Synthetic peptide
  Seed: LSTEAEQPFI (PRAME_HUMAN)
LATEAEQPFW

SEQ ID NO: 157008 - protein, 10 aa, Artificial Sequence
  Description of Artificial Sequence: Synthetic peptide
  Seed: TLAKFSPYLG (PRAME_HUMAN)
TLAKFSPYLA

SEQ ID NO: 157009 - protein, 10 aa, Artificial Sequence
  Description of Artificial Sequence: Synthetic peptide
  Seed: TFYDPEPILC (PRAME_HUMAN)
TRYDPEPILF

SEQ ID NO: 157010 - protein, 9 aa, Artificial Sequence
  Description of Artificial Sequence: Synthetic peptide
  Seed: IAQFTSQFL (PRAME_HUMAN)
ITQFTSQFL

SEQ ID NO: 157011 - protein, 10 aa, Artificial Sequence
  Description of Artificial Sequence: Synthetic peptide
  Seed: ALLERASATL (PRAME_HUMAN)
ALLERASATY

SEQ ID NO: 157012 - protein, 9 aa, Artificial Sequence
  Description of Artificial Sequence: Synthetic peptide
  Seed: AMVQAWPFT (PRAME_HUMAN)
AIVQAWPFV

SEQ ID NO: 157013 - protein, 9 aa, Artificial Sequence
  Description of Artificial Sequence: Synthetic peptide
  Seed: VWSGNRASL (PRAME_HUMAN)
VWSGNRASW

SEQ ID NO: 157014 - protein, 9 aa, Artificial Sequence
  Description of Artificial Sequence: Synthetic peptide
  Seed: RLRELLCEL (PRAME_HUMAN)
RLRELLCER

SEQ ID NO: 157015 - protein, 9 aa, Artificial Sequence
  Description of Artificial Sequence: Synthetic peptide
  Seed: SYEDIHGTL (PRAME_HUMAN)
SFEDIHGTM

SEQ ID NO: 157016 - protein, 9 aa, Artificial Sequence
  Description of Artificial Sequence: Synthetic peptide
  Seed: THVLYPVPL (PRAME_HUMAN)
TSVLYPVPF

SEQ ID NO: 157017 - protein, 10 aa, Artificial Sequence
  Description of Artificial Sequence: Synthetic peptide
  Seed: RHVMNPLETL (PRAME_HUMAN)
RPVMNPLETV

SEQ ID NO: 157018 - protein, 9 aa, Artificial Sequence
  Description of Artificial Sequence: Synthetic peptide
  Seed: LTDVSPEPL (PRAME_HUMAN)
LVDVSPEPF

SEQ ID NO: 157019 - protein, 9 aa, Artificial Sequence
  Description of Artificial Sequence: Synthetic peptide
  Seed: VFDECGITD (PRAME_HUMAN)
VGDECGITM

SEQ ID NO: 157020 - protein, 9 aa, Artificial Sequence
  Description of Artificial Sequence: Synthetic peptide
  Seed: ESYEDIHGT (PRAME_HUMAN)
EVYEDIHGV

SEQ ID NO: 157021 - protein, 10 aa, Artificial Sequence
  Description of Artificial Sequence: Synthetic peptide
  Seed: ISMSVWTSPR (PRAME_HUMAN)
IPMSVWTSPR

SEQ ID NO: 157022 - protein, 10 aa, Artificial Sequence
  Description of Artificial Sequence: Synthetic peptide
  Seed: MLTDVSPEPL (PRAME_HUMAN)
MATDVSPEPV

SEQ ID NO: 157023 - protein, 9 aa, Artificial Sequence
  Description of Artificial Sequence: Synthetic peptide
  Seed: FPPLFMAAF (PRAME_HUMAN)
FPPLFMAAA

SEQ ID NO: 157024 - protein, 9 aa, Artificial Sequence
  Description of Artificial Sequence: Synthetic peptide
  Seed: VSPEPLQAL (PRAME_HUMAN)
VHPEPLQAF

SEQ ID NO: 157025 - protein, 10 aa, Artificial Sequence
  Description of Artificial Sequence: Synthetic peptide
  Seed: RTFYDPEPIL (PRAME_HUMAN)
RLFYDPEPIW

SEQ ID NO: 157026 - protein, 9 aa, Artificial Sequence
  Description of Artificial Sequence: Synthetic peptide
  Seed: LLLSHIHAS (PRAME_HUMAN)
LQLSHIHAI

SEQ ID NO: 157027 - protein, 11 aa, Artificial Sequence
  Description of Artificial Sequence: Synthetic peptide
  Seed: SLQCLQALYVD (PRAME_HUMAN)
SMQCLQALYVV

SEQ ID NO: 157028 - protein, 9 aa, Artificial Sequence
  Description of Artificial Sequence: Synthetic peptide
  Seed: TLAKFSPYL (PRAME_HUMAN)
TYAKFSPYY

SEQ ID NO: 157029 - protein, 10 aa, Artificial Sequence
  Description of Artificial Sequence: Synthetic peptide
  Seed: SLLKDEALAI (PRAME_HUMAN)
SKLKDEALAV

SEQ ID NO: 157030 - protein, 11 aa, Artificial Sequence
  Description of Artificial Sequence: Synthetic peptide
  Seed: SQSPSVSQLSV (PRAME_HUMAN)
SLSPSVSQLSF

SEQ ID NO: 157031 - protein, 9 aa, Artificial Sequence
  Description of Artificial Sequence: Synthetic peptide
  Seed: SFYGNSISI (PRAME_HUMAN)
SEYGNSISM

SEQ ID NO: 157032 - protein, 10 aa, Artificial Sequence
  Description of Artificial Sequence: Synthetic peptide
  Seed: YISPEKEEQY (PRAME_HUMAN)
YRSPEKEEQF

SEQ ID NO: 157033 - protein, 10 aa, Artificial Sequence
  Description of Artificial Sequence: Synthetic peptide
  Seed: SNLTHVLYPV (PRAME_HUMAN)
SWLTHVLYPI

SEQ ID NO: 157034 - protein, 9 aa, Artificial Sequence
  Description of Artificial Sequence: Synthetic peptide
  Seed: SYEDIHGTL (PRAME_HUMAN)
SVEDIHGTW

SEQ ID NO: 157035 - protein, 9 aa, Artificial Sequence
  Description of Artificial Sequence: Synthetic peptide
  Seed: KLKIFAMPM (PRAME_HUMAN)
KVKIFAMPI

SEQ ID NO: 157036 - protein, 11 aa, Artificial Sequence
  Description of Artificial Sequence: Synthetic peptide
  Seed: MKGQHLHLETF (PRAME_HUMAN)
MEGQHLHLETF

SEQ ID NO: 157037 - protein, 10 aa, Artificial Sequence
  Description of Artificial Sequence: Synthetic peptide
  Seed: YISPEKEEQY (PRAME_HUMAN)
YPSPEKEEQY

SEQ ID NO: 157038 - protein, 9 aa, Artificial Sequence
  Description of Artificial Sequence: Synthetic peptide
  Seed: ISISALQSL (PRAME_HUMAN)
IFISALQSF

SEQ ID NO: 157039 - protein, 10 aa, Artificial Sequence
  Description of Artificial Sequence: Synthetic peptide
  Seed: MPMQDIKMIL (PRAME_HUMAN)
MPMQDIKMIV

SEQ ID NO: 157040 - protein, 9 aa, Artificial Sequence
  Description of Artificial Sequence: Synthetic peptide
  Seed: QALYVDSLF (PRAME_HUMAN)
QTLYVDSLY

SEQ ID NO: 157041 - protein, 11 aa, Artificial Sequence
  Description of Artificial Sequence: Synthetic peptide
  Seed: RLVELAGQSLL (PRAME_HUMAN)
RMVELAGQSLL

SEQ ID NO: 157042 - protein, 9 aa, Artificial Sequence
  Description of Artificial Sequence: Synthetic peptide
  Seed: LSHIHASSY (PRAME_HUMAN)
LPHIHASSL

SEQ ID NO: 157043 - protein, 10 aa, Artificial Sequence
  Description of Artificial Sequence: Synthetic peptide
  Seed: IGLSNLTHVL (PRAME_HUMAN)
IFLSNLTHVV

SEQ ID NO: 157044 - protein, 9 aa, Artificial Sequence
  Description of Artificial Sequence: Synthetic peptide
  Seed: WSGNRASLY (PRAME_HUMAN)
WQGNRASLF

SEQ ID NO: 157045 - protein, 10 aa, Artificial Sequence
  Description of Artificial Sequence: Synthetic peptide
  Seed: MPMQDIKMIL (PRAME_HUMAN)
MNMQDIKMIV

SEQ ID NO: 157046 - protein, 10 aa, Artificial Sequence
  Description of Artificial Sequence: Synthetic peptide
  Seed: SVLSLSGVML (PRAME_HUMAN)
SVLSLSGVMV

SEQ ID NO: 157047 - protein, 9 aa, Artificial Sequence
  Description of Artificial Sequence: Synthetic peptide
  Seed: ALAIAALEL (PRAME_HUMAN)
ATAIAALEF

SEQ ID NO: 157048 - protein, 9 aa, Artificial Sequence
  Description of Artificial Sequence: Synthetic peptide
  Seed: LSTEAEQPF (PRAME_HUMAN)
LTTEAEQPY

SEQ ID NO: 157049 - protein, 9 aa, Artificial Sequence
  Description of Artificial Sequence: Synthetic peptide
  Seed: GQHLHLETF (PRAME_HUMAN)
GYHLHLETY

SEQ ID NO: 157050 - protein, 11 aa, Artificial Sequence
  Description of Artificial Sequence: Synthetic peptide
  Seed: QALYVDSLFFL (PRAME_HUMAN)
QRLYVDSLFFL

SEQ ID NO: 157051 - protein, 10 aa, Artificial Sequence
  Description of Artificial Sequence: Synthetic peptide
  Seed: LLPRELFPPL (PRAME_HUMAN)
LVPRELFPPM

SEQ ID NO: 157052 - protein, 11 aa, Artificial Sequence
  Description of Artificial Sequence: Synthetic peptide
  Seed: AVLDGLDVLLA (PRAME_HUMAN)
ALLDGLDVLLL

SEQ ID NO: 157053 - protein, 10 aa, Artificial Sequence
  Description of Artificial Sequence: Synthetic peptide
  Seed: LQHLIGLSNL (PRAME_HUMAN)
LQHLIGLSNF

SEQ ID NO: 157054 - protein, 9 aa, Artificial Sequence
  Description of Artificial Sequence: Synthetic peptide
  Seed: SVWTSPRRL (PRAME_HUMAN)
SAWTSPRRY

SEQ ID NO: 157055 - protein, 10 aa, Artificial Sequence
  Description of Artificial Sequence: Synthetic peptide
  Seed: LLPRELFPPL (PRAME_HUMAN)
LNPRELFPPM

SEQ ID NO: 157056 - protein, 11 aa, Artificial Sequence
  Description of Artificial Sequence: Synthetic peptide
  Seed: RLRELLCELGR (PRAME_HUMAN)
RYRELLCELGR

SEQ ID NO: 157057 - protein, 9 aa, Artificial Sequence
  Description of Artificial Sequence: Synthetic peptide
  Seed: FDGRHSQTL (PRAME_HUMAN)
FHGRHSQTI

SEQ ID NO: 157058 - protein, 9 aa, Artificial Sequence
  Description of Artificial Sequence: Synthetic peptide
  Seed: YGNSISISA (PRAME_HUMAN)
YTNSISISM

SEQ ID NO: 157059 - protein, 10 aa, Artificial Sequence
  Description of Artificial Sequence: Synthetic peptide
  Seed: RRLLLSHIHA (PRAME_HUMAN)
RRLLLSHIHR

SEQ ID NO: 157060 - protein, 10 aa, Artificial Sequence
  Description of Artificial Sequence: Synthetic peptide
  Seed: GACDELFSYL (PRAME_HUMAN)
GMCDELFSYV

SEQ ID NO: 157061 - protein, 9 aa, Artificial Sequence
  Description of Artificial Sequence: Synthetic peptide
  Seed: ALLPSLSHC (PRAME_HUMAN)
AMLPSLSHT

SEQ ID NO: 157062 - protein, 9 aa, Artificial Sequence
  Description of Artificial Sequence: Synthetic peptide
  Seed: RLRELLCEL (PRAME_HUMAN)
RYRELLCEM

SEQ ID NO: 157063 - protein, 10 aa, Artificial Sequence
  Description of Artificial Sequence: Synthetic peptide
  Seed: FTCLPLGVLM (PRAME_HUMAN)
FACLPLGVLL

SEQ ID NO: 157064 - protein, 9 aa, Artificial Sequence
  Description of Artificial Sequence: Synthetic peptide
  Seed: YEDIHGTLH (PRAME_HUMAN)
YDDIHGTLF

SEQ ID NO: 157065 - protein, 10 aa, Artificial Sequence
  Description of Artificial Sequence: Synthetic peptide
  Seed: RLAYLHARLR (PRAME_HUMAN)
RMAYLHARLY

SEQ ID NO: 157066 - protein, 9 aa, Artificial Sequence
  Description of Artificial Sequence: Synthetic peptide
  Seed: THVLYPVPL (PRAME_HUMAN)
TRVLYPVPM

SEQ ID NO: 157067 - protein, 9 aa, Artificial Sequence
  Description of Artificial Sequence: Synthetic peptide
  Seed: LTDVSPEPL (PRAME_HUMAN)
LQDVSPEPM

SEQ ID NO: 157068 - protein, 9 aa, Artificial Sequence
  Description of Artificial Sequence: Synthetic peptide
  Seed: KLKIFAMPM (PRAME_HUMAN)
KLKIFAMPK

SEQ ID NO: 157069 - protein, 9 aa, Artificial Sequence
  Description of Artificial Sequence: Synthetic peptide
  Seed: FYDPEPILC (PRAME_HUMAN)
FEDPEPILV

SEQ ID NO: 157070 - protein, 9 aa, Artificial Sequence
  Description of Artificial Sequence: Synthetic peptide
  Seed: ALLPSLSHC (PRAME_HUMAN)
AILPSLSHA

SEQ ID NO: 157071 - protein, 10 aa, Artificial Sequence
  Description of Artificial Sequence: Synthetic peptide
  Seed: AAFDGRHSQT (PRAME_HUMAN)
ATFDGRHSQY

SEQ ID NO: 157072 - protein, 9 aa, Artificial Sequence
  Description of Artificial Sequence: Synthetic peptide
  Seed: FAMPMQDIK (PRAME_HUMAN)
FSMPMQDIL

SEQ ID NO: 157073 - protein, 9 aa, Artificial Sequence
  Description of Artificial Sequence: Synthetic peptide
  Seed: FPPLFMAAF (PRAME_HUMAN)
FPPLFMAAL

SEQ ID NO: 157074 - protein, 9 aa, Artificial Sequence
  Description of Artificial Sequence: Synthetic peptide
  Seed: RLAYLHARL (PRAME_HUMAN)
RKAYLHARY

SEQ ID NO: 157075 - protein, 10 aa, Artificial Sequence
  Description of Artificial Sequence: Synthetic peptide
  Seed: AQFTSQFLSL (PRAME_HUMAN)
ALFTSQFLSA

SEQ ID NO: 157076 - protein, 9 aa, Artificial Sequence
  Description of Artificial Sequence: Synthetic peptide
  Seed: VSQLSVLSL (PRAME_HUMAN)
VKQLSVLSM

SEQ ID NO: 157077 - protein, 9 aa, Artificial Sequence
  Description of Artificial Sequence: Synthetic peptide
  Seed: SISALQSLL (PRAME_HUMAN)
SVSALQSLL

SEQ ID NO: 157078 - protein, 9 aa, Artificial Sequence
  Description of Artificial Sequence: Synthetic peptide
  Seed: VFDECGITD (PRAME_HUMAN)
VTDECGITF

SEQ ID NO: 157079 - protein, 9 aa, Artificial Sequence
  Description of Artificial Sequence: Synthetic peptide
  Seed: YGNSISISA (PRAME_HUMAN)
YSNSISISF

SEQ ID NO: 157080 - protein, 9 aa, Artificial Sequence
  Description of Artificial Sequence: Synthetic peptide
  Seed: ITDDQLLAL (PRAME_HUMAN)
IYDDQLLAF

SEQ ID NO: 157081 - protein, 9 aa, Artificial Sequence
  Description of Artificial Sequence: Synthetic peptide
  Seed: TLAKFSPYL (PRAME_HUMAN)
TLAKFSPYM

SEQ ID NO: 157082 - protein, 9 aa, Artificial Sequence
  Description of Artificial Sequence: Synthetic peptide
  Seed: LALLPSLSH (PRAME_HUMAN)
LQLLPSLSL

SEQ ID NO: 157083 - protein, 8 aa, Artificial Sequence
  Description of Artificial Sequence: Synthetic peptide
  Seed: SQLTTLSF (PRAME_HUMAN)
SMLTTLSF

SEQ ID NO: 157084 - protein, 10 aa, Artificial Sequence
  Description of Artificial Sequence: Synthetic peptide
  Seed: HCSQLTTLSF (PRAME_HUMAN)
HFSQLTTLSW

SEQ ID NO: 157085 - protein, 9 aa, Artificial Sequence
  Description of Artificial Sequence: Synthetic peptide
  Seed: KAMVQAWPF (PRAME_HUMAN)
KKMVQAWPL

SEQ ID NO: 157086 - protein, 10 aa, Artificial Sequence
  Description of Artificial Sequence: Synthetic peptide
  Seed: ELFSYLIEKV (PRAME_HUMAN)
EVFSYLIEKL

SEQ ID NO: 157087 - protein, 9 aa, Artificial Sequence
  Description of Artificial Sequence: Synthetic peptide
  Seed: FPPLFMAAF (PRAME_HUMAN)
FAPLFMAAL

SEQ ID NO: 157088 - protein, 10 aa, Artificial Sequence
  Description of Artificial Sequence: Synthetic peptide
  Seed: FSYLIEKVKR (PRAME_HUMAN)
FFYLIEKVKR

SEQ ID NO: 157089 - protein, 10 aa, Artificial Sequence
  Description of Artificial Sequence: Synthetic peptide
  Seed: GRLDQLLRHV (PRAME_HUMAN)
GMLDQLLRHI

SEQ ID NO: 157090 - protein, 10 aa, Artificial Sequence
  Description of Artificial Sequence: Synthetic peptide
  Seed: LPTLAKFSPY (PRAME_HUMAN)
LRTLAKFSPW

SEQ ID NO: 157091 - protein, 9 aa, Artificial Sequence
  Description of Artificial Sequence: Synthetic peptide
  Seed: TFYDPEPIL (PRAME_HUMAN)
TTYDPEPII

SEQ ID NO: 157092 - protein, 10 aa, Artificial Sequence
  Description of Artificial Sequence: Synthetic peptide
  Seed: LQALYVDSLF (PRAME_HUMAN)
LTALYVDSLW

SEQ ID NO: 157093 - protein, 10 aa, Artificial Sequence
  Description of Artificial Sequence: Synthetic peptide
  Seed: RRLWGSIQSR (PRAME_HUMAN)
RRLWGSIQSF

SEQ ID NO: 157094 - protein, 9 aa, Artificial Sequence
  Description of Artificial Sequence: Synthetic peptide
  Seed: SFPEPEAAQ (PRAME_HUMAN)
SYPEPEAAM

SEQ ID NO: 157095 - protein, 9 aa, Artificial Sequence
  Description of Artificial Sequence: Synthetic peptide
  Seed: DEALAIAAL (PRAME_HUMAN)
DEALAIAAY

SEQ ID NO: 157096 - protein, 9 aa, Artificial Sequence
  Description of Artificial Sequence: Synthetic peptide
  Seed: CSQLTTLSF (PRAME_HUMAN)
CKQLTTLSF

SEQ ID NO: 157097 - protein, 10 aa, Artificial Sequence
  Description of Artificial Sequence: Synthetic peptide
  Seed: LKAMVQAWPF (PRAME_HUMAN)
LIAMVQAWPY

SEQ ID NO: 157098 - protein, 9 aa, Artificial Sequence
  Description of Artificial Sequence: Synthetic peptide
  Seed: MSVWTSPRR (PRAME_HUMAN)
MNVWTSPRR

SEQ ID NO: 157099 - protein, 9 aa, Artificial Sequence
  Description of Artificial Sequence: Synthetic peptide
  Seed: LQHLIGLSN (PRAME_HUMAN)
LHHLIGLSY

SEQ ID NO: 157100 - protein, 9 aa, Artificial Sequence
  Description of Artificial Sequence: Synthetic peptide
  Seed: LSEGDVMHL (PRAME_HUMAN)
LQEGDVMHL

SEQ ID NO: 157101 - protein, 11 aa, Artificial Sequence
  Description of Artificial Sequence: Synthetic peptide
  Seed: FKAVLDGLDVL (PRAME_HUMAN)
FVAVLDGLDVV

SEQ ID NO: 157102 - protein, 10 aa, Artificial Sequence
  Description of Artificial Sequence: Synthetic peptide
  Seed: PTLAKFSPYL (PRAME_HUMAN)
PSLAKFSPYL

SEQ ID NO: 157103 - protein, 9 aa, Artificial Sequence
  Description of Artificial Sequence: Synthetic peptide
  Seed: AMVQAWPFT (PRAME_HUMAN)
ALVQAWPFV

SEQ ID NO: 157104 - protein, 9 aa, Artificial Sequence
  Description of Artificial Sequence: Synthetic peptide
  Seed: ELAGQSLLK (PRAME_HUMAN)
EIAGQSLLK

SEQ ID NO: 157105 - protein, 10 aa, Artificial Sequence
  Description of Artificial Sequence: Synthetic peptide
  Seed: MNPLETLSIT (PRAME_HUMAN)
MGPLETLSIV

SEQ ID NO: 157106 - protein, 9 aa, Artificial Sequence
  Description of Artificial Sequence: Synthetic peptide
  Seed: EPLQALLER (PRAME_HUMAN)
ELLQALLER

SEQ ID NO: 157107 - protein, 9 aa, Artificial Sequence
  Description of Artificial Sequence: Synthetic peptide
  Seed: HARLRELLC (PRAME_HUMAN)
HLRLRELLM

SEQ ID NO: 157108 - protein, 9 aa, Artificial Sequence
  Description of Artificial Sequence: Synthetic peptide
  Seed: SALQSLLQH (PRAME_HUMAN)
SALQSLLQM

SEQ ID NO: 157109 - protein, 9 aa, Artificial Sequence
  Description of Artificial Sequence: Synthetic peptide
  Seed: FYDPEPILC (PRAME_HUMAN)
FNDPEPILI

SEQ ID NO: 157110 - protein, 9 aa, Artificial Sequence
  Description of Artificial Sequence: Synthetic peptide
  Seed: QDIKMILKM (PRAME_HUMAN)
QEIKMILKM

SEQ ID NO: 157111 - protein, 9 aa, Artificial Sequence
  Description of Artificial Sequence: Synthetic peptide
  Seed: RLRELLCEL (PRAME_HUMAN)
RTRELLCEP

SEQ ID NO: 157112 - protein, 11 aa, Artificial Sequence
  Description of Artificial Sequence: Synthetic peptide
  Seed: SIQSRYISMSV (PRAME_HUMAN)
SFQSRYISMSK

SEQ ID NO: 157113 - protein, 10 aa, Artificial Sequence
  Description of Artificial Sequence: Synthetic peptide
  Seed: LSFYGNSISI (PRAME_HUMAN)
LKFYGNSISF

SEQ ID NO: 157114 - protein, 10 aa, Artificial Sequence
  Description of Artificial Sequence: Synthetic peptide
  Seed: YIAQFTSQFL (PRAME_HUMAN)
YSAQFTSQFY

SEQ ID NO: 157115 - protein, 9 aa, Artificial Sequence
  Description of Artificial Sequence: Synthetic peptide
  Seed: DEALAIAAL (PRAME_HUMAN)
DEALAIAAH

SEQ ID NO: 157116 - protein, 9 aa, Artificial Sequence
  Description of Artificial Sequence: Synthetic peptide
  Seed: QMINLRRLL (PRAME_HUMAN)
QSINLRRLW

SEQ ID NO: 157117 - protein, 9 aa, Artificial Sequence
  Description of Artificial Sequence: Synthetic peptide
  Seed: ETLSITNCR (PRAME_HUMAN)
ELLSITNCR

SEQ ID NO: 157118 - protein, 11 aa, Artificial Sequence
  Description of Artificial Sequence: Synthetic peptide
  Seed: GTLHLERLAYL (PRAME_HUMAN)
GTLHLERLAYV

SEQ ID NO: 157119 - protein, 10 aa, Artificial Sequence
  Description of Artificial Sequence: Synthetic peptide
  Seed: LPTLAKFSPY (PRAME_HUMAN)
LLTLAKFSPW

SEQ ID NO: 157120 - protein, 10 aa, Artificial Sequence
  Description of Artificial Sequence: Synthetic peptide
  Seed: SLLKDEALAI (PRAME_HUMAN)
SNLKDEALAV

SEQ ID NO: 157121 - protein, 9 aa, Artificial Sequence
  Description of Artificial Sequence: Synthetic peptide
  Seed: LVELAGQSL (PRAME_HUMAN)
LWELAGQSM

SEQ ID NO: 157122 - protein, 10 aa, Artificial Sequence
  Description of Artificial Sequence: Synthetic peptide
  Seed: AAFDGRHSQT (PRAME_HUMAN)
ASFDGRHSQY

SEQ ID NO: 157123 - protein, 9 aa, Artificial Sequence
  Description of Artificial Sequence: Synthetic peptide
  Seed: TLAKFSPYL (PRAME_HUMAN)
TFAKFSPYM

SEQ ID NO: 157124 - protein, 10 aa, Artificial Sequence
  Description of Artificial Sequence: Synthetic peptide
  Seed: ITDDQLLALL (PRAME_HUMAN)
IQDDQLLALM

SEQ ID NO: 157125 - protein, 10 aa, Artificial Sequence
  Description of Artificial Sequence: Synthetic peptide
  Seed: FIPVEVLVDL (PRAME_HUMAN)
FQPVEVLVDA

SEQ ID NO: 157126 - protein, 9 aa, Artificial Sequence
  Description of Artificial Sequence: Synthetic peptide
  Seed: LKMVQLDSI (PRAME_HUMAN)
LHMVQLDSF

SEQ ID NO: 157127 - protein, 11 aa, Artificial Sequence
  Description of Artificial Sequence: Synthetic peptide
  Seed: QALYVDSLFFL (PRAME_HUMAN)
QCLYVDSLFFF

SEQ ID NO: 157128 - protein, 9 aa, Artificial Sequence
  Description of Artificial Sequence: Synthetic peptide
  Seed: SQLSVLSLS (PRAME_HUMAN)
SVLSVLSLV

SEQ ID NO: 157129 - protein, 11 aa, Artificial Sequence
  Description of Artificial Sequence: Synthetic peptide
  Seed: QALYVDSLFFL (PRAME_HUMAN)
QSLYVDSLFFA

SEQ ID NO: 157130 - protein, 9 aa, Artificial Sequence
  Description of Artificial Sequence: Synthetic peptide
  Seed: GQHLHLETF (PRAME_HUMAN)
GAHLHLETM

SEQ ID NO: 157131 - protein, 10 aa, Artificial Sequence
  Description of Artificial Sequence: Synthetic peptide
  Seed: QAWPFTCLPL (PRAME_HUMAN)
QAWPFTCLPF

SEQ ID NO: 157132 - protein, 10 aa, Artificial Sequence
  Description of Artificial Sequence: Synthetic peptide
  Seed: QSRYISMSVW (PRAME_HUMAN)
QSRYISMSVY

SEQ ID NO: 157133 - protein, 9 aa, Artificial Sequence
  Description of Artificial Sequence: Synthetic peptide
  Seed: FYDPEPILC (PRAME_HUMAN)
FKDPEPILL

SEQ ID NO: 157134 - protein, 10 aa, Artificial Sequence
  Description of Artificial Sequence: Synthetic peptide
  Seed: RHVMNPLETL (PRAME_HUMAN)
RQVMNPLETW

SEQ ID NO: 157135 - protein, 10 aa, Artificial Sequence
  Description of Artificial Sequence: Synthetic peptide
  Seed: ARLRELLCEL (PRAME_HUMAN)
ARLRELLCEM

SEQ ID NO: 157136 - protein, 11 aa, Artificial Sequence
  Description of Artificial Sequence: Synthetic peptide
  Seed: SYISPEKEEQY (PRAME_HUMAN)
SYISPEKEEQF

SEQ ID NO: 157137 - protein, 9 aa, Artificial Sequence
  Description of Artificial Sequence: Synthetic peptide
  Seed: LAIAALELL (PRAME_HUMAN)
LLIAALELW

SEQ ID NO: 157138 - protein, 10 aa, Artificial Sequence
  Description of Artificial Sequence: Synthetic peptide
  Seed: AVLDGLDVLL (PRAME_HUMAN)
AILDGLDVLL

SEQ ID NO: 157139 - protein, 9 aa, Artificial Sequence
  Description of Artificial Sequence: Synthetic peptide
  Seed: YLGQMINLR (PRAME_HUMAN)
YAGQMINLR

SEQ ID NO: 157140 - protein, 9 aa, Artificial Sequence
  Description of Artificial Sequence: Synthetic peptide
  Seed: TLHLERLAY (PRAME_HUMAN)
TMHLERLAW

SEQ ID NO: 157141 - protein, 10 aa, Artificial Sequence
  Description of Artificial Sequence: Synthetic peptide
  Seed: RTFYDPEPIL (PRAME_HUMAN)
RGFYDPEPIW

SEQ ID NO: 157142 - protein, 10 aa, Artificial Sequence
  Description of Artificial Sequence: Synthetic peptide
  Seed: RGRLDQLLRH (PRAME_HUMAN)
RNRLDQLLRI

SEQ ID NO: 157143 - protein, 9 aa, Artificial Sequence
  Description of Artificial Sequence: Synthetic peptide
  Seed: HVMNPLETL (PRAME_HUMAN)
HFMNPLETL

SEQ ID NO: 157144 - protein, 9 aa, Artificial Sequence
  Description of Artificial Sequence: Synthetic peptide
  Seed: HVMNPLETL (PRAME_HUMAN)
HLMNPLETM

SEQ ID NO: 157145 - protein, 9 aa, Artificial Sequence
  Description of Artificial Sequence: Synthetic peptide
  Seed: QALYVDSLF (PRAME_HUMAN)
QSLYVDSLW

SEQ ID NO: 157146 - protein, 9 aa, Artificial Sequence
  Description of Artificial Sequence: Synthetic peptide
  Seed: MHLSQSPSV (PRAME_HUMAN)
MLLSQSPSY

SEQ ID NO: 157147 - protein, 10 aa, Artificial Sequence
  Description of Artificial Sequence: Synthetic peptide
  Seed: SMSVWTSPRR (PRAME_HUMAN)
SMSVWTSPRK

SEQ ID NO: 157148 - protein, 10 aa, Artificial Sequence
  Description of Artificial Sequence: Synthetic peptide
  Seed: ELFSYLIEKV (PRAME_HUMAN)
ETFSYLIEKI

SEQ ID NO: 157149 - protein, 10 aa, Artificial Sequence
  Description of Artificial Sequence: Synthetic peptide
  Seed: KGQHLHLETF (PRAME_HUMAN)
KHQHLHLETM

SEQ ID NO: 157150 - protein, 9 aa, Artificial Sequence
  Description of Artificial Sequence: Synthetic peptide
  Seed: KVDGLSTEA (PRAME_HUMAN)
KIDGLSTEM

SEQ ID NO: 157151 - protein, 10 aa, Artificial Sequence
  Description of Artificial Sequence: Synthetic peptide
  Seed: ARLRELLCEL (PRAME_HUMAN)
APLRELLCEA

SEQ ID NO: 157152 - protein, 9 aa, Artificial Sequence
  Description of Artificial Sequence: Synthetic peptide
  Seed: SIEDLEVTC (PRAME_HUMAN)
SIEDLEVTV

SEQ ID NO: 157153 - protein, 9 aa, Artificial Sequence
  Description of Artificial Sequence: Synthetic peptide
  Seed: ITDDQLLAL (PRAME_HUMAN)
IHDDQLLAM

SEQ ID NO: 157154 - protein, 9 aa, Artificial Sequence
  Description of Artificial Sequence: Synthetic peptide
  Seed: LYPVPLESY (PRAME_HUMAN)
LIPVPLESY

SEQ ID NO: 157155 - protein, 9 aa, Artificial Sequence
  Description of Artificial Sequence: Synthetic peptide
  Seed: LQHLIGLSN (PRAME_HUMAN)
LNHLIGLSY

SEQ ID NO: 157156 - protein, 10 aa, Artificial Sequence
  Description of Artificial Sequence: Synthetic peptide
  Seed: FFLRGRLDQL (PRAME_HUMAN)
FVLRGRLDQI

SEQ ID NO: 157157 - protein, 11 aa, Artificial Sequence
  Description of Artificial Sequence: Synthetic peptide
  Seed: LLPRELFPPLF (PRAME_HUMAN)
LFPRELFPPLF

SEQ ID NO: 157158 - protein, 10 aa, Artificial Sequence
  Description of Artificial Sequence: Synthetic peptide
  Seed: SPSVSQLSVL (PRAME_HUMAN)
SSSVSQLSVY

SEQ ID NO: 157159 - protein, 9 aa, Artificial Sequence
  Description of Artificial Sequence: Synthetic peptide
  Seed: WSGNRASLY (PRAME_HUMAN)
WQGNRASLM

SEQ ID NO: 157160 - protein, 9 aa, Artificial Sequence
  Description of Artificial Sequence: Synthetic peptide
  Seed: WPFTCLPLG (PRAME_HUMAN)
WPFTCLPLM

SEQ ID NO: 157161 - protein, 9 aa, Artificial Sequence
  Description of Artificial Sequence: Synthetic peptide
  Seed: YIAQFTSQF (PRAME_HUMAN)
YYAQFTSQV

SEQ ID NO: 157162 - protein, 10 aa, Artificial Sequence
  Description of Artificial Sequence: Synthetic peptide
  Seed: TLAKFSPYLG (PRAME_HUMAN)
TLAKFSPYLV

SEQ ID NO: 157163 - protein, 9 aa, Artificial Sequence
  Description of Artificial Sequence: Synthetic peptide
  Seed: TLSFYGNSI (PRAME_HUMAN)
TMSFYGNSI

SEQ ID NO: 157164 - protein, 10 aa, Artificial Sequence
  Description of Artificial Sequence: Synthetic peptide
  Seed: ETFKAVLDGL (PRAME_HUMAN)
EVFKAVLDGF

SEQ ID NO: 157165 - protein, 9 aa, Artificial Sequence
  Description of Artificial Sequence: Synthetic peptide
  Seed: VQLDSIEDL (PRAME_HUMAN)
VRLDSIEDF

SEQ ID NO: 157166 - protein, 9 aa, Artificial Sequence
  Description of Artificial Sequence: Synthetic peptide
  Seed: ISISALQSL (PRAME_HUMAN)
IHISALQSF

SEQ ID NO: 157167 - protein, 10 aa, Artificial Sequence
  Description of Artificial Sequence: Synthetic peptide
  Seed: MNPLETLSIT (PRAME_HUMAN)
MVPLETLSIV

SEQ ID NO: 157168 - protein, 10 aa, Artificial Sequence
  Description of Artificial Sequence: Synthetic peptide
  Seed: YSFPEPEAAQ (PRAME_HUMAN)
YTFPEPEAAM

SEQ ID NO: 157169 - protein, 9 aa, Artificial Sequence
  Description of Artificial Sequence: Synthetic peptide
  Seed: QALYVDSLF (PRAME_HUMAN)
QTLYVDSLM

SEQ ID NO: 157170 - protein, 9 aa, Artificial Sequence
  Description of Artificial Sequence: Synthetic peptide
  Seed: LQDLVFDEC (PRAME_HUMAN)
LIDLVFDEI

SEQ ID NO: 157171 - protein, 9 aa, Artificial Sequence
  Description of Artificial Sequence: Synthetic peptide
  Seed: GACDELFSY (PRAME_HUMAN)
GMCDELFSY

SEQ ID NO: 157172 - protein, 9 aa, Artificial Sequence
  Description of Artificial Sequence: Synthetic peptide
  Seed: TSPRRLVEL (PRAME_HUMAN)
TMPRRLVEY

SEQ ID NO: 157173 - protein, 11 aa, Artificial Sequence
  Description of Artificial Sequence: Synthetic peptide
  Seed: SIEDLEVTCTW (PRAME_HUMAN)
SVEDLEVTCTY

SEQ ID NO: 157174 - protein, 9 aa, Artificial Sequence
  Description of Artificial Sequence: Synthetic peptide
  Seed: LVELAGQSL (PRAME_HUMAN)
LYELAGQSF

SEQ ID NO: 157175 - protein, 9 aa, Artificial Sequence
  Description of Artificial Sequence: Synthetic peptide
  Seed: SQFLSLQCL (PRAME_HUMAN)
SQFLSLQCY

SEQ ID NO: 157176 - protein, 10 aa, Artificial Sequence
  Description of Artificial Sequence: Synthetic peptide
  Seed: LSQSPSVSQL (PRAME_HUMAN)
LVQSPSVSQM

SEQ ID NO: 157177 - protein, 11 aa, Artificial Sequence
  Description of Artificial Sequence: Synthetic peptide
  Seed: RASATLQDLVF (PRAME_HUMAN)
RMSATLQDLVF

SEQ ID NO: 157178 - protein, 10 aa, Artificial Sequence
  Description of Artificial Sequence: Synthetic peptide
  Seed: SNLTHVLYPV (PRAME_HUMAN)
SRLTHVLYPI

SEQ ID NO: 157179 - protein, 10 aa, Artificial Sequence
  Description of Artificial Sequence: Synthetic peptide
  Seed: ALYVDSLFFL (PRAME_HUMAN)
AEYVDSLFFF

SEQ ID NO: 157180 - protein, 10 aa, Artificial Sequence
  Description of Artificial Sequence: Synthetic peptide
  Seed: AKFSPYLGQM (PRAME_HUMAN)
AKFSPYLGQY

SEQ ID NO: 157181 - protein, 9 aa, Artificial Sequence
  Description of Artificial Sequence: Synthetic peptide
  Seed: QSRYISMSV (PRAME_HUMAN)
QPRYISMST

SEQ ID NO: 157182 - protein, 11 aa, Artificial Sequence
  Description of Artificial Sequence: Synthetic peptide
  Seed: SQLSVLSLSGV (PRAME_HUMAN)
SLLSVLSLSGV

SEQ ID NO: 157183 - protein, 9 aa, Artificial Sequence
  Description of Artificial Sequence: Synthetic peptide
  Seed: YVDSLFFLR (PRAME_HUMAN)
YSDSLFFLH

SEQ ID NO: 157184 - protein, 9 aa, Artificial Sequence
  Description of Artificial Sequence: Synthetic peptide
  Seed: LDQLLRHVM (PRAME_HUMAN)
LEQLLRHVF

SEQ ID NO: 157185 - protein, 9 aa, Artificial Sequence
  Description of Artificial Sequence: Synthetic peptide
  Seed: TLAKFSPYL (PRAME_HUMAN)
TMAKFSPYM

SEQ ID NO: 157186 - protein, 10 aa, Artificial Sequence
  Description of Artificial Sequence: Synthetic peptide
  Seed: MPMQDIKMIL (PRAME_HUMAN)
MPMQDIKMIS

SEQ ID NO: 157187 - protein, 10 aa, Artificial Sequence
  Description of Artificial Sequence: Synthetic peptide
  Seed: RGRLDQLLRH (PRAME_HUMAN)
RARLDQLLRL

SEQ ID NO: 157188 - protein, 9 aa, Artificial Sequence
  Description of Artificial Sequence: Synthetic peptide
  Seed: SATLQDLVF (PRAME_HUMAN)
SATLQDLVY

SEQ ID NO: 157189 - protein, 10 aa, Artificial Sequence
  Description of Artificial Sequence: Synthetic peptide
  Seed: LSFYGNSISI (PRAME_HUMAN)
LIFYGNSISF

SEQ ID NO: 157190 - protein, 10 aa, Artificial Sequence
  Description of Artificial Sequence: Synthetic peptide
  Seed: ALLERASATL (PRAME_HUMAN)
ALLERASATV

SEQ ID NO: 157191 - protein, 10 aa, Artificial Sequence
  Description of Artificial Sequence: Synthetic peptide
  Seed: MERRRLWGSI (PRAME_HUMAN)
MSRRRLWGSL

SEQ ID NO: 157192 - protein, 11 aa, Artificial Sequence
  Description of Artificial Sequence: Synthetic peptide
  Seed: KAVLDGLDVLL (PRAME_HUMAN)
KAVLDGLDVLF

SEQ ID NO: 157193 - protein, 9 aa, Artificial Sequence
  Description of Artificial Sequence: Synthetic peptide
  Seed: KVDGLSTEA (PRAME_HUMAN)
KMDGLSTEM

SEQ ID NO: 157194 - protein, 9 aa, Artificial Sequence
  Description of Artificial Sequence: Synthetic peptide
  Seed: LSTEAEQPF (PRAME_HUMAN)
LQTEAEQPW

SEQ ID NO: 157195 - protein, 8 aa, Artificial Sequence
  Description of Artificial Sequence: Synthetic peptide
  Seed: DQLLRHVM (PRAME_HUMAN)
DLLLRHVL

SEQ ID NO: 157196 - protein, 9 aa, Artificial Sequence
  Description of Artificial Sequence: Synthetic peptide
  Seed: KAMVQAWPF (PRAME_HUMAN)
KHMVQAWPM

SEQ ID NO: 157197 - protein, 9 aa, Artificial Sequence
  Description of Artificial Sequence: Synthetic peptide
  Seed: FDGRHSQTL (PRAME_HUMAN)
FEGRHSQTI

SEQ ID NO: 157198 - protein, 11 aa, Artificial Sequence
  Description of Artificial Sequence: Synthetic peptide
  Seed: RRLLLSHIHAS (PRAME_HUMAN)
RRLLLSHIHAV

SEQ ID NO: 157199 - protein, 9 aa, Artificial Sequence
  Description of Artificial Sequence: Synthetic peptide
  Seed: LQDLVFDEC (PRAME_HUMAN)
LADLVFDEF

SEQ ID NO: 157200 - protein, 10 aa, Artificial Sequence
  Description of Artificial Sequence: Synthetic peptide
  Seed: RLDQLLRHVM (PRAME_HUMAN)
RMDQLLRHVL

SEQ ID NO: 157201 - protein, 9 aa, Artificial Sequence
  Description of Artificial Sequence: Synthetic peptide
  Seed: LSVLSLSGV (PRAME_HUMAN)
LTVLSLSGV

SEQ ID NO: 157202 - protein, 9 aa, Artificial Sequence
  Description of Artificial Sequence: Synthetic peptide
  Seed: YLHARLREL (PRAME_HUMAN)
YFHARLREW

SEQ ID NO: 157203 - protein, 9 aa, Artificial Sequence
  Description of Artificial Sequence: Synthetic peptide
  Seed: LLKDEALAI (PRAME_HUMAN)
LVKDEALAL

SEQ ID NO: 157204 - protein, 9 aa, Artificial Sequence
  Description of Artificial Sequence: Synthetic peptide
  Seed: ALLPSLSHC (PRAME_HUMAN)
AQLPSLSHM

SEQ ID NO: 157205 - protein, 11 aa, Artificial Sequence
  Description of Artificial Sequence: Synthetic peptide
  Seed: TVWSGNRASLY (PRAME_HUMAN)
TYWSGNRASLY

SEQ ID NO: 157206 - protein, 9 aa, Artificial Sequence
  Description of Artificial Sequence: Synthetic peptide
  Seed: AQEVRPRRW (PRAME_HUMAN)
ATEVRPRRW

SEQ ID NO: 157207 - protein, 9 aa, Artificial Sequence
  Description of Artificial Sequence: Synthetic peptide
  Seed: SQFLSLQCL (PRAME_HUMAN)
SLFLSLQCL

SEQ ID NO: 157208 - protein, 9 aa, Artificial Sequence
  Description of Artificial Sequence: Synthetic peptide
  Seed: SLLQHLIGL (PRAME_HUMAN)
SALQHLIGF

SEQ ID NO: 157209 - protein, 10 aa, Artificial Sequence
  Description of Artificial Sequence: Synthetic peptide
  Seed: LQALYVDSLF (PRAME_HUMAN)
LLALYVDSLW

SEQ ID NO: 157210 - protein, 9 aa, Artificial Sequence
  Description of Artificial Sequence: Synthetic peptide
  Seed: QLLALLPSL (PRAME_HUMAN)
QVLALLPSF

SEQ ID NO: 157211 - protein, 9 aa, Artificial Sequence
  Description of Artificial Sequence: Synthetic peptide
  Seed: ITDDQLLAL (PRAME_HUMAN)
ITDDQLLAC

SEQ ID NO: 157212 - protein, 10 aa, Artificial Sequence
  Description of Artificial Sequence: Synthetic peptide
  Seed: TFYDPEPILC (PRAME_HUMAN)
TRYDPEPILL

SEQ ID NO: 157213 - protein, 8 aa, Artificial Sequence
  Description of Artificial Sequence: Synthetic peptide
  Seed: LSFYGNSI (PRAME_HUMAN)
LAFYGNSL

SEQ ID NO: 157214 - protein, 10 aa, Artificial Sequence
  Description of Artificial Sequence: Synthetic peptide
  Seed: RLVELAGQSL (PRAME_HUMAN)
RRVELAGQSM

SEQ ID NO: 157215 - protein, 10 aa, Artificial Sequence
  Description of Artificial Sequence: Synthetic peptide
  Seed: PTLAKFSPYL (PRAME_HUMAN)
PILAKFSPYL

SEQ ID NO: 157216 - protein, 9 aa, Artificial Sequence
  Description of Artificial Sequence: Synthetic peptide
  Seed: MINLRRLLL (PRAME_HUMAN)
MSNLRRLLY

SEQ ID NO: 157217 - protein, 10 aa, Artificial Sequence
  Description of Artificial Sequence: Synthetic peptide
  Seed: FIPVEVLVDL (PRAME_HUMAN)
FSPVEVLVDW

SEQ ID NO: 157218 - protein, 10 aa, Artificial Sequence
  Description of Artificial Sequence: Synthetic peptide
  Seed: RTFYDPEPIL (PRAME_HUMAN)
RTFYDPEPIY

SEQ ID NO: 157219 - protein, 9 aa, Artificial Sequence
  Description of Artificial Sequence: Synthetic peptide
  Seed: VWSGNRASL (PRAME_HUMAN)
VWSGNRASM

SEQ ID NO: 157220 - protein, 9 aa, Artificial Sequence
  Description of Artificial Sequence: Synthetic peptide
  Seed: SALQSLLQH (PRAME_HUMAN)
SGLQSLLQY

SEQ ID NO: 157221 - protein, 9 aa, Artificial Sequence
  Description of Artificial Sequence: Synthetic peptide
  Seed: GQMINLRRL (PRAME_HUMAN)
GQMINLRRM

SEQ ID NO: 157222 - protein, 9 aa, Artificial Sequence
  Description of Artificial Sequence: Synthetic peptide
  Seed: SATLQDLVF (PRAME_HUMAN)
SSTLQDLVY

SEQ ID NO: 157223 - protein, 9 aa, Artificial Sequence
  Description of Artificial Sequence: Synthetic peptide
  Seed: AWPFTCLPL (PRAME_HUMAN)
AAPFTCLPL

SEQ ID NO: 157224 - protein, 10 aa, Artificial Sequence
  Description of Artificial Sequence: Synthetic peptide
  Seed: RLSEGDVMHL (PRAME_HUMAN)
RRSEGDVMHL

SEQ ID NO: 157225 - protein, 11 aa, Artificial Sequence
  Description of Artificial Sequence: Synthetic peptide
  Seed: RLWGSIQSRYI (PRAME_HUMAN)
RLWGSIQSRYY

SEQ ID NO: 157226 - protein, 9 aa, Artificial Sequence
  Description of Artificial Sequence: Synthetic peptide
  Seed: VSPEPLQAL (PRAME_HUMAN)
VSPEPLQAA

SEQ ID NO: 157227 - protein, 9 aa, Artificial Sequence
  Description of Artificial Sequence: Synthetic peptide
  Seed: SISALQSLL (PRAME_HUMAN)
STSALQSLV

SEQ ID NO: 157228 - protein, 8 aa, Artificial Sequence
  Description of Artificial Sequence: Synthetic peptide
  Seed: RLAYLHAR (PRAME_HUMAN)
RMAYLHAR

SEQ ID NO: 157229 - protein, 11 aa, Artificial Sequence
  Description of Artificial Sequence: Synthetic peptide
  Seed: RELFPPLFMAA (PRAME_HUMAN)
RYLFPPLFMAV

SEQ ID NO: 157230 - protein, 11 aa, Artificial Sequence
  Description of Artificial Sequence: Synthetic peptide
  Seed: SIEDLEVTCTW (PRAME_HUMAN)
STEDLEVTCTW

SEQ ID NO: 157231 - protein, 9 aa, Artificial Sequence
  Description of Artificial Sequence: Synthetic peptide
  Seed: ASATLQDLV (PRAME_HUMAN)
ASATLQDLW

SEQ ID NO: 157232 - protein, 10 aa, Artificial Sequence
  Description of Artificial Sequence: Synthetic peptide
  Seed: DVSPEPLQAL (PRAME_HUMAN)
DTSPEPLQAF

SEQ ID NO: 157233 - protein, 9 aa, Artificial Sequence
  Description of Artificial Sequence: Synthetic peptide
  Seed: SIQSRYISM (PRAME_HUMAN)
SAQSRYISI

SEQ ID NO: 157234 - protein, 9 aa, Artificial Sequence
  Description of Artificial Sequence: Synthetic peptide
  Seed: VLMKGQHLH (PRAME_HUMAN)
VAMKGQHLK

SEQ ID NO: 157235 - protein, 9 aa, Artificial Sequence
  Description of Artificial Sequence: Synthetic peptide
  Seed: FTCLPLGVL (PRAME_HUMAN)
FTCLPLGVM

SEQ ID NO: 157236 - protein, 9 aa, Artificial Sequence
  Description of Artificial Sequence: Synthetic peptide
  Seed: ASSYISPEK (PRAME_HUMAN)
ASSYISPER

SEQ ID NO: 157237 - protein, 10 aa, Artificial Sequence
  Description of Artificial Sequence: Synthetic peptide
  Seed: ERLAYLHARL (PRAME_HUMAN)
EFLAYLHARV

SEQ ID NO: 157238 - protein, 10 aa, Artificial Sequence
  Description of Artificial Sequence: Synthetic peptide
  Seed: LSQSPSVSQL (PRAME_HUMAN)
LCQSPSVSQF

SEQ ID NO: 157239 - protein, 9 aa, Artificial Sequence
  Description of Artificial Sequence: Synthetic peptide
  Seed: SRYISMSVW (PRAME_HUMAN)
SFYISMSVY

SEQ ID NO: 157240 - protein, 9 aa, Artificial Sequence
  Description of Artificial Sequence: Synthetic peptide
  Seed: LMKGQHLHL (PRAME_HUMAN)
LAKGQHLHM

SEQ ID NO: 157241 - protein, 9 aa, Artificial Sequence
  Description of Artificial Sequence: Synthetic peptide
  Seed: LFPPLFMAA (PRAME_HUMAN)
LMPPLFMAL

SEQ ID NO: 157242 - protein, 10 aa, Artificial Sequence
  Description of Artificial Sequence: Synthetic peptide
  Seed: RGRLDQLLRH (PRAME_HUMAN)
RNRLDQLLRF

SEQ ID NO: 157243 - protein, 9 aa, Artificial Sequence
  Description of Artificial Sequence: Synthetic peptide
  Seed: AMVQAWPFT (PRAME_HUMAN)
AQVQAWPFL

SEQ ID NO: 157244 - protein, 10 aa, Artificial Sequence
  Description of Artificial Sequence: Synthetic peptide
  Seed: PTLAKFSPYL (PRAME_HUMAN)
PWLAKFSPYV

SEQ ID NO: 157245 - protein, 9 aa, Artificial Sequence
  Description of Artificial Sequence: Synthetic peptide
  Seed: RTFYDPEPI (PRAME_HUMAN)
RYFYDPEPY

SEQ ID NO: 157246 - protein, 9 aa, Artificial Sequence
  Description of Artificial Sequence: Synthetic peptide
  Seed: RLRELLCEL (PRAME_HUMAN)
RYRELLCEY

SEQ ID NO: 157247 - protein, 10 aa, Artificial Sequence
  Description of Artificial Sequence: Synthetic peptide
  Seed: PTLAKFSPYL (PRAME_HUMAN)
PYLAKFSPYA

SEQ ID NO: 157248 - protein, 9 aa, Artificial Sequence
  Description of Artificial Sequence: Synthetic peptide
  Seed: AAFDGRHSQ (PRAME_HUMAN)
AAFDGRHSI

SEQ ID NO: 157249 - protein, 10 aa, Artificial Sequence
  Description of Artificial Sequence: Synthetic peptide
  Seed: MVQAWPFTCL (PRAME_HUMAN)
MQQAWPFTCI

SEQ ID NO: 157250 - protein, 10 aa, Artificial Sequence
  Description of Artificial Sequence: Synthetic peptide
  Seed: SLLKDEALAI (PRAME_HUMAN)
SSLKDEALAV

SEQ ID NO: 157251 - protein, 9 aa, Artificial Sequence
  Description of Artificial Sequence: Synthetic peptide
  Seed: ESYEDIHGT (PRAME_HUMAN)
ETYEDIHGM

SEQ ID NO: 157252 - protein, 9 aa, Artificial Sequence
  Description of Artificial Sequence: Synthetic peptide
  Seed: HVMNPLETL (PRAME_HUMAN)
HVMNPLETW

SEQ ID NO: 157253 - protein, 9 aa, Artificial Sequence
  Description of Artificial Sequence: Synthetic peptide
  Seed: RLAYLHARL (PRAME_HUMAN)
RLAYLHARI

SEQ ID NO: 157254 - protein, 10 aa, Artificial Sequence
  Description of Artificial Sequence: Synthetic peptide
  Seed: VRPRRWKLQV (PRAME_HUMAN)
VAPRRWKLQL

SEQ ID NO: 157255 - protein, 9 aa, Artificial Sequence
  Description of Artificial Sequence: Synthetic peptide
  Seed: RLSEGDVMH (PRAME_HUMAN)
RLSEGDVMY

SEQ ID NO: 157256 - protein, 10 aa, Artificial Sequence
  Description of Artificial Sequence: Synthetic peptide
  Seed: QAWPFTCLPL (PRAME_HUMAN)
QYWPFTCLPL

SEQ ID NO: 157257 - protein, 11 aa, Artificial Sequence
  Description of Artificial Sequence: Synthetic peptide
  Seed: QALYVDSLFFL (PRAME_HUMAN)
QILYVDSLFFL

SEQ ID NO: 157258 - protein, 9 aa, Artificial Sequence
  Description of Artificial Sequence: Synthetic peptide
  Seed: MQDIKMILK (PRAME_HUMAN)
MADIKMILL

SEQ ID NO: 157259 - protein, 9 aa, Artificial Sequence
  Description of Artificial Sequence: Synthetic peptide
  Seed: SHCSQLTTL (PRAME_HUMAN)
SHCSQLTTI

SEQ ID NO: 157260 - protein, 9 aa, Artificial Sequence
  Description of Artificial Sequence: Synthetic peptide
  Seed: EDLEVTCTW (PRAME_HUMAN)
ETLEVTCTL

SEQ ID NO: 157261 - protein, 9 aa, Artificial Sequence
  Description of Artificial Sequence: Synthetic peptide
  Seed: MVQAWPFTC (PRAME_HUMAN)
MLQAWPFTI

SEQ ID NO: 157262 - protein, 10 aa, Artificial Sequence
  Description of Artificial Sequence: Synthetic peptide
  Seed: YGNSISISAL (PRAME_HUMAN)
YANSISISAY

SEQ ID NO: 157263 - protein, 10 aa, Artificial Sequence
  Description of Artificial Sequence: Synthetic peptide
  Seed: KKLKIFAMPM (PRAME_HUMAN)
KELKIFAMPY

SEQ ID NO: 157264 - protein, 9 aa, Artificial Sequence
  Description of Artificial Sequence: Synthetic peptide
  Seed: RTFYDPEPI (PRAME_HUMAN)
RIFYDPEPF

SEQ ID NO: 157265 - protein, 10 aa, Artificial Sequence
  Description of Artificial Sequence: Synthetic peptide
  Seed: RGRLDQLLRH (PRAME_HUMAN)
RQRLDQLLRI

SEQ ID NO: 157266 - protein, 9 aa, Artificial Sequence
  Description of Artificial Sequence: Synthetic peptide
  Seed: QSRYISMSV (PRAME_HUMAN)
QSRYISMSK

SEQ ID NO: 157267 - protein, 10 aa, Artificial Sequence
  Description of Artificial Sequence: Synthetic peptide
  Seed: YIAQFTSQFL (PRAME_HUMAN)
YAAQFTSQFI

SEQ ID NO: 157268 - protein, 10 aa, Artificial Sequence
  Description of Artificial Sequence: Synthetic peptide
  Seed: IGLSNLTHVL (PRAME_HUMAN)
IRLSNLTHVL

SEQ ID NO: 157269 - protein, 10 aa, Artificial Sequence
  Description of Artificial Sequence: Synthetic peptide
  Seed: DRTFYDPEPI (PRAME_HUMAN)
DNTFYDPEPV

SEQ ID NO: 157270 - protein, 10 aa, Artificial Sequence
  Description of Artificial Sequence: Synthetic peptide
  Seed: MNPLETLSIT (PRAME_HUMAN)
MGPLETLSIA

SEQ ID NO: 157271 - protein, 10 aa, Artificial Sequence
  Description of Artificial Sequence: Synthetic peptide
  Seed: RLAYLHARLR (PRAME_HUMAN)
RAAYLHARLK

SEQ ID NO: 157272 - protein, 9 aa, Artificial Sequence
  Description of Artificial Sequence: Synthetic peptide
  Seed: RGRLDQLLR (PRAME_HUMAN)
RTRLDQLLY

SEQ ID NO: 157273 - protein, 9 aa, Artificial Sequence
  Description of Artificial Sequence: Synthetic peptide
  Seed: ALLERASAT (PRAME_HUMAN)
ALLERASAM

SEQ ID NO: 157274 - protein, 10 aa, Artificial Sequence
  Description of Artificial Sequence: Synthetic peptide
  Seed: MVQAWPFTCL (PRAME_HUMAN)
MIQAWPFTCW

SEQ ID NO: 157275 - protein, 10 aa, Artificial Sequence
  Description of Artificial Sequence: Synthetic peptide
  Seed: LSQSPSVSQL (PRAME_HUMAN)
LYQSPSVSQM

SEQ ID NO: 157276 - protein, 9 aa, Artificial Sequence
  Description of Artificial Sequence: Synthetic peptide
  Seed: MVQAWPFTC (PRAME_HUMAN)
MVQAWPFTA

SEQ ID NO: 157277 - protein, 10 aa, Artificial Sequence
  Description of Artificial Sequence: Synthetic peptide
  Seed: RLRELLCELG (PRAME_HUMAN)
RLRELLCELV

SEQ ID NO: 157278 - protein, 9 aa, Artificial Sequence
  Description of Artificial Sequence: Synthetic peptide
  Seed: MVQAWPFTC (PRAME_HUMAN)
MMQAWPFTV

SEQ ID NO: 157279 - protein, 9 aa, Artificial Sequence
  Description of Artificial Sequence: Synthetic peptide
  Seed: SMVWLSANP (PRAME_HUMAN)
SLVWLSANV

SEQ ID NO: 157280 - protein, 10 aa, Artificial Sequence
  Description of Artificial Sequence: Synthetic peptide
  Seed: FYDPEPILCP (PRAME_HUMAN)
FADPEPILCM

SEQ ID NO: 157281 - protein, 8 aa, Artificial Sequence
  Description of Artificial Sequence: Synthetic peptide
  Seed: FYDPEPIL (PRAME_HUMAN)
FLDPEPIM

SEQ ID NO: 157282 - protein, 9 aa, Artificial Sequence
  Description of Artificial Sequence: Synthetic peptide
  Seed: LSHIHASSY (PRAME_HUMAN)
LYHIHASSM

SEQ ID NO: 157283 - protein, 9 aa, Artificial Sequence
  Description of Artificial Sequence: Synthetic peptide
  Seed: NVLRLCCKK (PRAME_HUMAN)
NILRLCCKR

SEQ ID NO: 157284 - protein, 9 aa, Artificial Sequence
  Description of Artificial Sequence: Synthetic peptide
  Seed: NVLRLCCKK (PRAME_HUMAN)
NVLRLCCKR

SEQ ID NO: 157285 - protein, 9 aa, Artificial Sequence
  Description of Artificial Sequence: Synthetic peptide
  Seed: YIAQFTSQF (PRAME_HUMAN)
YGAQFTSQL

SEQ ID NO: 157286 - protein, 9 aa, Artificial Sequence
  Description of Artificial Sequence: Synthetic peptide
  Seed: KFSPYLGQM (PRAME_HUMAN)
KMSPYLGQY

SEQ ID NO: 157287 - protein, 10 aa, Artificial Sequence
  Description of Artificial Sequence: Synthetic peptide
  Seed: RLSEGDVMHL (PRAME_HUMAN)
RVSEGDVMHI

SEQ ID NO: 157288 - protein, 9 aa, Artificial Sequence
  Description of Artificial Sequence: Synthetic peptide
  Seed: SHCSQLTTL (PRAME_HUMAN)
SRCSQLTTF

SEQ ID NO: 157289 - protein, 10 aa, Artificial Sequence
  Description of Artificial Sequence: Synthetic peptide
  Seed: ASATLQDLVF (PRAME_HUMAN)
AMATLQDLVM

SEQ ID NO: 157290 - protein, 11 aa, Artificial Sequence
  Description of Artificial Sequence: Synthetic peptide
  Seed: FLSLQCLQALY (PRAME_HUMAN)
FMSLQCLQALL

SEQ ID NO: 157291 - protein, 9 aa, Artificial Sequence
  Description of Artificial Sequence: Synthetic peptide
  Seed: YSFPEPEAA (PRAME_HUMAN)
YVFPEPEAH

SEQ ID NO: 157292 - protein, 9 aa, Artificial Sequence
  Description of Artificial Sequence: Synthetic peptide
  Seed: HVMNPLETL (PRAME_HUMAN)
HMMNPLETY

SEQ ID NO: 157293 - protein, 10 aa, Artificial Sequence
  Description of Artificial Sequence: Synthetic peptide
  Seed: QLLRHVMNPL (PRAME_HUMAN)
QSLRHVMNPV

SEQ ID NO: 157294 - protein, 8 aa, Artificial Sequence
  Description of Artificial Sequence: Synthetic peptide
  Seed: YEDIHGTL (PRAME_HUMAN)
YYDIHGTM

SEQ ID NO: 157295 - protein, 9 aa, Artificial Sequence
  Description of Artificial Sequence: Synthetic peptide
  Seed: ITDDQLLAL (PRAME_HUMAN)
IYDDQLLAW

SEQ ID NO: 157296 - protein, 9 aa, Artificial Sequence
  Description of Artificial Sequence: Synthetic peptide
  Seed: VLYPVPLES (PRAME_HUMAN)
VLYPVPLEL

SEQ ID NO: 157297 - protein, 10 aa, Artificial Sequence
  Description of Artificial Sequence: Synthetic peptide
  Seed: MVQAWPFTCL (PRAME_HUMAN)
MFQAWPFTCY

SEQ ID NO: 157298 - protein, 10 aa, Artificial Sequence
  Description of Artificial Sequence: Synthetic peptide
  Seed: QLLRHVMNPL (PRAME_HUMAN)
QTLRHVMNPV

SEQ ID NO: 157299 - protein, 11 aa, Artificial Sequence
  Description of Artificial Sequence: Synthetic peptide
  Seed: NSISISALQSL (PRAME_HUMAN)
NTISISALQSW

SEQ ID NO: 157300 - protein, 10 aa, Artificial Sequence
  Description of Artificial Sequence: Synthetic peptide
  Seed: VLSLSGVMLT (PRAME_HUMAN)
VLSLSGVMLI

SEQ ID NO: 157301 - protein, 10 aa, Artificial Sequence
  Description of Artificial Sequence: Synthetic peptide
  Seed: RLSEGDVMHL (PRAME_HUMAN)
RTSEGDVMHW

SEQ ID NO: 157302 - protein, 9 aa, Artificial Sequence
  Description of Artificial Sequence: Synthetic peptide
  Seed: ITDDQLLAL (PRAME_HUMAN)
IDDDQLLAL

SEQ ID NO: 157303 - protein, 9 aa, Artificial Sequence
  Description of Artificial Sequence: Synthetic peptide
  Seed: SFYGNSISI (PRAME_HUMAN)
SHYGNSISF

SEQ ID NO: 157304 - protein, 9 aa, Artificial Sequence
  Description of Artificial Sequence: Synthetic peptide
  Seed: LMKGQHLHL (PRAME_HUMAN)
LMKGQHLHI

SEQ ID NO: 157305 - protein, 10 aa, Artificial Sequence
  Description of Artificial Sequence: Synthetic peptide
  Seed: YIAQFTSQFL (PRAME_HUMAN)
YVAQFTSQFY

SEQ ID NO: 157306 - protein, 9 aa, Artificial Sequence
  Description of Artificial Sequence: Synthetic peptide
  Seed: TLAKFSPYL (PRAME_HUMAN)
TWAKFSPYM

SEQ ID NO: 157307 - protein, 10 aa, Artificial Sequence
  Description of Artificial Sequence: Synthetic peptide
  Seed: ISMSVWTSPR (PRAME_HUMAN)
IDMSVWTSPR

SEQ ID NO: 157308 - protein, 9 aa, Artificial Sequence
  Description of Artificial Sequence: Synthetic peptide
  Seed: NLTHVLYPV (PRAME_HUMAN)
NATHVLYPL

SEQ ID NO: 157309 - protein, 10 aa, Artificial Sequence
  Description of Artificial Sequence: Synthetic peptide
  Seed: ARLRELLCEL (PRAME_HUMAN)
ANLRELLCEL

SEQ ID NO: 157310 - protein, 10 aa, Artificial Sequence
  Description of Artificial Sequence: Synthetic peptide
  Seed: LSLQCLQALY (PRAME_HUMAN)
LWLQCLQALY

SEQ ID NO: 157311 - protein, 9 aa, Artificial Sequence
  Description of Artificial Sequence: Synthetic peptide
  Seed: DSLFFLRGR (PRAME_HUMAN)
DNLFFLRGR

SEQ ID NO: 157312 - protein, 9 aa, Artificial Sequence
  Description of Artificial Sequence: Synthetic peptide
  Seed: SLSHCSQLT (PRAME_HUMAN)
SISHCSQLI

SEQ ID NO: 157313 - protein, 9 aa, Artificial Sequence
  Description of Artificial Sequence: Synthetic peptide
  Seed: QSRYISMSV (PRAME_HUMAN)
QYRYISMSK

SEQ ID NO: 157314 - protein, 11 aa, Artificial Sequence
  Description of Artificial Sequence: Synthetic peptide
  Seed: RLWGSIQSRYI (PRAME_HUMAN)
RMWGSIQSRYI

SEQ ID NO: 157315 - protein, 10 aa, Artificial Sequence
  Description of Artificial Sequence: Synthetic peptide
  Seed: SPYLGQMINL (PRAME_HUMAN)
SQYLGQMINW

SEQ ID NO: 157316 - protein, 9 aa, Artificial Sequence
  Description of Artificial Sequence: Synthetic peptide
  Seed: SALQSLLQH (PRAME_HUMAN)
SVLQSLLQR

SEQ ID NO: 157317 - protein, 9 aa, Artificial Sequence
  Description of Artificial Sequence: Synthetic peptide
  Seed: LKMVQLDSI (PRAME_HUMAN)
LAMVQLDSY

SEQ ID NO: 157318 - protein, 9 aa, Artificial Sequence
  Description of Artificial Sequence: Synthetic peptide
  Seed: SRYISMSVW (PRAME_HUMAN)
SSYISMSVF

SEQ ID NO: 157319 - protein, 9 aa, Artificial Sequence
  Description of Artificial Sequence: Synthetic peptide
  Seed: MNPLETLSI (PRAME_HUMAN)
MTPLETLSY

SEQ ID NO: 157320 - protein, 10 aa, Artificial Sequence
  Description of Artificial Sequence: Synthetic peptide
  Seed: HASSYISPEK (PRAME_HUMAN)
HISSYISPEK

SEQ ID NO: 157321 - protein, 9 aa, Artificial Sequence
  Description of Artificial Sequence: Synthetic peptide
  Seed: IAQFTSQFL (PRAME_HUMAN)
IVQFTSQFW

SEQ ID NO: 157322 - protein, 11 aa, Artificial Sequence
  Description of Artificial Sequence: Synthetic peptide
  Seed: FSPYLGQMINL (PRAME_HUMAN)
FPPYLGQMINF

SEQ ID NO: 157323 - protein, 10 aa, Artificial Sequence
  Description of Artificial Sequence: Synthetic peptide
  Seed: QLLRHVMNPL (PRAME_HUMAN)
QPLRHVMNPV

SEQ ID NO: 157324 - protein, 10 aa, Artificial Sequence
  Description of Artificial Sequence: Synthetic peptide
  Seed: MNPLETLSIT (PRAME_HUMAN)
MWPLETLSIV

SEQ ID NO: 157325 - protein, 9 aa, Artificial Sequence
  Description of Artificial Sequence: Synthetic peptide
  Seed: HGTLHLERL (PRAME_HUMAN)
HATLHLERL

SEQ ID NO: 157326 - protein, 11 aa, Artificial Sequence
  Description of Artificial Sequence: Synthetic peptide
  Seed: FLSLQCLQALY (PRAME_HUMAN)
FVSLQCLQALV

SEQ ID NO: 157327 - protein, 9 aa, Artificial Sequence
  Description of Artificial Sequence: Synthetic peptide
  Seed: RLRELLCEL (PRAME_HUMAN)
RARELLCEM

SEQ ID NO: 157328 - protein, 8 aa, Artificial Sequence
  Description of Artificial Sequence: Synthetic peptide
  Seed: ITDDQLLA (PRAME_HUMAN)
IMDDQLLM

SEQ ID NO: 157329 - protein, 9 aa, Artificial Sequence
  Description of Artificial Sequence: Synthetic peptide
  Seed: MSVWTSPRR (PRAME_HUMAN)
MLVWTSPRR

SEQ ID NO: 157330 - protein, 10 aa, Artificial Sequence
  Description of Artificial Sequence: Synthetic peptide
  Seed: KIFAMPMQDI (PRAME_HUMAN)
KLFAMPMQDW

SEQ ID NO: 157331 - protein, 9 aa, Artificial Sequence
  Description of Artificial Sequence: Synthetic peptide
  Seed: MPMQDIKMI (PRAME_HUMAN)
MPMQDIKMH

SEQ ID NO: 157332 - protein, 8 aa, Artificial Sequence
  Description of Artificial Sequence: Synthetic peptide
  Seed: LGRPSMVW (PRAME_HUMAN)
LTRPSMVW

SEQ ID NO: 157333 - protein, 9 aa, Artificial Sequence
  Description of Artificial Sequence: Synthetic peptide
  Seed: VFDECGITD (PRAME_HUMAN)
VLDECGITM

SEQ ID NO: 157334 - protein, 10 aa, Artificial Sequence
  Description of Artificial Sequence: Synthetic peptide
  Seed: RLSEGDVMHL (PRAME_HUMAN)
RQSEGDVMHY

SEQ ID NO: 157335 - protein, 9 aa, Artificial Sequence
  Description of Artificial Sequence: Synthetic peptide
  Seed: GQHLHLETF (PRAME_HUMAN)
GLHLHLETY

SEQ ID NO: 157336 - protein, 9 aa, Artificial Sequence
  Description of Artificial Sequence: Synthetic peptide
  Seed: SQFLSLQCL (PRAME_HUMAN)
SMFLSLQCI

SEQ ID NO: 157337 - protein, 9 aa, Artificial Sequence
  Description of Artificial Sequence: Synthetic peptide
  Seed: VSPEPLQAL (PRAME_HUMAN)
VSPEPLQAY

SEQ ID NO: 157338 - protein, 10 aa, Artificial Sequence
  Description of Artificial Sequence: Synthetic peptide
  Seed: SLYSFPEPEA (PRAME_HUMAN)
SMYSFPEPEI

SEQ ID NO: 157339 - protein, 10 aa, Artificial Sequence
  Description of Artificial Sequence: Synthetic peptide
  Seed: ARLRELLCEL (PRAME_HUMAN)
ASLRELLCEV

SEQ ID NO: 157340 - protein, 10 aa, Artificial Sequence
  Description of Artificial Sequence: Synthetic peptide
  Seed: RRRLWGSIQS (PRAME_HUMAN)
RARLWGSIQR

SEQ ID NO: 157341 - protein, 11 aa, Artificial Sequence
  Description of Artificial Sequence: Synthetic peptide
  Seed: LTDVSPEPLQA (PRAME_HUMAN)
LGDVSPEPLQM

SEQ ID NO: 157342 - protein, 9 aa, Artificial Sequence
  Description of Artificial Sequence: Synthetic peptide
  Seed: AMVQAWPFT (PRAME_HUMAN)
AAVQAWPFV

SEQ ID NO: 157343 - protein, 9 aa, Artificial Sequence
  Description of Artificial Sequence: Synthetic peptide
  Seed: RTFYDPEPI (PRAME_HUMAN)
RTFYDPEPV

SEQ ID NO: 157344 - protein, 10 aa, Artificial Sequence
  Description of Artificial Sequence: Synthetic peptide
  Seed: LKAMVQAWPF (PRAME_HUMAN)
LVAMVQAWPW

SEQ ID NO: 157345 - protein, 9 aa, Artificial Sequence
  Description of Artificial Sequence: Synthetic peptide
  Seed: TLSFYGNSI (PRAME_HUMAN)
TMSFYGNSL

SEQ ID NO: 157346 - protein, 10 aa, Artificial Sequence
  Description of Artificial Sequence: Synthetic peptide
  Seed: LSHCSQLTTL (PRAME_HUMAN)
LTHCSQLTTY

SEQ ID NO: 157347 - protein, 9 aa, Artificial Sequence
  Description of Artificial Sequence: Synthetic peptide
  Seed: LHLERLAYL (PRAME_HUMAN)
LFLERLAYL

SEQ ID NO: 157348 - protein, 10 aa, Artificial Sequence
  Description of Artificial Sequence: Synthetic peptide
  Seed: RLWGSIQSRY (PRAME_HUMAN)
RSWGSIQSRM

SEQ ID NO: 157349 - protein, 11 aa, Artificial Sequence
  Description of Artificial Sequence: Synthetic peptide
  Seed: FLSLQCLQALY (PRAME_HUMAN)
FCSLQCLQALL

SEQ ID NO: 157350 - protein, 11 aa, Artificial Sequence
  Description of Artificial Sequence: Synthetic peptide
  Seed: AAFDGRHSQTL (PRAME_HUMAN)
AYFDGRHSQTY

SEQ ID NO: 157351 - protein, 9 aa, Artificial Sequence
  Description of Artificial Sequence: Synthetic peptide
  Seed: TLSFYGNSI (PRAME_HUMAN)
TVSFYGNSV

SEQ ID NO: 157352 - protein, 10 aa, Artificial Sequence
  Description of Artificial Sequence: Synthetic peptide
  Seed: ESYEDIHGTL (PRAME_HUMAN)
EAYEDIHGTK

SEQ ID NO: 157353 - protein, 10 aa, Artificial Sequence
  Description of Artificial Sequence: Synthetic peptide
  Seed: EALAIAALEL (PRAME_HUMAN)
EALAIAALEV

SEQ ID NO: 157354 - protein, 11 aa, Artificial Sequence
  Description of Artificial Sequence: Synthetic peptide
  Seed: FSPYLGQMINL (PRAME_HUMAN)
FLPYLGQMINF

SEQ ID NO: 157355 - protein, 10 aa, Artificial Sequence
  Description of Artificial Sequence: Synthetic peptide
  Seed: SPSVSQLSVL (PRAME_HUMAN)
SYSVSQLSVF

SEQ ID NO: 157356 - protein, 9 aa, Artificial Sequence
  Description of Artificial Sequence: Synthetic peptide
  Seed: MNPLETLSI (PRAME_HUMAN)
MQPLETLSI

SEQ ID NO: 157357 - protein, 9 aa, Artificial Sequence
  Description of Artificial Sequence: Synthetic peptide
  Seed: ERLAYLHAR (PRAME_HUMAN)
EWLAYLHAR

SEQ ID NO: 157358 - protein, 9 aa, Artificial Sequence
  Description of Artificial Sequence: Synthetic peptide
  Seed: AAFDGRHSQ (PRAME_HUMAN)
AMFDGRHSL

SEQ ID NO: 157359 - protein, 9 aa, Artificial Sequence
  Description of Artificial Sequence: Synthetic peptide
  Seed: SIQSRYISM (PRAME_HUMAN)
SKQSRYISM

SEQ ID NO: 157360 - protein, 9 aa, Artificial Sequence
  Description of Artificial Sequence: Synthetic peptide
  Seed: KLKIFAMPM (PRAME_HUMAN)
KLKIFAMPR

SEQ ID NO: 157361 - protein, 9 aa, Artificial Sequence
  Description of Artificial Sequence: Synthetic peptide
  Seed: LQALYVDSL (PRAME_HUMAN)
LQALYVDSY

SEQ ID NO: 157362 - protein, 9 aa, Artificial Sequence
  Description of Artificial Sequence: Synthetic peptide
  Seed: NSISISALQ (PRAME_HUMAN)
NAISISALK

SEQ ID NO: 157363 - protein, 10 aa, Artificial Sequence
  Description of Artificial Sequence: Synthetic peptide
  Seed: NLRRLLLSHI (PRAME_HUMAN)
NLRRLLLSHV

SEQ ID NO: 157364 - protein, 10 aa, Artificial Sequence
  Description of Artificial Sequence: Synthetic peptide
  Seed: VLYPVPLESY (PRAME_HUMAN)
VVYPVPLESR

SEQ ID NO: 157365 - protein, 9 aa, Artificial Sequence
  Description of Artificial Sequence: Synthetic peptide
  Seed: RLRELLCEL (PRAME_HUMAN)
RSRELLCEF

SEQ ID NO: 157366 - protein, 10 aa, Artificial Sequence
  Description of Artificial Sequence: Synthetic peptide
  Seed: VEVLVDLFLK (PRAME_HUMAN)
VSVLVDLFLK

SEQ ID NO: 157367 - protein, 9 aa, Artificial Sequence
  Description of Artificial Sequence: Synthetic peptide
  Seed: ELFPPLFMA (PRAME_HUMAN)
EMFPPLFMI

SEQ ID NO: 157368 - protein, 10 aa, Artificial Sequence
  Description of Artificial Sequence: Synthetic peptide
  Seed: SALQSLLQHL (PRAME_HUMAN)
SMLQSLLQHL

SEQ ID NO: 157369 - protein, 10 aa, Artificial Sequence
  Description of Artificial Sequence: Synthetic peptide
  Seed: FIPVEVLVDL (PRAME_HUMAN)
FDPVEVLVDF

SEQ ID NO: 157370 - protein, 9 aa, Artificial Sequence
  Description of Artificial Sequence: Synthetic peptide
  Seed: FYDPEPILC (PRAME_HUMAN)
FYDPEPILI

SEQ ID NO: 157371 - protein, 9 aa, Artificial Sequence
  Description of Artificial Sequence: Synthetic peptide
  Seed: FYDPEPILC (PRAME_HUMAN)
FHDPEPILF

SEQ ID NO: 157372 - protein, 9 aa, Artificial Sequence
  Description of Artificial Sequence: Synthetic peptide
  Seed: LPLGVLMKG (PRAME_HUMAN)
LPLGVLMKL

SEQ ID NO: 157373 - protein, 9 aa, Artificial Sequence
  Description of Artificial Sequence: Synthetic peptide
  Seed: RLWGSIQSR (PRAME_HUMAN)
RTWGSIQSR

SEQ ID NO: 157374 - protein, 9 aa, Artificial Sequence
  Description of Artificial Sequence: Synthetic peptide
  Seed: SISALQSLL (PRAME_HUMAN)
SLSALQSLA

SEQ ID NO: 157375 - protein, 9 aa, Artificial Sequence
  Description of Artificial Sequence: Synthetic peptide
  Seed: FYDPEPILC (PRAME_HUMAN)
FVDPEPILF

SEQ ID NO: 157376 - protein, 9 aa, Artificial Sequence
  Description of Artificial Sequence: Synthetic peptide
  Seed: YSFPEPEAA (PRAME_HUMAN)
YAFPEPEAA

SEQ ID NO: 157377 - protein, 9 aa, Artificial Sequence
  Description of Artificial Sequence: Synthetic peptide
  Seed: LYVDSLFFL (PRAME_HUMAN)
LYVDSLFFW

SEQ ID NO: 157378 - protein, 10 aa, Artificial Sequence
  Description of Artificial Sequence: Synthetic peptide
  Seed: ETLSITNCRL (PRAME_HUMAN)
ESLSITNCRR

SEQ ID NO: 157379 - protein, 10 aa, Artificial Sequence
  Description of Artificial Sequence: Synthetic peptide
  Seed: LSQSPSVSQL (PRAME_HUMAN)
LHQSPSVSQY

SEQ ID NO: 157380 - protein, 10 aa, Artificial Sequence
  Description of Artificial Sequence: Synthetic peptide
  Seed: LLPRELFPPL (PRAME_HUMAN)
LQPRELFPPI

SEQ ID NO: 157381 - protein, 10 aa, Artificial Sequence
  Description of Artificial Sequence: Synthetic peptide
  Seed: ETFKAVLDGL (PRAME_HUMAN)
ESFKAVLDGL

SEQ ID NO: 157382 - protein, 10 aa, Artificial Sequence
  Description of Artificial Sequence: Synthetic peptide
  Seed: KGQHLHLETF (PRAME_HUMAN)
KIQHLHLETY

SEQ ID NO: 157383 - protein, 9 aa, Artificial Sequence
  Description of Artificial Sequence: Synthetic peptide
  Seed: YGNSISISA (PRAME_HUMAN)
YANSISISA

SEQ ID NO: 157384 - protein, 9 aa, Artificial Sequence
  Description of Artificial Sequence: Synthetic peptide
  Seed: KVKRKKNVL (PRAME_HUMAN)
KSKRKKNVA

SEQ ID NO: 157385 - protein, 9 aa, Artificial Sequence
  Description of Artificial Sequence: Synthetic peptide
  Seed: TLAKFSPYL (PRAME_HUMAN)
TQAKFSPYL

SEQ ID NO: 157386 - protein, 10 aa, Artificial Sequence
  Description of Artificial Sequence: Synthetic peptide
  Seed: RLWGSIQSRY (PRAME_HUMAN)
RWWGSIQSRR

SEQ ID NO: 157387 - protein, 9 aa, Artificial Sequence
  Description of Artificial Sequence: Synthetic peptide
  Seed: AAFDGRHSQ (PRAME_HUMAN)
AVFDGRHSH

SEQ ID NO: 157388 - protein, 9 aa, Artificial Sequence
  Description of Artificial Sequence: Synthetic peptide
  Seed: LSNLTHVLY (PRAME_HUMAN)
LTNLTHVLM

SEQ ID NO: 157389 - protein, 9 aa, Artificial Sequence
  Description of Artificial Sequence: Synthetic peptide
  Seed: SHCSQLTTL (PRAME_HUMAN)
SQCSQLTTW

SEQ ID NO: 157390 - protein, 9 aa, Artificial Sequence
  Description of Artificial Sequence: Synthetic peptide
  Seed: KLKIFAMPM (PRAME_HUMAN)
KAKIFAMPY

SEQ ID NO: 157391 - protein, 9 aa, Artificial Sequence
  Description of Artificial Sequence: Synthetic peptide
  Seed: AVLDGLDVL (PRAME_HUMAN)
ALLDGLDVA

SEQ ID NO: 157392 - protein, 9 aa, Artificial Sequence
  Description of Artificial Sequence: Synthetic peptide
  Seed: MSVWTSPRR (PRAME_HUMAN)
MFVWTSPRR

SEQ ID NO: 157393 - protein, 10 aa, Artificial Sequence
  Description of Artificial Sequence: Synthetic peptide
  Seed: SNLTHVLYPV (PRAME_HUMAN)
SWLTHVLYPL

SEQ ID NO: 157394 - protein, 9 aa, Artificial Sequence
  Description of Artificial Sequence: Synthetic peptide
  Seed: DSLFFLRGR (PRAME_HUMAN)
DLLFFLRGR

SEQ ID NO: 157395 - protein, 10 aa, Artificial Sequence
  Description of Artificial Sequence: Synthetic peptide
  Seed: IQSRYISMSV (PRAME_HUMAN)
IESRYISMSK

SEQ ID NO: 157396 - protein, 11 aa, Artificial Sequence
  Description of Artificial Sequence: Synthetic peptide
  Seed: LLLSHIHASSY (PRAME_HUMAN)
LGLSHIHASSW

SEQ ID NO: 157397 - protein, 9 aa, Artificial Sequence
  Description of Artificial Sequence: Synthetic peptide
  Seed: SPEPLQALL (PRAME_HUMAN)
SFEPLQALM

SEQ ID NO: 157398 - protein, 9 aa, Artificial Sequence
  Description of Artificial Sequence: Synthetic peptide
  Seed: SQSPSVSQL (PRAME_HUMAN)
SQSPSVSQA

SEQ ID NO: 157399 - protein, 11 aa, Artificial Sequence
  Description of Artificial Sequence: Synthetic peptide
  Seed: QALYVDSLFFL (PRAME_HUMAN)
QYLYVDSLFFV

SEQ ID NO: 157400 - protein, 9 aa, Artificial Sequence
  Description of Artificial Sequence: Synthetic peptide
  Seed: RWKLQVLDL (PRAME_HUMAN)
RTKLQVLDA

SEQ ID NO: 157401 - protein, 10 aa, Artificial Sequence
  Description of Artificial Sequence: Synthetic peptide
  Seed: SALQSLLQHL (PRAME_HUMAN)
SFLQSLLQHL

SEQ ID NO: 157402 - protein, 10 aa, Artificial Sequence
  Description of Artificial Sequence: Synthetic peptide
  Seed: RLWGSIQSRY (PRAME_HUMAN)
RQWGSIQSRI

SEQ ID NO: 157403 - protein, 9 aa, Artificial Sequence
  Description of Artificial Sequence: Synthetic peptide
  Seed: KFSPYLGQM (PRAME_HUMAN)
KHSPYLGQY

SEQ ID NO: 157404 - protein, 9 aa, Artificial Sequence
  Description of Artificial Sequence: Synthetic peptide
  Seed: TDDQLLALL (PRAME_HUMAN)
TGDQLLALI

SEQ ID NO: 157405 - protein, 10 aa, Artificial Sequence
  Description of Artificial Sequence: Synthetic peptide
  Seed: YEDIHGTLHL (PRAME_HUMAN)
YMDIHGTLHI

SEQ ID NO: 157406 - protein, 11 aa, Artificial Sequence
  Description of Artificial Sequence: Synthetic peptide
  Seed: SNLTHVLYPVP (PRAME_HUMAN)
SLLTHVLYPVM

SEQ ID NO: 157407 - protein, 10 aa, Artificial Sequence
  Description of Artificial Sequence: Synthetic peptide
  Seed: ALYVDSLFFL (PRAME_HUMAN)
ATYVDSLFFI

SEQ ID NO: 157408 - protein, 11 aa, Artificial Sequence
  Description of Artificial Sequence: Synthetic peptide
  Seed: FKAVLDGLDVL (PRAME_HUMAN)
FWAVLDGLDVV

SEQ ID NO: 157409 - protein, 10 aa, Artificial Sequence
  Description of Artificial Sequence: Synthetic peptide
  Seed: LSQSPSVSQL (PRAME_HUMAN)
LAQSPSVSQM

SEQ ID NO: 157410 - protein, 11 aa, Artificial Sequence
  Description of Artificial Sequence: Synthetic peptide
  Seed: ISMSVWTSPRR (PRAME_HUMAN)
IMMSVWTSPRR

SEQ ID NO: 157411 - protein, 10 aa, Artificial Sequence
  Description of Artificial Sequence: Synthetic peptide
  Seed: KVKRKKNVLR (PRAME_HUMAN)
KVKRKKNVLK

SEQ ID NO: 157412 - protein, 9 aa, Artificial Sequence
  Description of Artificial Sequence: Synthetic peptide
  Seed: KAMVQAWPF (PRAME_HUMAN)
KFMVQAWPW

SEQ ID NO: 157413 - protein, 11 aa, Artificial Sequence
  Description of Artificial Sequence: Synthetic peptide
  Seed: FKAVLDGLDVL (PRAME_HUMAN)
FGAVLDGLDVV

SEQ ID NO: 157414 - protein, 9 aa, Artificial Sequence
  Description of Artificial Sequence: Synthetic peptide
  Seed: KLKIFAMPM (PRAME_HUMAN)
KAKIFAMPF

SEQ ID NO: 157415 - protein, 9 aa, Artificial Sequence
  Description of Artificial Sequence: Synthetic peptide
  Seed: LAIAALELL (PRAME_HUMAN)
LSIAALELV

SEQ ID NO: 157416 - protein, 10 aa, Artificial Sequence
  Description of Artificial Sequence: Synthetic peptide
  Seed: CTWKLPTLAK (PRAME_HUMAN)
CYWKLPTLAR

SEQ ID NO: 157417 - protein, 10 aa, Artificial Sequence
  Description of Artificial Sequence: Synthetic peptide
  Seed: ITDDQLLALL (PRAME_HUMAN)
ITDDQLLALM

SEQ ID NO: 157418 - protein, 11 aa, Artificial Sequence
  Description of Artificial Sequence: Synthetic peptide
  Seed: TLSFYGNSISI (PRAME_HUMAN)
TMSFYGNSISV

SEQ ID NO: 157419 - protein, 11 aa, Artificial Sequence
  Description of Artificial Sequence: Synthetic peptide
  Seed: NPCPHCGDRTF (PRAME_HUMAN)
NPCPHCGDRTW

SEQ ID NO: 157420 - protein, 9 aa, Artificial Sequence
  Description of Artificial Sequence: Synthetic peptide
  Seed: QDIKMILKM (PRAME_HUMAN)
QQIKMILKY

SEQ ID NO: 157421 - protein, 9 aa, Artificial Sequence
  Description of Artificial Sequence: Synthetic peptide
  Seed: SISALQSLL (PRAME_HUMAN)
SQSALQSLY

SEQ ID NO: 157422 - protein, 10 aa, Artificial Sequence
  Description of Artificial Sequence: Synthetic peptide
  Seed: LYVDSLFFLR (PRAME_HUMAN)
LFVDSLFFLR

SEQ ID NO: 157423 - protein, 9 aa, Artificial Sequence
  Description of Artificial Sequence: Synthetic peptide
  Seed: DVSPEPLQA (PRAME_HUMAN)
DVSPEPLQV

SEQ ID NO: 157424 - protein, 9 aa, Artificial Sequence
  Description of Artificial Sequence: Synthetic peptide
  Seed: YSFPEPEAA (PRAME_HUMAN)
YPFPEPEAL

SEQ ID NO: 157425 - protein, 9 aa, Artificial Sequence
  Description of Artificial Sequence: Synthetic peptide
  Seed: FYDPEPILC (PRAME_HUMAN)
FIDPEPILA

SEQ ID NO: 157426 - protein, 9 aa, Artificial Sequence
  Description of Artificial Sequence: Synthetic peptide
  Seed: RGRLDQLLR (PRAME_HUMAN)
RSRLDQLLT

SEQ ID NO: 157427 - protein, 8 aa, Artificial Sequence
  Description of Artificial Sequence: Synthetic peptide
  Seed: TDDQLLAL (PRAME_HUMAN)
TSDQLLAV

SEQ ID NO: 157428 - protein, 10 aa, Artificial Sequence
  Description of Artificial Sequence: Synthetic peptide
  Seed: IGLSNLTHVL (PRAME_HUMAN)
IRLSNLTHVI

SEQ ID NO: 157429 - protein, 9 aa, Artificial Sequence
  Description of Artificial Sequence: Synthetic peptide
  Seed: KEEQYIAQF (PRAME_HUMAN)
KEEQYIAQV

SEQ ID NO: 157430 - protein, 9 aa, Artificial Sequence
  Description of Artificial Sequence: Synthetic peptide
  Seed: YLIEKVKRK (PRAME_HUMAN)
YVIEKVKRK

SEQ ID NO: 157431 - protein, 9 aa, Artificial Sequence
  Description of Artificial Sequence: Synthetic peptide
  Seed: EAAQPMTKK (PRAME_HUMAN)
ELAQPMTKK

SEQ ID NO: 157432 - protein, 9 aa, Artificial Sequence
  Description of Artificial Sequence: Synthetic peptide
  Seed: SLLQHLIGL (PRAME_HUMAN)
SSLQHLIGY

SEQ ID NO: 157433 - protein, 10 aa, Artificial Sequence
  Description of Artificial Sequence: Synthetic peptide
  Seed: RRLWGSIQSR (PRAME_HUMAN)
RTLWGSIQSR

SEQ ID NO: 157434 - protein, 9 aa, Artificial Sequence
  Description of Artificial Sequence: Synthetic peptide
  Seed: YGNSISISA (PRAME_HUMAN)
YPNSISISG

SEQ ID NO: 157435 - protein, 10 aa, Artificial Sequence
  Description of Artificial Sequence: Synthetic peptide
  Seed: LSHCSQLTTL (PRAME_HUMAN)
LMHCSQLTTW

SEQ ID NO: 157436 - protein, 10 aa, Artificial Sequence
  Description of Artificial Sequence: Synthetic peptide
  Seed: KKLKIFAMPM (PRAME_HUMAN)
KRLKIFAMPL

SEQ ID NO: 157437 - protein, 9 aa, Artificial Sequence
  Description of Artificial Sequence: Synthetic peptide
  Seed: SIQSRYISM (PRAME_HUMAN)
SYQSRYISV

SEQ ID NO: 157438 - protein, 9 aa, Artificial Sequence
  Description of Artificial Sequence: Synthetic peptide
  Seed: VLYPVPLES (PRAME_HUMAN)
VIYPVPLEL

SEQ ID NO: 157439 - protein, 9 aa, Artificial Sequence
  Description of Artificial Sequence: Synthetic peptide
  Seed: ALYVDSLFF (PRAME_HUMAN)
AEYVDSLFY

SEQ ID NO: 157440 - protein, 9 aa, Artificial Sequence
  Description of Artificial Sequence: Synthetic peptide
  Seed: MPMQDIKMI (PRAME_HUMAN)
MPMQDIKMW

SEQ ID NO: 157441 - protein, 10 aa, Artificial Sequence
  Description of Artificial Sequence: Synthetic peptide
  Seed: SISISALQSL (PRAME_HUMAN)
SSSISALQSF

SEQ ID NO: 157442 - protein, 10 aa, Artificial Sequence
  Description of Artificial Sequence: Synthetic peptide
  Seed: QLLRHVMNPL (PRAME_HUMAN)
QLLRHVMNPV

SEQ ID NO: 157443 - protein, 10 aa, Artificial Sequence
  Description of Artificial Sequence: Synthetic peptide
  Seed: LLPRELFPPL (PRAME_HUMAN)
LQPRELFPPV

SEQ ID NO: 157444 - protein, 9 aa, Artificial Sequence
  Description of Artificial Sequence: Synthetic peptide
  Seed: RLWGSIQSR (PRAME_HUMAN)
RQWGSIQSY

SEQ ID NO: 157445 - protein, 10 aa, Artificial Sequence
  Description of Artificial Sequence: Synthetic peptide
  Seed: YISPEKEEQY (PRAME_HUMAN)
YASPEKEEQY

SEQ ID NO: 157446 - protein, 9 aa, Artificial Sequence
  Description of Artificial Sequence: Synthetic peptide
  Seed: YLHARLREL (PRAME_HUMAN)
YIHARLREV

SEQ ID NO: 157447 - protein, 10 aa, Artificial Sequence
  Description of Artificial Sequence: Synthetic peptide
  Seed: RYISMSVWTS (PRAME_HUMAN)
RLISMSVWTF

SEQ ID NO: 157448 - protein, 9 aa, Artificial Sequence
  Description of Artificial Sequence: Synthetic peptide
  Seed: HLIGLSNLT (PRAME_HUMAN)
HTIGLSNLL

SEQ ID NO: 157449 - protein, 9 aa, Artificial Sequence
  Description of Artificial Sequence: Synthetic peptide
  Seed: MVQAWPFTC (PRAME_HUMAN)
MIQAWPFTA

SEQ ID NO: 157450 - protein, 9 aa, Artificial Sequence
  Description of Artificial Sequence: Synthetic peptide
  Seed: QLLALLPSL (PRAME_HUMAN)
QLLALLPSY

SEQ ID NO: 157451 - protein, 9 aa, Artificial Sequence
  Description of Artificial Sequence: Synthetic peptide
  Seed: YLHARLREL (PRAME_HUMAN)
YEHARLREL

SEQ ID NO: 157452 - protein, 10 aa, Artificial Sequence
  Description of Artificial Sequence: Synthetic peptide
  Seed: HASSYISPEK (PRAME_HUMAN)
HRSSYISPER

SEQ ID NO: 157453 - protein, 9 aa, Artificial Sequence
  Description of Artificial Sequence: Synthetic peptide
  Seed: SQLTTLSFY (PRAME_HUMAN)
SKLTTLSFM

SEQ ID NO: 157454 - protein, 9 aa, Artificial Sequence
  Description of Artificial Sequence: Synthetic peptide
  Seed: FTCLPLGVL (PRAME_HUMAN)
FMCLPLGVI

SEQ ID NO: 157455 - protein, 9 aa, Artificial Sequence
  Description of Artificial Sequence: Synthetic peptide
  Seed: YIAQFTSQF (PRAME_HUMAN)
YWAQFTSQY

SEQ ID NO: 157456 - protein, 9 aa, Artificial Sequence
  Description of Artificial Sequence: Synthetic peptide
  Seed: NSHQDFWTV (PRAME_HUMAN)
NLHQDFWTA

SEQ ID NO: 157457 - protein, 9 aa, Artificial Sequence
  Description of Artificial Sequence: Synthetic peptide
  Seed: LQALYVDSL (PRAME_HUMAN)
LLALYVDSI

SEQ ID NO: 157458 - protein, 10 aa, Artificial Sequence
  Description of Artificial Sequence: Synthetic peptide
  Seed: SISISALQSL (PRAME_HUMAN)
SASISALQSW

SEQ ID NO: 157459 - protein, 11 aa, Artificial Sequence
  Description of Artificial Sequence: Synthetic peptide
  Seed: DVSPEPLQALL (PRAME_HUMAN)
DVSPEPLQALR

SEQ ID NO: 157460 - protein, 9 aa, Artificial Sequence
  Description of Artificial Sequence: Synthetic peptide
  Seed: SISALQSLL (PRAME_HUMAN)
STSALQSLW

SEQ ID NO: 157461 - protein, 9 aa, Artificial Sequence
  Description of Artificial Sequence: Synthetic peptide
  Seed: LSHIHASSY (PRAME_HUMAN)
LTHIHASSI

SEQ ID NO: 157462 - protein, 9 aa, Artificial Sequence
  Description of Artificial Sequence: Synthetic peptide
  Seed: RLAYLHARL (PRAME_HUMAN)
RVAYLHARR

SEQ ID NO: 157463 - protein, 10 aa, Artificial Sequence
  Description of Artificial Sequence: Synthetic peptide
  Seed: IQSRYISMSV (PRAME_HUMAN)
IMSRYISMSK

SEQ ID NO: 157464 - protein, 10 aa, Artificial Sequence
  Description of Artificial Sequence: Synthetic peptide
  Seed: RLAYLHARLR (PRAME_HUMAN)
RFAYLHARLK

SEQ ID NO: 157465 - protein, 9 aa, Artificial Sequence
  Description of Artificial Sequence: Synthetic peptide
  Seed: ASSYISPEK (PRAME_HUMAN)
AASYISPEM

SEQ ID NO: 157466 - protein, 9 aa, Artificial Sequence
  Description of Artificial Sequence: Synthetic peptide
  Seed: TLHLERLAY (PRAME_HUMAN)
TSHLERLAF

SEQ ID NO: 157467 - protein, 9 aa, Artificial Sequence
  Description of Artificial Sequence: Synthetic peptide
  Seed: ITDDQLLAL (PRAME_HUMAN)
IVDDQLLAL

SEQ ID NO: 157468 - protein, 9 aa, Artificial Sequence
  Description of Artificial Sequence: Synthetic peptide
  Seed: LYPVPLESY (PRAME_HUMAN)
LTPVPLESM

SEQ ID NO: 157469 - protein, 10 aa, Artificial Sequence
  Description of Artificial Sequence: Synthetic peptide
  Seed: VELAGQSLLK (PRAME_HUMAN)
VCLAGQSLLK

SEQ ID NO: 157470 - protein, 9 aa, Artificial Sequence
  Description of Artificial Sequence: Synthetic peptide
  Seed: LMKGQHLHL (PRAME_HUMAN)
LQKGQHLHF

SEQ ID NO: 157471 - protein, 10 aa, Artificial Sequence
  Description of Artificial Sequence: Synthetic peptide
  Seed: AMVQAWPFTC (PRAME_HUMAN)
ASVQAWPFTV

SEQ ID NO: 157472 - protein, 9 aa, Artificial Sequence
  Description of Artificial Sequence: Synthetic peptide
  Seed: SLLQHLIGL (PRAME_HUMAN)
SALQHLIGI

SEQ ID NO: 157473 - protein, 8 aa, Artificial Sequence
  Description of Artificial Sequence: Synthetic peptide
  Seed: FIPVEVLV (PRAME_HUMAN)
FLPVEVLV

SEQ ID NO: 157474 - protein, 9 aa, Artificial Sequence
  Description of Artificial Sequence: Synthetic peptide
  Seed: QDIKMILKM (PRAME_HUMAN)
QEIKMILKC

SEQ ID NO: 157475 - protein, 9 aa, Artificial Sequence
  Description of Artificial Sequence: Synthetic peptide
  Seed: QTLKAMVQA (PRAME_HUMAN)
QILKAMVQV

SEQ ID NO: 157476 - protein, 10 aa, Artificial Sequence
  Description of Artificial Sequence: Synthetic peptide
  Seed: RGRLDQLLRH (PRAME_HUMAN)
RGRLDQLLRF

SEQ ID NO: 157477 - protein, 9 aa, Artificial Sequence
  Description of Artificial Sequence: Synthetic peptide
  Seed: SLLQHLIGL (PRAME_HUMAN)
SRLQHLIGV

SEQ ID NO: 157478 - protein, 9 aa, Artificial Sequence
  Description of Artificial Sequence: Synthetic peptide
  Seed: RLAYLHARL (PRAME_HUMAN)
RMAYLHARK

SEQ ID NO: 157479 - protein, 9 aa, Artificial Sequence
  Description of Artificial Sequence: Synthetic peptide
  Seed: TLKAMVQAW (PRAME_HUMAN)
TQKAMVQAM

SEQ ID NO: 157480 - protein, 10 aa, Artificial Sequence
  Description of Artificial Sequence: Synthetic peptide
  Seed: ETLSITNCRL (PRAME_HUMAN)
EGLSITNCRR

SEQ ID NO: 157481 - protein, 9 aa, Artificial Sequence
  Description of Artificial Sequence: Synthetic peptide
  Seed: YLHARLREL (PRAME_HUMAN)
YYHARLREY

SEQ ID NO: 157482 - protein, 10 aa, Artificial Sequence
  Description of Artificial Sequence: Synthetic peptide
  Seed: ARLRELLCEL (PRAME_HUMAN)
ALLRELLCEM

SEQ ID NO: 157483 - protein, 9 aa, Artificial Sequence
  Description of Artificial Sequence: Synthetic peptide
  Seed: HLIGLSNLT (PRAME_HUMAN)
HMIGLSNLM

SEQ ID NO: 157484 - protein, 9 aa, Artificial Sequence
  Description of Artificial Sequence: Synthetic peptide
  Seed: YGNSISISA (PRAME_HUMAN)
YPNSISISA

SEQ ID NO: 157485 - protein, 10 aa, Artificial Sequence
  Description of Artificial Sequence: Synthetic peptide
  Seed: KFSPYLGQMI (PRAME_HUMAN)
KWSPYLGQMF

SEQ ID NO: 157486 - protein, 9 aa, Artificial Sequence
  Description of Artificial Sequence: Synthetic peptide
  Seed: SYEDIHGTL (PRAME_HUMAN)
SWEDIHGTM

SEQ ID NO: 157487 - protein, 9 aa, Artificial Sequence
  Description of Artificial Sequence: Synthetic peptide
  Seed: SHIHASSYI (PRAME_HUMAN)
SRIHASSYM

SEQ ID NO: 157488 - protein, 11 aa, Artificial Sequence
  Description of Artificial Sequence: Synthetic peptide
  Seed: MKGQHLHLETF (PRAME_HUMAN)
MVGQHLHLETF

SEQ ID NO: 157489 - protein, 9 aa, Artificial Sequence
  Description of Artificial Sequence: Synthetic peptide
  Seed: GRHSQTLKA (PRAME_HUMAN)
GRHSQTLKV

SEQ ID NO: 157490 - protein, 9 aa, Artificial Sequence
  Description of Artificial Sequence: Synthetic peptide
  Seed: LLKDEALAI (PRAME_HUMAN)
LIKDEALAM

SEQ ID NO: 157491 - protein, 10 aa, Artificial Sequence
  Description of Artificial Sequence: Synthetic peptide
  Seed: SLYSFPEPEA (PRAME_HUMAN)
SLYSFPEPEM

SEQ ID NO: 157492 - protein, 9 aa, Artificial Sequence
  Description of Artificial Sequence: Synthetic peptide
  Seed: ETLSITNCR (PRAME_HUMAN)
EALSITNCK

SEQ ID NO: 157493 - protein, 10 aa, Artificial Sequence
  Description of Artificial Sequence: Synthetic peptide
  Seed: VLYPVPLESY (PRAME_HUMAN)
VLYPVPLESW

SEQ ID NO: 157494 - protein, 9 aa, Artificial Sequence
  Description of Artificial Sequence: Synthetic peptide
  Seed: ISPEKEEQY (PRAME_HUMAN)
ITPEKEEQI

SEQ ID NO: 157495 - protein, 10 aa, Artificial Sequence
  Description of Artificial Sequence: Synthetic peptide
  Seed: ALYVDSLFFL (PRAME_HUMAN)
AMYVDSLFFF

SEQ ID NO: 157496 - protein, 10 aa, Artificial Sequence
  Description of Artificial Sequence: Synthetic peptide
  Seed: LLKDEALAIA (PRAME_HUMAN)
LLKDEALAIV

SEQ ID NO: 157497 - protein, 10 aa, Artificial Sequence
  Description of Artificial Sequence: Synthetic peptide
  Seed: SLYSFPEPEA (PRAME_HUMAN)
SMYSFPEPEA

SEQ ID NO: 157498 - protein, 8 aa, Artificial Sequence
  Description of Artificial Sequence: Synthetic peptide
  Seed: MINLRRLL (PRAME_HUMAN)
MMNLRRLM

SEQ ID NO: 157499 - protein, 9 aa, Artificial Sequence
  Description of Artificial Sequence: Synthetic peptide
  Seed: ALQSLLQHL (PRAME_HUMAN)
AMQSLLQHR

SEQ ID NO: 157500 - protein, 9 aa, Artificial Sequence
  Description of Artificial Sequence: Synthetic peptide
  Seed: LALLPSLSH (PRAME_HUMAN)
LTLLPSLSR

SEQ ID NO: 157501 - protein, 9 aa, Artificial Sequence
  Description of Artificial Sequence: Synthetic peptide
  Seed: QSLLKDEAL (PRAME_HUMAN)
QILLKDEAY

SEQ ID NO: 157502 - protein, 9 aa, Artificial Sequence
  Description of Artificial Sequence: Synthetic peptide
  Seed: LVELAGQSL (PRAME_HUMAN)
LQELAGQSY

SEQ ID NO: 157503 - protein, 9 aa, Artificial Sequence
  Description of Artificial Sequence: Synthetic peptide
  Seed: KLKIFAMPM (PRAME_HUMAN)
KEKIFAMPY

SEQ ID NO: 157504 - protein, 10 aa, Artificial Sequence
  Description of Artificial Sequence: Synthetic peptide
  Seed: KVKRKKNVLR (PRAME_HUMAN)
KMKRKKNVLR

SEQ ID NO: 157505 - protein, 10 aa, Artificial Sequence
  Description of Artificial Sequence: Synthetic peptide
  Seed: MSVWTSPRRL (PRAME_HUMAN)
MVVWTSPRRW

SEQ ID NO: 157506 - protein, 8 aa, Artificial Sequence
  Description of Artificial Sequence: Synthetic peptide
  Seed: AQFTSQFL (PRAME_HUMAN)
AQFTSQFF

SEQ ID NO: 157507 - protein, 9 aa, Artificial Sequence
  Description of Artificial Sequence: Synthetic peptide
  Seed: KAMVQAWPF (PRAME_HUMAN)
KTMVQAWPV

SEQ ID NO: 157508 - protein, 10 aa, Artificial Sequence
  Description of Artificial Sequence: Synthetic peptide
  Seed: LQALYVDSLF (PRAME_HUMAN)
LFALYVDSLW

SEQ ID NO: 157509 - protein, 10 aa, Artificial Sequence
  Description of Artificial Sequence: Synthetic peptide
  Seed: LSQSPSVSQL (PRAME_HUMAN)
LMQSPSVSQY

SEQ ID NO: 157510 - protein, 10 aa, Artificial Sequence
  Description of Artificial Sequence: Synthetic peptide
  Seed: VWSGNRASLY (PRAME_HUMAN)
VQSGNRASLY

SEQ ID NO: 157511 - protein, 10 aa, Artificial Sequence
  Description of Artificial Sequence: Synthetic peptide
  Seed: RLVELAGQSL (PRAME_HUMAN)
RAVELAGQSW

SEQ ID NO: 157512 - protein, 10 aa, Artificial Sequence
  Description of Artificial Sequence: Synthetic peptide
  Seed: PTLAKFSPYL (PRAME_HUMAN)
PRLAKFSPYI

SEQ ID NO: 157513 - protein, 9 aa, Artificial Sequence
  Description of Artificial Sequence: Synthetic peptide
  Seed: RLCCKKLKI (PRAME_HUMAN)
RQCCKKLKI

SEQ ID NO: 157514 - protein, 9 aa, Artificial Sequence
  Description of Artificial Sequence: Synthetic peptide
  Seed: RLRELLCEL (PRAME_HUMAN)
RQRELLCER

SEQ ID NO: 157515 - protein, 9 aa, Artificial Sequence
  Description of Artificial Sequence: Synthetic peptide
  Seed: MQDIKMILK (PRAME_HUMAN)
MLDIKMILK

SEQ ID NO: 157516 - protein, 9 aa, Artificial Sequence
  Description of Artificial Sequence: Synthetic peptide
  Seed: SQLTTLSFY (PRAME_HUMAN)
SALTTLSFY

SEQ ID NO: 157517 - protein, 10 aa, Artificial Sequence
  Description of Artificial Sequence: Synthetic peptide
  Seed: SVSQLSVLSL (PRAME_HUMAN)
STSQLSVLSF

SEQ ID NO: 157518 - protein, 10 aa, Artificial Sequence
  Description of Artificial Sequence: Synthetic peptide
  Seed: VDSLFFLRGR (PRAME_HUMAN)
VSSLFFLRGR

SEQ ID NO: 157519 - protein, 10 aa, Artificial Sequence
  Description of Artificial Sequence: Synthetic peptide
  Seed: DQLLALLPSL (PRAME_HUMAN)
DHLLALLPSV

SEQ ID NO: 157520 - protein, 9 aa, Artificial Sequence
  Description of Artificial Sequence: Synthetic peptide
  Seed: AAFDGRHSQ (PRAME_HUMAN)
AIFDGRHSI

SEQ ID NO: 157521 - protein, 10 aa, Artificial Sequence
  Description of Artificial Sequence: Synthetic peptide
  Seed: ASATLQDLVF (PRAME_HUMAN)
AIATLQDLVW

SEQ ID NO: 157522 - protein, 9 aa, Artificial Sequence
  Description of Artificial Sequence: Synthetic peptide
  Seed: KAMVQAWPF (PRAME_HUMAN)
KKMVQAWPM

SEQ ID NO: 157523 - protein, 10 aa, Artificial Sequence
  Description of Artificial Sequence: Synthetic peptide
  Seed: ETLSITNCRL (PRAME_HUMAN)
EMLSITNCRK

SEQ ID NO: 157524 - protein, 10 aa, Artificial Sequence
  Description of Artificial Sequence: Synthetic peptide
  Seed: QYIAQFTSQF (PRAME_HUMAN)
QYIAQFTSQY

SEQ ID NO: 157525 - protein, 9 aa, Artificial Sequence
  Description of Artificial Sequence: Synthetic peptide
  Seed: SQSPSVSQL (PRAME_HUMAN)
STSPSVSQV

SEQ ID NO: 157526 - protein, 10 aa, Artificial Sequence
  Description of Artificial Sequence: Synthetic peptide
  Seed: ALYVDSLFFL (PRAME_HUMAN)
AGYVDSLFFW

SEQ ID NO: 157527 - protein, 10 aa, Artificial Sequence
  Description of Artificial Sequence: Synthetic peptide
  Seed: KDEALAIAAL (PRAME_HUMAN)
KVEALAIAAL

SEQ ID NO: 157528 - protein, 9 aa, Artificial Sequence
  Description of Artificial Sequence: Synthetic peptide
  Seed: SFYGNSISI (PRAME_HUMAN)
SYYGNSISF

SEQ ID NO: 157529 - protein, 10 aa, Artificial Sequence
  Description of Artificial Sequence: Synthetic peptide
  Seed: ESYEDIHGTL (PRAME_HUMAN)
EAYEDIHGTL

SEQ ID NO: 157530 - protein, 11 aa, Artificial Sequence
  Description of Artificial Sequence: Synthetic peptide
  Seed: HLSQSPSVSQL (PRAME_HUMAN)
HVSQSPSVSQF

SEQ ID NO: 157531 - protein, 10 aa, Artificial Sequence
  Description of Artificial Sequence: Synthetic peptide
  Seed: IKMILKMVQL (PRAME_HUMAN)
ILMILKMVQL

SEQ ID NO: 157532 - protein, 9 aa, Artificial Sequence
  Description of Artificial Sequence: Synthetic peptide
  Seed: KMILKMVQL (PRAME_HUMAN)
KQILKMVQM

SEQ ID NO: 157533 - protein, 9 aa, Artificial Sequence
  Description of Artificial Sequence: Synthetic peptide
  Seed: YSFPEPEAA (PRAME_HUMAN)
YDFPEPEAL

SEQ ID NO: 157534 - protein, 9 aa, Artificial Sequence
  Description of Artificial Sequence: Synthetic peptide
  Seed: NSISISALQ (PRAME_HUMAN)
NGISISALK

SEQ ID NO: 157535 - protein, 10 aa, Artificial Sequence
  Description of Artificial Sequence: Synthetic peptide
  Seed: ITDDQLLALL (PRAME_HUMAN)
ILDDQLLALI

SEQ ID NO: 157536 - protein, 10 aa, Artificial Sequence
  Description of Artificial Sequence: Synthetic peptide
  Seed: RRWKLQVLDL (PRAME_HUMAN)
RRWKLQVLDS

SEQ ID NO: 157537 - protein, 9 aa, Artificial Sequence
  Description of Artificial Sequence: Synthetic peptide
  Seed: KMILKMVQL (PRAME_HUMAN)
KMILKMVQF

SEQ ID NO: 157538 - protein, 9 aa, Artificial Sequence
  Description of Artificial Sequence: Synthetic peptide
  Seed: LEVTCTWKL (PRAME_HUMAN)
LQVTCTWKF

SEQ ID NO: 157539 - protein, 9 aa, Artificial Sequence
  Description of Artificial Sequence: Synthetic peptide
  Seed: ITDDQLLAL (PRAME_HUMAN)
ILDDQLLAC

SEQ ID NO: 157540 - protein, 10 aa, Artificial Sequence
  Description of Artificial Sequence: Synthetic peptide
  Seed: IGLSNLTHVL (PRAME_HUMAN)
IWLSNLTHVV

SEQ ID NO: 157541 - protein, 10 aa, Artificial Sequence
  Description of Artificial Sequence: Synthetic peptide
  Seed: EDLEVTCTWK (PRAME_HUMAN)
EILEVTCTWR

SEQ ID NO: 157542 - protein, 10 aa, Artificial Sequence
  Description of Artificial Sequence: Synthetic peptide
  Seed: VTCTWKLPTL (PRAME_HUMAN)
VMCTWKLPTV

SEQ ID NO: 157543 - protein, 9 aa, Artificial Sequence
  Description of Artificial Sequence: Synthetic peptide
  Seed: ALAIAALEL (PRAME_HUMAN)
ATAIAALEI

SEQ ID NO: 157544 - protein, 9 aa, Artificial Sequence
  Description of Artificial Sequence: Synthetic peptide
  Seed: SVLSLSGVM (PRAME_HUMAN)
SMLSLSGVI

SEQ ID NO: 157545 - protein, 9 aa, Artificial Sequence
  Description of Artificial Sequence: Synthetic peptide
  Seed: ALYVDSLFF (PRAME_HUMAN)
ASYVDSLFF

SEQ ID NO: 157546 - protein, 8 aa, Artificial Sequence
  Description of Artificial Sequence: Synthetic peptide
  Seed: YVDSLFFL (PRAME_HUMAN)
YADSLFFM

SEQ ID NO: 157547 - protein, 10 aa, Artificial Sequence
  Description of Artificial Sequence: Synthetic peptide
  Seed: LSLQCLQALY (PRAME_HUMAN)
LVLQCLQALW

SEQ ID NO: 157548 - protein, 9 aa, Artificial Sequence
  Description of Artificial Sequence: Synthetic peptide
  Seed: SQFLSLQCL (PRAME_HUMAN)
SDFLSLQCL

SEQ ID NO: 157549 - protein, 9 aa, Artificial Sequence
  Description of Artificial Sequence: Synthetic peptide
  Seed: MNPLETLSI (PRAME_HUMAN)
MGPLETLSL

SEQ ID NO: 157550 - protein, 8 aa, Artificial Sequence
  Description of Artificial Sequence: Synthetic peptide
  Seed: YSFPEPEA (PRAME_HUMAN)
YAFPEPEF

SEQ ID NO: 157551 - protein, 10 aa, Artificial Sequence
  Description of Artificial Sequence: Synthetic peptide
  Seed: FFLRGRLDQL (PRAME_HUMAN)
FCLRGRLDQA

SEQ ID NO: 157552 - protein, 10 aa, Artificial Sequence
  Description of Artificial Sequence: Synthetic peptide
  Seed: SGNRASLYSF (PRAME_HUMAN)
SQNRASLYSY

SEQ ID NO: 157553 - protein, 9 aa, Artificial Sequence
  Description of Artificial Sequence: Synthetic peptide
  Seed: IGLSNLTHV (PRAME_HUMAN)
IILSNLTHV

SEQ ID NO: 157554 - protein, 9 aa, Artificial Sequence
  Description of Artificial Sequence: Synthetic peptide
  Seed: LYPVPLESY (PRAME_HUMAN)
LFPVPLESM

SEQ ID NO: 157555 - protein, 11 aa, Artificial Sequence
  Description of Artificial Sequence: Synthetic peptide
  Seed: RRRLWGSIQSR (PRAME_HUMAN)
RWRLWGSIQSR

SEQ ID NO: 157556 - protein, 9 aa, Artificial Sequence
  Description of Artificial Sequence: Synthetic peptide
  Seed: LQALYVDSL (PRAME_HUMAN)
LTALYVDSI

SEQ ID NO: 157557 - protein, 9 aa, Artificial Sequence
  Description of Artificial Sequence: Synthetic peptide
  Seed: SFYGNSISI (PRAME_HUMAN)
SAYGNSISV

SEQ ID NO: 157558 - protein, 9 aa, Artificial Sequence
  Description of Artificial Sequence: Synthetic peptide
  Seed: AVLDGLDVL (PRAME_HUMAN)
AMLDGLDVW

SEQ ID NO: 157559 - protein, 9 aa, Artificial Sequence
  Description of Artificial Sequence: Synthetic peptide
  Seed: SQSPSVSQL (PRAME_HUMAN)
SMSPSVSQW

SEQ ID NO: 157560 - protein, 9 aa, Artificial Sequence
  Description of Artificial Sequence: Synthetic peptide
  Seed: YGNSISISA (PRAME_HUMAN)
YFNSISISM

SEQ ID NO: 157561 - protein, 11 aa, Artificial Sequence
  Description of Artificial Sequence: Synthetic peptide
  Seed: SLSGVMLTDVS (PRAME_HUMAN)
SMSGVMLTDVV

SEQ ID NO: 157562 - protein, 9 aa, Artificial Sequence
  Description of Artificial Sequence: Synthetic peptide
  Seed: YSFPEPEAA (PRAME_HUMAN)
YHFPEPEAF

SEQ ID NO: 157563 - protein, 9 aa, Artificial Sequence
  Description of Artificial Sequence: Synthetic peptide
  Seed: LELLPRELF (PRAME_HUMAN)
LQLLPRELY

SEQ ID NO: 157564 - protein, 11 aa, Artificial Sequence
  Description of Artificial Sequence: Synthetic peptide
  Seed: LPTLAKFSPYL (PRAME_HUMAN)
LGTLAKFSPYL

SEQ ID NO: 157565 - protein, 10 aa, Artificial Sequence
  Description of Artificial Sequence: Synthetic peptide
  Seed: AEQPFIPVEV (PRAME_HUMAN)
AQQPFIPVEI

SEQ ID NO: 157566 - protein, 9 aa, Artificial Sequence
  Description of Artificial Sequence: Synthetic peptide
  Seed: LSTEAEQPF (PRAME_HUMAN)
LVTEAEQPY

SEQ ID NO: 157567 - protein, 9 aa, Artificial Sequence
  Description of Artificial Sequence: Synthetic peptide
  Seed: VWSGNRASL (PRAME_HUMAN)
VYSGNRASV

SEQ ID NO: 157568 - protein, 11 aa, Artificial Sequence
  Description of Artificial Sequence: Synthetic peptide
  Seed: SHCSQLTTLSF (PRAME_HUMAN)
SHCSQLTTLSI

SEQ ID NO: 157569 - protein, 10 aa, Artificial Sequence
  Description of Artificial Sequence: Synthetic peptide
  Seed: LYVDSLFFLR (PRAME_HUMAN)
LVVDSLFFLK

SEQ ID NO: 157570 - protein, 10 aa, Artificial Sequence
  Description of Artificial Sequence: Synthetic peptide
  Seed: DELFSYLIEK (PRAME_HUMAN)
DYLFSYLIER

SEQ ID NO: 157571 - protein, 9 aa, Artificial Sequence
  Description of Artificial Sequence: Synthetic peptide
  Seed: QPFIPVEVL (PRAME_HUMAN)
QPFIPVEVW

SEQ ID NO: 157572 - protein, 10 aa, Artificial Sequence
  Description of Artificial Sequence: Synthetic peptide
  Seed: YISPEKEEQY (PRAME_HUMAN)
YQSPEKEEQW

SEQ ID NO: 157573 - protein, 10 aa, Artificial Sequence
  Description of Artificial Sequence: Synthetic peptide
  Seed: IQSRYISMSV (PRAME_HUMAN)
ILSRYISMSM

SEQ ID NO: 157574 - protein, 9 aa, Artificial Sequence
  Description of Artificial Sequence: Synthetic peptide
  Seed: ELFPPLFMA (PRAME_HUMAN)
ESFPPLFMT

SEQ ID NO: 157575 - protein, 9 aa, Artificial Sequence
  Description of Artificial Sequence: Synthetic peptide
  Seed: GQHLHLETF (PRAME_HUMAN)
GRHLHLETI

SEQ ID NO: 157576 - protein, 9 aa, Artificial Sequence
  Description of Artificial Sequence: Synthetic peptide
  Seed: DSLFFLRGR (PRAME_HUMAN)
DGLFFLRGR

SEQ ID NO: 157577 - protein, 10 aa, Artificial Sequence
  Description of Artificial Sequence: Synthetic peptide
  Seed: LSFYGNSISI (PRAME_HUMAN)
LAFYGNSISM

SEQ ID NO: 157578 - protein, 9 aa, Artificial Sequence
  Description of Artificial Sequence: Synthetic peptide
  Seed: SQFLSLQCL (PRAME_HUMAN)
SMFLSLQCV

SEQ ID NO: 157579 - protein, 9 aa, Artificial Sequence
  Description of Artificial Sequence: Synthetic peptide
  Seed: SMVWLSANP (PRAME_HUMAN)
SIVWLSANV

SEQ ID NO: 157580 - protein, 9 aa, Artificial Sequence
  Description of Artificial Sequence: Synthetic peptide
  Seed: SQFLSLQCL (PRAME_HUMAN)
SEFLSLQCC

SEQ ID NO: 157581 - protein, 9 aa, Artificial Sequence
  Description of Artificial Sequence: Synthetic peptide
  Seed: NSHQDFWTV (PRAME_HUMAN)
NTHQDFWTW

SEQ ID NO: 157582 - protein, 10 aa, Artificial Sequence
  Description of Artificial Sequence: Synthetic peptide
  Seed: LPTLAKFSPY (PRAME_HUMAN)
LQTLAKFSPF

SEQ ID NO: 157583 - protein, 9 aa, Artificial Sequence
  Description of Artificial Sequence: Synthetic peptide
  Seed: RGRLDQLLR (PRAME_HUMAN)
RVRLDQLLL

SEQ ID NO: 157584 - protein, 9 aa, Artificial Sequence
  Description of Artificial Sequence: Synthetic peptide
  Seed: YLHARLREL (PRAME_HUMAN)
YAHARLREL

SEQ ID NO: 157585 - protein, 10 aa, Artificial Sequence
  Description of Artificial Sequence: Synthetic peptide
  Seed: ITDDQLLALL (PRAME_HUMAN)
IIDDQLLALY

SEQ ID NO: 157586 - protein, 10 aa, Artificial Sequence
  Description of Artificial Sequence: Synthetic peptide
  Seed: IQSRYISMSV (PRAME_HUMAN)
IISRYISMSF

SEQ ID NO: 157587 - protein, 8 aa, Artificial Sequence
  Description of Artificial Sequence: Synthetic peptide
  Seed: FYDPEPIL (PRAME_HUMAN)
FWDPEPIF

SEQ ID NO: 157588 - protein, 8 aa, Artificial Sequence
  Description of Artificial Sequence: Synthetic peptide
  Seed: VMNPLETL (PRAME_HUMAN)
VTNPLETL

SEQ ID NO: 157589 - protein, 11 aa, Artificial Sequence
  Description of Artificial Sequence: Synthetic peptide
  Seed: FSPYLGQMINL (PRAME_HUMAN)
FNPYLGQMINF

SEQ ID NO: 157590 - protein, 10 aa, Artificial Sequence
  Description of Artificial Sequence: Synthetic peptide
  Seed: LLKDEALAIA (PRAME_HUMAN)
LLKDEALAIL

SEQ ID NO: 157591 - protein, 9 aa, Artificial Sequence
  Description of Artificial Sequence: Synthetic peptide
  Seed: LLERASATL (PRAME_HUMAN)
LMERASATY

SEQ ID NO: 157592 - protein, 9 aa, Artificial Sequence
  Description of Artificial Sequence: Synthetic peptide
  Seed: RLAYLHARL (PRAME_HUMAN)
RQAYLHARR

SEQ ID NO: 157593 - protein, 9 aa, Artificial Sequence
  Description of Artificial Sequence: Synthetic peptide
  Seed: LSLQCLQAL (PRAME_HUMAN)
LLLQCLQAL

SEQ ID NO: 157594 - protein, 11 aa, Artificial Sequence
  Description of Artificial Sequence: Synthetic peptide
  Seed: LLLSHIHASSY (PRAME_HUMAN)
LPLSHIHASSW

SEQ ID NO: 157595 - protein, 10 aa, Artificial Sequence
  Description of Artificial Sequence: Synthetic peptide
  Seed: FFLRGRLDQL (PRAME_HUMAN)
FGLRGRLDQL

SEQ ID NO: 157596 - protein, 10 aa, Artificial Sequence
  Description of Artificial Sequence: Synthetic peptide
  Seed: AAFDGRHSQT (PRAME_HUMAN)
AVFDGRHSQM

SEQ ID NO: 157597 - protein, 10 aa, Artificial Sequence
  Description of Artificial Sequence: Synthetic peptide
  Seed: RELFPPLFMA (PRAME_HUMAN)
RCLFPPLFMI

SEQ ID NO: 157598 - protein, 10 aa, Artificial Sequence
  Description of Artificial Sequence: Synthetic peptide
  Seed: YSFPEPEAAQ (PRAME_HUMAN)
YLFPEPEAAL

SEQ ID NO: 157599 - protein, 9 aa, Artificial Sequence
  Description of Artificial Sequence: Synthetic peptide
  Seed: MVQAWPFTC (PRAME_HUMAN)
MSQAWPFTV

SEQ ID NO: 157600 - protein, 9 aa, Artificial Sequence
  Description of Artificial Sequence: Synthetic peptide
  Seed: AQEVRPRRW (PRAME_HUMAN)
AEEVRPRRY

SEQ ID NO: 157601 - protein, 9 aa, Artificial Sequence
  Description of Artificial Sequence: Synthetic peptide
  Seed: RRWKLQVLD (PRAME_HUMAN)
RKWKLQVLR

SEQ ID NO: 157602 - protein, 9 aa, Artificial Sequence
  Description of Artificial Sequence: Synthetic peptide
  Seed: MINLRRLLL (PRAME_HUMAN)
MYNLRRLLF

SEQ ID NO: 157603 - protein, 10 aa, Artificial Sequence
  Description of Artificial Sequence: Synthetic peptide
  Seed: LLSHIHASSY (PRAME_HUMAN)
LKSHIHASSW

SEQ ID NO: 157604 - protein, 9 aa, Artificial Sequence
  Description of Artificial Sequence: Synthetic peptide
  Seed: QMINLRRLL (PRAME_HUMAN)
QAINLRRLW

SEQ ID NO: 157605 - protein, 8 aa, Artificial Sequence
  Description of Artificial Sequence: Synthetic peptide
  Seed: YEDIHGTL (PRAME_HUMAN)
YADIHGTL

SEQ ID NO: 157606 - protein, 10 aa, Artificial Sequence
  Description of Artificial Sequence: Synthetic peptide
  Seed: SPSVSQLSVL (PRAME_HUMAN)
SYSVSQLSVY

SEQ ID NO: 157607 - protein, 9 aa, Artificial Sequence
  Description of Artificial Sequence: Synthetic peptide
  Seed: HVMNPLETL (PRAME_HUMAN)
HLMNPLETV

SEQ ID NO: 157608 - protein, 10 aa, Artificial Sequence
  Description of Artificial Sequence: Synthetic peptide
  Seed: RGRLDQLLRH (PRAME_HUMAN)
RERLDQLLRI

SEQ ID NO: 157609 - protein, 11 aa, Artificial Sequence
  Description of Artificial Sequence: Synthetic peptide
  Seed: LPTLAKFSPYL (PRAME_HUMAN)
LFTLAKFSPYI

SEQ ID NO: 157610 - protein, 9 aa, Artificial Sequence
  Description of Artificial Sequence: Synthetic peptide
  Seed: QLLALLPSL (PRAME_HUMAN)
QMLALLPSI

SEQ ID NO: 157611 - protein, 9 aa, Artificial Sequence
  Description of Artificial Sequence: Synthetic peptide
  Seed: VSQLSVLSL (PRAME_HUMAN)
VEQLSVLSI

SEQ ID NO: 157612 - protein, 10 aa, Artificial Sequence
  Description of Artificial Sequence: Synthetic peptide
  Seed: RLVELAGQSL (PRAME_HUMAN)
RVVELAGQSR

SEQ ID NO: 157613 - protein, 9 aa, Artificial Sequence
  Description of Artificial Sequence: Synthetic peptide
  Seed: AVLDGLDVL (PRAME_HUMAN)
AMLDGLDVI

SEQ ID NO: 157614 - protein, 10 aa, Artificial Sequence
  Description of Artificial Sequence: Synthetic peptide
  Seed: FIPVEVLVDL (PRAME_HUMAN)
FMPVEVLVDW

SEQ ID NO: 157615 - protein, 10 aa, Artificial Sequence
  Description of Artificial Sequence: Synthetic peptide
  Seed: LSVLSLSGVM (PRAME_HUMAN)
LWVLSLSGVY

SEQ ID NO: 157616 - protein, 10 aa, Artificial Sequence
  Description of Artificial Sequence: Synthetic peptide
  Seed: AYLHARLREL (PRAME_HUMAN)
ARLHARLREV

SEQ ID NO: 157617 - protein, 9 aa, Artificial Sequence
  Description of Artificial Sequence: Synthetic peptide
  Seed: LQSLLQHLI (PRAME_HUMAN)
LHSLLQHLM

SEQ ID NO: 157618 - protein, 9 aa, Artificial Sequence
  Description of Artificial Sequence: Synthetic peptide
  Seed: TLAKFSPYL (PRAME_HUMAN)
TMAKFSPYY

SEQ ID NO: 157619 - protein, 9 aa, Artificial Sequence
  Description of Artificial Sequence: Synthetic peptide
  Seed: ALAIAALEL (PRAME_HUMAN)
AQAIAALEF

SEQ ID NO: 157620 - protein, 11 aa, Artificial Sequence
  Description of Artificial Sequence: Synthetic peptide
  Seed: RTFYDPEPILC (PRAME_HUMAN)
RSFYDPEPILW

SEQ ID NO: 157621 - protein, 9 aa, Artificial Sequence
  Description of Artificial Sequence: Synthetic peptide
  Seed: LTDVSPEPL (PRAME_HUMAN)
LCDVSPEPL

SEQ ID NO: 157622 - protein, 9 aa, Artificial Sequence
  Description of Artificial Sequence: Synthetic peptide
  Seed: KMILKMVQL (PRAME_HUMAN)
KVILKMVQK

SEQ ID NO: 157623 - protein, 8 aa, Artificial Sequence
  Description of Artificial Sequence: Synthetic peptide
  Seed: QSLLQHLI (PRAME_HUMAN)
QQLLQHLV

SEQ ID NO: 157624 - protein, 9 aa, Artificial Sequence
  Description of Artificial Sequence: Synthetic peptide
  Seed: EVLVDLFLK (PRAME_HUMAN)
EVLVDLFLR

SEQ ID NO: 157625 - protein, 11 aa, Artificial Sequence
  Description of Artificial Sequence: Synthetic peptide
  Seed: FKAVLDGLDVL (PRAME_HUMAN)
FEAVLDGLDVV

SEQ ID NO: 157626 - protein, 10 aa, Artificial Sequence
  Description of Artificial Sequence: Synthetic peptide
  Seed: HCSQLTTLSF (PRAME_HUMAN)
HESQLTTLSW

SEQ ID NO: 157627 - protein, 10 aa, Artificial Sequence
  Description of Artificial Sequence: Synthetic peptide
  Seed: ETFKAVLDGL (PRAME_HUMAN)
EMFKAVLDGV

SEQ ID NO: 157628 - protein, 9 aa, Artificial Sequence
  Description of Artificial Sequence: Synthetic peptide
  Seed: MVQAWPFTC (PRAME_HUMAN)
MVQAWPFTI

SEQ ID NO: 157629 - protein, 9 aa, Artificial Sequence
  Description of Artificial Sequence: Synthetic peptide
  Seed: AMVQAWPFT (PRAME_HUMAN)
ALVQAWPFL

SEQ ID NO: 157630 - protein, 10 aa, Artificial Sequence
  Description of Artificial Sequence: Synthetic peptide
  Seed: LSFYGNSISI (PRAME_HUMAN)
LSFYGNSISW

SEQ ID NO: 157631 - protein, 11 aa, Artificial Sequence
  Description of Artificial Sequence: Synthetic peptide
  Seed: RRWKLQVLDLR (PRAME_HUMAN)
RIWKLQVLDLR

SEQ ID NO: 157632 - protein, 11 aa, Artificial Sequence
  Description of Artificial Sequence: Synthetic peptide
  Seed: AAFDGRHSQTL (PRAME_HUMAN)
AIFDGRHSQTL

SEQ ID NO: 157633 - protein, 10 aa, Artificial Sequence
  Description of Artificial Sequence: Synthetic peptide
  Seed: QSLLQHLIGL (PRAME_HUMAN)
QPLLQHLIGV

SEQ ID NO: 157634 - protein, 9 aa, Artificial Sequence
  Description of Artificial Sequence: Synthetic peptide
  Seed: SFPEPEAAQ (PRAME_HUMAN)
SFPEPEAAY

SEQ ID NO: 157635 - protein, 9 aa, Artificial Sequence
  Description of Artificial Sequence: Synthetic peptide
  Seed: ITDDQLLAL (PRAME_HUMAN)
IFDDQLLAM

SEQ ID NO: 157636 - protein, 10 aa, Artificial Sequence
  Description of Artificial Sequence: Synthetic peptide
  Seed: HCSQLTTLSF (PRAME_HUMAN)
HWSQLTTLSF

SEQ ID NO: 157637 - protein, 9 aa, Artificial Sequence
  Description of Artificial Sequence: Synthetic peptide
  Seed: ALYVDSLFF (PRAME_HUMAN)
ARYVDSLFF

SEQ ID NO: 157638 - protein, 9 aa, Artificial Sequence
  Description of Artificial Sequence: Synthetic peptide
  Seed: ALYVDSLFF (PRAME_HUMAN)
AVYVDSLFF

SEQ ID NO: 157639 - protein, 9 aa, Artificial Sequence
  Description of Artificial Sequence: Synthetic peptide
  Seed: VQAWPFTCL (PRAME_HUMAN)
VTAWPFTCY

SEQ ID NO: 157640 - protein, 8 aa, Artificial Sequence
  Description of Artificial Sequence: Synthetic peptide
  Seed: LHLERLAY (PRAME_HUMAN)
LQLERLAF

SEQ ID NO: 157641 - protein, 9 aa, Artificial Sequence
  Description of Artificial Sequence: Synthetic peptide
  Seed: SIEDLEVTC (PRAME_HUMAN)
SMEDLEVTL

SEQ ID NO: 157642 - protein, 9 aa, Artificial Sequence
  Description of Artificial Sequence: Synthetic peptide
  Seed: WSGNRASLY (PRAME_HUMAN)
WTGNRASLY

SEQ ID NO: 157643 - protein, 9 aa, Artificial Sequence
  Description of Artificial Sequence: Synthetic peptide
  Seed: VFDECGITD (PRAME_HUMAN)
VQDECGITM

SEQ ID NO: 157644 - protein, 10 aa, Artificial Sequence
  Description of Artificial Sequence: Synthetic peptide
  Seed: ISISALQSLL (PRAME_HUMAN)
IFISALQSLW

SEQ ID NO: 157645 - protein, 10 aa, Artificial Sequence
  Description of Artificial Sequence: Synthetic peptide
  Seed: ETFKAVLDGL (PRAME_HUMAN)
EAFKAVLDGL

SEQ ID NO: 157646 - protein, 9 aa, Artificial Sequence
  Description of Artificial Sequence: Synthetic peptide
  Seed: KMILKMVQL (PRAME_HUMAN)
KMILKMVQV

SEQ ID NO: 157647 - protein, 10 aa, Artificial Sequence
  Description of Artificial Sequence: Synthetic peptide
  Seed: FLKEGACDEL (PRAME_HUMAN)
FVKEGACDEV

SEQ ID NO: 157648 - protein, 10 aa, Artificial Sequence
  Description of Artificial Sequence: Synthetic peptide
  Seed: GACDELFSYL (PRAME_HUMAN)
GLCDELFSYT

SEQ ID NO: 157649 - protein, 9 aa, Artificial Sequence
  Description of Artificial Sequence: Synthetic peptide
  Seed: RLSEGDVMH (PRAME_HUMAN)
RVSEGDVMF

SEQ ID NO: 157650 - protein, 9 aa, Artificial Sequence
  Description of Artificial Sequence: Synthetic peptide
  Seed: LQALYVDSL (PRAME_HUMAN)
LLALYVDSM

SEQ ID NO: 157651 - protein, 10 aa, Artificial Sequence
  Description of Artificial Sequence: Synthetic peptide
  Seed: IKMILKMVQL (PRAME_HUMAN)
IHMILKMVQV

SEQ ID NO: 157652 - protein, 10 aa, Artificial Sequence
  Description of Artificial Sequence: Synthetic peptide
  Seed: LKAMVQAWPF (PRAME_HUMAN)
LYAMVQAWPW

SEQ ID NO: 157653 - protein, 9 aa, Artificial Sequence
  Description of Artificial Sequence: Synthetic peptide
  Seed: EDLEVTCTW (PRAME_HUMAN)
ESLEVTCTL

SEQ ID NO: 157654 - protein, 9 aa, Artificial Sequence
  Description of Artificial Sequence: Synthetic peptide
  Seed: TLAKFSPYL (PRAME_HUMAN)
TLAKFSPYF

SEQ ID NO: 157655 - protein, 9 aa, Artificial Sequence
  Description of Artificial Sequence: Synthetic peptide
  Seed: AFDGRHSQT (PRAME_HUMAN)
AMDGRHSQL

SEQ ID NO: 157656 - protein, 9 aa, Artificial Sequence
  Description of Artificial Sequence: Synthetic peptide
  Seed: LGRPSMVWL (PRAME_HUMAN)
LVRPSMVWI

SEQ ID NO: 157657 - protein, 11 aa, Artificial Sequence
  Description of Artificial Sequence: Synthetic peptide
  Seed: RASATLQDLVF (PRAME_HUMAN)
RLSATLQDLVW

SEQ ID NO: 157658 - protein, 9 aa, Artificial Sequence
  Description of Artificial Sequence: Synthetic peptide
  Seed: GACDELFSY (PRAME_HUMAN)
GMCDELFSW

SEQ ID NO: 157659 - protein, 9 aa, Artificial Sequence
  Description of Artificial Sequence: Synthetic peptide
  Seed: SRYISMSVW (PRAME_HUMAN)
SRYISMSVL

SEQ ID NO: 157660 - protein, 10 aa, Artificial Sequence
  Description of Artificial Sequence: Synthetic peptide
  Seed: ARLRELLCEL (PRAME_HUMAN)
AWLRELLCEA

SEQ ID NO: 157661 - protein, 10 aa, Artificial Sequence
  Description of Artificial Sequence: Synthetic peptide
  Seed: ALYVDSLFFL (PRAME_HUMAN)
AHYVDSLFFF

SEQ ID NO: 157662 - protein, 9 aa, Artificial Sequence
  Description of Artificial Sequence: Synthetic peptide
  Seed: LLRHVMNPL (PRAME_HUMAN)
LMRHVMNPI

SEQ ID NO: 157663 - protein, 11 aa, Artificial Sequence
  Description of Artificial Sequence: Synthetic peptide
  Seed: QALYVDSLFFL (PRAME_HUMAN)
QWLYVDSLFFF

SEQ ID NO: 157664 - protein, 9 aa, Artificial Sequence
  Description of Artificial Sequence: Synthetic peptide
  Seed: AFDGRHSQT (PRAME_HUMAN)
AQDGRHSQL

SEQ ID NO: 157665 - protein, 10 aa, Artificial Sequence
  Description of Artificial Sequence: Synthetic peptide
  Seed: TFYDPEPILC (PRAME_HUMAN)
TRYDPEPILM

SEQ ID NO: 157666 - protein, 9 aa, Artificial Sequence
  Description of Artificial Sequence: Synthetic peptide
  Seed: VLDGLDVLL (PRAME_HUMAN)
VLDGLDVLF

SEQ ID NO: 157667 - protein, 10 aa, Artificial Sequence
  Description of Artificial Sequence: Synthetic peptide
  Seed: FTCLPLGVLM (PRAME_HUMAN)
FACLPLGVLM

SEQ ID NO: 157668 - protein, 9 aa, Artificial Sequence
  Description of Artificial Sequence: Synthetic peptide
  Seed: DELFSYLIE (PRAME_HUMAN)
DELFSYLIL

SEQ ID NO: 157669 - protein, 9 aa, Artificial Sequence
  Description of Artificial Sequence: Synthetic peptide
  Seed: KLQVLDLRK (PRAME_HUMAN)
KLQVLDLRR

SEQ ID NO: 157670 - protein, 9 aa, Artificial Sequence
  Description of Artificial Sequence: Synthetic peptide
  Seed: IGLSNLTHV (PRAME_HUMAN)
IMLSNLTHL

SEQ ID NO: 157671 - protein, 10 aa, Artificial Sequence
  Description of Artificial Sequence: Synthetic peptide
  Seed: AVLDGLDVLL (PRAME_HUMAN)
AALDGLDVLW

SEQ ID NO: 157672 - protein, 10 aa, Artificial Sequence
  Description of Artificial Sequence: Synthetic peptide
  Seed: IGLSNLTHVL (PRAME_HUMAN)
ILLSNLTHVS

SEQ ID NO: 157673 - protein, 9 aa, Artificial Sequence
  Description of Artificial Sequence: Synthetic peptide
  Seed: LWGSIQSRY (PRAME_HUMAN)
LLGSIQSRY

SEQ ID NO: 157674 - protein, 9 aa, Artificial Sequence
  Description of Artificial Sequence: Synthetic peptide
  Seed: FSPYLGQMI (PRAME_HUMAN)
FIPYLGQML

SEQ ID NO: 157675 - protein, 10 aa, Artificial Sequence
  Description of Artificial Sequence: Synthetic peptide
  Seed: RLSEGDVMHL (PRAME_HUMAN)
RVSEGDVMHW

SEQ ID NO: 157676 - protein, 9 aa, Artificial Sequence
  Description of Artificial Sequence: Synthetic peptide
  Seed: CSQLTTLSF (PRAME_HUMAN)
CAQLTTLSW

SEQ ID NO: 157677 - protein, 10 aa, Artificial Sequence
  Description of Artificial Sequence: Synthetic peptide
  Seed: LPTLAKFSPY (PRAME_HUMAN)
LHTLAKFSPF

SEQ ID NO: 157678 - protein, 10 aa, Artificial Sequence
  Description of Artificial Sequence: Synthetic peptide
  Seed: FFLRGRLDQL (PRAME_HUMAN)
FTLRGRLDQA

SEQ ID NO: 157679 - protein, 11 aa, Artificial Sequence
  Description of Artificial Sequence: Synthetic peptide
  Seed: RLAYLHARLRE (PRAME_HUMAN)
RMAYLHARLRR

SEQ ID NO: 157680 - protein, 10 aa, Artificial Sequence
  Description of Artificial Sequence: Synthetic peptide
  Seed: KVKRKKNVLR (PRAME_HUMAN)
KTKRKKNVLK

SEQ ID NO: 157681 - protein, 9 aa, Artificial Sequence
  Description of Artificial Sequence: Synthetic peptide
  Seed: VSPEPLQAL (PRAME_HUMAN)
VGPEPLQAV

SEQ ID NO: 157682 - protein, 11 aa, Artificial Sequence
  Description of Artificial Sequence: Synthetic peptide
  Seed: MKGQHLHLETF (PRAME_HUMAN)
MYGQHLHLETF

SEQ ID NO: 157683 - protein, 10 aa, Artificial Sequence
  Description of Artificial Sequence: Synthetic peptide
  Seed: LLPRELFPPL (PRAME_HUMAN)
LLPRELFPPV

SEQ ID NO: 157684 - protein, 10 aa, Artificial Sequence
  Description of Artificial Sequence: Synthetic peptide
  Seed: KAVLDGLDVL (PRAME_HUMAN)
KFVLDGLDVV

SEQ ID NO: 157685 - protein, 11 aa, Artificial Sequence
  Description of Artificial Sequence: Synthetic peptide
  Seed: SNLTHVLYPVP (PRAME_HUMAN)
SLLTHVLYPVE

SEQ ID NO: 157686 - protein, 10 aa, Artificial Sequence
  Description of Artificial Sequence: Synthetic peptide
  Seed: RELFPPLFMA (PRAME_HUMAN)
RALFPPLFMI

SEQ ID NO: 157687 - protein, 9 aa, Artificial Sequence
  Description of Artificial Sequence: Synthetic peptide
  Seed: YLHARLREL (PRAME_HUMAN)
YFHARLREV

SEQ ID NO: 157688 - protein, 10 aa, Artificial Sequence
  Description of Artificial Sequence: Synthetic peptide
  Seed: FFLRGRLDQL (PRAME_HUMAN)
FHLRGRLDQI

SEQ ID NO: 157689 - protein, 10 aa, Artificial Sequence
  Description of Artificial Sequence: Synthetic peptide
  Seed: ETLSITNCRL (PRAME_HUMAN)
EYLSITNCRR

SEQ ID NO: 157690 - protein, 10 aa, Artificial Sequence
  Description of Artificial Sequence: Synthetic peptide
  Seed: GTLHLERLAY (PRAME_HUMAN)
GSLHLERLAK

SEQ ID NO: 157691 - protein, 10 aa, Artificial Sequence
  Description of Artificial Sequence: Synthetic peptide
  Seed: RGRLDQLLRH (PRAME_HUMAN)
RSRLDQLLRM

SEQ ID NO: 157692 - protein, 11 aa, Artificial Sequence
  Description of Artificial Sequence: Synthetic peptide
  Seed: FSPYLGQMINL (PRAME_HUMAN)
FEPYLGQMINF

SEQ ID NO: 157693 - protein, 10 aa, Artificial Sequence
  Description of Artificial Sequence: Synthetic peptide
  Seed: SISISALQSL (PRAME_HUMAN)
SVSISALQSY

SEQ ID NO: 157694 - protein, 9 aa, Artificial Sequence
  Description of Artificial Sequence: Synthetic peptide
  Seed: HVMNPLETL (PRAME_HUMAN)
HLMNPLETT

SEQ ID NO: 157695 - protein, 10 aa, Artificial Sequence
  Description of Artificial Sequence: Synthetic peptide
  Seed: RGRLDQLLRH (PRAME_HUMAN)
RFRLDQLLRM

SEQ ID NO: 157696 - protein, 9 aa, Artificial Sequence
  Description of Artificial Sequence: Synthetic peptide
  Seed: QPFIPVEVL (PRAME_HUMAN)
QSFIPVEVY

SEQ ID NO: 157697 - protein, 10 aa, Artificial Sequence
  Description of Artificial Sequence: Synthetic peptide
  Seed: IGLSNLTHVL (PRAME_HUMAN)
IFLSNLTHVL

SEQ ID NO: 157698 - protein, 10 aa, Artificial Sequence
  Description of Artificial Sequence: Synthetic peptide
  Seed: LLPRELFPPL (PRAME_HUMAN)
LIPRELFPPM

SEQ ID NO: 157699 - protein, 9 aa, Artificial Sequence
  Description of Artificial Sequence: Synthetic peptide
  Seed: EDLEVTCTW (PRAME_HUMAN)
EVLEVTCTL

SEQ ID NO: 157700 - protein, 9 aa, Artificial Sequence
  Description of Artificial Sequence: Synthetic peptide
  Seed: WSGNRASLY (PRAME_HUMAN)
WMGNRASLF

SEQ ID NO: 157701 - protein, 10 aa, Artificial Sequence
  Description of Artificial Sequence: Synthetic peptide
  Seed: SLLQHLIGLS (PRAME_HUMAN)
SLLQHLIGLI

SEQ ID NO: 157702 - protein, 9 aa, Artificial Sequence
  Description of Artificial Sequence: Synthetic peptide
  Seed: YLHARLREL (PRAME_HUMAN)
YPHARLREV

SEQ ID NO: 157703 - protein, 10 aa, Artificial Sequence
  Description of Artificial Sequence: Synthetic peptide
  Seed: ETFKAVLDGL (PRAME_HUMAN)
EAFKAVLDGY

SEQ ID NO: 157704 - protein, 9 aa, Artificial Sequence
  Description of Artificial Sequence: Synthetic peptide
  Seed: FYDPEPILC (PRAME_HUMAN)
FYDPEPILW

SEQ ID NO: 157705 - protein, 9 aa, Artificial Sequence
  Description of Artificial Sequence: Synthetic peptide
  Seed: SLLQHLIGL (PRAME_HUMAN)
SRLQHLIGL

SEQ ID NO: 157706 - protein, 10 aa, Artificial Sequence
  Description of Artificial Sequence: Synthetic peptide
  Seed: LLPRELFPPL (PRAME_HUMAN)
LVPRELFPPV

SEQ ID NO: 157707 - protein, 9 aa, Artificial Sequence
  Description of Artificial Sequence: Synthetic peptide
  Seed: RLRELLCEL (PRAME_HUMAN)
RSRELLCER

SEQ ID NO: 157708 - protein, 10 aa, Artificial Sequence
  Description of Artificial Sequence: Synthetic peptide
  Seed: WTSPRRLVEL (PRAME_HUMAN)
WASPRRLVEM

SEQ ID NO: 157709 - protein, 10 aa, Artificial Sequence
  Description of Artificial Sequence: Synthetic peptide
  Seed: YEDIHGTLHL (PRAME_HUMAN)
YFDIHGTLHM

SEQ ID NO: 157710 - protein, 9 aa, Artificial Sequence
  Description of Artificial Sequence: Synthetic peptide
  Seed: EEQYIAQFT (PRAME_HUMAN)
EEQYIAQFI

SEQ ID NO: 157711 - protein, 10 aa, Artificial Sequence
  Description of Artificial Sequence: Synthetic peptide
  Seed: LLSHIHASSY (PRAME_HUMAN)
LGSHIHASSF

SEQ ID NO: 157712 - protein, 9 aa, Artificial Sequence
  Description of Artificial Sequence: Synthetic peptide
  Seed: LGRPSMVWL (PRAME_HUMAN)
LVRPSMVWW

SEQ ID NO: 157713 - protein, 9 aa, Artificial Sequence
  Description of Artificial Sequence: Synthetic peptide
  Seed: LAIAALELL (PRAME_HUMAN)
LIIAALELA

SEQ ID NO: 157714 - protein, 9 aa, Artificial Sequence
  Description of Artificial Sequence: Synthetic peptide
  Seed: ALYVDSLFF (PRAME_HUMAN)
ATYVDSLFI

SEQ ID NO: 157715 - protein, 10 aa, Artificial Sequence
  Description of Artificial Sequence: Synthetic peptide
  Seed: DQLLALLPSL (PRAME_HUMAN)
DRLLALLPSI

SEQ ID NO: 157716 - protein, 10 aa, Artificial Sequence
  Description of Artificial Sequence: Synthetic peptide
  Seed: AQFTSQFLSL (PRAME_HUMAN)
AMFTSQFLSF

SEQ ID NO: 157717 - protein, 10 aa, Artificial Sequence
  Description of Artificial Sequence: Synthetic peptide
  Seed: ISISALQSLL (PRAME_HUMAN)
IVISALQSLF

SEQ ID NO: 157718 - protein, 11 aa, Artificial Sequence
  Description of Artificial Sequence: Synthetic peptide
  Seed: TVWSGNRASLY (PRAME_HUMAN)
TTWSGNRASLY

SEQ ID NO: 157719 - protein, 10 aa, Artificial Sequence
  Description of Artificial Sequence: Synthetic peptide
  Seed: RLWGSIQSRY (PRAME_HUMAN)
RMWGSIQSRR

SEQ ID NO: 157720 - protein, 10 aa, Artificial Sequence
  Description of Artificial Sequence: Synthetic peptide
  Seed: ERLAYLHARL (PRAME_HUMAN)
ETLAYLHARL

SEQ ID NO: 157721 - protein, 9 aa, Artificial Sequence
  Description of Artificial Sequence: Synthetic peptide
  Seed: YSFPEPEAA (PRAME_HUMAN)
YVFPEPEAL

SEQ ID NO: 157722 - protein, 9 aa, Artificial Sequence
  Description of Artificial Sequence: Synthetic peptide
  Seed: TLAKFSPYL (PRAME_HUMAN)
TLAKFSPYI

SEQ ID NO: 157723 - protein, 9 aa, Artificial Sequence
  Description of Artificial Sequence: Synthetic peptide
  Seed: LLRHVMNPL (PRAME_HUMAN)
LHRHVMNPY

SEQ ID NO: 157724 - protein, 11 aa, Artificial Sequence
  Description of Artificial Sequence: Synthetic peptide
  Seed: IAQFTSQFLSL (PRAME_HUMAN)
ILQFTSQFLSF

SEQ ID NO: 157725 - protein, 9 aa, Artificial Sequence
  Description of Artificial Sequence: Synthetic peptide
  Seed: KLKIFAMPM (PRAME_HUMAN)
KMKIFAMPK

SEQ ID NO: 157726 - protein, 9 aa, Artificial Sequence
  Description of Artificial Sequence: Synthetic peptide
  Seed: FPPLFMAAF (PRAME_HUMAN)
FAPLFMAAY

SEQ ID NO: 157727 - protein, 9 aa, Artificial Sequence
  Description of Artificial Sequence: Synthetic peptide
  Seed: KLKIFAMPM (PRAME_HUMAN)
KVKIFAMPY

SEQ ID NO: 157728 - protein, 10 aa, Artificial Sequence
  Description of Artificial Sequence: Synthetic peptide
  Seed: ELFSYLIEKV (PRAME_HUMAN)
EVFSYLIEKV

SEQ ID NO: 157729 - protein, 10 aa, Artificial Sequence
  Description of Artificial Sequence: Synthetic peptide
  Seed: MNPLETLSIT (PRAME_HUMAN)
MSPLETLSIV

SEQ ID NO: 157730 - protein, 10 aa, Artificial Sequence
  Description of Artificial Sequence: Synthetic peptide
  Seed: GITDDQLLAL (PRAME_HUMAN)
GMTDDQLLAW

SEQ ID NO: 157731 - protein, 10 aa, Artificial Sequence
  Description of Artificial Sequence: Synthetic peptide
  Seed: SNLTHVLYPV (PRAME_HUMAN)
SMLTHVLYPT

SEQ ID NO: 157732 - protein, 9 aa, Artificial Sequence
  Description of Artificial Sequence: Synthetic peptide
  Seed: QSRYISMSV (PRAME_HUMAN)
QPRYISMSL

SEQ ID NO: 157733 - protein, 9 aa, Artificial Sequence
  Description of Artificial Sequence: Synthetic peptide
  Seed: THVLYPVPL (PRAME_HUMAN)
THVLYPVPA

SEQ ID NO: 157734 - protein, 9 aa, Artificial Sequence
  Description of Artificial Sequence: Synthetic peptide
  Seed: VSPEPLQAL (PRAME_HUMAN)
VPPEPLQAM

SEQ ID NO: 157735 - protein, 9 aa, Artificial Sequence
  Description of Artificial Sequence: Synthetic peptide
  Seed: SFYGNSISI (PRAME_HUMAN)
SMYGNSISL

SEQ ID NO: 157736 - protein, 9 aa, Artificial Sequence
  Description of Artificial Sequence: Synthetic peptide
  Seed: HVMNPLETL (PRAME_HUMAN)
HQMNPLETW

SEQ ID NO: 157737 - protein, 9 aa, Artificial Sequence
  Description of Artificial Sequence: Synthetic peptide
  Seed: YGNSISISA (PRAME_HUMAN)
YVNSISISY

SEQ ID NO: 157738 - protein, 11 aa, Artificial Sequence
  Description of Artificial Sequence: Synthetic peptide
  Seed: ESYEDIHGTLH (PRAME_HUMAN)
EAYEDIHGTLR

SEQ ID NO: 157739 - protein, 9 aa, Artificial Sequence
  Description of Artificial Sequence: Synthetic peptide
  Seed: SVLSLSGVM (PRAME_HUMAN)
STLSLSGVW

SEQ ID NO: 157740 - protein, 9 aa, Artificial Sequence
  Description of Artificial Sequence: Synthetic peptide
  Seed: RLAYLHARL (PRAME_HUMAN)
REAYLHARF

SEQ ID NO: 157741 - protein, 10 aa, Artificial Sequence
  Description of Artificial Sequence: Synthetic peptide
  Seed: FFLRGRLDQL (PRAME_HUMAN)
FILRGRLDQI

SEQ ID NO: 157742 - protein, 9 aa, Artificial Sequence
  Description of Artificial Sequence: Synthetic peptide
  Seed: KLQVLDLRK (PRAME_HUMAN)
KYQVLDLRR

SEQ ID NO: 157743 - protein, 10 aa, Artificial Sequence
  Description of Artificial Sequence: Synthetic peptide
  Seed: LSVLSLSGVM (PRAME_HUMAN)
LCVLSLSGVY

SEQ ID NO: 157744 - protein, 10 aa, Artificial Sequence
  Description of Artificial Sequence: Synthetic peptide
  Seed: GLSNLTHVLY (PRAME_HUMAN)
GMSNLTHVLM

SEQ ID NO: 157745 - protein, 9 aa, Artificial Sequence
  Description of Artificial Sequence: Synthetic peptide
  Seed: YSFPEPEAA (PRAME_HUMAN)
YMFPEPEAM

SEQ ID NO: 157746 - protein, 10 aa, Artificial Sequence
  Description of Artificial Sequence: Synthetic peptide
  Seed: RRRLWGSIQS (PRAME_HUMAN)
RLRLWGSIQK

SEQ ID NO: 157747 - protein, 9 aa, Artificial Sequence
  Description of Artificial Sequence: Synthetic peptide
  Seed: SALQSLLQH (PRAME_HUMAN)
SLLQSLLQY

SEQ ID NO: 157748 - protein, 11 aa, Artificial Sequence
  Description of Artificial Sequence: Synthetic peptide
  Seed: DVLLAQEVRPR (PRAME_HUMAN)
DTLLAQEVRPR

SEQ ID NO: 157749 - protein, 9 aa, Artificial Sequence
  Description of Artificial Sequence: Synthetic peptide
  Seed: FTCLPLGVL (PRAME_HUMAN)
FICLPLGVF

SEQ ID NO: 157750 - protein, 9 aa, Artificial Sequence
  Description of Artificial Sequence: Synthetic peptide
  Seed: SALQSLLQH (PRAME_HUMAN)
SLLQSLLQM

SEQ ID NO: 157751 - protein, 10 aa, Artificial Sequence
  Description of Artificial Sequence: Synthetic peptide
  Seed: RELFPPLFMA (PRAME_HUMAN)
RELFPPLFMM

SEQ ID NO: 157752 - protein, 10 aa, Artificial Sequence
  Description of Artificial Sequence: Synthetic peptide
  Seed: LETLSITNCR (PRAME_HUMAN)
LITLSITNCR

SEQ ID NO: 157753 - protein, 9 aa, Artificial Sequence
  Description of Artificial Sequence: Synthetic peptide
  Seed: ALQSLLQHL (PRAME_HUMAN)
ASQSLLQHL

SEQ ID NO: 157754 - protein, 9 aa, Artificial Sequence
  Description of Artificial Sequence: Synthetic peptide
  Seed: MINLRRLLL (PRAME_HUMAN)
MANLRRLLL

SEQ ID NO: 157755 - protein, 11 aa, Artificial Sequence
  Description of Artificial Sequence: Synthetic peptide
  Seed: ELLPRELFPPL (PRAME_HUMAN)
EMLPRELFPPV

SEQ ID NO: 157756 - protein, 10 aa, Artificial Sequence
  Description of Artificial Sequence: Synthetic peptide
  Seed: FTCLPLGVLM (PRAME_HUMAN)
FACLPLGVLW

SEQ ID NO: 157757 - protein, 8 aa, Artificial Sequence
  Description of Artificial Sequence: Synthetic peptide
  Seed: FTSQFLSL (PRAME_HUMAN)
FTSQFLSM

SEQ ID NO: 157758 - protein, 10 aa, Artificial Sequence
  Description of Artificial Sequence: Synthetic peptide
  Seed: MPMQDIKMIL (PRAME_HUMAN)
MPMQDIKMIP

SEQ ID NO: 157759 - protein, 9 aa, Artificial Sequence
  Description of Artificial Sequence: Synthetic peptide
  Seed: SISALQSLL (PRAME_HUMAN)
SMSALQSLR

SEQ ID NO: 157760 - protein, 10 aa, Artificial Sequence
  Description of Artificial Sequence: Synthetic peptide
  Seed: IQSRYISMSV (PRAME_HUMAN)
IDSRYISMSK

SEQ ID NO: 157761 - protein, 10 aa, Artificial Sequence
  Description of Artificial Sequence: Synthetic peptide
  Seed: RELFPPLFMA (PRAME_HUMAN)
RKLFPPLFMI

SEQ ID NO: 157762 - protein, 9 aa, Artificial Sequence
  Description of Artificial Sequence: Synthetic peptide
  Seed: SFYGNSISI (PRAME_HUMAN)
SHYGNSISM

SEQ ID NO: 157763 - protein, 10 aa, Artificial Sequence
  Description of Artificial Sequence: Synthetic peptide
  Seed: GRPSMVWLSA (PRAME_HUMAN)
GRPSMVWLSI

SEQ ID NO: 157764 - protein, 9 aa, Artificial Sequence
  Description of Artificial Sequence: Synthetic peptide
  Seed: GLSNLTHVL (PRAME_HUMAN)
GLSNLTHVW

SEQ ID NO: 157765 - protein, 10 aa, Artificial Sequence
  Description of Artificial Sequence: Synthetic peptide
  Seed: SVSQLSVLSL (PRAME_HUMAN)
SMSQLSVLSW

SEQ ID NO: 157766 - protein, 9 aa, Artificial Sequence
  Description of Artificial Sequence: Synthetic peptide
  Seed: RHSQTLKAM (PRAME_HUMAN)
RESQTLKAM

SEQ ID NO: 157767 - protein, 9 aa, Artificial Sequence
  Description of Artificial Sequence: Synthetic peptide
  Seed: VLDGLDVLL (PRAME_HUMAN)
VTDGLDVLI

SEQ ID NO: 157768 - protein, 10 aa, Artificial Sequence
  Description of Artificial Sequence: Synthetic peptide
  Seed: LSHIHASSYI (PRAME_HUMAN)
LMHIHASSYW

SEQ ID NO: 157769 - protein, 10 aa, Artificial Sequence
  Description of Artificial Sequence: Synthetic peptide
  Seed: FFLRGRLDQL (PRAME_HUMAN)
FYLRGRLDQA

SEQ ID NO: 157770 - protein, 9 aa, Artificial Sequence
  Description of Artificial Sequence: Synthetic peptide
  Seed: SISALQSLL (PRAME_HUMAN)
SMSALQSLL

SEQ ID NO: 157771 - protein, 9 aa, Artificial Sequence
  Description of Artificial Sequence: Synthetic peptide
  Seed: LLLSHIHAS (PRAME_HUMAN)
LLLSHIHAT

SEQ ID NO: 157772 - protein, 10 aa, Artificial Sequence
  Description of Artificial Sequence: Synthetic peptide
  Seed: MVQAWPFTCL (PRAME_HUMAN)
MHQAWPFTCV

SEQ ID NO: 157773 - protein, 10 aa, Artificial Sequence
  Description of Artificial Sequence: Synthetic peptide
  Seed: SLYSFPEPEA (PRAME_HUMAN)
SIYSFPEPEV

SEQ ID NO: 157774 - protein, 9 aa, Artificial Sequence
  Description of Artificial Sequence: Synthetic peptide
  Seed: QSRYISMSV (PRAME_HUMAN)
QQRYISMSK

SEQ ID NO: 157775 - protein, 10 aa, Artificial Sequence
  Description of Artificial Sequence: Synthetic peptide
  Seed: LSFYGNSISI (PRAME_HUMAN)
LKFYGNSISM

SEQ ID NO: 157776 - protein, 10 aa, Artificial Sequence
  Description of Artificial Sequence: Synthetic peptide
  Seed: ALYVDSLFFL (PRAME_HUMAN)
AVYVDSLFFK

SEQ ID NO: 157777 - protein, 9 aa, Artificial Sequence
  Description of Artificial Sequence: Synthetic peptide
  Seed: KAMVQAWPF (PRAME_HUMAN)
KYMVQAWPM

SEQ ID NO: 157778 - protein, 9 aa, Artificial Sequence
  Description of Artificial Sequence: Synthetic peptide
  Seed: SATLQDLVF (PRAME_HUMAN)
SPTLQDLVY

SEQ ID NO: 157779 - protein, 8 aa, Artificial Sequence
  Description of Artificial Sequence: Synthetic peptide
  Seed: TLAKFSPY (PRAME_HUMAN)
TQAKFSPM

SEQ ID NO: 157780 - protein, 9 aa, Artificial Sequence
  Description of Artificial Sequence: Synthetic peptide
  Seed: MINLRRLLL (PRAME_HUMAN)
MLNLRRLLA

SEQ ID NO: 157781 - protein, 9 aa, Artificial Sequence
  Description of Artificial Sequence: Synthetic peptide
  Seed: YVDSLFFLR (PRAME_HUMAN)
YLDSLFFLK

SEQ ID NO: 157782 - protein, 9 aa, Artificial Sequence
  Description of Artificial Sequence: Synthetic peptide
  Seed: YIAQFTSQF (PRAME_HUMAN)
YMAQFTSQS

SEQ ID NO: 157783 - protein, 9 aa, Artificial Sequence
  Description of Artificial Sequence: Synthetic peptide
  Seed: SLQCLQALY (PRAME_HUMAN)
SMQCLQALK

SEQ ID NO: 157784 - protein, 9 aa, Artificial Sequence
  Description of Artificial Sequence: Synthetic peptide
  Seed: SRYISMSVW (PRAME_HUMAN)
SKYISMSVL

SEQ ID NO: 157785 - protein, 9 aa, Artificial Sequence
  Description of Artificial Sequence: Synthetic peptide
  Seed: SLQCLQALY (PRAME_HUMAN)
SMQCLQALR

SEQ ID NO: 157786 - protein, 9 aa, Artificial Sequence
  Description of Artificial Sequence: Synthetic peptide
  Seed: YLIEKVKRK (PRAME_HUMAN)
YTIEKVKRK

SEQ ID NO: 157787 - protein, 10 aa, Artificial Sequence
  Description of Artificial Sequence: Synthetic peptide
  Seed: ARLRELLCEL (PRAME_HUMAN)
AVLRELLCEL

SEQ ID NO: 157788 - protein, 10 aa, Artificial Sequence
  Description of Artificial Sequence: Synthetic peptide
  Seed: IKMILKMVQL (PRAME_HUMAN)
IVMILKMVQV

SEQ ID NO: 157789 - protein, 10 aa, Artificial Sequence
  Description of Artificial Sequence: Synthetic peptide
  Seed: LQALYVDSLF (PRAME_HUMAN)
LMALYVDSLF

SEQ ID NO: 157790 - protein, 11 aa, Artificial Sequence
  Description of Artificial Sequence: Synthetic peptide
  Seed: ISALQSLLQHL (PRAME_HUMAN)
ILALQSLLQHL

SEQ ID NO: 157791 - protein, 10 aa, Artificial Sequence
  Description of Artificial Sequence: Synthetic peptide
  Seed: SNLTHVLYPV (PRAME_HUMAN)
SDLTHVLYPA

SEQ ID NO: 157792 - protein, 11 aa, Artificial Sequence
  Description of Artificial Sequence: Synthetic peptide
  Seed: SQSPSVSQLSV (PRAME_HUMAN)
SQSPSVSQLSM

SEQ ID NO: 157793 - protein, 9 aa, Artificial Sequence
  Description of Artificial Sequence: Synthetic peptide
  Seed: AMVQAWPFT (PRAME_HUMAN)
AQVQAWPFI

SEQ ID NO: 157794 - protein, 10 aa, Artificial Sequence
  Description of Artificial Sequence: Synthetic peptide
  Seed: AYLHARLREL (PRAME_HUMAN)
AELHARLREV

SEQ ID NO: 157795 - protein, 11 aa, Artificial Sequence
  Description of Artificial Sequence: Synthetic peptide
  Seed: QALYVDSLFFL (PRAME_HUMAN)
QKLYVDSLFFL

SEQ ID NO: 157796 - protein, 9 aa, Artificial Sequence
  Description of Artificial Sequence: Synthetic peptide
  Seed: FWTVWSGNR (PRAME_HUMAN)
FTTVWSGNR

SEQ ID NO: 157797 - protein, 9 aa, Artificial Sequence
  Description of Artificial Sequence: Synthetic peptide
  Seed: KAMVQAWPF (PRAME_HUMAN)
KQMVQAWPY

SEQ ID NO: 157798 - protein, 10 aa, Artificial Sequence
  Description of Artificial Sequence: Synthetic peptide
  Seed: YIAQFTSQFL (PRAME_HUMAN)
YQAQFTSQFA

SEQ ID NO: 157799 - protein, 8 aa, Artificial Sequence
  Description of Artificial Sequence: Synthetic peptide
  Seed: MINLRRLL (PRAME_HUMAN)
MPNLRRLI

SEQ ID NO: 157800 - protein, 10 aa, Artificial Sequence
  Description of Artificial Sequence: Synthetic peptide
  Seed: ALYVDSLFFL (PRAME_HUMAN)
AVYVDSLFFI

SEQ ID NO: 157801 - protein, 10 aa, Artificial Sequence
  Description of Artificial Sequence: Synthetic peptide
  Seed: RGRLDQLLRH (PRAME_HUMAN)
RKRLDQLLRF

SEQ ID NO: 157802 - protein, 9 aa, Artificial Sequence
  Description of Artificial Sequence: Synthetic peptide
  Seed: RLWGSIQSR (PRAME_HUMAN)
RWWGSIQSR

SEQ ID NO: 157803 - protein, 9 aa, Artificial Sequence
  Description of Artificial Sequence: Synthetic peptide
  Seed: ISPEKEEQY (PRAME_HUMAN)
ISPEKEEQF

SEQ ID NO: 157804 - protein, 10 aa, Artificial Sequence
  Description of Artificial Sequence: Synthetic peptide
  Seed: ESYEDIHGTL (PRAME_HUMAN)
EVYEDIHGTI

SEQ ID NO: 157805 - protein, 9 aa, Artificial Sequence
  Description of Artificial Sequence: Synthetic peptide
  Seed: LLRHVMNPL (PRAME_HUMAN)
LPRHVMNPV

SEQ ID NO: 157806 - protein, 10 aa, Artificial Sequence
  Description of Artificial Sequence: Synthetic peptide
  Seed: PTLAKFSPYL (PRAME_HUMAN)
PLLAKFSPYI

SEQ ID NO: 157807 - protein, 9 aa, Artificial Sequence
  Description of Artificial Sequence: Synthetic peptide
  Seed: LALLPSLSH (PRAME_HUMAN)
LTLLPSLSK

SEQ ID NO: 157808 - protein, 11 aa, Artificial Sequence
  Description of Artificial Sequence: Synthetic peptide
  Seed: IAQFTSQFLSL (PRAME_HUMAN)
IIQFTSQFLSY

SEQ ID NO: 157809 - protein, 9 aa, Artificial Sequence
  Description of Artificial Sequence: Synthetic peptide
  Seed: ALQSLLQHL (PRAME_HUMAN)
AQQSLLQHI

SEQ ID NO: 157810 - protein, 11 aa, Artificial Sequence
  Description of Artificial Sequence: Synthetic peptide
  Seed: DFWTVWSGNRA (PRAME_HUMAN)
DFWTVWSGNRR

SEQ ID NO: 157811 - protein, 10 aa, Artificial Sequence
  Description of Artificial Sequence: Synthetic peptide
  Seed: YISPEKEEQY (PRAME_HUMAN)
YRSPEKEEQY

SEQ ID NO: 157812 - protein, 11 aa, Artificial Sequence
  Description of Artificial Sequence: Synthetic peptide
  Seed: IAQFTSQFLSL (PRAME_HUMAN)
IKQFTSQFLSF

SEQ ID NO: 157813 - protein, 9 aa, Artificial Sequence
  Description of Artificial Sequence: Synthetic peptide
  Seed: NVLRLCCKK (PRAME_HUMAN)
NTLRLCCKR

SEQ ID NO: 157814 - protein, 11 aa, Artificial Sequence
  Description of Artificial Sequence: Synthetic peptide
  Seed: ALYVDSLFFLR (PRAME_HUMAN)
ALYVDSLFFLY

SEQ ID NO: 157815 - protein, 10 aa, Artificial Sequence
  Description of Artificial Sequence: Synthetic peptide
  Seed: KFSPYLGQMI (PRAME_HUMAN)
KYSPYLGQMF

SEQ ID NO: 157816 - protein, 10 aa, Artificial Sequence
  Description of Artificial Sequence: Synthetic peptide
  Seed: SPYLGQMINL (PRAME_HUMAN)
SPYLGQMINM

SEQ ID NO: 157817 - protein, 10 aa, Artificial Sequence
  Description of Artificial Sequence: Synthetic peptide
  Seed: DIHGTLHLER (PRAME_HUMAN)
DSHGTLHLEK

SEQ ID NO: 157818 - protein, 9 aa, Artificial Sequence
  Description of Artificial Sequence: Synthetic peptide
  Seed: RLRELLCEL (PRAME_HUMAN)
RPRELLCEF

SEQ ID NO: 157819 - protein, 10 aa, Artificial Sequence
  Description of Artificial Sequence: Synthetic peptide
  Seed: RELFPPLFMA (PRAME_HUMAN)
RTLFPPLFMI

SEQ ID NO: 157820 - protein, 10 aa, Artificial Sequence
  Description of Artificial Sequence: Synthetic peptide
  Seed: FLSLQCLQAL (PRAME_HUMAN)
FQSLQCLQAL

SEQ ID NO: 157821 - protein, 9 aa, Artificial Sequence
  Description of Artificial Sequence: Synthetic peptide
  Seed: RRWKLQVLD (PRAME_HUMAN)
RRWKLQVLY

SEQ ID NO: 157822 - protein, 11 aa, Artificial Sequence
  Description of Artificial Sequence: Synthetic peptide
  Seed: RLVELAGQSLL (PRAME_HUMAN)
RTVELAGQSLF

SEQ ID NO: 157823 - protein, 9 aa, Artificial Sequence
  Description of Artificial Sequence: Synthetic peptide
  Seed: TLAKFSPYL (PRAME_HUMAN)
TSAKFSPYI

SEQ ID NO: 157824 - protein, 8 aa, Artificial Sequence
  Description of Artificial Sequence: Synthetic peptide
  Seed: DEALAIAA (PRAME_HUMAN)
DEALAIAM

SEQ ID NO: 157825 - protein, 9 aa, Artificial Sequence
  Description of Artificial Sequence: Synthetic peptide
  Seed: LQDLVFDEC (PRAME_HUMAN)
LVDLVFDEI

SEQ ID NO: 157826 - protein, 9 aa, Artificial Sequence
  Description of Artificial Sequence: Synthetic peptide
  Seed: ALLERASAT (PRAME_HUMAN)
AQLERASAI

SEQ ID NO: 157827 - protein, 11 aa, Artificial Sequence
  Description of Artificial Sequence: Synthetic peptide
  Seed: IAQFTSQFLSL (PRAME_HUMAN)
IHQFTSQFLSF

SEQ ID NO: 157828 - protein, 8 aa, Artificial Sequence
  Description of Artificial Sequence: Synthetic peptide
  Seed: VSPEPLQA (PRAME_HUMAN)
VIPEPLQL

SEQ ID NO: 157829 - protein, 9 aa, Artificial Sequence
  Description of Artificial Sequence: Synthetic peptide
  Seed: LSHIHASSY (PRAME_HUMAN)
LQHIHASSH

SEQ ID NO: 157830 - protein, 9 aa, Artificial Sequence
  Description of Artificial Sequence: Synthetic peptide
  Seed: LAQEVRPRR (PRAME_HUMAN)
LYQEVRPRR

SEQ ID NO: 157831 - protein, 10 aa, Artificial Sequence
  Description of Artificial Sequence: Synthetic peptide
  Seed: LIGLSNLTHV (PRAME_HUMAN)
LMGLSNLTHA

SEQ ID NO: 157832 - protein, 8 aa, Artificial Sequence
  Description of Artificial Sequence: Synthetic peptide
  Seed: MINLRRLL (PRAME_HUMAN)
MQNLRRLL

SEQ ID NO: 157833 - protein, 10 aa, Artificial Sequence
  Description of Artificial Sequence: Synthetic peptide
  Seed: MVQAWPFTCL (PRAME_HUMAN)
MTQAWPFTCI

SEQ ID NO: 157834 - protein, 10 aa, Artificial Sequence
  Description of Artificial Sequence: Synthetic peptide
  Seed: RELFPPLFMA (PRAME_HUMAN)
RELFPPLFMI

SEQ ID NO: 157835 - protein, 10 aa, Artificial Sequence
  Description of Artificial Sequence: Synthetic peptide
  Seed: AQFTSQFLSL (PRAME_HUMAN)
AVFTSQFLSF

SEQ ID NO: 157836 - protein, 9 aa, Artificial Sequence
  Description of Artificial Sequence: Synthetic peptide
  Seed: GRLDQLLRH (PRAME_HUMAN)
GRLDQLLRM

SEQ ID NO: 157837 - protein, 9 aa, Artificial Sequence
  Description of Artificial Sequence: Synthetic peptide
  Seed: LLRHVMNPL (PRAME_HUMAN)
LERHVMNPY

SEQ ID NO: 157838 - protein, 10 aa, Artificial Sequence
  Description of Artificial Sequence: Synthetic peptide
  Seed: QALYVDSLFF (PRAME_HUMAN)
QSLYVDSLFY

SEQ ID NO: 157839 - protein, 9 aa, Artificial Sequence
  Description of Artificial Sequence: Synthetic peptide
  Seed: RPSMVWLSA (PRAME_HUMAN)
RPSMVWLST

SEQ ID NO: 157840 - protein, 9 aa, Artificial Sequence
  Description of Artificial Sequence: Synthetic peptide
  Seed: YPVPLESYE (PRAME_HUMAN)
YAVPLESYM

SEQ ID NO: 157841 - protein, 10 aa, Artificial Sequence
  Description of Artificial Sequence: Synthetic peptide
  Seed: ITDDQLLALL (PRAME_HUMAN)
IADDQLLALF

SEQ ID NO: 157842 - protein, 9 aa, Artificial Sequence
  Description of Artificial Sequence: Synthetic peptide
  Seed: VLMKGQHLH (PRAME_HUMAN)
VVMKGQHLY

SEQ ID NO: 157843 - protein, 9 aa, Artificial Sequence
  Description of Artificial Sequence: Synthetic peptide
  Seed: VSPEPLQAL (PRAME_HUMAN)
VGPEPLQAL

SEQ ID NO: 157844 - protein, 9 aa, Artificial Sequence
  Description of Artificial Sequence: Synthetic peptide
  Seed: THVLYPVPL (PRAME_HUMAN)
TRVLYPVPY

SEQ ID NO: 157845 - protein, 11 aa, Artificial Sequence
  Description of Artificial Sequence: Synthetic peptide
  Seed: RELFPPLFMAA (PRAME_HUMAN)
RYLFPPLFMAM

SEQ ID NO: 157846 - protein, 9 aa, Artificial Sequence
  Description of Artificial Sequence: Synthetic peptide
  Seed: RASATLQDL (PRAME_HUMAN)
RRSATLQDM

SEQ ID NO: 157847 - protein, 10 aa, Artificial Sequence
  Description of Artificial Sequence: Synthetic peptide
  Seed: CTWKLPTLAK (PRAME_HUMAN)
CQWKLPTLAR

SEQ ID NO: 157848 - protein, 10 aa, Artificial Sequence
  Description of Artificial Sequence: Synthetic peptide
  Seed: FLSLQCLQAL (PRAME_HUMAN)
FLSLQCLQAV

SEQ ID NO: 157849 - protein, 10 aa, Artificial Sequence
  Description of Artificial Sequence: Synthetic peptide
  Seed: IKMILKMVQL (PRAME_HUMAN)
ISMILKMVQV

SEQ ID NO: 157850 - protein, 10 aa, Artificial Sequence
  Description of Artificial Sequence: Synthetic peptide
  Seed: RLSEGDVMHL (PRAME_HUMAN)
RLSEGDVMHA

SEQ ID NO: 157851 - protein, 9 aa, Artificial Sequence
  Description of Artificial Sequence: Synthetic peptide
  Seed: RWKLQVLDL (PRAME_HUMAN)
RYKLQVLDL

SEQ ID NO: 157852 - protein, 9 aa, Artificial Sequence
  Description of Artificial Sequence: Synthetic peptide
  Seed: CSQLTTLSF (PRAME_HUMAN)
CVQLTTLSF

SEQ ID NO: 157853 - protein, 9 aa, Artificial Sequence
  Description of Artificial Sequence: Synthetic peptide
  Seed: EAAQPMTKK (PRAME_HUMAN)
EWAQPMTKR

SEQ ID NO: 157854 - protein, 9 aa, Artificial Sequence
  Description of Artificial Sequence: Synthetic peptide
  Seed: LQDLVFDEC (PRAME_HUMAN)
LLDLVFDEL

SEQ ID NO: 157855 - protein, 9 aa, Artificial Sequence
  Description of Artificial Sequence: Synthetic peptide
  Seed: SHCSQLTTL (PRAME_HUMAN)
SHCSQLTTM

SEQ ID NO: 157856 - protein, 9 aa, Artificial Sequence
  Description of Artificial Sequence: Synthetic peptide
  Seed: DEALAIAAL (PRAME_HUMAN)
DHALAIAAM

SEQ ID NO: 157857 - protein, 9 aa, Artificial Sequence
  Description of Artificial Sequence: Synthetic peptide
  Seed: MNPLETLSI (PRAME_HUMAN)
MNPLETLSL

SEQ ID NO: 157858 - protein, 9 aa, Artificial Sequence
  Description of Artificial Sequence: Synthetic peptide
  Seed: ALYVDSLFF (PRAME_HUMAN)
AEYVDSLFF

SEQ ID NO: 157859 - protein, 9 aa, Artificial Sequence
  Description of Artificial Sequence: Synthetic peptide
  Seed: RLRELLCEL (PRAME_HUMAN)
RSRELLCET

SEQ ID NO: 157860 - protein, 8 aa, Artificial Sequence
  Description of Artificial Sequence: Synthetic peptide
  Seed: MQDIKMIL (PRAME_HUMAN)
MFDIKMIL

SEQ ID NO: 157861 - protein, 9 aa, Artificial Sequence
  Description of Artificial Sequence: Synthetic peptide
  Seed: NSHQDFWTV (PRAME_HUMAN)
NLHQDFWTV

SEQ ID NO: 157862 - protein, 11 aa, Artificial Sequence
  Description of Artificial Sequence: Synthetic peptide
  Seed: SIEDLEVTCTW (PRAME_HUMAN)
SQEDLEVTCTF

SEQ ID NO: 157863 - protein, 9 aa, Artificial Sequence
  Description of Artificial Sequence: Synthetic peptide
  Seed: LYVDSLFFL (PRAME_HUMAN)
LVVDSLFFM

SEQ ID NO: 157864 - protein, 9 aa, Artificial Sequence
  Description of Artificial Sequence: Synthetic peptide
  Seed: CELGRPSMV (PRAME_HUMAN)
CELGRPSMA

SEQ ID NO: 157865 - protein, 11 aa, Artificial Sequence
  Description of Artificial Sequence: Synthetic peptide
  Seed: RLWGSIQSRYI (PRAME_HUMAN)
RSWGSIQSRYW

SEQ ID NO: 157866 - protein, 10 aa, Artificial Sequence
  Description of Artificial Sequence: Synthetic peptide
  Seed: FYDPEPILCP (PRAME_HUMAN)
FSDPEPILCL

SEQ ID NO: 157867 - protein, 9 aa, Artificial Sequence
  Description of Artificial Sequence: Synthetic peptide
  Seed: LLALLPSLS (PRAME_HUMAN)
LMALLPSLL

SEQ ID NO: 157868 - protein, 10 aa, Artificial Sequence
  Description of Artificial Sequence: Synthetic peptide
  Seed: HCSQLTTLSF (PRAME_HUMAN)
HSSQLTTLSY

SEQ ID NO: 157869 - protein, 9 aa, Artificial Sequence
  Description of Artificial Sequence: Synthetic peptide
  Seed: ISPEKEEQY (PRAME_HUMAN)
ISPEKEEQI

SEQ ID NO: 157870 - protein, 9 aa, Artificial Sequence
  Description of Artificial Sequence: Synthetic peptide
  Seed: ISPEKEEQY (PRAME_HUMAN)
IVPEKEEQI

SEQ ID NO: 157871 - protein, 9 aa, Artificial Sequence
  Description of Artificial Sequence: Synthetic peptide
  Seed: SHQDFWTVW (PRAME_HUMAN)
SWQDFWTVF

SEQ ID NO: 157872 - protein, 10 aa, Artificial Sequence
  Description of Artificial Sequence: Synthetic peptide
  Seed: QSLLQHLIGL (PRAME_HUMAN)
QELLQHLIGV

SEQ ID NO: 157873 - protein, 10 aa, Artificial Sequence
  Description of Artificial Sequence: Synthetic peptide
  Seed: ALYVDSLFFL (PRAME_HUMAN)
AVYVDSLFFA

SEQ ID NO: 157874 - protein, 9 aa, Artificial Sequence
  Description of Artificial Sequence: Synthetic peptide
  Seed: ASSYISPEK (PRAME_HUMAN)
ATSYISPEK

SEQ ID NO: 157875 - protein, 9 aa, Artificial Sequence
  Description of Artificial Sequence: Synthetic peptide
  Seed: RLDQLLRHV (PRAME_HUMAN)
RIDQLLRHL

SEQ ID NO: 157876 - protein, 9 aa, Artificial Sequence
  Description of Artificial Sequence: Synthetic peptide
  Seed: TLAKFSPYL (PRAME_HUMAN)
TVAKFSPYW

SEQ ID NO: 157877 - protein, 9 aa, Artificial Sequence
  Description of Artificial Sequence: Synthetic peptide
  Seed: RELFPPLFM (PRAME_HUMAN)
RILFPPLFF

SEQ ID NO: 157878 - protein, 10 aa, Artificial Sequence
  Description of Artificial Sequence: Synthetic peptide
  Seed: AEQPFIPVEV (PRAME_HUMAN)
AEQPFIPVEC

SEQ ID NO: 157879 - protein, 9 aa, Artificial Sequence
  Description of Artificial Sequence: Synthetic peptide
  Seed: SPSVSQLSV (PRAME_HUMAN)
SHSVSQLSA

SEQ ID NO: 157880 - protein, 9 aa, Artificial Sequence
  Description of Artificial Sequence: Synthetic peptide
  Seed: YVDSLFFLR (PRAME_HUMAN)
YTDSLFFLF

SEQ ID NO: 157881 - protein, 10 aa, Artificial Sequence
  Description of Artificial Sequence: Synthetic peptide
  Seed: DFWTVWSGNR (PRAME_HUMAN)
DWWTVWSGNR

SEQ ID NO: 157882 - protein, 11 aa, Artificial Sequence
  Description of Artificial Sequence: Synthetic peptide
  Seed: IQSRYISMSVW (PRAME_HUMAN)
IKSRYISMSVY

SEQ ID NO: 157883 - protein, 9 aa, Artificial Sequence
  Description of Artificial Sequence: Synthetic peptide
  Seed: FTCLPLGVL (PRAME_HUMAN)
FMCLPLGVV

SEQ ID NO: 157884 - protein, 9 aa, Artificial Sequence
  Description of Artificial Sequence: Synthetic peptide
  Seed: YSFPEPEAA (PRAME_HUMAN)
YEFPEPEAY

SEQ ID NO: 157885 - protein, 9 aa, Artificial Sequence
  Description of Artificial Sequence: Synthetic peptide
  Seed: LKMVQLDSI (PRAME_HUMAN)
LQMVQLDSY

SEQ ID NO: 157886 - protein, 10 aa, Artificial Sequence
  Description of Artificial Sequence: Synthetic peptide
  Seed: FFLRGRLDQL (PRAME_HUMAN)
FPLRGRLDQI

SEQ ID NO: 157887 - protein, 10 aa, Artificial Sequence
  Description of Artificial Sequence: Synthetic peptide
  Seed: ALYVDSLFFL (PRAME_HUMAN)
ADYVDSLFFW

SEQ ID NO: 157888 - protein, 9 aa, Artificial Sequence
  Description of Artificial Sequence: Synthetic peptide
  Seed: YLHARLREL (PRAME_HUMAN)
YVHARLREA

SEQ ID NO: 157889 - protein, 10 aa, Artificial Sequence
  Description of Artificial Sequence: Synthetic peptide
  Seed: RGRLDQLLRH (PRAME_HUMAN)
RYRLDQLLRR

SEQ ID NO: 157890 - protein, 9 aa, Artificial Sequence
  Description of Artificial Sequence: Synthetic peptide
  Seed: GRHSQTLKA (PRAME_HUMAN)
GRHSQTLKL

SEQ ID NO: 157891 - protein, 10 aa, Artificial Sequence
  Description of Artificial Sequence: Synthetic peptide
  Seed: FIPVEVLVDL (PRAME_HUMAN)
FVPVEVLVDW

SEQ ID NO: 157892 - protein, 10 aa, Artificial Sequence
  Description of Artificial Sequence: Synthetic peptide
  Seed: LSVLSLSGVM (PRAME_HUMAN)
LGVLSLSGVY

SEQ ID NO: 157893 - protein, 9 aa, Artificial Sequence
  Description of Artificial Sequence: Synthetic peptide
  Seed: VFDECGITD (PRAME_HUMAN)
VYDECGITM

SEQ ID NO: 157894 - protein, 9 aa, Artificial Sequence
  Description of Artificial Sequence: Synthetic peptide
  Seed: MINLRRLLL (PRAME_HUMAN)
MMNLRRLLR

SEQ ID NO: 157895 - protein, 10 aa, Artificial Sequence
  Description of Artificial Sequence: Synthetic peptide
  Seed: KGQHLHLETF (PRAME_HUMAN)
KQQHLHLETF

SEQ ID NO: 157896 - protein, 10 aa, Artificial Sequence
  Description of Artificial Sequence: Synthetic peptide
  Seed: ALYVDSLFFL (PRAME_HUMAN)
ARYVDSLFFF

SEQ ID NO: 157897 - protein, 9 aa, Artificial Sequence
  Description of Artificial Sequence: Synthetic peptide
  Seed: YIAQFTSQF (PRAME_HUMAN)
YAAQFTSQL

SEQ ID NO: 157898 - protein, 9 aa, Artificial Sequence
  Description of Artificial Sequence: Synthetic peptide
  Seed: YLGQMINLR (PRAME_HUMAN)
YFGQMINLR

SEQ ID NO: 157899 - protein, 8 aa, Artificial Sequence
  Description of Artificial Sequence: Synthetic peptide
  Seed: ITDDQLLA (PRAME_HUMAN)
IIDDQLLF

SEQ ID NO: 157900 - protein, 9 aa, Artificial Sequence
  Description of Artificial Sequence: Synthetic peptide
  Seed: LSVLSLSGV (PRAME_HUMAN)
LVVLSLSGW

SEQ ID NO: 157901 - protein, 9 aa, Artificial Sequence
  Description of Artificial Sequence: Synthetic peptide
  Seed: TFYDPEPIL (PRAME_HUMAN)
TYYDPEPIM

SEQ ID NO: 157902 - protein, 9 aa, Artificial Sequence
  Description of Artificial Sequence: Synthetic peptide
  Seed: SLLQHLIGL (PRAME_HUMAN)
SLLQHLIGW

SEQ ID NO: 157903 - protein, 10 aa, Artificial Sequence
  Description of Artificial Sequence: Synthetic peptide
  Seed: LSVLSLSGVM (PRAME_HUMAN)
LTVLSLSGVF

SEQ ID NO: 157904 - protein, 9 aa, Artificial Sequence
  Description of Artificial Sequence: Synthetic peptide
  Seed: LLRHVMNPL (PRAME_HUMAN)
LVRHVMNPL

SEQ ID NO: 157905 - protein, 10 aa, Artificial Sequence
  Description of Artificial Sequence: Synthetic peptide
  Seed: RELFPPLFMA (PRAME_HUMAN)
RMLFPPLFML

SEQ ID NO: 157906 - protein, 9 aa, Artificial Sequence
  Description of Artificial Sequence: Synthetic peptide
  Seed: VLDGLDVLL (PRAME_HUMAN)
VQDGLDVLM

SEQ ID NO: 157907 - protein, 9 aa, Artificial Sequence
  Description of Artificial Sequence: Synthetic peptide
  Seed: RLCCKKLKI (PRAME_HUMAN)
RTCCKKLKW

SEQ ID NO: 157908 - protein, 11 aa, Artificial Sequence
  Description of Artificial Sequence: Synthetic peptide
  Seed: QALLERASATL (PRAME_HUMAN)
QKLLERASATV

SEQ ID NO: 157909 - protein, 9 aa, Artificial Sequence
  Description of Artificial Sequence: Synthetic peptide
  Seed: ITDDQLLAL (PRAME_HUMAN)
IADDQLLAF

SEQ ID NO: 157910 - protein, 11 aa, Artificial Sequence
  Description of Artificial Sequence: Synthetic peptide
  Seed: MKGQHLHLETF (PRAME_HUMAN)
MPGQHLHLETY

SEQ ID NO: 157911 - protein, 9 aa, Artificial Sequence
  Description of Artificial Sequence: Synthetic peptide
  Seed: KVDGLSTEA (PRAME_HUMAN)
KMDGLSTEI

SEQ ID NO: 157912 - protein, 9 aa, Artificial Sequence
  Description of Artificial Sequence: Synthetic peptide
  Seed: YLHARLREL (PRAME_HUMAN)
YMHARLREF

SEQ ID NO: 157913 - protein, 9 aa, Artificial Sequence
  Description of Artificial Sequence: Synthetic peptide
  Seed: YISMSVWTS (PRAME_HUMAN)
YMSMSVWTI

SEQ ID NO: 157914 - protein, 9 aa, Artificial Sequence
  Description of Artificial Sequence: Synthetic peptide
  Seed: KMILKMVQL (PRAME_HUMAN)
KSILKMVQI

SEQ ID NO: 157915 - protein, 9 aa, Artificial Sequence
  Description of Artificial Sequence: Synthetic peptide
  Seed: LQDLVFDEC (PRAME_HUMAN)
LLDLVFDEI

SEQ ID NO: 157916 - protein, 9 aa, Artificial Sequence
  Description of Artificial Sequence: Synthetic peptide
  Seed: VSQLSVLSL (PRAME_HUMAN)
VYQLSVLSF

SEQ ID NO: 157917 - protein, 9 aa, Artificial Sequence
  Description of Artificial Sequence: Synthetic peptide
  Seed: SQLTTLSFY (PRAME_HUMAN)
SSLTTLSFY

SEQ ID NO: 157918 - protein, 9 aa, Artificial Sequence
  Description of Artificial Sequence: Synthetic peptide
  Seed: ETLSITNCR (PRAME_HUMAN)
EYLSITNCK

SEQ ID NO: 157919 - protein, 9 aa, Artificial Sequence
  Description of Artificial Sequence: Synthetic peptide
  Seed: SFYGNSISI (PRAME_HUMAN)
SFYGNSISV

SEQ ID NO: 157920 - protein, 9 aa, Artificial Sequence
  Description of Artificial Sequence: Synthetic peptide
  Seed: SFYGNSISI (PRAME_HUMAN)
SYYGNSISI

SEQ ID NO: 157921 - protein, 9 aa, Artificial Sequence
  Description of Artificial Sequence: Synthetic peptide
  Seed: YGNSISISA (PRAME_HUMAN)
YQNSISISM

SEQ ID NO: 157922 - protein, 10 aa, Artificial Sequence
  Description of Artificial Sequence: Synthetic peptide
  Seed: KKLKIFAMPM (PRAME_HUMAN)
KELKIFAMPK

SEQ ID NO: 157923 - protein, 9 aa, Artificial Sequence
  Description of Artificial Sequence: Synthetic peptide
  Seed: RGRLDQLLR (PRAME_HUMAN)
RTRLDQLLF

SEQ ID NO: 157924 - protein, 9 aa, Artificial Sequence
  Description of Artificial Sequence: Synthetic peptide
  Seed: MINLRRLLL (PRAME_HUMAN)
MTNLRRLLK

SEQ ID NO: 157925 - protein, 10 aa, Artificial Sequence
  Description of Artificial Sequence: Synthetic peptide
  Seed: GRPSMVWLSA (PRAME_HUMAN)
GYPSMVWLSL

SEQ ID NO: 157926 - protein, 9 aa, Artificial Sequence
  Description of Artificial Sequence: Synthetic peptide
  Seed: SFYGNSISI (PRAME_HUMAN)
SRYGNSISV

SEQ ID NO: 157927 - protein, 10 aa, Artificial Sequence
  Description of Artificial Sequence: Synthetic peptide
  Seed: RRRLWGSIQS (PRAME_HUMAN)
RRRLWGSIQR

SEQ ID NO: 157928 - protein, 8 aa, Artificial Sequence
  Description of Artificial Sequence: Synthetic peptide
  Seed: FYDPEPIL (PRAME_HUMAN)
FMDPEPIM

SEQ ID NO: 157929 - protein, 9 aa, Artificial Sequence
  Description of Artificial Sequence: Synthetic peptide
  Seed: TFYDPEPIL (PRAME_HUMAN)
TSYDPEPIV

SEQ ID NO: 157930 - protein, 9 aa, Artificial Sequence
  Description of Artificial Sequence: Synthetic peptide
  Seed: MHLSQSPSV (PRAME_HUMAN)
MKLSQSPSM

SEQ ID NO: 157931 - protein, 9 aa, Artificial Sequence
  Description of Artificial Sequence: Synthetic peptide
  Seed: QFTSQFLSL (PRAME_HUMAN)
QATSQFLSL

SEQ ID NO: 157932 - protein, 11 aa, Artificial Sequence
  Description of Artificial Sequence: Synthetic peptide
  Seed: LLLSHIHASSY (PRAME_HUMAN)
LQLSHIHASSM

SEQ ID NO: 157933 - protein, 9 aa, Artificial Sequence
  Description of Artificial Sequence: Synthetic peptide
  Seed: WLSANPCPH (PRAME_HUMAN)
WMSANPCPL

SEQ ID NO: 157934 - protein, 9 aa, Artificial Sequence
  Description of Artificial Sequence: Synthetic peptide
  Seed: YSFPEPEAA (PRAME_HUMAN)
YLFPEPEAL

SEQ ID NO: 157935 - protein, 10 aa, Artificial Sequence
  Description of Artificial Sequence: Synthetic peptide
  Seed: MTKKRKVDGL (PRAME_HUMAN)
MPKKRKVDGL

SEQ ID NO: 157936 - protein, 11 aa, Artificial Sequence
  Description of Artificial Sequence: Synthetic peptide
  Seed: KNSHQDFWTVW (PRAME_HUMAN)
KTSHQDFWTVW

SEQ ID NO: 157937 - protein, 9 aa, Artificial Sequence
  Description of Artificial Sequence: Synthetic peptide
  Seed: SQSPSVSQL (PRAME_HUMAN)
SSSPSVSQM

SEQ ID NO: 157938 - protein, 10 aa, Artificial Sequence
  Description of Artificial Sequence: Synthetic peptide
  Seed: SPYLGQMINL (PRAME_HUMAN)
SKYLGQMINF

SEQ ID NO: 157939 - protein, 9 aa, Artificial Sequence
  Description of Artificial Sequence: Synthetic peptide
  Seed: LQHLIGLSN (PRAME_HUMAN)
LHHLIGLSF

SEQ ID NO: 157940 - protein, 10 aa, Artificial Sequence
  Description of Artificial Sequence: Synthetic peptide
  Seed: MPMQDIKMIL (PRAME_HUMAN)
MVMQDIKMIL

SEQ ID NO: 157941 - protein, 10 aa, Artificial Sequence
  Description of Artificial Sequence: Synthetic peptide
  Seed: TSQFLSLQCL (PRAME_HUMAN)
TMQFLSLQCF

SEQ ID NO: 157942 - protein, 10 aa, Artificial Sequence
  Description of Artificial Sequence: Synthetic peptide
  Seed: VLYPVPLESY (PRAME_HUMAN)
VVYPVPLESY

SEQ ID NO: 157943 - protein, 9 aa, Artificial Sequence
  Description of Artificial Sequence: Synthetic peptide
  Seed: LSNLTHVLY (PRAME_HUMAN)
LANLTHVLF

SEQ ID NO: 157944 - protein, 9 aa, Artificial Sequence
  Description of Artificial Sequence: Synthetic peptide
  Seed: KLKIFAMPM (PRAME_HUMAN)
KFKIFAMPR

SEQ ID NO: 157945 - protein, 9 aa, Artificial Sequence
  Description of Artificial Sequence: Synthetic peptide
  Seed: LFPPLFMAA (PRAME_HUMAN)
LFPPLFMAF

SEQ ID NO: 157946 - protein, 8 aa, Artificial Sequence
  Description of Artificial Sequence: Synthetic peptide
  Seed: SQLSVLSL (PRAME_HUMAN)
SQLSVLSF

SEQ ID NO: 157947 - protein, 10 aa, Artificial Sequence
  Description of Artificial Sequence: Synthetic peptide
  Seed: LERLAYLHAR (PRAME_HUMAN)
LVRLAYLHAK

SEQ ID NO: 157948 - protein, 10 aa, Artificial Sequence
  Description of Artificial Sequence: Synthetic peptide
  Seed: VSPEPLQALL (PRAME_HUMAN)
VAPEPLQALY

SEQ ID NO: 157949 - protein, 9 aa, Artificial Sequence
  Description of Artificial Sequence: Synthetic peptide
  Seed: FDGRHSQTL (PRAME_HUMAN)
FHGRHSQTV

SEQ ID NO: 157950 - protein, 10 aa, Artificial Sequence
  Description of Artificial Sequence: Synthetic peptide
  Seed: SPYLGQMINL (PRAME_HUMAN)
SPYLGQMINF

SEQ ID NO: 157951 - protein, 9 aa, Artificial Sequence
  Description of Artificial Sequence: Synthetic peptide
  Seed: ISISALQSL (PRAME_HUMAN)
IMISALQSA

SEQ ID NO: 157952 - protein, 11 aa, Artificial Sequence
  Description of Artificial Sequence: Synthetic peptide
  Seed: IAQFTSQFLSL (PRAME_HUMAN)
IAQFTSQFLSF

SEQ ID NO: 157953 - protein, 9 aa, Artificial Sequence
  Description of Artificial Sequence: Synthetic peptide
  Seed: KMILKMVQL (PRAME_HUMAN)
KVILKMVQV

SEQ ID NO: 157954 - protein, 9 aa, Artificial Sequence
  Description of Artificial Sequence: Synthetic peptide
  Seed: KVDGLSTEA (PRAME_HUMAN)
KDDGLSTEL

SEQ ID NO: 157955 - protein, 10 aa, Artificial Sequence
  Description of Artificial Sequence: Synthetic peptide
  Seed: GACDELFSYL (PRAME_HUMAN)
GQCDELFSYM

SEQ ID NO: 157956 - protein, 9 aa, Artificial Sequence
  Description of Artificial Sequence: Synthetic peptide
  Seed: NLTHVLYPV (PRAME_HUMAN)
NMTHVLYPI

SEQ ID NO: 157957 - protein, 10 aa, Artificial Sequence
  Description of Artificial Sequence: Synthetic peptide
  Seed: AFDGRHSQTL (PRAME_HUMAN)
AADGRHSQTM

SEQ ID NO: 157958 - protein, 10 aa, Artificial Sequence
  Description of Artificial Sequence: Synthetic peptide
  Seed: RRRLWGSIQS (PRAME_HUMAN)
RWRLWGSIQR

SEQ ID NO: 157959 - protein, 9 aa, Artificial Sequence
  Description of Artificial Sequence: Synthetic peptide
  Seed: LQALYVDSL (PRAME_HUMAN)
LMALYVDSV

SEQ ID NO: 157960 - protein, 10 aa, Artificial Sequence
  Description of Artificial Sequence: Synthetic peptide
  Seed: RELFPPLFMA (PRAME_HUMAN)
RFLFPPLFMA

SEQ ID NO: 157961 - protein, 10 aa, Artificial Sequence
  Description of Artificial Sequence: Synthetic peptide
  Seed: ELFPPLFMAA (PRAME_HUMAN)
ETFPPLFMAT

SEQ ID NO: 157962 - protein, 9 aa, Artificial Sequence
  Description of Artificial Sequence: Synthetic peptide
  Seed: LTDVSPEPL (PRAME_HUMAN)
LADVSPEPM

SEQ ID NO: 157963 - protein, 10 aa, Artificial Sequence
  Description of Artificial Sequence: Synthetic peptide
  Seed: MINLRRLLLS (PRAME_HUMAN)
MMNLRRLLLM

SEQ ID NO: 157964 - protein, 11 aa, Artificial Sequence
  Description of Artificial Sequence: Synthetic peptide
  Seed: RASATLQDLVF (PRAME_HUMAN)
RRSATLQDLVW

SEQ ID NO: 157965 - protein, 9 aa, Artificial Sequence
  Description of Artificial Sequence: Synthetic peptide
  Seed: HVMNPLETL (PRAME_HUMAN)
HRMNPLETF

SEQ ID NO: 157966 - protein, 10 aa, Artificial Sequence
  Description of Artificial Sequence: Synthetic peptide
  Seed: RLVELAGQSL (PRAME_HUMAN)
RLVELAGQSR

SEQ ID NO: 157967 - protein, 9 aa, Artificial Sequence
  Description of Artificial Sequence: Synthetic peptide
  Seed: HVMNPLETL (PRAME_HUMAN)
HQMNPLETY

SEQ ID NO: 157968 - protein, 11 aa, Artificial Sequence
  Description of Artificial Sequence: Synthetic peptide
  Seed: SQTLKAMVQAW (PRAME_HUMAN)
SRTLKAMVQAW

SEQ ID NO: 157969 - protein, 9 aa, Artificial Sequence
  Description of Artificial Sequence: Synthetic peptide
  Seed: RELFPPLFM (PRAME_HUMAN)
RILFPPLFY

SEQ ID NO: 157970 - protein, 9 aa, Artificial Sequence
  Description of Artificial Sequence: Synthetic peptide
  Seed: LSVLSLSGV (PRAME_HUMAN)
LSVLSLSGM

SEQ ID NO: 157971 - protein, 9 aa, Artificial Sequence
  Description of Artificial Sequence: Synthetic peptide
  Seed: HGTLHLERL (PRAME_HUMAN)
HATLHLERM

SEQ ID NO: 157972 - protein, 9 aa, Artificial Sequence
  Description of Artificial Sequence: Synthetic peptide
  Seed: SRYISMSVW (PRAME_HUMAN)
SMYISMSVV

SEQ ID NO: 157973 - protein, 9 aa, Artificial Sequence
  Description of Artificial Sequence: Synthetic peptide
  Seed: FYDPEPILC (PRAME_HUMAN)
FYDPEPILA

SEQ ID NO: 157974 - protein, 9 aa, Artificial Sequence
  Description of Artificial Sequence: Synthetic peptide
  Seed: VSPEPLQAL (PRAME_HUMAN)
VLPEPLQAA

SEQ ID NO: 157975 - protein, 9 aa, Artificial Sequence
  Description of Artificial Sequence: Synthetic peptide
  Seed: RHSQTLKAM (PRAME_HUMAN)
RWSQTLKAF

SEQ ID NO: 157976 - protein, 11 aa, Artificial Sequence
  Description of Artificial Sequence: Synthetic peptide
  Seed: RRRLWGSIQSR (PRAME_HUMAN)
RLRLWGSIQSR

SEQ ID NO: 157977 - protein, 9 aa, Artificial Sequence
  Description of Artificial Sequence: Synthetic peptide
  Seed: ITDDQLLAL (PRAME_HUMAN)
IPDDQLLAM

SEQ ID NO: 157978 - protein, 9 aa, Artificial Sequence
  Description of Artificial Sequence: Synthetic peptide
  Seed: MNPLETLSI (PRAME_HUMAN)
MLPLETLSL

SEQ ID NO: 157979 - protein, 8 aa, Artificial Sequence
  Description of Artificial Sequence: Synthetic peptide
  Seed: FYDPEPIL (PRAME_HUMAN)
FMDPEPIV

SEQ ID NO: 157980 - protein, 9 aa, Artificial Sequence
  Description of Artificial Sequence: Synthetic peptide
  Seed: RRRLWGSIQ (PRAME_HUMAN)
RRRLWGSIM

SEQ ID NO: 157981 - protein, 10 aa, Artificial Sequence
  Description of Artificial Sequence: Synthetic peptide
  Seed: KAVLDGLDVL (PRAME_HUMAN)
KVVLDGLDVV

SEQ ID NO: 157982 - protein, 9 aa, Artificial Sequence
  Description of Artificial Sequence: Synthetic peptide
  Seed: LQDLVFDEC (PRAME_HUMAN)
LNDLVFDEM

SEQ ID NO: 157983 - protein, 10 aa, Artificial Sequence
  Description of Artificial Sequence: Synthetic peptide
  Seed: VLMKGQHLHL (PRAME_HUMAN)
VTMKGQHLHW

SEQ ID NO: 157984 - protein, 9 aa, Artificial Sequence
  Description of Artificial Sequence: Synthetic peptide
  Seed: KMILKMVQL (PRAME_HUMAN)
KVILKMVQR

SEQ ID NO: 157985 - protein, 9 aa, Artificial Sequence
  Description of Artificial Sequence: Synthetic peptide
  Seed: EAAQPMTKK (PRAME_HUMAN)
EFAQPMTKR

SEQ ID NO: 157986 - protein, 10 aa, Artificial Sequence
  Description of Artificial Sequence: Synthetic peptide
  Seed: VMHLSQSPSV (PRAME_HUMAN)
VLHLSQSPSV

SEQ ID NO: 157987 - protein, 10 aa, Artificial Sequence
  Description of Artificial Sequence: Synthetic peptide
  Seed: MVQAWPFTCL (PRAME_HUMAN)
MNQAWPFTCM

SEQ ID NO: 157988 - protein, 9 aa, Artificial Sequence
  Description of Artificial Sequence: Synthetic peptide
  Seed: SFYGNSISI (PRAME_HUMAN)
SMYGNSISY

SEQ ID NO: 157989 - protein, 10 aa, Artificial Sequence
  Description of Artificial Sequence: Synthetic peptide
  Seed: LPTLAKFSPY (PRAME_HUMAN)
LFTLAKFSPY

SEQ ID NO: 157990 - protein, 10 aa, Artificial Sequence
  Description of Artificial Sequence: Synthetic peptide
  Seed: YIAQFTSQFL (PRAME_HUMAN)
YLAQFTSQFI

SEQ ID NO: 157991 - protein, 9 aa, Artificial Sequence
  Description of Artificial Sequence: Synthetic peptide
  Seed: ASATLQDLV (PRAME_HUMAN)
ATATLQDLF

SEQ ID NO: 157992 - protein, 9 aa, Artificial Sequence
  Description of Artificial Sequence: Synthetic peptide
  Seed: LTDVSPEPL (PRAME_HUMAN)
LADVSPEPI

SEQ ID NO: 157993 - protein, 10 aa, Artificial Sequence
  Description of Artificial Sequence: Synthetic peptide
  Seed: LLPRELFPPL (PRAME_HUMAN)
LNPRELFPPV

SEQ ID NO: 157994 - protein, 10 aa, Artificial Sequence
  Description of Artificial Sequence: Synthetic peptide
  Seed: YIAQFTSQFL (PRAME_HUMAN)
YVAQFTSQFM

SEQ ID NO: 157995 - protein, 9 aa, Artificial Sequence
  Description of Artificial Sequence: Synthetic peptide
  Seed: LQALYVDSL (PRAME_HUMAN)
LMALYVDSL

SEQ ID NO: 157996 - protein, 9 aa, Artificial Sequence
  Description of Artificial Sequence: Synthetic peptide
  Seed: TFYDPEPIL (PRAME_HUMAN)
TRYDPEPIF

SEQ ID NO: 157997 - protein, 9 aa, Artificial Sequence
  Description of Artificial Sequence: Synthetic peptide
  Seed: KLKIFAMPM (PRAME_HUMAN)
KQKIFAMPL

SEQ ID NO: 157998 - protein, 9 aa, Artificial Sequence
  Description of Artificial Sequence: Synthetic peptide
  Seed: SISALQSLL (PRAME_HUMAN)
SASALQSLF

SEQ ID NO: 157999 - protein, 10 aa, Artificial Sequence
  Description of Artificial Sequence: Synthetic peptide
  Seed: AMVQAWPFTC (PRAME_HUMAN)
ALVQAWPFTL

SEQ ID NO: 158000 - protein, 9 aa, Artificial Sequence
  Description of Artificial Sequence: Synthetic peptide
  Seed: LSHIHASSY (PRAME_HUMAN)
LPHIHASSF

SEQ ID NO: 158001 - protein, 10 aa, Artificial Sequence
  Description of Artificial Sequence: Synthetic peptide
  Seed: GACDELFSYL (PRAME_HUMAN)
GLCDELFSYM

SEQ ID NO: 158002 - protein, 10 aa, Artificial Sequence
  Description of Artificial Sequence: Synthetic peptide
  Seed: ETFKAVLDGL (PRAME_HUMAN)
EIFKAVLDGY

SEQ ID NO: 158003 - protein, 10 aa, Artificial Sequence
  Description of Artificial Sequence: Synthetic peptide
  Seed: RGRLDQLLRH (PRAME_HUMAN)
RERLDQLLRF

SEQ ID NO: 158004 - protein, 11 aa, Artificial Sequence
  Description of Artificial Sequence: Synthetic peptide
  Seed: RLVELAGQSLL (PRAME_HUMAN)
RLVELAGQSLV

SEQ ID NO: 158005 - protein, 9 aa, Artificial Sequence
  Description of Artificial Sequence: Synthetic peptide
  Seed: AVLDGLDVL (PRAME_HUMAN)
AQLDGLDVV

SEQ ID NO: 158006 - protein, 10 aa, Artificial Sequence
  Description of Artificial Sequence: Synthetic peptide
  Seed: RPSMVWLSAN (PRAME_HUMAN)
RPSMVWLSAI

SEQ ID NO: 158007 - protein, 10 aa, Artificial Sequence
  Description of Artificial Sequence: Synthetic peptide
  Seed: TSQFLSLQCL (PRAME_HUMAN)
TGQFLSLQCY

SEQ ID NO: 158008 - protein, 10 aa, Artificial Sequence
  Description of Artificial Sequence: Synthetic peptide
  Seed: SALQSLLQHL (PRAME_HUMAN)
SPLQSLLQHV

SEQ ID NO: 158009 - protein, 9 aa, Artificial Sequence
  Description of Artificial Sequence: Synthetic peptide
  Seed: YLHARLREL (PRAME_HUMAN)
YWHARLREF

SEQ ID NO: 158010 - protein, 10 aa, Artificial Sequence
  Description of Artificial Sequence: Synthetic peptide
  Seed: QLSVLSLSGV (PRAME_HUMAN)
QTSVLSLSGV

SEQ ID NO: 158011 - protein, 10 aa, Artificial Sequence
  Description of Artificial Sequence: Synthetic peptide
  Seed: SNLTHVLYPV (PRAME_HUMAN)
SRLTHVLYPL

SEQ ID NO: 158012 - protein, 10 aa, Artificial Sequence
  Description of Artificial Sequence: Synthetic peptide
  Seed: RLSEGDVMHL (PRAME_HUMAN)
RRSEGDVMHM

SEQ ID NO: 158013 - protein, 10 aa, Artificial Sequence
  Description of Artificial Sequence: Synthetic peptide
  Seed: RHVMNPLETL (PRAME_HUMAN)
RKVMNPLETM

SEQ ID NO: 158014 - protein, 10 aa, Artificial Sequence
  Description of Artificial Sequence: Synthetic peptide
  Seed: LSTEAEQPFI (PRAME_HUMAN)
LTTEAEQPFF

SEQ ID NO: 158015 - protein, 10 aa, Artificial Sequence
  Description of Artificial Sequence: Synthetic peptide
  Seed: ETFKAVLDGL (PRAME_HUMAN)
ESFKAVLDGR

SEQ ID NO: 158016 - protein, 10 aa, Artificial Sequence
  Description of Artificial Sequence: Synthetic peptide
  Seed: RLWGSIQSRY (PRAME_HUMAN)
RTWGSIQSRF

SEQ ID NO: 158017 - protein, 10 aa, Artificial Sequence
  Description of Artificial Sequence: Synthetic peptide
  Seed: RLSEGDVMHL (PRAME_HUMAN)
RISEGDVMHF

SEQ ID NO: 158018 - protein, 10 aa, Artificial Sequence
  Description of Artificial Sequence: Synthetic peptide
  Seed: ALAIAALELL (PRAME_HUMAN)
ALAIAALELM

SEQ ID NO: 158019 - protein, 9 aa, Artificial Sequence
  Description of Artificial Sequence: Synthetic peptide
  Seed: SLLQHLIGL (PRAME_HUMAN)
SVLQHLIGV

SEQ ID NO: 158020 - protein, 9 aa, Artificial Sequence
  Description of Artificial Sequence: Synthetic peptide
  Seed: RLRELLCEL (PRAME_HUMAN)
RNRELLCEY

SEQ ID NO: 158021 - protein, 9 aa, Artificial Sequence
  Description of Artificial Sequence: Synthetic peptide
  Seed: LSTEAEQPF (PRAME_HUMAN)
LMTEAEQPW

SEQ ID NO: 158022 - protein, 9 aa, Artificial Sequence
  Description of Artificial Sequence: Synthetic peptide
  Seed: LSHIHASSY (PRAME_HUMAN)
LWHIHASSL

SEQ ID NO: 158023 - protein, 9 aa, Artificial Sequence
  Description of Artificial Sequence: Synthetic peptide
  Seed: TWKLPTLAK (PRAME_HUMAN)
TQKLPTLAK

SEQ ID NO: 158024 - protein, 9 aa, Artificial Sequence
  Description of Artificial Sequence: Synthetic peptide
  Seed: GQHLHLETF (PRAME_HUMAN)
GSHLHLETF

SEQ ID NO: 158025 - protein, 9 aa, Artificial Sequence
  Description of Artificial Sequence: Synthetic peptide
  Seed: SYEDIHGTL (PRAME_HUMAN)
SREDIHGTL

SEQ ID NO: 158026 - protein, 9 aa, Artificial Sequence
  Description of Artificial Sequence: Synthetic peptide
  Seed: SLLQHLIGL (PRAME_HUMAN)
SILQHLIGR

SEQ ID NO: 158027 - protein, 9 aa, Artificial Sequence
  Description of Artificial Sequence: Synthetic peptide
  Seed: EDLEVTCTW (PRAME_HUMAN)
ESLEVTCTW

SEQ ID NO: 158028 - protein, 9 aa, Artificial Sequence
  Description of Artificial Sequence: Synthetic peptide
  Seed: LSVLSLSGV (PRAME_HUMAN)
LAVLSLSGY

SEQ ID NO: 158029 - protein, 8 aa, Artificial Sequence
  Description of Artificial Sequence: Synthetic peptide
  Seed: VLDGLDVL (PRAME_HUMAN)
VYDGLDVL

SEQ ID NO: 158030 - protein, 10 aa, Artificial Sequence
  Description of Artificial Sequence: Synthetic peptide
  Seed: RRRLWGSIQS (PRAME_HUMAN)
RNRLWGSIQK

SEQ ID NO: 158031 - protein, 9 aa, Artificial Sequence
  Description of Artificial Sequence: Synthetic peptide
  Seed: SHIHASSYI (PRAME_HUMAN)
SEIHASSYM

SEQ ID NO: 158032 - protein, 10 aa, Artificial Sequence
  Description of Artificial Sequence: Synthetic peptide
  Seed: QLLRHVMNPL (PRAME_HUMAN)
QMLRHVMNPA

SEQ ID NO: 158033 - protein, 9 aa, Artificial Sequence
  Description of Artificial Sequence: Synthetic peptide
  Seed: CPHCGDRTF (PRAME_HUMAN)
CMHCGDRTF

SEQ ID NO: 158034 - protein, 9 aa, Artificial Sequence
  Description of Artificial Sequence: Synthetic peptide
  Seed: ITDDQLLAL (PRAME_HUMAN)
IMDDQLLAV

SEQ ID NO: 158035 - protein, 9 aa, Artificial Sequence
  Description of Artificial Sequence: Synthetic peptide
  Seed: MSVWTSPRR (PRAME_HUMAN)
MMVWTSPRK

SEQ ID NO: 158036 - protein, 9 aa, Artificial Sequence
  Description of Artificial Sequence: Synthetic peptide
  Seed: RGRLDQLLR (PRAME_HUMAN)
RSRLDQLLS

SEQ ID NO: 158037 - protein, 9 aa, Artificial Sequence
  Description of Artificial Sequence: Synthetic peptide
  Seed: KAMVQAWPF (PRAME_HUMAN)
KAMVQAWPV

SEQ ID NO: 158038 - protein, 11 aa, Artificial Sequence
  Description of Artificial Sequence: Synthetic peptide
  Seed: IAQFTSQFLSL (PRAME_HUMAN)
IVQFTSQFLSF

SEQ ID NO: 158039 - protein, 10 aa, Artificial Sequence
  Description of Artificial Sequence: Synthetic peptide
  Seed: LLLSHIHASS (PRAME_HUMAN)
LVLSHIHASL

SEQ ID NO: 158040 - protein, 10 aa, Artificial Sequence
  Description of Artificial Sequence: Synthetic peptide
  Seed: IKMILKMVQL (PRAME_HUMAN)
IMMILKMVQI

SEQ ID NO: 158041 - protein, 9 aa, Artificial Sequence
  Description of Artificial Sequence: Synthetic peptide
  Seed: KLKIFAMPM (PRAME_HUMAN)
KFKIFAMPM

SEQ ID NO: 158042 - protein, 10 aa, Artificial Sequence
  Description of Artificial Sequence: Synthetic peptide
  Seed: ELFSYLIEKV (PRAME_HUMAN)
ESFSYLIEKI

SEQ ID NO: 158043 - protein, 11 aa, Artificial Sequence
  Description of Artificial Sequence: Synthetic peptide
  Seed: KAVLDGLDVLL (PRAME_HUMAN)
KYVLDGLDVLV

SEQ ID NO: 158044 - protein, 10 aa, Artificial Sequence
  Description of Artificial Sequence: Synthetic peptide
  Seed: QAWPFTCLPL (PRAME_HUMAN)
QSWPFTCLPV

SEQ ID NO: 158045 - protein, 10 aa, Artificial Sequence
  Description of Artificial Sequence: Synthetic peptide
  Seed: LSFYGNSISI (PRAME_HUMAN)
LIFYGNSISW

SEQ ID NO: 158046 - protein, 10 aa, Artificial Sequence
  Description of Artificial Sequence: Synthetic peptide
  Seed: SPYLGQMINL (PRAME_HUMAN)
SQYLGQMINI

SEQ ID NO: 158047 - protein, 10 aa, Artificial Sequence
  Description of Artificial Sequence: Synthetic peptide
  Seed: VTCTWKLPTL (PRAME_HUMAN)
VLCTWKLPTA

SEQ ID NO: 158048 - protein, 9 aa, Artificial Sequence
  Description of Artificial Sequence: Synthetic peptide
  Seed: MSVWTSPRR (PRAME_HUMAN)
MYVWTSPRR

SEQ ID NO: 158049 - protein, 9 aa, Artificial Sequence
  Description of Artificial Sequence: Synthetic peptide
  Seed: MVQAWPFTC (PRAME_HUMAN)
MLQAWPFTM

SEQ ID NO: 158050 - protein, 9 aa, Artificial Sequence
  Description of Artificial Sequence: Synthetic peptide
  Seed: VLDGLDVLL (PRAME_HUMAN)
VTDGLDVLV

SEQ ID NO: 158051 - protein, 10 aa, Artificial Sequence
  Description of Artificial Sequence: Synthetic peptide
  Seed: ARLRELLCEL (PRAME_HUMAN)
ANLRELLCEV

SEQ ID NO: 158052 - protein, 9 aa, Artificial Sequence
  Description of Artificial Sequence: Synthetic peptide
  Seed: FTCLPLGVL (PRAME_HUMAN)
FLCLPLGVY

SEQ ID NO: 158053 - protein, 9 aa, Artificial Sequence
  Description of Artificial Sequence: Synthetic peptide
  Seed: LQALYVDSL (PRAME_HUMAN)
LVALYVDSV

SEQ ID NO: 158054 - protein, 10 aa, Artificial Sequence
  Description of Artificial Sequence: Synthetic peptide
  Seed: FFLRGRLDQL (PRAME_HUMAN)
FILRGRLDQA

SEQ ID NO: 158055 - protein, 9 aa, Artificial Sequence
  Description of Artificial Sequence: Synthetic peptide
  Seed: ISPEKEEQY (PRAME_HUMAN)
IFPEKEEQF

SEQ ID NO: 158056 - protein, 9 aa, Artificial Sequence
  Description of Artificial Sequence: Synthetic peptide
  Seed: ERLAYLHAR (PRAME_HUMAN)
EALAYLHAK

SEQ ID NO: 158057 - protein, 10 aa, Artificial Sequence
  Description of Artificial Sequence: Synthetic peptide
  Seed: KIFAMPMQDI (PRAME_HUMAN)
KMFAMPMQDV

SEQ ID NO: 158058 - protein, 9 aa, Artificial Sequence
  Description of Artificial Sequence: Synthetic peptide
  Seed: DGRHSQTLK (PRAME_HUMAN)
DYRHSQTLK

SEQ ID NO: 158059 - protein, 10 aa, Artificial Sequence
  Description of Artificial Sequence: Synthetic peptide
  Seed: NLRRLLLSHI (PRAME_HUMAN)
NMRRLLLSHV

SEQ ID NO: 158060 - protein, 10 aa, Artificial Sequence
  Description of Artificial Sequence: Synthetic peptide
  Seed: FIPVEVLVDL (PRAME_HUMAN)
FPPVEVLVDM

SEQ ID NO: 158061 - protein, 9 aa, Artificial Sequence
  Description of Artificial Sequence: Synthetic peptide
  Seed: MINLRRLLL (PRAME_HUMAN)
MINLRRLLI

SEQ ID NO: 158062 - protein, 10 aa, Artificial Sequence
  Description of Artificial Sequence: Synthetic peptide
  Seed: MVQAWPFTCL (PRAME_HUMAN)
MPQAWPFTCV

SEQ ID NO: 158063 - protein, 10 aa, Artificial Sequence
  Description of Artificial Sequence: Synthetic peptide
  Seed: YIAQFTSQFL (PRAME_HUMAN)
YWAQFTSQFY

SEQ ID NO: 158064 - protein, 9 aa, Artificial Sequence
  Description of Artificial Sequence: Synthetic peptide
  Seed: SLLKDEALA (PRAME_HUMAN)
SMLKDEALV

SEQ ID NO: 158065 - protein, 9 aa, Artificial Sequence
  Description of Artificial Sequence: Synthetic peptide
  Seed: SQSPSVSQL (PRAME_HUMAN)
SQSPSVSQY

SEQ ID NO: 158066 - protein, 9 aa, Artificial Sequence
  Description of Artificial Sequence: Synthetic peptide
  Seed: YSFPEPEAA (PRAME_HUMAN)
YMFPEPEAY

SEQ ID NO: 158067 - protein, 10 aa, Artificial Sequence
  Description of Artificial Sequence: Synthetic peptide
  Seed: ALYVDSLFFL (PRAME_HUMAN)
AEYVDSLFFL

SEQ ID NO: 158068 - protein, 10 aa, Artificial Sequence
  Description of Artificial Sequence: Synthetic peptide
  Seed: GRPSMVWLSA (PRAME_HUMAN)
GAPSMVWLSL

SEQ ID NO: 158069 - protein, 10 aa, Artificial Sequence
  Description of Artificial Sequence: Synthetic peptide
  Seed: FFLRGRLDQL (PRAME_HUMAN)
FSLRGRLDQI

SEQ ID NO: 158070 - protein, 9 aa, Artificial Sequence
  Description of Artificial Sequence: Synthetic peptide
  Seed: TLHLERLAY (PRAME_HUMAN)
TTHLERLAF

SEQ ID NO: 158071 - protein, 9 aa, Artificial Sequence
  Description of Artificial Sequence: Synthetic peptide
  Seed: ISPEKEEQY (PRAME_HUMAN)
ILPEKEEQI

SEQ ID NO: 158072 - protein, 9 aa, Artificial Sequence
  Description of Artificial Sequence: Synthetic peptide
  Seed: QALYVDSLF (PRAME_HUMAN)
QSLYVDSLI

SEQ ID NO: 158073 - protein, 10 aa, Artificial Sequence
  Description of Artificial Sequence: Synthetic peptide
  Seed: SISISALQSL (PRAME_HUMAN)
SSSISALQSY

SEQ ID NO: 158074 - protein, 9 aa, Artificial Sequence
  Description of Artificial Sequence: Synthetic peptide
  Seed: YEDIHGTLH (PRAME_HUMAN)
YIDIHGTLY

SEQ ID NO: 158075 - protein, 9 aa, Artificial Sequence
  Description of Artificial Sequence: Synthetic peptide
  Seed: LSLQCLQAL (PRAME_HUMAN)
LELQCLQAF

SEQ ID NO: 158076 - protein, 11 aa, Artificial Sequence
  Description of Artificial Sequence: Synthetic peptide
  Seed: TVWSGNRASLY (PRAME_HUMAN)
TMWSGNRASLY

SEQ ID NO: 158077 - protein, 9 aa, Artificial Sequence
  Description of Artificial Sequence: Synthetic peptide
  Seed: HVMNPLETL (PRAME_HUMAN)
HAMNPLETI

SEQ ID NO: 158078 - protein, 9 aa, Artificial Sequence
  Description of Artificial Sequence: Synthetic peptide
  Seed: ALLPSLSHC (PRAME_HUMAN)
AALPSLSHV

SEQ ID NO: 158079 - protein, 9 aa, Artificial Sequence
  Description of Artificial Sequence: Synthetic peptide
  Seed: KVKRKKNVL (PRAME_HUMAN)
KVKRKKNVK

SEQ ID NO: 158080 - protein, 10 aa, Artificial Sequence
  Description of Artificial Sequence: Synthetic peptide
  Seed: ARLRELLCEL (PRAME_HUMAN)
AQLRELLCEV

SEQ ID NO: 158081 - protein, 10 aa, Artificial Sequence
  Description of Artificial Sequence: Synthetic peptide
  Seed: FTCLPLGVLM (PRAME_HUMAN)
FTCLPLGVLF

SEQ ID NO: 158082 - protein, 11 aa, Artificial Sequence
  Description of Artificial Sequence: Synthetic peptide
  Seed: RRWKLQVLDLR (PRAME_HUMAN)
RRWKLQVLDLE

SEQ ID NO: 158083 - protein, 10 aa, Artificial Sequence
  Description of Artificial Sequence: Synthetic peptide
  Seed: TVWSGNRASL (PRAME_HUMAN)
TPWSGNRASM

SEQ ID NO: 158084 - protein, 10 aa, Artificial Sequence
  Description of Artificial Sequence: Synthetic peptide
  Seed: TSQFLSLQCL (PRAME_HUMAN)
TTQFLSLQCY

SEQ ID NO: 158085 - protein, 11 aa, Artificial Sequence
  Description of Artificial Sequence: Synthetic peptide
  Seed: LSNLTHVLYPV (PRAME_HUMAN)
LANLTHVLYPV

SEQ ID NO: 158086 - protein, 9 aa, Artificial Sequence
  Description of Artificial Sequence: Synthetic peptide
  Seed: AAFDGRHSQ (PRAME_HUMAN)
AFFDGRHSF

SEQ ID NO: 158087 - protein, 9 aa, Artificial Sequence
  Description of Artificial Sequence: Synthetic peptide
  Seed: GQHLHLETF (PRAME_HUMAN)
GEHLHLETW

SEQ ID NO: 158088 - protein, 9 aa, Artificial Sequence
  Description of Artificial Sequence: Synthetic peptide
  Seed: LRKNSHQDF (PRAME_HUMAN)
LQKNSHQDL

SEQ ID NO: 158089 - protein, 9 aa, Artificial Sequence
  Description of Artificial Sequence: Synthetic peptide
  Seed: FYDPEPILC (PRAME_HUMAN)
FGDPEPILF

SEQ ID NO: 158090 - protein, 8 aa, Artificial Sequence
  Description of Artificial Sequence: Synthetic peptide
  Seed: ITDDQLLA (PRAME_HUMAN)
ISDDQLLL

SEQ ID NO: 158091 - protein, 11 aa, Artificial Sequence
  Description of Artificial Sequence: Synthetic peptide
  Seed: AAFDGRHSQTL (PRAME_HUMAN)
AMFDGRHSQTM

SEQ ID NO: 158092 - protein, 9 aa, Artificial Sequence
  Description of Artificial Sequence: Synthetic peptide
  Seed: SLLQHLIGL (PRAME_HUMAN)
SILQHLIGW

SEQ ID NO: 158093 - protein, 9 aa, Artificial Sequence
  Description of Artificial Sequence: Synthetic peptide
  Seed: EAAQPMTKK (PRAME_HUMAN)
EVAQPMTKR

SEQ ID NO: 158094 - protein, 9 aa, Artificial Sequence
  Description of Artificial Sequence: Synthetic peptide
  Seed: AQFTSQFLS (PRAME_HUMAN)
ALFTSQFLL

SEQ ID NO: 158095 - protein, 10 aa, Artificial Sequence
  Description of Artificial Sequence: Synthetic peptide
  Seed: ISISALQSLL (PRAME_HUMAN)
ISISALQSLM

SEQ ID NO: 158096 - protein, 10 aa, Artificial Sequence
  Description of Artificial Sequence: Synthetic peptide
  Seed: WTSPRRLVEL (PRAME_HUMAN)
WASPRRLVEY

SEQ ID NO: 158097 - protein, 9 aa, Artificial Sequence
  Description of Artificial Sequence: Synthetic peptide
  Seed: KEEQYIAQF (PRAME_HUMAN)
KQEQYIAQL

SEQ ID NO: 158098 - protein, 11 aa, Artificial Sequence
  Description of Artificial Sequence: Synthetic peptide
  Seed: KNSHQDFWTVW (PRAME_HUMAN)
KSSHQDFWTVW

SEQ ID NO: 158099 - protein, 9 aa, Artificial Sequence
  Description of Artificial Sequence: Synthetic peptide
  Seed: YISMSVWTS (PRAME_HUMAN)
YVSMSVWTV

SEQ ID NO: 158100 - protein, 9 aa, Artificial Sequence
  Description of Artificial Sequence: Synthetic peptide
  Seed: LPRELFPPL (PRAME_HUMAN)
LPRELFPPY

SEQ ID NO: 158101 - protein, 10 aa, Artificial Sequence
  Description of Artificial Sequence: Synthetic peptide
  Seed: ITDDQLLALL (PRAME_HUMAN)
ILDDQLLALF

SEQ ID NO: 158102 - protein, 10 aa, Artificial Sequence
  Description of Artificial Sequence: Synthetic peptide
  Seed: ISPEKEEQYI (PRAME_HUMAN)
IAPEKEEQYL

SEQ ID NO: 158103 - protein, 9 aa, Artificial Sequence
  Description of Artificial Sequence: Synthetic peptide
  Seed: LSLQCLQAL (PRAME_HUMAN)
LMLQCLQAW

SEQ ID NO: 158104 - protein, 9 aa, Artificial Sequence
  Description of Artificial Sequence: Synthetic peptide
  Seed: LSHIHASSY (PRAME_HUMAN)
LEHIHASSY

SEQ ID NO: 158105 - protein, 10 aa, Artificial Sequence
  Description of Artificial Sequence: Synthetic peptide
  Seed: RLVELAGQSL (PRAME_HUMAN)
RYVELAGQSF

SEQ ID NO: 158106 - protein, 9 aa, Artificial Sequence
  Description of Artificial Sequence: Synthetic peptide
  Seed: LSVLSLSGV (PRAME_HUMAN)
LQVLSLSGL

SEQ ID NO: 158107 - protein, 10 aa, Artificial Sequence
  Description of Artificial Sequence: Synthetic peptide
  Seed: ITDDQLLALL (PRAME_HUMAN)
IWDDQLLALL

SEQ ID NO: 158108 - protein, 9 aa, Artificial Sequence
  Description of Artificial Sequence: Synthetic peptide
  Seed: VQAWPFTCL (PRAME_HUMAN)
VMAWPFTCY

SEQ ID NO: 158109 - protein, 10 aa, Artificial Sequence
  Description of Artificial Sequence: Synthetic peptide
  Seed: MERRRLWGSI (PRAME_HUMAN)
MPRRRLWGSA

SEQ ID NO: 158110 - protein, 9 aa, Artificial Sequence
  Description of Artificial Sequence: Synthetic peptide
  Seed: EEQYIAQFT (PRAME_HUMAN)
EEQYIAQFL

SEQ ID NO: 158111 - protein, 10 aa, Artificial Sequence
  Description of Artificial Sequence: Synthetic peptide
  Seed: LSHIHASSYI (PRAME_HUMAN)
LSHIHASSYF

SEQ ID NO: 158112 - protein, 10 aa, Artificial Sequence
  Description of Artificial Sequence: Synthetic peptide
  Seed: TVWSGNRASL (PRAME_HUMAN)
TPWSGNRASL

SEQ ID NO: 158113 - protein, 11 aa, Artificial Sequence
  Description of Artificial Sequence: Synthetic peptide
  Seed: LPTLAKFSPYL (PRAME_HUMAN)
LLTLAKFSPYI

SEQ ID NO: 158114 - protein, 10 aa, Artificial Sequence
  Description of Artificial Sequence: Synthetic peptide
  Seed: LQALYVDSLF (PRAME_HUMAN)
LLALYVDSLF

SEQ ID NO: 158115 - protein, 10 aa, Artificial Sequence
  Description of Artificial Sequence: Synthetic peptide
  Seed: RYISMSVWTS (PRAME_HUMAN)
RWISMSVWTV

SEQ ID NO: 158116 - protein, 9 aa, Artificial Sequence
  Description of Artificial Sequence: Synthetic peptide
  Seed: SVLSLSGVM (PRAME_HUMAN)
SMLSLSGVY

SEQ ID NO: 158117 - protein, 9 aa, Artificial Sequence
  Description of Artificial Sequence: Synthetic peptide
  Seed: YSFPEPEAA (PRAME_HUMAN)
YSFPEPEAF

SEQ ID NO: 158118 - protein, 10 aa, Artificial Sequence
  Description of Artificial Sequence: Synthetic peptide
  Seed: AVLDGLDVLL (PRAME_HUMAN)
AQLDGLDVLW

SEQ ID NO: 158119 - protein, 10 aa, Artificial Sequence
  Description of Artificial Sequence: Synthetic peptide
  Seed: VLYPVPLESY (PRAME_HUMAN)
VTYPVPLESW

SEQ ID NO: 158120 - protein, 10 aa, Artificial Sequence
  Description of Artificial Sequence: Synthetic peptide
  Seed: SISISALQSL (PRAME_HUMAN)
SFSISALQSF

SEQ ID NO: 158121 - protein, 10 aa, Artificial Sequence
  Description of Artificial Sequence: Synthetic peptide
  Seed: SPYLGQMINL (PRAME_HUMAN)
SIYLGQMINL

SEQ ID NO: 158122 - protein, 10 aa, Artificial Sequence
  Description of Artificial Sequence: Synthetic peptide
  Seed: SALQSLLQHL (PRAME_HUMAN)
SSLQSLLQHF

SEQ ID NO: 158123 - protein, 9 aa, Artificial Sequence
  Description of Artificial Sequence: Synthetic peptide
  Seed: YVDSLFFLR (PRAME_HUMAN)
YMDSLFFLK

SEQ ID NO: 158124 - protein, 9 aa, Artificial Sequence
  Description of Artificial Sequence: Synthetic peptide
  Seed: KFSPYLGQM (PRAME_HUMAN)
KRSPYLGQF

SEQ ID NO: 158125 - protein, 9 aa, Artificial Sequence
  Description of Artificial Sequence: Synthetic peptide
  Seed: KLKIFAMPM (PRAME_HUMAN)
KRKIFAMPY

SEQ ID NO: 158126 - protein, 9 aa, Artificial Sequence
  Description of Artificial Sequence: Synthetic peptide
  Seed: LQDLVFDEC (PRAME_HUMAN)
LFDLVFDEF

SEQ ID NO: 158127 - protein, 9 aa, Artificial Sequence
  Description of Artificial Sequence: Synthetic peptide
  Seed: FLSLQCLQA (PRAME_HUMAN)
FMSLQCLQT

SEQ ID NO: 158128 - protein, 9 aa, Artificial Sequence
  Description of Artificial Sequence: Synthetic peptide
  Seed: RTFYDPEPI (PRAME_HUMAN)
RMFYDPEPW

SEQ ID NO: 158129 - protein, 10 aa, Artificial Sequence
  Description of Artificial Sequence: Synthetic peptide
  Seed: SNLTHVLYPV (PRAME_HUMAN)
SHLTHVLYPI

SEQ ID NO: 158130 - protein, 11 aa, Artificial Sequence
  Description of Artificial Sequence: Synthetic peptide
  Seed: SHCSQLTTLSF (PRAME_HUMAN)
SHCSQLTTLSL

SEQ ID NO: 158131 - protein, 9 aa, Artificial Sequence
  Description of Artificial Sequence: Synthetic peptide
  Seed: CKKLKIFAM (PRAME_HUMAN)
CVKLKIFAL

SEQ ID NO: 158132 - protein, 9 aa, Artificial Sequence
  Description of Artificial Sequence: Synthetic peptide
  Seed: LQHLIGLSN (PRAME_HUMAN)
LKHLIGLSI

SEQ ID NO: 158133 - protein, 9 aa, Artificial Sequence
  Description of Artificial Sequence: Synthetic peptide
  Seed: SHIHASSYI (PRAME_HUMAN)
SMIHASSYI

SEQ ID NO: 158134 - protein, 10 aa, Artificial Sequence
  Description of Artificial Sequence: Synthetic peptide
  Seed: SMVWLSANPC (PRAME_HUMAN)
SMVWLSANPI

SEQ ID NO: 158135 - protein, 10 aa, Artificial Sequence
  Description of Artificial Sequence: Synthetic peptide
  Seed: GLSNLTHVLY (PRAME_HUMAN)
GWSNLTHVLY

SEQ ID NO: 158136 - protein, 9 aa, Artificial Sequence
  Description of Artificial Sequence: Synthetic peptide
  Seed: RHSQTLKAM (PRAME_HUMAN)
RYSQTLKAF

SEQ ID NO: 158137 - protein, 9 aa, Artificial Sequence
  Description of Artificial Sequence: Synthetic peptide
  Seed: LVELAGQSL (PRAME_HUMAN)
LPELAGQSL

SEQ ID NO: 158138 - protein, 9 aa, Artificial Sequence
  Description of Artificial Sequence: Synthetic peptide
  Seed: TLAKFSPYL (PRAME_HUMAN)
TMAKFSPYK

SEQ ID NO: 158139 - protein, 9 aa, Artificial Sequence
  Description of Artificial Sequence: Synthetic peptide
  Seed: KFSPYLGQM (PRAME_HUMAN)
KLSPYLGQY

SEQ ID NO: 158140 - protein, 9 aa, Artificial Sequence
  Description of Artificial Sequence: Synthetic peptide
  Seed: LQDLVFDEC (PRAME_HUMAN)
LIDLVFDEV

SEQ ID NO: 158141 - protein, 9 aa, Artificial Sequence
  Description of Artificial Sequence: Synthetic peptide
  Seed: LYVDSLFFL (PRAME_HUMAN)
LLVDSLFFA

SEQ ID NO: 158142 - protein, 9 aa, Artificial Sequence
  Description of Artificial Sequence: Synthetic peptide
  Seed: AFDGRHSQT (PRAME_HUMAN)
AFDGRHSQL

SEQ ID NO: 158143 - protein, 9 aa, Artificial Sequence
  Description of Artificial Sequence: Synthetic peptide
  Seed: LSNLTHVLY (PRAME_HUMAN)
LLNLTHVLW

SEQ ID NO: 158144 - protein, 9 aa, Artificial Sequence
  Description of Artificial Sequence: Synthetic peptide
  Seed: TDDQLLALL (PRAME_HUMAN)
TQDQLLALV

SEQ ID NO: 158145 - protein, 10 aa, Artificial Sequence
  Description of Artificial Sequence: Synthetic peptide
  Seed: RYISMSVWTS (PRAME_HUMAN)
RFISMSVWTV

SEQ ID NO: 158146 - protein, 8 aa, Artificial Sequence
  Description of Artificial Sequence: Synthetic peptide
  Seed: SHIHASSY (PRAME_HUMAN)
SQIHASSF

SEQ ID NO: 158147 - protein, 11 aa, Artificial Sequence
  Description of Artificial Sequence: Synthetic peptide
  Seed: QALYVDSLFFL (PRAME_HUMAN)
QDLYVDSLFFF

SEQ ID NO: 158148 - protein, 9 aa, Artificial Sequence
  Description of Artificial Sequence: Synthetic peptide
  Seed: VQAWPFTCL (PRAME_HUMAN)
VAAWPFTCF

SEQ ID NO: 158149 - protein, 9 aa, Artificial Sequence
  Description of Artificial Sequence: Synthetic peptide
  Seed: ALLPSLSHC (PRAME_HUMAN)
ASLPSLSHL

SEQ ID NO: 158150 - protein, 8 aa, Artificial Sequence
  Description of Artificial Sequence: Synthetic peptide
  Seed: MINLRRLL (PRAME_HUMAN)
MANLRRLL

SEQ ID NO: 158151 - protein, 10 aa, Artificial Sequence
  Description of Artificial Sequence: Synthetic peptide
  Seed: ESYEDIHGTL (PRAME_HUMAN)
EIYEDIHGTK

SEQ ID NO: 158152 - protein, 9 aa, Artificial Sequence
  Description of Artificial Sequence: Synthetic peptide
  Seed: AAQPMTKKR (PRAME_HUMAN)
AVQPMTKKR

SEQ ID NO: 158153 - protein, 9 aa, Artificial Sequence
  Description of Artificial Sequence: Synthetic peptide
  Seed: RLWGSIQSR (PRAME_HUMAN)
RQWGSIQSI

SEQ ID NO: 158154 - protein, 10 aa, Artificial Sequence
  Description of Artificial Sequence: Synthetic peptide
  Seed: FIPVEVLVDL (PRAME_HUMAN)
FEPVEVLVDW

SEQ ID NO: 158155 - protein, 9 aa, Artificial Sequence
  Description of Artificial Sequence: Synthetic peptide
  Seed: FLSLQCLQA (PRAME_HUMAN)
FMSLQCLQV

SEQ ID NO: 158156 - protein, 10 aa, Artificial Sequence
  Description of Artificial Sequence: Synthetic peptide
  Seed: KAVLDGLDVL (PRAME_HUMAN)
KMVLDGLDVV

SEQ ID NO: 158157 - protein, 10 aa, Artificial Sequence
  Description of Artificial Sequence: Synthetic peptide
  Seed: VLDGLDVLLA (PRAME_HUMAN)
VLDGLDVLLI

SEQ ID NO: 158158 - protein, 9 aa, Artificial Sequence
  Description of Artificial Sequence: Synthetic peptide
  Seed: AAQPMTKKR (PRAME_HUMAN)
AVQPMTKKK

SEQ ID NO: 158159 - protein, 9 aa, Artificial Sequence
  Description of Artificial Sequence: Synthetic peptide
  Seed: VLDGLDVLL (PRAME_HUMAN)
VTDGLDVLL

SEQ ID NO: 158160 - protein, 10 aa, Artificial Sequence
  Description of Artificial Sequence: Synthetic peptide
  Seed: ESYEDIHGTL (PRAME_HUMAN)
ETYEDIHGTL

SEQ ID NO: 158161 - protein, 11 aa, Artificial Sequence
  Description of Artificial Sequence: Synthetic peptide
  Seed: LSNLTHVLYPV (PRAME_HUMAN)
LKNLTHVLYPV

SEQ ID NO: 158162 - protein, 10 aa, Artificial Sequence
  Description of Artificial Sequence: Synthetic peptide
  Seed: ISMSVWTSPR (PRAME_HUMAN)
IPMSVWTSPK

SEQ ID NO: 158163 - protein, 10 aa, Artificial Sequence
  Description of Artificial Sequence: Synthetic peptide
  Seed: AVLDGLDVLL (PRAME_HUMAN)
AILDGLDVLR

SEQ ID NO: 158164 - protein, 10 aa, Artificial Sequence
  Description of Artificial Sequence: Synthetic peptide
  Seed: YEDIHGTLHL (PRAME_HUMAN)
YADIHGTLHL

SEQ ID NO: 158165 - protein, 10 aa, Artificial Sequence
  Description of Artificial Sequence: Synthetic peptide
  Seed: LKAMVQAWPF (PRAME_HUMAN)
LWAMVQAWPW

SEQ ID NO: 158166 - protein, 9 aa, Artificial Sequence
  Description of Artificial Sequence: Synthetic peptide
  Seed: ESYEDIHGT (PRAME_HUMAN)
EVYEDIHGA

SEQ ID NO: 158167 - protein, 11 aa, Artificial Sequence
  Description of Artificial Sequence: Synthetic peptide
  Seed: ISMSVWTSPRR (PRAME_HUMAN)
IMMSVWTSPRK

SEQ ID NO: 158168 - protein, 9 aa, Artificial Sequence
  Description of Artificial Sequence: Synthetic peptide
  Seed: RLLLSHIHA (PRAME_HUMAN)
RLLLSHIHI

SEQ ID NO: 158169 - protein, 9 aa, Artificial Sequence
  Description of Artificial Sequence: Synthetic peptide
  Seed: RASATLQDL (PRAME_HUMAN)
RSSATLQDM

SEQ ID NO: 158170 - protein, 9 aa, Artificial Sequence
  Description of Artificial Sequence: Synthetic peptide
  Seed: SFYGNSISI (PRAME_HUMAN)
SKYGNSISL

SEQ ID NO: 158171 - protein, 9 aa, Artificial Sequence
  Description of Artificial Sequence: Synthetic peptide
  Seed: RLDQLLRHV (PRAME_HUMAN)
RTDQLLRHL

SEQ ID NO: 158172 - protein, 9 aa, Artificial Sequence
  Description of Artificial Sequence: Synthetic peptide
  Seed: SFYGNSISI (PRAME_HUMAN)
SQYGNSISW

SEQ ID NO: 158173 - protein, 8 aa, Artificial Sequence
  Description of Artificial Sequence: Synthetic peptide
  Seed: TDDQLLAL (PRAME_HUMAN)
TIDQLLAM

SEQ ID NO: 158174 - protein, 10 aa, Artificial Sequence
  Description of Artificial Sequence: Synthetic peptide
  Seed: RRWKLQVLDL (PRAME_HUMAN)
RRWKLQVLDM

SEQ ID NO: 158175 - protein, 10 aa, Artificial Sequence
  Description of Artificial Sequence: Synthetic peptide
  Seed: MPMQDIKMIL (PRAME_HUMAN)
MDMQDIKMIL

SEQ ID NO: 158176 - protein, 10 aa, Artificial Sequence
  Description of Artificial Sequence: Synthetic peptide
  Seed: RHVMNPLETL (PRAME_HUMAN)
RYVMNPLETV

SEQ ID NO: 158177 - protein, 10 aa, Artificial Sequence
  Description of Artificial Sequence: Synthetic peptide
  Seed: ITDDQLLALL (PRAME_HUMAN)
IMDDQLLALI

SEQ ID NO: 158178 - protein, 9 aa, Artificial Sequence
  Description of Artificial Sequence: Synthetic peptide
  Seed: LSNLTHVLY (PRAME_HUMAN)
LTNLTHVLW

SEQ ID NO: 158179 - protein, 9 aa, Artificial Sequence
  Description of Artificial Sequence: Synthetic peptide
  Seed: RRWKLQVLD (PRAME_HUMAN)
RRWKLQVLW

SEQ ID NO: 158180 - protein, 11 aa, Artificial Sequence
  Description of Artificial Sequence: Synthetic peptide
  Seed: AAFDGRHSQTL (PRAME_HUMAN)
AGFDGRHSQTY

SEQ ID NO: 158181 - protein, 10 aa, Artificial Sequence
  Description of Artificial Sequence: Synthetic peptide
  Seed: IGLSNLTHVL (PRAME_HUMAN)
INLSNLTHVI

SEQ ID NO: 158182 - protein, 9 aa, Artificial Sequence
  Description of Artificial Sequence: Synthetic peptide
  Seed: RHSQTLKAM (PRAME_HUMAN)
RASQTLKAM

SEQ ID NO: 158183 - protein, 9 aa, Artificial Sequence
  Description of Artificial Sequence: Synthetic peptide
  Seed: ALAIAALEL (PRAME_HUMAN)
ATAIAALEM

SEQ ID NO: 158184 - protein, 9 aa, Artificial Sequence
  Description of Artificial Sequence: Synthetic peptide
  Seed: LLRHVMNPL (PRAME_HUMAN)
LPRHVMNPF

SEQ ID NO: 158185 - protein, 9 aa, Artificial Sequence
  Description of Artificial Sequence: Synthetic peptide
  Seed: RASATLQDL (PRAME_HUMAN)
RMSATLQDY

SEQ ID NO: 158186 - protein, 9 aa, Artificial Sequence
  Description of Artificial Sequence: Synthetic peptide
  Seed: FLRGRLDQL (PRAME_HUMAN)
FYRGRLDQM

SEQ ID NO: 158187 - protein, 10 aa, Artificial Sequence
  Description of Artificial Sequence: Synthetic peptide
  Seed: SPYLGQMINL (PRAME_HUMAN)
SLYLGQMINL

SEQ ID NO: 158188 - protein, 9 aa, Artificial Sequence
  Description of Artificial Sequence: Synthetic peptide
  Seed: KMILKMVQL (PRAME_HUMAN)
KPILKMVQL

SEQ ID NO: 158189 - protein, 9 aa, Artificial Sequence
  Description of Artificial Sequence: Synthetic peptide
  Seed: LHLERLAYL (PRAME_HUMAN)
LRLERLAYL

SEQ ID NO: 158190 - protein, 10 aa, Artificial Sequence
  Description of Artificial Sequence: Synthetic peptide
  Seed: RLVELAGQSL (PRAME_HUMAN)
RTVELAGQSW

SEQ ID NO: 158191 - protein, 9 aa, Artificial Sequence
  Description of Artificial Sequence: Synthetic peptide
  Seed: ELFSYLIEK (PRAME_HUMAN)
EMFSYLIEK

SEQ ID NO: 158192 - protein, 9 aa, Artificial Sequence
  Description of Artificial Sequence: Synthetic peptide
  Seed: DEALAIAAL (PRAME_HUMAN)
DQALAIAAY

SEQ ID NO: 158193 - protein, 9 aa, Artificial Sequence
  Description of Artificial Sequence: Synthetic peptide
  Seed: HLETFKAVL (PRAME_HUMAN)
HQETFKAVF

SEQ ID NO: 158194 - protein, 9 aa, Artificial Sequence
  Description of Artificial Sequence: Synthetic peptide
  Seed: THVLYPVPL (PRAME_HUMAN)
TFVLYPVPL

SEQ ID NO: 158195 - protein, 10 aa, Artificial Sequence
  Description of Artificial Sequence: Synthetic peptide
  Seed: LQHLIGLSNL (PRAME_HUMAN)
LMHLIGLSNY

SEQ ID NO: 158196 - protein, 9 aa, Artificial Sequence
  Description of Artificial Sequence: Synthetic peptide
  Seed: SRYISMSVW (PRAME_HUMAN)
SQYISMSVY

SEQ ID NO: 158197 - protein, 10 aa, Artificial Sequence
  Description of Artificial Sequence: Synthetic peptide
  Seed: SALQSLLQHL (PRAME_HUMAN)
SLLQSLLQHV

SEQ ID NO: 158198 - protein, 9 aa, Artificial Sequence
  Description of Artificial Sequence: Synthetic peptide
  Seed: NSHQDFWTV (PRAME_HUMAN)
NPHQDFWTV

SEQ ID NO: 158199 - protein, 9 aa, Artificial Sequence
  Description of Artificial Sequence: Synthetic peptide
  Seed: SHIHASSYI (PRAME_HUMAN)
SAIHASSYM

SEQ ID NO: 158200 - protein, 9 aa, Artificial Sequence
  Description of Artificial Sequence: Synthetic peptide
  Seed: RLAYLHARL (PRAME_HUMAN)
RVAYLHARY

SEQ ID NO: 158201 - protein, 9 aa, Artificial Sequence
  Description of Artificial Sequence: Synthetic peptide
  Seed: SHIHASSYI (PRAME_HUMAN)
SWIHASSYF

SEQ ID NO: 158202 - protein, 9 aa, Artificial Sequence
  Description of Artificial Sequence: Synthetic peptide
  Seed: NSISISALQ (PRAME_HUMAN)
NIISISALR

SEQ ID NO: 158203 - protein, 11 aa, Artificial Sequence
  Description of Artificial Sequence: Synthetic peptide
  Seed: AAFDGRHSQTL (PRAME_HUMAN)
AVFDGRHSQTV

SEQ ID NO: 158204 - protein, 10 aa, Artificial Sequence
  Description of Artificial Sequence: Synthetic peptide
  Seed: SNLTHVLYPV (PRAME_HUMAN)
SVLTHVLYPI

SEQ ID NO: 158205 - protein, 9 aa, Artificial Sequence
  Description of Artificial Sequence: Synthetic peptide
  Seed: VSPEPLQAL (PRAME_HUMAN)
VPPEPLQAP

SEQ ID NO: 158206 - protein, 9 aa, Artificial Sequence
  Description of Artificial Sequence: Synthetic peptide
  Seed: YLHARLREL (PRAME_HUMAN)
YHHARLREL

SEQ ID NO: 158207 - protein, 10 aa, Artificial Sequence
  Description of Artificial Sequence: Synthetic peptide
  Seed: HCSQLTTLSF (PRAME_HUMAN)
HGSQLTTLSF

SEQ ID NO: 158208 - protein, 9 aa, Artificial Sequence
  Description of Artificial Sequence: Synthetic peptide
  Seed: ISPEKEEQY (PRAME_HUMAN)
IQPEKEEQL

SEQ ID NO: 158209 - protein, 10 aa, Artificial Sequence
  Description of Artificial Sequence: Synthetic peptide
  Seed: MERRRLWGSI (PRAME_HUMAN)
MWRRRLWGSL

SEQ ID NO: 158210 - protein, 9 aa, Artificial Sequence
  Description of Artificial Sequence: Synthetic peptide
  Seed: FLSLQCLQA (PRAME_HUMAN)
FISLQCLQI

SEQ ID NO: 158211 - protein, 9 aa, Artificial Sequence
  Description of Artificial Sequence: Synthetic peptide
  Seed: RLAYLHARL (PRAME_HUMAN)
RIAYLHARK

SEQ ID NO: 158212 - protein, 10 aa, Artificial Sequence
  Description of Artificial Sequence: Synthetic peptide
  Seed: QYIAQFTSQF (PRAME_HUMAN)
QLIAQFTSQY

SEQ ID NO: 158213 - protein, 10 aa, Artificial Sequence
  Description of Artificial Sequence: Synthetic peptide
  Seed: DFWTVWSGNR (PRAME_HUMAN)
DSWTVWSGNR

SEQ ID NO: 158214 - protein, 9 aa, Artificial Sequence
  Description of Artificial Sequence: Synthetic peptide
  Seed: LALLPSLSH (PRAME_HUMAN)
LMLLPSLSM

SEQ ID NO: 158215 - protein, 10 aa, Artificial Sequence
  Description of Artificial Sequence: Synthetic peptide
  Seed: LLSHIHASSY (PRAME_HUMAN)
LVSHIHASSW

SEQ ID NO: 158216 - protein, 8 aa, Artificial Sequence
  Description of Artificial Sequence: Synthetic peptide
  Seed: YEDIHGTL (PRAME_HUMAN)
YGDIHGTL

SEQ ID NO: 158217 - protein, 10 aa, Artificial Sequence
  Description of Artificial Sequence: Synthetic peptide
  Seed: YEDIHGTLHL (PRAME_HUMAN)
YYDIHGTLHI

SEQ ID NO: 158218 - protein, 9 aa, Artificial Sequence
  Description of Artificial Sequence: Synthetic peptide
  Seed: YIAQFTSQF (PRAME_HUMAN)
YYAQFTSQL

SEQ ID NO: 158219 - protein, 9 aa, Artificial Sequence
  Description of Artificial Sequence: Synthetic peptide
  Seed: RLRELLCEL (PRAME_HUMAN)
RKRELLCEM

SEQ ID NO: 158220 - protein, 9 aa, Artificial Sequence
  Description of Artificial Sequence: Synthetic peptide
  Seed: ISISALQSL (PRAME_HUMAN)
IAISALQSL

SEQ ID NO: 158221 - protein, 9 aa, Artificial Sequence
  Description of Artificial Sequence: Synthetic peptide
  Seed: YSFPEPEAA (PRAME_HUMAN)
YAFPEPEAL

SEQ ID NO: 158222 - protein, 10 aa, Artificial Sequence
  Description of Artificial Sequence: Synthetic peptide
  Seed: RLWGSIQSRY (PRAME_HUMAN)
RSWGSIQSRR

SEQ ID NO: 158223 - protein, 8 aa, Artificial Sequence
  Description of Artificial Sequence: Synthetic peptide
  Seed: CTWKLPTL (PRAME_HUMAN)
CQWKLPTI

SEQ ID NO: 158224 - protein, 10 aa, Artificial Sequence
  Description of Artificial Sequence: Synthetic peptide
  Seed: KVKRKKNVLR (PRAME_HUMAN)
KYKRKKNVLA

SEQ ID NO: 158225 - protein, 9 aa, Artificial Sequence
  Description of Artificial Sequence: Synthetic peptide
  Seed: YSFPEPEAA (PRAME_HUMAN)
YVFPEPEAV

SEQ ID NO: 158226 - protein, 10 aa, Artificial Sequence
  Description of Artificial Sequence: Synthetic peptide
  Seed: RLWGSIQSRY (PRAME_HUMAN)
RTWGSIQSRI

SEQ ID NO: 158227 - protein, 9 aa, Artificial Sequence
  Description of Artificial Sequence: Synthetic peptide
  Seed: HVMNPLETL (PRAME_HUMAN)
HYMNPLETM

SEQ ID NO: 158228 - protein, 10 aa, Artificial Sequence
  Description of Artificial Sequence: Synthetic peptide
  Seed: RLWGSIQSRY (PRAME_HUMAN)
RAWGSIQSRR

SEQ ID NO: 158229 - protein, 9 aa, Artificial Sequence
  Description of Artificial Sequence: Synthetic peptide
  Seed: KLKIFAMPM (PRAME_HUMAN)
KYKIFAMPM

SEQ ID NO: 158230 - protein, 9 aa, Artificial Sequence
  Description of Artificial Sequence: Synthetic peptide
  Seed: VSQLSVLSL (PRAME_HUMAN)
VKQLSVLSL

SEQ ID NO: 158231 - protein, 10 aa, Artificial Sequence
  Description of Artificial Sequence: Synthetic peptide
  Seed: ITDDQLLALL (PRAME_HUMAN)
ISDDQLLALM

SEQ ID NO: 158232 - protein, 9 aa, Artificial Sequence
  Description of Artificial Sequence: Synthetic peptide
  Seed: FYDPEPILC (PRAME_HUMAN)
FRDPEPILV

SEQ ID NO: 158233 - protein, 10 aa, Artificial Sequence
  Description of Artificial Sequence: Synthetic peptide
  Seed: KVKRKKNVLR (PRAME_HUMAN)
KVKRKKNVLV

SEQ ID NO: 158234 - protein, 9 aa, Artificial Sequence
  Description of Artificial Sequence: Synthetic peptide
  Seed: VFDECGITD (PRAME_HUMAN)
VWDECGITM

SEQ ID NO: 158235 - protein, 10 aa, Artificial Sequence
  Description of Artificial Sequence: Synthetic peptide
  Seed: ALAIAALELL (PRAME_HUMAN)
ALAIAALELI

SEQ ID NO: 158236 - protein, 9 aa, Artificial Sequence
  Description of Artificial Sequence: Synthetic peptide
  Seed: TWKLPTLAK (PRAME_HUMAN)
TSKLPTLAA

SEQ ID NO: 158237 - protein, 10 aa, Artificial Sequence
  Description of Artificial Sequence: Synthetic peptide
  Seed: IGLSNLTHVL (PRAME_HUMAN)
ILLSNLTHVK

SEQ ID NO: 158238 - protein, 10 aa, Artificial Sequence
  Description of Artificial Sequence: Synthetic peptide
  Seed: LPTLAKFSPY (PRAME_HUMAN)
LTTLAKFSPF

SEQ ID NO: 158239 - protein, 11 aa, Artificial Sequence
  Description of Artificial Sequence: Synthetic peptide
  Seed: SYISPEKEEQY (PRAME_HUMAN)
SQISPEKEEQY

SEQ ID NO: 158240 - protein, 11 aa, Artificial Sequence
  Description of Artificial Sequence: Synthetic peptide
  Seed: SFPEPEAAQPM (PRAME_HUMAN)
SVPEPEAAQPL

SEQ ID NO: 158241 - protein, 8 aa, Artificial Sequence
  Description of Artificial Sequence: Synthetic peptide
  Seed: YEDIHGTL (PRAME_HUMAN)
YSDIHGTF

SEQ ID NO: 158242 - protein, 10 aa, Artificial Sequence
  Description of Artificial Sequence: Synthetic peptide
  Seed: LSQSPSVSQL (PRAME_HUMAN)
LAQSPSVSQY

SEQ ID NO: 158243 - protein, 10 aa, Artificial Sequence
  Description of Artificial Sequence: Synthetic peptide
  Seed: SPYLGQMINL (PRAME_HUMAN)
SNYLGQMINL

SEQ ID NO: 158244 - protein, 10 aa, Artificial Sequence
  Description of Artificial Sequence: Synthetic peptide
  Seed: LERLAYLHAR (PRAME_HUMAN)
LPRLAYLHAK

SEQ ID NO: 158245 - protein, 11 aa, Artificial Sequence
  Description of Artificial Sequence: Synthetic peptide
  Seed: GRLDQLLRHVM (PRAME_HUMAN)
GRLDQLLRHVL

SEQ ID NO: 158246 - protein, 10 aa, Artificial Sequence
  Description of Artificial Sequence: Synthetic peptide
  Seed: RHVMNPLETL (PRAME_HUMAN)
RSVMNPLETF

SEQ ID NO: 158247 - protein, 10 aa, Artificial Sequence
  Description of Artificial Sequence: Synthetic peptide
  Seed: SISISALQSL (PRAME_HUMAN)
SMSISALQSA

SEQ ID NO: 158248 - protein, 9 aa, Artificial Sequence
  Description of Artificial Sequence: Synthetic peptide
  Seed: ITDDQLLAL (PRAME_HUMAN)
IYDDQLLAI

SEQ ID NO: 158249 - protein, 10 aa, Artificial Sequence
  Description of Artificial Sequence: Synthetic peptide
  Seed: RRRLWGSIQS (PRAME_HUMAN)
RIRLWGSIQK

SEQ ID NO: 158250 - protein, 10 aa, Artificial Sequence
  Description of Artificial Sequence: Synthetic peptide
  Seed: AMVQAWPFTC (PRAME_HUMAN)
AYVQAWPFTV

SEQ ID NO: 158251 - protein, 10 aa, Artificial Sequence
  Description of Artificial Sequence: Synthetic peptide
  Seed: TSQFLSLQCL (PRAME_HUMAN)
TNQFLSLQCY

SEQ ID NO: 158252 - protein, 9 aa, Artificial Sequence
  Description of Artificial Sequence: Synthetic peptide
  Seed: SLSHCSQLT (PRAME_HUMAN)
STSHCSQLV

SEQ ID NO: 158253 - protein, 9 aa, Artificial Sequence
  Description of Artificial Sequence: Synthetic peptide
  Seed: LAYLHARLR (PRAME_HUMAN)
LGYLHARLR

SEQ ID NO: 158254 - protein, 9 aa, Artificial Sequence
  Description of Artificial Sequence: Synthetic peptide
  Seed: RLRELLCEL (PRAME_HUMAN)
RLRELLCEI

SEQ ID NO: 158255 - protein, 10 aa, Artificial Sequence
  Description of Artificial Sequence: Synthetic peptide
  Seed: VTCTWKLPTL (PRAME_HUMAN)
VQCTWKLPTV

SEQ ID NO: 158256 - protein, 8 aa, Artificial Sequence
  Description of Artificial Sequence: Synthetic peptide
  Seed: YSFPEPEA (PRAME_HUMAN)
YTFPEPEY

SEQ ID NO: 158257 - protein, 9 aa, Artificial Sequence
  Description of Artificial Sequence: Synthetic peptide
  Seed: SQSPSVSQL (PRAME_HUMAN)
SISPSVSQA

SEQ ID NO: 158258 - protein, 9 aa, Artificial Sequence
  Description of Artificial Sequence: Synthetic peptide
  Seed: CSQLTTLSF (PRAME_HUMAN)
CPQLTTLSL

SEQ ID NO: 158259 - protein, 9 aa, Artificial Sequence
  Description of Artificial Sequence: Synthetic peptide
  Seed: LALLPSLSH (PRAME_HUMAN)
LHLLPSLSF

SEQ ID NO: 158260 - protein, 9 aa, Artificial Sequence
  Description of Artificial Sequence: Synthetic peptide
  Seed: VSPEPLQAL (PRAME_HUMAN)
VMPEPLQAA

SEQ ID NO: 158261 - protein, 9 aa, Artificial Sequence
  Description of Artificial Sequence: Synthetic peptide
  Seed: SYEDIHGTL (PRAME_HUMAN)
SVEDIHGTL

SEQ ID NO: 158262 - protein, 9 aa, Artificial Sequence
  Description of Artificial Sequence: Synthetic peptide
  Seed: RGRLDQLLR (PRAME_HUMAN)
RTRLDQLLI

SEQ ID NO: 158263 - protein, 9 aa, Artificial Sequence
  Description of Artificial Sequence: Synthetic peptide
  Seed: ALYVDSLFF (PRAME_HUMAN)
AFYVDSLFF

SEQ ID NO: 158264 - protein, 11 aa, Artificial Sequence
  Description of Artificial Sequence: Synthetic peptide
  Seed: AAFDGRHSQTL (PRAME_HUMAN)
ALFDGRHSQTI

SEQ ID NO: 158265 - protein, 9 aa, Artificial Sequence
  Description of Artificial Sequence: Synthetic peptide
  Seed: ISISALQSL (PRAME_HUMAN)
ILISALQSA

SEQ ID NO: 158266 - protein, 9 aa, Artificial Sequence
  Description of Artificial Sequence: Synthetic peptide
  Seed: KLKIFAMPM (PRAME_HUMAN)
KWKIFAMPI

SEQ ID NO: 158267 - protein, 10 aa, Artificial Sequence
  Description of Artificial Sequence: Synthetic peptide
  Seed: AEQPFIPVEV (PRAME_HUMAN)
AQQPFIPVEL

SEQ ID NO: 158268 - protein, 9 aa, Artificial Sequence
  Description of Artificial Sequence: Synthetic peptide
  Seed: LQHLIGLSN (PRAME_HUMAN)
LRHLIGLSM

SEQ ID NO: 158269 - protein, 9 aa, Artificial Sequence
  Description of Artificial Sequence: Synthetic peptide
  Seed: AAFDGRHSQ (PRAME_HUMAN)
AQFDGRHSL

SEQ ID NO: 158270 - protein, 9 aa, Artificial Sequence
  Description of Artificial Sequence: Synthetic peptide
  Seed: YEDIHGTLH (PRAME_HUMAN)
YEDIHGTLL

SEQ ID NO: 158271 - protein, 9 aa, Artificial Sequence
  Description of Artificial Sequence: Synthetic peptide
  Seed: VQAWPFTCL (PRAME_HUMAN)
VLAWPFTCY

SEQ ID NO: 158272 - protein, 9 aa, Artificial Sequence
  Description of Artificial Sequence: Synthetic peptide
  Seed: VSPEPLQAL (PRAME_HUMAN)
VTPEPLQAR

SEQ ID NO: 158273 - protein, 9 aa, Artificial Sequence
  Description of Artificial Sequence: Synthetic peptide
  Seed: RASATLQDL (PRAME_HUMAN)
RISATLQDF

SEQ ID NO: 158274 - protein, 8 aa, Artificial Sequence
  Description of Artificial Sequence: Synthetic peptide
  Seed: YSFPEPEA (PRAME_HUMAN)
YIFPEPEL

SEQ ID NO: 158275 - protein, 10 aa, Artificial Sequence
  Description of Artificial Sequence: Synthetic peptide
  Seed: KDEALAIAAL (PRAME_HUMAN)
KSEALAIAAA

SEQ ID NO: 158276 - protein, 9 aa, Artificial Sequence
  Description of Artificial Sequence: Synthetic peptide
  Seed: RLLLSHIHA (PRAME_HUMAN)
RQLLSHIHK

SEQ ID NO: 158277 - protein, 10 aa, Artificial Sequence
  Description of Artificial Sequence: Synthetic peptide
  Seed: VEVLVDLFLK (PRAME_HUMAN)
VTVLVDLFLK

SEQ ID NO: 158278 - protein, 9 aa, Artificial Sequence
  Description of Artificial Sequence: Synthetic peptide
  Seed: AVLDGLDVL (PRAME_HUMAN)
ALLDGLDVF

SEQ ID NO: 158279 - protein, 9 aa, Artificial Sequence
  Description of Artificial Sequence: Synthetic peptide
  Seed: ITDDQLLAL (PRAME_HUMAN)
IHDDQLLAF

SEQ ID NO: 158280 - protein, 11 aa, Artificial Sequence
  Description of Artificial Sequence: Synthetic peptide
  Seed: LSNLTHVLYPV (PRAME_HUMAN)
LYNLTHVLYPV

SEQ ID NO: 158281 - protein, 9 aa, Artificial Sequence
  Description of Artificial Sequence: Synthetic peptide
  Seed: GLSNLTHVL (PRAME_HUMAN)
GMSNLTHVF

SEQ ID NO: 158282 - protein, 9 aa, Artificial Sequence
  Description of Artificial Sequence: Synthetic peptide
  Seed: LSVLSLSGV (PRAME_HUMAN)
LIVLSLSGV

SEQ ID NO: 158283 - protein, 10 aa, Artificial Sequence
  Description of Artificial Sequence: Synthetic peptide
  Seed: YIAQFTSQFL (PRAME_HUMAN)
YLAQFTSQFY

SEQ ID NO: 158284 - protein, 9 aa, Artificial Sequence
  Description of Artificial Sequence: Synthetic peptide
  Seed: YVDSLFFLR (PRAME_HUMAN)
YSDSLFFLY

SEQ ID NO: 158285 - protein, 9 aa, Artificial Sequence
  Description of Artificial Sequence: Synthetic peptide
  Seed: SVWTSPRRL (PRAME_HUMAN)
SLWTSPRRV

SEQ ID NO: 158286 - protein, 9 aa, Artificial Sequence
  Description of Artificial Sequence: Synthetic peptide
  Seed: SLLQHLIGL (PRAME_HUMAN)
SHLQHLIGL

SEQ ID NO: 158287 - protein, 10 aa, Artificial Sequence
  Description of Artificial Sequence: Synthetic peptide
  Seed: RLAYLHARLR (PRAME_HUMAN)
RCAYLHARLK

SEQ ID NO: 158288 - protein, 10 aa, Artificial Sequence
  Description of Artificial Sequence: Synthetic peptide
  Seed: KVKRKKNVLR (PRAME_HUMAN)
KYKRKKNVLR

SEQ ID NO: 158289 - protein, 10 aa, Artificial Sequence
  Description of Artificial Sequence: Synthetic peptide
  Seed: VLYPVPLESY (PRAME_HUMAN)
VQYPVPLESF

SEQ ID NO: 158290 - protein, 10 aa, Artificial Sequence
  Description of Artificial Sequence: Synthetic peptide
  Seed: MVQAWPFTCL (PRAME_HUMAN)
MTQAWPFTCV

SEQ ID NO: 158291 - protein, 10 aa, Artificial Sequence
  Description of Artificial Sequence: Synthetic peptide
  Seed: FLSLQCLQAL (PRAME_HUMAN)
FTSLQCLQAV

SEQ ID NO: 158292 - protein, 10 aa, Artificial Sequence
  Description of Artificial Sequence: Synthetic peptide
  Seed: RLAYLHARLR (PRAME_HUMAN)
RMAYLHARLL

SEQ ID NO: 158293 - protein, 9 aa, Artificial Sequence
  Description of Artificial Sequence: Synthetic peptide
  Seed: AQEVRPRRW (PRAME_HUMAN)
AEEVRPRRW

SEQ ID NO: 158294 - protein, 10 aa, Artificial Sequence
  Description of Artificial Sequence: Synthetic peptide
  Seed: SGNRASLYSF (PRAME_HUMAN)
SSNRASLYSW

SEQ ID NO: 158295 - protein, 9 aa, Artificial Sequence
  Description of Artificial Sequence: Synthetic peptide
  Seed: NSHQDFWTV (PRAME_HUMAN)
NTHQDFWTV

SEQ ID NO: 158296 - protein, 10 aa, Artificial Sequence
  Description of Artificial Sequence: Synthetic peptide
  Seed: FYDPEPILCP (PRAME_HUMAN)
FWDPEPILCM

SEQ ID NO: 158297 - protein, 10 aa, Artificial Sequence
  Description of Artificial Sequence: Synthetic peptide
  Seed: ALYVDSLFFL (PRAME_HUMAN)
ASYVDSLFFF

SEQ ID NO: 158298 - protein, 8 aa, Artificial Sequence
  Description of Artificial Sequence: Synthetic peptide
  Seed: YEDIHGTL (PRAME_HUMAN)
YSDIHGTV

SEQ ID NO: 158299 - protein, 10 aa, Artificial Sequence
  Description of Artificial Sequence: Synthetic peptide
  Seed: RLSEGDVMHL (PRAME_HUMAN)
RQSEGDVMHW

SEQ ID NO: 158300 - protein, 10 aa, Artificial Sequence
  Description of Artificial Sequence: Synthetic peptide
  Seed: ISMSVWTSPR (PRAME_HUMAN)
IHMSVWTSPR

SEQ ID NO: 158301 - protein, 9 aa, Artificial Sequence
  Description of Artificial Sequence: Synthetic peptide
  Seed: TFYDPEPIL (PRAME_HUMAN)
TSYDPEPIY

SEQ ID NO: 158302 - protein, 9 aa, Artificial Sequence
  Description of Artificial Sequence: Synthetic peptide
  Seed: LQDLVFDEC (PRAME_HUMAN)
LGDLVFDEL

SEQ ID NO: 158303 - protein, 9 aa, Artificial Sequence
  Description of Artificial Sequence: Synthetic peptide
  Seed: ALAIAALEL (PRAME_HUMAN)
ASAIAALEM

SEQ ID NO: 158304 - protein, 9 aa, Artificial Sequence
  Description of Artificial Sequence: Synthetic peptide
  Seed: MHLSQSPSV (PRAME_HUMAN)
MQLSQSPSM

SEQ ID NO: 158305 - protein, 10 aa, Artificial Sequence
  Description of Artificial Sequence: Synthetic peptide
  Seed: VRPRRWKLQV (PRAME_HUMAN)
VGPRRWKLQL

SEQ ID NO: 158306 - protein, 9 aa, Artificial Sequence
  Description of Artificial Sequence: Synthetic peptide
  Seed: MNPLETLSI (PRAME_HUMAN)
MAPLETLSM

SEQ ID NO: 158307 - protein, 10 aa, Artificial Sequence
  Description of Artificial Sequence: Synthetic peptide
  Seed: LPTLAKFSPY (PRAME_HUMAN)
LVTLAKFSPY

SEQ ID NO: 158308 - protein, 9 aa, Artificial Sequence
  Description of Artificial Sequence: Synthetic peptide
  Seed: TLAKFSPYL (PRAME_HUMAN)
TLAKFSPYA

SEQ ID NO: 158309 - protein, 10 aa, Artificial Sequence
  Description of Artificial Sequence: Synthetic peptide
  Seed: GACDELFSYL (PRAME_HUMAN)
GTCDELFSYI

SEQ ID NO: 158310 - protein, 9 aa, Artificial Sequence
  Description of Artificial Sequence: Synthetic peptide
  Seed: KFSPYLGQM (PRAME_HUMAN)
KYSPYLGQF

SEQ ID NO: 158311 - protein, 9 aa, Artificial Sequence
  Description of Artificial Sequence: Synthetic peptide
  Seed: AMVQAWPFT (PRAME_HUMAN)
AIVQAWPFA

SEQ ID NO: 158312 - protein, 10 aa, Artificial Sequence
  Description of Artificial Sequence: Synthetic peptide
  Seed: HLERLAYLHA (PRAME_HUMAN)
HQERLAYLHK

SEQ ID NO: 158313 - protein, 10 aa, Artificial Sequence
  Description of Artificial Sequence: Synthetic peptide
  Seed: RELFPPLFMA (PRAME_HUMAN)
RWLFPPLFML

SEQ ID NO: 158314 - protein, 10 aa, Artificial Sequence
  Description of Artificial Sequence: Synthetic peptide
  Seed: IQSRYISMSV (PRAME_HUMAN)
IPSRYISMSK

SEQ ID NO: 158315 - protein, 9 aa, Artificial Sequence
  Description of Artificial Sequence: Synthetic peptide
  Seed: DSLFFLRGR (PRAME_HUMAN)
DVLFFLRGK

SEQ ID NO: 158316 - protein, 10 aa, Artificial Sequence
  Description of Artificial Sequence: Synthetic peptide
  Seed: SLLKDEALAI (PRAME_HUMAN)
STLKDEALAV

SEQ ID NO: 158317 - protein, 9 aa, Artificial Sequence
  Description of Artificial Sequence: Synthetic peptide
  Seed: YIAQFTSQF (PRAME_HUMAN)
YPAQFTSQH

SEQ ID NO: 158318 - protein, 8 aa, Artificial Sequence
  Description of Artificial Sequence: Synthetic peptide
  Seed: TDDQLLAL (PRAME_HUMAN)
TIDQLLAL

SEQ ID NO: 158319 - protein, 9 aa, Artificial Sequence
  Description of Artificial Sequence: Synthetic peptide
  Seed: YSFPEPEAA (PRAME_HUMAN)
YMFPEPEAT

SEQ ID NO: 158320 - protein, 9 aa, Artificial Sequence
  Description of Artificial Sequence: Synthetic peptide
  Seed: YLGQMINLR (PRAME_HUMAN)
YYGQMINLR

SEQ ID NO: 158321 - protein, 9 aa, Artificial Sequence
  Description of Artificial Sequence: Synthetic peptide
  Seed: VSPEPLQAL (PRAME_HUMAN)
VLPEPLQAF

SEQ ID NO: 158322 - protein, 10 aa, Artificial Sequence
  Description of Artificial Sequence: Synthetic peptide
  Seed: AVLDGLDVLL (PRAME_HUMAN)
AFLDGLDVLV

SEQ ID NO: 158323 - protein, 10 aa, Artificial Sequence
  Description of Artificial Sequence: Synthetic peptide
  Seed: MVQAWPFTCL (PRAME_HUMAN)
MDQAWPFTCF

SEQ ID NO: 158324 - protein, 9 aa, Artificial Sequence
  Description of Artificial Sequence: Synthetic peptide
  Seed: VLSLSGVML (PRAME_HUMAN)
VQSLSGVMF

SEQ ID NO: 158325 - protein, 8 aa, Artificial Sequence
  Description of Artificial Sequence: Synthetic peptide
  Seed: YSFPEPEA (PRAME_HUMAN)
YAFPEPEI

SEQ ID NO: 158326 - protein, 10 aa, Artificial Sequence
  Description of Artificial Sequence: Synthetic peptide
  Seed: LTDVSPEPLQ (PRAME_HUMAN)
LVDVSPEPLY

SEQ ID NO: 158327 - protein, 9 aa, Artificial Sequence
  Description of Artificial Sequence: Synthetic peptide
  Seed: GLSNLTHVL (PRAME_HUMAN)
GVSNLTHVF

SEQ ID NO: 158328 - protein, 9 aa, Artificial Sequence
  Description of Artificial Sequence: Synthetic peptide
  Seed: LQHLIGLSN (PRAME_HUMAN)
LIHLIGLSF

SEQ ID NO: 158329 - protein, 9 aa, Artificial Sequence
  Description of Artificial Sequence: Synthetic peptide
  Seed: RLRELLCEL (PRAME_HUMAN)
RIRELLCEK

SEQ ID NO: 158330 - protein, 9 aa, Artificial Sequence
  Description of Artificial Sequence: Synthetic peptide
  Seed: FLRGRLDQL (PRAME_HUMAN)
FTRGRLDQI

SEQ ID NO: 158331 - protein, 9 aa, Artificial Sequence
  Description of Artificial Sequence: Synthetic peptide
  Seed: LQALYVDSL (PRAME_HUMAN)
LQALYVDSV

SEQ ID NO: 158332 - protein, 10 aa, Artificial Sequence
  Description of Artificial Sequence: Synthetic peptide
  Seed: RLAYLHARLR (PRAME_HUMAN)
RIAYLHARLK

SEQ ID NO: 158333 - protein, 8 aa, Artificial Sequence
  Description of Artificial Sequence: Synthetic peptide
  Seed: LAYLHARL (PRAME_HUMAN)
LQYLHARL

SEQ ID NO: 158334 - protein, 9 aa, Artificial Sequence
  Description of Artificial Sequence: Synthetic peptide
  Seed: VFDECGITD (PRAME_HUMAN)
VFDECGITF

SEQ ID NO: 158335 - protein, 9 aa, Artificial Sequence
  Description of Artificial Sequence: Synthetic peptide
  Seed: RHSQTLKAM (PRAME_HUMAN)
RRSQTLKAY

SEQ ID NO: 158336 - protein, 8 aa, Artificial Sequence
  Description of Artificial Sequence: Synthetic peptide
  Seed: TDDQLLAL (PRAME_HUMAN)
TWDQLLAF

SEQ ID NO: 158337 - protein, 9 aa, Artificial Sequence
  Description of Artificial Sequence: Synthetic peptide
  Seed: YLGQMINLR (PRAME_HUMAN)
YMGQMINLR

SEQ ID NO: 158338 - protein, 9 aa, Artificial Sequence
  Description of Artificial Sequence: Synthetic peptide
  Seed: SQFLSLQCL (PRAME_HUMAN)
SRFLSLQCM

SEQ ID NO: 158339 - protein, 9 aa, Artificial Sequence
  Description of Artificial Sequence: Synthetic peptide
  Seed: QALLERASA (PRAME_HUMAN)
QPLLERASA

SEQ ID NO: 158340 - protein, 9 aa, Artificial Sequence
  Description of Artificial Sequence: Synthetic peptide
  Seed: MINLRRLLL (PRAME_HUMAN)
MNNLRRLLL

SEQ ID NO: 158341 - protein, 11 aa, Artificial Sequence
  Description of Artificial Sequence: Synthetic peptide
  Seed: LSLSGVMLTDV (PRAME_HUMAN)
LLLSGVMLTDV

SEQ ID NO: 158342 - protein, 9 aa, Artificial Sequence
  Description of Artificial Sequence: Synthetic peptide
  Seed: FTCLPLGVL (PRAME_HUMAN)
FLCLPLGVA

SEQ ID NO: 158343 - protein, 10 aa, Artificial Sequence
  Description of Artificial Sequence: Synthetic peptide
  Seed: LKAMVQAWPF (PRAME_HUMAN)
LTAMVQAWPY

SEQ ID NO: 158344 - protein, 9 aa, Artificial Sequence
  Description of Artificial Sequence: Synthetic peptide
  Seed: MPMQDIKMI (PRAME_HUMAN)
MPMQDIKMA

SEQ ID NO: 158345 - protein, 10 aa, Artificial Sequence
  Description of Artificial Sequence: Synthetic peptide
  Seed: RASATLQDLV (PRAME_HUMAN)
RYSATLQDLW

SEQ ID NO: 158346 - protein, 11 aa, Artificial Sequence
  Description of Artificial Sequence: Synthetic peptide
  Seed: LPTLAKFSPYL (PRAME_HUMAN)
LGTLAKFSPYV

SEQ ID NO: 158347 - protein, 9 aa, Artificial Sequence
  Description of Artificial Sequence: Synthetic peptide
  Seed: YIAQFTSQF (PRAME_HUMAN)
YPAQFTSQR

SEQ ID NO: 158348 - protein, 9 aa, Artificial Sequence
  Description of Artificial Sequence: Synthetic peptide
  Seed: SIQSRYISM (PRAME_HUMAN)
SSQSRYISY

SEQ ID NO: 158349 - protein, 9 aa, Artificial Sequence
  Description of Artificial Sequence: Synthetic peptide
  Seed: LMKGQHLHL (PRAME_HUMAN)
LMKGQHLHW

SEQ ID NO: 158350 - protein, 10 aa, Artificial Sequence
  Description of Artificial Sequence: Synthetic peptide
  Seed: FLSLQCLQAL (PRAME_HUMAN)
FISLQCLQAI

SEQ ID NO: 158351 - protein, 9 aa, Artificial Sequence
  Description of Artificial Sequence: Synthetic peptide
  Seed: RLRELLCEL (PRAME_HUMAN)
RIRELLCEW

SEQ ID NO: 158352 - protein, 9 aa, Artificial Sequence
  Description of Artificial Sequence: Synthetic peptide
  Seed: GQHLHLETF (PRAME_HUMAN)
GIHLHLETF

SEQ ID NO: 158353 - protein, 9 aa, Artificial Sequence
  Description of Artificial Sequence: Synthetic peptide
  Seed: YSFPEPEAA (PRAME_HUMAN)
YGFPEPEAV

SEQ ID NO: 158354 - protein, 9 aa, Artificial Sequence
  Description of Artificial Sequence: Synthetic peptide
  Seed: TSPRRLVEL (PRAME_HUMAN)
TRPRRLVEM

SEQ ID NO: 158355 - protein, 8 aa, Artificial Sequence
  Description of Artificial Sequence: Synthetic peptide
  Seed: FYDPEPIL (PRAME_HUMAN)
FADPEPII

SEQ ID NO: 158356 - protein, 9 aa, Artificial Sequence
  Description of Artificial Sequence: Synthetic peptide
  Seed: QSRYISMSV (PRAME_HUMAN)
QARYISMSM

SEQ ID NO: 158357 - protein, 10 aa, Artificial Sequence
  Description of Artificial Sequence: Synthetic peptide
  Seed: ESYEDIHGTL (PRAME_HUMAN)
ESYEDIHGTF

SEQ ID NO: 158358 - protein, 9 aa, Artificial Sequence
  Description of Artificial Sequence: Synthetic peptide
  Seed: CKKLKIFAM (PRAME_HUMAN)
CMKLKIFAM

SEQ ID NO: 158359 - protein, 9 aa, Artificial Sequence
  Description of Artificial Sequence: Synthetic peptide
  Seed: TSPRRLVEL (PRAME_HUMAN)
TLPRRLVEV

SEQ ID NO: 158360 - protein, 9 aa, Artificial Sequence
  Description of Artificial Sequence: Synthetic peptide
  Seed: VLMKGQHLH (PRAME_HUMAN)
VYMKGQHLY

SEQ ID NO: 158361 - protein, 9 aa, Artificial Sequence
  Description of Artificial Sequence: Synthetic peptide
  Seed: KLQVLDLRK (PRAME_HUMAN)
KFQVLDLRR

SEQ ID NO: 158362 - protein, 10 aa, Artificial Sequence
  Description of Artificial Sequence: Synthetic peptide
  Seed: FFLRGRLDQL (PRAME_HUMAN)
FVLRGRLDQV

SEQ ID NO: 158363 - protein, 9 aa, Artificial Sequence
  Description of Artificial Sequence: Synthetic peptide
  Seed: ERLAYLHAR (PRAME_HUMAN)
EYLAYLHAR

SEQ ID NO: 158364 - protein, 10 aa, Artificial Sequence
  Description of Artificial Sequence: Synthetic peptide
  Seed: SNLTHVLYPV (PRAME_HUMAN)
SDLTHVLYPV

SEQ ID NO: 158365 - protein, 9 aa, Artificial Sequence
  Description of Artificial Sequence: Synthetic peptide
  Seed: SQFLSLQCL (PRAME_HUMAN)
SLFLSLQCA

SEQ ID NO: 158366 - protein, 9 aa, Artificial Sequence
  Description of Artificial Sequence: Synthetic peptide
  Seed: KAMVQAWPF (PRAME_HUMAN)
KFMVQAWPI

SEQ ID NO: 158367 - protein, 9 aa, Artificial Sequence
  Description of Artificial Sequence: Synthetic peptide
  Seed: SMSVWTSPR (PRAME_HUMAN)
SLSVWTSPR

SEQ ID NO: 158368 - protein, 10 aa, Artificial Sequence
  Description of Artificial Sequence: Synthetic peptide
  Seed: DVSPEPLQAL (PRAME_HUMAN)
DTSPEPLQAV

SEQ ID NO: 158369 - protein, 10 aa, Artificial Sequence
  Description of Artificial Sequence: Synthetic peptide
  Seed: ISISALQSLL (PRAME_HUMAN)
IYISALQSLW

SEQ ID NO: 158370 - protein, 9 aa, Artificial Sequence
  Description of Artificial Sequence: Synthetic peptide
  Seed: GACDELFSY (PRAME_HUMAN)
GMCDELFSR

SEQ ID NO: 158371 - protein, 10 aa, Artificial Sequence
  Description of Artificial Sequence: Synthetic peptide
  Seed: LLSHIHASSY (PRAME_HUMAN)
LESHIHASSY

SEQ ID NO: 158372 - protein, 9 aa, Artificial Sequence
  Description of Artificial Sequence: Synthetic peptide
  Seed: ITDDQLLAL (PRAME_HUMAN)
IDDDQLLAI

SEQ ID NO: 158373 - protein, 9 aa, Artificial Sequence
  Description of Artificial Sequence: Synthetic peptide
  Seed: TCLPLGVLM (PRAME_HUMAN)
TALPLGVLY

SEQ ID NO: 158374 - protein, 9 aa, Artificial Sequence
  Description of Artificial Sequence: Synthetic peptide
  Seed: LSHIHASSY (PRAME_HUMAN)
LFHIHASSL

SEQ ID NO: 158375 - protein, 9 aa, Artificial Sequence
  Description of Artificial Sequence: Synthetic peptide
  Seed: LQHLIGLSN (PRAME_HUMAN)
LTHLIGLSF

SEQ ID NO: 158376 - protein, 9 aa, Artificial Sequence
  Description of Artificial Sequence: Synthetic peptide
  Seed: AMPMQDIKM (PRAME_HUMAN)
AAPMQDIKL

SEQ ID NO: 158377 - protein, 9 aa, Artificial Sequence
  Description of Artificial Sequence: Synthetic peptide
  Seed: LMKGQHLHL (PRAME_HUMAN)
LFKGQHLHL

SEQ ID NO: 158378 - protein, 9 aa, Artificial Sequence
  Description of Artificial Sequence: Synthetic peptide
  Seed: LLSHIHASS (PRAME_HUMAN)
LISHIHASV

SEQ ID NO: 158379 - protein, 9 aa, Artificial Sequence
  Description of Artificial Sequence: Synthetic peptide
  Seed: AQEVRPRRW (PRAME_HUMAN)
AEEVRPRRF

SEQ ID NO: 158380 - protein, 8 aa, Artificial Sequence
  Description of Artificial Sequence: Synthetic peptide
  Seed: TDDQLLAL (PRAME_HUMAN)
TVDQLLAI

SEQ ID NO: 158381 - protein, 11 aa, Artificial Sequence
  Description of Artificial Sequence: Synthetic peptide
  Seed: PRELFPPLFMA (PRAME_HUMAN)
PFELFPPLFMI

SEQ ID NO: 158382 - protein, 10 aa, Artificial Sequence
  Description of Artificial Sequence: Synthetic peptide
  Seed: GLSNLTHVLY (PRAME_HUMAN)
GLSNLTHVLK

SEQ ID NO: 158383 - protein, 10 aa, Artificial Sequence
  Description of Artificial Sequence: Synthetic peptide
  Seed: GLSNLTHVLY (PRAME_HUMAN)
GLSNLTHVLL

SEQ ID NO: 158384 - protein, 9 aa, Artificial Sequence
  Description of Artificial Sequence: Synthetic peptide
  Seed: LMKGQHLHL (PRAME_HUMAN)
LAKGQHLHF

SEQ ID NO: 158385 - protein, 9 aa, Artificial Sequence
  Description of Artificial Sequence: Synthetic peptide
  Seed: ALQSLLQHL (PRAME_HUMAN)
AVQSLLQHR

SEQ ID NO: 158386 - protein, 10 aa, Artificial Sequence
  Description of Artificial Sequence: Synthetic peptide
  Seed: KDEALAIAAL (PRAME_HUMAN)
KMEALAIAAA

SEQ ID NO: 158387 - protein, 9 aa, Artificial Sequence
  Description of Artificial Sequence: Synthetic peptide
  Seed: RLWGSIQSR (PRAME_HUMAN)
RMWGSIQSV

SEQ ID NO: 158388 - protein, 9 aa, Artificial Sequence
  Description of Artificial Sequence: Synthetic peptide
  Seed: CSQLTTLSF (PRAME_HUMAN)
CEQLTTLSY

SEQ ID NO: 158389 - protein, 10 aa, Artificial Sequence
  Description of Artificial Sequence: Synthetic peptide
  Seed: FAMPMQDIKM (PRAME_HUMAN)
FQMPMQDIKL

SEQ ID NO: 158390 - protein, 11 aa, Artificial Sequence
  Description of Artificial Sequence: Synthetic peptide
  Seed: AAFDGRHSQTL (PRAME_HUMAN)
AVFDGRHSQTL

SEQ ID NO: 158391 - protein, 9 aa, Artificial Sequence
  Description of Artificial Sequence: Synthetic peptide
  Seed: QLLALLPSL (PRAME_HUMAN)
QILALLPSV

SEQ ID NO: 158392 - protein, 10 aa, Artificial Sequence
  Description of Artificial Sequence: Synthetic peptide
  Seed: LLLSHIHASS (PRAME_HUMAN)
LHLSHIHASA

SEQ ID NO: 158393 - protein, 9 aa, Artificial Sequence
  Description of Artificial Sequence: Synthetic peptide
  Seed: FYDPEPILC (PRAME_HUMAN)
FDDPEPILM

SEQ ID NO: 158394 - protein, 10 aa, Artificial Sequence
  Description of Artificial Sequence: Synthetic peptide
  Seed: IGLSNLTHVL (PRAME_HUMAN)
IILSNLTHVV

SEQ ID NO: 158395 - protein, 9 aa, Artificial Sequence
  Description of Artificial Sequence: Synthetic peptide
  Seed: LLLSHIHAS (PRAME_HUMAN)
LQLSHIHAM

SEQ ID NO: 158396 - protein, 10 aa, Artificial Sequence
  Description of Artificial Sequence: Synthetic peptide
  Seed: IQSRYISMSV (PRAME_HUMAN)
IGSRYISMSA

SEQ ID NO: 158397 - protein, 11 aa, Artificial Sequence
  Description of Artificial Sequence: Synthetic peptide
  Seed: MKGQHLHLETF (PRAME_HUMAN)
MYGQHLHLETY

SEQ ID NO: 158398 - protein, 10 aa, Artificial Sequence
  Description of Artificial Sequence: Synthetic peptide
  Seed: FLRGRLDQLL (PRAME_HUMAN)
FIRGRLDQLV

SEQ ID NO: 158399 - protein, 10 aa, Artificial Sequence
  Description of Artificial Sequence: Synthetic peptide
  Seed: RLVELAGQSL (PRAME_HUMAN)
RMVELAGQSR

SEQ ID NO: 158400 - protein, 10 aa, Artificial Sequence
  Description of Artificial Sequence: Synthetic peptide
  Seed: EDLEVTCTWK (PRAME_HUMAN)
EMLEVTCTWK

SEQ ID NO: 158401 - protein, 10 aa, Artificial Sequence
  Description of Artificial Sequence: Synthetic peptide
  Seed: RPSMVWLSAN (PRAME_HUMAN)
RPSMVWLSAT

SEQ ID NO: 158402 - protein, 10 aa, Artificial Sequence
  Description of Artificial Sequence: Synthetic peptide
  Seed: LPTLAKFSPY (PRAME_HUMAN)
LQTLAKFSPY

SEQ ID NO: 158403 - protein, 9 aa, Artificial Sequence
  Description of Artificial Sequence: Synthetic peptide
  Seed: YSFPEPEAA (PRAME_HUMAN)
YAFPEPEAY

SEQ ID NO: 158404 - protein, 9 aa, Artificial Sequence
  Description of Artificial Sequence: Synthetic peptide
  Seed: LMKGQHLHL (PRAME_HUMAN)
LTKGQHLHF

SEQ ID NO: 158405 - protein, 9 aa, Artificial Sequence
  Description of Artificial Sequence: Synthetic peptide
  Seed: LQHLIGLSN (PRAME_HUMAN)
LMHLIGLSI

SEQ ID NO: 158406 - protein, 10 aa, Artificial Sequence
  Description of Artificial Sequence: Synthetic peptide
  Seed: RLSEGDVMHL (PRAME_HUMAN)
RFSEGDVMHY

SEQ ID NO: 158407 - protein, 9 aa, Artificial Sequence
  Description of Artificial Sequence: Synthetic peptide
  Seed: SHQDFWTVW (PRAME_HUMAN)
SYQDFWTVY

SEQ ID NO: 158408 - protein, 9 aa, Artificial Sequence
  Description of Artificial Sequence: Synthetic peptide
  Seed: MINLRRLLL (PRAME_HUMAN)
MINLRRLLW

SEQ ID NO: 158409 - protein, 9 aa, Artificial Sequence
  Description of Artificial Sequence: Synthetic peptide
  Seed: MINLRRLLL (PRAME_HUMAN)
MTNLRRLLY

SEQ ID NO: 158410 - protein, 10 aa, Artificial Sequence
  Description of Artificial Sequence: Synthetic peptide
  Seed: RELFPPLFMA (PRAME_HUMAN)
RDLFPPLFML

SEQ ID NO: 158411 - protein, 10 aa, Artificial Sequence
  Description of Artificial Sequence: Synthetic peptide
  Seed: AQFTSQFLSL (PRAME_HUMAN)
AKFTSQFLSL

SEQ ID NO: 158412 - protein, 9 aa, Artificial Sequence
  Description of Artificial Sequence: Synthetic peptide
  Seed: ACDELFSYL (PRAME_HUMAN)
AVDELFSYW

SEQ ID NO: 158413 - protein, 11 aa, Artificial Sequence
  Description of Artificial Sequence: Synthetic peptide
  Seed: KAVLDGLDVLL (PRAME_HUMAN)
KMVLDGLDVLW

SEQ ID NO: 158414 - protein, 11 aa, Artificial Sequence
  Description of Artificial Sequence: Synthetic peptide
  Seed: FSPYLGQMINL (PRAME_HUMAN)
FSPYLGQMINF

SEQ ID NO: 158415 - protein, 10 aa, Artificial Sequence
  Description of Artificial Sequence: Synthetic peptide
  Seed: LLPRELFPPL (PRAME_HUMAN)
LFPRELFPPM

SEQ ID NO: 158416 - protein, 10 aa, Artificial Sequence
  Description of Artificial Sequence: Synthetic peptide
  Seed: RLVELAGQSL (PRAME_HUMAN)
RTVELAGQSL

SEQ ID NO: 158417 - protein, 9 aa, Artificial Sequence
  Description of Artificial Sequence: Synthetic peptide
  Seed: ASATLQDLV (PRAME_HUMAN)
ALATLQDLV

SEQ ID NO: 158418 - protein, 11 aa, Artificial Sequence
  Description of Artificial Sequence: Synthetic peptide
  Seed: IAQFTSQFLSL (PRAME_HUMAN)
IFQFTSQFLSF

SEQ ID NO: 158419 - protein, 10 aa, Artificial Sequence
  Description of Artificial Sequence: Synthetic peptide
  Seed: IKMILKMVQL (PRAME_HUMAN)
IIMILKMVQV

SEQ ID NO: 158420 - protein, 11 aa, Artificial Sequence
  Description of Artificial Sequence: Synthetic peptide
  Seed: GTLHLERLAYL (PRAME_HUMAN)
GALHLERLAYV

SEQ ID NO: 158421 - protein, 9 aa, Artificial Sequence
  Description of Artificial Sequence: Synthetic peptide
  Seed: RELFPPLFM (PRAME_HUMAN)
RLLFPPLFF

SEQ ID NO: 158422 - protein, 9 aa, Artificial Sequence
  Description of Artificial Sequence: Synthetic peptide
  Seed: LQDLVFDEC (PRAME_HUMAN)
LMDLVFDEL

SEQ ID NO: 158423 - protein, 9 aa, Artificial Sequence
  Description of Artificial Sequence: Synthetic peptide
  Seed: LSHIHASSY (PRAME_HUMAN)
LTHIHASSR

SEQ ID NO: 158424 - protein, 9 aa, Artificial Sequence
  Description of Artificial Sequence: Synthetic peptide
  Seed: YGNSISISA (PRAME_HUMAN)
YVNSISISF

SEQ ID NO: 158425 - protein, 9 aa, Artificial Sequence
  Description of Artificial Sequence: Synthetic peptide
  Seed: KVDGLSTEA (PRAME_HUMAN)
KIDGLSTEV

SEQ ID NO: 158426 - protein, 9 aa, Artificial Sequence
  Description of Artificial Sequence: Synthetic peptide
  Seed: GQHLHLETF (PRAME_HUMAN)
GEHLHLETY

SEQ ID NO: 158427 - protein, 9 aa, Artificial Sequence
  Description of Artificial Sequence: Synthetic peptide
  Seed: QLLALLPSL (PRAME_HUMAN)
QQLALLPSA

SEQ ID NO: 158428 - protein, 10 aa, Artificial Sequence
  Description of Artificial Sequence: Synthetic peptide
  Seed: RPSMVWLSAN (PRAME_HUMAN)
RPSMVWLSAA

SEQ ID NO: 158429 - protein, 9 aa, Artificial Sequence
  Description of Artificial Sequence: Synthetic peptide
  Seed: TSPRRLVEL (PRAME_HUMAN)
TRPRRLVEL

SEQ ID NO: 158430 - protein, 10 aa, Artificial Sequence
  Description of Artificial Sequence: Synthetic peptide
  Seed: RHVMNPLETL (PRAME_HUMAN)
RGVMNPLETW

SEQ ID NO: 158431 - protein, 9 aa, Artificial Sequence
  Description of Artificial Sequence: Synthetic peptide
  Seed: FPPLFMAAF (PRAME_HUMAN)
FPPLFMAAV

SEQ ID NO: 158432 - protein, 10 aa, Artificial Sequence
  Description of Artificial Sequence: Synthetic peptide
  Seed: SNLTHVLYPV (PRAME_HUMAN)
SFLTHVLYPA

SEQ ID NO: 158433 - protein, 9 aa, Artificial Sequence
  Description of Artificial Sequence: Synthetic peptide
  Seed: ITDDQLLAL (PRAME_HUMAN)
IWDDQLLAF

SEQ ID NO: 158434 - protein, 11 aa, Artificial Sequence
  Description of Artificial Sequence: Synthetic peptide
  Seed: SQLSVLSLSGV (PRAME_HUMAN)
SFLSVLSLSGV

SEQ ID NO: 158435 - protein, 10 aa, Artificial Sequence
  Description of Artificial Sequence: Synthetic peptide
  Seed: LLPRELFPPL (PRAME_HUMAN)
LGPRELFPPV

SEQ ID NO: 158436 - protein, 8 aa, Artificial Sequence
  Description of Artificial Sequence: Synthetic peptide
  Seed: NSISISAL (PRAME_HUMAN)
NQISISAI

SEQ ID NO: 158437 - protein, 9 aa, Artificial Sequence
  Description of Artificial Sequence: Synthetic peptide
  Seed: SQSPSVSQL (PRAME_HUMAN)
SISPSVSQY

SEQ ID NO: 158438 - protein, 9 aa, Artificial Sequence
  Description of Artificial Sequence: Synthetic peptide
  Seed: TSPRRLVEL (PRAME_HUMAN)
TWPRRLVEF

SEQ ID NO: 158439 - protein, 10 aa, Artificial Sequence
  Description of Artificial Sequence: Synthetic peptide
  Seed: VLYPVPLESY (PRAME_HUMAN)
VPYPVPLESY

SEQ ID NO: 158440 - protein, 9 aa, Artificial Sequence
  Description of Artificial Sequence: Synthetic peptide
  Seed: SPSVSQLSV (PRAME_HUMAN)
SPSVSQLSY

SEQ ID NO: 158441 - protein, 8 aa, Artificial Sequence
  Description of Artificial Sequence: Synthetic peptide
  Seed: YEDIHGTL (PRAME_HUMAN)
YLDIHGTV

SEQ ID NO: 158442 - protein, 9 aa, Artificial Sequence
  Description of Artificial Sequence: Synthetic peptide
  Seed: VSQLSVLSL (PRAME_HUMAN)
VRQLSVLSF

SEQ ID NO: 158443 - protein, 9 aa, Artificial Sequence
  Description of Artificial Sequence: Synthetic peptide
  Seed: KLKIFAMPM (PRAME_HUMAN)
KHKIFAMPY

SEQ ID NO: 158444 - protein, 9 aa, Artificial Sequence
  Description of Artificial Sequence: Synthetic peptide
  Seed: QLLALLPSL (PRAME_HUMAN)
QALALLPSL

SEQ ID NO: 158445 - protein, 10 aa, Artificial Sequence
  Description of Artificial Sequence: Synthetic peptide
  Seed: SPSVSQLSVL (PRAME_HUMAN)
SWSVSQLSVW

SEQ ID NO: 158446 - protein, 9 aa, Artificial Sequence
  Description of Artificial Sequence: Synthetic peptide
  Seed: LSLQCLQAL (PRAME_HUMAN)
LTLQCLQAV

SEQ ID NO: 158447 - protein, 9 aa, Artificial Sequence
  Description of Artificial Sequence: Synthetic peptide
  Seed: LSHIHASSY (PRAME_HUMAN)
LEHIHASSF

SEQ ID NO: 158448 - protein, 10 aa, Artificial Sequence
  Description of Artificial Sequence: Synthetic peptide
  Seed: KGQHLHLETF (PRAME_HUMAN)
KVQHLHLETF

SEQ ID NO: 158449 - protein, 9 aa, Artificial Sequence
  Description of Artificial Sequence: Synthetic peptide
  Seed: LYVDSLFFL (PRAME_HUMAN)
LLVDSLFFT

SEQ ID NO: 158450 - protein, 9 aa, Artificial Sequence
  Description of Artificial Sequence: Synthetic peptide
  Seed: LSHIHASSY (PRAME_HUMAN)
LQHIHASSW

SEQ ID NO: 158451 - protein, 10 aa, Artificial Sequence
  Description of Artificial Sequence: Synthetic peptide
  Seed: LLLSHIHASS (PRAME_HUMAN)
LYLSHIHASV

SEQ ID NO: 158452 - protein, 10 aa, Artificial Sequence
  Description of Artificial Sequence: Synthetic peptide
  Seed: IGLSNLTHVL (PRAME_HUMAN)
ILLSNLTHVA

SEQ ID NO: 158453 - protein, 9 aa, Artificial Sequence
  Description of Artificial Sequence: Synthetic peptide
  Seed: VLYPVPLES (PRAME_HUMAN)
VSYPVPLEV

SEQ ID NO: 158454 - protein, 9 aa, Artificial Sequence
  Description of Artificial Sequence: Synthetic peptide
  Seed: IGLSNLTHV (PRAME_HUMAN)
IVLSNLTHA

SEQ ID NO: 158455 - protein, 9 aa, Artificial Sequence
  Description of Artificial Sequence: Synthetic peptide
  Seed: ACDELFSYL (PRAME_HUMAN)
AVDELFSYL

SEQ ID NO: 158456 - protein, 10 aa, Artificial Sequence
  Description of Artificial Sequence: Synthetic peptide
  Seed: ISISALQSLL (PRAME_HUMAN)
IHISALQSLW

SEQ ID NO: 158457 - protein, 9 aa, Artificial Sequence
  Description of Artificial Sequence: Synthetic peptide
  Seed: LLKDEALAI (PRAME_HUMAN)
LAKDEALAI

SEQ ID NO: 158458 - protein, 9 aa, Artificial Sequence
  Description of Artificial Sequence: Synthetic peptide
  Seed: SQSPSVSQL (PRAME_HUMAN)
SVSPSVSQR

SEQ ID NO: 158459 - protein, 9 aa, Artificial Sequence
  Description of Artificial Sequence: Synthetic peptide
  Seed: KRKKNVLRL (PRAME_HUMAN)
KRKKNVLRY

SEQ ID NO: 158460 - protein, 10 aa, Artificial Sequence
  Description of Artificial Sequence: Synthetic peptide
  Seed: GQMINLRRLL (PRAME_HUMAN)
GRMINLRRLF

SEQ ID NO: 158461 - protein, 9 aa, Artificial Sequence
  Description of Artificial Sequence: Synthetic peptide
  Seed: SPSVSQLSV (PRAME_HUMAN)
SHSVSQLSV

SEQ ID NO: 158462 - protein, 10 aa, Artificial Sequence
  Description of Artificial Sequence: Synthetic peptide
  Seed: RHVMNPLETL (PRAME_HUMAN)
RAVMNPLETY

SEQ ID NO: 158463 - protein, 9 aa, Artificial Sequence
  Description of Artificial Sequence: Synthetic peptide
  Seed: KMILKMVQL (PRAME_HUMAN)
KTILKMVQV

SEQ ID NO: 158464 - protein, 10 aa, Artificial Sequence
  Description of Artificial Sequence: Synthetic peptide
  Seed: AFDGRHSQTL (PRAME_HUMAN)
AFDGRHSQTF

SEQ ID NO: 158465 - protein, 9 aa, Artificial Sequence
  Description of Artificial Sequence: Synthetic peptide
  Seed: LQALYVDSL (PRAME_HUMAN)
LEALYVDSM

SEQ ID NO: 158466 - protein, 9 aa, Artificial Sequence
  Description of Artificial Sequence: Synthetic peptide
  Seed: RLLLSHIHA (PRAME_HUMAN)
RVLLSHIHK

SEQ ID NO: 158467 - protein, 8 aa, Artificial Sequence
  Description of Artificial Sequence: Synthetic peptide
  Seed: SHIHASSY (PRAME_HUMAN)
SMIHASSY

SEQ ID NO: 158468 - protein, 10 aa, Artificial Sequence
  Description of Artificial Sequence: Synthetic peptide
  Seed: RHVMNPLETL (PRAME_HUMAN)
RIVMNPLETV

SEQ ID NO: 158469 - protein, 10 aa, Artificial Sequence
  Description of Artificial Sequence: Synthetic peptide
  Seed: AKFSPYLGQM (PRAME_HUMAN)
AQFSPYLGQF

SEQ ID NO: 158470 - protein, 9 aa, Artificial Sequence
  Description of Artificial Sequence: Synthetic peptide
  Seed: RGRLDQLLR (PRAME_HUMAN)
RMRLDQLLS

SEQ ID NO: 158471 - protein, 9 aa, Artificial Sequence
  Description of Artificial Sequence: Synthetic peptide
  Seed: LAIAALELL (PRAME_HUMAN)
LTIAALELL

SEQ ID NO: 158472 - protein, 9 aa, Artificial Sequence
  Description of Artificial Sequence: Synthetic peptide
  Seed: SISALQSLL (PRAME_HUMAN)
STSALQSLI

SEQ ID NO: 158473 - protein, 10 aa, Artificial Sequence
  Description of Artificial Sequence: Synthetic peptide
  Seed: ETFKAVLDGL (PRAME_HUMAN)
EAFKAVLDGR

SEQ ID NO: 158474 - protein, 9 aa, Artificial Sequence
  Description of Artificial Sequence: Synthetic peptide
  Seed: RHSQTLKAM (PRAME_HUMAN)
RESQTLKAF

SEQ ID NO: 158475 - protein, 10 aa, Artificial Sequence
  Description of Artificial Sequence: Synthetic peptide
  Seed: DQLLALLPSL (PRAME_HUMAN)
DLLLALLPSL

SEQ ID NO: 158476 - protein, 9 aa, Artificial Sequence
  Description of Artificial Sequence: Synthetic peptide
  Seed: YEDIHGTLH (PRAME_HUMAN)
YTDIHGTLH

SEQ ID NO: 158477 - protein, 10 aa, Artificial Sequence
  Description of Artificial Sequence: Synthetic peptide
  Seed: MPMQDIKMIL (PRAME_HUMAN)
MRMQDIKMIV

SEQ ID NO: 158478 - protein, 10 aa, Artificial Sequence
  Description of Artificial Sequence: Synthetic peptide
  Seed: LKAMVQAWPF (PRAME_HUMAN)
LYAMVQAWPY

SEQ ID NO: 158479 - protein, 10 aa, Artificial Sequence
  Description of Artificial Sequence: Synthetic peptide
  Seed: AVLDGLDVLL (PRAME_HUMAN)
AVLDGLDVLV

SEQ ID NO: 158480 - protein, 10 aa, Artificial Sequence
  Description of Artificial Sequence: Synthetic peptide
  Seed: SNLTHVLYPV (PRAME_HUMAN)
SKLTHVLYPI

SEQ ID NO: 158481 - protein, 10 aa, Artificial Sequence
  Description of Artificial Sequence: Synthetic peptide
  Seed: KKLKIFAMPM (PRAME_HUMAN)
KSLKIFAMPM

SEQ ID NO: 158482 - protein, 9 aa, Artificial Sequence
  Description of Artificial Sequence: Synthetic peptide
  Seed: MVQAWPFTC (PRAME_HUMAN)
MLQAWPFTT

SEQ ID NO: 158483 - protein, 10 aa, Artificial Sequence
  Description of Artificial Sequence: Synthetic peptide
  Seed: QLLRHVMNPL (PRAME_HUMAN)
QMLRHVMNPL

SEQ ID NO: 158484 - protein, 9 aa, Artificial Sequence
  Description of Artificial Sequence: Synthetic peptide
  Seed: FYDPEPILC (PRAME_HUMAN)
FQDPEPILC

SEQ ID NO: 158485 - protein, 10 aa, Artificial Sequence
  Description of Artificial Sequence: Synthetic peptide
  Seed: IQSRYISMSV (PRAME_HUMAN)
IQSRYISMSA

SEQ ID NO: 158486 - protein, 10 aa, Artificial Sequence
  Description of Artificial Sequence: Synthetic peptide
  Seed: LPTLAKFSPY (PRAME_HUMAN)
LLTLAKFSPF

SEQ ID NO: 158487 - protein, 10 aa, Artificial Sequence
  Description of Artificial Sequence: Synthetic peptide
  Seed: ALLERASATL (PRAME_HUMAN)
AMLERASATL

SEQ ID NO: 158488 - protein, 9 aa, Artificial Sequence
  Description of Artificial Sequence: Synthetic peptide
  Seed: KMILKMVQL (PRAME_HUMAN)
KTILKMVQF

SEQ ID NO: 158489 - protein, 10 aa, Artificial Sequence
  Description of Artificial Sequence: Synthetic peptide
  Seed: RYISMSVWTS (PRAME_HUMAN)
RWISMSVWTY

SEQ ID NO: 158490 - protein, 9 aa, Artificial Sequence
  Description of Artificial Sequence: Synthetic peptide
  Seed: LSEGDVMHL (PRAME_HUMAN)
LAEGDVMHV

SEQ ID NO: 158491 - protein, 9 aa, Artificial Sequence
  Description of Artificial Sequence: Synthetic peptide
  Seed: RLDQLLRHV (PRAME_HUMAN)
RWDQLLRHM

SEQ ID NO: 158492 - protein, 9 aa, Artificial Sequence
  Description of Artificial Sequence: Synthetic peptide
  Seed: SLLQHLIGL (PRAME_HUMAN)
SVLQHLIGW

SEQ ID NO: 158493 - protein, 9 aa, Artificial Sequence
  Description of Artificial Sequence: Synthetic peptide
  Seed: TSPRRLVEL (PRAME_HUMAN)
TFPRRLVEI

SEQ ID NO: 158494 - protein, 9 aa, Artificial Sequence
  Description of Artificial Sequence: Synthetic peptide
  Seed: VLYPVPLES (PRAME_HUMAN)
VIYPVPLEM

SEQ ID NO: 158495 - protein, 9 aa, Artificial Sequence
  Description of Artificial Sequence: Synthetic peptide
  Seed: SRYISMSVW (PRAME_HUMAN)
SAYISMSVM

SEQ ID NO: 158496 - protein, 10 aa, Artificial Sequence
  Description of Artificial Sequence: Synthetic peptide
  Seed: TTLSFYGNSI (PRAME_HUMAN)
TYLSFYGNSL

SEQ ID NO: 158497 - protein, 10 aa, Artificial Sequence
  Description of Artificial Sequence: Synthetic peptide
  Seed: EDLEVTCTWK (PRAME_HUMAN)
EVLEVTCTWR

SEQ ID NO: 158498 - protein, 9 aa, Artificial Sequence
  Description of Artificial Sequence: Synthetic peptide
  Seed: SFYGNSISI (PRAME_HUMAN)
SLYGNSISI

SEQ ID NO: 158499 - protein, 9 aa, Artificial Sequence
  Description of Artificial Sequence: Synthetic peptide
  Seed: VWSGNRASL (PRAME_HUMAN)
VYSGNRASM

SEQ ID NO: 158500 - protein, 10 aa, Artificial Sequence
  Description of Artificial Sequence: Synthetic peptide
  Seed: ALYVDSLFFL (PRAME_HUMAN)
AWYVDSLFFF

SEQ ID NO: 158501 - protein, 9 aa, Artificial Sequence
  Description of Artificial Sequence: Synthetic peptide
  Seed: LQALYVDSL (PRAME_HUMAN)
LKALYVDSM

SEQ ID NO: 158502 - protein, 10 aa, Artificial Sequence
  Description of Artificial Sequence: Synthetic peptide
  Seed: RRWKLQVLDL (PRAME_HUMAN)
RRWKLQVLDV

SEQ ID NO: 158503 - protein, 9 aa, Artificial Sequence
  Description of Artificial Sequence: Synthetic peptide
  Seed: CRLSEGDVM (PRAME_HUMAN)
CQLSEGDVM

SEQ ID NO: 158504 - protein, 10 aa, Artificial Sequence
  Description of Artificial Sequence: Synthetic peptide
  Seed: RLDQLLRHVM (PRAME_HUMAN)
RQDQLLRHVW

SEQ ID NO: 158505 - protein, 11 aa, Artificial Sequence
  Description of Artificial Sequence: Synthetic peptide
  Seed: MKGQHLHLETF (PRAME_HUMAN)
MIGQHLHLETF

SEQ ID NO: 158506 - protein, 8 aa, Artificial Sequence
  Description of Artificial Sequence: Synthetic peptide
  Seed: ITDDQLLA (PRAME_HUMAN)
ILDDQLLI

SEQ ID NO: 158507 - protein, 9 aa, Artificial Sequence
  Description of Artificial Sequence: Synthetic peptide
  Seed: VFDECGITD (PRAME_HUMAN)
VQDECGITF

SEQ ID NO: 158508 - protein, 10 aa, Artificial Sequence
  Description of Artificial Sequence: Synthetic peptide
  Seed: MVQAWPFTCL (PRAME_HUMAN)
MMQAWPFTCW

SEQ ID NO: 158509 - protein, 9 aa, Artificial Sequence
  Description of Artificial Sequence: Synthetic peptide
  Seed: EVLVDLFLK (PRAME_HUMAN)
EALVDLFLK

SEQ ID NO: 158510 - protein, 9 aa, Artificial Sequence
  Description of Artificial Sequence: Synthetic peptide
  Seed: TLAKFSPYL (PRAME_HUMAN)
TAAKFSPYL

SEQ ID NO: 158511 - protein, 9 aa, Artificial Sequence
  Description of Artificial Sequence: Synthetic peptide
  Seed: EDIHGTLHL (PRAME_HUMAN)
EEIHGTLHI

SEQ ID NO: 158512 - protein, 10 aa, Artificial Sequence
  Description of Artificial Sequence: Synthetic peptide
  Seed: FTCLPLGVLM (PRAME_HUMAN)
FLCLPLGVLV

SEQ ID NO: 158513 - protein, 9 aa, Artificial Sequence
  Description of Artificial Sequence: Synthetic peptide
  Seed: SRYISMSVW (PRAME_HUMAN)
SIYISMSVM

SEQ ID NO: 158514 - protein, 10 aa, Artificial Sequence
  Description of Artificial Sequence: Synthetic peptide
  Seed: RASATLQDLV (PRAME_HUMAN)
RKSATLQDLW

SEQ ID NO: 158515 - protein, 9 aa, Artificial Sequence
  Description of Artificial Sequence: Synthetic peptide
  Seed: KLKIFAMPM (PRAME_HUMAN)
KSKIFAMPW

SEQ ID NO: 158516 - protein, 11 aa, Artificial Sequence
  Description of Artificial Sequence: Synthetic peptide
  Seed: QALYVDSLFFL (PRAME_HUMAN)
QALYVDSLFFF

SEQ ID NO: 158517 - protein, 10 aa, Artificial Sequence
  Description of Artificial Sequence: Synthetic peptide
  Seed: DFWTVWSGNR (PRAME_HUMAN)
DAWTVWSGNR

SEQ ID NO: 158518 - protein, 9 aa, Artificial Sequence
  Description of Artificial Sequence: Synthetic peptide
  Seed: HVMNPLETL (PRAME_HUMAN)
HSMNPLETM

SEQ ID NO: 158519 - protein, 10 aa, Artificial Sequence
  Description of Artificial Sequence: Synthetic peptide
  Seed: IPVEVLVDLF (PRAME_HUMAN)
IPVEVLVDLW

SEQ ID NO: 158520 - protein, 9 aa, Artificial Sequence
  Description of Artificial Sequence: Synthetic peptide
  Seed: ISISALQSL (PRAME_HUMAN)
ITISALQSW

SEQ ID NO: 158521 - protein, 10 aa, Artificial Sequence
  Description of Artificial Sequence: Synthetic peptide
  Seed: VLDGLDVLLA (PRAME_HUMAN)
VLDGLDVLLV

SEQ ID NO: 158522 - protein, 9 aa, Artificial Sequence
  Description of Artificial Sequence: Synthetic peptide
  Seed: GLSNLTHVL (PRAME_HUMAN)
GISNLTHVF

SEQ ID NO: 158523 - protein, 10 aa, Artificial Sequence
  Description of Artificial Sequence: Synthetic peptide
  Seed: KAVLDGLDVL (PRAME_HUMAN)
KTVLDGLDVF

SEQ ID NO: 158524 - protein, 9 aa, Artificial Sequence
  Description of Artificial Sequence: Synthetic peptide
  Seed: LPRELFPPL (PRAME_HUMAN)
LARELFPPY

SEQ ID NO: 158525 - protein, 9 aa, Artificial Sequence
  Description of Artificial Sequence: Synthetic peptide
  Seed: KVDGLSTEA (PRAME_HUMAN)
KVDGLSTEF

SEQ ID NO: 158526 - protein, 10 aa, Artificial Sequence
  Description of Artificial Sequence: Synthetic peptide
  Seed: PTLAKFSPYL (PRAME_HUMAN)
PGLAKFSPYL

SEQ ID NO: 158527 - protein, 10 aa, Artificial Sequence
  Description of Artificial Sequence: Synthetic peptide
  Seed: ALELLPRELF (PRAME_HUMAN)
AEELLPRELF

SEQ ID NO: 158528 - protein, 11 aa, Artificial Sequence
  Description of Artificial Sequence: Synthetic peptide
  Seed: FLSLQCLQALY (PRAME_HUMAN)
FMSLQCLQALV

SEQ ID NO: 158529 - protein, 9 aa, Artificial Sequence
  Description of Artificial Sequence: Synthetic peptide
  Seed: KMILKMVQL (PRAME_HUMAN)
KYILKMVQL

SEQ ID NO: 158530 - protein, 9 aa, Artificial Sequence
  Description of Artificial Sequence: Synthetic peptide
  Seed: LPRELFPPL (PRAME_HUMAN)
LPRELFPPI

SEQ ID NO: 158531 - protein, 9 aa, Artificial Sequence
  Description of Artificial Sequence: Synthetic peptide
  Seed: LSEGDVMHL (PRAME_HUMAN)
LAEGDVMHM

SEQ ID NO: 158532 - protein, 9 aa, Artificial Sequence
  Description of Artificial Sequence: Synthetic peptide
  Seed: SLQCLQALY (PRAME_HUMAN)
SKQCLQALF

SEQ ID NO: 158533 - protein, 11 aa, Artificial Sequence
  Description of Artificial Sequence: Synthetic peptide
  Seed: RRWKLQVLDLR (PRAME_HUMAN)
RTWKLQVLDLR

SEQ ID NO: 158534 - protein, 9 aa, Artificial Sequence
  Description of Artificial Sequence: Synthetic peptide
  Seed: ITDDQLLAL (PRAME_HUMAN)
IWDDQLLAM

SEQ ID NO: 158535 - protein, 9 aa, Artificial Sequence
  Description of Artificial Sequence: Synthetic peptide
  Seed: VQLDSIEDL (PRAME_HUMAN)
VELDSIEDL

SEQ ID NO: 158536 - protein, 9 aa, Artificial Sequence
  Description of Artificial Sequence: Synthetic peptide
  Seed: RHSQTLKAM (PRAME_HUMAN)
RLSQTLKAY

SEQ ID NO: 158537 - protein, 10 aa, Artificial Sequence
  Description of Artificial Sequence: Synthetic peptide
  Seed: VTCTWKLPTL (PRAME_HUMAN)
VICTWKLPTV

SEQ ID NO: 158538 - protein, 10 aa, Artificial Sequence
  Description of Artificial Sequence: Synthetic peptide
  Seed: GACDELFSYL (PRAME_HUMAN)
GLCDELFSYW

SEQ ID NO: 158539 - protein, 9 aa, Artificial Sequence
  Description of Artificial Sequence: Synthetic peptide
  Seed: SQLTTLSFY (PRAME_HUMAN)
SLLTTLSFY

SEQ ID NO: 158540 - protein, 10 aa, Artificial Sequence
  Description of Artificial Sequence: Synthetic peptide
  Seed: LSQSPSVSQL (PRAME_HUMAN)
LEQSPSVSQY

SEQ ID NO: 158541 - protein, 10 aa, Artificial Sequence
  Description of Artificial Sequence: Synthetic peptide
  Seed: AVLDGLDVLL (PRAME_HUMAN)
AALDGLDVLM

SEQ ID NO: 158542 - protein, 9 aa, Artificial Sequence
  Description of Artificial Sequence: Synthetic peptide
  Seed: MVQAWPFTC (PRAME_HUMAN)
MAQAWPFTL

SEQ ID NO: 158543 - protein, 9 aa, Artificial Sequence
  Description of Artificial Sequence: Synthetic peptide
  Seed: DEALAIAAL (PRAME_HUMAN)
DLALAIAAY

SEQ ID NO: 158544 - protein, 9 aa, Artificial Sequence
  Description of Artificial Sequence: Synthetic peptide
  Seed: TLSITNCRL (PRAME_HUMAN)
TLSITNCRV

SEQ ID NO: 158545 - protein, 9 aa, Artificial Sequence
  Description of Artificial Sequence: Synthetic peptide
  Seed: TLHLERLAY (PRAME_HUMAN)
THHLERLAY

SEQ ID NO: 158546 - protein, 10 aa, Artificial Sequence
  Description of Artificial Sequence: Synthetic peptide
  Seed: FFLRGRLDQL (PRAME_HUMAN)
FILRGRLDQV

SEQ ID NO: 158547 - protein, 8 aa, Artificial Sequence
  Description of Artificial Sequence: Synthetic peptide
  Seed: VMNPLETL (PRAME_HUMAN)
VSNPLETL

SEQ ID NO: 158548 - protein, 9 aa, Artificial Sequence
  Description of Artificial Sequence: Synthetic peptide
  Seed: SHCSQLTTL (PRAME_HUMAN)
SYCSQLTTY

SEQ ID NO: 158549 - protein, 9 aa, Artificial Sequence
  Description of Artificial Sequence: Synthetic peptide
  Seed: VSQLSVLSL (PRAME_HUMAN)
VSQLSVLSW

SEQ ID NO: 158550 - protein, 8 aa, Artificial Sequence
  Description of Artificial Sequence: Synthetic peptide
  Seed: DQLLRHVM (PRAME_HUMAN)
DMLLRHVM

SEQ ID NO: 158551 - protein, 9 aa, Artificial Sequence
  Description of Artificial Sequence: Synthetic peptide
  Seed: LLERASATL (PRAME_HUMAN)
LFERASATL

SEQ ID NO: 158552 - protein, 9 aa, Artificial Sequence
  Description of Artificial Sequence: Synthetic peptide
  Seed: KFSPYLGQM (PRAME_HUMAN)
KWSPYLGQL

SEQ ID NO: 158553 - protein, 10 aa, Artificial Sequence
  Description of Artificial Sequence: Synthetic peptide
  Seed: MLTDVSPEPL (PRAME_HUMAN)
MTTDVSPEPL

SEQ ID NO: 158554 - protein, 10 aa, Artificial Sequence
  Description of Artificial Sequence: Synthetic peptide
  Seed: QSLLQHLIGL (PRAME_HUMAN)
QQLLQHLIGI

SEQ ID NO: 158555 - protein, 9 aa, Artificial Sequence
  Description of Artificial Sequence: Synthetic peptide
  Seed: VLMKGQHLH (PRAME_HUMAN)
VIMKGQHLY

SEQ ID NO: 158556 - protein, 10 aa, Artificial Sequence
  Description of Artificial Sequence: Synthetic peptide
  Seed: ALYVDSLFFL (PRAME_HUMAN)
ACYVDSLFFL

SEQ ID NO: 158557 - protein, 9 aa, Artificial Sequence
  Description of Artificial Sequence: Synthetic peptide
  Seed: MPMQDIKMI (PRAME_HUMAN)
MPMQDIKMF

SEQ ID NO: 158558 - protein, 9 aa, Artificial Sequence
  Description of Artificial Sequence: Synthetic peptide
  Seed: MNPLETLSI (PRAME_HUMAN)
MQPLETLSL

SEQ ID NO: 158559 - protein, 9 aa, Artificial Sequence
  Description of Artificial Sequence: Synthetic peptide
  Seed: ELFPPLFMA (PRAME_HUMAN)
EIFPPLFMV

SEQ ID NO: 158560 - protein, 9 aa, Artificial Sequence
  Description of Artificial Sequence: Synthetic peptide
  Seed: QPFIPVEVL (PRAME_HUMAN)
QHFIPVEVV

SEQ ID NO: 158561 - protein, 9 aa, Artificial Sequence
  Description of Artificial Sequence: Synthetic peptide
  Seed: YIAQFTSQF (PRAME_HUMAN)
YCAQFTSQF

SEQ ID NO: 158562 - protein, 11 aa, Artificial Sequence
  Description of Artificial Sequence: Synthetic peptide
  Seed: RRLWGSIQSRY (PRAME_HUMAN)
RFLWGSIQSRR

SEQ ID NO: 158563 - protein, 9 aa, Artificial Sequence
  Description of Artificial Sequence: Synthetic peptide
  Seed: ASATLQDLV (PRAME_HUMAN)
AIATLQDLI

SEQ ID NO: 158564 - protein, 10 aa, Artificial Sequence
  Description of Artificial Sequence: Synthetic peptide
  Seed: SALQSLLQHL (PRAME_HUMAN)
SQLQSLLQHI

SEQ ID NO: 158565 - protein, 9 aa, Artificial Sequence
  Description of Artificial Sequence: Synthetic peptide
  Seed: LSLQCLQAL (PRAME_HUMAN)
LTLQCLQAM

SEQ ID NO: 158566 - protein, 9 aa, Artificial Sequence
  Description of Artificial Sequence: Synthetic peptide
  Seed: LWGSIQSRY (PRAME_HUMAN)
LIGSIQSRY

SEQ ID NO: 158567 - protein, 10 aa, Artificial Sequence
  Description of Artificial Sequence: Synthetic peptide
  Seed: SPSVSQLSVL (PRAME_HUMAN)
SLSVSQLSVF

SEQ ID NO: 158568 - protein, 10 aa, Artificial Sequence
  Description of Artificial Sequence: Synthetic peptide
  Seed: LLLSHIHASS (PRAME_HUMAN)
LELSHIHASA

SEQ ID NO: 158569 - protein, 10 aa, Artificial Sequence
  Description of Artificial Sequence: Synthetic peptide
  Seed: DRTFYDPEPI (PRAME_HUMAN)
DQTFYDPEPV

SEQ ID NO: 158570 - protein, 10 aa, Artificial Sequence
  Description of Artificial Sequence: Synthetic peptide
  Seed: LLLSHIHASS (PRAME_HUMAN)
LVLSHIHASI

SEQ ID NO: 158571 - protein, 10 aa, Artificial Sequence
  Description of Artificial Sequence: Synthetic peptide
  Seed: RELFPPLFMA (PRAME_HUMAN)
RDLFPPLFMA

SEQ ID NO: 158572 - protein, 10 aa, Artificial Sequence
  Description of Artificial Sequence: Synthetic peptide
  Seed: LSQSPSVSQL (PRAME_HUMAN)
LPQSPSVSQF

SEQ ID NO: 158573 - protein, 10 aa, Artificial Sequence
  Description of Artificial Sequence: Synthetic peptide
  Seed: LLPRELFPPL (PRAME_HUMAN)
LTPRELFPPM

SEQ ID NO: 158574 - protein, 9 aa, Artificial Sequence
  Description of Artificial Sequence: Synthetic peptide
  Seed: RLRELLCEL (PRAME_HUMAN)
RQRELLCEY

SEQ ID NO: 158575 - protein, 10 aa, Artificial Sequence
  Description of Artificial Sequence: Synthetic peptide
  Seed: ALYVDSLFFL (PRAME_HUMAN)
AIYVDSLFFF

SEQ ID NO: 158576 - protein, 9 aa, Artificial Sequence
  Description of Artificial Sequence: Synthetic peptide
  Seed: HARLRELLC (PRAME_HUMAN)
HLRLRELLL

SEQ ID NO: 158577 - protein, 9 aa, Artificial Sequence
  Description of Artificial Sequence: Synthetic peptide
  Seed: KFSPYLGQM (PRAME_HUMAN)
KWSPYLGQY

SEQ ID NO: 158578 - protein, 8 aa, Artificial Sequence
  Description of Artificial Sequence: Synthetic peptide
  Seed: VELAGQSL (PRAME_HUMAN)
VQLAGQSL

SEQ ID NO: 158579 - protein, 9 aa, Artificial Sequence
  Description of Artificial Sequence: Synthetic peptide
  Seed: SHCSQLTTL (PRAME_HUMAN)
SMCSQLTTL

SEQ ID NO: 158580 - protein, 9 aa, Artificial Sequence
  Description of Artificial Sequence: Synthetic peptide
  Seed: RLLLSHIHA (PRAME_HUMAN)
RILLSHIHV

SEQ ID NO: 158581 - protein, 10 aa, Artificial Sequence
  Description of Artificial Sequence: Synthetic peptide
  Seed: QLDSIEDLEV (PRAME_HUMAN)
QADSIEDLEL

SEQ ID NO: 158582 - protein, 8 aa, Artificial Sequence
  Description of Artificial Sequence: Synthetic peptide
  Seed: QSLLQHLI (PRAME_HUMAN)
QQLLQHLI

SEQ ID NO: 158583 - protein, 10 aa, Artificial Sequence
  Description of Artificial Sequence: Synthetic peptide
  Seed: LSVLSLSGVM (PRAME_HUMAN)
LAVLSLSGVF

SEQ ID NO: 158584 - protein, 10 aa, Artificial Sequence
  Description of Artificial Sequence: Synthetic peptide
  Seed: QSLLQHLIGL (PRAME_HUMAN)
QRLLQHLIGV

SEQ ID NO: 158585 - protein, 10 aa, Artificial Sequence
  Description of Artificial Sequence: Synthetic peptide
  Seed: RRLLLSHIHA (PRAME_HUMAN)
RRLLLSHIHY

SEQ ID NO: 158586 - protein, 10 aa, Artificial Sequence
  Description of Artificial Sequence: Synthetic peptide
  Seed: SALQSLLQHL (PRAME_HUMAN)
STLQSLLQHW

SEQ ID NO: 158587 - protein, 9 aa, Artificial Sequence
  Description of Artificial Sequence: Synthetic peptide
  Seed: AVLDGLDVL (PRAME_HUMAN)
ATLDGLDVA

SEQ ID NO: 158588 - protein, 10 aa, Artificial Sequence
  Description of Artificial Sequence: Synthetic peptide
  Seed: ETLSITNCRL (PRAME_HUMAN)
ETLSITNCRF

SEQ ID NO: 158589 - protein, 11 aa, Artificial Sequence
  Description of Artificial Sequence: Synthetic peptide
  Seed: SQTLKAMVQAW (PRAME_HUMAN)
SETLKAMVQAW

SEQ ID NO: 158590 - protein, 10 aa, Artificial Sequence
  Description of Artificial Sequence: Synthetic peptide
  Seed: TVWSGNRASL (PRAME_HUMAN)
TSWSGNRASY

SEQ ID NO: 158591 - protein, 10 aa, Artificial Sequence
  Description of Artificial Sequence: Synthetic peptide
  Seed: FFLRGRLDQL (PRAME_HUMAN)
FHLRGRLDQL

SEQ ID NO: 158592 - protein, 9 aa, Artificial Sequence
  Description of Artificial Sequence: Synthetic peptide
  Seed: LQSLLQHLI (PRAME_HUMAN)
LKSLLQHLY

SEQ ID NO: 158593 - protein, 9 aa, Artificial Sequence
  Description of Artificial Sequence: Synthetic peptide
  Seed: MSVWTSPRR (PRAME_HUMAN)
MTVWTSPRK

SEQ ID NO: 158594 - protein, 9 aa, Artificial Sequence
  Description of Artificial Sequence: Synthetic peptide
  Seed: TLAKFSPYL (PRAME_HUMAN)
TLAKFSPYC

SEQ ID NO: 158595 - protein, 9 aa, Artificial Sequence
  Description of Artificial Sequence: Synthetic peptide
  Seed: SIEDLEVTC (PRAME_HUMAN)
SAEDLEVTL

SEQ ID NO: 158596 - protein, 8 aa, Artificial Sequence
  Description of Artificial Sequence: Synthetic peptide
  Seed: LLALLPSL (PRAME_HUMAN)
LLALLPSV

SEQ ID NO: 158597 - protein, 9 aa, Artificial Sequence
  Description of Artificial Sequence: Synthetic peptide
  Seed: FPPLFMAAF (PRAME_HUMAN)
FTPLFMAAL

SEQ ID NO: 158598 - protein, 10 aa, Artificial Sequence
  Description of Artificial Sequence: Synthetic peptide
  Seed: YIAQFTSQFL (PRAME_HUMAN)
YFAQFTSQFY

SEQ ID NO: 158599 - protein, 9 aa, Artificial Sequence
  Description of Artificial Sequence: Synthetic peptide
  Seed: ETLSITNCR (PRAME_HUMAN)
EFLSITNCR

SEQ ID NO: 158600 - protein, 9 aa, Artificial Sequence
  Description of Artificial Sequence: Synthetic peptide
  Seed: HVMNPLETL (PRAME_HUMAN)
HHMNPLETF

SEQ ID NO: 158601 - protein, 9 aa, Artificial Sequence
  Description of Artificial Sequence: Synthetic peptide
  Seed: RHSQTLKAM (PRAME_HUMAN)
RHSQTLKAY

SEQ ID NO: 158602 - protein, 9 aa, Artificial Sequence
  Description of Artificial Sequence: Synthetic peptide
  Seed: RLRELLCEL (PRAME_HUMAN)
RMRELLCEI

SEQ ID NO: 158603 - protein, 9 aa, Artificial Sequence
  Description of Artificial Sequence: Synthetic peptide
  Seed: KVDGLSTEA (PRAME_HUMAN)
KNDGLSTEM

SEQ ID NO: 158604 - protein, 9 aa, Artificial Sequence
  Description of Artificial Sequence: Synthetic peptide
  Seed: LRKNSHQDF (PRAME_HUMAN)
LMKNSHQDF

SEQ ID NO: 158605 - protein, 10 aa, Artificial Sequence
  Description of Artificial Sequence: Synthetic peptide
  Seed: KGQHLHLETF (PRAME_HUMAN)
KYQHLHLETF

SEQ ID NO: 158606 - protein, 10 aa, Artificial Sequence
  Description of Artificial Sequence: Synthetic peptide
  Seed: LYVDSLFFLR (PRAME_HUMAN)
LVVDSLFFLR

SEQ ID NO: 158607 - protein, 10 aa, Artificial Sequence
  Description of Artificial Sequence: Synthetic peptide
  Seed: TLHLERLAYL (PRAME_HUMAN)
TLHLERLAYI

SEQ ID NO: 158608 - protein, 10 aa, Artificial Sequence
  Description of Artificial Sequence: Synthetic peptide
  Seed: VLYPVPLESY (PRAME_HUMAN)
VSYPVPLESM

SEQ ID NO: 158609 - protein, 9 aa, Artificial Sequence
  Description of Artificial Sequence: Synthetic peptide
  Seed: LYPVPLESY (PRAME_HUMAN)
LRPVPLESL

SEQ ID NO: 158610 - protein, 9 aa, Artificial Sequence
  Description of Artificial Sequence: Synthetic peptide
  Seed: SALQSLLQH (PRAME_HUMAN)
SMLQSLLQY

SEQ ID NO: 158611 - protein, 10 aa, Artificial Sequence
  Description of Artificial Sequence: Synthetic peptide
  Seed: DELFSYLIEK (PRAME_HUMAN)
DMLFSYLIEK

SEQ ID NO: 158612 - protein, 9 aa, Artificial Sequence
  Description of Artificial Sequence: Synthetic peptide
  Seed: SISALQSLL (PRAME_HUMAN)
SVSALQSLW

SEQ ID NO: 158613 - protein, 8 aa, Artificial Sequence
  Description of Artificial Sequence: Synthetic peptide
  Seed: CTWKLPTL (PRAME_HUMAN)
CQWKLPTL

SEQ ID NO: 158614 - protein, 10 aa, Artificial Sequence
  Description of Artificial Sequence: Synthetic peptide
  Seed: QSLLQHLIGL (PRAME_HUMAN)
QYLLQHLIGL

SEQ ID NO: 158615 - protein, 10 aa, Artificial Sequence
  Description of Artificial Sequence: Synthetic peptide
  Seed: LLSHIHASSY (PRAME_HUMAN)
LQSHIHASSY

SEQ ID NO: 158616 - protein, 8 aa, Artificial Sequence
  Description of Artificial Sequence: Synthetic peptide
  Seed: LQSLLQHL (PRAME_HUMAN)
LQSLLQHI

SEQ ID NO: 158617 - protein, 9 aa, Artificial Sequence
  Description of Artificial Sequence: Synthetic peptide
  Seed: LHLETFKAV (PRAME_HUMAN)
LQLETFKAL

SEQ ID NO: 158618 - protein, 9 aa, Artificial Sequence
  Description of Artificial Sequence: Synthetic peptide
  Seed: TSPRRLVEL (PRAME_HUMAN)
TIPRRLVEV

SEQ ID NO: 158619 - protein, 9 aa, Artificial Sequence
  Description of Artificial Sequence: Synthetic peptide
  Seed: VFDECGITD (PRAME_HUMAN)
VNDECGITL

SEQ ID NO: 158620 - protein, 9 aa, Artificial Sequence
  Description of Artificial Sequence: Synthetic peptide
  Seed: HGTLHLERL (PRAME_HUMAN)
HATLHLERY

SEQ ID NO: 158621 - protein, 9 aa, Artificial Sequence
  Description of Artificial Sequence: Synthetic peptide
  Seed: LYVDSLFFL (PRAME_HUMAN)
LWVDSLFFL

SEQ ID NO: 158622 - protein, 9 aa, Artificial Sequence
  Description of Artificial Sequence: Synthetic peptide
  Seed: ALELLPREL (PRAME_HUMAN)
AQELLPREL

SEQ ID NO: 158623 - protein, 11 aa, Artificial Sequence
  Description of Artificial Sequence: Synthetic peptide
  Seed: RLWGSIQSRYI (PRAME_HUMAN)
RMWGSIQSRYY

SEQ ID NO: 158624 - protein, 9 aa, Artificial Sequence
  Description of Artificial Sequence: Synthetic peptide
  Seed: VQAWPFTCL (PRAME_HUMAN)
VQAWPFTCV

SEQ ID NO: 158625 - protein, 11 aa, Artificial Sequence
  Description of Artificial Sequence: Synthetic peptide
  Seed: SLSHCSQLTTL (PRAME_HUMAN)
SLSHCSQLTTV

SEQ ID NO: 158626 - protein, 9 aa, Artificial Sequence
  Description of Artificial Sequence: Synthetic peptide
  Seed: VSPEPLQAL (PRAME_HUMAN)
VLPEPLQAY

SEQ ID NO: 158627 - protein, 8 aa, Artificial Sequence
  Description of Artificial Sequence: Synthetic peptide
  Seed: LPRELFPP (PRAME_HUMAN)
LPRELFPA

SEQ ID NO: 158628 - protein, 10 aa, Artificial Sequence
  Description of Artificial Sequence: Synthetic peptide
  Seed: MNPLETLSIT (PRAME_HUMAN)
MFPLETLSIV

SEQ ID NO: 158629 - protein, 11 aa, Artificial Sequence
  Description of Artificial Sequence: Synthetic peptide
  Seed: ALYVDSLFFLR (PRAME_HUMAN)
AMYVDSLFFLQ

SEQ ID NO: 158630 - protein, 8 aa, Artificial Sequence
  Description of Artificial Sequence: Synthetic peptide
  Seed: ITDDQLLA (PRAME_HUMAN)
ILDDQLLM

SEQ ID NO: 158631 - protein, 9 aa, Artificial Sequence
  Description of Artificial Sequence: Synthetic peptide
  Seed: ISISALQSL (PRAME_HUMAN)
IQISALQSH

SEQ ID NO: 158632 - protein, 9 aa, Artificial Sequence
  Description of Artificial Sequence: Synthetic peptide
  Seed: RTFYDPEPI (PRAME_HUMAN)
RYFYDPEPF

SEQ ID NO: 158633 - protein, 9 aa, Artificial Sequence
  Description of Artificial Sequence: Synthetic peptide
  Seed: YIAQFTSQF (PRAME_HUMAN)
YEAQFTSQF

SEQ ID NO: 158634 - protein, 10 aa, Artificial Sequence
  Description of Artificial Sequence: Synthetic peptide
  Seed: RGRLDQLLRH (PRAME_HUMAN)
RSRLDQLLRF

SEQ ID NO: 158635 - protein, 10 aa, Artificial Sequence
  Description of Artificial Sequence: Synthetic peptide
  Seed: SLSGVMLTDV (PRAME_HUMAN)
SMSGVMLTDL

SEQ ID NO: 158636 - protein, 10 aa, Artificial Sequence
  Description of Artificial Sequence: Synthetic peptide
  Seed: KIFAMPMQDI (PRAME_HUMAN)
KLFAMPMQDA

SEQ ID NO: 158637 - protein, 11 aa, Artificial Sequence
  Description of Artificial Sequence: Synthetic peptide
  Seed: SYEDIHGTLHL (PRAME_HUMAN)
SYEDIHGTLHW

SEQ ID NO: 158638 - protein, 11 aa, Artificial Sequence
  Description of Artificial Sequence: Synthetic peptide
  Seed: PRELFPPLFMA (PRAME_HUMAN)
PAELFPPLFMV

SEQ ID NO: 158639 - protein, 11 aa, Artificial Sequence
  Description of Artificial Sequence: Synthetic peptide
  Seed: IQSRYISMSVW (PRAME_HUMAN)
ISSRYISMSVF

SEQ ID NO: 158640 - protein, 9 aa, Artificial Sequence
  Description of Artificial Sequence: Synthetic peptide
  Seed: YSFPEPEAA (PRAME_HUMAN)
YSFPEPEAL

SEQ ID NO: 158641 - protein, 11 aa, Artificial Sequence
  Description of Artificial Sequence: Synthetic peptide
  Seed: RRRLWGSIQSR (PRAME_HUMAN)
RSRLWGSIQSR

SEQ ID NO: 158642 - protein, 11 aa, Artificial Sequence
  Description of Artificial Sequence: Synthetic peptide
  Seed: QALYVDSLFFL (PRAME_HUMAN)
QYLYVDSLFFW

SEQ ID NO: 158643 - protein, 10 aa, Artificial Sequence
  Description of Artificial Sequence: Synthetic peptide
  Seed: LLPRELFPPL (PRAME_HUMAN)
LPPRELFPPL

SEQ ID NO: 158644 - protein, 10 aa, Artificial Sequence
  Description of Artificial Sequence: Synthetic peptide
  Seed: KDEALAIAAL (PRAME_HUMAN)
KAEALAIAAA

SEQ ID NO: 158645 - protein, 9 aa, Artificial Sequence
  Description of Artificial Sequence: Synthetic peptide
  Seed: LSLQCLQAL (PRAME_HUMAN)
LSLQCLQAV

SEQ ID NO: 158646 - protein, 9 aa, Artificial Sequence
  Description of Artificial Sequence: Synthetic peptide
  Seed: SLSHCSQLT (PRAME_HUMAN)
SMSHCSQLV

SEQ ID NO: 158647 - protein, 9 aa, Artificial Sequence
  Description of Artificial Sequence: Synthetic peptide
  Seed: RLRELLCEL (PRAME_HUMAN)
RWRELLCEK

SEQ ID NO: 158648 - protein, 9 aa, Artificial Sequence
  Description of Artificial Sequence: Synthetic peptide
  Seed: LTDVSPEPL (PRAME_HUMAN)
LGDVSPEPI

SEQ ID NO: 158649 - protein, 9 aa, Artificial Sequence
  Description of Artificial Sequence: Synthetic peptide
  Seed: LSLQCLQAL (PRAME_HUMAN)
LQLQCLQAV

SEQ ID NO: 158650 - protein, 10 aa, Artificial Sequence
  Description of Artificial Sequence: Synthetic peptide
  Seed: ETLSITNCRL (PRAME_HUMAN)
EVLSITNCRV

SEQ ID NO: 158651 - protein, 9 aa, Artificial Sequence
  Description of Artificial Sequence: Synthetic peptide
  Seed: YSFPEPEAA (PRAME_HUMAN)
YIFPEPEAY

SEQ ID NO: 158652 - protein, 9 aa, Artificial Sequence
  Description of Artificial Sequence: Synthetic peptide
  Seed: DVLLAQEVR (PRAME_HUMAN)
DVLLAQEVK

SEQ ID NO: 158653 - protein, 9 aa, Artificial Sequence
  Description of Artificial Sequence: Synthetic peptide
  Seed: SLLQHLIGL (PRAME_HUMAN)
SFLQHLIGY

SEQ ID NO: 158654 - protein, 11 aa, Artificial Sequence
  Description of Artificial Sequence: Synthetic peptide
  Seed: RLWGSIQSRYI (PRAME_HUMAN)
RLWGSIQSRYA

SEQ ID NO: 158655 - protein, 9 aa, Artificial Sequence
  Description of Artificial Sequence: Synthetic peptide
  Seed: RGRLDQLLR (PRAME_HUMAN)
RSRLDQLLL

SEQ ID NO: 158656 - protein, 10 aa, Artificial Sequence
  Description of Artificial Sequence: Synthetic peptide
  Seed: SPYLGQMINL (PRAME_HUMAN)
SDYLGQMINW

SEQ ID NO: 158657 - protein, 9 aa, Artificial Sequence
  Description of Artificial Sequence: Synthetic peptide
  Seed: ALQSLLQHL (PRAME_HUMAN)
AMQSLLQHW

SEQ ID NO: 158658 - protein, 11 aa, Artificial Sequence
  Description of Artificial Sequence: Synthetic peptide
  Seed: FSPYLGQMINL (PRAME_HUMAN)
FTPYLGQMINF

SEQ ID NO: 158659 - protein, 9 aa, Artificial Sequence
  Description of Artificial Sequence: Synthetic peptide
  Seed: RHSQTLKAM (PRAME_HUMAN)
RISQTLKAF

SEQ ID NO: 158660 - protein, 10 aa, Artificial Sequence
  Description of Artificial Sequence: Synthetic peptide
  Seed: LSVLSLSGVM (PRAME_HUMAN)
LHVLSLSGVF

SEQ ID NO: 158661 - protein, 11 aa, Artificial Sequence
  Description of Artificial Sequence: Synthetic peptide
  Seed: SNLTHVLYPVP (PRAME_HUMAN)
SLLTHVLYPVG

SEQ ID NO: 158662 - protein, 9 aa, Artificial Sequence
  Description of Artificial Sequence: Synthetic peptide
  Seed: VSQLSVLSL (PRAME_HUMAN)
VAQLSVLSW

SEQ ID NO: 158663 - protein, 8 aa, Artificial Sequence
  Description of Artificial Sequence: Synthetic peptide
  Seed: YVDSLFFL (PRAME_HUMAN)
YADSLFFL

SEQ ID NO: 158664 - protein, 10 aa, Artificial Sequence
  Description of Artificial Sequence: Synthetic peptide
  Seed: LSFYGNSISI (PRAME_HUMAN)
LYFYGNSISI

SEQ ID NO: 158665 - protein, 9 aa, Artificial Sequence
  Description of Artificial Sequence: Synthetic peptide
  Seed: ITDDQLLAL (PRAME_HUMAN)
IRDDQLLAF

SEQ ID NO: 158666 - protein, 9 aa, Artificial Sequence
  Description of Artificial Sequence: Synthetic peptide
  Seed: LSANPCPHC (PRAME_HUMAN)
LAANPCPHW

SEQ ID NO: 158667 - protein, 9 aa, Artificial Sequence
  Description of Artificial Sequence: Synthetic peptide
  Seed: LYPVPLESY (PRAME_HUMAN)
LAPVPLESF

SEQ ID NO: 158668 - protein, 9 aa, Artificial Sequence
  Description of Artificial Sequence: Synthetic peptide
  Seed: CKKLKIFAM (PRAME_HUMAN)
CAKLKIFAL

SEQ ID NO: 158669 - protein, 9 aa, Artificial Sequence
  Description of Artificial Sequence: Synthetic peptide
  Seed: YLHARLREL (PRAME_HUMAN)
YTHARLREI

SEQ ID NO: 158670 - protein, 8 aa, Artificial Sequence
  Description of Artificial Sequence: Synthetic peptide
  Seed: TDDQLLAL (PRAME_HUMAN)
TWDQLLAM

SEQ ID NO: 158671 - protein, 10 aa, Artificial Sequence
  Description of Artificial Sequence: Synthetic peptide
  Seed: TFYDPEPILC (PRAME_HUMAN)
TWYDPEPILL

SEQ ID NO: 158672 - protein, 10 aa, Artificial Sequence
  Description of Artificial Sequence: Synthetic peptide
  Seed: PTLAKFSPYL (PRAME_HUMAN)
PCLAKFSPYV

SEQ ID NO: 158673 - protein, 9 aa, Artificial Sequence
  Description of Artificial Sequence: Synthetic peptide
  Seed: NSISISALQ (PRAME_HUMAN)
NVISISALY

SEQ ID NO: 158674 - protein, 9 aa, Artificial Sequence
  Description of Artificial Sequence: Synthetic peptide
  Seed: MPMQDIKMI (PRAME_HUMAN)
MSMQDIKMY

SEQ ID NO: 158675 - protein, 10 aa, Artificial Sequence
  Description of Artificial Sequence: Synthetic peptide
  Seed: SLYSFPEPEA (PRAME_HUMAN)
SMYSFPEPEM

SEQ ID NO: 158676 - protein, 9 aa, Artificial Sequence
  Description of Artificial Sequence: Synthetic peptide
  Seed: QSLLKDEAL (PRAME_HUMAN)
QELLKDEAI

SEQ ID NO: 158677 - protein, 10 aa, Artificial Sequence
  Description of Artificial Sequence: Synthetic peptide
  Seed: VTCTWKLPTL (PRAME_HUMAN)
VLCTWKLPTV

SEQ ID NO: 158678 - protein, 9 aa, Artificial Sequence
  Description of Artificial Sequence: Synthetic peptide
  Seed: ALAIAALEL (PRAME_HUMAN)
AAAIAALEY

SEQ ID NO: 158679 - protein, 10 aa, Artificial Sequence
  Description of Artificial Sequence: Synthetic peptide
  Seed: GRPSMVWLSA (PRAME_HUMAN)
GYPSMVWLSA

SEQ ID NO: 158680 - protein, 11 aa, Artificial Sequence
  Description of Artificial Sequence: Synthetic peptide
  Seed: YISMSVWTSPR (PRAME_HUMAN)
YTSMSVWTSPR

SEQ ID NO: 158681 - protein, 10 aa, Artificial Sequence
  Description of Artificial Sequence: Synthetic peptide
  Seed: AFDGRHSQTL (PRAME_HUMAN)
AYDGRHSQTY

SEQ ID NO: 158682 - protein, 9 aa, Artificial Sequence
  Description of Artificial Sequence: Synthetic peptide
  Seed: QMINLRRLL (PRAME_HUMAN)
QQINLRRLI

SEQ ID NO: 158683 - protein, 9 aa, Artificial Sequence
  Description of Artificial Sequence: Synthetic peptide
  Seed: KMILKMVQL (PRAME_HUMAN)
KKILKMVQF

SEQ ID NO: 158684 - protein, 9 aa, Artificial Sequence
  Description of Artificial Sequence: Synthetic peptide
  Seed: SQLSVLSLS (PRAME_HUMAN)
STLSVLSLL

SEQ ID NO: 158685 - protein, 9 aa, Artificial Sequence
  Description of Artificial Sequence: Synthetic peptide
  Seed: AWPFTCLPL (PRAME_HUMAN)
ATPFTCLPL

SEQ ID NO: 158686 - protein, 11 aa, Artificial Sequence
  Description of Artificial Sequence: Synthetic peptide
  Seed: FSPYLGQMINL (PRAME_HUMAN)
FFPYLGQMINF

SEQ ID NO: 158687 - protein, 10 aa, Artificial Sequence
  Description of Artificial Sequence: Synthetic peptide
  Seed: SISISALQSL (PRAME_HUMAN)
SGSISALQSF

SEQ ID NO: 158688 - protein, 10 aa, Artificial Sequence
  Description of Artificial Sequence: Synthetic peptide
  Seed: MVQAWPFTCL (PRAME_HUMAN)
MEQAWPFTCY

SEQ ID NO: 158689 - protein, 9 aa, Artificial Sequence
  Description of Artificial Sequence: Synthetic peptide
  Seed: RHSQTLKAM (PRAME_HUMAN)
RMSQTLKAF

SEQ ID NO: 158690 - protein, 9 aa, Artificial Sequence
  Description of Artificial Sequence: Synthetic peptide
  Seed: TSPRRLVEL (PRAME_HUMAN)
TTPRRLVEL

SEQ ID NO: 158691 - protein, 10 aa, Artificial Sequence
  Description of Artificial Sequence: Synthetic peptide
  Seed: LSLQCLQALY (PRAME_HUMAN)
LQLQCLQALM

SEQ ID NO: 158692 - protein, 9 aa, Artificial Sequence
  Description of Artificial Sequence: Synthetic peptide
  Seed: KMILKMVQL (PRAME_HUMAN)
KFILKMVQY

SEQ ID NO: 158693 - protein, 9 aa, Artificial Sequence
  Description of Artificial Sequence: Synthetic peptide
  Seed: LRKNSHQDF (PRAME_HUMAN)
LLKNSHQDF

SEQ ID NO: 158694 - protein, 9 aa, Artificial Sequence
  Description of Artificial Sequence: Synthetic peptide
  Seed: SIQSRYISM (PRAME_HUMAN)
SSQSRYISF

SEQ ID NO: 158695 - protein, 10 aa, Artificial Sequence
  Description of Artificial Sequence: Synthetic peptide
  Seed: AALELLPREL (PRAME_HUMAN)
AVLELLPREV

SEQ ID NO: 158696 - protein, 9 aa, Artificial Sequence
  Description of Artificial Sequence: Synthetic peptide
  Seed: LAIAALELL (PRAME_HUMAN)
LQIAALELF

SEQ ID NO: 158697 - protein, 10 aa, Artificial Sequence
  Description of Artificial Sequence: Synthetic peptide
  Seed: HCSQLTTLSF (PRAME_HUMAN)
HVSQLTTLSW

SEQ ID NO: 158698 - protein, 11 aa, Artificial Sequence
  Description of Artificial Sequence: Synthetic peptide
  Seed: QALYVDSLFFL (PRAME_HUMAN)
QTLYVDSLFFI

SEQ ID NO: 158699 - protein, 10 aa, Artificial Sequence
  Description of Artificial Sequence: Synthetic peptide
  Seed: YSFPEPEAAQ (PRAME_HUMAN)
YTFPEPEAAY

SEQ ID NO: 158700 - protein, 9 aa, Artificial Sequence
  Description of Artificial Sequence: Synthetic peptide
  Seed: LLRHVMNPL (PRAME_HUMAN)
LKRHVMNPY

SEQ ID NO: 158701 - protein, 9 aa, Artificial Sequence
  Description of Artificial Sequence: Synthetic peptide
  Seed: KLKIFAMPM (PRAME_HUMAN)
KIKIFAMPA

SEQ ID NO: 158702 - protein, 9 aa, Artificial Sequence
  Description of Artificial Sequence: Synthetic peptide
  Seed: RLAYLHARL (PRAME_HUMAN)
RKAYLHARF

SEQ ID NO: 158703 - protein, 10 aa, Artificial Sequence
  Description of Artificial Sequence: Synthetic peptide
  Seed: FSYLIEKVKR (PRAME_HUMAN)
FAYLIEKVKR

SEQ ID NO: 158704 - protein, 9 aa, Artificial Sequence
  Description of Artificial Sequence: Synthetic peptide
  Seed: VSPEPLQAL (PRAME_HUMAN)
VYPEPLQAM

SEQ ID NO: 158705 - protein, 10 aa, Artificial Sequence
  Description of Artificial Sequence: Synthetic peptide
  Seed: QAWPFTCLPL (PRAME_HUMAN)
QDWPFTCLPF

SEQ ID NO: 158706 - protein, 11 aa, Artificial Sequence
  Description of Artificial Sequence: Synthetic peptide
  Seed: RLSEGDVMHLS (PRAME_HUMAN)
RLSEGDVMHLV

SEQ ID NO: 158707 - protein, 9 aa, Artificial Sequence
  Description of Artificial Sequence: Synthetic peptide
  Seed: YIAQFTSQF (PRAME_HUMAN)
YIAQFTSQA

SEQ ID NO: 158708 - protein, 9 aa, Artificial Sequence
  Description of Artificial Sequence: Synthetic peptide
  Seed: QTLKAMVQA (PRAME_HUMAN)
QLLKAMVQV

SEQ ID NO: 158709 - protein, 8 aa, Artificial Sequence
  Description of Artificial Sequence: Synthetic peptide
  Seed: LLALLPSL (PRAME_HUMAN)
LMALLPSV

SEQ ID NO: 158710 - protein, 9 aa, Artificial Sequence
  Description of Artificial Sequence: Synthetic peptide
  Seed: RLAYLHARL (PRAME_HUMAN)
RQAYLHARL

SEQ ID NO: 158711 - protein, 10 aa, Artificial Sequence
  Description of Artificial Sequence: Synthetic peptide
  Seed: LLPRELFPPL (PRAME_HUMAN)
LTPRELFPPI

SEQ ID NO: 158712 - protein, 9 aa, Artificial Sequence
  Description of Artificial Sequence: Synthetic peptide
  Seed: VQAWPFTCL (PRAME_HUMAN)
VKAWPFTCM

SEQ ID NO: 158713 - protein, 9 aa, Artificial Sequence
  Description of Artificial Sequence: Synthetic peptide
  Seed: ASATLQDLV (PRAME_HUMAN)
ATATLQDLV

SEQ ID NO: 158714 - protein, 9 aa, Artificial Sequence
  Description of Artificial Sequence: Synthetic peptide
  Seed: SQLTTLSFY (PRAME_HUMAN)
SMLTTLSFF

SEQ ID NO: 158715 - protein, 10 aa, Artificial Sequence
  Description of Artificial Sequence: Synthetic peptide
  Seed: VRPRRWKLQV (PRAME_HUMAN)
VLPRRWKLQL

SEQ ID NO: 158716 - protein, 10 aa, Artificial Sequence
  Description of Artificial Sequence: Synthetic peptide
  Seed: KIFAMPMQDI (PRAME_HUMAN)
KMFAMPMQDW

SEQ ID NO: 158717 - protein, 10 aa, Artificial Sequence
  Description of Artificial Sequence: Synthetic peptide
  Seed: SNLTHVLYPV (PRAME_HUMAN)
SILTHVLYPV

SEQ ID NO: 158718 - protein, 9 aa, Artificial Sequence
  Description of Artificial Sequence: Synthetic peptide
  Seed: TSPRRLVEL (PRAME_HUMAN)
TYPRRLVEV

SEQ ID NO: 158719 - protein, 10 aa, Artificial Sequence
  Description of Artificial Sequence: Synthetic peptide
  Seed: RLWGSIQSRY (PRAME_HUMAN)
RKWGSIQSRM

SEQ ID NO: 158720 - protein, 9 aa, Artificial Sequence
  Description of Artificial Sequence: Synthetic peptide
  Seed: VSPEPLQAL (PRAME_HUMAN)
VRPEPLQAF

SEQ ID NO: 158721 - protein, 8 aa, Artificial Sequence
  Description of Artificial Sequence: Synthetic peptide
  Seed: FYDPEPIL (PRAME_HUMAN)
FGDPEPIM

SEQ ID NO: 158722 - protein, 8 aa, Artificial Sequence
  Description of Artificial Sequence: Synthetic peptide
  Seed: FYDPEPIL (PRAME_HUMAN)
FGDPEPIV

SEQ ID NO: 158723 - protein, 10 aa, Artificial Sequence
  Description of Artificial Sequence: Synthetic peptide
  Seed: RELFPPLFMA (PRAME_HUMAN)
RPLFPPLFMV

SEQ ID NO: 158724 - protein, 9 aa, Artificial Sequence
  Description of Artificial Sequence: Synthetic peptide
  Seed: KLQVLDLRK (PRAME_HUMAN)
KIQVLDLRR

SEQ ID NO: 158725 - protein, 10 aa, Artificial Sequence
  Description of Artificial Sequence: Synthetic peptide
  Seed: AIAALELLPR (PRAME_HUMAN)
AMAALELLPR

SEQ ID NO: 158726 - protein, 10 aa, Artificial Sequence
  Description of Artificial Sequence: Synthetic peptide
  Seed: LLSHIHASSY (PRAME_HUMAN)
LQSHIHASSW

SEQ ID NO: 158727 - protein, 10 aa, Artificial Sequence
  Description of Artificial Sequence: Synthetic peptide
  Seed: ASATLQDLVF (PRAME_HUMAN)
AKATLQDLVF

SEQ ID NO: 158728 - protein, 10 aa, Artificial Sequence
  Description of Artificial Sequence: Synthetic peptide
  Seed: ARLRELLCEL (PRAME_HUMAN)
AHLRELLCEI

SEQ ID NO: 158729 - protein, 9 aa, Artificial Sequence
  Description of Artificial Sequence: Synthetic peptide
  Seed: FMAAFDGRH (PRAME_HUMAN)
FKAAFDGRY

SEQ ID NO: 158730 - protein, 9 aa, Artificial Sequence
  Description of Artificial Sequence: Synthetic peptide
  Seed: VSPEPLQAL (PRAME_HUMAN)
VFPEPLQAI

SEQ ID NO: 158731 - protein, 9 aa, Artificial Sequence
  Description of Artificial Sequence: Synthetic peptide
  Seed: LQALYVDSL (PRAME_HUMAN)
LEALYVDSI

SEQ ID NO: 158732 - protein, 10 aa, Artificial Sequence
  Description of Artificial Sequence: Synthetic peptide
  Seed: QLLALLPSLS (PRAME_HUMAN)
QFLALLPSLV

SEQ ID NO: 158733 - protein, 9 aa, Artificial Sequence
  Description of Artificial Sequence: Synthetic peptide
  Seed: RTFYDPEPI (PRAME_HUMAN)
RMFYDPEPV

SEQ ID NO: 158734 - protein, 9 aa, Artificial Sequence
  Description of Artificial Sequence: Synthetic peptide
  Seed: FPPLFMAAF (PRAME_HUMAN)
FPPLFMAAY

SEQ ID NO: 158735 - protein, 10 aa, Artificial Sequence
  Description of Artificial Sequence: Synthetic peptide
  Seed: GACDELFSYL (PRAME_HUMAN)
GVCDELFSYM

SEQ ID NO: 158736 - protein, 9 aa, Artificial Sequence
  Description of Artificial Sequence: Synthetic peptide
  Seed: ASATLQDLV (PRAME_HUMAN)
ALATLQDLL

SEQ ID NO: 158737 - protein, 9 aa, Artificial Sequence
  Description of Artificial Sequence: Synthetic peptide
  Seed: TLAKFSPYL (PRAME_HUMAN)
TSAKFSPYV

SEQ ID NO: 158738 - protein, 9 aa, Artificial Sequence
  Description of Artificial Sequence: Synthetic peptide
  Seed: VQLDSIEDL (PRAME_HUMAN)
VTLDSIEDV

SEQ ID NO: 158739 - protein, 9 aa, Artificial Sequence
  Description of Artificial Sequence: Synthetic peptide
  Seed: FSPYLGQMI (PRAME_HUMAN)
FAPYLGQMY

SEQ ID NO: 158740 - protein, 11 aa, Artificial Sequence
  Description of Artificial Sequence: Synthetic peptide
  Seed: AVLDGLDVLLA (PRAME_HUMAN)
AVLDGLDVLLV

SEQ ID NO: 158741 - protein, 11 aa, Artificial Sequence
  Description of Artificial Sequence: Synthetic peptide
  Seed: FSPYLGQMINL (PRAME_HUMAN)
FMPYLGQMINF

SEQ ID NO: 158742 - protein, 9 aa, Artificial Sequence
  Description of Artificial Sequence: Synthetic peptide
  Seed: KLKIFAMPM (PRAME_HUMAN)
KAKIFAMPV

SEQ ID NO: 158743 - protein, 9 aa, Artificial Sequence
  Description of Artificial Sequence: Synthetic peptide
  Seed: AAFDGRHSQ (PRAME_HUMAN)
AVFDGRHSY

SEQ ID NO: 158744 - protein, 9 aa, Artificial Sequence
  Description of Artificial Sequence: Synthetic peptide
  Seed: ISISALQSL (PRAME_HUMAN)
ISISALQSW

SEQ ID NO: 158745 - protein, 10 aa, Artificial Sequence
  Description of Artificial Sequence: Synthetic peptide
  Seed: LSLQCLQALY (PRAME_HUMAN)
LLLQCLQALY

SEQ ID NO: 158746 - protein, 9 aa, Artificial Sequence
  Description of Artificial Sequence: Synthetic peptide
  Seed: RRWKLQVLD (PRAME_HUMAN)
RQWKLQVLM

SEQ ID NO: 158747 - protein, 11 aa, Artificial Sequence
  Description of Artificial Sequence: Synthetic peptide
  Seed: SNLTHVLYPVP (PRAME_HUMAN)
SFLTHVLYPVV

SEQ ID NO: 158748 - protein, 9 aa, Artificial Sequence
  Description of Artificial Sequence: Synthetic peptide
  Seed: KAMVQAWPF (PRAME_HUMAN)
KEMVQAWPI

SEQ ID NO: 158749 - protein, 10 aa, Artificial Sequence
  Description of Artificial Sequence: Synthetic peptide
  Seed: FAMPMQDIKM (PRAME_HUMAN)
FTMPMQDIKF

SEQ ID NO: 158750 - protein, 9 aa, Artificial Sequence
  Description of Artificial Sequence: Synthetic peptide
  Seed: AVLDGLDVL (PRAME_HUMAN)
AILDGLDVI

SEQ ID NO: 158751 - protein, 9 aa, Artificial Sequence
  Description of Artificial Sequence: Synthetic peptide
  Seed: ELAGQSLLK (PRAME_HUMAN)
EVAGQSLLR

SEQ ID NO: 158752 - protein, 9 aa, Artificial Sequence
  Description of Artificial Sequence: Synthetic peptide
  Seed: ITDDQLLAL (PRAME_HUMAN)
IVDDQLLAV

SEQ ID NO: 158753 - protein, 9 aa, Artificial Sequence
  Description of Artificial Sequence: Synthetic peptide
  Seed: VSPEPLQAL (PRAME_HUMAN)
VHPEPLQAL

SEQ ID NO: 158754 - protein, 10 aa, Artificial Sequence
  Description of Artificial Sequence: Synthetic peptide
  Seed: FIPVEVLVDL (PRAME_HUMAN)
FMPVEVLVDL

SEQ ID NO: 158755 - protein, 9 aa, Artificial Sequence
  Description of Artificial Sequence: Synthetic peptide
  Seed: VFDECGITD (PRAME_HUMAN)
VWDECGITL

SEQ ID NO: 158756 - protein, 8 aa, Artificial Sequence
  Description of Artificial Sequence: Synthetic peptide
  Seed: DQLLRHVM (PRAME_HUMAN)
DILLRHVL

SEQ ID NO: 158757 - protein, 9 aa, Artificial Sequence
  Description of Artificial Sequence: Synthetic peptide
  Seed: FYDPEPILC (PRAME_HUMAN)
FGDPEPILA

SEQ ID NO: 158758 - protein, 9 aa, Artificial Sequence
  Description of Artificial Sequence: Synthetic peptide
  Seed: KLKIFAMPM (PRAME_HUMAN)
KTKIFAMPM

SEQ ID NO: 158759 - protein, 8 aa, Artificial Sequence
  Description of Artificial Sequence: Synthetic peptide
  Seed: FYDPEPIL (PRAME_HUMAN)
FFDPEPIV

SEQ ID NO: 158760 - protein, 9 aa, Artificial Sequence
  Description of Artificial Sequence: Synthetic peptide
  Seed: SYLIEKVKR (PRAME_HUMAN)
SVLIEKVKR

SEQ ID NO: 158761 - protein, 11 aa, Artificial Sequence
  Description of Artificial Sequence: Synthetic peptide
  Seed: HVLYPVPLESY (PRAME_HUMAN)
HQLYPVPLESY

SEQ ID NO: 158762 - protein, 11 aa, Artificial Sequence
  Description of Artificial Sequence: Synthetic peptide
  Seed: QALYVDSLFFL (PRAME_HUMAN)
QLLYVDSLFFI

SEQ ID NO: 158763 - protein, 9 aa, Artificial Sequence
  Description of Artificial Sequence: Synthetic peptide
  Seed: LTDVSPEPL (PRAME_HUMAN)
LADVSPEPF

SEQ ID NO: 158764 - protein, 9 aa, Artificial Sequence
  Description of Artificial Sequence: Synthetic peptide
  Seed: LGRPSMVWL (PRAME_HUMAN)
LFRPSMVWK

SEQ ID NO: 158765 - protein, 11 aa, Artificial Sequence
  Description of Artificial Sequence: Synthetic peptide
  Seed: SIEDLEVTCTW (PRAME_HUMAN)
SAEDLEVTCTW

SEQ ID NO: 158766 - protein, 9 aa, Artificial Sequence
  Description of Artificial Sequence: Synthetic peptide
  Seed: FYDPEPILC (PRAME_HUMAN)
FVDPEPILA

SEQ ID NO: 158767 - protein, 9 aa, Artificial Sequence
  Description of Artificial Sequence: Synthetic peptide
  Seed: SLLQHLIGL (PRAME_HUMAN)
SLLQHLIGF

SEQ ID NO: 158768 - protein, 11 aa, Artificial Sequence
  Description of Artificial Sequence: Synthetic peptide
  Seed: SNLTHVLYPVP (PRAME_HUMAN)
SMLTHVLYPVS

SEQ ID NO: 158769 - protein, 10 aa, Artificial Sequence
  Description of Artificial Sequence: Synthetic peptide
  Seed: KDEALAIAAL (PRAME_HUMAN)
KQEALAIAAA

SEQ ID NO: 158770 - protein, 9 aa, Artificial Sequence
  Description of Artificial Sequence: Synthetic peptide
  Seed: SISALQSLL (PRAME_HUMAN)
STSALQSLL

SEQ ID NO: 158771 - protein, 9 aa, Artificial Sequence
  Description of Artificial Sequence: Synthetic peptide
  Seed: ACDELFSYL (PRAME_HUMAN)
AGDELFSYV

SEQ ID NO: 158772 - protein, 9 aa, Artificial Sequence
  Description of Artificial Sequence: Synthetic peptide
  Seed: VSPEPLQAL (PRAME_HUMAN)
VRPEPLQAL

SEQ ID NO: 158773 - protein, 9 aa, Artificial Sequence
  Description of Artificial Sequence: Synthetic peptide
  Seed: SIQSRYISM (PRAME_HUMAN)
STQSRYISR

SEQ ID NO: 158774 - protein, 10 aa, Artificial Sequence
  Description of Artificial Sequence: Synthetic peptide
  Seed: ITDDQLLALL (PRAME_HUMAN)
IVDDQLLALF

SEQ ID NO: 158775 - protein, 11 aa, Artificial Sequence
  Description of Artificial Sequence: Synthetic peptide
  Seed: LLPRELFPPLF (PRAME_HUMAN)
LYPRELFPPLF

SEQ ID NO: 158776 - protein, 9 aa, Artificial Sequence
  Description of Artificial Sequence: Synthetic peptide
  Seed: ACDELFSYL (PRAME_HUMAN)
AIDELFSYA

SEQ ID NO: 158777 - protein, 9 aa, Artificial Sequence
  Description of Artificial Sequence: Synthetic peptide
  Seed: SQSPSVSQL (PRAME_HUMAN)
SQSPSVSQW

SEQ ID NO: 158778 - protein, 11 aa, Artificial Sequence
  Description of Artificial Sequence: Synthetic peptide
  Seed: PRELFPPLFMA (PRAME_HUMAN)
PSELFPPLFMV

SEQ ID NO: 158779 - protein, 10 aa, Artificial Sequence
  Description of Artificial Sequence: Synthetic peptide
  Seed: RGRLDQLLRH (PRAME_HUMAN)
RNRLDQLLRR

SEQ ID NO: 158780 - protein, 9 aa, Artificial Sequence
  Description of Artificial Sequence: Synthetic peptide
  Seed: LYPVPLESY (PRAME_HUMAN)
LFPVPLESF

SEQ ID NO: 158781 - protein, 11 aa, Artificial Sequence
  Description of Artificial Sequence: Synthetic peptide
  Seed: LTDVSPEPLQA (PRAME_HUMAN)
LMDVSPEPLQM

SEQ ID NO: 158782 - protein, 10 aa, Artificial Sequence
  Description of Artificial Sequence: Synthetic peptide
  Seed: SLLQHLIGLS (PRAME_HUMAN)
SFLQHLIGLV

SEQ ID NO: 158783 - protein, 9 aa, Artificial Sequence
  Description of Artificial Sequence: Synthetic peptide
  Seed: SLLQHLIGL (PRAME_HUMAN)
SQLQHLIGF

SEQ ID NO: 158784 - protein, 10 aa, Artificial Sequence
  Description of Artificial Sequence: Synthetic peptide
  Seed: ASATLQDLVF (PRAME_HUMAN)
AQATLQDLVY

SEQ ID NO: 158785 - protein, 10 aa, Artificial Sequence
  Description of Artificial Sequence: Synthetic peptide
  Seed: DQLLALLPSL (PRAME_HUMAN)
DKLLALLPSI

SEQ ID NO: 158786 - protein, 9 aa, Artificial Sequence
  Description of Artificial Sequence: Synthetic peptide
  Seed: YIAQFTSQF (PRAME_HUMAN)
YSAQFTSQH

SEQ ID NO: 158787 - protein, 10 aa, Artificial Sequence
  Description of Artificial Sequence: Synthetic peptide
  Seed: LLSHIHASSY (PRAME_HUMAN)
LRSHIHASSF

SEQ ID NO: 158788 - protein, 10 aa, Artificial Sequence
  Description of Artificial Sequence: Synthetic peptide
  Seed: SLLQHLIGLS (PRAME_HUMAN)
SMLQHLIGLV

SEQ ID NO: 158789 - protein, 10 aa, Artificial Sequence
  Description of Artificial Sequence: Synthetic peptide
  Seed: RELFPPLFMA (PRAME_HUMAN)
RCLFPPLFMA

SEQ ID NO: 158790 - protein, 10 aa, Artificial Sequence
  Description of Artificial Sequence: Synthetic peptide
  Seed: VMNPLETLSI (PRAME_HUMAN)
VQNPLETLSY

SEQ ID NO: 158791 - protein, 9 aa, Artificial Sequence
  Description of Artificial Sequence: Synthetic peptide
  Seed: HLIGLSNLT (PRAME_HUMAN)
HMIGLSNLI

SEQ ID NO: 158792 - protein, 9 aa, Artificial Sequence
  Description of Artificial Sequence: Synthetic peptide
  Seed: QHLIGLSNL (PRAME_HUMAN)
QHLIGLSNA

SEQ ID NO: 158793 - protein, 9 aa, Artificial Sequence
  Description of Artificial Sequence: Synthetic peptide
  Seed: ELFPPLFMA (PRAME_HUMAN)
ETFPPLFML

SEQ ID NO: 158794 - protein, 10 aa, Artificial Sequence
  Description of Artificial Sequence: Synthetic peptide
  Seed: FLSLQCLQAL (PRAME_HUMAN)
FASLQCLQAV

SEQ ID NO: 158795 - protein, 10 aa, Artificial Sequence
  Description of Artificial Sequence: Synthetic peptide
  Seed: YEDIHGTLHL (PRAME_HUMAN)
YGDIHGTLHM

SEQ ID NO: 158796 - protein, 9 aa, Artificial Sequence
  Description of Artificial Sequence: Synthetic peptide
  Seed: ALQSLLQHL (PRAME_HUMAN)
AIQSLLQHV

SEQ ID NO: 158797 - protein, 9 aa, Artificial Sequence
  Description of Artificial Sequence: Synthetic peptide
  Seed: WKLPTLAKF (PRAME_HUMAN)
WALPTLAKY

SEQ ID NO: 158798 - protein, 10 aa, Artificial Sequence
  Description of Artificial Sequence: Synthetic peptide
  Seed: FIPVEVLVDL (PRAME_HUMAN)
FIPVEVLVDM

SEQ ID NO: 158799 - protein, 9 aa, Artificial Sequence
  Description of Artificial Sequence: Synthetic peptide
  Seed: ELFSYLIEK (PRAME_HUMAN)
EIFSYLIEH

SEQ ID NO: 158800 - protein, 9 aa, Artificial Sequence
  Description of Artificial Sequence: Synthetic peptide
  Seed: LLKDEALAI (PRAME_HUMAN)
LIKDEALAY

SEQ ID NO: 158801 - protein, 8 aa, Artificial Sequence
  Description of Artificial Sequence: Synthetic peptide
  Seed: LSFYGNSI (PRAME_HUMAN)
LTFYGNSW

SEQ ID NO: 158802 - protein, 9 aa, Artificial Sequence
  Description of Artificial Sequence: Synthetic peptide
  Seed: LPRELFPPL (PRAME_HUMAN)
LARELFPPA

SEQ ID NO: 158803 - protein, 10 aa, Artificial Sequence
  Description of Artificial Sequence: Synthetic peptide
  Seed: LLPRELFPPL (PRAME_HUMAN)
LFPRELFPPL

SEQ ID NO: 158804 - protein, 10 aa, Artificial Sequence
  Description of Artificial Sequence: Synthetic peptide
  Seed: LLPRELFPPL (PRAME_HUMAN)
LAPRELFPPL

SEQ ID NO: 158805 - protein, 11 aa, Artificial Sequence
  Description of Artificial Sequence: Synthetic peptide
  Seed: FLKEGACDELF (PRAME_HUMAN)
FMKEGACDELV

SEQ ID NO: 158806 - protein, 10 aa, Artificial Sequence
  Description of Artificial Sequence: Synthetic peptide
  Seed: LSQSPSVSQL (PRAME_HUMAN)
LQQSPSVSQY

SEQ ID NO: 158807 - protein, 10 aa, Artificial Sequence
  Description of Artificial Sequence: Synthetic peptide
  Seed: LPTLAKFSPY (PRAME_HUMAN)
LDTLAKFSPW

SEQ ID NO: 158808 - protein, 9 aa, Artificial Sequence
  Description of Artificial Sequence: Synthetic peptide
  Seed: LYPVPLESY (PRAME_HUMAN)
LYPVPLESM

SEQ ID NO: 158809 - protein, 9 aa, Artificial Sequence
  Description of Artificial Sequence: Synthetic peptide
  Seed: MNPLETLSI (PRAME_HUMAN)
MTPLETLSI

SEQ ID NO: 158810 - protein, 11 aa, Artificial Sequence
  Description of Artificial Sequence: Synthetic peptide
  Seed: EDIHGTLHLER (PRAME_HUMAN)
EFIHGTLHLER

SEQ ID NO: 158811 - protein, 10 aa, Artificial Sequence
  Description of Artificial Sequence: Synthetic peptide
  Seed: FFLRGRLDQL (PRAME_HUMAN)
FRLRGRLDQI

SEQ ID NO: 158812 - protein, 9 aa, Artificial Sequence
  Description of Artificial Sequence: Synthetic peptide
  Seed: LSLQCLQAL (PRAME_HUMAN)
LQLQCLQAF

SEQ ID NO: 158813 - protein, 9 aa, Artificial Sequence
  Description of Artificial Sequence: Synthetic peptide
  Seed: TLAKFSPYL (PRAME_HUMAN)
TAAKFSPYM

SEQ ID NO: 158814 - protein, 8 aa, Artificial Sequence
  Description of Artificial Sequence: Synthetic peptide
  Seed: AQFTSQFL (PRAME_HUMAN)
AQFTSQFM

SEQ ID NO: 158815 - protein, 9 aa, Artificial Sequence
  Description of Artificial Sequence: Synthetic peptide
  Seed: AFDGRHSQT (PRAME_HUMAN)
AWDGRHSQI

SEQ ID NO: 158816 - protein, 9 aa, Artificial Sequence
  Description of Artificial Sequence: Synthetic peptide
  Seed: SYEDIHGTL (PRAME_HUMAN)
SAEDIHGTM

SEQ ID NO: 158817 - protein, 9 aa, Artificial Sequence
  Description of Artificial Sequence: Synthetic peptide
  Seed: SLLQHLIGL (PRAME_HUMAN)
SALQHLIGK

SEQ ID NO: 158818 - protein, 10 aa, Artificial Sequence
  Description of Artificial Sequence: Synthetic peptide
  Seed: VLYPVPLESY (PRAME_HUMAN)
VRYPVPLESY

SEQ ID NO: 158819 - protein, 10 aa, Artificial Sequence
  Description of Artificial Sequence: Synthetic peptide
  Seed: ITDDQLLALL (PRAME_HUMAN)
IADDQLLALW

SEQ ID NO: 158820 - protein, 10 aa, Artificial Sequence
  Description of Artificial Sequence: Synthetic peptide
  Seed: AQFTSQFLSL (PRAME_HUMAN)
AKFTSQFLSY

SEQ ID NO: 158821 - protein, 10 aa, Artificial Sequence
  Description of Artificial Sequence: Synthetic peptide
  Seed: DRTFYDPEPI (PRAME_HUMAN)
DATFYDPEPV

SEQ ID NO: 158822 - protein, 9 aa, Artificial Sequence
  Description of Artificial Sequence: Synthetic peptide
  Seed: ISISALQSL (PRAME_HUMAN)
IYISALQSL

SEQ ID NO: 158823 - protein, 9 aa, Artificial Sequence
  Description of Artificial Sequence: Synthetic peptide
  Seed: VLMKGQHLH (PRAME_HUMAN)
VMMKGQHLM

SEQ ID NO: 158824 - protein, 10 aa, Artificial Sequence
  Description of Artificial Sequence: Synthetic peptide
  Seed: YEDIHGTLHL (PRAME_HUMAN)
YWDIHGTLHM

SEQ ID NO: 158825 - protein, 10 aa, Artificial Sequence
  Description of Artificial Sequence: Synthetic peptide
  Seed: FIPVEVLVDL (PRAME_HUMAN)
FIPVEVLVDF

SEQ ID NO: 158826 - protein, 10 aa, Artificial Sequence
  Description of Artificial Sequence: Synthetic peptide
  Seed: YIAQFTSQFL (PRAME_HUMAN)
YRAQFTSQFY

SEQ ID NO: 158827 - protein, 11 aa, Artificial Sequence
  Description of Artificial Sequence: Synthetic peptide
  Seed: MKGQHLHLETF (PRAME_HUMAN)
MKGQHLHLETY

SEQ ID NO: 158828 - protein, 10 aa, Artificial Sequence
  Description of Artificial Sequence: Synthetic peptide
  Seed: LLLSHIHASS (PRAME_HUMAN)
LTLSHIHASL

SEQ ID NO: 158829 - protein, 9 aa, Artificial Sequence
  Description of Artificial Sequence: Synthetic peptide
  Seed: SVWTSPRRL (PRAME_HUMAN)
SMWTSPRRI

SEQ ID NO: 158830 - protein, 10 aa, Artificial Sequence
  Description of Artificial Sequence: Synthetic peptide
  Seed: ITDDQLLALL (PRAME_HUMAN)
ISDDQLLALY

SEQ ID NO: 158831 - protein, 9 aa, Artificial Sequence
  Description of Artificial Sequence: Synthetic peptide
  Seed: SLLQHLIGL (PRAME_HUMAN)
SSLQHLIGI

SEQ ID NO: 158832 - protein, 9 aa, Artificial Sequence
  Description of Artificial Sequence: Synthetic peptide
  Seed: RELLCELGR (PRAME_HUMAN)
RVLLCELGR

SEQ ID NO: 158833 - protein, 9 aa, Artificial Sequence
  Description of Artificial Sequence: Synthetic peptide
  Seed: KVDGLSTEA (PRAME_HUMAN)
KFDGLSTEV

SEQ ID NO: 158834 - protein, 9 aa, Artificial Sequence
  Description of Artificial Sequence: Synthetic peptide
  Seed: SEGDVMHLS (PRAME_HUMAN)
SEGDVMHLM

SEQ ID NO: 158835 - protein, 9 aa, Artificial Sequence
  Description of Artificial Sequence: Synthetic peptide
  Seed: ELAGQSLLK (PRAME_HUMAN)
EAAGQSLLK

SEQ ID NO: 158836 - protein, 9 aa, Artificial Sequence
  Description of Artificial Sequence: Synthetic peptide
  Seed: LTDVSPEPL (PRAME_HUMAN)
LTDVSPEPY

SEQ ID NO: 158837 - protein, 8 aa, Artificial Sequence
  Description of Artificial Sequence: Synthetic peptide
  Seed: YEDIHGTL (PRAME_HUMAN)
YLDIHGTM

SEQ ID NO: 158838 - protein, 10 aa, Artificial Sequence
  Description of Artificial Sequence: Synthetic peptide
  Seed: DELFSYLIEK (PRAME_HUMAN)
DELFSYLIER

SEQ ID NO: 158839 - protein, 10 aa, Artificial Sequence
  Description of Artificial Sequence: Synthetic peptide
  Seed: KGQHLHLETF (PRAME_HUMAN)
KKQHLHLETY

SEQ ID NO: 158840 - protein, 11 aa, Artificial Sequence
  Description of Artificial Sequence: Synthetic peptide
  Seed: KMVQLDSIEDL (PRAME_HUMAN)
KLVQLDSIEDV

SEQ ID NO: 158841 - protein, 10 aa, Artificial Sequence
  Description of Artificial Sequence: Synthetic peptide
  Seed: MPMQDIKMIL (PRAME_HUMAN)
MGMQDIKMIL

SEQ ID NO: 158842 - protein, 9 aa, Artificial Sequence
  Description of Artificial Sequence: Synthetic peptide
  Seed: YVDSLFFLR (PRAME_HUMAN)
YTDSLFFLY

SEQ ID NO: 158843 - protein, 9 aa, Artificial Sequence
  Description of Artificial Sequence: Synthetic peptide
  Seed: ISPEKEEQY (PRAME_HUMAN)
IFPEKEEQY

SEQ ID NO: 158844 - protein, 9 aa, Artificial Sequence
  Description of Artificial Sequence: Synthetic peptide
  Seed: VSQLSVLSL (PRAME_HUMAN)
VHQLSVLSY

SEQ ID NO: 158845 - protein, 9 aa, Artificial Sequence
  Description of Artificial Sequence: Synthetic peptide
  Seed: GQHLHLETF (PRAME_HUMAN)
GQHLHLETI

SEQ ID NO: 158846 - protein, 11 aa, Artificial Sequence
  Description of Artificial Sequence: Synthetic peptide
  Seed: RASATLQDLVF (PRAME_HUMAN)
RESATLQDLVW

SEQ ID NO: 158847 - protein, 9 aa, Artificial Sequence
  Description of Artificial Sequence: Synthetic peptide
  Seed: SVLSLSGVM (PRAME_HUMAN)
SVLSLSGVY

SEQ ID NO: 158848 - protein, 10 aa, Artificial Sequence
  Description of Artificial Sequence: Synthetic peptide
  Seed: IQSRYISMSV (PRAME_HUMAN)
IVSRYISMSA

SEQ ID NO: 158849 - protein, 10 aa, Artificial Sequence
  Description of Artificial Sequence: Synthetic peptide
  Seed: RELFPPLFMA (PRAME_HUMAN)
RQLFPPLFMA

SEQ ID NO: 158850 - protein, 9 aa, Artificial Sequence
  Description of Artificial Sequence: Synthetic peptide
  Seed: GNRASLYSF (PRAME_HUMAN)
GLRASLYSF

SEQ ID NO: 158851 - protein, 9 aa, Artificial Sequence
  Description of Artificial Sequence: Synthetic peptide
  Seed: TLKAMVQAW (PRAME_HUMAN)
TSKAMVQAY

SEQ ID NO: 158852 - protein, 10 aa, Artificial Sequence
  Description of Artificial Sequence: Synthetic peptide
  Seed: FIPVEVLVDL (PRAME_HUMAN)
FCPVEVLVDW

SEQ ID NO: 158853 - protein, 9 aa, Artificial Sequence
  Description of Artificial Sequence: Synthetic peptide
  Seed: LAIAALELL (PRAME_HUMAN)
LVIAALELW

SEQ ID NO: 158854 - protein, 10 aa, Artificial Sequence
  Description of Artificial Sequence: Synthetic peptide
  Seed: LETLSITNCR (PRAME_HUMAN)
LVTLSITNCR

SEQ ID NO: 158855 - protein, 11 aa, Artificial Sequence
  Description of Artificial Sequence: Synthetic peptide
  Seed: RRLLLSHIHAS (PRAME_HUMAN)
RRLLLSHIHAI

SEQ ID NO: 158856 - protein, 9 aa, Artificial Sequence
  Description of Artificial Sequence: Synthetic peptide
  Seed: YEDIHGTLH (PRAME_HUMAN)
YNDIHGTLY

SEQ ID NO: 158857 - protein, 10 aa, Artificial Sequence
  Description of Artificial Sequence: Synthetic peptide
  Seed: RELFPPLFMA (PRAME_HUMAN)
RLLFPPLFML

SEQ ID NO: 158858 - protein, 9 aa, Artificial Sequence
  Description of Artificial Sequence: Synthetic peptide
  Seed: VFDECGITD (PRAME_HUMAN)
VTDECGITL

SEQ ID NO: 158859 - protein, 9 aa, Artificial Sequence
  Description of Artificial Sequence: Synthetic peptide
  Seed: FLSLQCLQA (PRAME_HUMAN)
FQSLQCLQV

SEQ ID NO: 158860 - protein, 10 aa, Artificial Sequence
  Description of Artificial Sequence: Synthetic peptide
  Seed: LLLSHIHASS (PRAME_HUMAN)
LQLSHIHASA

SEQ ID NO: 158861 - protein, 9 aa, Artificial Sequence
  Description of Artificial Sequence: Synthetic peptide
  Seed: RLLLSHIHA (PRAME_HUMAN)
RMLLSHIHV

SEQ ID NO: 158862 - protein, 9 aa, Artificial Sequence
  Description of Artificial Sequence: Synthetic peptide
  Seed: DGRHSQTLK (PRAME_HUMAN)
DSRHSQTLK

SEQ ID NO: 158863 - protein, 9 aa, Artificial Sequence
  Description of Artificial Sequence: Synthetic peptide
  Seed: VQAWPFTCL (PRAME_HUMAN)
VPAWPFTCY

SEQ ID NO: 158864 - protein, 9 aa, Artificial Sequence
  Description of Artificial Sequence: Synthetic peptide
  Seed: VSQLSVLSL (PRAME_HUMAN)
VFQLSVLSF

SEQ ID NO: 158865 - protein, 9 aa, Artificial Sequence
  Description of Artificial Sequence: Synthetic peptide
  Seed: QSRYISMSV (PRAME_HUMAN)
QGRYISMSK

SEQ ID NO: 158866 - protein, 10 aa, Artificial Sequence
  Description of Artificial Sequence: Synthetic peptide
  Seed: YSFPEPEAAQ (PRAME_HUMAN)
YSFPEPEAAY

SEQ ID NO: 158867 - protein, 9 aa, Artificial Sequence
  Description of Artificial Sequence: Synthetic peptide
  Seed: NVLRLCCKK (PRAME_HUMAN)
NTLRLCCKK

SEQ ID NO: 158868 - protein, 10 aa, Artificial Sequence
  Description of Artificial Sequence: Synthetic peptide
  Seed: ARLRELLCEL (PRAME_HUMAN)
AYLRELLCEA

SEQ ID NO: 158869 - protein, 9 aa, Artificial Sequence
  Description of Artificial Sequence: Synthetic peptide
  Seed: NSHQDFWTV (PRAME_HUMAN)
NIHQDFWTI

SEQ ID NO: 158870 - protein, 9 aa, Artificial Sequence
  Description of Artificial Sequence: Synthetic peptide
  Seed: LLKDEALAI (PRAME_HUMAN)
LMKDEALAL

SEQ ID NO: 158871 - protein, 11 aa, Artificial Sequence
  Description of Artificial Sequence: Synthetic peptide
  Seed: RRWKLQVLDLR (PRAME_HUMAN)
RRWKLQVLDLY

SEQ ID NO: 158872 - protein, 9 aa, Artificial Sequence
  Description of Artificial Sequence: Synthetic peptide
  Seed: LSHIHASSY (PRAME_HUMAN)
LQHIHASSA

SEQ ID NO: 158873 - protein, 9 aa, Artificial Sequence
  Description of Artificial Sequence: Synthetic peptide
  Seed: MHLSQSPSV (PRAME_HUMAN)
MELSQSPSY

SEQ ID NO: 158874 - protein, 9 aa, Artificial Sequence
  Description of Artificial Sequence: Synthetic peptide
  Seed: GACDELFSY (PRAME_HUMAN)
GRCDELFSY

SEQ ID NO: 158875 - protein, 10 aa, Artificial Sequence
  Description of Artificial Sequence: Synthetic peptide
  Seed: SPSVSQLSVL (PRAME_HUMAN)
SLSVSQLSVY

SEQ ID NO: 158876 - protein, 10 aa, Artificial Sequence
  Description of Artificial Sequence: Synthetic peptide
  Seed: RTFYDPEPIL (PRAME_HUMAN)
RIFYDPEPIW

SEQ ID NO: 158877 - protein, 11 aa, Artificial Sequence
  Description of Artificial Sequence: Synthetic peptide
  Seed: SQTLKAMVQAW (PRAME_HUMAN)
SKTLKAMVQAW

SEQ ID NO: 158878 - protein, 9 aa, Artificial Sequence
  Description of Artificial Sequence: Synthetic peptide
  Seed: SPSVSQLSV (PRAME_HUMAN)
SPSVSQLSA

SEQ ID NO: 158879 - protein, 9 aa, Artificial Sequence
  Description of Artificial Sequence: Synthetic peptide
  Seed: YIAQFTSQF (PRAME_HUMAN)
YLAQFTSQF

SEQ ID NO: 158880 - protein, 10 aa, Artificial Sequence
  Description of Artificial Sequence: Synthetic peptide
  Seed: LKAMVQAWPF (PRAME_HUMAN)
LGAMVQAWPW

SEQ ID NO: 158881 - protein, 10 aa, Artificial Sequence
  Description of Artificial Sequence: Synthetic peptide
  Seed: DRTFYDPEPI (PRAME_HUMAN)
DYTFYDPEPV

SEQ ID NO: 158882 - protein, 9 aa, Artificial Sequence
  Description of Artificial Sequence: Synthetic peptide
  Seed: LLALLPSLS (PRAME_HUMAN)
LMALLPSLA

SEQ ID NO: 158883 - protein, 9 aa, Artificial Sequence
  Description of Artificial Sequence: Synthetic peptide
  Seed: YLHARLREL (PRAME_HUMAN)
YVHARLREL

SEQ ID NO: 158884 - protein, 10 aa, Artificial Sequence
  Description of Artificial Sequence: Synthetic peptide
  Seed: IGLSNLTHVL (PRAME_HUMAN)
ILLSNLTHVI

SEQ ID NO: 158885 - protein, 9 aa, Artificial Sequence
  Description of Artificial Sequence: Synthetic peptide
  Seed: LSLQCLQAL (PRAME_HUMAN)
LRLQCLQAF

SEQ ID NO: 158886 - protein, 9 aa, Artificial Sequence
  Description of Artificial Sequence: Synthetic peptide
  Seed: SIQSRYISM (PRAME_HUMAN)
SLQSRYISV

SEQ ID NO: 158887 - protein, 11 aa, Artificial Sequence
  Description of Artificial Sequence: Synthetic peptide
  Seed: YISMSVWTSPR (PRAME_HUMAN)
YWSMSVWTSPR

SEQ ID NO: 158888 - protein, 10 aa, Artificial Sequence
  Description of Artificial Sequence: Synthetic peptide
  Seed: KKLKIFAMPM (PRAME_HUMAN)
KRLKIFAMPV

SEQ ID NO: 158889 - protein, 9 aa, Artificial Sequence
  Description of Artificial Sequence: Synthetic peptide
  Seed: RLSEGDVMH (PRAME_HUMAN)
RQSEGDVMY

SEQ ID NO: 158890 - protein, 11 aa, Artificial Sequence
  Description of Artificial Sequence: Synthetic peptide
  Seed: MLTDVSPEPLQ (PRAME_HUMAN)
MLTDVSPEPLV

SEQ ID NO: 158891 - protein, 9 aa, Artificial Sequence
  Description of Artificial Sequence: Synthetic peptide
  Seed: SHIHASSYI (PRAME_HUMAN)
SVIHASSYF

SEQ ID NO: 158892 - protein, 9 aa, Artificial Sequence
  Description of Artificial Sequence: Synthetic peptide
  Seed: LLRHVMNPL (PRAME_HUMAN)
LERHVMNPF

SEQ ID NO: 158893 - protein, 9 aa, Artificial Sequence
  Description of Artificial Sequence: Synthetic peptide
  Seed: SMSVWTSPR (PRAME_HUMAN)
SISVWTSPK

SEQ ID NO: 158894 - protein, 9 aa, Artificial Sequence
  Description of Artificial Sequence: Synthetic peptide
  Seed: VSPEPLQAL (PRAME_HUMAN)
VVPEPLQAI

SEQ ID NO: 158895 - protein, 10 aa, Artificial Sequence
  Description of Artificial Sequence: Synthetic peptide
  Seed: KDEALAIAAL (PRAME_HUMAN)
KIEALAIAAA

SEQ ID NO: 158896 - protein, 9 aa, Artificial Sequence
  Description of Artificial Sequence: Synthetic peptide
  Seed: GQMINLRRL (PRAME_HUMAN)
GLMINLRRV

SEQ ID NO: 158897 - protein, 9 aa, Artificial Sequence
  Description of Artificial Sequence: Synthetic peptide
  Seed: IFAMPMQDI (PRAME_HUMAN)
IYAMPMQDW

SEQ ID NO: 158898 - protein, 10 aa, Artificial Sequence
  Description of Artificial Sequence: Synthetic peptide
  Seed: CSQLTTLSFY (PRAME_HUMAN)
CTQLTTLSFY

SEQ ID NO: 158899 - protein, 10 aa, Artificial Sequence
  Description of Artificial Sequence: Synthetic peptide
  Seed: ALYVDSLFFL (PRAME_HUMAN)
ALYVDSLFFV

SEQ ID NO: 158900 - protein, 8 aa, Artificial Sequence
  Description of Artificial Sequence: Synthetic peptide
  Seed: YEDIHGTL (PRAME_HUMAN)
YMDIHGTF

SEQ ID NO: 158901 - protein, 10 aa, Artificial Sequence
  Description of Artificial Sequence: Synthetic peptide
  Seed: LSHCSQLTTL (PRAME_HUMAN)
LAHCSQLTTW

SEQ ID NO: 158902 - protein, 9 aa, Artificial Sequence
  Description of Artificial Sequence: Synthetic peptide
  Seed: LAIAALELL (PRAME_HUMAN)
LVIAALELA

SEQ ID NO: 158903 - protein, 8 aa, Artificial Sequence
  Description of Artificial Sequence: Synthetic peptide
  Seed: MINLRRLL (PRAME_HUMAN)
MMNLRRLF

SEQ ID NO: 158904 - protein, 9 aa, Artificial Sequence
  Description of Artificial Sequence: Synthetic peptide
  Seed: TLKAMVQAW (PRAME_HUMAN)
TMKAMVQAF

SEQ ID NO: 158905 - protein, 10 aa, Artificial Sequence
  Description of Artificial Sequence: Synthetic peptide
  Seed: ALELLPRELF (PRAME_HUMAN)
AGELLPRELW

SEQ ID NO: 158906 - protein, 9 aa, Artificial Sequence
  Description of Artificial Sequence: Synthetic peptide
  Seed: YLIEKVKRK (PRAME_HUMAN)
YMIEKVKRI

SEQ ID NO: 158907 - protein, 11 aa, Artificial Sequence
  Description of Artificial Sequence: Synthetic peptide
  Seed: LPTLAKFSPYL (PRAME_HUMAN)
LRTLAKFSPYL

SEQ ID NO: 158908 - protein, 10 aa, Artificial Sequence
  Description of Artificial Sequence: Synthetic peptide
  Seed: MLTDVSPEPL (PRAME_HUMAN)
MTTDVSPEPV

SEQ ID NO: 158909 - protein, 9 aa, Artificial Sequence
  Description of Artificial Sequence: Synthetic peptide
  Seed: YLHARLREL (PRAME_HUMAN)
YIHARLREL

SEQ ID NO: 158910 - protein, 9 aa, Artificial Sequence
  Description of Artificial Sequence: Synthetic peptide
  Seed: IGLSNLTHV (PRAME_HUMAN)
IALSNLTHY

SEQ ID NO: 158911 - protein, 9 aa, Artificial Sequence
  Description of Artificial Sequence: Synthetic peptide
  Seed: VSQLSVLSL (PRAME_HUMAN)
VQQLSVLSM

SEQ ID NO: 158912 - protein, 10 aa, Artificial Sequence
  Description of Artificial Sequence: Synthetic peptide
  Seed: ISMSVWTSPR (PRAME_HUMAN)
IWMSVWTSPK

SEQ ID NO: 158913 - protein, 9 aa, Artificial Sequence
  Description of Artificial Sequence: Synthetic peptide
  Seed: SEGDVMHLS (PRAME_HUMAN)
SEGDVMHLI

SEQ ID NO: 158914 - protein, 9 aa, Artificial Sequence
  Description of Artificial Sequence: Synthetic peptide
  Seed: MVQAWPFTC (PRAME_HUMAN)
MLQAWPFTV

SEQ ID NO: 158915 - protein, 9 aa, Artificial Sequence
  Description of Artificial Sequence: Synthetic peptide
  Seed: VQAWPFTCL (PRAME_HUMAN)
VLAWPFTCI

SEQ ID NO: 158916 - protein, 10 aa, Artificial Sequence
  Description of Artificial Sequence: Synthetic peptide
  Seed: LSFYGNSISI (PRAME_HUMAN)
LTFYGNSISF

SEQ ID NO: 158917 - protein, 9 aa, Artificial Sequence
  Description of Artificial Sequence: Synthetic peptide
  Seed: FYDPEPILC (PRAME_HUMAN)
FYDPEPILY

SEQ ID NO: 158918 - protein, 10 aa, Artificial Sequence
  Description of Artificial Sequence: Synthetic peptide
  Seed: ISMSVWTSPR (PRAME_HUMAN)
IQMSVWTSPK

SEQ ID NO: 158919 - protein, 11 aa, Artificial Sequence
  Description of Artificial Sequence: Synthetic peptide
  Seed: AAFDGRHSQTL (PRAME_HUMAN)
AYFDGRHSQTF

SEQ ID NO: 158920 - protein, 9 aa, Artificial Sequence
  Description of Artificial Sequence: Synthetic peptide
  Seed: TCLPLGVLM (PRAME_HUMAN)
TVLPLGVLW

SEQ ID NO: 158921 - protein, 8 aa, Artificial Sequence
  Description of Artificial Sequence: Synthetic peptide
  Seed: YVDSLFFL (PRAME_HUMAN)
YMDSLFFM

SEQ ID NO: 158922 - protein, 9 aa, Artificial Sequence
  Description of Artificial Sequence: Synthetic peptide
  Seed: MINLRRLLL (PRAME_HUMAN)
MLNLRRLLF

SEQ ID NO: 158923 - protein, 9 aa, Artificial Sequence
  Description of Artificial Sequence: Synthetic peptide
  Seed: SIQSRYISM (PRAME_HUMAN)
SFQSRYISF

SEQ ID NO: 158924 - protein, 9 aa, Artificial Sequence
  Description of Artificial Sequence: Synthetic peptide
  Seed: ISISALQSL (PRAME_HUMAN)
IKISALQSF

SEQ ID NO: 158925 - protein, 9 aa, Artificial Sequence
  Description of Artificial Sequence: Synthetic peptide
  Seed: LQDLVFDEC (PRAME_HUMAN)
LSDLVFDEI

SEQ ID NO: 158926 - protein, 9 aa, Artificial Sequence
  Description of Artificial Sequence: Synthetic peptide
  Seed: KDEALAIAA (PRAME_HUMAN)
KEEALAIAT

SEQ ID NO: 158927 - protein, 9 aa, Artificial Sequence
  Description of Artificial Sequence: Synthetic peptide
  Seed: ELFPPLFMA (PRAME_HUMAN)
EIFPPLFMI

SEQ ID NO: 158928 - protein, 9 aa, Artificial Sequence
  Description of Artificial Sequence: Synthetic peptide
  Seed: SHCSQLTTL (PRAME_HUMAN)
SLCSQLTTW

SEQ ID NO: 158929 - protein, 10 aa, Artificial Sequence
  Description of Artificial Sequence: Synthetic peptide
  Seed: LPTLAKFSPY (PRAME_HUMAN)
LGTLAKFSPY

SEQ ID NO: 158930 - protein, 9 aa, Artificial Sequence
  Description of Artificial Sequence: Synthetic peptide
  Seed: ACDELFSYL (PRAME_HUMAN)
ANDELFSYL

SEQ ID NO: 158931 - protein, 9 aa, Artificial Sequence
  Description of Artificial Sequence: Synthetic peptide
  Seed: MINLRRLLL (PRAME_HUMAN)
MVNLRRLLL

SEQ ID NO: 158932 - protein, 9 aa, Artificial Sequence
  Description of Artificial Sequence: Synthetic peptide
  Seed: ELFPPLFMA (PRAME_HUMAN)
EQFPPLFMV

SEQ ID NO: 158933 - protein, 10 aa, Artificial Sequence
  Description of Artificial Sequence: Synthetic peptide
  Seed: QLLALLPSLS (PRAME_HUMAN)
QYLALLPSLV

SEQ ID NO: 158934 - protein, 9 aa, Artificial Sequence
  Description of Artificial Sequence: Synthetic peptide
  Seed: ELAGQSLLK (PRAME_HUMAN)
EAAGQSLLR

SEQ ID NO: 158935 - protein, 10 aa, Artificial Sequence
  Description of Artificial Sequence: Synthetic peptide
  Seed: RELFPPLFMA (PRAME_HUMAN)
RLLFPPLFMA

SEQ ID NO: 158936 - protein, 9 aa, Artificial Sequence
  Description of Artificial Sequence: Synthetic peptide
  Seed: YLHARLREL (PRAME_HUMAN)
YWHARLREM

SEQ ID NO: 158937 - protein, 9 aa, Artificial Sequence
  Description of Artificial Sequence: Synthetic peptide
  Seed: LSTEAEQPF (PRAME_HUMAN)
LITEAEQPY

SEQ ID NO: 158938 - protein, 9 aa, Artificial Sequence
  Description of Artificial Sequence: Synthetic peptide
  Seed: ITDDQLLAL (PRAME_HUMAN)
IGDDQLLAL

SEQ ID NO: 158939 - protein, 9 aa, Artificial Sequence
  Description of Artificial Sequence: Synthetic peptide
  Seed: TDDQLLALL (PRAME_HUMAN)
TTDQLLALV

SEQ ID NO: 158940 - protein, 11 aa, Artificial Sequence
  Description of Artificial Sequence: Synthetic peptide
  Seed: GTLHLERLAYL (PRAME_HUMAN)
GYLHLERLAYL

SEQ ID NO: 158941 - protein, 9 aa, Artificial Sequence
  Description of Artificial Sequence: Synthetic peptide
  Seed: RHSQTLKAM (PRAME_HUMAN)
RWSQTLKAM

SEQ ID NO: 158942 - protein, 10 aa, Artificial Sequence
  Description of Artificial Sequence: Synthetic peptide
  Seed: LKAMVQAWPF (PRAME_HUMAN)
LTAMVQAWPW

SEQ ID NO: 158943 - protein, 11 aa, Artificial Sequence
  Description of Artificial Sequence: Synthetic peptide
  Seed: RTFYDPEPILC (PRAME_HUMAN)
RTFYDPEPILM

SEQ ID NO: 158944 - protein, 10 aa, Artificial Sequence
  Description of Artificial Sequence: Synthetic peptide
  Seed: HASSYISPEK (PRAME_HUMAN)
HGSSYISPER

SEQ ID NO: 158945 - protein, 10 aa, Artificial Sequence
  Description of Artificial Sequence: Synthetic peptide
  Seed: VLYPVPLESY (PRAME_HUMAN)
VLYPVPLESK

SEQ ID NO: 158946 - protein, 8 aa, Artificial Sequence
  Description of Artificial Sequence: Synthetic peptide
  Seed: VLDGLDVL (PRAME_HUMAN)
VSDGLDVL

SEQ ID NO: 158947 - protein, 10 aa, Artificial Sequence
  Description of Artificial Sequence: Synthetic peptide
  Seed: SPSVSQLSVL (PRAME_HUMAN)
SGSVSQLSVW

SEQ ID NO: 158948 - protein, 10 aa, Artificial Sequence
  Description of Artificial Sequence: Synthetic peptide
  Seed: SPYLGQMINL (PRAME_HUMAN)
SWYLGQMINW

SEQ ID NO: 158949 - protein, 9 aa, Artificial Sequence
  Description of Artificial Sequence: Synthetic peptide
  Seed: GQHLHLETF (PRAME_HUMAN)
GWHLHLETF

SEQ ID NO: 158950 - protein, 9 aa, Artificial Sequence
  Description of Artificial Sequence: Synthetic peptide
  Seed: VSQLSVLSL (PRAME_HUMAN)
VSQLSVLSY

SEQ ID NO: 158951 - protein, 11 aa, Artificial Sequence
  Description of Artificial Sequence: Synthetic peptide
  Seed: NLTHVLYPVPL (PRAME_HUMAN)
NMTHVLYPVPV

SEQ ID NO: 158952 - protein, 9 aa, Artificial Sequence
  Description of Artificial Sequence: Synthetic peptide
  Seed: RLRELLCEL (PRAME_HUMAN)
RARELLCEL

SEQ ID NO: 158953 - protein, 9 aa, Artificial Sequence
  Description of Artificial Sequence: Synthetic peptide
  Seed: HARLRELLC (PRAME_HUMAN)
HMRLRELLV

SEQ ID NO: 158954 - protein, 9 aa, Artificial Sequence
  Description of Artificial Sequence: Synthetic peptide
  Seed: GACDELFSY (PRAME_HUMAN)
GVCDELFSY

SEQ ID NO: 158955 - protein, 9 aa, Artificial Sequence
  Description of Artificial Sequence: Synthetic peptide
  Seed: LQDLVFDEC (PRAME_HUMAN)
LLDLVFDEF

SEQ ID NO: 158956 - protein, 10 aa, Artificial Sequence
  Description of Artificial Sequence: Synthetic peptide
  Seed: RGRLDQLLRH (PRAME_HUMAN)
RHRLDQLLRF

SEQ ID NO: 158957 - protein, 9 aa, Artificial Sequence
  Description of Artificial Sequence: Synthetic peptide
  Seed: EAAQPMTKK (PRAME_HUMAN)
EAAQPMTKM

SEQ ID NO: 158958 - protein, 9 aa, Artificial Sequence
  Description of Artificial Sequence: Synthetic peptide
  Seed: RLWGSIQSR (PRAME_HUMAN)
RRWGSIQSF

SEQ ID NO: 158959 - protein, 9 aa, Artificial Sequence
  Description of Artificial Sequence: Synthetic peptide
  Seed: TFYDPEPIL (PRAME_HUMAN)
TTYDPEPIM

SEQ ID NO: 158960 - protein, 9 aa, Artificial Sequence
  Description of Artificial Sequence: Synthetic peptide
  Seed: TDDQLLALL (PRAME_HUMAN)
TWDQLLALF

SEQ ID NO: 158961 - protein, 10 aa, Artificial Sequence
  Description of Artificial Sequence: Synthetic peptide
  Seed: AKFSPYLGQM (PRAME_HUMAN)
AQFSPYLGQY

SEQ ID NO: 158962 - protein, 10 aa, Artificial Sequence
  Description of Artificial Sequence: Synthetic peptide
  Seed: ELFPPLFMAA (PRAME_HUMAN)
EIFPPLFMAI

SEQ ID NO: 158963 - protein, 8 aa, Artificial Sequence
  Description of Artificial Sequence: Synthetic peptide
  Seed: VMNPLETL (PRAME_HUMAN)
VANPLETY

SEQ ID NO: 158964 - protein, 9 aa, Artificial Sequence
  Description of Artificial Sequence: Synthetic peptide
  Seed: ITDDQLLAL (PRAME_HUMAN)
INDDQLLAM

SEQ ID NO: 158965 - protein, 10 aa, Artificial Sequence
  Description of Artificial Sequence: Synthetic peptide
  Seed: NLTHVLYPVP (PRAME_HUMAN)
NLTHVLYPVV

SEQ ID NO: 158966 - protein, 9 aa, Artificial Sequence
  Description of Artificial Sequence: Synthetic peptide
  Seed: YIAQFTSQF (PRAME_HUMAN)
YHAQFTSQL

SEQ ID NO: 158967 - protein, 10 aa, Artificial Sequence
  Description of Artificial Sequence: Synthetic peptide
  Seed: ISMSVWTSPR (PRAME_HUMAN)
IKMSVWTSPR

SEQ ID NO: 158968 - protein, 11 aa, Artificial Sequence
  Description of Artificial Sequence: Synthetic peptide
  Seed: MKGQHLHLETF (PRAME_HUMAN)
MQGQHLHLETY

SEQ ID NO: 158969 - protein, 9 aa, Artificial Sequence
  Description of Artificial Sequence: Synthetic peptide
  Seed: SISALQSLL (PRAME_HUMAN)
SVSALQSLV

SEQ ID NO: 158970 - protein, 9 aa, Artificial Sequence
  Description of Artificial Sequence: Synthetic peptide
  Seed: KMILKMVQL (PRAME_HUMAN)
KSILKMVQK

SEQ ID NO: 158971 - protein, 9 aa, Artificial Sequence
  Description of Artificial Sequence: Synthetic peptide
  Seed: LYVDSLFFL (PRAME_HUMAN)
LTVDSLFFA

SEQ ID NO: 158972 - protein, 10 aa, Artificial Sequence
  Description of Artificial Sequence: Synthetic peptide
  Seed: VLYPVPLESY (PRAME_HUMAN)
VSYPVPLESK

SEQ ID NO: 158973 - protein, 10 aa, Artificial Sequence
  Description of Artificial Sequence: Synthetic peptide
  Seed: SVSQLSVLSL (PRAME_HUMAN)
SSSQLSVLSY

SEQ ID NO: 158974 - protein, 9 aa, Artificial Sequence
  Description of Artificial Sequence: Synthetic peptide
  Seed: SHQDFWTVW (PRAME_HUMAN)
SHQDFWTVY

SEQ ID NO: 158975 - protein, 9 aa, Artificial Sequence
  Description of Artificial Sequence: Synthetic peptide
  Seed: YISMSVWTS (PRAME_HUMAN)
YVSMSVWTL

SEQ ID NO: 158976 - protein, 10 aa, Artificial Sequence
  Description of Artificial Sequence: Synthetic peptide
  Seed: MVQAWPFTCL (PRAME_HUMAN)
MAQAWPFTCM

SEQ ID NO: 158977 - protein, 10 aa, Artificial Sequence
  Description of Artificial Sequence: Synthetic peptide
  Seed: KKLKIFAMPM (PRAME_HUMAN)
KPLKIFAMPK

SEQ ID NO: 158978 - protein, 10 aa, Artificial Sequence
  Description of Artificial Sequence: Synthetic peptide
  Seed: LSFYGNSISI (PRAME_HUMAN)
LGFYGNSISL

SEQ ID NO: 158979 - protein, 9 aa, Artificial Sequence
  Description of Artificial Sequence: Synthetic peptide
  Seed: LPRELFPPL (PRAME_HUMAN)
LPRELFPPP

SEQ ID NO: 158980 - protein, 9 aa, Artificial Sequence
  Description of Artificial Sequence: Synthetic peptide
  Seed: YIAQFTSQF (PRAME_HUMAN)
YPAQFTSQW

SEQ ID NO: 158981 - protein, 9 aa, Artificial Sequence
  Description of Artificial Sequence: Synthetic peptide
  Seed: LPRELFPPL (PRAME_HUMAN)
LPRELFPPT

SEQ ID NO: 158982 - protein, 11 aa, Artificial Sequence
  Description of Artificial Sequence: Synthetic peptide
  Seed: AAFDGRHSQTL (PRAME_HUMAN)
AVFDGRHSQTY

SEQ ID NO: 158983 - protein, 11 aa, Artificial Sequence
  Description of Artificial Sequence: Synthetic peptide
  Seed: LLLSHIHASSY (PRAME_HUMAN)
LWLSHIHASSW

SEQ ID NO: 158984 - protein, 10 aa, Artificial Sequence
  Description of Artificial Sequence: Synthetic peptide
  Seed: LLLSHIHASS (PRAME_HUMAN)
LMLSHIHASL

SEQ ID NO: 158985 - protein, 10 aa, Artificial Sequence
  Description of Artificial Sequence: Synthetic peptide
  Seed: LLSHIHASSY (PRAME_HUMAN)
LQSHIHASSM

SEQ ID NO: 158986 - protein, 9 aa, Artificial Sequence
  Description of Artificial Sequence: Synthetic peptide
  Seed: LQHLIGLSN (PRAME_HUMAN)
LKHLIGLSM

SEQ ID NO: 158987 - protein, 10 aa, Artificial Sequence
  Description of Artificial Sequence: Synthetic peptide
  Seed: AALELLPREL (PRAME_HUMAN)
ALLELLPREA

SEQ ID NO: 158988 - protein, 10 aa, Artificial Sequence
  Description of Artificial Sequence: Synthetic peptide
  Seed: RLVELAGQSL (PRAME_HUMAN)
RQVELAGQSF

SEQ ID NO: 158989 - protein, 9 aa, Artificial Sequence
  Description of Artificial Sequence: Synthetic peptide
  Seed: SALQSLLQH (PRAME_HUMAN)
SMLQSLLQM

SEQ ID NO: 158990 - protein, 9 aa, Artificial Sequence
  Description of Artificial Sequence: Synthetic peptide
  Seed: LYVDSLFFL (PRAME_HUMAN)
LTVDSLFFI

SEQ ID NO: 158991 - protein, 9 aa, Artificial Sequence
  Description of Artificial Sequence: Synthetic peptide
  Seed: ITDDQLLAL (PRAME_HUMAN)
ISDDQLLAF

SEQ ID NO: 158992 - protein, 9 aa, Artificial Sequence
  Description of Artificial Sequence: Synthetic peptide
  Seed: WLSANPCPH (PRAME_HUMAN)
WVSANPCPF

SEQ ID NO: 158993 - protein, 9 aa, Artificial Sequence
  Description of Artificial Sequence: Synthetic peptide
  Seed: RLWGSIQSR (PRAME_HUMAN)
RIWGSIQSM

SEQ ID NO: 158994 - protein, 9 aa, Artificial Sequence
  Description of Artificial Sequence: Synthetic peptide
  Seed: TSPRRLVEL (PRAME_HUMAN)
TPPRRLVEL

SEQ ID NO: 158995 - protein, 10 aa, Artificial Sequence
  Description of Artificial Sequence: Synthetic peptide
  Seed: QSRYISMSVW (PRAME_HUMAN)
QSRYISMSVM

SEQ ID NO: 158996 - protein, 9 aa, Artificial Sequence
  Description of Artificial Sequence: Synthetic peptide
  Seed: YLHARLREL (PRAME_HUMAN)
YQHARLREI

SEQ ID NO: 158997 - protein, 10 aa, Artificial Sequence
  Description of Artificial Sequence: Synthetic peptide
  Seed: GRPSMVWLSA (PRAME_HUMAN)
GFPSMVWLSA

SEQ ID NO: 158998 - protein, 11 aa, Artificial Sequence
  Description of Artificial Sequence: Synthetic peptide
  Seed: RRRLWGSIQSR (PRAME_HUMAN)
RTRLWGSIQSR

SEQ ID NO: 158999 - protein, 9 aa, Artificial Sequence
  Description of Artificial Sequence: Synthetic peptide
  Seed: SQSPSVSQL (PRAME_HUMAN)
SISPSVSQF

SEQ ID NO: 159000 - protein, 9 aa, Artificial Sequence
  Description of Artificial Sequence: Synthetic peptide
  Seed: GRHSQTLKA (PRAME_HUMAN)
GRHSQTLKY

SEQ ID NO: 159001 - protein, 11 aa, Artificial Sequence
  Description of Artificial Sequence: Synthetic peptide
  Seed: SNLTHVLYPVP (PRAME_HUMAN)
SMLTHVLYPVT

SEQ ID NO: 159002 - protein, 9 aa, Artificial Sequence
  Description of Artificial Sequence: Synthetic peptide
  Seed: ACDELFSYL (PRAME_HUMAN)
ASDELFSYF

SEQ ID NO: 159003 - protein, 10 aa, Artificial Sequence
  Description of Artificial Sequence: Synthetic peptide
  Seed: RHVMNPLETL (PRAME_HUMAN)
RKVMNPLETF

SEQ ID NO: 159004 - protein, 10 aa, Artificial Sequence
  Description of Artificial Sequence: Synthetic peptide
  Seed: RLSEGDVMHL (PRAME_HUMAN)
RISEGDVMHR

SEQ ID NO: 159005 - protein, 10 aa, Artificial Sequence
  Description of Artificial Sequence: Synthetic peptide
  Seed: TSQFLSLQCL (PRAME_HUMAN)
TSQFLSLQCY

SEQ ID NO: 159006 - protein, 10 aa, Artificial Sequence
  Description of Artificial Sequence: Synthetic peptide
  Seed: RASATLQDLV (PRAME_HUMAN)
RASATLQDLW

SEQ ID NO: 159007 - protein, 9 aa, Artificial Sequence
  Description of Artificial Sequence: Synthetic peptide
  Seed: ALAIAALEL (PRAME_HUMAN)
AIAIAALEV

SEQ ID NO: 159008 - protein, 9 aa, Artificial Sequence
  Description of Artificial Sequence: Synthetic peptide
  Seed: IAALELLPR (PRAME_HUMAN)
ILALELLPR

SEQ ID NO: 159009 - protein, 10 aa, Artificial Sequence
  Description of Artificial Sequence: Synthetic peptide
  Seed: TTLSFYGNSI (PRAME_HUMAN)
TVLSFYGNSV

SEQ ID NO: 159010 - protein, 11 aa, Artificial Sequence
  Description of Artificial Sequence: Synthetic peptide
  Seed: RRWKLQVLDLR (PRAME_HUMAN)
RRWKLQVLDLI

SEQ ID NO: 159011 - protein, 9 aa, Artificial Sequence
  Description of Artificial Sequence: Synthetic peptide
  Seed: VFDECGITD (PRAME_HUMAN)
VFDECGITL

SEQ ID NO: 159012 - protein, 9 aa, Artificial Sequence
  Description of Artificial Sequence: Synthetic peptide
  Seed: FLRGRLDQL (PRAME_HUMAN)
FPRGRLDQV

SEQ ID NO: 159013 - protein, 10 aa, Artificial Sequence
  Description of Artificial Sequence: Synthetic peptide
  Seed: RGRLDQLLRH (PRAME_HUMAN)
RRRLDQLLRI

SEQ ID NO: 159014 - protein, 10 aa, Artificial Sequence
  Description of Artificial Sequence: Synthetic peptide
  Seed: MVQAWPFTCL (PRAME_HUMAN)
MLQAWPFTCV

SEQ ID NO: 159015 - protein, 10 aa, Artificial Sequence
  Description of Artificial Sequence: Synthetic peptide
  Seed: LLLSHIHASS (PRAME_HUMAN)
LELSHIHASL

SEQ ID NO: 159016 - protein, 10 aa, Artificial Sequence
  Description of Artificial Sequence: Synthetic peptide
  Seed: SNLTHVLYPV (PRAME_HUMAN)
SALTHVLYPV

SEQ ID NO: 159017 - protein, 9 aa, Artificial Sequence
  Description of Artificial Sequence: Synthetic peptide
  Seed: LVELAGQSL (PRAME_HUMAN)
LFELAGQSF

SEQ ID NO: 159018 - protein, 10 aa, Artificial Sequence
  Description of Artificial Sequence: Synthetic peptide
  Seed: CTWKLPTLAK (PRAME_HUMAN)
CTWKLPTLAR

SEQ ID NO: 159019 - protein, 10 aa, Artificial Sequence
  Description of Artificial Sequence: Synthetic peptide
  Seed: RGRLDQLLRH (PRAME_HUMAN)
RHRLDQLLRR

SEQ ID NO: 159020 - protein, 10 aa, Artificial Sequence
  Description of Artificial Sequence: Synthetic peptide
  Seed: LSQSPSVSQL (PRAME_HUMAN)
LIQSPSVSQF

SEQ ID NO: 159021 - protein, 9 aa, Artificial Sequence
  Description of Artificial Sequence: Synthetic peptide
  Seed: RLRELLCEL (PRAME_HUMAN)
RSRELLCEV

SEQ ID NO: 159022 - protein, 9 aa, Artificial Sequence
  Description of Artificial Sequence: Synthetic peptide
  Seed: YIAQFTSQF (PRAME_HUMAN)
YGAQFTSQW

SEQ ID NO: 159023 - protein, 10 aa, Artificial Sequence
  Description of Artificial Sequence: Synthetic peptide
  Seed: RLWGSIQSRY (PRAME_HUMAN)
RSWGSIQSRI

SEQ ID NO: 159024 - protein, 9 aa, Artificial Sequence
  Description of Artificial Sequence: Synthetic peptide
  Seed: LKMVQLDSI (PRAME_HUMAN)
LKMVQLDSY

SEQ ID NO: 159025 - protein, 9 aa, Artificial Sequence
  Description of Artificial Sequence: Synthetic peptide
  Seed: AVLDGLDVL (PRAME_HUMAN)
AMLDGLDVT

SEQ ID NO: 159026 - protein, 9 aa, Artificial Sequence
  Description of Artificial Sequence: Synthetic peptide
  Seed: KLKIFAMPM (PRAME_HUMAN)
KQKIFAMPM

SEQ ID NO: 159027 - protein, 11 aa, Artificial Sequence
  Description of Artificial Sequence: Synthetic peptide
  Seed: ESYEDIHGTLH (PRAME_HUMAN)
EAYEDIHGTLK

SEQ ID NO: 159028 - protein, 10 aa, Artificial Sequence
  Description of Artificial Sequence: Synthetic peptide
  Seed: IKMILKMVQL (PRAME_HUMAN)
IMMILKMVQV

SEQ ID NO: 159029 - protein, 10 aa, Artificial Sequence
  Description of Artificial Sequence: Synthetic peptide
  Seed: YIAQFTSQFL (PRAME_HUMAN)
YCAQFTSQFY

SEQ ID NO: 159030 - protein, 8 aa, Artificial Sequence
  Description of Artificial Sequence: Synthetic peptide
  Seed: MSVWTSPR (PRAME_HUMAN)
MFVWTSPR

SEQ ID NO: 159031 - protein, 10 aa, Artificial Sequence
  Description of Artificial Sequence: Synthetic peptide
  Seed: YEDIHGTLHL (PRAME_HUMAN)
YLDIHGTLHL

SEQ ID NO: 159032 - protein, 10 aa, Artificial Sequence
  Description of Artificial Sequence: Synthetic peptide
  Seed: ETLSITNCRL (PRAME_HUMAN)
EILSITNCRR

SEQ ID NO: 159033 - protein, 9 aa, Artificial Sequence
  Description of Artificial Sequence: Synthetic peptide
  Seed: WKLPTLAKF (PRAME_HUMAN)
WALPTLAKF

SEQ ID NO: 159034 - protein, 10 aa, Artificial Sequence
  Description of Artificial Sequence: Synthetic peptide
  Seed: RLAYLHARLR (PRAME_HUMAN)
RMAYLHARLI

SEQ ID NO: 159035 - protein, 9 aa, Artificial Sequence
  Description of Artificial Sequence: Synthetic peptide
  Seed: YGNSISISA (PRAME_HUMAN)
YQNSISISY

SEQ ID NO: 159036 - protein, 10 aa, Artificial Sequence
  Description of Artificial Sequence: Synthetic peptide
  Seed: HLIGLSNLTH (PRAME_HUMAN)
HAIGLSNLTF

SEQ ID NO: 159037 - protein, 11 aa, Artificial Sequence
  Description of Artificial Sequence: Synthetic peptide
  Seed: CRLSEGDVMHL (PRAME_HUMAN)
CFLSEGDVMHI

SEQ ID NO: 159038 - protein, 9 aa, Artificial Sequence
  Description of Artificial Sequence: Synthetic peptide
  Seed: SHQDFWTVW (PRAME_HUMAN)
SYQDFWTVM

SEQ ID NO: 159039 - protein, 9 aa, Artificial Sequence
  Description of Artificial Sequence: Synthetic peptide
  Seed: AMVQAWPFT (PRAME_HUMAN)
AMVQAWPFV

SEQ ID NO: 159040 - protein, 10 aa, Artificial Sequence
  Description of Artificial Sequence: Synthetic peptide
  Seed: LLSHIHASSY (PRAME_HUMAN)
LTSHIHASSW

SEQ ID NO: 159041 - protein, 9 aa, Artificial Sequence
  Description of Artificial Sequence: Synthetic peptide
  Seed: VLYPVPLES (PRAME_HUMAN)
VAYPVPLEV

SEQ ID NO: 159042 - protein, 9 aa, Artificial Sequence
  Description of Artificial Sequence: Synthetic peptide
  Seed: NSISISALQ (PRAME_HUMAN)
NCISISALR

SEQ ID NO: 159043 - protein, 10 aa, Artificial Sequence
  Description of Artificial Sequence: Synthetic peptide
  Seed: FIPVEVLVDL (PRAME_HUMAN)
FQPVEVLVDF

SEQ ID NO: 159044 - protein, 9 aa, Artificial Sequence
  Description of Artificial Sequence: Synthetic peptide
  Seed: NLTHVLYPV (PRAME_HUMAN)
NMTHVLYPT

SEQ ID NO: 159045 - protein, 9 aa, Artificial Sequence
  Description of Artificial Sequence: Synthetic peptide
  Seed: LAIAALELL (PRAME_HUMAN)
LAIAALELV

SEQ ID NO: 159046 - protein, 9 aa, Artificial Sequence
  Description of Artificial Sequence: Synthetic peptide
  Seed: ELAGQSLLK (PRAME_HUMAN)
EVAGQSLLY

SEQ ID NO: 159047 - protein, 9 aa, Artificial Sequence
  Description of Artificial Sequence: Synthetic peptide
  Seed: YLHARLREL (PRAME_HUMAN)
YYHARLREF

SEQ ID NO: 159048 - protein, 9 aa, Artificial Sequence
  Description of Artificial Sequence: Synthetic peptide
  Seed: HVMNPLETL (PRAME_HUMAN)
HVMNPLETR

SEQ ID NO: 159049 - protein, 9 aa, Artificial Sequence
  Description of Artificial Sequence: Synthetic peptide
  Seed: YSFPEPEAA (PRAME_HUMAN)
YKFPEPEAY

SEQ ID NO: 159050 - protein, 10 aa, Artificial Sequence
  Description of Artificial Sequence: Synthetic peptide
  Seed: RTFYDPEPIL (PRAME_HUMAN)
RSFYDPEPIL

SEQ ID NO: 159051 - protein, 8 aa, Artificial Sequence
  Description of Artificial Sequence: Synthetic peptide
  Seed: FYDPEPIL (PRAME_HUMAN)
FIDPEPII

SEQ ID NO: 159052 - protein, 9 aa, Artificial Sequence
  Description of Artificial Sequence: Synthetic peptide
  Seed: LLRHVMNPL (PRAME_HUMAN)
LIRHVMNPL

SEQ ID NO: 159053 - protein, 9 aa, Artificial Sequence
  Description of Artificial Sequence: Synthetic peptide
  Seed: SISALQSLL (PRAME_HUMAN)
SSSALQSLL

SEQ ID NO: 159054 - protein, 9 aa, Artificial Sequence
  Description of Artificial Sequence: Synthetic peptide
  Seed: SRYISMSVW (PRAME_HUMAN)
SEYISMSVL

SEQ ID NO: 159055 - protein, 9 aa, Artificial Sequence
  Description of Artificial Sequence: Synthetic peptide
  Seed: YSFPEPEAA (PRAME_HUMAN)
YGFPEPEAM

SEQ ID NO: 159056 - protein, 9 aa, Artificial Sequence
  Description of Artificial Sequence: Synthetic peptide
  Seed: YSFPEPEAA (PRAME_HUMAN)
YKFPEPEAF

SEQ ID NO: 159057 - protein, 9 aa, Artificial Sequence
  Description of Artificial Sequence: Synthetic peptide
  Seed: FLRGRLDQL (PRAME_HUMAN)
FVRGRLDQV

SEQ ID NO: 159058 - protein, 9 aa, Artificial Sequence
  Description of Artificial Sequence: Synthetic peptide
  Seed: VSPEPLQAL (PRAME_HUMAN)
VQPEPLQAV

SEQ ID NO: 159059 - protein, 10 aa, Artificial Sequence
  Description of Artificial Sequence: Synthetic peptide
  Seed: LSFYGNSISI (PRAME_HUMAN)
LRFYGNSISL

SEQ ID NO: 159060 - protein, 9 aa, Artificial Sequence
  Description of Artificial Sequence: Synthetic peptide
  Seed: LYPVPLESY (PRAME_HUMAN)
LRPVPLESF

SEQ ID NO: 159061 - protein, 9 aa, Artificial Sequence
  Description of Artificial Sequence: Synthetic peptide
  Seed: MQDIKMILK (PRAME_HUMAN)
MADIKMILY

SEQ ID NO: 159062 - protein, 9 aa, Artificial Sequence
  Description of Artificial Sequence: Synthetic peptide
  Seed: KMILKMVQL (PRAME_HUMAN)
KQILKMVQV

SEQ ID NO: 159063 - protein, 10 aa, Artificial Sequence
  Description of Artificial Sequence: Synthetic peptide
  Seed: LLPRELFPPL (PRAME_HUMAN)
LYPRELFPPI

SEQ ID NO: 159064 - protein, 9 aa, Artificial Sequence
  Description of Artificial Sequence: Synthetic peptide
  Seed: EAAQPMTKK (PRAME_HUMAN)
EVAQPMTKM

SEQ ID NO: 159065 - protein, 8 aa, Artificial Sequence
  Description of Artificial Sequence: Synthetic peptide
  Seed: ITDDQLLA (PRAME_HUMAN)
IMDDQLLL

SEQ ID NO: 159066 - protein, 10 aa, Artificial Sequence
  Description of Artificial Sequence: Synthetic peptide
  Seed: LLPRELFPPL (PRAME_HUMAN)
LCPRELFPPF

SEQ ID NO: 159067 - protein, 9 aa, Artificial Sequence
  Description of Artificial Sequence: Synthetic peptide
  Seed: YISMSVWTS (PRAME_HUMAN)
YLSMSVWTA

SEQ ID NO: 159068 - protein, 9 aa, Artificial Sequence
  Description of Artificial Sequence: Synthetic peptide
  Seed: RLWGSIQSR (PRAME_HUMAN)
RYWGSIQSR

SEQ ID NO: 159069 - protein, 9 aa, Artificial Sequence
  Description of Artificial Sequence: Synthetic peptide
  Seed: LSNLTHVLY (PRAME_HUMAN)
LWNLTHVLY

SEQ ID NO: 159070 - protein, 9 aa, Artificial Sequence
  Description of Artificial Sequence: Synthetic peptide
  Seed: ASSYISPEK (PRAME_HUMAN)
AVSYISPER

SEQ ID NO: 159071 - protein, 9 aa, Artificial Sequence
  Description of Artificial Sequence: Synthetic peptide
  Seed: HLIGLSNLT (PRAME_HUMAN)
HLIGLSNLV

SEQ ID NO: 159072 - protein, 9 aa, Artificial Sequence
  Description of Artificial Sequence: Synthetic peptide
  Seed: RLRELLCEL (PRAME_HUMAN)
RTRELLCES

SEQ ID NO: 159073 - protein, 11 aa, Artificial Sequence
  Description of Artificial Sequence: Synthetic peptide
  Seed: SNLTHVLYPVP (PRAME_HUMAN)
SYLTHVLYPVV

SEQ ID NO: 159074 - protein, 9 aa, Artificial Sequence
  Description of Artificial Sequence: Synthetic peptide
  Seed: ALYVDSLFF (PRAME_HUMAN)
AAYVDSLFL

SEQ ID NO: 159075 - protein, 9 aa, Artificial Sequence
  Description of Artificial Sequence: Synthetic peptide
  Seed: LSLQCLQAL (PRAME_HUMAN)
LVLQCLQAF

SEQ ID NO: 159076 - protein, 10 aa, Artificial Sequence
  Description of Artificial Sequence: Synthetic peptide
  Seed: RHVMNPLETL (PRAME_HUMAN)
RTVMNPLETM

SEQ ID NO: 159077 - protein, 9 aa, Artificial Sequence
  Description of Artificial Sequence: Synthetic peptide
  Seed: VSPEPLQAL (PRAME_HUMAN)
VMPEPLQAI

SEQ ID NO: 159078 - protein, 9 aa, Artificial Sequence
  Description of Artificial Sequence: Synthetic peptide
  Seed: ERLAYLHAR (PRAME_HUMAN)
EGLAYLHAR

SEQ ID NO: 159079 - protein, 10 aa, Artificial Sequence
  Description of Artificial Sequence: Synthetic peptide
  Seed: IQSRYISMSV (PRAME_HUMAN)
IKSRYISMSI

SEQ ID NO: 159080 - protein, 9 aa, Artificial Sequence
  Description of Artificial Sequence: Synthetic peptide
  Seed: ISISALQSL (PRAME_HUMAN)
ISISALQSV

SEQ ID NO: 159081 - protein, 9 aa, Artificial Sequence
  Description of Artificial Sequence: Synthetic peptide
  Seed: PFIPVEVLV (PRAME_HUMAN)
PYIPVEVLF

SEQ ID NO: 159082 - protein, 9 aa, Artificial Sequence
  Description of Artificial Sequence: Synthetic peptide
  Seed: LSHIHASSY (PRAME_HUMAN)
LHHIHASSM

SEQ ID NO: 159083 - protein, 11 aa, Artificial Sequence
  Description of Artificial Sequence: Synthetic peptide
  Seed: RLVELAGQSLL (PRAME_HUMAN)
REVELAGQSLL

SEQ ID NO: 159084 - protein, 10 aa, Artificial Sequence
  Description of Artificial Sequence: Synthetic peptide
  Seed: ISISALQSLL (PRAME_HUMAN)
IMISALQSLV

SEQ ID NO: 159085 - protein, 10 aa, Artificial Sequence
  Description of Artificial Sequence: Synthetic peptide
  Seed: IQSRYISMSV (PRAME_HUMAN)
ILSRYISMSV

SEQ ID NO: 159086 - protein, 10 aa, Artificial Sequence
  Description of Artificial Sequence: Synthetic peptide
  Seed: RLAYLHARLR (PRAME_HUMAN)
RAAYLHARLR

SEQ ID NO: 159087 - protein, 10 aa, Artificial Sequence
  Description of Artificial Sequence: Synthetic peptide
  Seed: SNLTHVLYPV (PRAME_HUMAN)
SMLTHVLYPL

SEQ ID NO: 159088 - protein, 9 aa, Artificial Sequence
  Description of Artificial Sequence: Synthetic peptide
  Seed: SQLTTLSFY (PRAME_HUMAN)
SVLTTLSFK

SEQ ID NO: 159089 - protein, 9 aa, Artificial Sequence
  Description of Artificial Sequence: Synthetic peptide
  Seed: LQDLVFDEC (PRAME_HUMAN)
LSDLVFDEL

SEQ ID NO: 159090 - protein, 9 aa, Artificial Sequence
  Description of Artificial Sequence: Synthetic peptide
  Seed: RLRELLCEL (PRAME_HUMAN)
RMRELLCER

SEQ ID NO: 159091 - protein, 10 aa, Artificial Sequence
  Description of Artificial Sequence: Synthetic peptide
  Seed: RELFPPLFMA (PRAME_HUMAN)
RVLFPPLFMI

SEQ ID NO: 159092 - protein, 9 aa, Artificial Sequence
  Description of Artificial Sequence: Synthetic peptide
  Seed: TWKLPTLAK (PRAME_HUMAN)
TSKLPTLAK

SEQ ID NO: 159093 - protein, 9 aa, Artificial Sequence
  Description of Artificial Sequence: Synthetic peptide
  Seed: KAMVQAWPF (PRAME_HUMAN)
KPMVQAWPW

SEQ ID NO: 159094 - protein, 9 aa, Artificial Sequence
  Description of Artificial Sequence: Synthetic peptide
  Seed: VQAWPFTCL (PRAME_HUMAN)
VSAWPFTCM

SEQ ID NO: 159095 - protein, 10 aa, Artificial Sequence
  Description of Artificial Sequence: Synthetic peptide
  Seed: ISISALQSLL (PRAME_HUMAN)
INISALQSLW

SEQ ID NO: 159096 - protein, 9 aa, Artificial Sequence
  Description of Artificial Sequence: Synthetic peptide
  Seed: NSISISALQ (PRAME_HUMAN)
NPISISALR

SEQ ID NO: 159097 - protein, 9 aa, Artificial Sequence
  Description of Artificial Sequence: Synthetic peptide
  Seed: MQDIKMILK (PRAME_HUMAN)
MADIKMILF

SEQ ID NO: 159098 - protein, 9 aa, Artificial Sequence
  Description of Artificial Sequence: Synthetic peptide
  Seed: MINLRRLLL (PRAME_HUMAN)
MPNLRRLLV

SEQ ID NO: 159099 - protein, 10 aa, Artificial Sequence
  Description of Artificial Sequence: Synthetic peptide
  Seed: FFLRGRLDQL (PRAME_HUMAN)
FFLRGRLDQI

SEQ ID NO: 159100 - protein, 8 aa, Artificial Sequence
  Description of Artificial Sequence: Synthetic peptide
  Seed: LKIFAMPM (PRAME_HUMAN)
LMIFAMPF

SEQ ID NO: 159101 - protein, 9 aa, Artificial Sequence
  Description of Artificial Sequence: Synthetic peptide
  Seed: RGRLDQLLR (PRAME_HUMAN)
RWRLDQLLK

SEQ ID NO: 159102 - protein, 10 aa, Artificial Sequence
  Description of Artificial Sequence: Synthetic peptide
  Seed: SPSVSQLSVL (PRAME_HUMAN)
SPSVSQLSVY

SEQ ID NO: 159103 - protein, 9 aa, Artificial Sequence
  Description of Artificial Sequence: Synthetic peptide
  Seed: ISISALQSL (PRAME_HUMAN)
ITISALQSY

SEQ ID NO: 159104 - protein, 9 aa, Artificial Sequence
  Description of Artificial Sequence: Synthetic peptide
  Seed: RLRELLCEL (PRAME_HUMAN)
RIRELLCEL

SEQ ID NO: 159105 - protein, 9 aa, Artificial Sequence
  Description of Artificial Sequence: Synthetic peptide
  Seed: LSEGDVMHL (PRAME_HUMAN)
LIEGDVMHV

SEQ ID NO: 159106 - protein, 10 aa, Artificial Sequence
  Description of Artificial Sequence: Synthetic peptide
  Seed: QSLLQHLIGL (PRAME_HUMAN)
QKLLQHLIGL

SEQ ID NO: 159107 - protein, 9 aa, Artificial Sequence
  Description of Artificial Sequence: Synthetic peptide
  Seed: SISALQSLL (PRAME_HUMAN)
SISALQSLV

SEQ ID NO: 159108 - protein, 9 aa, Artificial Sequence
  Description of Artificial Sequence: Synthetic peptide
  Seed: LQSLLQHLI (PRAME_HUMAN)
LSSLLQHLL

SEQ ID NO: 159109 - protein, 9 aa, Artificial Sequence
  Description of Artificial Sequence: Synthetic peptide
  Seed: EDLEVTCTW (PRAME_HUMAN)
EVLEVTCTY

SEQ ID NO: 159110 - protein, 9 aa, Artificial Sequence
  Description of Artificial Sequence: Synthetic peptide
  Seed: SPEPLQALL (PRAME_HUMAN)
SIEPLQALL

SEQ ID NO: 159111 - protein, 9 aa, Artificial Sequence
  Description of Artificial Sequence: Synthetic peptide
  Seed: HVMNPLETL (PRAME_HUMAN)
HGMNPLETY

SEQ ID NO: 159112 - protein, 9 aa, Artificial Sequence
  Description of Artificial Sequence: Synthetic peptide
  Seed: SLLQHLIGL (PRAME_HUMAN)
SQLQHLIGM

SEQ ID NO: 159113 - protein, 9 aa, Artificial Sequence
  Description of Artificial Sequence: Synthetic peptide
  Seed: KEEQYIAQF (PRAME_HUMAN)
KLEQYIAQL

SEQ ID NO: 159114 - protein, 9 aa, Artificial Sequence
  Description of Artificial Sequence: Synthetic peptide
  Seed: KAMVQAWPF (PRAME_HUMAN)
KPMVQAWPF

SEQ ID NO: 159115 - protein, 10 aa, Artificial Sequence
  Description of Artificial Sequence: Synthetic peptide
  Seed: QALYVDSLFF (PRAME_HUMAN)
QTLYVDSLFW

SEQ ID NO: 159116 - protein, 9 aa, Artificial Sequence
  Description of Artificial Sequence: Synthetic peptide
  Seed: ACDELFSYL (PRAME_HUMAN)
AVDELFSYV

SEQ ID NO: 159117 - protein, 9 aa, Artificial Sequence
  Description of Artificial Sequence: Synthetic peptide
  Seed: AAFDGRHSQ (PRAME_HUMAN)
AIFDGRHSL

SEQ ID NO: 159118 - protein, 9 aa, Artificial Sequence
  Description of Artificial Sequence: Synthetic peptide
  Seed: KLKIFAMPM (PRAME_HUMAN)
KTKIFAMPL

SEQ ID NO: 159119 - protein, 9 aa, Artificial Sequence
  Description of Artificial Sequence: Synthetic peptide
  Seed: DEALAIAAL (PRAME_HUMAN)
DRALAIAAI

SEQ ID NO: 159120 - protein, 11 aa, Artificial Sequence
  Description of Artificial Sequence: Synthetic peptide
  Seed: SQTLKAMVQAW (PRAME_HUMAN)
SSTLKAMVQAW

SEQ ID NO: 159121 - protein, 9 aa, Artificial Sequence
  Description of Artificial Sequence: Synthetic peptide
  Seed: LQALYVDSL (PRAME_HUMAN)
LHALYVDSY

SEQ ID NO: 159122 - protein, 8 aa, Artificial Sequence
  Description of Artificial Sequence: Synthetic peptide
  Seed: RYISMSVW (PRAME_HUMAN)
RYISMSVL

SEQ ID NO: 159123 - protein, 9 aa, Artificial Sequence
  Description of Artificial Sequence: Synthetic peptide
  Seed: RLRELLCEL (PRAME_HUMAN)
RTRELLCER

SEQ ID NO: 159124 - protein, 8 aa, Artificial Sequence
  Description of Artificial Sequence: Synthetic peptide
  Seed: YLGQMINL (PRAME_HUMAN)
YAGQMINL

SEQ ID NO: 159125 - protein, 11 aa, Artificial Sequence
  Description of Artificial Sequence: Synthetic peptide
  Seed: HLSQSPSVSQL (PRAME_HUMAN)
HMSQSPSVSQW

SEQ ID NO: 159126 - protein, 11 aa, Artificial Sequence
  Description of Artificial Sequence: Synthetic peptide
  Seed: ALYVDSLFFLR (PRAME_HUMAN)
AMYVDSLFFLT

SEQ ID NO: 159127 - protein, 11 aa, Artificial Sequence
  Description of Artificial Sequence: Synthetic peptide
  Seed: HLSQSPSVSQL (PRAME_HUMAN)
HQSQSPSVSQM

SEQ ID NO: 159128 - protein, 10 aa, Artificial Sequence
  Description of Artificial Sequence: Synthetic peptide
  Seed: SNLTHVLYPV (PRAME_HUMAN)
SNLTHVLYPI

SEQ ID NO: 159129 - protein, 9 aa, Artificial Sequence
  Description of Artificial Sequence: Synthetic peptide
  Seed: QSRYISMSV (PRAME_HUMAN)
QTRYISMST

SEQ ID NO: 159130 - protein, 9 aa, Artificial Sequence
  Description of Artificial Sequence: Synthetic peptide
  Seed: MQDIKMILK (PRAME_HUMAN)
MVDIKMILK

SEQ ID NO: 159131 - protein, 10 aa, Artificial Sequence
  Description of Artificial Sequence: Synthetic peptide
  Seed: IQSRYISMSV (PRAME_HUMAN)
IQSRYISMSY

SEQ ID NO: 159132 - protein, 10 aa, Artificial Sequence
  Description of Artificial Sequence: Synthetic peptide
  Seed: RGRLDQLLRH (PRAME_HUMAN)
RMRLDQLLRM

SEQ ID NO: 159133 - protein, 9 aa, Artificial Sequence
  Description of Artificial Sequence: Synthetic peptide
  Seed: FYDPEPILC (PRAME_HUMAN)
FGDPEPILY

SEQ ID NO: 159134 - protein, 9 aa, Artificial Sequence
  Description of Artificial Sequence: Synthetic peptide
  Seed: MVQAWPFTC (PRAME_HUMAN)
MIQAWPFTL

SEQ ID NO: 159135 - protein, 10 aa, Artificial Sequence
  Description of Artificial Sequence: Synthetic peptide
  Seed: SGNRASLYSF (PRAME_HUMAN)
SMNRASLYSY

SEQ ID NO: 159136 - protein, 9 aa, Artificial Sequence
  Description of Artificial Sequence: Synthetic peptide
  Seed: KAMVQAWPF (PRAME_HUMAN)
KYMVQAWPF

SEQ ID NO: 159137 - protein, 9 aa, Artificial Sequence
  Description of Artificial Sequence: Synthetic peptide
  Seed: GNRASLYSF (PRAME_HUMAN)
GERASLYSF

SEQ ID NO: 159138 - protein, 9 aa, Artificial Sequence
  Description of Artificial Sequence: Synthetic peptide
  Seed: LVELAGQSL (PRAME_HUMAN)
LFELAGQSI

SEQ ID NO: 159139 - protein, 9 aa, Artificial Sequence
  Description of Artificial Sequence: Synthetic peptide
  Seed: VQLDSIEDL (PRAME_HUMAN)
VHLDSIEDI

SEQ ID NO: 159140 - protein, 10 aa, Artificial Sequence
  Description of Artificial Sequence: Synthetic peptide
  Seed: LSQSPSVSQL (PRAME_HUMAN)
LLQSPSVSQF

SEQ ID NO: 159141 - protein, 9 aa, Artificial Sequence
  Description of Artificial Sequence: Synthetic peptide
  Seed: RLWGSIQSR (PRAME_HUMAN)
RMWGSIQSH

SEQ ID NO: 159142 - protein, 9 aa, Artificial Sequence
  Description of Artificial Sequence: Synthetic peptide
  Seed: SHIHASSYI (PRAME_HUMAN)
SWIHASSYM

SEQ ID NO: 159143 - protein, 10 aa, Artificial Sequence
  Description of Artificial Sequence: Synthetic peptide
  Seed: RLAYLHARLR (PRAME_HUMAN)
RGAYLHARLK

SEQ ID NO: 159144 - protein, 11 aa, Artificial Sequence
  Description of Artificial Sequence: Synthetic peptide
  Seed: CTWKLPTLAKF (PRAME_HUMAN)
CTWKLPTLAKW

SEQ ID NO: 159145 - protein, 9 aa, Artificial Sequence
  Description of Artificial Sequence: Synthetic peptide
  Seed: KAMVQAWPF (PRAME_HUMAN)
KVMVQAWPV

SEQ ID NO: 159146 - protein, 9 aa, Artificial Sequence
  Description of Artificial Sequence: Synthetic peptide
  Seed: RLAYLHARL (PRAME_HUMAN)
RFAYLHARY

SEQ ID NO: 159147 - protein, 10 aa, Artificial Sequence
  Description of Artificial Sequence: Synthetic peptide
  Seed: VELAGQSLLK (PRAME_HUMAN)
VALAGQSLLK

SEQ ID NO: 159148 - protein, 9 aa, Artificial Sequence
  Description of Artificial Sequence: Synthetic peptide
  Seed: KVKRKKNVL (PRAME_HUMAN)
KIKRKKNVK

SEQ ID NO: 159149 - protein, 9 aa, Artificial Sequence
  Description of Artificial Sequence: Synthetic peptide
  Seed: LSHIHASSY (PRAME_HUMAN)
LSHIHASSI

SEQ ID NO: 159150 - protein, 10 aa, Artificial Sequence
  Description of Artificial Sequence: Synthetic peptide
  Seed: SNLTHVLYPV (PRAME_HUMAN)
SMLTHVLYPA

SEQ ID NO: 159151 - protein, 9 aa, Artificial Sequence
  Description of Artificial Sequence: Synthetic peptide
  Seed: RLRELLCEL (PRAME_HUMAN)
RERELLCEF

SEQ ID NO: 159152 - protein, 9 aa, Artificial Sequence
  Description of Artificial Sequence: Synthetic peptide
  Seed: CSQLTTLSF (PRAME_HUMAN)
CMQLTTLSL

SEQ ID NO: 159153 - protein, 10 aa, Artificial Sequence
  Description of Artificial Sequence: Synthetic peptide
  Seed: GLDVLLAQEV (PRAME_HUMAN)
GMDVLLAQEV

SEQ ID NO: 159154 - protein, 11 aa, Artificial Sequence
  Description of Artificial Sequence: Synthetic peptide
  Seed: LPTLAKFSPYL (PRAME_HUMAN)
LPTLAKFSPYV

SEQ ID NO: 159155 - protein, 9 aa, Artificial Sequence
  Description of Artificial Sequence: Synthetic peptide
  Seed: ISPEKEEQY (PRAME_HUMAN)
IYPEKEEQM

SEQ ID NO: 159156 - protein, 11 aa, Artificial Sequence
  Description of Artificial Sequence: Synthetic peptide
  Seed: RTFYDPEPILC (PRAME_HUMAN)
RVFYDPEPILW

SEQ ID NO: 159157 - protein, 9 aa, Artificial Sequence
  Description of Artificial Sequence: Synthetic peptide
  Seed: KVDGLSTEA (PRAME_HUMAN)
KCDGLSTEF

SEQ ID NO: 159158 - protein, 9 aa, Artificial Sequence
  Description of Artificial Sequence: Synthetic peptide
  Seed: LQSLLQHLI (PRAME_HUMAN)
LLSLLQHLM

SEQ ID NO: 159159 - protein, 9 aa, Artificial Sequence
  Description of Artificial Sequence: Synthetic peptide
  Seed: SPEPLQALL (PRAME_HUMAN)
SPEPLQALY

SEQ ID NO: 159160 - protein, 9 aa, Artificial Sequence
  Description of Artificial Sequence: Synthetic peptide
  Seed: TLKAMVQAW (PRAME_HUMAN)
TMKAMVQAY

SEQ ID NO: 159161 - protein, 9 aa, Artificial Sequence
  Description of Artificial Sequence: Synthetic peptide
  Seed: IGLSNLTHV (PRAME_HUMAN)
ISLSNLTHV

SEQ ID NO: 159162 - protein, 10 aa, Artificial Sequence
  Description of Artificial Sequence: Synthetic peptide
  Seed: ISISALQSLL (PRAME_HUMAN)
IQISALQSLW

SEQ ID NO: 159163 - protein, 9 aa, Artificial Sequence
  Description of Artificial Sequence: Synthetic peptide
  Seed: SPSVSQLSV (PRAME_HUMAN)
SPSVSQLSI

SEQ ID NO: 159164 - protein, 10 aa, Artificial Sequence
  Description of Artificial Sequence: Synthetic peptide
  Seed: FIPVEVLVDL (PRAME_HUMAN)
FIPVEVLVDY

SEQ ID NO: 159165 - protein, 10 aa, Artificial Sequence
  Description of Artificial Sequence: Synthetic peptide
  Seed: FIPVEVLVDL (PRAME_HUMAN)
FQPVEVLVDM

SEQ ID NO: 159166 - protein, 11 aa, Artificial Sequence
  Description of Artificial Sequence: Synthetic peptide
  Seed: RLVELAGQSLL (PRAME_HUMAN)
RQVELAGQSLW

SEQ ID NO: 159167 - protein, 10 aa, Artificial Sequence
  Description of Artificial Sequence: Synthetic peptide
  Seed: ALYVDSLFFL (PRAME_HUMAN)
ACYVDSLFFI

SEQ ID NO: 159168 - protein, 9 aa, Artificial Sequence
  Description of Artificial Sequence: Synthetic peptide
  Seed: IGLSNLTHV (PRAME_HUMAN)
IQLSNLTHL

SEQ ID NO: 159169 - protein, 9 aa, Artificial Sequence
  Description of Artificial Sequence: Synthetic peptide
  Seed: KLKIFAMPM (PRAME_HUMAN)
KTKIFAMPF

SEQ ID NO: 159170 - protein, 9 aa, Artificial Sequence
  Description of Artificial Sequence: Synthetic peptide
  Seed: VQLDSIEDL (PRAME_HUMAN)
VLLDSIEDI

SEQ ID NO: 159171 - protein, 9 aa, Artificial Sequence
  Description of Artificial Sequence: Synthetic peptide
  Seed: SALQSLLQH (PRAME_HUMAN)
SQLQSLLQF

SEQ ID NO: 159172 - protein, 9 aa, Artificial Sequence
  Description of Artificial Sequence: Synthetic peptide
  Seed: RLDQLLRHV (PRAME_HUMAN)
RQDQLLRHL

SEQ ID NO: 159173 - protein, 10 aa, Artificial Sequence
  Description of Artificial Sequence: Synthetic peptide
  Seed: EALAIAALEL (PRAME_HUMAN)
ETLAIAALEV

SEQ ID NO: 159174 - protein, 9 aa, Artificial Sequence
  Description of Artificial Sequence: Synthetic peptide
  Seed: KVDGLSTEA (PRAME_HUMAN)
KSDGLSTEL

SEQ ID NO: 159175 - protein, 9 aa, Artificial Sequence
  Description of Artificial Sequence: Synthetic peptide
  Seed: FSPYLGQMI (PRAME_HUMAN)
FIPYLGQMV

SEQ ID NO: 159176 - protein, 9 aa, Artificial Sequence
  Description of Artificial Sequence: Synthetic peptide
  Seed: YSFPEPEAA (PRAME_HUMAN)
YLFPEPEAI

SEQ ID NO: 159177 - protein, 10 aa, Artificial Sequence
  Description of Artificial Sequence: Synthetic peptide
  Seed: LLPRELFPPL (PRAME_HUMAN)
LKPRELFPPI

SEQ ID NO: 159178 - protein, 11 aa, Artificial Sequence
  Description of Artificial Sequence: Synthetic peptide
  Seed: RRRLWGSIQSR (PRAME_HUMAN)
RRRLWGSIQSK

SEQ ID NO: 159179 - protein, 11 aa, Artificial Sequence
  Description of Artificial Sequence: Synthetic peptide
  Seed: AAFDGRHSQTL (PRAME_HUMAN)
AFFDGRHSQTY

SEQ ID NO: 159180 - protein, 9 aa, Artificial Sequence
  Description of Artificial Sequence: Synthetic peptide
  Seed: KVDGLSTEA (PRAME_HUMAN)
KADGLSTEM

SEQ ID NO: 159181 - protein, 9 aa, Artificial Sequence
  Description of Artificial Sequence: Synthetic peptide
  Seed: SALQSLLQH (PRAME_HUMAN)
STLQSLLQF

SEQ ID NO: 159182 - protein, 11 aa, Artificial Sequence
  Description of Artificial Sequence: Synthetic peptide
  Seed: ALYVDSLFFLR (PRAME_HUMAN)
ALYVDSLFFLC

SEQ ID NO: 159183 - protein, 9 aa, Artificial Sequence
  Description of Artificial Sequence: Synthetic peptide
  Seed: RPRRWKLQV (PRAME_HUMAN)
RPRRWKLQT

SEQ ID NO: 159184 - protein, 10 aa, Artificial Sequence
  Description of Artificial Sequence: Synthetic peptide
  Seed: KNVLRLCCKK (PRAME_HUMAN)
KIVLRLCCKR

SEQ ID NO: 159185 - protein, 9 aa, Artificial Sequence
  Description of Artificial Sequence: Synthetic peptide
  Seed: VQAWPFTCL (PRAME_HUMAN)
VRAWPFTCY

SEQ ID NO: 159186 - protein, 9 aa, Artificial Sequence
  Description of Artificial Sequence: Synthetic peptide
  Seed: YLHARLREL (PRAME_HUMAN)
YLHARLREF

SEQ ID NO: 159187 - protein, 10 aa, Artificial Sequence
  Description of Artificial Sequence: Synthetic peptide
  Seed: LLLSHIHASS (PRAME_HUMAN)
LDLSHIHASA

SEQ ID NO: 159188 - protein, 11 aa, Artificial Sequence
  Description of Artificial Sequence: Synthetic peptide
  Seed: LLLSHIHASSY (PRAME_HUMAN)
LSLSHIHASSW

SEQ ID NO: 159189 - protein, 9 aa, Artificial Sequence
  Description of Artificial Sequence: Synthetic peptide
  Seed: VWTSPRRLV (PRAME_HUMAN)
VFTSPRRLM

SEQ ID NO: 159190 - protein, 9 aa, Artificial Sequence
  Description of Artificial Sequence: Synthetic peptide
  Seed: LPTLAKFSP (PRAME_HUMAN)
LPTLAKFSM

SEQ ID NO: 159191 - protein, 9 aa, Artificial Sequence
  Description of Artificial Sequence: Synthetic peptide
  Seed: TFYDPEPIL (PRAME_HUMAN)
TRYDPEPIL

SEQ ID NO: 159192 - protein, 9 aa, Artificial Sequence
  Description of Artificial Sequence: Synthetic peptide
  Seed: HVMNPLETL (PRAME_HUMAN)
HVMNPLETH

SEQ ID NO: 159193 - protein, 9 aa, Artificial Sequence
  Description of Artificial Sequence: Synthetic peptide
  Seed: LGRPSMVWL (PRAME_HUMAN)
LSRPSMVWF

SEQ ID NO: 159194 - protein, 10 aa, Artificial Sequence
  Description of Artificial Sequence: Synthetic peptide
  Seed: RLVELAGQSL (PRAME_HUMAN)
RTVELAGQSR

SEQ ID NO: 159195 - protein, 10 aa, Artificial Sequence
  Description of Artificial Sequence: Synthetic peptide
  Seed: YVDSLFFLRG (PRAME_HUMAN)
YVDSLFFLRR

SEQ ID NO: 159196 - protein, 11 aa, Artificial Sequence
  Description of Artificial Sequence: Synthetic peptide
  Seed: VQLDSIEDLEV (PRAME_HUMAN)
VILDSIEDLEL

SEQ ID NO: 159197 - protein, 9 aa, Artificial Sequence
  Description of Artificial Sequence: Synthetic peptide
  Seed: YGNSISISA (PRAME_HUMAN)
YLNSISISF

SEQ ID NO: 159198 - protein, 10 aa, Artificial Sequence
  Description of Artificial Sequence: Synthetic peptide
  Seed: RGRLDQLLRH (PRAME_HUMAN)
RCRLDQLLRR

SEQ ID NO: 159199 - protein, 9 aa, Artificial Sequence
  Description of Artificial Sequence: Synthetic peptide
  Seed: ITDDQLLAL (PRAME_HUMAN)
ICDDQLLAV

SEQ ID NO: 159200 - protein, 9 aa, Artificial Sequence
  Description of Artificial Sequence: Synthetic peptide
  Seed: LELLPRELF (PRAME_HUMAN)
LELLPRELM

SEQ ID NO: 159201 - protein, 9 aa, Artificial Sequence
  Description of Artificial Sequence: Synthetic peptide
  Seed: QSRYISMSV (PRAME_HUMAN)
QWRYISMSK

SEQ ID NO: 159202 - protein, 10 aa, Artificial Sequence
  Description of Artificial Sequence: Synthetic peptide
  Seed: FLSLQCLQAL (PRAME_HUMAN)
FVSLQCLQAI

SEQ ID NO: 159203 - protein, 9 aa, Artificial Sequence
  Description of Artificial Sequence: Synthetic peptide
  Seed: QFTSQFLSL (PRAME_HUMAN)
QWTSQFLSW

SEQ ID NO: 159204 - protein, 9 aa, Artificial Sequence
  Description of Artificial Sequence: Synthetic peptide
  Seed: YSFPEPEAA (PRAME_HUMAN)
YWFPEPEAY

SEQ ID NO: 159205 - protein, 10 aa, Artificial Sequence
  Description of Artificial Sequence: Synthetic peptide
  Seed: LSFYGNSISI (PRAME_HUMAN)
LSFYGNSISV

SEQ ID NO: 159206 - protein, 9 aa, Artificial Sequence
  Description of Artificial Sequence: Synthetic peptide
  Seed: SVWTSPRRL (PRAME_HUMAN)
SLWTSPRRL

SEQ ID NO: 159207 - protein, 10 aa, Artificial Sequence
  Description of Artificial Sequence: Synthetic peptide
  Seed: FPEPEAAQPM (PRAME_HUMAN)
FPEPEAAQPW

SEQ ID NO: 159208 - protein, 11 aa, Artificial Sequence
  Description of Artificial Sequence: Synthetic peptide
  Seed: CRLSEGDVMHL (PRAME_HUMAN)
CHLSEGDVMHF

SEQ ID NO: 159209 - protein, 9 aa, Artificial Sequence
  Description of Artificial Sequence: Synthetic peptide
  Seed: SHCSQLTTL (PRAME_HUMAN)
SQCSQLTTM

SEQ ID NO: 159210 - protein, 8 aa, Artificial Sequence
  Description of Artificial Sequence: Synthetic peptide
  Seed: ITDDQLLA (PRAME_HUMAN)
ISDDQLLF

SEQ ID NO: 159211 - protein, 9 aa, Artificial Sequence
  Description of Artificial Sequence: Synthetic peptide
  Seed: QFTSQFLSL (PRAME_HUMAN)
QYTSQFLSF

SEQ ID NO: 159212 - protein, 9 aa, Artificial Sequence
  Description of Artificial Sequence: Synthetic peptide
  Seed: VQLDSIEDL (PRAME_HUMAN)
VHLDSIEDL

SEQ ID NO: 159213 - protein, 10 aa, Artificial Sequence
  Description of Artificial Sequence: Synthetic peptide
  Seed: YEDIHGTLHL (PRAME_HUMAN)
YADIHGTLHV

SEQ ID NO: 159214 - protein, 10 aa, Artificial Sequence
  Description of Artificial Sequence: Synthetic peptide
  Seed: LSQSPSVSQL (PRAME_HUMAN)
LDQSPSVSQY

SEQ ID NO: 159215 - protein, 9 aa, Artificial Sequence
  Description of Artificial Sequence: Synthetic peptide
  Seed: MVQAWPFTC (PRAME_HUMAN)
MLQAWPFTL

SEQ ID NO: 159216 - protein, 9 aa, Artificial Sequence
  Description of Artificial Sequence: Synthetic peptide
  Seed: SLQCLQALY (PRAME_HUMAN)
SQQCLQALM

SEQ ID NO: 159217 - protein, 10 aa, Artificial Sequence
  Description of Artificial Sequence: Synthetic peptide
  Seed: TWKLPTLAKF (PRAME_HUMAN)
TQKLPTLAKY

SEQ ID NO: 159218 - protein, 9 aa, Artificial Sequence
  Description of Artificial Sequence: Synthetic peptide
  Seed: ALYVDSLFF (PRAME_HUMAN)
AKYVDSLFM

SEQ ID NO: 159219 - protein, 9 aa, Artificial Sequence
  Description of Artificial Sequence: Synthetic peptide
  Seed: ETLSITNCR (PRAME_HUMAN)
EYLSITNCR

SEQ ID NO: 159220 - protein, 9 aa, Artificial Sequence
  Description of Artificial Sequence: Synthetic peptide
  Seed: RLLLSHIHA (PRAME_HUMAN)
RFLLSHIHK

SEQ ID NO: 159221 - protein, 9 aa, Artificial Sequence
  Description of Artificial Sequence: Synthetic peptide
  Seed: RLRELLCEL (PRAME_HUMAN)
RTRELLCEC

SEQ ID NO: 159222 - protein, 11 aa, Artificial Sequence
  Description of Artificial Sequence: Synthetic peptide
  Seed: AAFDGRHSQTL (PRAME_HUMAN)
ALFDGRHSQTR

SEQ ID NO: 159223 - protein, 11 aa, Artificial Sequence
  Description of Artificial Sequence: Synthetic peptide
  Seed: RELFPPLFMAA (PRAME_HUMAN)
RRLFPPLFMAL

SEQ ID NO: 159224 - protein, 10 aa, Artificial Sequence
  Description of Artificial Sequence: Synthetic peptide
  Seed: RGRLDQLLRH (PRAME_HUMAN)
RWRLDQLLRY

SEQ ID NO: 159225 - protein, 9 aa, Artificial Sequence
  Description of Artificial Sequence: Synthetic peptide
  Seed: KLKIFAMPM (PRAME_HUMAN)
KIKIFAMPF

SEQ ID NO: 159226 - protein, 9 aa, Artificial Sequence
  Description of Artificial Sequence: Synthetic peptide
  Seed: LSHIHASSY (PRAME_HUMAN)
LMHIHASSK

SEQ ID NO: 159227 - protein, 10 aa, Artificial Sequence
  Description of Artificial Sequence: Synthetic peptide
  Seed: YEDIHGTLHL (PRAME_HUMAN)
YSDIHGTLHI

SEQ ID NO: 159228 - protein, 9 aa, Artificial Sequence
  Description of Artificial Sequence: Synthetic peptide
  Seed: LAQEVRPRR (PRAME_HUMAN)
LFQEVRPRR

SEQ ID NO: 159229 - protein, 10 aa, Artificial Sequence
  Description of Artificial Sequence: Synthetic peptide
  Seed: FIPVEVLVDL (PRAME_HUMAN)
FMPVEVLVDM

SEQ ID NO: 159230 - protein, 10 aa, Artificial Sequence
  Description of Artificial Sequence: Synthetic peptide
  Seed: QAWPFTCLPL (PRAME_HUMAN)
QLWPFTCLPI

SEQ ID NO: 159231 - protein, 9 aa, Artificial Sequence
  Description of Artificial Sequence: Synthetic peptide
  Seed: HLETFKAVL (PRAME_HUMAN)
HMETFKAVY

SEQ ID NO: 159232 - protein, 11 aa, Artificial Sequence
  Description of Artificial Sequence: Synthetic peptide
  Seed: ALYVDSLFFLR (PRAME_HUMAN)
ALYVDSLFFLG

SEQ ID NO: 159233 - protein, 9 aa, Artificial Sequence
  Description of Artificial Sequence: Synthetic peptide
  Seed: LGQMINLRR (PRAME_HUMAN)
LFQMINLRR

SEQ ID NO: 159234 - protein, 9 aa, Artificial Sequence
  Description of Artificial Sequence: Synthetic peptide
  Seed: LALLPSLSH (PRAME_HUMAN)
LGLLPSLSY

SEQ ID NO: 159235 - protein, 9 aa, Artificial Sequence
  Description of Artificial Sequence: Synthetic peptide
  Seed: ISPEKEEQY (PRAME_HUMAN)
IYPEKEEQV

SEQ ID NO: 159236 - protein, 9 aa, Artificial Sequence
  Description of Artificial Sequence: Synthetic peptide
  Seed: LLAQEVRPR (PRAME_HUMAN)
LTAQEVRPR

SEQ ID NO: 159237 - protein, 9 aa, Artificial Sequence
  Description of Artificial Sequence: Synthetic peptide
  Seed: CKKLKIFAM (PRAME_HUMAN)
CIKLKIFAM

SEQ ID NO: 159238 - protein, 9 aa, Artificial Sequence
  Description of Artificial Sequence: Synthetic peptide
  Seed: MQDIKMILK (PRAME_HUMAN)
MTDIKMILY

SEQ ID NO: 159239 - protein, 9 aa, Artificial Sequence
  Description of Artificial Sequence: Synthetic peptide
  Seed: QMINLRRLL (PRAME_HUMAN)
QLINLRRLW

SEQ ID NO: 159240 - protein, 9 aa, Artificial Sequence
  Description of Artificial Sequence: Synthetic peptide
  Seed: SQSPSVSQL (PRAME_HUMAN)
SRSPSVSQM

SEQ ID NO: 159241 - protein, 11 aa, Artificial Sequence
  Description of Artificial Sequence: Synthetic peptide
  Seed: RELFPPLFMAA (PRAME_HUMAN)
RALFPPLFMAV

SEQ ID NO: 159242 - protein, 9 aa, Artificial Sequence
  Description of Artificial Sequence: Synthetic peptide
  Seed: RLAYLHARL (PRAME_HUMAN)
RAAYLHARM

SEQ ID NO: 159243 - protein, 9 aa, Artificial Sequence
  Description of Artificial Sequence: Synthetic peptide
  Seed: LYPVPLESY (PRAME_HUMAN)
LPPVPLESY

SEQ ID NO: 159244 - protein, 11 aa, Artificial Sequence
  Description of Artificial Sequence: Synthetic peptide
  Seed: IQSRYISMSVW (PRAME_HUMAN)
IKSRYISMSVF

SEQ ID NO: 159245 - protein, 10 aa, Artificial Sequence
  Description of Artificial Sequence: Synthetic peptide
  Seed: RLAYLHARLR (PRAME_HUMAN)
RSAYLHARLA

SEQ ID NO: 159246 - protein, 10 aa, Artificial Sequence
  Description of Artificial Sequence: Synthetic peptide
  Seed: AFDGRHSQTL (PRAME_HUMAN)
AYDGRHSQTF

SEQ ID NO: 159247 - protein, 9 aa, Artificial Sequence
  Description of Artificial Sequence: Synthetic peptide
  Seed: RGRLDQLLR (PRAME_HUMAN)
RLRLDQLLR

SEQ ID NO: 159248 - protein, 9 aa, Artificial Sequence
  Description of Artificial Sequence: Synthetic peptide
  Seed: LSLQCLQAL (PRAME_HUMAN)
LILQCLQAA

SEQ ID NO: 159249 - protein, 9 aa, Artificial Sequence
  Description of Artificial Sequence: Synthetic peptide
  Seed: GNRASLYSF (PRAME_HUMAN)
GARASLYSY

SEQ ID NO: 159250 - protein, 9 aa, Artificial Sequence
  Description of Artificial Sequence: Synthetic peptide
  Seed: AAFDGRHSQ (PRAME_HUMAN)
AAFDGRHSM

SEQ ID NO: 159251 - protein, 11 aa, Artificial Sequence
  Description of Artificial Sequence: Synthetic peptide
  Seed: ALLERASATLQ (PRAME_HUMAN)
AMLERASATLV

SEQ ID NO: 159252 - protein, 9 aa, Artificial Sequence
  Description of Artificial Sequence: Synthetic peptide
  Seed: GQHLHLETF (PRAME_HUMAN)
GDHLHLETL

SEQ ID NO: 159253 - protein, 9 aa, Artificial Sequence
  Description of Artificial Sequence: Synthetic peptide
  Seed: LTDVSPEPL (PRAME_HUMAN)
LMDVSPEPM

SEQ ID NO: 159254 - protein, 9 aa, Artificial Sequence
  Description of Artificial Sequence: Synthetic peptide
  Seed: RELFPPLFM (PRAME_HUMAN)
RSLFPPLFY

SEQ ID NO: 159255 - protein, 10 aa, Artificial Sequence
  Description of Artificial Sequence: Synthetic peptide
  Seed: RLAYLHARLR (PRAME_HUMAN)
RDAYLHARLR

SEQ ID NO: 159256 - protein, 8 aa, Artificial Sequence
  Description of Artificial Sequence: Synthetic peptide
  Seed: YEDIHGTL (PRAME_HUMAN)
YIDIHGTI

SEQ ID NO: 159257 - protein, 9 aa, Artificial Sequence
  Description of Artificial Sequence: Synthetic peptide
  Seed: FAMPMQDIK (PRAME_HUMAN)
FAMPMQDIL

SEQ ID NO: 159258 - protein, 9 aa, Artificial Sequence
  Description of Artificial Sequence: Synthetic peptide
  Seed: TLSFYGNSI (PRAME_HUMAN)
TMSFYGNSV

SEQ ID NO: 159259 - protein, 9 aa, Artificial Sequence
  Description of Artificial Sequence: Synthetic peptide
  Seed: WLSANPCPH (PRAME_HUMAN)
WASANPCPF

SEQ ID NO: 159260 - protein, 9 aa, Artificial Sequence
  Description of Artificial Sequence: Synthetic peptide
  Seed: LPRELFPPL (PRAME_HUMAN)
LLRELFPPY

SEQ ID NO: 159261 - protein, 9 aa, Artificial Sequence
  Description of Artificial Sequence: Synthetic peptide
  Seed: YSFPEPEAA (PRAME_HUMAN)
YIFPEPEAI

SEQ ID NO: 159262 - protein, 10 aa, Artificial Sequence
  Description of Artificial Sequence: Synthetic peptide
  Seed: LFPPLFMAAF (PRAME_HUMAN)
LYPPLFMAAY

SEQ ID NO: 159263 - protein, 9 aa, Artificial Sequence
  Description of Artificial Sequence: Synthetic peptide
  Seed: RLRELLCEL (PRAME_HUMAN)
RFRELLCEV

SEQ ID NO: 159264 - protein, 10 aa, Artificial Sequence
  Description of Artificial Sequence: Synthetic peptide
  Seed: SPYLGQMINL (PRAME_HUMAN)
STYLGQMINL

SEQ ID NO: 159265 - protein, 9 aa, Artificial Sequence
  Description of Artificial Sequence: Synthetic peptide
  Seed: LQDLVFDEC (PRAME_HUMAN)
LADLVFDEL

SEQ ID NO: 159266 - protein, 10 aa, Artificial Sequence
  Description of Artificial Sequence: Synthetic peptide
  Seed: RPSMVWLSAN (PRAME_HUMAN)
RPSMVWLSAM

SEQ ID NO: 159267 - protein, 8 aa, Artificial Sequence
  Description of Artificial Sequence: Synthetic peptide
  Seed: ITDDQLLA (PRAME_HUMAN)
IIDDQLLM

SEQ ID NO: 159268 - protein, 11 aa, Artificial Sequence
  Description of Artificial Sequence: Synthetic peptide
  Seed: YISMSVWTSPR (PRAME_HUMAN)
YESMSVWTSPR

SEQ ID NO: 159269 - protein, 9 aa, Artificial Sequence
  Description of Artificial Sequence: Synthetic peptide
  Seed: FYDPEPILC (PRAME_HUMAN)
FGDPEPILV

SEQ ID NO: 159270 - protein, 10 aa, Artificial Sequence
  Description of Artificial Sequence: Synthetic peptide
  Seed: IGLSNLTHVL (PRAME_HUMAN)
IQLSNLTHVL

SEQ ID NO: 159271 - protein, 9 aa, Artificial Sequence
  Description of Artificial Sequence: Synthetic peptide
  Seed: YLGQMINLR (PRAME_HUMAN)
YTGQMINLK

SEQ ID NO: 159272 - protein, 9 aa, Artificial Sequence
  Description of Artificial Sequence: Synthetic peptide
  Seed: RHSQTLKAM (PRAME_HUMAN)
RHSQTLKAF

SEQ ID NO: 159273 - protein, 8 aa, Artificial Sequence
  Description of Artificial Sequence: Synthetic peptide
  Seed: YVDSLFFL (PRAME_HUMAN)
YLDSLFFV

SEQ ID NO: 159274 - protein, 9 aa, Artificial Sequence
  Description of Artificial Sequence: Synthetic peptide
  Seed: RLWGSIQSR (PRAME_HUMAN)
RTWGSIQSY

SEQ ID NO: 159275 - protein, 10 aa, Artificial Sequence
  Description of Artificial Sequence: Synthetic peptide
  Seed: RRRLWGSIQS (PRAME_HUMAN)
RARLWGSIQK

SEQ ID NO: 159276 - protein, 9 aa, Artificial Sequence
  Description of Artificial Sequence: Synthetic peptide
  Seed: EPLQALLER (PRAME_HUMAN)
ELLQALLEK

SEQ ID NO: 159277 - protein, 9 aa, Artificial Sequence
  Description of Artificial Sequence: Synthetic peptide
  Seed: GQSLLKDEA (PRAME_HUMAN)
GQSLLKDEI

SEQ ID NO: 159278 - protein, 9 aa, Artificial Sequence
  Description of Artificial Sequence: Synthetic peptide
  Seed: WKLPTLAKF (PRAME_HUMAN)
WVLPTLAKY

SEQ ID NO: 159279 - protein, 9 aa, Artificial Sequence
  Description of Artificial Sequence: Synthetic peptide
  Seed: SIQSRYISM (PRAME_HUMAN)
SKQSRYISY

SEQ ID NO: 159280 - protein, 9 aa, Artificial Sequence
  Description of Artificial Sequence: Synthetic peptide
  Seed: SMVWLSANP (PRAME_HUMAN)
SQVWLSANV

SEQ ID NO: 159281 - protein, 9 aa, Artificial Sequence
  Description of Artificial Sequence: Synthetic peptide
  Seed: TCTWKLPTL (PRAME_HUMAN)
TTTWKLPTV

SEQ ID NO: 159282 - protein, 10 aa, Artificial Sequence
  Description of Artificial Sequence: Synthetic peptide
  Seed: LQALYVDSLF (PRAME_HUMAN)
LIALYVDSLW

SEQ ID NO: 159283 - protein, 9 aa, Artificial Sequence
  Description of Artificial Sequence: Synthetic peptide
  Seed: FTCLPLGVL (PRAME_HUMAN)
FTCLPLGVF

SEQ ID NO: 159284 - protein, 10 aa, Artificial Sequence
  Description of Artificial Sequence: Synthetic peptide
  Seed: SISISALQSL (PRAME_HUMAN)
SASISALQSY

SEQ ID NO: 159285 - protein, 9 aa, Artificial Sequence
  Description of Artificial Sequence: Synthetic peptide
  Seed: SQSPSVSQL (PRAME_HUMAN)
SLSPSVSQV

SEQ ID NO: 159286 - protein, 10 aa, Artificial Sequence
  Description of Artificial Sequence: Synthetic peptide
  Seed: RHVMNPLETL (PRAME_HUMAN)
RAVMNPLETV

SEQ ID NO: 159287 - protein, 9 aa, Artificial Sequence
  Description of Artificial Sequence: Synthetic peptide
  Seed: LLSHIHASS (PRAME_HUMAN)
LMSHIHASL

SEQ ID NO: 159288 - protein, 10 aa, Artificial Sequence
  Description of Artificial Sequence: Synthetic peptide
  Seed: RLWGSIQSRY (PRAME_HUMAN)
RGWGSIQSRR

SEQ ID NO: 159289 - protein, 10 aa, Artificial Sequence
  Description of Artificial Sequence: Synthetic peptide
  Seed: SPSVSQLSVL (PRAME_HUMAN)
SMSVSQLSVY

SEQ ID NO: 159290 - protein, 9 aa, Artificial Sequence
  Description of Artificial Sequence: Synthetic peptide
  Seed: YSFPEPEAA (PRAME_HUMAN)
YMFPEPEAF

SEQ ID NO: 159291 - protein, 9 aa, Artificial Sequence
  Description of Artificial Sequence: Synthetic peptide
  Seed: KEGACDELF (PRAME_HUMAN)
KLGACDELL

SEQ ID NO: 159292 - protein, 10 aa, Artificial Sequence
  Description of Artificial Sequence: Synthetic peptide
  Seed: YSFPEPEAAQ (PRAME_HUMAN)
YGFPEPEAAM

SEQ ID NO: 159293 - protein, 9 aa, Artificial Sequence
  Description of Artificial Sequence: Synthetic peptide
  Seed: ALQSLLQHL (PRAME_HUMAN)
ATQSLLQHL

SEQ ID NO: 159294 - protein, 10 aa, Artificial Sequence
  Description of Artificial Sequence: Synthetic peptide
  Seed: SISISALQSL (PRAME_HUMAN)
SGSISALQSW

SEQ ID NO: 159295 - protein, 9 aa, Artificial Sequence
  Description of Artificial Sequence: Synthetic peptide
  Seed: MINLRRLLL (PRAME_HUMAN)
MLNLRRLLL

SEQ ID NO: 159296 - protein, 9 aa, Artificial Sequence
  Description of Artificial Sequence: Synthetic peptide
  Seed: QSRYISMSV (PRAME_HUMAN)
QLRYISMSK

SEQ ID NO: 159297 - protein, 10 aa, Artificial Sequence
  Description of Artificial Sequence: Synthetic peptide
  Seed: RLSEGDVMHL (PRAME_HUMAN)
RMSEGDVMHK

SEQ ID NO: 159298 - protein, 9 aa, Artificial Sequence
  Description of Artificial Sequence: Synthetic peptide
  Seed: SVWTSPRRL (PRAME_HUMAN)
SAWTSPRRF

SEQ ID NO: 159299 - protein, 10 aa, Artificial Sequence
  Description of Artificial Sequence: Synthetic peptide
  Seed: RRWKLQVLDL (PRAME_HUMAN)
RQWKLQVLDL

SEQ ID NO: 159300 - protein, 9 aa, Artificial Sequence
  Description of Artificial Sequence: Synthetic peptide
  Seed: TLHLERLAY (PRAME_HUMAN)
TYHLERLAY

SEQ ID NO: 159301 - protein, 9 aa, Artificial Sequence
  Description of Artificial Sequence: Synthetic peptide
  Seed: RPRRWKLQV (PRAME_HUMAN)
RPRRWKLQF

SEQ ID NO: 159302 - protein, 9 aa, Artificial Sequence
  Description of Artificial Sequence: Synthetic peptide
  Seed: LSTEAEQPF (PRAME_HUMAN)
LATEAEQPY

SEQ ID NO: 159303 - protein, 10 aa, Artificial Sequence
  Description of Artificial Sequence: Synthetic peptide
  Seed: MPMQDIKMIL (PRAME_HUMAN)
MMMQDIKMIM

SEQ ID NO: 159304 - protein, 11 aa, Artificial Sequence
  Description of Artificial Sequence: Synthetic peptide
  Seed: FKAVLDGLDVL (PRAME_HUMAN)
FPAVLDGLDVV

SEQ ID NO: 159305 - protein, 9 aa, Artificial Sequence
  Description of Artificial Sequence: Synthetic peptide
  Seed: CSQLTTLSF (PRAME_HUMAN)
CRQLTTLSY

SEQ ID NO: 159306 - protein, 10 aa, Artificial Sequence
  Description of Artificial Sequence: Synthetic peptide
  Seed: SLYSFPEPEA (PRAME_HUMAN)
SVYSFPEPEI

SEQ ID NO: 159307 - protein, 10 aa, Artificial Sequence
  Description of Artificial Sequence: Synthetic peptide
  Seed: KEEQYIAQFT (PRAME_HUMAN)
KEEQYIAQFV

SEQ ID NO: 159308 - protein, 10 aa, Artificial Sequence
  Description of Artificial Sequence: Synthetic peptide
  Seed: LETLSITNCR (PRAME_HUMAN)
LFTLSITNCR

SEQ ID NO: 159309 - protein, 9 aa, Artificial Sequence
  Description of Artificial Sequence: Synthetic peptide
  Seed: RLRELLCEL (PRAME_HUMAN)
RIRELLCEM

SEQ ID NO: 159310 - protein, 10 aa, Artificial Sequence
  Description of Artificial Sequence: Synthetic peptide
  Seed: SALQSLLQHL (PRAME_HUMAN)
SDLQSLLQHV

SEQ ID NO: 159311 - protein, 11 aa, Artificial Sequence
  Description of Artificial Sequence: Synthetic peptide
  Seed: SIEDLEVTCTW (PRAME_HUMAN)
SSEDLEVTCTW

SEQ ID NO: 159312 - protein, 10 aa, Artificial Sequence
  Description of Artificial Sequence: Synthetic peptide
  Seed: MLTDVSPEPL (PRAME_HUMAN)
MATDVSPEPL

SEQ ID NO: 159313 - protein, 9 aa, Artificial Sequence
  Description of Artificial Sequence: Synthetic peptide
  Seed: ALLPSLSHC (PRAME_HUMAN)
ALLPSLSHM

SEQ ID NO: 159314 - protein, 10 aa, Artificial Sequence
  Description of Artificial Sequence: Synthetic peptide
  Seed: YIAQFTSQFL (PRAME_HUMAN)
YMAQFTSQFI

SEQ ID NO: 159315 - protein, 9 aa, Artificial Sequence
  Description of Artificial Sequence: Synthetic peptide
  Seed: YIAQFTSQF (PRAME_HUMAN)
YVAQFTSQY

SEQ ID NO: 159316 - protein, 11 aa, Artificial Sequence
  Description of Artificial Sequence: Synthetic peptide
  Seed: KAVLDGLDVLL (PRAME_HUMAN)
KMVLDGLDVLF

SEQ ID NO: 159317 - protein, 9 aa, Artificial Sequence
  Description of Artificial Sequence: Synthetic peptide
  Seed: SHIHASSYI (PRAME_HUMAN)
SAIHASSYY

SEQ ID NO: 159318 - protein, 8 aa, Artificial Sequence
  Description of Artificial Sequence: Synthetic peptide
  Seed: YEDIHGTL (PRAME_HUMAN)
YTDIHGTL

SEQ ID NO: 159319 - protein, 10 aa, Artificial Sequence
  Description of Artificial Sequence: Synthetic peptide
  Seed: FAMPMQDIKM (PRAME_HUMAN)
FVMPMQDIKI

SEQ ID NO: 159320 - protein, 9 aa, Artificial Sequence
  Description of Artificial Sequence: Synthetic peptide
  Seed: CSQLTTLSF (PRAME_HUMAN)
CSQLTTLSY

SEQ ID NO: 159321 - protein, 9 aa, Artificial Sequence
  Description of Artificial Sequence: Synthetic peptide
  Seed: VSPEPLQAL (PRAME_HUMAN)
VLPEPLQAV

SEQ ID NO: 159322 - protein, 9 aa, Artificial Sequence
  Description of Artificial Sequence: Synthetic peptide
  Seed: SPEPLQALL (PRAME_HUMAN)
SAEPLQALM

SEQ ID NO: 159323 - protein, 11 aa, Artificial Sequence
  Description of Artificial Sequence: Synthetic peptide
  Seed: SMSVWTSPRRL (PRAME_HUMAN)
SLSVWTSPRRV

SEQ ID NO: 159324 - protein, 10 aa, Artificial Sequence
  Description of Artificial Sequence: Synthetic peptide
  Seed: ALQSLLQHLI (PRAME_HUMAN)
ALQSLLQHLL

SEQ ID NO: 159325 - protein, 10 aa, Artificial Sequence
  Description of Artificial Sequence: Synthetic peptide
  Seed: ILKMVQLDSI (PRAME_HUMAN)
ILKMVQLDSV

SEQ ID NO: 159326 - protein, 10 aa, Artificial Sequence
  Description of Artificial Sequence: Synthetic peptide
  Seed: KDEALAIAAL (PRAME_HUMAN)
KDEALAIAAA

SEQ ID NO: 159327 - protein, 9 aa, Artificial Sequence
  Description of Artificial Sequence: Synthetic peptide
  Seed: RWKLQVLDL (PRAME_HUMAN)
RTKLQVLDI

SEQ ID NO: 159328 - protein, 8 aa, Artificial Sequence
  Description of Artificial Sequence: Synthetic peptide
  Seed: VELAGQSL (PRAME_HUMAN)
VQLAGQSV

SEQ ID NO: 159329 - protein, 9 aa, Artificial Sequence
  Description of Artificial Sequence: Synthetic peptide
  Seed: KAMVQAWPF (PRAME_HUMAN)
KAMVQAWPI

SEQ ID NO: 159330 - protein, 9 aa, Artificial Sequence
  Description of Artificial Sequence: Synthetic peptide
  Seed: LSNLTHVLY (PRAME_HUMAN)
LHNLTHVLF

SEQ ID NO: 159331 - protein, 10 aa, Artificial Sequence
  Description of Artificial Sequence: Synthetic peptide
  Seed: IGLSNLTHVL (PRAME_HUMAN)
ICLSNLTHVI

SEQ ID NO: 159332 - protein, 8 aa, Artificial Sequence
  Description of Artificial Sequence: Synthetic peptide
  Seed: YEDIHGTL (PRAME_HUMAN)
YADIHGTM

SEQ ID NO: 159333 - protein, 9 aa, Artificial Sequence
  Description of Artificial Sequence: Synthetic peptide
  Seed: LSLQCLQAL (PRAME_HUMAN)
LSLQCLQAF

SEQ ID NO: 159334 - protein, 11 aa, Artificial Sequence
  Description of Artificial Sequence: Synthetic peptide
  Seed: QALYVDSLFFL (PRAME_HUMAN)
QRLYVDSLFFF

SEQ ID NO: 159335 - protein, 9 aa, Artificial Sequence
  Description of Artificial Sequence: Synthetic peptide
  Seed: RELFPPLFM (PRAME_HUMAN)
RELFPPLFW

SEQ ID NO: 159336 - protein, 9 aa, Artificial Sequence
  Description of Artificial Sequence: Synthetic peptide
  Seed: FPPLFMAAF (PRAME_HUMAN)
FMPLFMAAL

SEQ ID NO: 159337 - protein, 9 aa, Artificial Sequence
  Description of Artificial Sequence: Synthetic peptide
  Seed: ELFPPLFMA (PRAME_HUMAN)
EVFPPLFML

SEQ ID NO: 159338 - protein, 10 aa, Artificial Sequence
  Description of Artificial Sequence: Synthetic peptide
  Seed: AMVQAWPFTC (PRAME_HUMAN)
ADVQAWPFTV

SEQ ID NO: 159339 - protein, 10 aa, Artificial Sequence
  Description of Artificial Sequence: Synthetic peptide
  Seed: ISMSVWTSPR (PRAME_HUMAN)
IAMSVWTSPK

SEQ ID NO: 159340 - protein, 9 aa, Artificial Sequence
  Description of Artificial Sequence: Synthetic peptide
  Seed: SFYGNSISI (PRAME_HUMAN)
SWYGNSISF

SEQ ID NO: 159341 - protein, 10 aa, Artificial Sequence
  Description of Artificial Sequence: Synthetic peptide
  Seed: AAFDGRHSQT (PRAME_HUMAN)
ASFDGRHSQV

SEQ ID NO: 159342 - protein, 10 aa, Artificial Sequence
  Description of Artificial Sequence: Synthetic peptide
  Seed: YIAQFTSQFL (PRAME_HUMAN)
YVAQFTSQFV

SEQ ID NO: 159343 - protein, 9 aa, Artificial Sequence
  Description of Artificial Sequence: Synthetic peptide
  Seed: YISMSVWTS (PRAME_HUMAN)
YSSMSVWTV

SEQ ID NO: 159344 - protein, 10 aa, Artificial Sequence
  Description of Artificial Sequence: Synthetic peptide
  Seed: LIGLSNLTHV (PRAME_HUMAN)
LMGLSNLTHL

SEQ ID NO: 159345 - protein, 9 aa, Artificial Sequence
  Description of Artificial Sequence: Synthetic peptide
  Seed: QTLKAMVQA (PRAME_HUMAN)
QMLKAMVQV

SEQ ID NO: 159346 - protein, 10 aa, Artificial Sequence
  Description of Artificial Sequence: Synthetic peptide
  Seed: RASATLQDLV (PRAME_HUMAN)
RSSATLQDLM

SEQ ID NO: 159347 - protein, 9 aa, Artificial Sequence
  Description of Artificial Sequence: Synthetic peptide
  Seed: SFYGNSISI (PRAME_HUMAN)
SGYGNSISM

SEQ ID NO: 159348 - protein, 10 aa, Artificial Sequence
  Description of Artificial Sequence: Synthetic peptide
  Seed: RELFPPLFMA (PRAME_HUMAN)
RWLFPPLFMT

SEQ ID NO: 159349 - protein, 9 aa, Artificial Sequence
  Description of Artificial Sequence: Synthetic peptide
  Seed: QALYVDSLF (PRAME_HUMAN)
QILYVDSLW

SEQ ID NO: 159350 - protein, 8 aa, Artificial Sequence
  Description of Artificial Sequence: Synthetic peptide
  Seed: ITDDQLLA (PRAME_HUMAN)
IIDDQLLL

SEQ ID NO: 159351 - protein, 9 aa, Artificial Sequence
  Description of Artificial Sequence: Synthetic peptide
  Seed: HARLRELLC (PRAME_HUMAN)
HMRLRELLM

SEQ ID NO: 159352 - protein, 10 aa, Artificial Sequence
  Description of Artificial Sequence: Synthetic peptide
  Seed: VTCTWKLPTL (PRAME_HUMAN)
VSCTWKLPTF

SEQ ID NO: 159353 - protein, 10 aa, Artificial Sequence
  Description of Artificial Sequence: Synthetic peptide
  Seed: VMNPLETLSI (PRAME_HUMAN)
VVNPLETLSF

SEQ ID NO: 159354 - protein, 9 aa, Artificial Sequence
  Description of Artificial Sequence: Synthetic peptide
  Seed: LVELAGQSL (PRAME_HUMAN)
LFELAGQSM

SEQ ID NO: 159355 - protein, 10 aa, Artificial Sequence
  Description of Artificial Sequence: Synthetic peptide
  Seed: RLWGSIQSRY (PRAME_HUMAN)
RAWGSIQSRK

SEQ ID NO: 159356 - protein, 9 aa, Artificial Sequence
  Description of Artificial Sequence: Synthetic peptide
  Seed: TLAKFSPYL (PRAME_HUMAN)
TYAKFSPYM

SEQ ID NO: 159357 - protein, 10 aa, Artificial Sequence
  Description of Artificial Sequence: Synthetic peptide
  Seed: RGRLDQLLRH (PRAME_HUMAN)
RFRLDQLLRI

SEQ ID NO: 159358 - protein, 10 aa, Artificial Sequence
  Description of Artificial Sequence: Synthetic peptide
  Seed: ITDDQLLALL (PRAME_HUMAN)
ILDDQLLALV

SEQ ID NO: 159359 - protein, 10 aa, Artificial Sequence
  Description of Artificial Sequence: Synthetic peptide
  Seed: ARLRELLCEL (PRAME_HUMAN)
ALLRELLCEA

SEQ ID NO: 159360 - protein, 9 aa, Artificial Sequence
  Description of Artificial Sequence: Synthetic peptide
  Seed: YSFPEPEAA (PRAME_HUMAN)
YRFPEPEAM

SEQ ID NO: 159361 - protein, 10 aa, Artificial Sequence
  Description of Artificial Sequence: Synthetic peptide
  Seed: RHVMNPLETL (PRAME_HUMAN)
RSVMNPLETI

SEQ ID NO: 159362 - protein, 10 aa, Artificial Sequence
  Description of Artificial Sequence: Synthetic peptide
  Seed: SLLKDEALAI (PRAME_HUMAN)
SYLKDEALAV

SEQ ID NO: 159363 - protein, 10 aa, Artificial Sequence
  Description of Artificial Sequence: Synthetic peptide
  Seed: RRWKLQVLDL (PRAME_HUMAN)
RRWKLQVLDW

SEQ ID NO: 159364 - protein, 9 aa, Artificial Sequence
  Description of Artificial Sequence: Synthetic peptide
  Seed: FYDPEPILC (PRAME_HUMAN)
FTDPEPILF

SEQ ID NO: 159365 - protein, 9 aa, Artificial Sequence
  Description of Artificial Sequence: Synthetic peptide
  Seed: LSTEAEQPF (PRAME_HUMAN)
LATEAEQPM

SEQ ID NO: 159366 - protein, 10 aa, Artificial Sequence
  Description of Artificial Sequence: Synthetic peptide
  Seed: ALELLPRELF (PRAME_HUMAN)
AEELLPRELY

SEQ ID NO: 159367 - protein, 11 aa, Artificial Sequence
  Description of Artificial Sequence: Synthetic peptide
  Seed: RASATLQDLVF (PRAME_HUMAN)
RHSATLQDLVW

SEQ ID NO: 159368 - protein, 11 aa, Artificial Sequence
  Description of Artificial Sequence: Synthetic peptide
  Seed: LVELAGQSLLK (PRAME_HUMAN)
LTELAGQSLLY

SEQ ID NO: 159369 - protein, 9 aa, Artificial Sequence
  Description of Artificial Sequence: Synthetic peptide
  Seed: ESYEDIHGT (PRAME_HUMAN)
ESYEDIHGI

SEQ ID NO: 159370 - protein, 9 aa, Artificial Sequence
  Description of Artificial Sequence: Synthetic peptide
  Seed: RASATLQDL (PRAME_HUMAN)
RMSATLQDV

SEQ ID NO: 159371 - protein, 9 aa, Artificial Sequence
  Description of Artificial Sequence: Synthetic peptide
  Seed: LKMVQLDSI (PRAME_HUMAN)
LSMVQLDSF

SEQ ID NO: 159372 - protein, 9 aa, Artificial Sequence
  Description of Artificial Sequence: Synthetic peptide
  Seed: MHLSQSPSV (PRAME_HUMAN)
MFLSQSPSF

SEQ ID NO: 159373 - protein, 9 aa, Artificial Sequence
  Description of Artificial Sequence: Synthetic peptide
  Seed: YIAQFTSQF (PRAME_HUMAN)
YSAQFTSQL

SEQ ID NO: 159374 - protein, 10 aa, Artificial Sequence
  Description of Artificial Sequence: Synthetic peptide
  Seed: CCKKLKIFAM (PRAME_HUMAN)
CIKKLKIFAL

SEQ ID NO: 159375 - protein, 9 aa, Artificial Sequence
  Description of Artificial Sequence: Synthetic peptide
  Seed: YLHARLREL (PRAME_HUMAN)
YYHARLREA

SEQ ID NO: 159376 - protein, 10 aa, Artificial Sequence
  Description of Artificial Sequence: Synthetic peptide
  Seed: RRWKLQVLDL (PRAME_HUMAN)
RRWKLQVLDH

SEQ ID NO: 159377 - protein, 9 aa, Artificial Sequence
  Description of Artificial Sequence: Synthetic peptide
  Seed: ERLAYLHAR (PRAME_HUMAN)
EVLAYLHAK

SEQ ID NO: 159378 - protein, 10 aa, Artificial Sequence
  Description of Artificial Sequence: Synthetic peptide
  Seed: ITDDQLLALL (PRAME_HUMAN)
ILDDQLLALM

SEQ ID NO: 159379 - protein, 10 aa, Artificial Sequence
  Description of Artificial Sequence: Synthetic peptide
  Seed: VLDGLDVLLA (PRAME_HUMAN)
VIDGLDVLLL

SEQ ID NO: 159380 - protein, 9 aa, Artificial Sequence
  Description of Artificial Sequence: Synthetic peptide
  Seed: QPFIPVEVL (PRAME_HUMAN)
QPFIPVEVY

SEQ ID NO: 159381 - protein, 10 aa, Artificial Sequence
  Description of Artificial Sequence: Synthetic peptide
  Seed: AVLDGLDVLL (PRAME_HUMAN)
AVLDGLDVLI

SEQ ID NO: 159382 - protein, 9 aa, Artificial Sequence
  Description of Artificial Sequence: Synthetic peptide
  Seed: LSTEAEQPF (PRAME_HUMAN)
LVTEAEQPM

SEQ ID NO: 159383 - protein, 11 aa, Artificial Sequence
  Description of Artificial Sequence: Synthetic peptide
  Seed: LQSLLQHLIGL (PRAME_HUMAN)
LCSLLQHLIGV

SEQ ID NO: 159384 - protein, 9 aa, Artificial Sequence
  Description of Artificial Sequence: Synthetic peptide
  Seed: RHSQTLKAM (PRAME_HUMAN)
RASQTLKAF

SEQ ID NO: 159385 - protein, 10 aa, Artificial Sequence
  Description of Artificial Sequence: Synthetic peptide
  Seed: ALYVDSLFFL (PRAME_HUMAN)
AMYVDSLFFW

SEQ ID NO: 159386 - protein, 9 aa, Artificial Sequence
  Description of Artificial Sequence: Synthetic peptide
  Seed: IGLSNLTHV (PRAME_HUMAN)
IALSNLTHV

SEQ ID NO: 159387 - protein, 9 aa, Artificial Sequence
  Description of Artificial Sequence: Synthetic peptide
  Seed: HLIGLSNLT (PRAME_HUMAN)
HMIGLSNLA

SEQ ID NO: 159388 - protein, 9 aa, Artificial Sequence
  Description of Artificial Sequence: Synthetic peptide
  Seed: TLAKFSPYL (PRAME_HUMAN)
TVAKFSPYV

SEQ ID NO: 159389 - protein, 10 aa, Artificial Sequence
  Description of Artificial Sequence: Synthetic peptide
  Seed: QSLLQHLIGL (PRAME_HUMAN)
QALLQHLIGI

SEQ ID NO: 159390 - protein, 10 aa, Artificial Sequence
  Description of Artificial Sequence: Synthetic peptide
  Seed: RASATLQDLV (PRAME_HUMAN)
RQSATLQDLI

SEQ ID NO: 159391 - protein, 9 aa, Artificial Sequence
  Description of Artificial Sequence: Synthetic peptide
  Seed: LLLSHIHAS (PRAME_HUMAN)
LMLSHIHAI

SEQ ID NO: 159392 - protein, 11 aa, Artificial Sequence
  Description of Artificial Sequence: Synthetic peptide
  Seed: AAFDGRHSQTL (PRAME_HUMAN)
AMFDGRHSQTV

SEQ ID NO: 159393 - protein, 9 aa, Artificial Sequence
  Description of Artificial Sequence: Synthetic peptide
  Seed: LQALYVDSL (PRAME_HUMAN)
LLALYVDSF

SEQ ID NO: 159394 - protein, 11 aa, Artificial Sequence
  Description of Artificial Sequence: Synthetic peptide
  Seed: SIQSRYISMSV (PRAME_HUMAN)
SSQSRYISMSK

SEQ ID NO: 159395 - protein, 10 aa, Artificial Sequence
  Description of Artificial Sequence: Synthetic peptide
  Seed: VWSGNRASLY (PRAME_HUMAN)
VFSGNRASLY

SEQ ID NO: 159396 - protein, 10 aa, Artificial Sequence
  Description of Artificial Sequence: Synthetic peptide
  Seed: ERLAYLHARL (PRAME_HUMAN)
EILAYLHARV

SEQ ID NO: 159397 - protein, 10 aa, Artificial Sequence
  Description of Artificial Sequence: Synthetic peptide
  Seed: MVQAWPFTCL (PRAME_HUMAN)
MMQAWPFTCL

SEQ ID NO: 159398 - protein, 9 aa, Artificial Sequence
  Description of Artificial Sequence: Synthetic peptide
  Seed: YIAQFTSQF (PRAME_HUMAN)
YWAQFTSQL

SEQ ID NO: 159399 - protein, 9 aa, Artificial Sequence
  Description of Artificial Sequence: Synthetic peptide
  Seed: ITDDQLLAL (PRAME_HUMAN)
IWDDQLLAV

SEQ ID NO: 159400 - protein, 9 aa, Artificial Sequence
  Description of Artificial Sequence: Synthetic peptide
  Seed: LQHLIGLSN (PRAME_HUMAN)
LVHLIGLSF

SEQ ID NO: 159401 - protein, 9 aa, Artificial Sequence
  Description of Artificial Sequence: Synthetic peptide
  Seed: RWKLQVLDL (PRAME_HUMAN)
RFKLQVLDK

SEQ ID NO: 159402 - protein, 9 aa, Artificial Sequence
  Description of Artificial Sequence: Synthetic peptide
  Seed: RTFYDPEPI (PRAME_HUMAN)
REFYDPEPM

SEQ ID NO: 159403 - protein, 9 aa, Artificial Sequence
  Description of Artificial Sequence: Synthetic peptide
  Seed: NSISISALQ (PRAME_HUMAN)
NNISISALR

SEQ ID NO: 159404 - protein, 9 aa, Artificial Sequence
  Description of Artificial Sequence: Synthetic peptide
  Seed: LQDLVFDEC (PRAME_HUMAN)
LLDLVFDEM

SEQ ID NO: 159405 - protein, 9 aa, Artificial Sequence
  Description of Artificial Sequence: Synthetic peptide
  Seed: RLSEGDVMH (PRAME_HUMAN)
RMSEGDVMY

SEQ ID NO: 159406 - protein, 10 aa, Artificial Sequence
  Description of Artificial Sequence: Synthetic peptide
  Seed: HASSYISPEK (PRAME_HUMAN)
HMSSYISPER

SEQ ID NO: 159407 - protein, 9 aa, Artificial Sequence
  Description of Artificial Sequence: Synthetic peptide
  Seed: RELLCELGR (PRAME_HUMAN)
RMLLCELGR

SEQ ID NO: 159408 - protein, 10 aa, Artificial Sequence
  Description of Artificial Sequence: Synthetic peptide
  Seed: ARLRELLCEL (PRAME_HUMAN)
APLRELLCEL

SEQ ID NO: 159409 - protein, 9 aa, Artificial Sequence
  Description of Artificial Sequence: Synthetic peptide
  Seed: ELAGQSLLK (PRAME_HUMAN)
ELAGQSLLR

SEQ ID NO: 159410 - protein, 9 aa, Artificial Sequence
  Description of Artificial Sequence: Synthetic peptide
  Seed: SFYGNSISI (PRAME_HUMAN)
SEYGNSISI

SEQ ID NO: 159411 - protein, 9 aa, Artificial Sequence
  Description of Artificial Sequence: Synthetic peptide
  Seed: MNPLETLSI (PRAME_HUMAN)
MTPLETLSL

SEQ ID NO: 159412 - protein, 10 aa, Artificial Sequence
  Description of Artificial Sequence: Synthetic peptide
  Seed: CSQLTTLSFY (PRAME_HUMAN)
CIQLTTLSFY

SEQ ID NO: 159413 - protein, 9 aa, Artificial Sequence
  Description of Artificial Sequence: Synthetic peptide
  Seed: RLWGSIQSR (PRAME_HUMAN)
RRWGSIQSY

SEQ ID NO: 159414 - protein, 10 aa, Artificial Sequence
  Description of Artificial Sequence: Synthetic peptide
  Seed: RLRELLCELG (PRAME_HUMAN)
RIRELLCELV

SEQ ID NO: 159415 - protein, 9 aa, Artificial Sequence
  Description of Artificial Sequence: Synthetic peptide
  Seed: NSISISALQ (PRAME_HUMAN)
NTISISALR

SEQ ID NO: 159416 - protein, 9 aa, Artificial Sequence
  Description of Artificial Sequence: Synthetic peptide
  Seed: RRLWGSIQS (PRAME_HUMAN)
RRLWGSIQI

SEQ ID NO: 159417 - protein, 11 aa, Artificial Sequence
  Description of Artificial Sequence: Synthetic peptide
  Seed: RRWKLQVLDLR (PRAME_HUMAN)
RRWKLQVLDLF

SEQ ID NO: 159418 - protein, 10 aa, Artificial Sequence
  Description of Artificial Sequence: Synthetic peptide
  Seed: LSFYGNSISI (PRAME_HUMAN)
LYFYGNSISM

SEQ ID NO: 159419 - protein, 11 aa, Artificial Sequence
  Description of Artificial Sequence: Synthetic peptide
  Seed: RLVELAGQSLL (PRAME_HUMAN)
RQVELAGQSLV

SEQ ID NO: 159420 - protein, 10 aa, Artificial Sequence
  Description of Artificial Sequence: Synthetic peptide
  Seed: RRLWGSIQSR (PRAME_HUMAN)
RRLWGSIQSW

SEQ ID NO: 159421 - protein, 10 aa, Artificial Sequence
  Description of Artificial Sequence: Synthetic peptide
  Seed: RLVELAGQSL (PRAME_HUMAN)
RRVELAGQSY

SEQ ID NO: 159422 - protein, 11 aa, Artificial Sequence
  Description of Artificial Sequence: Synthetic peptide
  Seed: SQSPSVSQLSV (PRAME_HUMAN)
SLSPSVSQLSL

SEQ ID NO: 159423 - protein, 9 aa, Artificial Sequence
  Description of Artificial Sequence: Synthetic peptide
  Seed: VWSGNRASL (PRAME_HUMAN)
VISGNRASL

SEQ ID NO: 159424 - protein, 9 aa, Artificial Sequence
  Description of Artificial Sequence: Synthetic peptide
  Seed: IGLSNLTHV (PRAME_HUMAN)
IQLSNLTHV

SEQ ID NO: 159425 - protein, 9 aa, Artificial Sequence
  Description of Artificial Sequence: Synthetic peptide
  Seed: FLRGRLDQL (PRAME_HUMAN)
FIRGRLDQV

SEQ ID NO: 159426 - protein, 10 aa, Artificial Sequence
  Description of Artificial Sequence: Synthetic peptide
  Seed: LSFYGNSISI (PRAME_HUMAN)
LHFYGNSISF

SEQ ID NO: 159427 - protein, 9 aa, Artificial Sequence
  Description of Artificial Sequence: Synthetic peptide
  Seed: GACDELFSY (PRAME_HUMAN)
GQCDELFSF

SEQ ID NO: 159428 - protein, 10 aa, Artificial Sequence
  Description of Artificial Sequence: Synthetic peptide
  Seed: AALELLPREL (PRAME_HUMAN)
AMLELLPREI

SEQ ID NO: 159429 - protein, 9 aa, Artificial Sequence
  Description of Artificial Sequence: Synthetic peptide
  Seed: QALYVDSLF (PRAME_HUMAN)
QALYVDSLY

SEQ ID NO: 159430 - protein, 11 aa, Artificial Sequence
  Description of Artificial Sequence: Synthetic peptide
  Seed: KIFAMPMQDIK (PRAME_HUMAN)
KVFAMPMQDIR

SEQ ID NO: 159431 - protein, 10 aa, Artificial Sequence
  Description of Artificial Sequence: Synthetic peptide
  Seed: PTLAKFSPYL (PRAME_HUMAN)
PILAKFSPYV

SEQ ID NO: 159432 - protein, 10 aa, Artificial Sequence
  Description of Artificial Sequence: Synthetic peptide
  Seed: YIAQFTSQFL (PRAME_HUMAN)
YQAQFTSQFM

SEQ ID NO: 159433 - protein, 9 aa, Artificial Sequence
  Description of Artificial Sequence: Synthetic peptide
  Seed: ISISALQSL (PRAME_HUMAN)
IQISALQSY

SEQ ID NO: 159434 - protein, 10 aa, Artificial Sequence
  Description of Artificial Sequence: Synthetic peptide
  Seed: RPRRWKLQVL (PRAME_HUMAN)
RRRRWKLQVM

SEQ ID NO: 159435 - protein, 9 aa, Artificial Sequence
  Description of Artificial Sequence: Synthetic peptide
  Seed: CRLSEGDVM (PRAME_HUMAN)
CHLSEGDVM

SEQ ID NO: 159436 - protein, 9 aa, Artificial Sequence
  Description of Artificial Sequence: Synthetic peptide
  Seed: EQPFIPVEV (PRAME_HUMAN)
EHPFIPVEL

SEQ ID NO: 159437 - protein, 8 aa, Artificial Sequence
  Description of Artificial Sequence: Synthetic peptide
  Seed: TDDQLLAL (PRAME_HUMAN)
TGDQLLAL

SEQ ID NO: 159438 - protein, 9 aa, Artificial Sequence
  Description of Artificial Sequence: Synthetic peptide
  Seed: QDIKMILKM (PRAME_HUMAN)
QEIKMILKL

SEQ ID NO: 159439 - protein, 9 aa, Artificial Sequence
  Description of Artificial Sequence: Synthetic peptide
  Seed: VSPEPLQAL (PRAME_HUMAN)
VPPEPLQAF

SEQ ID NO: 159440 - protein, 9 aa, Artificial Sequence
  Description of Artificial Sequence: Synthetic peptide
  Seed: YGNSISISA (PRAME_HUMAN)
YINSISISY

SEQ ID NO: 159441 - protein, 9 aa, Artificial Sequence
  Description of Artificial Sequence: Synthetic peptide
  Seed: FMAAFDGRH (PRAME_HUMAN)
FLAAFDGRF

SEQ ID NO: 159442 - protein, 10 aa, Artificial Sequence
  Description of Artificial Sequence: Synthetic peptide
  Seed: FAMPMQDIKM (PRAME_HUMAN)
FSMPMQDIKF

SEQ ID NO: 159443 - protein, 9 aa, Artificial Sequence
  Description of Artificial Sequence: Synthetic peptide
  Seed: RLRELLCEL (PRAME_HUMAN)
RPRELLCEA

SEQ ID NO: 159444 - protein, 9 aa, Artificial Sequence
  Description of Artificial Sequence: Synthetic peptide
  Seed: TDDQLLALL (PRAME_HUMAN)
TIDQLLALI

SEQ ID NO: 159445 - protein, 9 aa, Artificial Sequence
  Description of Artificial Sequence: Synthetic peptide
  Seed: KLKIFAMPM (PRAME_HUMAN)
KVKIFAMPW

SEQ ID NO: 159446 - protein, 11 aa, Artificial Sequence
  Description of Artificial Sequence: Synthetic peptide
  Seed: GITDDQLLALL (PRAME_HUMAN)
GQTDDQLLALF

SEQ ID NO: 159447 - protein, 9 aa, Artificial Sequence
  Description of Artificial Sequence: Synthetic peptide
  Seed: SMSVWTSPR (PRAME_HUMAN)
SVSVWTSPK

SEQ ID NO: 159448 - protein, 9 aa, Artificial Sequence
  Description of Artificial Sequence: Synthetic peptide
  Seed: KMILKMVQL (PRAME_HUMAN)
KMILKMVQW

SEQ ID NO: 159449 - protein, 10 aa, Artificial Sequence
  Description of Artificial Sequence: Synthetic peptide
  Seed: KAVLDGLDVL (PRAME_HUMAN)
KSVLDGLDVV

SEQ ID NO: 159450 - protein, 11 aa, Artificial Sequence
  Description of Artificial Sequence: Synthetic peptide
  Seed: LLSHIHASSYI (PRAME_HUMAN)
LMSHIHASSYL

SEQ ID NO: 159451 - protein, 10 aa, Artificial Sequence
  Description of Artificial Sequence: Synthetic peptide
  Seed: QSLLQHLIGL (PRAME_HUMAN)
QTLLQHLIGI

SEQ ID NO: 159452 - protein, 9 aa, Artificial Sequence
  Description of Artificial Sequence: Synthetic peptide
  Seed: ELFPPLFMA (PRAME_HUMAN)
EVFPPLFMM

SEQ ID NO: 159453 - protein, 8 aa, Artificial Sequence
  Description of Artificial Sequence: Synthetic peptide
  Seed: LKIFAMPM (PRAME_HUMAN)
LQIFAMPL

SEQ ID NO: 159454 - protein, 9 aa, Artificial Sequence
  Description of Artificial Sequence: Synthetic peptide
  Seed: TLHLERLAY (PRAME_HUMAN)
TMHLERLAM

SEQ ID NO: 159455 - protein, 9 aa, Artificial Sequence
  Description of Artificial Sequence: Synthetic peptide
  Seed: FLRGRLDQL (PRAME_HUMAN)
FLRGRLDQV

SEQ ID NO: 159456 - protein, 9 aa, Artificial Sequence
  Description of Artificial Sequence: Synthetic peptide
  Seed: GNRASLYSF (PRAME_HUMAN)
GMRASLYSY

SEQ ID NO: 159457 - protein, 9 aa, Artificial Sequence
  Description of Artificial Sequence: Synthetic peptide
  Seed: SQLSVLSLS (PRAME_HUMAN)
SQLSVLSLL

SEQ ID NO: 159458 - protein, 8 aa, Artificial Sequence
  Description of Artificial Sequence: Synthetic peptide
  Seed: ITDDQLLA (PRAME_HUMAN)
INDDQLLL

SEQ ID NO: 159459 - protein, 9 aa, Artificial Sequence
  Description of Artificial Sequence: Synthetic peptide
  Seed: SIEDLEVTC (PRAME_HUMAN)
SIEDLEVTM

SEQ ID NO: 159460 - protein, 9 aa, Artificial Sequence
  Description of Artificial Sequence: Synthetic peptide
  Seed: ELFSYLIEK (PRAME_HUMAN)
EVFSYLIEK

SEQ ID NO: 159461 - protein, 9 aa, Artificial Sequence
  Description of Artificial Sequence: Synthetic peptide
  Seed: YSFPEPEAA (PRAME_HUMAN)
YIFPEPEAL

SEQ ID NO: 159462 - protein, 10 aa, Artificial Sequence
  Description of Artificial Sequence: Synthetic peptide
  Seed: MPMQDIKMIL (PRAME_HUMAN)
MQMQDIKMIV

SEQ ID NO: 159463 - protein, 9 aa, Artificial Sequence
  Description of Artificial Sequence: Synthetic peptide
  Seed: RHSQTLKAM (PRAME_HUMAN)
RKSQTLKAY

SEQ ID NO: 159464 - protein, 10 aa, Artificial Sequence
  Description of Artificial Sequence: Synthetic peptide
  Seed: QLLALLPSLS (PRAME_HUMAN)
QMLALLPSLL

SEQ ID NO: 159465 - protein, 9 aa, Artificial Sequence
  Description of Artificial Sequence: Synthetic peptide
  Seed: YIAQFTSQF (PRAME_HUMAN)
YWAQFTSQM

SEQ ID NO: 159466 - protein, 10 aa, Artificial Sequence
  Description of Artificial Sequence: Synthetic peptide
  Seed: EDLEVTCTWK (PRAME_HUMAN)
ELLEVTCTWR

SEQ ID NO: 159467 - protein, 8 aa, Artificial Sequence
  Description of Artificial Sequence: Synthetic peptide
  Seed: YEDIHGTL (PRAME_HUMAN)
YSDIHGTL

SEQ ID NO: 159468 - protein, 10 aa, Artificial Sequence
  Description of Artificial Sequence: Synthetic peptide
  Seed: DQLLALLPSL (PRAME_HUMAN)
DYLLALLPSL

SEQ ID NO: 159469 - protein, 10 aa, Artificial Sequence
  Description of Artificial Sequence: Synthetic peptide
  Seed: LSVLSLSGVM (PRAME_HUMAN)
LEVLSLSGVY

SEQ ID NO: 159470 - protein, 10 aa, Artificial Sequence
  Description of Artificial Sequence: Synthetic peptide
  Seed: YEDIHGTLHL (PRAME_HUMAN)
YTDIHGTLHL

SEQ ID NO: 159471 - protein, 9 aa, Artificial Sequence
  Description of Artificial Sequence: Synthetic peptide
  Seed: LMKGQHLHL (PRAME_HUMAN)
LLKGQHLHK

SEQ ID NO: 159472 - protein, 9 aa, Artificial Sequence
  Description of Artificial Sequence: Synthetic peptide
  Seed: QSRYISMSV (PRAME_HUMAN)
QTRYISMSS

SEQ ID NO: 159473 - protein, 10 aa, Artificial Sequence
  Description of Artificial Sequence: Synthetic peptide
  Seed: SISISALQSL (PRAME_HUMAN)
SMSISALQSF

SEQ ID NO: 159474 - protein, 9 aa, Artificial Sequence
  Description of Artificial Sequence: Synthetic peptide
  Seed: IGLSNLTHV (PRAME_HUMAN)
ITLSNLTHL

SEQ ID NO: 159475 - protein, 9 aa, Artificial Sequence
  Description of Artificial Sequence: Synthetic peptide
  Seed: ALLPSLSHC (PRAME_HUMAN)
ALLPSLSHV

SEQ ID NO: 159476 - protein, 10 aa, Artificial Sequence
  Description of Artificial Sequence: Synthetic peptide
  Seed: FAMPMQDIKM (PRAME_HUMAN)
FMMPMQDIKA

SEQ ID NO: 159477 - protein, 8 aa, Artificial Sequence
  Description of Artificial Sequence: Synthetic peptide
  Seed: ITDDQLLA (PRAME_HUMAN)
IQDDQLLL

SEQ ID NO: 159478 - protein, 10 aa, Artificial Sequence
  Description of Artificial Sequence: Synthetic peptide
  Seed: DFWTVWSGNR (PRAME_HUMAN)
DTWTVWSGNR

SEQ ID NO: 159479 - protein, 9 aa, Artificial Sequence
  Description of Artificial Sequence: Synthetic peptide
  Seed: KMILKMVQL (PRAME_HUMAN)
KSILKMVQW

SEQ ID NO: 159480 - protein, 10 aa, Artificial Sequence
  Description of Artificial Sequence: Synthetic peptide
  Seed: SNLTHVLYPV (PRAME_HUMAN)
SQLTHVLYPL

SEQ ID NO: 159481 - protein, 9 aa, Artificial Sequence
  Description of Artificial Sequence: Synthetic peptide
  Seed: VLDGLDVLL (PRAME_HUMAN)
VGDGLDVLI

SEQ ID NO: 159482 - protein, 11 aa, Artificial Sequence
  Description of Artificial Sequence: Synthetic peptide
  Seed: SLLKDEALAIA (PRAME_HUMAN)
SLLKDEALAIL

SEQ ID NO: 159483 - protein, 9 aa, Artificial Sequence
  Description of Artificial Sequence: Synthetic peptide
  Seed: YISMSVWTS (PRAME_HUMAN)
YISMSVWTM

SEQ ID NO: 159484 - protein, 10 aa, Artificial Sequence
  Description of Artificial Sequence: Synthetic peptide
  Seed: AQFTSQFLSL (PRAME_HUMAN)
ALFTSQFLSF

SEQ ID NO: 159485 - protein, 10 aa, Artificial Sequence
  Description of Artificial Sequence: Synthetic peptide
  Seed: SNLTHVLYPV (PRAME_HUMAN)
STLTHVLYPA

SEQ ID NO: 159486 - protein, 9 aa, Artificial Sequence
  Description of Artificial Sequence: Synthetic peptide
  Seed: ALLERASAT (PRAME_HUMAN)
AMLERASAL

SEQ ID NO: 159487 - protein, 9 aa, Artificial Sequence
  Description of Artificial Sequence: Synthetic peptide
  Seed: VQAWPFTCL (PRAME_HUMAN)
VHAWPFTCA

SEQ ID NO: 159488 - protein, 9 aa, Artificial Sequence
  Description of Artificial Sequence: Synthetic peptide
  Seed: ACDELFSYL (PRAME_HUMAN)
AMDELFSYA

SEQ ID NO: 159489 - protein, 8 aa, Artificial Sequence
  Description of Artificial Sequence: Synthetic peptide
  Seed: FYDPEPIL (PRAME_HUMAN)
FTDPEPIV

SEQ ID NO: 159490 - protein, 9 aa, Artificial Sequence
  Description of Artificial Sequence: Synthetic peptide
  Seed: AQFTSQFLS (PRAME_HUMAN)
AQFTSQFLM

SEQ ID NO: 159491 - protein, 9 aa, Artificial Sequence
  Description of Artificial Sequence: Synthetic peptide
  Seed: ACDELFSYL (PRAME_HUMAN)
ASDELFSYI

SEQ ID NO: 159492 - protein, 9 aa, Artificial Sequence
  Description of Artificial Sequence: Synthetic peptide
  Seed: KMILKMVQL (PRAME_HUMAN)
KIILKMVQV

SEQ ID NO: 159493 - protein, 9 aa, Artificial Sequence
  Description of Artificial Sequence: Synthetic peptide
  Seed: LLKDEALAI (PRAME_HUMAN)
LQKDEALAI

SEQ ID NO: 159494 - protein, 10 aa, Artificial Sequence
  Description of Artificial Sequence: Synthetic peptide
  Seed: RELFPPLFMA (PRAME_HUMAN)
RHLFPPLFMM

SEQ ID NO: 159495 - protein, 9 aa, Artificial Sequence
  Description of Artificial Sequence: Synthetic peptide
  Seed: CSQLTTLSF (PRAME_HUMAN)
CTQLTTLSF

SEQ ID NO: 159496 - protein, 9 aa, Artificial Sequence
  Description of Artificial Sequence: Synthetic peptide
  Seed: EAAQPMTKK (PRAME_HUMAN)
EIAQPMTKK

SEQ ID NO: 159497 - protein, 9 aa, Artificial Sequence
  Description of Artificial Sequence: Synthetic peptide
  Seed: ALYVDSLFF (PRAME_HUMAN)
AQYVDSLFF

SEQ ID NO: 159498 - protein, 9 aa, Artificial Sequence
  Description of Artificial Sequence: Synthetic peptide
  Seed: QLLALLPSL (PRAME_HUMAN)
QMLALLPST

SEQ ID NO: 159499 - protein, 11 aa, Artificial Sequence
  Description of Artificial Sequence: Synthetic peptide
  Seed: KLPTLAKFSPY (PRAME_HUMAN)
KMPTLAKFSPY

SEQ ID NO: 159500 - protein, 9 aa, Artificial Sequence
  Description of Artificial Sequence: Synthetic peptide
  Seed: SVWTSPRRL (PRAME_HUMAN)
SQWTSPRRL

SEQ ID NO: 159501 - protein, 9 aa, Artificial Sequence
  Description of Artificial Sequence: Synthetic peptide
  Seed: SISALQSLL (PRAME_HUMAN)
SQSALQSLL

SEQ ID NO: 159502 - protein, 10 aa, Artificial Sequence
  Description of Artificial Sequence: Synthetic peptide
  Seed: LLPRELFPPL (PRAME_HUMAN)
LEPRELFPPL

SEQ ID NO: 159503 - protein, 9 aa, Artificial Sequence
  Description of Artificial Sequence: Synthetic peptide
  Seed: LTDVSPEPL (PRAME_HUMAN)
LIDVSPEPL

SEQ ID NO: 159504 - protein, 9 aa, Artificial Sequence
  Description of Artificial Sequence: Synthetic peptide
  Seed: VWSGNRASL (PRAME_HUMAN)
VFSGNRASL

SEQ ID NO: 159505 - protein, 9 aa, Artificial Sequence
  Description of Artificial Sequence: Synthetic peptide
  Seed: SLQCLQALY (PRAME_HUMAN)
SFQCLQALY

SEQ ID NO: 159506 - protein, 9 aa, Artificial Sequence
  Description of Artificial Sequence: Synthetic peptide
  Seed: SQLTTLSFY (PRAME_HUMAN)
SKLTTLSFF

SEQ ID NO: 159507 - protein, 9 aa, Artificial Sequence
  Description of Artificial Sequence: Synthetic peptide
  Seed: EDIHGTLHL (PRAME_HUMAN)
EEIHGTLHV

SEQ ID NO: 159508 - protein, 10 aa, Artificial Sequence
  Description of Artificial Sequence: Synthetic peptide
  Seed: FIPVEVLVDL (PRAME_HUMAN)
FLPVEVLVDF

SEQ ID NO: 159509 - protein, 11 aa, Artificial Sequence
  Description of Artificial Sequence: Synthetic peptide
  Seed: MKGQHLHLETF (PRAME_HUMAN)
MNGQHLHLETF

SEQ ID NO: 159510 - protein, 9 aa, Artificial Sequence
  Description of Artificial Sequence: Synthetic peptide
  Seed: VQLDSIEDL (PRAME_HUMAN)
VELDSIEDM

SEQ ID NO: 159511 - protein, 9 aa, Artificial Sequence
  Description of Artificial Sequence: Synthetic peptide
  Seed: QMINLRRLL (PRAME_HUMAN)
QMINLRRLM

SEQ ID NO: 159512 - protein, 9 aa, Artificial Sequence
  Description of Artificial Sequence: Synthetic peptide
  Seed: LSLQCLQAL (PRAME_HUMAN)
LALQCLQAL

SEQ ID NO: 159513 - protein, 9 aa, Artificial Sequence
  Description of Artificial Sequence: Synthetic peptide
  Seed: THVLYPVPL (PRAME_HUMAN)
TKVLYPVPY

SEQ ID NO: 159514 - protein, 9 aa, Artificial Sequence
  Description of Artificial Sequence: Synthetic peptide
  Seed: VLSLSGVML (PRAME_HUMAN)
VLSLSGVMF

SEQ ID NO: 159515 - protein, 9 aa, Artificial Sequence
  Description of Artificial Sequence: Synthetic peptide
  Seed: VWSGNRASL (PRAME_HUMAN)
VFSGNRASW

SEQ ID NO: 159516 - protein, 9 aa, Artificial Sequence
  Description of Artificial Sequence: Synthetic peptide
  Seed: ACDELFSYL (PRAME_HUMAN)
AADELFSYY

SEQ ID NO: 159517 - protein, 9 aa, Artificial Sequence
  Description of Artificial Sequence: Synthetic peptide
  Seed: YIAQFTSQF (PRAME_HUMAN)
YIAQFTSQK

SEQ ID NO: 159518 - protein, 11 aa, Artificial Sequence
  Description of Artificial Sequence: Synthetic peptide
  Seed: KAVLDGLDVLL (PRAME_HUMAN)
KSVLDGLDVLF

SEQ ID NO: 159519 - protein, 10 aa, Artificial Sequence
  Description of Artificial Sequence: Synthetic peptide
  Seed: RLAYLHARLR (PRAME_HUMAN)
RWAYLHARLR

SEQ ID NO: 159520 - protein, 10 aa, Artificial Sequence
  Description of Artificial Sequence: Synthetic peptide
  Seed: HLERLAYLHA (PRAME_HUMAN)
HTERLAYLHA

SEQ ID NO: 159521 - protein, 10 aa, Artificial Sequence
  Description of Artificial Sequence: Synthetic peptide
  Seed: AMVQAWPFTC (PRAME_HUMAN)
AKVQAWPFTV

SEQ ID NO: 159522 - protein, 9 aa, Artificial Sequence
  Description of Artificial Sequence: Synthetic peptide
  Seed: LHLERLAYL (PRAME_HUMAN)
LRLERLAYM

SEQ ID NO: 159523 - protein, 10 aa, Artificial Sequence
  Description of Artificial Sequence: Synthetic peptide
  Seed: ALLERASATL (PRAME_HUMAN)
ALLERASATI

SEQ ID NO: 159524 - protein, 9 aa, Artificial Sequence
  Description of Artificial Sequence: Synthetic peptide
  Seed: KMILKMVQL (PRAME_HUMAN)
KVILKMVQW

SEQ ID NO: 159525 - protein, 11 aa, Artificial Sequence
  Description of Artificial Sequence: Synthetic peptide
  Seed: ISMSVWTSPRR (PRAME_HUMAN)
ILMSVWTSPRR

SEQ ID NO: 159526 - protein, 9 aa, Artificial Sequence
  Description of Artificial Sequence: Synthetic peptide
  Seed: CSQLTTLSF (PRAME_HUMAN)
CHQLTTLSY

SEQ ID NO: 159527 - protein, 8 aa, Artificial Sequence
  Description of Artificial Sequence: Synthetic peptide
  Seed: TDDQLLAL (PRAME_HUMAN)
TFDQLLAV

SEQ ID NO: 159528 - protein, 10 aa, Artificial Sequence
  Description of Artificial Sequence: Synthetic peptide
  Seed: KKLKIFAMPM (PRAME_HUMAN)
KILKIFAMPK

SEQ ID NO: 159529 - protein, 11 aa, Artificial Sequence
  Description of Artificial Sequence: Synthetic peptide
  Seed: KMVQLDSIEDL (PRAME_HUMAN)
KMVQLDSIEDF

SEQ ID NO: 159530 - protein, 8 aa, Artificial Sequence
  Description of Artificial Sequence: Synthetic peptide
  Seed: VKRKKNVL (PRAME_HUMAN)
VARKKNVL

SEQ ID NO: 159531 - protein, 10 aa, Artificial Sequence
  Description of Artificial Sequence: Synthetic peptide
  Seed: AVLDGLDVLL (PRAME_HUMAN)
AILDGLDVLM

SEQ ID NO: 159532 - protein, 9 aa, Artificial Sequence
  Description of Artificial Sequence: Synthetic peptide
  Seed: LQHLIGLSN (PRAME_HUMAN)
LLHLIGLSY

SEQ ID NO: 159533 - protein, 9 aa, Artificial Sequence
  Description of Artificial Sequence: Synthetic peptide
  Seed: RASATLQDL (PRAME_HUMAN)
RQSATLQDM

SEQ ID NO: 159534 - protein, 10 aa, Artificial Sequence
  Description of Artificial Sequence: Synthetic peptide
  Seed: CSQLTTLSFY (PRAME_HUMAN)
CLQLTTLSFF

SEQ ID NO: 159535 - protein, 10 aa, Artificial Sequence
  Description of Artificial Sequence: Synthetic peptide
  Seed: AIAALELLPR (PRAME_HUMAN)
ALAALELLPK

SEQ ID NO: 159536 - protein, 11 aa, Artificial Sequence
  Description of Artificial Sequence: Synthetic peptide
  Seed: AAFDGRHSQTL (PRAME_HUMAN)
ALFDGRHSQTY

SEQ ID NO: 159537 - protein, 9 aa, Artificial Sequence
  Description of Artificial Sequence: Synthetic peptide
  Seed: YIAQFTSQF (PRAME_HUMAN)
YQAQFTSQF

SEQ ID NO: 159538 - protein, 10 aa, Artificial Sequence
  Description of Artificial Sequence: Synthetic peptide
  Seed: VSPEPLQALL (PRAME_HUMAN)
VTPEPLQALF

SEQ ID NO: 159539 - protein, 9 aa, Artificial Sequence
  Description of Artificial Sequence: Synthetic peptide
  Seed: HVMNPLETL (PRAME_HUMAN)
HPMNPLETS

SEQ ID NO: 159540 - protein, 9 aa, Artificial Sequence
  Description of Artificial Sequence: Synthetic peptide
  Seed: AMVQAWPFT (PRAME_HUMAN)
ALVQAWPFI

SEQ ID NO: 159541 - protein, 9 aa, Artificial Sequence
  Description of Artificial Sequence: Synthetic peptide
  Seed: LHLETFKAV (PRAME_HUMAN)
LHLETFKAA

SEQ ID NO: 159542 - protein, 10 aa, Artificial Sequence
  Description of Artificial Sequence: Synthetic peptide
  Seed: RELFPPLFMA (PRAME_HUMAN)
RMLFPPLFMT

SEQ ID NO: 159543 - protein, 10 aa, Artificial Sequence
  Description of Artificial Sequence: Synthetic peptide
  Seed: LSFYGNSISI (PRAME_HUMAN)
LAFYGNSISW

SEQ ID NO: 159544 - protein, 10 aa, Artificial Sequence
  Description of Artificial Sequence: Synthetic peptide
  Seed: MNPLETLSIT (PRAME_HUMAN)
MNPLETLSIV

SEQ ID NO: 159545 - protein, 9 aa, Artificial Sequence
  Description of Artificial Sequence: Synthetic peptide
  Seed: LMKGQHLHL (PRAME_HUMAN)
LAKGQHLHY

SEQ ID NO: 159546 - protein, 9 aa, Artificial Sequence
  Description of Artificial Sequence: Synthetic peptide
  Seed: LQHLIGLSN (PRAME_HUMAN)
LQHLIGLSM

SEQ ID NO: 159547 - protein, 10 aa, Artificial Sequence
  Description of Artificial Sequence: Synthetic peptide
  Seed: FYDPEPILCP (PRAME_HUMAN)
FMDPEPILCL

SEQ ID NO: 159548 - protein, 9 aa, Artificial Sequence
  Description of Artificial Sequence: Synthetic peptide
  Seed: KLKIFAMPM (PRAME_HUMAN)
KIKIFAMPY

SEQ ID NO: 159549 - protein, 9 aa, Artificial Sequence
  Description of Artificial Sequence: Synthetic peptide
  Seed: SVWTSPRRL (PRAME_HUMAN)
SMWTSPRRF

SEQ ID NO: 159550 - protein, 10 aa, Artificial Sequence
  Description of Artificial Sequence: Synthetic peptide
  Seed: FIPVEVLVDL (PRAME_HUMAN)
FAPVEVLVDY

SEQ ID NO: 159551 - protein, 11 aa, Artificial Sequence
  Description of Artificial Sequence: Synthetic peptide
  Seed: FSPYLGQMINL (PRAME_HUMAN)
FIPYLGQMINF

SEQ ID NO: 159552 - protein, 9 aa, Artificial Sequence
  Description of Artificial Sequence: Synthetic peptide
  Seed: KNVLRLCCK (PRAME_HUMAN)
KTVLRLCCK

SEQ ID NO: 159553 - protein, 10 aa, Artificial Sequence
  Description of Artificial Sequence: Synthetic peptide
  Seed: ARLRELLCEL (PRAME_HUMAN)
AKLRELLCEV

SEQ ID NO: 159554 - protein, 9 aa, Artificial Sequence
  Description of Artificial Sequence: Synthetic peptide
  Seed: FYDPEPILC (PRAME_HUMAN)
FMDPEPILT

SEQ ID NO: 159555 - protein, 9 aa, Artificial Sequence
  Description of Artificial Sequence: Synthetic peptide
  Seed: MHLSQSPSV (PRAME_HUMAN)
MMLSQSPSV

SEQ ID NO: 159556 - protein, 11 aa, Artificial Sequence
  Description of Artificial Sequence: Synthetic peptide
  Seed: RLWGSIQSRYI (PRAME_HUMAN)
RIWGSIQSRYW

SEQ ID NO: 159557 - protein, 10 aa, Artificial Sequence
  Description of Artificial Sequence: Synthetic peptide
  Seed: SLLQHLIGLS (PRAME_HUMAN)
SQLQHLIGLV

SEQ ID NO: 159558 - protein, 10 aa, Artificial Sequence
  Description of Artificial Sequence: Synthetic peptide
  Seed: YGNSISISAL (PRAME_HUMAN)
YTNSISISAY

SEQ ID NO: 159559 - protein, 10 aa, Artificial Sequence
  Description of Artificial Sequence: Synthetic peptide
  Seed: AIAALELLPR (PRAME_HUMAN)
ATAALELLPK

SEQ ID NO: 159560 - protein, 11 aa, Artificial Sequence
  Description of Artificial Sequence: Synthetic peptide
  Seed: CRLSEGDVMHL (PRAME_HUMAN)
CMLSEGDVMHL

SEQ ID NO: 159561 - protein, 10 aa, Artificial Sequence
  Description of Artificial Sequence: Synthetic peptide
  Seed: AYLHARLREL (PRAME_HUMAN)
AVLHARLREV

SEQ ID NO: 159562 - protein, 11 aa, Artificial Sequence
  Description of Artificial Sequence: Synthetic peptide
  Seed: AEQPFIPVEVL (PRAME_HUMAN)
AQQPFIPVEVF

SEQ ID NO: 159563 - protein, 9 aa, Artificial Sequence
  Description of Artificial Sequence: Synthetic peptide
  Seed: LPRELFPPL (PRAME_HUMAN)
LMRELFPPY

SEQ ID NO: 159564 - protein, 9 aa, Artificial Sequence
  Description of Artificial Sequence: Synthetic peptide
  Seed: HVMNPLETL (PRAME_HUMAN)
HTMNPLETR

SEQ ID NO: 159565 - protein, 9 aa, Artificial Sequence
  Description of Artificial Sequence: Synthetic peptide
  Seed: RHSQTLKAM (PRAME_HUMAN)
RFSQTLKAL

SEQ ID NO: 159566 - protein, 9 aa, Artificial Sequence
  Description of Artificial Sequence: Synthetic peptide
  Seed: LSVLSLSGV (PRAME_HUMAN)
LLVLSLSGA

SEQ ID NO: 159567 - protein, 9 aa, Artificial Sequence
  Description of Artificial Sequence: Synthetic peptide
  Seed: LYPVPLESY (PRAME_HUMAN)
LVPVPLESM

SEQ ID NO: 159568 - protein, 9 aa, Artificial Sequence
  Description of Artificial Sequence: Synthetic peptide
  Seed: ISISALQSL (PRAME_HUMAN)
IQISALQSI

SEQ ID NO: 159569 - protein, 11 aa, Artificial Sequence
  Description of Artificial Sequence: Synthetic peptide
  Seed: LSLSGVMLTDV (PRAME_HUMAN)
LMLSGVMLTDL

SEQ ID NO: 159570 - protein, 11 aa, Artificial Sequence
  Description of Artificial Sequence: Synthetic peptide
  Seed: RELFPPLFMAA (PRAME_HUMAN)
RKLFPPLFMAI

SEQ ID NO: 159571 - protein, 10 aa, Artificial Sequence
  Description of Artificial Sequence: Synthetic peptide
  Seed: AMVQAWPFTC (PRAME_HUMAN)
AIVQAWPFTV

SEQ ID NO: 159572 - protein, 9 aa, Artificial Sequence
  Description of Artificial Sequence: Synthetic peptide
  Seed: LLRHVMNPL (PRAME_HUMAN)
LARHVMNPY

SEQ ID NO: 159573 - protein, 10 aa, Artificial Sequence
  Description of Artificial Sequence: Synthetic peptide
  Seed: ALQSLLQHLI (PRAME_HUMAN)
AQQSLLQHLI

SEQ ID NO: 159574 - protein, 10 aa, Artificial Sequence
  Description of Artificial Sequence: Synthetic peptide
  Seed: MPMQDIKMIL (PRAME_HUMAN)
MSMQDIKMIV

SEQ ID NO: 159575 - protein, 10 aa, Artificial Sequence
  Description of Artificial Sequence: Synthetic peptide
  Seed: LLPRELFPPL (PRAME_HUMAN)
LMPRELFPPF

SEQ ID NO: 159576 - protein, 11 aa, Artificial Sequence
  Description of Artificial Sequence: Synthetic peptide
  Seed: QALYVDSLFFL (PRAME_HUMAN)
QYLYVDSLFFM

SEQ ID NO: 159577 - protein, 9 aa, Artificial Sequence
  Description of Artificial Sequence: Synthetic peptide
  Seed: VSQLSVLSL (PRAME_HUMAN)
VSQLSVLSI

SEQ ID NO: 159578 - protein, 9 aa, Artificial Sequence
  Description of Artificial Sequence: Synthetic peptide
  Seed: KLKIFAMPM (PRAME_HUMAN)
KIKIFAMPW

SEQ ID NO: 159579 - protein, 9 aa, Artificial Sequence
  Description of Artificial Sequence: Synthetic peptide
  Seed: LAIAALELL (PRAME_HUMAN)
LKIAALELF

SEQ ID NO: 159580 - protein, 9 aa, Artificial Sequence
  Description of Artificial Sequence: Synthetic peptide
  Seed: RHSQTLKAM (PRAME_HUMAN)
RYSQTLKAM

SEQ ID NO: 159581 - protein, 10 aa, Artificial Sequence
  Description of Artificial Sequence: Synthetic peptide
  Seed: YIAQFTSQFL (PRAME_HUMAN)
YQAQFTSQFF

SEQ ID NO: 159582 - protein, 11 aa, Artificial Sequence
  Description of Artificial Sequence: Synthetic peptide
  Seed: SQSPSVSQLSV (PRAME_HUMAN)
SQSPSVSQLSI

SEQ ID NO: 159583 - protein, 9 aa, Artificial Sequence
  Description of Artificial Sequence: Synthetic peptide
  Seed: VSPEPLQAL (PRAME_HUMAN)
VSPEPLQAV

SEQ ID NO: 159584 - protein, 10 aa, Artificial Sequence
  Description of Artificial Sequence: Synthetic peptide
  Seed: GTLHLERLAY (PRAME_HUMAN)
GTLHLERLAK

SEQ ID NO: 159585 - protein, 10 aa, Artificial Sequence
  Description of Artificial Sequence: Synthetic peptide
  Seed: FIPVEVLVDL (PRAME_HUMAN)
FPPVEVLVDF

SEQ ID NO: 159586 - protein, 10 aa, Artificial Sequence
  Description of Artificial Sequence: Synthetic peptide
  Seed: KVKRKKNVLR (PRAME_HUMAN)
KFKRKKNVLK

SEQ ID NO: 159587 - protein, 10 aa, Artificial Sequence
  Description of Artificial Sequence: Synthetic peptide
  Seed: KDEALAIAAL (PRAME_HUMAN)
KQEALAIAAL

SEQ ID NO: 159588 - protein, 10 aa, Artificial Sequence
  Description of Artificial Sequence: Synthetic peptide
  Seed: FLSLQCLQAL (PRAME_HUMAN)
FMSLQCLQAI

SEQ ID NO: 159589 - protein, 9 aa, Artificial Sequence
  Description of Artificial Sequence: Synthetic peptide
  Seed: MHLSQSPSV (PRAME_HUMAN)
MELSQSPSF

SEQ ID NO: 159590 - protein, 8 aa, Artificial Sequence
  Description of Artificial Sequence: Synthetic peptide
  Seed: YEDIHGTL (PRAME_HUMAN)
YWDIHGTL

SEQ ID NO: 159591 - protein, 9 aa, Artificial Sequence
  Description of Artificial Sequence: Synthetic peptide
  Seed: LSLQCLQAL (PRAME_HUMAN)
LQLQCLQAI

SEQ ID NO: 159592 - protein, 9 aa, Artificial Sequence
  Description of Artificial Sequence: Synthetic peptide
  Seed: RLLLSHIHA (PRAME_HUMAN)
RALLSHIHK

SEQ ID NO: 159593 - protein, 10 aa, Artificial Sequence
  Description of Artificial Sequence: Synthetic peptide
  Seed: ISISALQSLL (PRAME_HUMAN)
IVISALQSLI

SEQ ID NO: 159594 - protein, 11 aa, Artificial Sequence
  Description of Artificial Sequence: Synthetic peptide
  Seed: MKGQHLHLETF (PRAME_HUMAN)
MCGQHLHLETF

SEQ ID NO: 159595 - protein, 9 aa, Artificial Sequence
  Description of Artificial Sequence: Synthetic peptide
  Seed: WKLPTLAKF (PRAME_HUMAN)
WLLPTLAKY

SEQ ID NO: 159596 - protein, 11 aa, Artificial Sequence
  Description of Artificial Sequence: Synthetic peptide
  Seed: TVWSGNRASLY (PRAME_HUMAN)
TLWSGNRASLY

SEQ ID NO: 159597 - protein, 8 aa, Artificial Sequence
  Description of Artificial Sequence: Synthetic peptide
  Seed: DQLLRHVM (PRAME_HUMAN)
DQLLRHVL

SEQ ID NO: 159598 - protein, 9 aa, Artificial Sequence
  Description of Artificial Sequence: Synthetic peptide
  Seed: RLAYLHARL (PRAME_HUMAN)
RTAYLHARK

SEQ ID NO: 159599 - protein, 9 aa, Artificial Sequence
  Description of Artificial Sequence: Synthetic peptide
  Seed: TDDQLLALL (PRAME_HUMAN)
TEDQLLALF

SEQ ID NO: 159600 - protein, 9 aa, Artificial Sequence
  Description of Artificial Sequence: Synthetic peptide
  Seed: SHIHASSYI (PRAME_HUMAN)
SYIHASSYF

SEQ ID NO: 159601 - protein, 10 aa, Artificial Sequence
  Description of Artificial Sequence: Synthetic peptide
  Seed: ETFKAVLDGL (PRAME_HUMAN)
ELFKAVLDGR

SEQ ID NO: 159602 - protein, 9 aa, Artificial Sequence
  Description of Artificial Sequence: Synthetic peptide
  Seed: LFPPLFMAA (PRAME_HUMAN)
LFPPLFMAV

SEQ ID NO: 159603 - protein, 9 aa, Artificial Sequence
  Description of Artificial Sequence: Synthetic peptide
  Seed: WSGNRASLY (PRAME_HUMAN)
WYGNRASLY

SEQ ID NO: 159604 - protein, 9 aa, Artificial Sequence
  Description of Artificial Sequence: Synthetic peptide
  Seed: EAAQPMTKK (PRAME_HUMAN)
EPAQPMTKR

SEQ ID NO: 159605 - protein, 9 aa, Artificial Sequence
  Description of Artificial Sequence: Synthetic peptide
  Seed: LSHIHASSY (PRAME_HUMAN)
LAHIHASSF

SEQ ID NO: 159606 - protein, 11 aa, Artificial Sequence
  Description of Artificial Sequence: Synthetic peptide
  Seed: RASATLQDLVF (PRAME_HUMAN)
RQSATLQDLVW

SEQ ID NO: 159607 - protein, 9 aa, Artificial Sequence
  Description of Artificial Sequence: Synthetic peptide
  Seed: SVLSLSGVM (PRAME_HUMAN)
SALSLSGVY

SEQ ID NO: 159608 - protein, 9 aa, Artificial Sequence
  Description of Artificial Sequence: Synthetic peptide
  Seed: TDDQLLALL (PRAME_HUMAN)
TLDQLLALV

SEQ ID NO: 159609 - protein, 9 aa, Artificial Sequence
  Description of Artificial Sequence: Synthetic peptide
  Seed: ITDDQLLAL (PRAME_HUMAN)
IWDDQLLAA

SEQ ID NO: 159610 - protein, 8 aa, Artificial Sequence
  Description of Artificial Sequence: Synthetic peptide
  Seed: RELFPPLF (PRAME_HUMAN)
RELFPPLA

SEQ ID NO: 159611 - protein, 8 aa, Artificial Sequence
  Description of Artificial Sequence: Synthetic peptide
  Seed: YEDIHGTL (PRAME_HUMAN)
YYDIHGTV

SEQ ID NO: 159612 - protein, 10 aa, Artificial Sequence
  Description of Artificial Sequence: Synthetic peptide
  Seed: RLRELLCELG (PRAME_HUMAN)
RMRELLCELV

SEQ ID NO: 159613 - protein, 10 aa, Artificial Sequence
  Description of Artificial Sequence: Synthetic peptide
  Seed: DQLLALLPSL (PRAME_HUMAN)
DKLLALLPSL

SEQ ID NO: 159614 - protein, 11 aa, Artificial Sequence
  Description of Artificial Sequence: Synthetic peptide
  Seed: SQSPSVSQLSV (PRAME_HUMAN)
SMSPSVSQLSW

SEQ ID NO: 159615 - protein, 10 aa, Artificial Sequence
  Description of Artificial Sequence: Synthetic peptide
  Seed: RLWGSIQSRY (PRAME_HUMAN)
RVWGSIQSRF

SEQ ID NO: 159616 - protein, 9 aa, Artificial Sequence
  Description of Artificial Sequence: Synthetic peptide
  Seed: QLLALLPSL (PRAME_HUMAN)
QVLALLPSA

SEQ ID NO: 159617 - protein, 9 aa, Artificial Sequence
  Description of Artificial Sequence: Synthetic peptide
  Seed: NLTHVLYPV (PRAME_HUMAN)
NMTHVLYPR

SEQ ID NO: 159618 - protein, 9 aa, Artificial Sequence
  Description of Artificial Sequence: Synthetic peptide
  Seed: SQLSVLSLS (PRAME_HUMAN)
SQLSVLSLM

SEQ ID NO: 159619 - protein, 10 aa, Artificial Sequence
  Description of Artificial Sequence: Synthetic peptide
  Seed: TLHLERLAYL (PRAME_HUMAN)
TMHLERLAYV

SEQ ID NO: 159620 - protein, 10 aa, Artificial Sequence
  Description of Artificial Sequence: Synthetic peptide
  Seed: VMNPLETLSI (PRAME_HUMAN)
VMNPLETLSF

SEQ ID NO: 159621 - protein, 9 aa, Artificial Sequence
  Description of Artificial Sequence: Synthetic peptide
  Seed: FPPLFMAAF (PRAME_HUMAN)
FFPLFMAAM

SEQ ID NO: 159622 - protein, 9 aa, Artificial Sequence
  Description of Artificial Sequence: Synthetic peptide
  Seed: AQFTSQFLS (PRAME_HUMAN)
AMFTSQFLI

SEQ ID NO: 159623 - protein, 9 aa, Artificial Sequence
  Description of Artificial Sequence: Synthetic peptide
  Seed: TLHLERLAY (PRAME_HUMAN)
TQHLERLAY

SEQ ID NO: 159624 - protein, 9 aa, Artificial Sequence
  Description of Artificial Sequence: Synthetic peptide
  Seed: RTFYDPEPI (PRAME_HUMAN)
RTFYDPEPK

SEQ ID NO: 159625 - protein, 9 aa, Artificial Sequence
  Description of Artificial Sequence: Synthetic peptide
  Seed: LELLPRELF (PRAME_HUMAN)
LLLLPRELY

SEQ ID NO: 159626 - protein, 10 aa, Artificial Sequence
  Description of Artificial Sequence: Synthetic peptide
  Seed: LLLSHIHASS (PRAME_HUMAN)
LSLSHIHASL

SEQ ID NO: 159627 - protein, 10 aa, Artificial Sequence
  Description of Artificial Sequence: Synthetic peptide
  Seed: RLRELLCELG (PRAME_HUMAN)
RLRELLCELL

SEQ ID NO: 159628 - protein, 10 aa, Artificial Sequence
  Description of Artificial Sequence: Synthetic peptide
  Seed: SLYSFPEPEA (PRAME_HUMAN)
SIYSFPEPEI

SEQ ID NO: 159629 - protein, 10 aa, Artificial Sequence
  Description of Artificial Sequence: Synthetic peptide
  Seed: RLVELAGQSL (PRAME_HUMAN)
RSVELAGQSY

SEQ ID NO: 159630 - protein, 10 aa, Artificial Sequence
  Description of Artificial Sequence: Synthetic peptide
  Seed: MVQAWPFTCL (PRAME_HUMAN)
MEQAWPFTCM

SEQ ID NO: 159631 - protein, 10 aa, Artificial Sequence
  Description of Artificial Sequence: Synthetic peptide
  Seed: LSHCSQLTTL (PRAME_HUMAN)
LSHCSQLTTW

SEQ ID NO: 159632 - protein, 8 aa, Artificial Sequence
  Description of Artificial Sequence: Synthetic peptide
  Seed: SPYLGQMI (PRAME_HUMAN)
SQYLGQML

SEQ ID NO: 159633 - protein, 8 aa, Artificial Sequence
  Description of Artificial Sequence: Synthetic peptide
  Seed: SQLSVLSL (PRAME_HUMAN)
SELSVLSL

SEQ ID NO: 159634 - protein, 10 aa, Artificial Sequence
  Description of Artificial Sequence: Synthetic peptide
  Seed: IQSRYISMSV (PRAME_HUMAN)
ILSRYISMSA

SEQ ID NO: 159635 - protein, 10 aa, Artificial Sequence
  Description of Artificial Sequence: Synthetic peptide
  Seed: AVLDGLDVLL (PRAME_HUMAN)
ASLDGLDVLF

SEQ ID NO: 159636 - protein, 9 aa, Artificial Sequence
  Description of Artificial Sequence: Synthetic peptide
  Seed: ELAGQSLLK (PRAME_HUMAN)
ESAGQSLLK

SEQ ID NO: 159637 - protein, 9 aa, Artificial Sequence
  Description of Artificial Sequence: Synthetic peptide
  Seed: HVMNPLETL (PRAME_HUMAN)
HSMNPLETW

SEQ ID NO: 159638 - protein, 11 aa, Artificial Sequence
  Description of Artificial Sequence: Synthetic peptide
  Seed: FLSLQCLQALY (PRAME_HUMAN)
FESLQCLQALL

SEQ ID NO: 159639 - protein, 9 aa, Artificial Sequence
  Description of Artificial Sequence: Synthetic peptide
  Seed: KFSPYLGQM (PRAME_HUMAN)
KFSPYLGQW

SEQ ID NO: 159640 - protein, 9 aa, Artificial Sequence
  Description of Artificial Sequence: Synthetic peptide
  Seed: EQPFIPVEV (PRAME_HUMAN)
ETPFIPVEV

SEQ ID NO: 159641 - protein, 10 aa, Artificial Sequence
  Description of Artificial Sequence: Synthetic peptide
  Seed: VWSGNRASLY (PRAME_HUMAN)
VMSGNRASLY

SEQ ID NO: 159642 - protein, 10 aa, Artificial Sequence
  Description of Artificial Sequence: Synthetic peptide
  Seed: RLSEGDVMHL (PRAME_HUMAN)
RLSEGDVMHF

SEQ ID NO: 159643 - protein, 11 aa, Artificial Sequence
  Description of Artificial Sequence: Synthetic peptide
  Seed: QALYVDSLFFL (PRAME_HUMAN)
QVLYVDSLFFV

SEQ ID NO: 159644 - protein, 9 aa, Artificial Sequence
  Description of Artificial Sequence: Synthetic peptide
  Seed: SPEPLQALL (PRAME_HUMAN)
SWEPLQALL

SEQ ID NO: 159645 - protein, 10 aa, Artificial Sequence
  Description of Artificial Sequence: Synthetic peptide
  Seed: FFLRGRLDQL (PRAME_HUMAN)
FDLRGRLDQL

SEQ ID NO: 159646 - protein, 11 aa, Artificial Sequence
  Description of Artificial Sequence: Synthetic peptide
  Seed: SNLTHVLYPVP (PRAME_HUMAN)
SLLTHVLYPVC

SEQ ID NO: 159647 - protein, 9 aa, Artificial Sequence
  Description of Artificial Sequence: Synthetic peptide
  Seed: SMSVWTSPR (PRAME_HUMAN)
SVSVWTSPR

SEQ ID NO: 159648 - protein, 9 aa, Artificial Sequence
  Description of Artificial Sequence: Synthetic peptide
  Seed: HVMNPLETL (PRAME_HUMAN)
HHMNPLETM

SEQ ID NO: 159649 - protein, 9 aa, Artificial Sequence
  Description of Artificial Sequence: Synthetic peptide
  Seed: RLRELLCEL (PRAME_HUMAN)
RYRELLCEL

SEQ ID NO: 159650 - protein, 9 aa, Artificial Sequence
  Description of Artificial Sequence: Synthetic peptide
  Seed: IHASSYISP (PRAME_HUMAN)
IHASSYISA

SEQ ID NO: 159651 - protein, 10 aa, Artificial Sequence
  Description of Artificial Sequence: Synthetic peptide
  Seed: FYDPEPILCP (PRAME_HUMAN)
FADPEPILCL

SEQ ID NO: 159652 - protein, 10 aa, Artificial Sequence
  Description of Artificial Sequence: Synthetic peptide
  Seed: QLLRHVMNPL (PRAME_HUMAN)
QLLRHVMNPI

SEQ ID NO: 159653 - protein, 10 aa, Artificial Sequence
  Description of Artificial Sequence: Synthetic peptide
  Seed: SISISALQSL (PRAME_HUMAN)
SNSISALQSW

SEQ ID NO: 159654 - protein, 9 aa, Artificial Sequence
  Description of Artificial Sequence: Synthetic peptide
  Seed: SQFLSLQCL (PRAME_HUMAN)
SRFLSLQCY

SEQ ID NO: 159655 - protein, 9 aa, Artificial Sequence
  Description of Artificial Sequence: Synthetic peptide
  Seed: ALLPSLSHC (PRAME_HUMAN)
ASLPSLSHI

SEQ ID NO: 159656 - protein, 9 aa, Artificial Sequence
  Description of Artificial Sequence: Synthetic peptide
  Seed: CSQLTTLSF (PRAME_HUMAN)
CQQLTTLSL

SEQ ID NO: 159657 - protein, 9 aa, Artificial Sequence
  Description of Artificial Sequence: Synthetic peptide
  Seed: ISPEKEEQY (PRAME_HUMAN)
IGPEKEEQL

SEQ ID NO: 159658 - protein, 10 aa, Artificial Sequence
  Description of Artificial Sequence: Synthetic peptide
  Seed: RLSEGDVMHL (PRAME_HUMAN)
RLSEGDVMHM

SEQ ID NO: 159659 - protein, 9 aa, Artificial Sequence
  Description of Artificial Sequence: Synthetic peptide
  Seed: TCLPLGVLM (PRAME_HUMAN)
TTLPLGVLV

SEQ ID NO: 159660 - protein, 9 aa, Artificial Sequence
  Description of Artificial Sequence: Synthetic peptide
  Seed: VFDECGITD (PRAME_HUMAN)
VHDECGITL

SEQ ID NO: 159661 - protein, 10 aa, Artificial Sequence
  Description of Artificial Sequence: Synthetic peptide
  Seed: SISISALQSL (PRAME_HUMAN)
SISISALQSI

SEQ ID NO: 159662 - protein, 9 aa, Artificial Sequence
  Description of Artificial Sequence: Synthetic peptide
  Seed: YIAQFTSQF (PRAME_HUMAN)
YNAQFTSQV

SEQ ID NO: 159663 - protein, 10 aa, Artificial Sequence
  Description of Artificial Sequence: Synthetic peptide
  Seed: CSQLTTLSFY (PRAME_HUMAN)
CKQLTTLSFY

SEQ ID NO: 159664 - protein, 9 aa, Artificial Sequence
  Description of Artificial Sequence: Synthetic peptide
  Seed: THVLYPVPL (PRAME_HUMAN)
TAVLYPVPY

SEQ ID NO: 159665 - protein, 9 aa, Artificial Sequence
  Description of Artificial Sequence: Synthetic peptide
  Seed: SQFLSLQCL (PRAME_HUMAN)
SEFLSLQCM

SEQ ID NO: 159666 - protein, 9 aa, Artificial Sequence
  Description of Artificial Sequence: Synthetic peptide
  Seed: RLSEGDVMH (PRAME_HUMAN)
RMSEGDVMK

SEQ ID NO: 159667 - protein, 10 aa, Artificial Sequence
  Description of Artificial Sequence: Synthetic peptide
  Seed: ETLSITNCRL (PRAME_HUMAN)
ESLSITNCRV

SEQ ID NO: 159668 - protein, 9 aa, Artificial Sequence
  Description of Artificial Sequence: Synthetic peptide
  Seed: LSVLSLSGV (PRAME_HUMAN)
LVVLSLSGL

SEQ ID NO: 159669 - protein, 10 aa, Artificial Sequence
  Description of Artificial Sequence: Synthetic peptide
  Seed: VRPRRWKLQV (PRAME_HUMAN)
VRPRRWKLQL

SEQ ID NO: 159670 - protein, 9 aa, Artificial Sequence
  Description of Artificial Sequence: Synthetic peptide
  Seed: IPVEVLVDL (PRAME_HUMAN)
IPVEVLVDI

SEQ ID NO: 159671 - protein, 9 aa, Artificial Sequence
  Description of Artificial Sequence: Synthetic peptide
  Seed: FLRGRLDQL (PRAME_HUMAN)
FMRGRLDQF

SEQ ID NO: 159672 - protein, 9 aa, Artificial Sequence
  Description of Artificial Sequence: Synthetic peptide
  Seed: GQHLHLETF (PRAME_HUMAN)
GYHLHLETF

SEQ ID NO: 159673 - protein, 9 aa, Artificial Sequence
  Description of Artificial Sequence: Synthetic peptide
  Seed: LGRPSMVWL (PRAME_HUMAN)
LSRPSMVWW

SEQ ID NO: 159674 - protein, 10 aa, Artificial Sequence
  Description of Artificial Sequence: Synthetic peptide
  Seed: SALQSLLQHL (PRAME_HUMAN)
SQLQSLLQHL

SEQ ID NO: 159675 - protein, 9 aa, Artificial Sequence
  Description of Artificial Sequence: Synthetic peptide
  Seed: TWKLPTLAK (PRAME_HUMAN)
TWKLPTLAR

SEQ ID NO: 159676 - protein, 9 aa, Artificial Sequence
  Description of Artificial Sequence: Synthetic peptide
  Seed: HARLRELLC (PRAME_HUMAN)
HARLRELLI

SEQ ID NO: 159677 - protein, 10 aa, Artificial Sequence
  Description of Artificial Sequence: Synthetic peptide
  Seed: TDVSPEPLQA (PRAME_HUMAN)
TEVSPEPLQV

SEQ ID NO: 159678 - protein, 9 aa, Artificial Sequence
  Description of Artificial Sequence: Synthetic peptide
  Seed: CSQLTTLSF (PRAME_HUMAN)
CEQLTTLSF

SEQ ID NO: 159679 - protein, 10 aa, Artificial Sequence
  Description of Artificial Sequence: Synthetic peptide
  Seed: RHVMNPLETL (PRAME_HUMAN)
RKVMNPLETY

SEQ ID NO: 159680 - protein, 9 aa, Artificial Sequence
  Description of Artificial Sequence: Synthetic peptide
  Seed: ELAGQSLLK (PRAME_HUMAN)
EMAGQSLLK

SEQ ID NO: 159681 - protein, 10 aa, Artificial Sequence
  Description of Artificial Sequence: Synthetic peptide
  Seed: FIPVEVLVDL (PRAME_HUMAN)
FLPVEVLVDA

SEQ ID NO: 159682 - protein, 9 aa, Artificial Sequence
  Description of Artificial Sequence: Synthetic peptide
  Seed: YIAQFTSQF (PRAME_HUMAN)
YAAQFTSQH

SEQ ID NO: 159683 - protein, 11 aa, Artificial Sequence
  Description of Artificial Sequence: Synthetic peptide
  Seed: FLSLQCLQALY (PRAME_HUMAN)
FTSLQCLQALL

SEQ ID NO: 159684 - protein, 9 aa, Artificial Sequence
  Description of Artificial Sequence: Synthetic peptide
  Seed: CPHCGDRTF (PRAME_HUMAN)
CMHCGDRTY

SEQ ID NO: 159685 - protein, 10 aa, Artificial Sequence
  Description of Artificial Sequence: Synthetic peptide
  Seed: ALQSLLQHLI (PRAME_HUMAN)
AQQSLLQHLL

SEQ ID NO: 159686 - protein, 9 aa, Artificial Sequence
  Description of Artificial Sequence: Synthetic peptide
  Seed: QFTSQFLSL (PRAME_HUMAN)
QATSQFLSY

SEQ ID NO: 159687 - protein, 9 aa, Artificial Sequence
  Description of Artificial Sequence: Synthetic peptide
  Seed: FLRGRLDQL (PRAME_HUMAN)
FLRGRLDQI

SEQ ID NO: 159688 - protein, 9 aa, Artificial Sequence
  Description of Artificial Sequence: Synthetic peptide
  Seed: FYDPEPILC (PRAME_HUMAN)
FPDPEPILF

SEQ ID NO: 159689 - protein, 9 aa, Artificial Sequence
  Description of Artificial Sequence: Synthetic peptide
  Seed: VLYPVPLES (PRAME_HUMAN)
VTYPVPLEV

SEQ ID NO: 159690 - protein, 9 aa, Artificial Sequence
  Description of Artificial Sequence: Synthetic peptide
  Seed: AEQPFIPVE (PRAME_HUMAN)
AEQPFIPVV

SEQ ID NO: 159691 - protein, 9 aa, Artificial Sequence
  Description of Artificial Sequence: Synthetic peptide
  Seed: HVMNPLETL (PRAME_HUMAN)
HCMNPLETY

SEQ ID NO: 159692 - protein, 9 aa, Artificial Sequence
  Description of Artificial Sequence: Synthetic peptide
  Seed: HVMNPLETL (PRAME_HUMAN)
HPMNPLETV

SEQ ID NO: 159693 - protein, 9 aa, Artificial Sequence
  Description of Artificial Sequence: Synthetic peptide
  Seed: SMSVWTSPR (PRAME_HUMAN)
SQSVWTSPY

SEQ ID NO: 159694 - protein, 9 aa, Artificial Sequence
  Description of Artificial Sequence: Synthetic peptide
  Seed: VLMKGQHLH (PRAME_HUMAN)
VLMKGQHLK

SEQ ID NO: 159695 - protein, 9 aa, Artificial Sequence
  Description of Artificial Sequence: Synthetic peptide
  Seed: ALAIAALEL (PRAME_HUMAN)
AIAIAALEL

SEQ ID NO: 159696 - protein, 10 aa, Artificial Sequence
  Description of Artificial Sequence: Synthetic peptide
  Seed: DELFSYLIEK (PRAME_HUMAN)
DFLFSYLIER

SEQ ID NO: 159697 - protein, 11 aa, Artificial Sequence
  Description of Artificial Sequence: Synthetic peptide
  Seed: SHCSQLTTLSF (PRAME_HUMAN)
SQCSQLTTLSY

SEQ ID NO: 159698 - protein, 9 aa, Artificial Sequence
  Description of Artificial Sequence: Synthetic peptide
  Seed: QMINLRRLL (PRAME_HUMAN)
QSINLRRLF

SEQ ID NO: 159699 - protein, 9 aa, Artificial Sequence
  Description of Artificial Sequence: Synthetic peptide
  Seed: SPSVSQLSV (PRAME_HUMAN)
SPSVSQLSW

SEQ ID NO: 159700 - protein, 10 aa, Artificial Sequence
  Description of Artificial Sequence: Synthetic peptide
  Seed: SALQSLLQHL (PRAME_HUMAN)
SYLQSLLQHI

SEQ ID NO: 159701 - protein, 10 aa, Artificial Sequence
  Description of Artificial Sequence: Synthetic peptide
  Seed: SPYLGQMINL (PRAME_HUMAN)
SCYLGQMINW

SEQ ID NO: 159702 - protein, 10 aa, Artificial Sequence
  Description of Artificial Sequence: Synthetic peptide
  Seed: LLSHIHASSY (PRAME_HUMAN)
LLSHIHASSF

SEQ ID NO: 159703 - protein, 9 aa, Artificial Sequence
  Description of Artificial Sequence: Synthetic peptide
  Seed: RLRELLCEL (PRAME_HUMAN)
RMRELLCEL

SEQ ID NO: 159704 - protein, 10 aa, Artificial Sequence
  Description of Artificial Sequence: Synthetic peptide
  Seed: KGQHLHLETF (PRAME_HUMAN)
KQQHLHLETY

SEQ ID NO: 159705 - protein, 9 aa, Artificial Sequence
  Description of Artificial Sequence: Synthetic peptide
  Seed: TWKLPTLAK (PRAME_HUMAN)
TLKLPTLAK

SEQ ID NO: 159706 - protein, 9 aa, Artificial Sequence
  Description of Artificial Sequence: Synthetic peptide
  Seed: ITDDQLLAL (PRAME_HUMAN)
IGDDQLLAM

SEQ ID NO: 159707 - protein, 9 aa, Artificial Sequence
  Description of Artificial Sequence: Synthetic peptide
  Seed: ELAGQSLLK (PRAME_HUMAN)
ETAGQSLLR

SEQ ID NO: 159708 - protein, 9 aa, Artificial Sequence
  Description of Artificial Sequence: Synthetic peptide
  Seed: RRWKLQVLD (PRAME_HUMAN)
RRWKLQVLP

SEQ ID NO: 159709 - protein, 9 aa, Artificial Sequence
  Description of Artificial Sequence: Synthetic peptide
  Seed: ITDDQLLAL (PRAME_HUMAN)
IMDDQLLAW

SEQ ID NO: 159710 - protein, 10 aa, Artificial Sequence
  Description of Artificial Sequence: Synthetic peptide
  Seed: ISMSVWTSPR (PRAME_HUMAN)
ILMSVWTSPK

SEQ ID NO: 159711 - protein, 10 aa, Artificial Sequence
  Description of Artificial Sequence: Synthetic peptide
  Seed: YISPEKEEQY (PRAME_HUMAN)
YMSPEKEEQL

SEQ ID NO: 159712 - protein, 9 aa, Artificial Sequence
  Description of Artificial Sequence: Synthetic peptide
  Seed: SHQDFWTVW (PRAME_HUMAN)
SWQDFWTVI

SEQ ID NO: 159713 - protein, 10 aa, Artificial Sequence
  Description of Artificial Sequence: Synthetic peptide
  Seed: LSHCSQLTTL (PRAME_HUMAN)
LSHCSQLTTY

SEQ ID NO: 159714 - protein, 9 aa, Artificial Sequence
  Description of Artificial Sequence: Synthetic peptide
  Seed: ISPEKEEQY (PRAME_HUMAN)
IWPEKEEQM

SEQ ID NO: 159715 - protein, 9 aa, Artificial Sequence
  Description of Artificial Sequence: Synthetic peptide
  Seed: NSISISALQ (PRAME_HUMAN)
NMISISALR

SEQ ID NO: 159716 - protein, 9 aa, Artificial Sequence
  Description of Artificial Sequence: Synthetic peptide
  Seed: KEEQYIAQF (PRAME_HUMAN)
KEEQYIAQW

SEQ ID NO: 159717 - protein, 9 aa, Artificial Sequence
  Description of Artificial Sequence: Synthetic peptide
  Seed: LFPPLFMAA (PRAME_HUMAN)
LWPPLFMAM

SEQ ID NO: 159718 - protein, 9 aa, Artificial Sequence
  Description of Artificial Sequence: Synthetic peptide
  Seed: MHLSQSPSV (PRAME_HUMAN)
MQLSQSPSY

SEQ ID NO: 159719 - protein, 9 aa, Artificial Sequence
  Description of Artificial Sequence: Synthetic peptide
  Seed: KAMVQAWPF (PRAME_HUMAN)
KAMVQAWPW

SEQ ID NO: 159720 - protein, 10 aa, Artificial Sequence
  Description of Artificial Sequence: Synthetic peptide
  Seed: SALQSLLQHL (PRAME_HUMAN)
STLQSLLQHY

SEQ ID NO: 159721 - protein, 9 aa, Artificial Sequence
  Description of Artificial Sequence: Synthetic peptide
  Seed: SQFLSLQCL (PRAME_HUMAN)
SLFLSLQCM

SEQ ID NO: 159722 - protein, 9 aa, Artificial Sequence
  Description of Artificial Sequence: Synthetic peptide
  Seed: DSLFFLRGR (PRAME_HUMAN)
DQLFFLRGR

SEQ ID NO: 159723 - protein, 9 aa, Artificial Sequence
  Description of Artificial Sequence: Synthetic peptide
  Seed: LLLSHIHAS (PRAME_HUMAN)
LALSHIHAA

SEQ ID NO: 159724 - protein, 9 aa, Artificial Sequence
  Description of Artificial Sequence: Synthetic peptide
  Seed: LQDLVFDEC (PRAME_HUMAN)
LIDLVFDEL

SEQ ID NO: 159725 - protein, 9 aa, Artificial Sequence
  Description of Artificial Sequence: Synthetic peptide
  Seed: ISISALQSL (PRAME_HUMAN)
IAISALQSV

SEQ ID NO: 159726 - protein, 9 aa, Artificial Sequence
  Description of Artificial Sequence: Synthetic peptide
  Seed: YISMSVWTS (PRAME_HUMAN)
YMSMSVWTF

SEQ ID NO: 159727 - protein, 9 aa, Artificial Sequence
  Description of Artificial Sequence: Synthetic peptide
  Seed: SQSPSVSQL (PRAME_HUMAN)
SESPSVSQI

SEQ ID NO: 159728 - protein, 11 aa, Artificial Sequence
  Description of Artificial Sequence: Synthetic peptide
  Seed: RELFPPLFMAA (PRAME_HUMAN)
RMLFPPLFMAI

SEQ ID NO: 159729 - protein, 10 aa, Artificial Sequence
  Description of Artificial Sequence: Synthetic peptide
  Seed: SALQSLLQHL (PRAME_HUMAN)
SALQSLLQHV

SEQ ID NO: 159730 - protein, 10 aa, Artificial Sequence
  Description of Artificial Sequence: Synthetic peptide
  Seed: AFDGRHSQTL (PRAME_HUMAN)
ALDGRHSQTL

SEQ ID NO: 159731 - protein, 9 aa, Artificial Sequence
  Description of Artificial Sequence: Synthetic peptide
  Seed: KMILKMVQL (PRAME_HUMAN)
KTILKMVQK

SEQ ID NO: 159732 - protein, 11 aa, Artificial Sequence
  Description of Artificial Sequence: Synthetic peptide
  Seed: FSPYLGQMINL (PRAME_HUMAN)
FAPYLGQMINF

SEQ ID NO: 159733 - protein, 9 aa, Artificial Sequence
  Description of Artificial Sequence: Synthetic peptide
  Seed: MHLSQSPSV (PRAME_HUMAN)
MVLSQSPSY

SEQ ID NO: 159734 - protein, 10 aa, Artificial Sequence
  Description of Artificial Sequence: Synthetic peptide
  Seed: QLLALLPSLS (PRAME_HUMAN)
QMLALLPSLV

SEQ ID NO: 159735 - protein, 10 aa, Artificial Sequence
  Description of Artificial Sequence: Synthetic peptide
  Seed: RASATLQDLV (PRAME_HUMAN)
RNSATLQDLF

SEQ ID NO: 159736 - protein, 10 aa, Artificial Sequence
  Description of Artificial Sequence: Synthetic peptide
  Seed: LLLSHIHASS (PRAME_HUMAN)
LLLSHIHASM

SEQ ID NO: 159737 - protein, 10 aa, Artificial Sequence
  Description of Artificial Sequence: Synthetic peptide
  Seed: SLSHCSQLTT (PRAME_HUMAN)
SLSHCSQLTI

SEQ ID NO: 159738 - protein, 10 aa, Artificial Sequence
  Description of Artificial Sequence: Synthetic peptide
  Seed: MERRRLWGSI (PRAME_HUMAN)
MARRRLWGSI

SEQ ID NO: 159739 - protein, 11 aa, Artificial Sequence
  Description of Artificial Sequence: Synthetic peptide
  Seed: ISMSVWTSPRR (PRAME_HUMAN)
IIMSVWTSPRR

SEQ ID NO: 159740 - protein, 10 aa, Artificial Sequence
  Description of Artificial Sequence: Synthetic peptide
  Seed: ETLSITNCRL (PRAME_HUMAN)
EFLSITNCRR

SEQ ID NO: 159741 - protein, 9 aa, Artificial Sequence
  Description of Artificial Sequence: Synthetic peptide
  Seed: SFPEPEAAQ (PRAME_HUMAN)
SMPEPEAAL

SEQ ID NO: 159742 - protein, 10 aa, Artificial Sequence
  Description of Artificial Sequence: Synthetic peptide
  Seed: SISISALQSL (PRAME_HUMAN)
STSISALQSM

SEQ ID NO: 159743 - protein, 9 aa, Artificial Sequence
  Description of Artificial Sequence: Synthetic peptide
  Seed: SHCSQLTTL (PRAME_HUMAN)
SRCSQLTTL

SEQ ID NO: 159744 - protein, 9 aa, Artificial Sequence
  Description of Artificial Sequence: Synthetic peptide
  Seed: SQFLSLQCL (PRAME_HUMAN)
SSFLSLQCF

SEQ ID NO: 159745 - protein, 11 aa, Artificial Sequence
  Description of Artificial Sequence: Synthetic peptide
  Seed: RLVELAGQSLL (PRAME_HUMAN)
RMVELAGQSLW

SEQ ID NO: 159746 - protein, 9 aa, Artificial Sequence
  Description of Artificial Sequence: Synthetic peptide
  Seed: IGLSNLTHV (PRAME_HUMAN)
ILLSNLTHI

SEQ ID NO: 159747 - protein, 9 aa, Artificial Sequence
  Description of Artificial Sequence: Synthetic peptide
  Seed: LKMVQLDSI (PRAME_HUMAN)
LMMVQLDSF

SEQ ID NO: 159748 - protein, 9 aa, Artificial Sequence
  Description of Artificial Sequence: Synthetic peptide
  Seed: SFYGNSISI (PRAME_HUMAN)
SYYGNSISY

SEQ ID NO: 159749 - protein, 10 aa, Artificial Sequence
  Description of Artificial Sequence: Synthetic peptide
  Seed: ARLRELLCEL (PRAME_HUMAN)
AILRELLCEA

SEQ ID NO: 159750 - protein, 10 aa, Artificial Sequence
  Description of Artificial Sequence: Synthetic peptide
  Seed: FFLRGRLDQL (PRAME_HUMAN)
FSLRGRLDQA

SEQ ID NO: 159751 - protein, 11 aa, Artificial Sequence
  Description of Artificial Sequence: Synthetic peptide
  Seed: IQSRYISMSVW (PRAME_HUMAN)
ISSRYISMSVY

SEQ ID NO: 159752 - protein, 10 aa, Artificial Sequence
  Description of Artificial Sequence: Synthetic peptide
  Seed: QYIAQFTSQF (PRAME_HUMAN)
QQIAQFTSQM

SEQ ID NO: 159753 - protein, 10 aa, Artificial Sequence
  Description of Artificial Sequence: Synthetic peptide
  Seed: ALYVDSLFFL (PRAME_HUMAN)
AWYVDSLFFL

SEQ ID NO: 159754 - protein, 10 aa, Artificial Sequence
  Description of Artificial Sequence: Synthetic peptide
  Seed: LSFYGNSISI (PRAME_HUMAN)
LTFYGNSISM

SEQ ID NO: 159755 - protein, 9 aa, Artificial Sequence
  Description of Artificial Sequence: Synthetic peptide
  Seed: LAIAALELL (PRAME_HUMAN)
LVIAALELI

SEQ ID NO: 159756 - protein, 9 aa, Artificial Sequence
  Description of Artificial Sequence: Synthetic peptide
  Seed: LQALYVDSL (PRAME_HUMAN)
LEALYVDSV

SEQ ID NO: 159757 - protein, 10 aa, Artificial Sequence
  Description of Artificial Sequence: Synthetic peptide
  Seed: GRPSMVWLSA (PRAME_HUMAN)
GRPSMVWLSL

SEQ ID NO: 159758 - protein, 11 aa, Artificial Sequence
  Description of Artificial Sequence: Synthetic peptide
  Seed: RELFPPLFMAA (PRAME_HUMAN)
RSLFPPLFMAV

SEQ ID NO: 159759 - protein, 9 aa, Artificial Sequence
  Description of Artificial Sequence: Synthetic peptide
  Seed: EVLVDLFLK (PRAME_HUMAN)
ELLVDLFLR

SEQ ID NO: 159760 - protein, 10 aa, Artificial Sequence
  Description of Artificial Sequence: Synthetic peptide
  Seed: HCSQLTTLSF (PRAME_HUMAN)
HVSQLTTLSF

SEQ ID NO: 159761 - protein, 10 aa, Artificial Sequence
  Description of Artificial Sequence: Synthetic peptide
  Seed: FFLRGRLDQL (PRAME_HUMAN)
FTLRGRLDQI

SEQ ID NO: 159762 - protein, 10 aa, Artificial Sequence
  Description of Artificial Sequence: Synthetic peptide
  Seed: FYDPEPILCP (PRAME_HUMAN)
FWDPEPILCI

SEQ ID NO: 159763 - protein, 9 aa, Artificial Sequence
  Description of Artificial Sequence: Synthetic peptide
  Seed: VSPEPLQAL (PRAME_HUMAN)
VYPEPLQAW

SEQ ID NO: 159764 - protein, 9 aa, Artificial Sequence
  Description of Artificial Sequence: Synthetic peptide
  Seed: YSFPEPEAA (PRAME_HUMAN)
YRFPEPEAY

SEQ ID NO: 159765 - protein, 8 aa, Artificial Sequence
  Description of Artificial Sequence: Synthetic peptide
  Seed: SPYLGQMI (PRAME_HUMAN)
SPYLGQMA

SEQ ID NO: 159766 - protein, 11 aa, Artificial Sequence
  Description of Artificial Sequence: Synthetic peptide
  Seed: EQYIAQFTSQF (PRAME_HUMAN)
EKYIAQFTSQF

SEQ ID NO: 159767 - protein, 10 aa, Artificial Sequence
  Description of Artificial Sequence: Synthetic peptide
  Seed: ALYVDSLFFL (PRAME_HUMAN)
AQYVDSLFFW

SEQ ID NO: 159768 - protein, 9 aa, Artificial Sequence
  Description of Artificial Sequence: Synthetic peptide
  Seed: TLAKFSPYL (PRAME_HUMAN)
TAAKFSPYI

SEQ ID NO: 159769 - protein, 10 aa, Artificial Sequence
  Description of Artificial Sequence: Synthetic peptide
  Seed: SVSQLSVLSL (PRAME_HUMAN)
SSSQLSVLSW

SEQ ID NO: 159770 - protein, 10 aa, Artificial Sequence
  Description of Artificial Sequence: Synthetic peptide
  Seed: FLSLQCLQAL (PRAME_HUMAN)
FVSLQCLQAL

SEQ ID NO: 159771 - protein, 9 aa, Artificial Sequence
  Description of Artificial Sequence: Synthetic peptide
  Seed: IHASSYISP (PRAME_HUMAN)
IHASSYISV

SEQ ID NO: 159772 - protein, 10 aa, Artificial Sequence
  Description of Artificial Sequence: Synthetic peptide
  Seed: SISISALQSL (PRAME_HUMAN)
SRSISALQSY

SEQ ID NO: 159773 - protein, 9 aa, Artificial Sequence
  Description of Artificial Sequence: Synthetic peptide
  Seed: MNPLETLSI (PRAME_HUMAN)
MAPLETLSF

SEQ ID NO: 159774 - protein, 9 aa, Artificial Sequence
  Description of Artificial Sequence: Synthetic peptide
  Seed: RLRELLCEL (PRAME_HUMAN)
RPRELLCEV

SEQ ID NO: 159775 - protein, 9 aa, Artificial Sequence
  Description of Artificial Sequence: Synthetic peptide
  Seed: RTFYDPEPI (PRAME_HUMAN)
RAFYDPEPM

SEQ ID NO: 159776 - protein, 9 aa, Artificial Sequence
  Description of Artificial Sequence: Synthetic peptide
  Seed: LTDVSPEPL (PRAME_HUMAN)
LSDVSPEPF

SEQ ID NO: 159777 - protein, 8 aa, Artificial Sequence
  Description of Artificial Sequence: Synthetic peptide
  Seed: DQLLRHVM (PRAME_HUMAN)
DELLRHVF

SEQ ID NO: 159778 - protein, 9 aa, Artificial Sequence
  Description of Artificial Sequence: Synthetic peptide
  Seed: ALAIAALEL (PRAME_HUMAN)
AIAIAALEY

SEQ ID NO: 159779 - protein, 10 aa, Artificial Sequence
  Description of Artificial Sequence: Synthetic peptide
  Seed: LYVDSLFFLR (PRAME_HUMAN)
LMVDSLFFLR

SEQ ID NO: 159780 - protein, 10 aa, Artificial Sequence
  Description of Artificial Sequence: Synthetic peptide
  Seed: YIAQFTSQFL (PRAME_HUMAN)
YQAQFTSQFL

SEQ ID NO: 159781 - protein, 10 aa, Artificial Sequence
  Description of Artificial Sequence: Synthetic peptide
  Seed: ETFKAVLDGL (PRAME_HUMAN)
EAFKAVLDGF

SEQ ID NO: 159782 - protein, 9 aa, Artificial Sequence
  Description of Artificial Sequence: Synthetic peptide
  Seed: HVMNPLETL (PRAME_HUMAN)
HLMNPLETW

SEQ ID NO: 159783 - protein, 9 aa, Artificial Sequence
  Description of Artificial Sequence: Synthetic peptide
  Seed: SFPEPEAAQ (PRAME_HUMAN)
SMPEPEAAF

SEQ ID NO: 159784 - protein, 9 aa, Artificial Sequence
  Description of Artificial Sequence: Synthetic peptide
  Seed: SPYLGQMIN (PRAME_HUMAN)
SPYLGQMIT

SEQ ID NO: 159785 - protein, 10 aa, Artificial Sequence
  Description of Artificial Sequence: Synthetic peptide
  Seed: VMNPLETLSI (PRAME_HUMAN)
VQNPLETLSL

SEQ ID NO: 159786 - protein, 9 aa, Artificial Sequence
  Description of Artificial Sequence: Synthetic peptide
  Seed: SFYGNSISI (PRAME_HUMAN)
SSYGNSISV

SEQ ID NO: 159787 - protein, 11 aa, Artificial Sequence
  Description of Artificial Sequence: Synthetic peptide
  Seed: AVLDGLDVLLA (PRAME_HUMAN)
AMLDGLDVLLA

SEQ ID NO: 159788 - protein, 9 aa, Artificial Sequence
  Description of Artificial Sequence: Synthetic peptide
  Seed: AMVQAWPFT (PRAME_HUMAN)
AIVQAWPFL

SEQ ID NO: 159789 - protein, 10 aa, Artificial Sequence
  Description of Artificial Sequence: Synthetic peptide
  Seed: VSPEPLQALL (PRAME_HUMAN)
VMPEPLQALM

SEQ ID NO: 159790 - protein, 9 aa, Artificial Sequence
  Description of Artificial Sequence: Synthetic peptide
  Seed: LAIAALELL (PRAME_HUMAN)
LVIAALELV

SEQ ID NO: 159791 - protein, 8 aa, Artificial Sequence
  Description of Artificial Sequence: Synthetic peptide
  Seed: LAKFSPYL (PRAME_HUMAN)
LWKFSPYV

SEQ ID NO: 159792 - protein, 10 aa, Artificial Sequence
  Description of Artificial Sequence: Synthetic peptide
  Seed: ALYVDSLFFL (PRAME_HUMAN)
AQYVDSLFFV

SEQ ID NO: 159793 - protein, 9 aa, Artificial Sequence
  Description of Artificial Sequence: Synthetic peptide
  Seed: FPPLFMAAF (PRAME_HUMAN)
FGPLFMAAL

SEQ ID NO: 159794 - protein, 9 aa, Artificial Sequence
  Description of Artificial Sequence: Synthetic peptide
  Seed: LQALYVDSL (PRAME_HUMAN)
LTALYVDSL

SEQ ID NO: 159795 - protein, 11 aa, Artificial Sequence
  Description of Artificial Sequence: Synthetic peptide
  Seed: VQLDSIEDLEV (PRAME_HUMAN)
VILDSIEDLEV

SEQ ID NO: 159796 - protein, 9 aa, Artificial Sequence
  Description of Artificial Sequence: Synthetic peptide
  Seed: LTDVSPEPL (PRAME_HUMAN)
LFDVSPEPL

SEQ ID NO: 159797 - protein, 9 aa, Artificial Sequence
  Description of Artificial Sequence: Synthetic peptide
  Seed: ACDELFSYL (PRAME_HUMAN)
ATDELFSYY

SEQ ID NO: 159798 - protein, 9 aa, Artificial Sequence
  Description of Artificial Sequence: Synthetic peptide
  Seed: MERRRLWGS (PRAME_HUMAN)
MERRRLWGM

SEQ ID NO: 159799 - protein, 9 aa, Artificial Sequence
  Description of Artificial Sequence: Synthetic peptide
  Seed: YIAQFTSQF (PRAME_HUMAN)
YFAQFTSQY

SEQ ID NO: 159800 - protein, 9 aa, Artificial Sequence
  Description of Artificial Sequence: Synthetic peptide
  Seed: LQDLVFDEC (PRAME_HUMAN)
LVDLVFDEL

SEQ ID NO: 159801 - protein, 9 aa, Artificial Sequence
  Description of Artificial Sequence: Synthetic peptide
  Seed: SYEDIHGTL (PRAME_HUMAN)
SHEDIHGTV

SEQ ID NO: 159802 - protein, 9 aa, Artificial Sequence
  Description of Artificial Sequence: Synthetic peptide
  Seed: VLYPVPLES (PRAME_HUMAN)
VLYPVPLEM

SEQ ID NO: 159803 - protein, 9 aa, Artificial Sequence
  Description of Artificial Sequence: Synthetic peptide
  Seed: EDLEVTCTW (PRAME_HUMAN)
ETLEVTCTI

SEQ ID NO: 159804 - protein, 9 aa, Artificial Sequence
  Description of Artificial Sequence: Synthetic peptide
  Seed: VSPEPLQAL (PRAME_HUMAN)
VEPEPLQAI

SEQ ID NO: 159805 - protein, 9 aa, Artificial Sequence
  Description of Artificial Sequence: Synthetic peptide
  Seed: FLRGRLDQL (PRAME_HUMAN)
FIRGRLDQM

SEQ ID NO: 159806 - protein, 9 aa, Artificial Sequence
  Description of Artificial Sequence: Synthetic peptide
  Seed: FLSLQCLQA (PRAME_HUMAN)
FLSLQCLQL

SEQ ID NO: 159807 - protein, 9 aa, Artificial Sequence
  Description of Artificial Sequence: Synthetic peptide
  Seed: TSPRRLVEL (PRAME_HUMAN)
TAPRRLVEM

SEQ ID NO: 159808 - protein, 10 aa, Artificial Sequence
  Description of Artificial Sequence: Synthetic peptide
  Seed: YIAQFTSQFL (PRAME_HUMAN)
YQAQFTSQFI

SEQ ID NO: 159809 - protein, 9 aa, Artificial Sequence
  Description of Artificial Sequence: Synthetic peptide
  Seed: IPVEVLVDL (PRAME_HUMAN)
IPVEVLVDF

SEQ ID NO: 159810 - protein, 9 aa, Artificial Sequence
  Description of Artificial Sequence: Synthetic peptide
  Seed: YSFPEPEAA (PRAME_HUMAN)
YPFPEPEAA

SEQ ID NO: 159811 - protein, 10 aa, Artificial Sequence
  Description of Artificial Sequence: Synthetic peptide
  Seed: VMNPLETLSI (PRAME_HUMAN)
VMNPLETLSL

SEQ ID NO: 159812 - protein, 10 aa, Artificial Sequence
  Description of Artificial Sequence: Synthetic peptide
  Seed: AQFTSQFLSL (PRAME_HUMAN)
ARFTSQFLSL

SEQ ID NO: 159813 - protein, 9 aa, Artificial Sequence
  Description of Artificial Sequence: Synthetic peptide
  Seed: SQFLSLQCL (PRAME_HUMAN)
SIFLSLQCV

SEQ ID NO: 159814 - protein, 9 aa, Artificial Sequence
  Description of Artificial Sequence: Synthetic peptide
  Seed: ALAIAALEL (PRAME_HUMAN)
ALAIAALEY

SEQ ID NO: 159815 - protein, 10 aa, Artificial Sequence
  Description of Artificial Sequence: Synthetic peptide
  Seed: MSVWTSPRRL (PRAME_HUMAN)
MSVWTSPRRW

SEQ ID NO: 159816 - protein, 9 aa, Artificial Sequence
  Description of Artificial Sequence: Synthetic peptide
  Seed: ISPEKEEQY (PRAME_HUMAN)
ITPEKEEQL

SEQ ID NO: 159817 - protein, 9 aa, Artificial Sequence
  Description of Artificial Sequence: Synthetic peptide
  Seed: LMKGQHLHL (PRAME_HUMAN)
LVKGQHLHK

SEQ ID NO: 159818 - protein, 11 aa, Artificial Sequence
  Description of Artificial Sequence: Synthetic peptide
  Seed: RASATLQDLVF (PRAME_HUMAN)
RQSATLQDLVY

SEQ ID NO: 159819 - protein, 9 aa, Artificial Sequence
  Description of Artificial Sequence: Synthetic peptide
  Seed: MQDIKMILK (PRAME_HUMAN)
MSDIKMILL

SEQ ID NO: 159820 - protein, 9 aa, Artificial Sequence
  Description of Artificial Sequence: Synthetic peptide
  Seed: YIAQFTSQF (PRAME_HUMAN)
YIAQFTSQY

SEQ ID NO: 159821 - protein, 9 aa, Artificial Sequence
  Description of Artificial Sequence: Synthetic peptide
  Seed: RWKLQVLDL (PRAME_HUMAN)
RTKLQVLDS

SEQ ID NO: 159822 - protein, 9 aa, Artificial Sequence
  Description of Artificial Sequence: Synthetic peptide
  Seed: VDLFLKEGA (PRAME_HUMAN)
VELFLKEGL

SEQ ID NO: 159823 - protein, 10 aa, Artificial Sequence
  Description of Artificial Sequence: Synthetic peptide
  Seed: KIFAMPMQDI (PRAME_HUMAN)
KVFAMPMQDF

SEQ ID NO: 159824 - protein, 11 aa, Artificial Sequence
  Description of Artificial Sequence: Synthetic peptide
  Seed: ALYVDSLFFLR (PRAME_HUMAN)
AQYVDSLFFLR

SEQ ID NO: 159825 - protein, 10 aa, Artificial Sequence
  Description of Artificial Sequence: Synthetic peptide
  Seed: YLHARLRELL (PRAME_HUMAN)
YLHARLRELA

SEQ ID NO: 159826 - protein, 9 aa, Artificial Sequence
  Description of Artificial Sequence: Synthetic peptide
  Seed: IPVEVLVDL (PRAME_HUMAN)
ISVEVLVDL

SEQ ID NO: 159827 - protein, 11 aa, Artificial Sequence
  Description of Artificial Sequence: Synthetic peptide
  Seed: SIQSRYISMSV (PRAME_HUMAN)
SCQSRYISMSK

SEQ ID NO: 159828 - protein, 11 aa, Artificial Sequence
  Description of Artificial Sequence: Synthetic peptide
  Seed: SNLTHVLYPVP (PRAME_HUMAN)
SMLTHVLYPVE

SEQ ID NO: 159829 - protein, 9 aa, Artificial Sequence
  Description of Artificial Sequence: Synthetic peptide
  Seed: LQALYVDSL (PRAME_HUMAN)
LMALYVDSM

SEQ ID NO: 159830 - protein, 9 aa, Artificial Sequence
  Description of Artificial Sequence: Synthetic peptide
  Seed: SIQSRYISM (PRAME_HUMAN)
SSQSRYISM

SEQ ID NO: 159831 - protein, 9 aa, Artificial Sequence
  Description of Artificial Sequence: Synthetic peptide
  Seed: YSFPEPEAA (PRAME_HUMAN)
YPFPEPEAS

SEQ ID NO: 159832 - protein, 10 aa, Artificial Sequence
  Description of Artificial Sequence: Synthetic peptide
  Seed: LLLSHIHASS (PRAME_HUMAN)
LQLSHIHASV

SEQ ID NO: 159833 - protein, 10 aa, Artificial Sequence
  Description of Artificial Sequence: Synthetic peptide
  Seed: SPYLGQMINL (PRAME_HUMAN)
SSYLGQMINF

SEQ ID NO: 159834 - protein, 9 aa, Artificial Sequence
  Description of Artificial Sequence: Synthetic peptide
  Seed: YLHARLREL (PRAME_HUMAN)
YVHARLREM

SEQ ID NO: 159835 - protein, 9 aa, Artificial Sequence
  Description of Artificial Sequence: Synthetic peptide
  Seed: SLSHCSQLT (PRAME_HUMAN)
SISHCSQLL

SEQ ID NO: 159836 - protein, 9 aa, Artificial Sequence
  Description of Artificial Sequence: Synthetic peptide
  Seed: RGRLDQLLR (PRAME_HUMAN)
RTRLDQLLS

SEQ ID NO: 159837 - protein, 9 aa, Artificial Sequence
  Description of Artificial Sequence: Synthetic peptide
  Seed: EQPFIPVEV (PRAME_HUMAN)
EVPFIPVEA

SEQ ID NO: 159838 - protein, 9 aa, Artificial Sequence
  Description of Artificial Sequence: Synthetic peptide
  Seed: RLDQLLRHV (PRAME_HUMAN)
RMDQLLRHI

SEQ ID NO: 159839 - protein, 9 aa, Artificial Sequence
  Description of Artificial Sequence: Synthetic peptide
  Seed: TLAKFSPYL (PRAME_HUMAN)
TQAKFSPYA

SEQ ID NO: 159840 - protein, 8 aa, Artificial Sequence
  Description of Artificial Sequence: Synthetic peptide
  Seed: HARLRELL (PRAME_HUMAN)
HPRLRELL

SEQ ID NO: 159841 - protein, 10 aa, Artificial Sequence
  Description of Artificial Sequence: Synthetic peptide
  Seed: MSVWTSPRRL (PRAME_HUMAN)
MAVWTSPRRF

SEQ ID NO: 159842 - protein, 9 aa, Artificial Sequence
  Description of Artificial Sequence: Synthetic peptide
  Seed: SQLSVLSLS (PRAME_HUMAN)
STLSVLSLI

SEQ ID NO: 159843 - protein, 9 aa, Artificial Sequence
  Description of Artificial Sequence: Synthetic peptide
  Seed: TFYDPEPIL (PRAME_HUMAN)
TYYDPEPIW

SEQ ID NO: 159844 - protein, 9 aa, Artificial Sequence
  Description of Artificial Sequence: Synthetic peptide
  Seed: TWKLPTLAK (PRAME_HUMAN)
TYKLPTLAK

SEQ ID NO: 159845 - protein, 9 aa, Artificial Sequence
  Description of Artificial Sequence: Synthetic peptide
  Seed: VFDECGITD (PRAME_HUMAN)
VVDECGITI

SEQ ID NO: 159846 - protein, 9 aa, Artificial Sequence
  Description of Artificial Sequence: Synthetic peptide
  Seed: HVMNPLETL (PRAME_HUMAN)
HGMNPLETW

SEQ ID NO: 159847 - protein, 10 aa, Artificial Sequence
  Description of Artificial Sequence: Synthetic peptide
  Seed: YEDIHGTLHL (PRAME_HUMAN)
YSDIHGTLHF

SEQ ID NO: 159848 - protein, 9 aa, Artificial Sequence
  Description of Artificial Sequence: Synthetic peptide
  Seed: SQSPSVSQL (PRAME_HUMAN)
SSSPSVSQV

SEQ ID NO: 159849 - protein, 9 aa, Artificial Sequence
  Description of Artificial Sequence: Synthetic peptide
  Seed: ACDELFSYL (PRAME_HUMAN)
ALDELFSYI

SEQ ID NO: 159850 - protein, 10 aa, Artificial Sequence
  Description of Artificial Sequence: Synthetic peptide
  Seed: LSQSPSVSQL (PRAME_HUMAN)
LEQSPSVSQM

SEQ ID NO: 159851 - protein, 10 aa, Artificial Sequence
  Description of Artificial Sequence: Synthetic peptide
  Seed: LPTLAKFSPY (PRAME_HUMAN)
LGTLAKFSPW

SEQ ID NO: 159852 - protein, 11 aa, Artificial Sequence
  Description of Artificial Sequence: Synthetic peptide
  Seed: ALYVDSLFFLR (PRAME_HUMAN)
AVYVDSLFFLK

SEQ ID NO: 159853 - protein, 9 aa, Artificial Sequence
  Description of Artificial Sequence: Synthetic peptide
  Seed: SQFLSLQCL (PRAME_HUMAN)
SMFLSLQCM

SEQ ID NO: 159854 - protein, 10 aa, Artificial Sequence
  Description of Artificial Sequence: Synthetic peptide
  Seed: SMSVWTSPRR (PRAME_HUMAN)
SVSVWTSPRK

SEQ ID NO: 159855 - protein, 9 aa, Artificial Sequence
  Description of Artificial Sequence: Synthetic peptide
  Seed: VQLDSIEDL (PRAME_HUMAN)
VMLDSIEDV

SEQ ID NO: 159856 - protein, 9 aa, Artificial Sequence
  Description of Artificial Sequence: Synthetic peptide
  Seed: LQSLLQHLI (PRAME_HUMAN)
LQSLLQHLL

SEQ ID NO: 159857 - protein, 10 aa, Artificial Sequence
  Description of Artificial Sequence: Synthetic peptide
  Seed: MNPLETLSIT (PRAME_HUMAN)
MLPLETLSIA

SEQ ID NO: 159858 - protein, 9 aa, Artificial Sequence
  Description of Artificial Sequence: Synthetic peptide
  Seed: SPEPLQALL (PRAME_HUMAN)
SLEPLQALM

SEQ ID NO: 159859 - protein, 10 aa, Artificial Sequence
  Description of Artificial Sequence: Synthetic peptide
  Seed: QLLRHVMNPL (PRAME_HUMAN)
QYLRHVMNPV

SEQ ID NO: 159860 - protein, 10 aa, Artificial Sequence
  Description of Artificial Sequence: Synthetic peptide
  Seed: SALQSLLQHL (PRAME_HUMAN)
SSLQSLLQHM

SEQ ID NO: 159861 - protein, 10 aa, Artificial Sequence
  Description of Artificial Sequence: Synthetic peptide
  Seed: FIPVEVLVDL (PRAME_HUMAN)
FQPVEVLVDI

SEQ ID NO: 159862 - protein, 9 aa, Artificial Sequence
  Description of Artificial Sequence: Synthetic peptide
  Seed: QSLLKDEAL (PRAME_HUMAN)
QMLLKDEAY

SEQ ID NO: 159863 - protein, 9 aa, Artificial Sequence
  Description of Artificial Sequence: Synthetic peptide
  Seed: SMSVWTSPR (PRAME_HUMAN)
SLSVWTSPK

SEQ ID NO: 159864 - protein, 9 aa, Artificial Sequence
  Description of Artificial Sequence: Synthetic peptide
  Seed: IAQFTSQFL (PRAME_HUMAN)
ITQFTSQFF

SEQ ID NO: 159865 - protein, 9 aa, Artificial Sequence
  Description of Artificial Sequence: Synthetic peptide
  Seed: CKKLKIFAM (PRAME_HUMAN)
CMKLKIFAI

SEQ ID NO: 159866 - protein, 9 aa, Artificial Sequence
  Description of Artificial Sequence: Synthetic peptide
  Seed: RLWGSIQSR (PRAME_HUMAN)
RLWGSIQSA

SEQ ID NO: 159867 - protein, 10 aa, Artificial Sequence
  Description of Artificial Sequence: Synthetic peptide
  Seed: VMNPLETLSI (PRAME_HUMAN)
VANPLETLSL

SEQ ID NO: 159868 - protein, 11 aa, Artificial Sequence
  Description of Artificial Sequence: Synthetic peptide
  Seed: MKGQHLHLETF (PRAME_HUMAN)
MNGQHLHLETY

SEQ ID NO: 159869 - protein, 10 aa, Artificial Sequence
  Description of Artificial Sequence: Synthetic peptide
  Seed: LPTLAKFSPY (PRAME_HUMAN)
LATLAKFSPY

SEQ ID NO: 159870 - protein, 10 aa, Artificial Sequence
  Description of Artificial Sequence: Synthetic peptide
  Seed: MVQAWPFTCL (PRAME_HUMAN)
MRQAWPFTCY

SEQ ID NO: 159871 - protein, 10 aa, Artificial Sequence
  Description of Artificial Sequence: Synthetic peptide
  Seed: SALQSLLQHL (PRAME_HUMAN)
SALQSLLQHF

SEQ ID NO: 159872 - protein, 9 aa, Artificial Sequence
  Description of Artificial Sequence: Synthetic peptide
  Seed: SLLKDEALA (PRAME_HUMAN)
SLLKDEALV

SEQ ID NO: 159873 - protein, 11 aa, Artificial Sequence
  Description of Artificial Sequence: Synthetic peptide
  Seed: QALYVDSLFFL (PRAME_HUMAN)
QLLYVDSLFFA

SEQ ID NO: 159874 - protein, 10 aa, Artificial Sequence
  Description of Artificial Sequence: Synthetic peptide
  Seed: SLSHCSQLTT (PRAME_HUMAN)
SLSHCSQLTV

SEQ ID NO: 159875 - protein, 9 aa, Artificial Sequence
  Description of Artificial Sequence: Synthetic peptide
  Seed: VELAGQSLL (PRAME_HUMAN)
VHLAGQSLL

SEQ ID NO: 159876 - protein, 10 aa, Artificial Sequence
  Description of Artificial Sequence: Synthetic peptide
  Seed: IGLSNLTHVL (PRAME_HUMAN)
IFLSNLTHVM

SEQ ID NO: 159877 - protein, 9 aa, Artificial Sequence
  Description of Artificial Sequence: Synthetic peptide
  Seed: LRGRLDQLL (PRAME_HUMAN)
LHGRLDQLL

SEQ ID NO: 159878 - protein, 10 aa, Artificial Sequence
  Description of Artificial Sequence: Synthetic peptide
  Seed: LLCELGRPSM (PRAME_HUMAN)
LLCELGRPSY

SEQ ID NO: 159879 - protein, 10 aa, Artificial Sequence
  Description of Artificial Sequence: Synthetic peptide
  Seed: SPSVSQLSVL (PRAME_HUMAN)
SISVSQLSVF

SEQ ID NO: 159880 - protein, 8 aa, Artificial Sequence
  Description of Artificial Sequence: Synthetic peptide
  Seed: VLMKGQHL (PRAME_HUMAN)
VQMKGQHI

SEQ ID NO: 159881 - protein, 9 aa, Artificial Sequence
  Description of Artificial Sequence: Synthetic peptide
  Seed: ITDDQLLAL (PRAME_HUMAN)
IVDDQLLAW

SEQ ID NO: 159882 - protein, 10 aa, Artificial Sequence
  Description of Artificial Sequence: Synthetic peptide
  Seed: QSLLQHLIGL (PRAME_HUMAN)
QDLLQHLIGI

SEQ ID NO: 159883 - protein, 9 aa, Artificial Sequence
  Description of Artificial Sequence: Synthetic peptide
  Seed: FYDPEPILC (PRAME_HUMAN)
FWDPEPILC

SEQ ID NO: 159884 - protein, 10 aa, Artificial Sequence
  Description of Artificial Sequence: Synthetic peptide
  Seed: VLSLSGVMLT (PRAME_HUMAN)
VMSLSGVMLM

SEQ ID NO: 159885 - protein, 9 aa, Artificial Sequence
  Description of Artificial Sequence: Synthetic peptide
  Seed: SQSPSVSQL (PRAME_HUMAN)
SISPSVSQL

SEQ ID NO: 159886 - protein, 10 aa, Artificial Sequence
  Description of Artificial Sequence: Synthetic peptide
  Seed: VLYPVPLESY (PRAME_HUMAN)
VFYPVPLESL

SEQ ID NO: 159887 - protein, 10 aa, Artificial Sequence
  Description of Artificial Sequence: Synthetic peptide
  Seed: SPYLGQMINL (PRAME_HUMAN)
SEYLGQMINW

SEQ ID NO: 159888 - protein, 9 aa, Artificial Sequence
  Description of Artificial Sequence: Synthetic peptide
  Seed: VLYPVPLES (PRAME_HUMAN)
VVYPVPLEV

SEQ ID NO: 159889 - protein, 9 aa, Artificial Sequence
  Description of Artificial Sequence: Synthetic peptide
  Seed: ITDDQLLAL (PRAME_HUMAN)
IPDDQLLAL

SEQ ID NO: 159890 - protein, 10 aa, Artificial Sequence
  Description of Artificial Sequence: Synthetic peptide
  Seed: FLSLQCLQAL (PRAME_HUMAN)
FQSLQCLQAI

SEQ ID NO: 159891 - protein, 9 aa, Artificial Sequence
  Description of Artificial Sequence: Synthetic peptide
  Seed: MHLSQSPSV (PRAME_HUMAN)
MTLSQSPSF

SEQ ID NO: 159892 - protein, 10 aa, Artificial Sequence
  Description of Artificial Sequence: Synthetic peptide
  Seed: AQFTSQFLSL (PRAME_HUMAN)
AKFTSQFLSF

SEQ ID NO: 159893 - protein, 9 aa, Artificial Sequence
  Description of Artificial Sequence: Synthetic peptide
  Seed: ALLERASAT (PRAME_HUMAN)
ATLERASAI

SEQ ID NO: 159894 - protein, 9 aa, Artificial Sequence
  Description of Artificial Sequence: Synthetic peptide
  Seed: KAMVQAWPF (PRAME_HUMAN)
KNMVQAWPY

SEQ ID NO: 159895 - protein, 9 aa, Artificial Sequence
  Description of Artificial Sequence: Synthetic peptide
  Seed: ACDELFSYL (PRAME_HUMAN)
AYDELFSYM

SEQ ID NO: 159896 - protein, 10 aa, Artificial Sequence
  Description of Artificial Sequence: Synthetic peptide
  Seed: SISISALQSL (PRAME_HUMAN)
SMSISALQSY

SEQ ID NO: 159897 - protein, 9 aa, Artificial Sequence
  Description of Artificial Sequence: Synthetic peptide
  Seed: VQLDSIEDL (PRAME_HUMAN)
VHLDSIEDF

SEQ ID NO: 159898 - protein, 9 aa, Artificial Sequence
  Description of Artificial Sequence: Synthetic peptide
  Seed: QALYVDSLF (PRAME_HUMAN)
QPLYVDSLF

SEQ ID NO: 159899 - protein, 10 aa, Artificial Sequence
  Description of Artificial Sequence: Synthetic peptide
  Seed: DIHGTLHLER (PRAME_HUMAN)
DVHGTLHLER

SEQ ID NO: 159900 - protein, 9 aa, Artificial Sequence
  Description of Artificial Sequence: Synthetic peptide
  Seed: RTFYDPEPI (PRAME_HUMAN)
RLFYDPEPC

SEQ ID NO: 159901 - protein, 10 aa, Artificial Sequence
  Description of Artificial Sequence: Synthetic peptide
  Seed: SMVWLSANPC (PRAME_HUMAN)
SLVWLSANPI

SEQ ID NO: 159902 - protein, 10 aa, Artificial Sequence
  Description of Artificial Sequence: Synthetic peptide
  Seed: ALLERASATL (PRAME_HUMAN)
AMLERASATY

SEQ ID NO: 159903 - protein, 10 aa, Artificial Sequence
  Description of Artificial Sequence: Synthetic peptide
  Seed: RELFPPLFMA (PRAME_HUMAN)
RRLFPPLFMV

SEQ ID NO: 159904 - protein, 9 aa, Artificial Sequence
  Description of Artificial Sequence: Synthetic peptide
  Seed: LPRELFPPL (PRAME_HUMAN)
LVRELFPPF

SEQ ID NO: 159905 - protein, 9 aa, Artificial Sequence
  Description of Artificial Sequence: Synthetic peptide
  Seed: SFPEPEAAQ (PRAME_HUMAN)
SFPEPEAAI

SEQ ID NO: 159906 - protein, 10 aa, Artificial Sequence
  Description of Artificial Sequence: Synthetic peptide
  Seed: YISPEKEEQY (PRAME_HUMAN)
YQSPEKEEQY

SEQ ID NO: 159907 - protein, 9 aa, Artificial Sequence
  Description of Artificial Sequence: Synthetic peptide
  Seed: SQFLSLQCL (PRAME_HUMAN)
SHFLSLQCM

SEQ ID NO: 159908 - protein, 9 aa, Artificial Sequence
  Description of Artificial Sequence: Synthetic peptide
  Seed: LQSLLQHLI (PRAME_HUMAN)
LHSLLQHLI

SEQ ID NO: 159909 - protein, 9 aa, Artificial Sequence
  Description of Artificial Sequence: Synthetic peptide
  Seed: SMSVWTSPR (PRAME_HUMAN)
SVSVWTSPY

SEQ ID NO: 159910 - protein, 10 aa, Artificial Sequence
  Description of Artificial Sequence: Synthetic peptide
  Seed: IQSRYISMSV (PRAME_HUMAN)
IRSRYISMSV

SEQ ID NO: 159911 - protein, 9 aa, Artificial Sequence
  Description of Artificial Sequence: Synthetic peptide
  Seed: MHLSQSPSV (PRAME_HUMAN)
MQLSQSPSA

SEQ ID NO: 159912 - protein, 10 aa, Artificial Sequence
  Description of Artificial Sequence: Synthetic peptide
  Seed: LKAMVQAWPF (PRAME_HUMAN)
LPAMVQAWPF

SEQ ID NO: 159913 - protein, 8 aa, Artificial Sequence
  Description of Artificial Sequence: Synthetic peptide
  Seed: VMNPLETL (PRAME_HUMAN)
VQNPLETL

SEQ ID NO: 159914 - protein, 10 aa, Artificial Sequence
  Description of Artificial Sequence: Synthetic peptide
  Seed: LLPRELFPPL (PRAME_HUMAN)
LQPRELFPPF

SEQ ID NO: 159915 - protein, 9 aa, Artificial Sequence
  Description of Artificial Sequence: Synthetic peptide
  Seed: KEGACDELF (PRAME_HUMAN)
KMGACDELL

SEQ ID NO: 159916 - protein, 10 aa, Artificial Sequence
  Description of Artificial Sequence: Synthetic peptide
  Seed: LLLSHIHASS (PRAME_HUMAN)
LGLSHIHASV

SEQ ID NO: 159917 - protein, 9 aa, Artificial Sequence
  Description of Artificial Sequence: Synthetic peptide
  Seed: NSHQDFWTV (PRAME_HUMAN)
NAHQDFWTV

SEQ ID NO: 159918 - protein, 9 aa, Artificial Sequence
  Description of Artificial Sequence: Synthetic peptide
  Seed: FYDPEPILC (PRAME_HUMAN)
FGDPEPILI

SEQ ID NO: 159919 - protein, 8 aa, Artificial Sequence
  Description of Artificial Sequence: Synthetic peptide
  Seed: FYGNSISI (PRAME_HUMAN)
FYGNSISL

SEQ ID NO: 159920 - protein, 9 aa, Artificial Sequence
  Description of Artificial Sequence: Synthetic peptide
  Seed: YIAQFTSQF (PRAME_HUMAN)
YTAQFTSQV

SEQ ID NO: 159921 - protein, 10 aa, Artificial Sequence
  Description of Artificial Sequence: Synthetic peptide
  Seed: LSVLSLSGVM (PRAME_HUMAN)
LRVLSLSGVY

SEQ ID NO: 159922 - protein, 9 aa, Artificial Sequence
  Description of Artificial Sequence: Synthetic peptide
  Seed: CSQLTTLSF (PRAME_HUMAN)
CQQLTTLSM

SEQ ID NO: 159923 - protein, 10 aa, Artificial Sequence
  Description of Artificial Sequence: Synthetic peptide
  Seed: EALAIAALEL (PRAME_HUMAN)
EYLAIAALEV

SEQ ID NO: 159924 - protein, 9 aa, Artificial Sequence
  Description of Artificial Sequence: Synthetic peptide
  Seed: KAMVQAWPF (PRAME_HUMAN)
KPMVQAWPM

SEQ ID NO: 159925 - protein, 10 aa, Artificial Sequence
  Description of Artificial Sequence: Synthetic peptide
  Seed: SNLTHVLYPV (PRAME_HUMAN)
SGLTHVLYPL

SEQ ID NO: 159926 - protein, 9 aa, Artificial Sequence
  Description of Artificial Sequence: Synthetic peptide
  Seed: EAAQPMTKK (PRAME_HUMAN)
EIAQPMTKM

SEQ ID NO: 159927 - protein, 9 aa, Artificial Sequence
  Description of Artificial Sequence: Synthetic peptide
  Seed: FYDPEPILC (PRAME_HUMAN)
FMDPEPILI

SEQ ID NO: 159928 - protein, 9 aa, Artificial Sequence
  Description of Artificial Sequence: Synthetic peptide
  Seed: ISISALQSL (PRAME_HUMAN)
IFISALQSM

SEQ ID NO: 159929 - protein, 9 aa, Artificial Sequence
  Description of Artificial Sequence: Synthetic peptide
  Seed: RLDQLLRHV (PRAME_HUMAN)
RADQLLRHI

SEQ ID NO: 159930 - protein, 10 aa, Artificial Sequence
  Description of Artificial Sequence: Synthetic peptide
  Seed: VLYPVPLESY (PRAME_HUMAN)
VMYPVPLESY

SEQ ID NO: 159931 - protein, 9 aa, Artificial Sequence
  Description of Artificial Sequence: Synthetic peptide
  Seed: TSPRRLVEL (PRAME_HUMAN)
TSPRRLVEI

SEQ ID NO: 159932 - protein, 9 aa, Artificial Sequence
  Description of Artificial Sequence: Synthetic peptide
  Seed: AAFDGRHSQ (PRAME_HUMAN)
ALFDGRHSL

SEQ ID NO: 159933 - protein, 9 aa, Artificial Sequence
  Description of Artificial Sequence: Synthetic peptide
  Seed: LAIAALELL (PRAME_HUMAN)
LQIAALELY

SEQ ID NO: 159934 - protein, 10 aa, Artificial Sequence
  Description of Artificial Sequence: Synthetic peptide
  Seed: LLLSHIHASS (PRAME_HUMAN)
LMLSHIHASA

SEQ ID NO: 159935 - protein, 9 aa, Artificial Sequence
  Description of Artificial Sequence: Synthetic peptide
  Seed: THVLYPVPL (PRAME_HUMAN)
TYVLYPVPV

SEQ ID NO: 159936 - protein, 9 aa, Artificial Sequence
  Description of Artificial Sequence: Synthetic peptide
  Seed: KLKIFAMPM (PRAME_HUMAN)
KAKIFAMPR

SEQ ID NO: 159937 - protein, 10 aa, Artificial Sequence
  Description of Artificial Sequence: Synthetic peptide
  Seed: LLLSHIHASS (PRAME_HUMAN)
LQLSHIHASL

SEQ ID NO: 159938 - protein, 10 aa, Artificial Sequence
  Description of Artificial Sequence: Synthetic peptide
  Seed: RRLLLSHIHA (PRAME_HUMAN)
RRLLLSHIHF

SEQ ID NO: 159939 - protein, 9 aa, Artificial Sequence
  Description of Artificial Sequence: Synthetic peptide
  Seed: SQSPSVSQL (PRAME_HUMAN)
SWSPSVSQL

SEQ ID NO: 159940 - protein, 9 aa, Artificial Sequence
  Description of Artificial Sequence: Synthetic peptide
  Seed: ALQSLLQHL (PRAME_HUMAN)
AAQSLLQHL

SEQ ID NO: 159941 - protein, 9 aa, Artificial Sequence
  Description of Artificial Sequence: Synthetic peptide
  Seed: RHSQTLKAM (PRAME_HUMAN)
RQSQTLKAF

SEQ ID NO: 159942 - protein, 10 aa, Artificial Sequence
  Description of Artificial Sequence: Synthetic peptide
  Seed: SLQCLQALYV (PRAME_HUMAN)
SMQCLQALYI

SEQ ID NO: 159943 - protein, 10 aa, Artificial Sequence
  Description of Artificial Sequence: Synthetic peptide
  Seed: TFYDPEPILC (PRAME_HUMAN)
TYYDPEPILM

SEQ ID NO: 159944 - protein, 10 aa, Artificial Sequence
  Description of Artificial Sequence: Synthetic peptide
  Seed: SNLTHVLYPV (PRAME_HUMAN)
STLTHVLYPI

SEQ ID NO: 159945 - protein, 11 aa, Artificial Sequence
  Description of Artificial Sequence: Synthetic peptide
  Seed: KAVLDGLDVLL (PRAME_HUMAN)
KLVLDGLDVLW

SEQ ID NO: 159946 - protein, 9 aa, Artificial Sequence
  Description of Artificial Sequence: Synthetic peptide
  Seed: RLDQLLRHV (PRAME_HUMAN)
RIDQLLRHM

SEQ ID NO: 159947 - protein, 10 aa, Artificial Sequence
  Description of Artificial Sequence: Synthetic peptide
  Seed: RLWGSIQSRY (PRAME_HUMAN)
RFWGSIQSRK

SEQ ID NO: 159948 - protein, 11 aa, Artificial Sequence
  Description of Artificial Sequence: Synthetic peptide
  Seed: AAFDGRHSQTL (PRAME_HUMAN)
AIFDGRHSQTM

SEQ ID NO: 159949 - protein, 9 aa, Artificial Sequence
  Description of Artificial Sequence: Synthetic peptide
  Seed: KFSPYLGQM (PRAME_HUMAN)
KNSPYLGQY

SEQ ID NO: 159950 - protein, 9 aa, Artificial Sequence
  Description of Artificial Sequence: Synthetic peptide
  Seed: TLAKFSPYL (PRAME_HUMAN)
TIAKFSPYV

SEQ ID NO: 159951 - protein, 10 aa, Artificial Sequence
  Description of Artificial Sequence: Synthetic peptide
  Seed: LQHLIGLSNL (PRAME_HUMAN)
LMHLIGLSNM

SEQ ID NO: 159952 - protein, 9 aa, Artificial Sequence
  Description of Artificial Sequence: Synthetic peptide
  Seed: IAALELLPR (PRAME_HUMAN)
ITALELLPK

SEQ ID NO: 159953 - protein, 9 aa, Artificial Sequence
  Description of Artificial Sequence: Synthetic peptide
  Seed: RLAYLHARL (PRAME_HUMAN)
RTAYLHARL

SEQ ID NO: 159954 - protein, 9 aa, Artificial Sequence
  Description of Artificial Sequence: Synthetic peptide
  Seed: AAFDGRHSQ (PRAME_HUMAN)
AAFDGRHSA

SEQ ID NO: 159955 - protein, 9 aa, Artificial Sequence
  Description of Artificial Sequence: Synthetic peptide
  Seed: VQLDSIEDL (PRAME_HUMAN)
VALDSIEDL

SEQ ID NO: 159956 - protein, 10 aa, Artificial Sequence
  Description of Artificial Sequence: Synthetic peptide
  Seed: ASATLQDLVF (PRAME_HUMAN)
ALATLQDLVW

SEQ ID NO: 159957 - protein, 10 aa, Artificial Sequence
  Description of Artificial Sequence: Synthetic peptide
  Seed: GQMINLRRLL (PRAME_HUMAN)
GRMINLRRLL

SEQ ID NO: 159958 - protein, 9 aa, Artificial Sequence
  Description of Artificial Sequence: Synthetic peptide
  Seed: CSQLTTLSF (PRAME_HUMAN)
CTQLTTLSM

SEQ ID NO: 159959 - protein, 10 aa, Artificial Sequence
  Description of Artificial Sequence: Synthetic peptide
  Seed: QAWPFTCLPL (PRAME_HUMAN)
QMWPFTCLPF

SEQ ID NO: 159960 - protein, 9 aa, Artificial Sequence
  Description of Artificial Sequence: Synthetic peptide
  Seed: LAIAALELL (PRAME_HUMAN)
LTIAALELI

SEQ ID NO: 159961 - protein, 9 aa, Artificial Sequence
  Description of Artificial Sequence: Synthetic peptide
  Seed: LLRHVMNPL (PRAME_HUMAN)
LPRHVMNPL

SEQ ID NO: 159962 - protein, 9 aa, Artificial Sequence
  Description of Artificial Sequence: Synthetic peptide
  Seed: SQSPSVSQL (PRAME_HUMAN)
SASPSVSQF

SEQ ID NO: 159963 - protein, 9 aa, Artificial Sequence
  Description of Artificial Sequence: Synthetic peptide
  Seed: RASATLQDL (PRAME_HUMAN)
RLSATLQDL

SEQ ID NO: 159964 - protein, 8 aa, Artificial Sequence
  Description of Artificial Sequence: Synthetic peptide
  Seed: ALYVDSLF (PRAME_HUMAN)
AQYVDSLY

SEQ ID NO: 159965 - protein, 9 aa, Artificial Sequence
  Description of Artificial Sequence: Synthetic peptide
  Seed: ESYEDIHGT (PRAME_HUMAN)
ELYEDIHGV

SEQ ID NO: 159966 - protein, 10 aa, Artificial Sequence
  Description of Artificial Sequence: Synthetic peptide
  Seed: LLSHIHASSY (PRAME_HUMAN)
LLSHIHASSW

SEQ ID NO: 159967 - protein, 10 aa, Artificial Sequence
  Description of Artificial Sequence: Synthetic peptide
  Seed: QLLRHVMNPL (PRAME_HUMAN)
QFLRHVMNPI

SEQ ID NO: 159968 - protein, 11 aa, Artificial Sequence
  Description of Artificial Sequence: Synthetic peptide
  Seed: FSPYLGQMINL (PRAME_HUMAN)
FKPYLGQMINF

SEQ ID NO: 159969 - protein, 10 aa, Artificial Sequence
  Description of Artificial Sequence: Synthetic peptide
  Seed: QAWPFTCLPL (PRAME_HUMAN)
QQWPFTCLPF

SEQ ID NO: 159970 - protein, 9 aa, Artificial Sequence
  Description of Artificial Sequence: Synthetic peptide
  Seed: LGRPSMVWL (PRAME_HUMAN)
LLRPSMVWK

SEQ ID NO: 159971 - protein, 9 aa, Artificial Sequence
  Description of Artificial Sequence: Synthetic peptide
  Seed: LQHLIGLSN (PRAME_HUMAN)
LAHLIGLSY

SEQ ID NO: 159972 - protein, 9 aa, Artificial Sequence
  Description of Artificial Sequence: Synthetic peptide
  Seed: YEDIHGTLH (PRAME_HUMAN)
YEDIHGTLF

SEQ ID NO: 159973 - protein, 9 aa, Artificial Sequence
  Description of Artificial Sequence: Synthetic peptide
  Seed: ALQSLLQHL (PRAME_HUMAN)
ALQSLLQHF

SEQ ID NO: 159974 - protein, 10 aa, Artificial Sequence
  Description of Artificial Sequence: Synthetic peptide
  Seed: RHVMNPLETL (PRAME_HUMAN)
RVVMNPLETY

SEQ ID NO: 159975 - protein, 11 aa, Artificial Sequence
  Description of Artificial Sequence: Synthetic peptide
  Seed: LPTLAKFSPYL (PRAME_HUMAN)
LWTLAKFSPYL

SEQ ID NO: 159976 - protein, 10 aa, Artificial Sequence
  Description of Artificial Sequence: Synthetic peptide
  Seed: SISISALQSL (PRAME_HUMAN)
SYSISALQSW

SEQ ID NO: 159977 - protein, 9 aa, Artificial Sequence
  Description of Artificial Sequence: Synthetic peptide
  Seed: ASATLQDLV (PRAME_HUMAN)
AMATLQDLA

SEQ ID NO: 159978 - protein, 10 aa, Artificial Sequence
  Description of Artificial Sequence: Synthetic peptide
  Seed: ASATLQDLVF (PRAME_HUMAN)
ACATLQDLVW

SEQ ID NO: 159979 - protein, 9 aa, Artificial Sequence
  Description of Artificial Sequence: Synthetic peptide
  Seed: AEQPFIPVE (PRAME_HUMAN)
AEQPFIPVF

SEQ ID NO: 159980 - protein, 9 aa, Artificial Sequence
  Description of Artificial Sequence: Synthetic peptide
  Seed: RLCCKKLKI (PRAME_HUMAN)
RFCCKKLKY

SEQ ID NO: 159981 - protein, 11 aa, Artificial Sequence
  Description of Artificial Sequence: Synthetic peptide
  Seed: RLVELAGQSLL (PRAME_HUMAN)
RQVELAGQSLL

SEQ ID NO: 159982 - protein, 9 aa, Artificial Sequence
  Description of Artificial Sequence: Synthetic peptide
  Seed: LSTEAEQPF (PRAME_HUMAN)
LQTEAEQPY

SEQ ID NO: 159983 - protein, 9 aa, Artificial Sequence
  Description of Artificial Sequence: Synthetic peptide
  Seed: SYEDIHGTL (PRAME_HUMAN)
SQEDIHGTY

SEQ ID NO: 159984 - protein, 10 aa, Artificial Sequence
  Description of Artificial Sequence: Synthetic peptide
  Seed: ISPEKEEQYI (PRAME_HUMAN)
ILPEKEEQYL

SEQ ID NO: 159985 - protein, 9 aa, Artificial Sequence
  Description of Artificial Sequence: Synthetic peptide
  Seed: ALQSLLQHL (PRAME_HUMAN)
AMQSLLQHL

SEQ ID NO: 159986 - protein, 10 aa, Artificial Sequence
  Description of Artificial Sequence: Synthetic peptide
  Seed: SVSQLSVLSL (PRAME_HUMAN)
SQSQLSVLSV

SEQ ID NO: 159987 - protein, 10 aa, Artificial Sequence
  Description of Artificial Sequence: Synthetic peptide
  Seed: LSFYGNSISI (PRAME_HUMAN)
LYFYGNSISL

SEQ ID NO: 159988 - protein, 9 aa, Artificial Sequence
  Description of Artificial Sequence: Synthetic peptide
  Seed: SQFLSLQCL (PRAME_HUMAN)
SQFLSLQCM

SEQ ID NO: 159989 - protein, 8 aa, Artificial Sequence
  Description of Artificial Sequence: Synthetic peptide
  Seed: YSFPEPEA (PRAME_HUMAN)
YSFPEPEI

SEQ ID NO: 159990 - protein, 10 aa, Artificial Sequence
  Description of Artificial Sequence: Synthetic peptide
  Seed: MPMQDIKMIL (PRAME_HUMAN)
MPMQDIKMII

SEQ ID NO: 159991 - protein, 9 aa, Artificial Sequence
  Description of Artificial Sequence: Synthetic peptide
  Seed: TLKAMVQAW (PRAME_HUMAN)
TTKAMVQAW

SEQ ID NO: 159992 - protein, 10 aa, Artificial Sequence
  Description of Artificial Sequence: Synthetic peptide
  Seed: QAWPFTCLPL (PRAME_HUMAN)
QNWPFTCLPF

SEQ ID NO: 159993 - protein, 11 aa, Artificial Sequence
  Description of Artificial Sequence: Synthetic peptide
  Seed: QALYVDSLFFL (PRAME_HUMAN)
QNLYVDSLFFV

SEQ ID NO: 159994 - protein, 8 aa, Artificial Sequence
  Description of Artificial Sequence: Synthetic peptide
  Seed: DVLLAQEV (PRAME_HUMAN)
DQLLAQEV

SEQ ID NO: 159995 - protein, 10 aa, Artificial Sequence
  Description of Artificial Sequence: Synthetic peptide
  Seed: RELFPPLFMA (PRAME_HUMAN)
RNLFPPLFMM

SEQ ID NO: 159996 - protein, 9 aa, Artificial Sequence
  Description of Artificial Sequence: Synthetic peptide
  Seed: ACDELFSYL (PRAME_HUMAN)
AFDELFSYF

SEQ ID NO: 159997 - protein, 9 aa, Artificial Sequence
  Description of Artificial Sequence: Synthetic peptide
  Seed: SQFLSLQCL (PRAME_HUMAN)
SMFLSLQCL

SEQ ID NO: 159998 - protein, 9 aa, Artificial Sequence
  Description of Artificial Sequence: Synthetic peptide
  Seed: YISMSVWTS (PRAME_HUMAN)
YLSMSVWTI

SEQ ID NO: 159999 - protein, 9 aa, Artificial Sequence
  Description of Artificial Sequence: Synthetic peptide
  Seed: GQHLHLETF (PRAME_HUMAN)
GVHLHLETF

SEQ ID NO: 160000 - protein, 10 aa, Artificial Sequence
  Description of Artificial Sequence: Synthetic peptide
  Seed: FFLRGRLDQL (PRAME_HUMAN)
FELRGRLDQL

SEQ ID NO: 160001 - protein, 9 aa, Artificial Sequence
  Description of Artificial Sequence: Synthetic peptide
  Seed: LTDVSPEPL (PRAME_HUMAN)
LMDVSPEPI

SEQ ID NO: 160002 - protein, 9 aa, Artificial Sequence
  Description of Artificial Sequence: Synthetic peptide
  Seed: YLHARLREL (PRAME_HUMAN)
YVHARLREI

SEQ ID NO: 160003 - protein, 11 aa, Artificial Sequence
  Description of Artificial Sequence: Synthetic peptide
  Seed: AYLHARLRELL (PRAME_HUMAN)
AYLHARLRELW

SEQ ID NO: 160004 - protein, 9 aa, Artificial Sequence
  Description of Artificial Sequence: Synthetic peptide
  Seed: KAMVQAWPF (PRAME_HUMAN)
KGMVQAWPW

SEQ ID NO: 160005 - protein, 10 aa, Artificial Sequence
  Description of Artificial Sequence: Synthetic peptide
  Seed: MERRRLWGSI (PRAME_HUMAN)
MQRRRLWGSL

SEQ ID NO: 160006 - protein, 8 aa, Artificial Sequence
  Description of Artificial Sequence: Synthetic peptide
  Seed: QMINLRRL (PRAME_HUMAN)
QQINLRRI

SEQ ID NO: 160007 - protein, 10 aa, Artificial Sequence
  Description of Artificial Sequence: Synthetic peptide
  Seed: RLWGSIQSRY (PRAME_HUMAN)
RWWGSIQSRK

SEQ ID NO: 160008 - protein, 10 aa, Artificial Sequence
  Description of Artificial Sequence: Synthetic peptide
  Seed: RGRLDQLLRH (PRAME_HUMAN)
RARLDQLLRI

SEQ ID NO: 160009 - protein, 9 aa, Artificial Sequence
  Description of Artificial Sequence: Synthetic peptide
  Seed: ISISALQSL (PRAME_HUMAN)
ITISALQSF

SEQ ID NO: 160010 - protein, 9 aa, Artificial Sequence
  Description of Artificial Sequence: Synthetic peptide
  Seed: LWGSIQSRY (PRAME_HUMAN)
LYGSIQSRY

SEQ ID NO: 160011 - protein, 9 aa, Artificial Sequence
  Description of Artificial Sequence: Synthetic peptide
  Seed: ISISALQSL (PRAME_HUMAN)
IQISALQSM

SEQ ID NO: 160012 - protein, 10 aa, Artificial Sequence
  Description of Artificial Sequence: Synthetic peptide
  Seed: LLPRELFPPL (PRAME_HUMAN)
LVPRELFPPL

SEQ ID NO: 160013 - protein, 11 aa, Artificial Sequence
  Description of Artificial Sequence: Synthetic peptide
  Seed: RLWGSIQSRYI (PRAME_HUMAN)
RLWGSIQSRYV

SEQ ID NO: 160014 - protein, 10 aa, Artificial Sequence
  Description of Artificial Sequence: Synthetic peptide
  Seed: ALYVDSLFFL (PRAME_HUMAN)
AVYVDSLFFF

SEQ ID NO: 160015 - protein, 9 aa, Artificial Sequence
  Description of Artificial Sequence: Synthetic peptide
  Seed: AQFTSQFLS (PRAME_HUMAN)
AQFTSQFLI

SEQ ID NO: 160016 - protein, 10 aa, Artificial Sequence
  Description of Artificial Sequence: Synthetic peptide
  Seed: GACDELFSYL (PRAME_HUMAN)
GTCDELFSYW

SEQ ID NO: 160017 - protein, 9 aa, Artificial Sequence
  Description of Artificial Sequence: Synthetic peptide
  Seed: AMVQAWPFT (PRAME_HUMAN)
AQVQAWPFM

SEQ ID NO: 160018 - protein, 10 aa, Artificial Sequence
  Description of Artificial Sequence: Synthetic peptide
  Seed: QAWPFTCLPL (PRAME_HUMAN)
QSWPFTCLPF

SEQ ID NO: 160019 - protein, 11 aa, Artificial Sequence
  Description of Artificial Sequence: Synthetic peptide
  Seed: VQLDSIEDLEV (PRAME_HUMAN)
VLLDSIEDLEI

SEQ ID NO: 160020 - protein, 9 aa, Artificial Sequence
  Description of Artificial Sequence: Synthetic peptide
  Seed: LSVLSLSGV (PRAME_HUMAN)
LTVLSLSGL

SEQ ID NO: 160021 - protein, 10 aa, Artificial Sequence
  Description of Artificial Sequence: Synthetic peptide
  Seed: ISISALQSLL (PRAME_HUMAN)
ILISALQSLI

SEQ ID NO: 160022 - protein, 9 aa, Artificial Sequence
  Description of Artificial Sequence: Synthetic peptide
  Seed: ACDELFSYL (PRAME_HUMAN)
AVDELFSYI

SEQ ID NO: 160023 - protein, 9 aa, Artificial Sequence
  Description of Artificial Sequence: Synthetic peptide
  Seed: ITDDQLLAL (PRAME_HUMAN)
IFDDQLLAI

SEQ ID NO: 160024 - protein, 9 aa, Artificial Sequence
  Description of Artificial Sequence: Synthetic peptide
  Seed: SYEDIHGTL (PRAME_HUMAN)
SIEDIHGTI

SEQ ID NO: 160025 - protein, 8 aa, Artificial Sequence
  Description of Artificial Sequence: Synthetic peptide
  Seed: RLAYLHAR (PRAME_HUMAN)
RVAYLHAR

SEQ ID NO: 160026 - protein, 9 aa, Artificial Sequence
  Description of Artificial Sequence: Synthetic peptide
  Seed: LYVDSLFFL (PRAME_HUMAN)
LMVDSLFFS

SEQ ID NO: 160027 - protein, 9 aa, Artificial Sequence
  Description of Artificial Sequence: Synthetic peptide
  Seed: LLLSHIHAS (PRAME_HUMAN)
LTLSHIHAM

SEQ ID NO: 160028 - protein, 9 aa, Artificial Sequence
  Description of Artificial Sequence: Synthetic peptide
  Seed: YGNSISISA (PRAME_HUMAN)
YANSISISI

SEQ ID NO: 160029 - protein, 9 aa, Artificial Sequence
  Description of Artificial Sequence: Synthetic peptide
  Seed: ISPEKEEQY (PRAME_HUMAN)
IIPEKEEQI

SEQ ID NO: 160030 - protein, 10 aa, Artificial Sequence
  Description of Artificial Sequence: Synthetic peptide
  Seed: RASATLQDLV (PRAME_HUMAN)
RSSATLQDLY

SEQ ID NO: 160031 - protein, 10 aa, Artificial Sequence
  Description of Artificial Sequence: Synthetic peptide
  Seed: HLERLAYLHA (PRAME_HUMAN)
HTERLAYLHV

SEQ ID NO: 160032 - protein, 11 aa, Artificial Sequence
  Description of Artificial Sequence: Synthetic peptide
  Seed: LLLSHIHASSY (PRAME_HUMAN)
LYLSHIHASSW

SEQ ID NO: 160033 - protein, 9 aa, Artificial Sequence
  Description of Artificial Sequence: Synthetic peptide
  Seed: ERLAYLHAR (PRAME_HUMAN)
EYLAYLHAK
